United States Patent 11,078,247 (RNA ENCODING A THERAPEUTIC PROTEIN) - sequence listing, part 27

SEQ ID NO: 46710 - RNA, 459 nt, Artificial Sequence
  derived and/or modified sequence opt2 from NME1__Homo_sapiens__NP_000260
auggccaacugcgagcgcaccuucaucgccaucaagcccgacggcguccagcgcggccucgucggcgagaucaucaagcgcuucgagcagaagggcuuccgccucgucggccucaaguucaugcaggccuccgaggaccuccucaaggagcacuacgucgaccucaaggaccgccccuucuucgccggccucgucaaguacaugcacuccggccccgucgucgccauggucugggagggccucaacgucgucaagaccggccgcgucaugcucggcgagaccaaccccgccgacuccaagcccggcaccauccgcggcgacuucugcauccaggucggccgcaacaucauccacggcuccgacuccgucgaguccgccgagaaggagaucggccucugguuccaccccgaggagcucgucgacuacaccuccugcgcccagaacuggaucuacgaguga

SEQ ID NO: 46711 - RNA, 804 nt, Artificial Sequence
  derived and/or modified sequence opt2 from NME1-NME2__Homo_sapiens__NP_001018146
auggccaacugcgagcgcaccuucaucgccaucaagcccgacggcguccagcgcggccucgucggcgagaucaucaagcgcuucgagcagaagggcuuccgccucgucggccucaaguucaugcaggccuccgaggaccuccucaaggagcacuacgucgaccucaaggaccgccccuucuucgccggccucgucaaguacaugcacuccggccccgucgucgccauggucugggagggccucaacgucgucaagaccggccgcgucaugcucggcgagaccaaccccgccgacuccaagcccggcaccauccgcggcgacuucugcauccaggucggccgcaccauggccaaccucgagcgcaccuucaucgccaucaagcccgacggcguccagcgcggccucgucggcgagaucaucaagcgcuucgagcagaagggcuuccgccucgucgccaugaaguuccuccgcgccuccgaggagcaccucaagcagcacuacaucgaccucaaggaccgccccuucuuccccggccucgucaaguacaugaacuccggccccgucgucgccauggucugggagggccucaacgucgucaagaccggccgcgucaugcucggcgagaccaaccccgccgacuccaagcccggcaccauccgcggcgacuucugcauccaggucggccgcaacaucauccacggcuccgacuccgucaaguccgccgagaaggagaucucccucugguucaagcccgaggagcucgucgacuacaaguccugcgcccacgacugggucuacgaguga

SEQ ID NO: 46712 - RNA, 459 nt, Artificial Sequence
  derived and/or modified sequence opt2 from NME2__Homo_sapiens__NP_001018148
auggccaaccucgagcgcaccuucaucgccaucaagcccgacggcguccagcgcggccucgucggcgagaucaucaagcgcuucgagcagaagggcuuccgccucgucgccaugaaguuccuccgcgccuccgaggagcaccucaagcagcacuacaucgaccucaaggaccgccccuucuuccccggccucgucaaguacaugaacuccggccccgucgucgccauggucugggagggccucaacgucgucaagaccggccgcgucaugcucggcgagaccaaccccgccgacuccaagcccggcaccauccgcggcgacuucugcauccaggucggccgcaacaucauccacggcuccgacuccgucaaguccgccgagaaggagaucucccucugguucaagcccgaggagcucgucgacuacaaguccugcgcccacgacugggucuacgaguga

SEQ ID NO: 46713 - RNA, 510 nt, Artificial Sequence
  derived and/or modified sequence opt2 from NME3__Homo_sapiens__NP_002504
augaucugccucguccucaccaucuucgccaaccucuuccccgccgccugcaccggcgcccacgagcgcaccuuccucgccgucaagcccgacggcguccagcgccgccucgucggcgagaucguccgccgcuucgagcgcaagggcuucaagcucgucgcccucaagcucguccaggccuccgaggagcuccuccgcgagcacuacgccgagcuccgcgagcgccccuucuacggccgccucgucaaguacauggccuccggccccgucgucgccauggucuggcagggccucgacgucguccgcaccucccgcgcccucaucggcgccaccaaccccgccgacgccccccccggcaccauccgcggcgacuucugcaucgaggucggcaagaaccucauccacggcuccgacuccgucgaguccgcccgccgcgagaucgcccucugguuccgcgccgacgagcuccucugcugggaggacuccgccggccacuggcucuacgaguga

SEQ ID NO: 46714 - RNA, 522 nt, Artificial Sequence
  derived and/or modified sequence opt2 from NME4__Homo_sapiens__NP_001273364
augggcggccucuucuggcgcuccgcccuccgcggccuccgcugcggcccccgcgcccccggccccucccuccucguccgccacggcuccggcggccccuccuggacccgcgagcgcacccucgucgccgucaagcccgacggcguccagcgccgccucgucggcgacgucauccagcgcuucgagcgccgcggcuucacccucgucggcaugaagaugcuccaggcccccgaguccguccucgccgagcacuaccaggaccuccgccgcaagcccuucuaccccgcccucauccgcuacauguccuccggccccgucgucgccauggucugggagggcuacaacgucguccgcgccucccgcgccaugaucggccacaccgacuccgccgaggccgcccccggcaccauccgcggcgacuucuccguccacaucuccucccaccgccucgccccccucgaccgcggccagcgcgagcagcagaugguccccggcaucccccagggcgcccacgaggccuga

SEQ ID NO: 46715 - RNA, 639 nt, Artificial Sequence
  derived and/or modified sequence opt2 from NME5__Homo_sapiens__NP_003542
auggagaucuccaugccccccccccagaucuacgucgagaagacccucgccaucaucaagcccgacaucgucgacaaggaggaggagauccaggacaucauccuccgcuccggcuucaccaucguccagcgccgcaagcuccgccucucccccgagcagugcuccaacuucuacgucgagaaguacggcaagauguucuuccccaaccucaccgccuacauguccuccggcccccucgucgccaugauccucgcccgccacaaggccaucuccuacuggcucgagcuccucggccccaacaacucccucgucgccaaggagacccaccccgacucccuccgcgccaucuacggcaccgacgaccuccgcaacgcccuccacggcuccaacgacuucgccgccgccgagcgcgagauccgcuucauguuccccgaggucaucgucgagcccauccccaucggccaggccgccaaggacuaccucaaccuccacaucaugcccacccuccucgagggccucaccgagcucugcaagcagaagcccgccgacccccucaucuggcucgccgacuggcuccucaagaacaaccccaacaagcccaagcucugccaccaccccaucgucgaggagcccuacuga

SEQ ID NO: 46716 - RNA, 585 nt, Artificial Sequence
  derived and/or modified sequence opt2 from NME6__Homo_sapiens__NP_005784
augacccagaaccucggcuccgagauggccuccauccuccgcuccccccaggcccuccagcucacccucgcccucaucaagcccgacgccgucgcccacccccucauccucgaggccguccaccagcagauccucuccaacaaguuccucaucguccgcaugcgcgagcuccucuggcgcaaggaggacugccagcgcuucuaccgcgagcacgagggccgcuucuucuaccagcgccucgucgaguucauggccuccggccccauccgcgccuacauccucgcccacaaggacgccauccagcucuggcgcacccucaugggccccacccgcgucuuccgcgcccgccacgucgcccccgacuccauccgcggcuccuucggccucaccgacacccgcaacaccacccacggcuccgacuccgucgucuccgccucccgcgagaucgccgccuucuuccccgacuucuccgagcagcgcugguacgaggaggaggagccccagcuccgcugcggccccgucugcuacucccccgagggcggcguccacuacgucgccggcaccggcggccucggccccgccuga

SEQ ID NO: 46717 - RNA, 1131 nt, Artificial Sequence
  derived and/or modified sequence opt2 from NME7__Homo_sapiens__NP_037462
augaaccacuccgagcgcuucgucuucaucgccgagugguacgaccccaacgccucccuccuccgccgcuacgagcuccucuucuaccccggcgacggcuccgucgagaugcacgacgucaagaaccaccgcaccuuccucaagcgcaccaaguacgacaaccuccaccucgaggaccucuucaucggcaacaaggucaacgucuucucccgccagcucguccucaucgacuacggcgaccaguacaccgcccgccagcucggcucccgcaaggagaagacccucgcccucaucaagcccgacgccaucuccaaggccggcgagaucaucgagaucaucaacaaggccggcuucaccaucaccaagcucaagaugaugaugcucucccgcaaggaggcccucgacuuccacgucgaccaccagucccgccccuucuucaacgagcucauccaguucaucaccaccggccccaucaucgccauggagauccuccgcgacgacgccaucugcgaguggaagcgccuccucggccccgccaacuccggcgucgcccgcaccgacgccuccgaguccauccgcgcccucuucggcaccgacggcauccgcaacgccgcccacggccccgacuccuucgccuccgccgcccgcgagauggagcucuucuuccccuccuccggcggcugcggccccgccaacaccgccaaguucaccaacugcaccugcugcaucgucaagccccacgccgucuccgagggccuccucggcaagauccucauggccauccgcgacgccggcuucgagaucuccgccaugcagauguucaacauggaccgcgucaacgucgaggaguucuacgaggucuacaagggcgucgucaccgaguaccacgacauggucaccgagauguacuccggccccugcgucgccauggagauccagcagaacaacgccaccaagaccuuccgcgaguucugcggccccgccgaccccgagaucgcccgccaccuccgccccggcacccuccgcgccaucuucggcaagaccaagauccagaacgccguccacugcaccgaccuccccgaggacggccuccucgagguccaguacuucuucaagauccucgacaacuga

SEQ ID NO: 46718 - RNA, 1767 nt, Artificial Sequence
  derived and/or modified sequence opt2 from NME8__Homo_sapiens__NP_057700
auggccuccaagaagcgcgagguccagcuccagaccgucaucaacaaccagucccucugggacgagaugcuccagaacaagggccucaccgucaucgacgucuaccaggccuggugcggccccugccgcgccaugcagccccucuuccgcaagcucaagaacgagcucaacgaggacgagauccuccacuucgccgucgccgaggccgacaacaucgucacccuccagcccuuccgcgacaagugcgagcccgucuuccucuucuccgucaacggcaagaucaucgagaagauccagggcgccaacgccccccucgucaacaagaaggucaucaaccucaucgacgaggagcgcaagaucgccgccggcgagauggcccgcccccaguaccccgagaucccccucgucgacuccgacuccgaggucuccgaggagucccccugcgaguccguccaggagcucuacuccaucgccaucaucaagcccgacgccgucaucuccaagaagguccucgagaucaagcgcaagaucaccaaggccggcuucaucaucgaggccgagcacaagaccguccucaccgaggagcaggucgucaacuucuacucccgcaucgccgaccagugcgacuucgaggaguucgucuccuucaugaccuccggccucuccuacauccucgucgucucccagggcuccaagcacaacccccccuccgaggagaccgagccccagaccgacaccgagcccaacgagcgcuccgaggaccagcccgaggucgaggcccaggucacccccggcaugaugaagaacaagcaggacucccuccaggaguaccucgagcgccagcaccucgcccagcucugcgacaucgaggaggacgccgccaacgucgccaaguucauggacgccuucuuccccgacuucaagaagaugaaguccaugaagcucgagaagacccucgcccuccuccgccccaaccucuuccacgagcgcaaggacgacguccuccgcaucaucaaggacgaggacuucaagauccucgagcagcgccaggucguccucuccgagaaggaggcccaggcccucugcaaggaguacgagaacgaggacuacuucaacaagcucaucgagaacaugaccuccggccccucccucgcccucguccuccuccgcgacaacggccuccaguacuggaagcagcuccucggcccccgcaccgucgaggaggccaucgaguacuuccccgagucccucugcgcccaguucgccauggacucccuccccgucaaccagcucuacggcuccgacucccucgagaccgccgagcgcgagauccagcacuucuucccccuccaguccacccucggccucaucaagccccacgccaccuccgagcagcgcgagcagauccucaagaucgucaaggaggccggcuucgaccucacccaggucaagaagauguuccucacccccgagcagaucgagaagaucuaccccaaggucaccggcaaggacuucuacaaggaccuccucgagaugcucuccgucggccccuccauggucaugauccucaccaaguggaacgccgucgccgaguggcgccgccucaugggccccaccgaccccgaggaggccaagcuccucucccccgacuccauccgcgcccaguucggcaucuccaagcucaagaacaucguccacggcgccuccaacgccuacgaggccaaggaggucgucaaccgccucuucgaggaccccgaggagaacuga

SEQ ID NO: 46719 - RNA, 792 nt, Artificial Sequence
  derived and/or modified sequence opt2 from NME9__Homo_sapiens__NP_835231
augcucuccuccaagggccucaccgucgucgacgucuaccagggcuggugcggccccugcaagcccgucgucucccucuuccagaagaugcgcaucgaggucggccucgaccuccuccacuucgcccucgccgaggccgaccgccucgacguccucgagaaguaccgcggcaagugcgagcccaccuuccucuucuacgccaucaaggacgaggcccucuccgacgaggacgagugcgucucccacggcaagaacaacggcgaggacgaggacauggucuccuccgagcgcaccugcacccucgccaucaucaagcccgacgccgucgcccacggcaagaccgacgagaucaucaugaagauccaggaggccggcuucgagauccucaccaacgaggagcgcaccaugaccgaggccgagguccgccucuucuaccagcacaaggccggcgaggaggccuucgagaagcucguccaccacaugugcuccggccccucccaccuccucauccucacccgcaccgagggcuucgaggacgucgucaccaccuggcgcaccgucaugggcccccgcgaccccaacgucgcccgccgcgagcagcccgagucccuccgcgcccaguacggcaccgagaugcccuucaacgccguccacggcucccgcgaccgcgaggacgccgaccgcgagcucgcccuccucuuccccucccucaaguucuccgacaaggacaccgaggccccccagggcgaguccuccacccagccccgccucaagaucaccgaccucgacuga

SEQ ID NO: 46720 - RNA, 924 nt, Artificial Sequence
  derived and/or modified sequence opt2 from NMI__Homo_sapiens__NP_004679
auggaggccgacaaggacgacacccagcagauccucaaggagcacucccccgacgaguucaucaaggacgagcagaacaagggccucaucgacgagaucaccaagaagaacauccagcucaagaaggagauccagaagcucgagaccgagcuccaggaggccaccaaggaguuccagaucaaggaggacauccccgagaccaagaugaaguuccucuccgucgagacccccgagaacgacucccagcucuccaacaucuccugcuccuuccaggucuccuccaagguccccuacgagauccagaagggccaggcccucaucaccuucgagaaggaggaggucgcccagaacgucgucuccauguccaagcaccacguccagaucaaggacgucaaccucgaggucaccgccaagcccgucccccucaacuccggcguccgcuuccaggucuacgucgaggucuccaagaugaagaucaacgucaccgagauccccgacacccuccgcgaggaccagaugcgcgacaagcucgagcucuccuucuccaagucccgcaacggcggcggcgaggucgaccgcgucgacuacgaccgccaguccggcuccgccgucaucaccuucgucgagaucggcgucgccgacaagauccucaagaagaaggaguacccccucuacaucaaccagaccugccaccgcgucaccgucucccccuacaccgagauccaccucaagaaguaccagaucuucuccggcaccuccaagcgcaccguccuccucaccggcauggagggcauccagauggacgaggagaucgucgaggaccucaucaacauccacuuccagcgcgccaagaacggcggcggcgaggucgacgucgucaagugcucccucggccagccccacaucgccuacuucgaggaguga

SEQ ID NO: 46721 - RNA, 840 nt, Artificial Sequence
  derived and/or modified sequence opt2 from NMNAT1__Homo_sapiens__NP_001284707
auggagaacuccgagaagaccgaggucguccuccucgccugcggcuccuucaaccccaucaccaacaugcaccuccgccucuucgagcucgccaaggacuacaugaacggcaccggccgcuacaccgucgucaagggcaucaucucccccgucggcgacgccuacaagaagaagggccucauccccgccuaccaccgcgucaucauggccgagcucgccaccaagaacuccaagugggucgaggucgacaccugggagucccuccagaaggaguggaaggagacccucaagguccuccgccaccaccaggagaagcucgaggccuccgacugcgaccaccagcagaacucccccacccucgagcgccccggccgcaagcgcaaguggaccgagacccaggacuccucccagaagaagucccucgagcccaagaccaaggccguccccaaggucaagcuccucugcggcgccgaccuccucgaguccuucgccguccccaaccucuggaaguccgaggacaucacccagaucgucgccaacuacggccucaucugcgucacccgcgccggcaacgacgcccagaaguucaucuacgaguccgacguccucuggaagcaccgcuccaacauccacgucgucaacgaguggaucgccaacgacaucuccuccaccaagauccgccgcgcccuccgccgcggccaguccauccgcuaccucguccccgaccucguccaggaguacaucgagaagcacaaccucuacuccuccgaguccgaggaccgcaacgccggcgucauccucgccccccuccagcgcaacaccgccgaggccaagaccuga

SEQ ID NO: 46722 - RNA, 924 nt, Artificial Sequence
  derived and/or modified sequence opt2 from NMNAT2__Homo_sapiens__NP_055854
augaccgagaccaccaagacccacgucauccuccucgccugcggcuccuucaaccccaucaccaagggccacauccagauguucgagcgcgcccgcgacuaccuccacaagaccggccgcuucaucgucaucggcggcaucgucucccccguccacgacuccuacggcaagcagggccucgucuccucccgccaccgccucaucaugugccagcucgccguccagaacuccgacuggauccgcgucgaccccugggagugcuaccaggacaccuggcagaccaccugcuccguccucgagcaccaccgcgaccucaugaagcgcgucaccggcugcauccucuccaacgucaacacccccuccaugacccccgucaucggccagccccagaacgagaccccccagcccaucuaccagaacuccaacgucgccaccaagcccaccgccgccaagauccucggcaaggucggcgagucccucucccgcaucugcugcguccgcccccccgucgagcgcuucaccuucgucgacgagaacgccaaccucggcaccgucaugcgcuacgaggagaucgagcuccgcauccuccuccucugcggcuccgaccuccucgaguccuucugcauccccggccucuggaacgaggccgacauggaggucaucgucggcgacuucggcaucgucgucgucccccgcgacgccgccgacaccgaccgcaucaugaaccacuccuccauccuccgcaaguacaagaacaacaucauggucgucaaggacgacaucaaccaccccauguccgucgucuccuccaccaagucccgccucgcccuccagcacggcgacggccacgucgucgacuaccucucccagcccgucaucgacuacauccucaagucccagcucuacaucaacgccuccggcuga

SEQ ID NO: 46723 - RNA, 492 nt, Artificial Sequence
  derived and/or modified sequence opt2 from NMNAT3__Homo_sapiens__NP_001186976
augaagucccgcauccccgucguccuccucgccugcggcuccuucaaccccaucaccaacaugcaccuccgcauguucgaggucgcccgcgaccaccuccaccagaccgccguccccgagcucaagcuccucugcggcgccgacguccucaagaccuuccagacccccaaccucuggaaggacgcccacauccaggagaucgucgagaaguucggccucgucugcgucggccgcgucggccacgaccccaagggcuacaucgccgagucccccauccuccgcaugcaccagcacaacauccaccucgccaaggagcccguccagaacgagaucuccgccaccuacauccgccgcgcccucggccagggccaguccgucaaguaccucauccccgacgccgucaucaccuacaucaaggaccacggccucuacaccaagggcuccaccuggaagggcaaguccacccaguccaccgagggcaagaccuccuga

SEQ ID NO: 46724 - RNA, 462 nt, Artificial Sequence
  derived and/or modified sequence opt2 from NMS__Homo_sapiens__NP_001011717
augaagcaccuccgcccccaguucccccucauccucgccaucuacugcuucugcaugcuccagauccccuccuccggcuucccccagccccucgccgaccccuccgacggccucgacaucguccagcucgagcagcucgccuacugccucucccagugggccccccucucccgccagcccaaggacaaccaggacaucuacaagcgcuuccucuuccacuacucccgcacccaggaggccacccaccccgucaagaccggcuucccccccguccacccccucaugcaccucgccgccaagcucgccaaccgccgcaugaagcgcauccuccagcgcggcuccggcaccgccgccgucgacuucaccaagaaggaccacaccgccaccuggggccgccccuucuuccucuuccgcccccgcaacggccgcaacaucgaggacgaggcccagauccagugguga

SEQ ID NO: 46725 - RNA, 1491 nt, Artificial Sequence
  derived and/or modified sequence opt2 from NMT1__Homo_sapiens__NP_066565
auggccgacgaguccgagaccgccgucaagccccccgcccccccccucccccagaugauggagggcaacggcaacggccacgagcacugcuccgacugcgagaacgaggaggacaacuccuacaaccgcggcggccucucccccgccaacgacaccggcgccaagaagaagaagaagaagcagaagaagaagaaggagaagggcuccgagaccgacuccgcccaggaccagcccgucaagaugaacucccuccccgccgagcgcauccaggagauccagaaggccaucgagcucuucuccgucggccagggccccgccaagaccauggaggaggccuccaagcgcuccuaccaguucugggacacccagcccguccccaagcucggcgaggucgucaacacccacggccccgucgagcccgacaaggacaacauccgccaggagcccuacacccucccccagggcuucaccugggacgcccucgaccucggcgaccgcggcguccucaaggagcucuacacccuccucaacgagaacuacgucgaggacgacgacaacauguuccgcuucgacuacucccccgaguuccuccucugggcccuccgcccccccggcuggcucccccaguggcacugcggcguccgcgucgucuccucccgcaagcucgucggcuucaucuccgccauccccgccaacauccacaucuacgacaccgagaagaagauggucgagaucaacuuccucugcguccacaagaagcuccgcuccaagcgcgucgcccccguccucauccgcgagaucacccgccgcguccaccucgagggcaucuuccaggccgucuacaccgccggcgucguccuccccaagcccgucggcaccugccgcuacuggcaccgcucccucaacccccgcaagcucaucgaggucaaguucucccaccucucccgcaacaugaccaugcagcgcaccaugaagcucuaccgccuccccgagacccccaagaccgccggccuccgccccauggagaccaaggacauccccgucguccaccagcuccucacccgcuaccucaagcaguuccaccucacccccgucaugucccaggaggaggucgagcacugguucuacccccaggagaacaucaucgacaccuucgucgucgagaacgccaacggcgaggucaccgacuuccucuccuucuacacccuccccuccaccaucaugaaccaccccacccacaagucccucaaggccgccuacuccuucuacaacguccacacccagaccccccuccucgaccucauguccgacgcccucguccucgccaagaugaagggcuucgacgucuucaacgcccucgaccucauggagaacaagaccuuccucgagaagcucaaguucggcaucggcgacggcaaccuccaguacuaccucuacaacuggaagugccccuccaugggcgccgagaaggucggccucguccuccaguga

SEQ ID NO: 46726 - RNA, 1497 nt, Artificial Sequence
  derived and/or modified sequence opt2 from NMT2__Homo_sapiens__NP_004799
auggccgaggacuccgaguccgccgccucccagcagucccucgagcucgacgaccaggacaccugcggcaucgacggcgacaacgaggaggagaccgagcacgccaagggcucccccggcggcuaccucggcgccaagaagaagaagaagaagcagaagcgcaagaaggagaagcccaacuccggcggcaccaaguccgacuccgccuccgacucccaggagaucaagauccagcagcccuccaagaaccccuccguccccaugcagaagcuccaggacauccagcgcgccauggagcuccucuccgccugccagggccccgcccgcaacaucgacgaggccgccaagcaccgcuaccaguucugggacacccagcccguccccaagcucgacgaggucaucaccucccacggcgccaucgagcccgacaaggacaacguccgccaggagcccuacucccucccccagggcuucaugugggacacccucgaccucuccgacgccgagguccucaaggagcucuacacccuccucaacgagaacuacgucgaggacgacgacaacauguuccgcuucgacuacucccccgaguuccuccucugggcccuccgcccccccggcuggcuccuccaguggcacugcggcguccgcgucuccuccaacaagaagcucgucggcuucaucuccgccauccccgccaacauccgcaucuacgacuccgucaagaagauggucgagaucaacuuccucugcguccacaagaagcuccgcuccaagcgcgucgcccccguccucauccgcgagaucacccgccgcgucaaccucgagggcaucuuccaggccgucuacaccgccggcgucguccuccccaagcccaucgccaccugccgcuacuggcaccgcucccucaacccccgcaagcucgucgaggucaaguucucccaccucucccgcaacaugacccuccagcgcaccaugaagcucuaccgccuccccgacgucaccaagaccuccggccuccgccccauggagcccaaggacaucaaguccguccgcgagcucaucaacaccuaccucaagcaguuccaccucgcccccgucauggacgaggaggaggucgcccacugguuccucccccgcgagcacaucaucgacaccuucgucgucgagucccccaacggcaagcucaccgacuuccucuccuucuacacccuccccuccaccgucaugcaccaccccgcccacaagucccucaaggccgccuacuccuucuacaacauccacaccgagaccccccuccucgaccucauguccgacgcccucauccucgccaaguccaagggcuucgacgucuucaacgcccucgaccucauggagaacaagaccuuccucgagaagcucaaguucggcaucggcgacggcaaccuccaguacuaccucuacaacuggcgcugccccggcaccgacuccgagaaggucggccucguccuccaguga

SEQ ID NO: 46727 - RNA, 525 nt, Artificial Sequence
  derived and/or modified sequence opt2 from NMU__Homo_sapiens__NP_006672
augcuccgcaccgaguccugccgcccccgcucccccgccggccaggucgccgccgccuccccccuccuccuccuccuccuccuccucgccuggugcgccggcgccugccgcggcgcccccauccucccccagggccuccagcccgagcagcagcuccagcucuggaacgagaucgacgacaccugcuccuccuuccucuccaucgacucccagccccaggccuccaacgcccucgaggagcucugcuucaugaucaugggcaugcuccccaagccccaggagcaggacgagaaggacaacaccaagcgcuuccucuuccacuacuccaagacccagaagcucggcaaguccaacgucgucuccuccgucguccacccccuccuccagcucgucccccaccuccacgagcgccgcaugaagcgcuuccgcgucgacgaggaguuccagucccccuucgccucccagucccgcggcuacuuccucuuccgcccccgcaacggccgccgcuccgccggcuucaucuga

SEQ ID NO: 46728 - RNA, 1281 nt, Artificial Sequence
  derived and/or modified sequence opt2 from NMUR1__Homo_sapiens__NP_006047
augaccccccucugccucaacugcuccguccuccccggcgaccucuaccccggcggcgcccgcaaccccauggccugcaacggcuccgccgcccgcggccacuucgaccccgaggaccucaaccucaccgacgaggcccuccgccucaaguaccucggcccccagcagaccgagcucuucaugcccaucugcgccaccuaccuccucaucuucgucgucggcgccgucggcaacggccucaccugccucgucauccuccgccacaaggccaugcgcacccccaccaacuacuaccucuucucccucgccgucuccgaccuccucguccuccucgucggccucccccucgagcucuacgagauguggcacaacuaccccuuccuccucggcgucggcggcugcuacuuccgcacccuccucuucgagauggucugccucgccuccguccucaacgucaccgcccucuccgucgagcgcuacgucgccgucguccacccccuccaggcccgcuccauggucacccgcgcccacguccgccgcguccucggcgccgucuggggccucgccaugcucugcucccuccccaacaccucccuccacggcauccgccagcuccacguccccugccgcggccccguccccgacuccgccgucugcaugcucguccgcccccgcgcccucuacaacauggucguccagaccaccgcccuccucuucuucugccuccccauggccaucauguccguccucuaccuccucaucggccuccgccuccgccgcgagcgccuccuccucaugcaggaggccaagggccgcggcuccgccgccgcccgcucccgcuacaccugccgccuccagcagcacgaccgcggccgccgccaggucaccaagaugcucuucguccucgucgucgucuucggcaucugcugggcccccuuccacgccgaccgcgucaugugguccgucgucucccaguggaccgacggccuccaccucgccuuccagcacguccacgucaucuccggcaucuucuucuaccucggcuccgccgccaaccccguccucuacucccucauguccucccgcuuccgcgagaccuuccaggaggcccucugccucggcgccugcugccaccgccuccgcccccgccacuccucccacucccucucccgcaugaccaccggcuccacccucugcgacgucggcucccucggcuccuggguccacccccucgccggcaacgacggccccgaggcccagcaggagaccgaccccuccuga

SEQ ID NO: 46729 - RNA, 1248 nt, Artificial Sequence
  derived and/or modified sequence opt2 from NMUR2__Homo_sapiens__NP_064552
auguccggcauggagaagcuccagaacgccuccuggaucuaccagcagaagcucgaggaccccuuccagaagcaccucaacuccaccgaggaguaccucgccuuccucugcggcccccgccgcucccacuucuuccuccccgucuccgucgucuacguccccaucuucgucgucggcgucaucggcaacguccucgucugccucgucauccuccagcaccaggccaugaagacccccaccaacuacuaccucuucucccucgccgucuccgaccuccucguccuccuccucggcaugccccucgaggucuacgagauguggcgcaacuaccccuuccucuucggccccgucggcugcuacuucaagaccgcccucuucgagaccgucugcuucgccuccauccucuccaucaccaccgucuccgucgagcgcuacgucgccauccuccaccccuuccgcgccaagcuccaguccacccgccgccgcgcccuccgcauccucggcaucgucuggggcuucuccguccucuucucccuccccaacaccuccauccacggcaucaaguuccacuacuuccccaacggcucccucguccccggcuccgccaccugcaccgucaucaagcccauguggaucuacaacuucaucauccaggucaccuccuuccucuucuaccuccuccccaugaccgucaucuccguccucuacuaccucauggcccuccgccucaagaaggacaagucccucgaggccgacgagggcaacgccaacauccagcgccccugccgcaaguccgucaacaagaugcucuucguccucguccucgucuucgccaucugcugggcccccuuccacaucgaccgccucuucuucuccuucgucgaggagugguccgagucccucgccgccgucuucaaccucguccacgucgucuccggcgucuucuucuaccucuccuccgccgucaaccccaucaucuacaaccuccucucccgccgcuuccaggccgccuuccagaacgucaucuccuccuuccacaagcaguggcacucccagcacgacccccagcucccccccgcccagcgcaacaucuuccucaccgagugccacuucgucgagcucaccgaggacaucggcccccaguuccccugccaguccuccaugcacaacucccaccuccccgccgcccucuccuccgagcagaugucccgcaccaacuaccaguccuuccacuucaacaagaccuga

SEQ ID NO: 46730 - RNA, 246 nt, Artificial Sequence
  derived and/or modified sequence opt2 from NNAT__Homo_sapiens__NP_005377
auggccgccgucgccgccgccuccgccgagcuccucaucaucggcugguacaucuuccgcguccuccuccaggucuuccucgagugcugcaucuacugggucggcuucgccuuccgcaacccccccggcacccagcccaucgcccgcuccgaggucuuccgcuacucccuccagaagcucgccuacaccgucucccgcaccggccgccagguccucggcgagcgccgccagcgcgcccccaacuga

SEQ ID NO: 46731 - RNA, 795 nt, Artificial Sequence
  derived and/or modified sequence opt2 from NNMT__Homo_sapiens__NP_006160
auggaguccggcuucaccuccaaggacaccuaccucucccacuucaacccccgcgacuaccucgagaaguacuacaaguucggcucccgccacuccgccgagucccagauccucaagcaccuccucaagaaccucuucaagaucuucugccucgacggcgucaagggcgaccuccucaucgacaucggcuccggccccaccaucuaccagcuccucuccgccugcgaguccuucaaggagaucgucgucaccgacuacuccgaccagaaccuccaggagcucgagaaguggcucaagaaggagcccgaggccuucgacuggucccccgucgucaccuacgucugcgaccucgagggcaaccgcgucaagggccccgagaaggaggagaagcuccgccaggccgucaagcagguccucaagugcgacgucacccagucccagccccucggcgccgucccccucccccccgccgacugcguccucuccacccucugccucgacgccgccugccccgaccuccccaccuacugccgcgcccuccgcaaccucggcucccuccucaagcccggcggcuuccucgucaucauggacgcccucaaguccuccuacuacaugaucggcgagcagaaguucuccucccucccccucggccgcgaggccgucgaggccgccgucaaggaggccggcuacaccaucgagugguucgaggucaucucccaguccuacuccuccaccauggccaacaacgagggccucuucucccucgucgcccgcaagcucucccgcccccucuga

SEQ ID NO: 46732 - RNA, 2868 nt, Artificial Sequence
  derived and/or modified sequence opt2 from NNT__Homo_sapiens__XP_006714524
auggucaaccccacccucggcguccacgaggccgaccuccucaagaccuccggcacccucaucuccuucaucuaccccgcccagaaccccgagcuccucaacaagcucucccagcgcaagaccaccguccucgccauggaccaggucccccgcgucaccaucgcccagggcuacgacgcccucuccuccauggccaacaucgccggcuacaaggccgucguccucgccgccaaccacuucggccgcuucuucaccggccagaucaccgccgccggcaaggucccccccgccaagauccucaucgucggcggcggcgucgccggccucgccuccgccggcgccgccaaguccaugggcgccaucguccgcggcuucgacacccgcgccgccgcccucgagcaguucaagucccucggcgccgagccccucgaggucgaccucaaggaguccggcgagggccagggcggcuacgccaaggagauguccaaggaguucaucgaggccgagaugaagcucuucgcccagcagugcaaggaggucgacauccucaucuccaccgcccucauccccggcaagaaggcccccguccucuucaacaaggagaugaucgaguccaugaaggagggcuccgucgucgucgaccucgccgccgaggccggcggcaacuucgagaccaccaagcccggcgagcucuacauccacaagggcaucacccacaucggcuacaccgaccuccccucccgcauggccacccaggccuccacccucuacuccaacaacaucaccaagcuccucaaggccaucucccccgacaaggacaacuucuacuucgacgucaaggacgacuucgacuucggcaccaugggccacgucauccgcggcaccgucgucaugaaggacggcaaggucaucuuccccgcccccacccccaagaacaucccccagggcgcccccgucaagcagaagaccgucgccgagcucgaggccgagaaggccgccaccaucacccccuuccgcaagaccauguccaccgccuccgccuacaccgccggccucaccggcauccucggccucggcaucgccgcccccaaccucgccuucucccagauggucaccaccuucggccucgccggcaucgucggcuaccacaccgucuggggcgucacccccgcccuccacuccccccucauguccgucaccaacgccaucuccggccucaccgccgucggcggccucgcccucaugggcggccaccucuaccccuccaccaccucccagggccucgccgcccucgccgccuucaucuccuccgucaacaucgccggcggcuuccucgucacccagcgcaugcucgacauguucaagcgccccaccgacccccccgaguacaacuaccucuaccuccuccccgccggcaccuucgucggcggcuaccucgccgcccucuacuccggcuacaacaucgagcagaucauguaccucggcuccggccucugcugcgucggcgcccucgccggccucuccacccagggcaccgcccgccucggcaacgcccucggcaugaucggcgucgccggcggccucgccgccacccucggcguccucaagcccggccccgagcuccucgcccagauguccggcgccauggcccucggcggcaccaucggccucaccaucgccaagcgcauccagaucuccgaccucccccagcucgucgccgccuuccacucccucgucggccucgccgccguccucaccugcaucgccgaguacaucaucgaguacccccacuucgccaccgacgccgccgccaaccucaccaagaucgucgccuaccucggcaccuacaucggcggcgucaccuucuccggcucccucaucgccuacggcaagcuccagggccuccucaaguccgccccccuccuccuccccggccgccaccuccucaacgccggccuccucgccgccuccgucggcggcaucauccccuucauggucgaccccuccuucaccaccggcaucaccugccucggcuccgucuccgcccucuccgccgucaugggcgucacccucaccgccgccaucggcggcgccgacaugcccgucgucaucaccguccucaacuccuacuccggcugggcccucugcgccgagggcuuccuccucaacaacaaccuccucaccaucgucggcgcccucaucggcuccuccggcgccauccucuccuacaucaugugcgucgccaugaaccgcucccucgccaacgucauccucggcggcuacggcaccaccuccaccgccggcggcaagcccauggagaucuccggcacccacaccgagaucaaccucgacaacgccaucgacaugauccgcgaggccaacuccaucaucaucacccccggcuacggccucugcgccgccaaggcccaguaccccaucgccgaccucgucaagaugcucaccgagcagggcaagaagguccgcuucggcauccaccccgucgccggccgcaugcccggccagcucaacguccuccucgccgaggccggcguccccuacgacaucguccucgagauggacgagaucaaccacgacuuccccgacaccgaccucguccucgucaucggcgccaacgacaccgucaacuccgccgcccaggaggaccccaacuccaucaucgccggcaugcccguccucgaggucuggaaguccaagcaggucaucgucaugaagcgcucccucggcgucggcuacgccgccgucgacaaccccaucuucuacaagcccaacaccgccaugcuccucggcgacgccaagaagaccugcgacgcccuccaggccaagguccgcgaguccuaccagaaguga

SEQ ID NO: 46733 - RNA, 2097 nt, Artificial Sequence
  derived and/or modified sequence opt2 from NOA1__Homo_sapiens__NP_115689
augcuccccgcccgccuccccuuccgccuccucucccucuuccuccgcggcuccgcccccaccgccgcccgccacggccuccgcgagccccuccucgagcgccgcugcgccgccgccuccuccuuccagcacuccuccucccucggccgcgagcuccccuacgaccccgucgacaccgagggcuucggcgagggcggcgacaugcaggagcgcuuccucuuccccgaguacauccucgaccccgagccccagcccacccgcgagaagcagcuccaggagcuccagcagcagcaggaggaggaggagcgccagcgccagcagcgccgcgaggagcgccgccagcagaaccuccgcgcccgcucccgcgagcaccccgucgucggccaccccgaccccgcccucccccccuccggcgucaacugcuccggcugcggcgccgagcuccacugccaggacgccggcguccccggcuaccucccccgcgagaaguuccuccgcaccgccgaggccgacggcggccucgcccgcaccgucugccagcgcugcuggcuccucucccaccaccgccgcgcccuccgccuccaggucucccgcgagcaguaccucgagcucgucuccgccgcccuccgccgccccggccccucccucguccucuacauggucgaccuccucgaccuccccgacgcccuccuccccgaccuccccgcccucgucggccccaagcagcucaucguccucggcaacaaggucgaccuccucccccaggacgcccccggcuaccgccagcgccuccgcgagcgccucugggaggacugcgcccgcgccggccuccuccucgcccccggccaccagggcccccagcgccccgucaaggacgagccccaggacggcgagaaccccaacccccccaacuggucccgcaccgucguccgcgacguccgccucaucuccgccaagaccggcuacggcgucgaggagcucaucuccgcccuccagcgcuccuggcgcuaccgcggcgacgucuaccucgucggcgccaccaacgccggcaaguccacccucuucaacacccuccucgaguccgacuacugcaccgccaagggcuccgaggccaucgaccgcgccaccaucucccccuggcccggcaccacccucaaccuccucaaguuccccaucugcaaccccacccccuaccgcauguucaagcgccaccagcgccucaagaaggacuccacccaggccgaggaggaccucuccgagcaggagcagaaccagcucaacguccucaagaagcacggcuacgucgucggccgcgucggccgcaccuuccucuacuccgaggagcagaaggacaacauccccuucgaguucgacgccgacucccucgccuucgacauggagaacgaccccgucaugggcacccacaaguccaccaagcaggucgagcucaccgcccaggacgucaaggacgcccacugguucuacgacacccccggcaucaccaaggagaacugcauccucaaccuccucaccgagaaggaggucaacaucguccuccccacccaguccaucgucccccgcaccuucguccucaagcccggcaugguccucuuccucggcgccaucggccgcaucgacuuccuccagggcaaccaguccgccugguucaccgucgucgccuccaacauccuccccguccacaucaccucccucgaccgcgccgacgcccucuaccagaagcacgccggccacacccuccuccagauccccaugggcggcaaggagcgcauggccggcuuccccccccucgucgccgaggacaucaugcucaaggagggccucggcgccuccgaggccgucgccgacaucaaguucuccuccgccggcugggucuccgucacccccaacuucaaggaccgccuccaccuccgcggcuacacccccgagggcaccguccucaccguccgccccccccuccuccccuacaucgucaacaucaagggccagcgcaucaagaaguccgucgccuacaagaccaagaagccccccucccucauguacaacguccgcaagaagaagggcaagaucaacgucuga

SEQ ID NO: 46734 - RNA, 1239 nt, Artificial Sequence
  derived and/or modified sequence opt2 from NOB1__Homo_sapiens__NP_054781
auggcccccgucgagcacgucgucgccgacgccggcgccuuccuccgccacgccgcccuccaggacaucggcaagaacaucuacaccauccgcgaggucgucaccgagauccgcgacaaggccacccgccgccgccucgccguccuccccuacgagcuccgcuucaaggagccccuccccgaguacguccgccucgucaccgaguucuccaagaagaccggcgacuaccccucccucuccgccaccgacauccagguccucgcccucaccuaccagcucgaggccgaguucgucggcgucucccaccucaagcaggagccccagaaggucaaggucuccuccuccauccagcaccccgagaccccccuccacaucuccggcuuccaccuccccuacaagcccaagcccccccaggagaccgagaagggccacuccgccugcgagcccgagaaccucgaguucuccuccuucauguucuggcgcaacccccuccccaacaucgaccacgagcuccaggagcuccucaucgaccgcggcgaggacguccccuccgaggaggaggaggaggaggagaacggcuucgaggaccgcaaggacgacuccgacgacgacggcggcggcuggaucacccccuccaacaucaagcagauccagcaggagcucgagcagugcgacguccccgaggacguccgcgucggcugccucaccaccgacuucgccaugcagaacguccuccuccagaugggccuccacguccucgccgucaacggcaugcucauccgcgaggcccgcuccuacauccuccgcugccacggcugcuucaagaccaccuccgacaugucccgcgucuucugcucccacugcggcaacaagacccucaagaaggucuccgucaccgucuccgacgacggcacccuccacaugcacuucucccgcaaccccaagguccucaacccccgcggccuccgcuacucccuccccacccccaagggcggcaaguacgccaucaacccccaccucaccgaggaccagcgcuucccccagcuccgccucucccagaaggcccgccagaagaccaacgucuucgcccccgacuacaucgccggcgucucccccuucgucgagaacgacaucuccucccgcuccgccacccuccagguccgcgacuccacccucggcgccggccgccgccgccucaaccccaacgccucccgcaagaaguucgucaagaagcgcuga

SEQ ID NO: 46735 - RNA, 2076 nt, Artificial Sequence
  derived and/or modified sequence opt2 from NOBOX__Homo_sapiens__NP_001073882
auggcccuccuccucacccucaccucccccgaccucgagggcaccugggacacccgcgacaaggacggcuucaaggcccaggagggccccccccucgccguccccgaguuccccgucugcggccucuaccgcaucuacggcgucugcggcuccuucuccuccuucuucaucauccgcugcucccucugcgcccucgagacccucaaguccccccagcacgacccccucgagauccccgagcagucccucaagcucaucccccucgucuccggcaagcgcgagcucacccgcggccagaaggccggcgagaagccccucgccgccggccccggcgaggaggagcuccuccgcggcuccgccccccacgcccaggacacccaguccgaggagcucccccccuccugcaccaucuccggcgagaagaagccccccgccgucuccggcgaggccaccggcgccgacgccggccgccucugcccccccccccgcucccgcgccccccacaaggaccgcacccucgcccgcucccgcccccagacccagggcgaggacugcucccuccccgucggcgaggucaagaucggcaagcgcuccuacucccccgcccccggcaagcagaagaagcccaacgccaugggccucgcccccaccuccucccccggcgcccccaacuccgcccgcgccacccacaaccccguccccugcggcuccggccgcggccccugccaccucgccaaccuccucuccacccucgcccaguccaaccagaaccgcgaccacaagcagggcccccccgaggucaccugccagauccgcaagaagacccgcacccucuaccgcuccgaccagcucgaggagcucgagaagaucuuccaggaggaccacuaccccgacuccgacaagcgccgcgagaucgcccagaccgucggcgucaccccccagcgcaucauggucaagggcgccggcucccucgucgccggcugguccggcggcggccccaccaucgagacccucgagcuccaguccgagcgcuccgccgucgccugggucugguuccagaaccgccgcgccaaguggcgcaagauggagaagcucaacggcaaggaguccaaggacaaccccgccgcccccggccccgccuccucccagugcuccuccgccgccgagauccuccccgccguccccauggagcccaagcccgaccccuucccccaggaguccccccucgacaccuuccccgagccccccaugcuccucaccuccgaccagacccucgcccccacccagcccuccgagggcgcccagcgcgucgucacccccccccucuucucccccccccccguccgccgcgccgaccuccccuucccccucggccccguccacaccccccagcucaugccccuccucauggacgucgccggcuccgacuccucccacaaggacggccccugcggcuccuggggcaccuccaucacccuccccccccccugcuccuaccucgaggagcucgagccccaggacuaccagcaguccaaccagcccggccccuuccaguucucccaggccccccagcccccccucuuccaguccccccagcccaagcuccccuaccuccccaccuuccccuucuccaugcccuccucccucacccuccccccccccgaggacucccucuucauguuccccugcggccccuccggcggcaccucccagggcuacugccccggcgccuccuccggccagauccucaugcagccccccgccggcaacaucggcaccgccuccugguccgaccccugccuccccgagcuccccuuccccggccccuucugcccccaggcccucggccacccccccggcggcgacggcuacuuccccgaccucuuccccacccccugcccccaggcccucggccgccagcccuccuccgcccucuccuggaugcccgagggcgcccgccccggcaccggcccccuccucuccaaggccaaggaggagccccccgccgccucccucgaccagcccuccgcccucgaggaggcccgcggcgacgacaagaacucccacguccccuga

SEQ ID NO: 46736 - RNA, 2403 nt, Artificial Sequence
  derived and/or modified sequence opt2 from NOC3L__Homo_sapiens__NP_071896
augaaggcccgccgcaacaagaagcagauccccuccuuccgcaagcucaucaagaccuccaaggucaagcucgagaacaagcucaagaacaagcaguucaagcagcaguccacccucaagaaguaccgcaaggagcagcgcaagcuccgccaggccgucaaggacgccgucuccaagaagcccaucccccucgagaaccccaaggagaagcgccccggcaagcgcaucgagcgcgaggaggaggaggaggaggaggcccucccccucgacaugauggacgaggacgaccuccagcucaugaaggaccucggccagcgcgucuccuuccucacccgcgaccucuccuccuccgagcccguccacgccaagaagcgcaagcacgagcgcaucaucgacaaguacgagaagaucccccgcacccuccagaccgcccccgagaaggagcucauccaccuccuccccaucaaggacaaguccggcaucaucccccagacccgcgagaagcccgucaccgacuccaacaaggacgaggaggaccaggaggaggagcgcgagcucgaggaggagaucaucgaggaccccauccaggagcucaccaucgaggagcaccucaucgagcgcaagaagaagcuccaggagaagaagaugcacaucgccgcccucgccuccgccauccucuccgaccccgagaacaacaucaagaagcucaaggagcuccgcuccaugcucauggagcaggaccccgacgucgccgucaccguccgcaagcucgucaucgucucccucauggagcucuucaaggacaucacccccuccuacaagauccgcccccucaccgaggccgagaaguccaccaagacccgcaaggagacccagaagcuccgcgaguucgaggagggccucgucucccaguacaaguucuaccucgagaaccucgagcagauggucaaggacuggaagcagcgcaagcucaagaaguccaacgucgucucccucaaggccuacaagggccucgccgaggucgccgucaagucccucugcgagcuccucgucgcccucccccacuucaacuuccacaacaacaucaucguccucaucgucccccucaugaacgacauguccaagcucaucuccgagaugugcugcgaggccgucaagaagcucuucaagcaggacaagcucggccaggccucccucggcgucaucaaggucaucuccggcuucgucaagggccgcaacuacgagguccgccccgagaugcucaagaccuuccucugccuccgcaucaaggaggucgaggucaagaaggacaccgaggacaucaacaagcccaagaaguucaugaccuucaaggagaagcgcaagucccucucccgcaugcagcgcaaguggaagaaggccgaggagaagcucgagcgcgagcuccgcgaggccgaggccuccgaguccaccgagaagaagcucaagcuccacaccgagacccucaacaucgucuucgucaccuacuuccgcauccucaagaaggcccagcgcuccccccuccuccccgccguccucgagggccucgccaaguucgcccaccucaucaacgucgaguucuucgacgaccuccucgucguccuccacacccucaucgaguccggcgaccucuccuaccaggagucccuccacugcguccagaccgccuuccacauccucuccggccagggcgacguccucaacaucgacccccucaaguucuacacccaccucuacaagacccucuucaagcuccacgccggcgccaccaacgagggcgucgagaucguccuccagugccucgacgucaugcucaccaagcgccgcaagcaggucucccagcagcgcgcccucgccuucaucaagcgccucugcacccucgcccuccacguccuccccaacuccuccaucggcauccucgccaccacccgcauccucaugcacaccuuccccaagaccgaccuccuccucgacuccgagucccagggcuccggcgucuuccuccccgagcucgacgagcccgaguacugcaacgcccagaacaccgcccucugggagcuccacgcccuccgccgccacuaccaccccaucguccagcgcuucgccgcccaccucaucgccggcgcccccuccgagggcuccggcgcccucaagcccgagcucucccgccgcuccgccaccgagcucuucgaggccuacuccauggccgagaugaccuucaacccccccgucgaguccuccaaccccaagaucaagggcaaguuccuccagggcgacuccuuccucaacgaggaccucaaccagcucaucaagcgcuacuccuccgaggucgccaccgaguccccccucgacuucaccaaguaccucaagaccucccuccacuga

SEQ ID NO: 46737 - RNA, 2862 nt, Artificial Sequence
  derived and/or modified sequence opt2 from NOD1__Homo_sapiens__NP_006083
auggaggagcagggccacuccgagauggagaucauccccuccgagucccacccccacauccagcuccucaaguccaaccgcgagcuccucgucacccacauccgcaacacccagugccucgucgacaaccuccucaagaacgacuacuucuccgccgaggacgccgagaucgucugcgccugccccacccagcccgacaagguccgcaagauccucgaccucguccaguccaagggcgaggaggucuccgaguucuuccucuaccuccuccagcagcucgccgacgccuacgucgaccuccgccccuggcuccucgagaucggcuucucccccucccuccucacccaguccaaggucgucgucaacaccgaccccgucucccgcuacacccagcagcuccgccaccaccucggccgcgacuccaaguucguccucugcuacgcccagaaggaggagcuccuccucgaggagaucuacauggacaccaucauggagcucgucggcuucuccaacgagucccucggcucccucaacucccucgccugccuccucgaccacaccaccggcauccucaacgagcagggcgagaccaucuucauccucggcgacgccggcgucggcaaguccaugcuccuccagcgccuccagucccucugggccaccggccgccucgacgccggcgucaaguucuucuuccacuuccgcugccgcauguucuccugcuucaaggaguccgaccgccucugccuccaggaccuccucuucaagcacuacugcuaccccgagcgcgaccccgaggaggucuucgccuuccuccuccgcuucccccacgucgcccucuucaccuucgacggccucgacgagcuccacuccgaccucgaccucucccgcguccccgacuccuccugccccugggagcccgcccacccccucguccuccucgccaaccuccucuccggcaagcuccucaagggcgccuccaagcuccucaccgcccgcaccggcaucgaggucccccgccaguuccuccgcaagaagguccuccuccgcggcuucucccccucccaccuccgcgccuacgcccgccgcauguuccccgagcgcgcccuccaggaccgccuccucucccagcucgaggccaaccccaaccucugcucccucugcuccgucccccucuucugcuggaucaucuuccgcugcuuccagcacuuccgcgccgccuucgagggcuccccccagcuccccgacugcaccaugacccucaccgacgucuuccuccucgucaccgagguccaccucaaccgcaugcagcccuccucccucguccagcgcaacacccgcucccccgucgagacccuccacgccggccgcgacacccucugcucccucggccaggucgcccaccgcggcauggagaagucccucuucgucuucacccaggaggagguccaggccuccggccuccaggagcgcgacaugcagcucggcuuccuccgcgcccuccccgagcucggccccggcggcgaccagcaguccuacgaguucuuccaccucacccuccaggccuucuucaccgccuucuuccucguccucgacgaccgcgucggcacccaggagcuccuccgcuucuuccaggaguggaugccccccgccggcgccgccaccaccuccugcuacccccccuuccuccccuuccagugccuccagggcuccggccccgcccgcgaggaccucuucaagaacaaggaccacuuccaguucaccaaccucuuccucugcggccuccucuccaaggccaagcagaagcuccuccgccaccucguccccgccgccgcccuccgccgcaagcgcaaggcccucugggcccaccucuucuccucccuccgcggcuaccucaagucccucccccgcguccaggucgaguccuucaaccagguccaggccaugcccaccuucaucuggaugcuccgcugcaucuacgagacccagucccagaaggucggccagcucgccgcccgcggcaucugcgccaacuaccucaagcucaccuacugcaacgccugcuccgccgacugcuccgcccucuccuucguccuccaccacuuccccaagcgccucgcccucgaccucgacaacaacaaccucaacgacuacggcguccgcgagcuccagcccugcuucucccgccucaccguccuccgccucuccgucaaccagaucaccgacggcggcgucaagguccucuccgaggagcucaccaaguacaagaucgucaccuaccucggccucuacaacaaccagaucaccgacgucggcgcccgcuacgucaccaagauccucgacgagugcaagggccucacccaccucaagcucggcaagaacaagaucaccuccgagggcggcaaguaccucgcccucgccgucaagaacuccaaguccaucuccgaggucggcauguggggcaaccaggucggcgacgagggcgccaaggccuucgccgaggcccuccgcaaccaccccucccucaccacccucucccucgccuccaacggcaucuccaccgagggcggcaagucccucgcccgcgcccuccagcagaacaccucccucgagauccucuggcucacccagaacgagcucaacgacgaggucgccgagucccucgccgagaugcucaaggucaaccagacccucaagcaccucuggcucauccagaaccagaucaccgccaagggcaccgcccagcucgccgacgcccuccaguccaacaccggcaucaccgagaucugccucaacggcaaccucaucaagcccgaggaggccaaggucuacgaggacgagaagcgcaucaucugcuucuga

SEQ ID NO: 46738 - RNA, 3123 nt, Artificial Sequence
  derived and/or modified sequence opt2 from NOD2__Homo_sapiens__NP_071445
augggcgaggagggcggcuccgccucccacgacgaggaggagcgcgccuccguccuccucggccacucccccggcugcgagaugugcucccaggaggccuuccaggcccagcgcucccagcucgucgagcuccucgucuccggcucccucgagggcuucgaguccguccucgacuggcuccucuccugggagguccucuccugggaggacuacgagggcuuccaccuccucggccagccccucucccaccucgcccgccgccuccucgacaccgucuggaacaagggcaccugggccugccagaagcucaucgccgccgcccaggaggcccaggccgacucccagucccccaagcuccacggcugcugggacccccacucccuccaccccgcccgcgaccuccagucccaccgccccgccaucguccgccgccuccacucccacgucgagaacaugcucgaccucgccugggagcgcggcuucgucucccaguacgagugcgacgagauccgccuccccaucuucacccccucccagcgcgcccgccgccuccucgaccucgccaccgucaaggccaacggccucgccgccuuccuccuccagcacguccaggagcuccccgucccccucgcccucccccucgaggccgccaccugcaagaaguacauggccaagcuccgcaccaccgucuccgcccagucccgcuuccucuccaccuacgacggcgccgagacccucugccucgaggacaucuacaccgagaacguccucgaggucugggccgacgucggcauggccggccccccccagaagucccccgccacccucggccucgaggagcucuucuccacccccggccaccucaacgacgacgccgacaccguccucgucgucggcgaggccggcuccggcaaguccacccuccuccagcgccuccaccuccucugggccgccggccaggacuuccaggaguuccucuucgucuuccccuucuccugccgccagcuccagugcauggccaagccccucuccguccgcacccuccucuucgagcacugcugcuggcccgacgucggccaggaggacaucuuccagcuccuccucgaccaccccgaccgcguccuccucaccuucgacggcuucgacgaguucaaguuccgcuucaccgaccgcgagcgccacugcucccccaccgaccccaccuccguccagacccuccucuucaaccuccuccagggcaaccuccucaagaacgcccgcaaggucgucaccucccgccccgccgccgucuccgccuuccuccgcaaguacauccgcaccgaguucaaccucaagggcuucuccgagcagggcaucgagcucuaccuccgcaagcgccaccacgagcccggcgucgccgaccgccucauccgccuccuccaggagaccuccgcccuccacggccucugccaccuccccgucuucuccuggauggucuccaagugccaccaggagcuccuccuccaggagggcggcucccccaagaccaccaccgacauguaccuccucauccuccagcacuuccuccuccacgccaccccccccgacuccgccucccagggccucggccccucccuccuccgcggccgccuccccacccuccuccaccucggccgccucgcccucuggggccucggcaugugcugcuacgucuucuccgcccagcagcuccaggccgcccaggucucccccgacgacaucucccucggcuuccucguccgcgccaagggcgucguccccggcuccaccgccccccucgaguuccuccacaucaccuuccagugcuucuucgccgccuucuaccucgcccucuccgccgacgucccccccgcccuccuccgccaccucuucaacugcggccgccccggcaacucccccauggcccgccuccuccccaccaugugcauccaggccuccgagggcaaggacuccuccgucgccgcccuccuccagaaggccgagccccacaaccuccagaucaccgccgccuuccucgccggccuccucucccgcgagcacuggggccuccucgccgagugccagaccuccgagaaggcccuccuccgccgccaggccugcgcccgcuggugccucgcccgcucccuccgcaagcacuuccacuccaucccccccgccgcccccggcgaggccaaguccguccacgccaugcccggcuucaucuggcucauccgcucccucuacgagaugcaggaggagcgccucgcccgcaaggccgcccgcggccucaacgucggccaccucaagcucaccuucugcuccgucggccccaccgagugcgccgcccucgccuucguccuccagcaccuccgccgccccgucgcccuccagcucgacuacaacuccgucggcgacaucggcgucgagcagcuccuccccugccucggcgucugcaaggcccucuaccuccgcgacaacaacaucuccgaccgcggcaucugcaagcucaucgagugcgcccuccacugcgagcagcuccagaagcucgcccucuucaacaacaagcucaccgacggcugcgcccacuccauggccaagcuccucgccugccgccagaacuuccucgcccuccgccucggcaacaacuacaucaccgccgccggcgcccagguccucgccgagggccuccgcggcaacaccucccuccaguuccucggcuucuggggcaaccgcgucggcgacgagggcgcccaggcccucgccgaggcccucggcgaccaccagucccuccgcuggcucucccucgucggcaacaacaucggcuccgucggcgcccaggcccucgcccucaugcucgccaagaacgucaugcucgaggagcucugccucgaggagaaccaccuccaggacgagggcgucugcucccucgccgagggccucaagaagaacuccucccucaagauccucaagcucuccaacaacugcaucaccuaccucggcgccgaggcccuccuccaggcccucgagcgcaacgacaccauccucgaggucuggcuccgcggcaacaccuucucccucgaggaggucgacaagcucggcugccgcgacacccgccuccuccucuga

SEQ ID NO: 46739 - RNA, 1044 nt, Artificial Sequence
  derived and/or modified sequence opt2 from NODAL__Homo_sapiens__NP_060525
augcacgcccacugccuccccuuccuccuccacgccuggugggcccuccuccaggccggcgccgccaccgucgccaccgcccuccuccgcacccgcggccagcccuccucccccuccccccucgccuacaugcucucccucuaccgcgacccccucccccgcgccgacaucauccgcucccuccaggccgaggacgucgccgucgacggccagaacuggaccuucgccuucgacuucuccuuccucucccagcaggaggaccucgccugggccgagcuccgccuccagcucuccucccccgucgaccuccccaccgagggcucccucgccaucgagaucuuccaccagcccaagcccgacaccgagcaggccuccgacuccugccucgagcgcuuccagauggaccucuucaccgucacccucucccaggucaccuucucccucggcuccaugguccucgaggucacccgcccccucuccaaguggcucaagcaccccggcgcccucgagaagcagaugucccgcgucgccggcgagugcuggccccgcccccccaccccccccgccaccaacguccuccucaugcucuacuccaaccucucccaggagcagcgccagcucggcggcuccacccuccucugggaggccgaguccuccuggcgcgcccaggagggccagcucuccugggaguggggcaagcgccaccgccgccaccaccuccccgaccgcucccagcucugccgcaaggucaaguuccaggucgacuucaaccucaucggcuggggcuccuggaucaucuaccccaagcaguacaacgccuaccgcugcgagggcgagugccccaaccccgucggcgaggaguuccaccccaccaaccacgccuacauccagucccuccucaagcgcuaccagccccaccgcguccccuccaccugcugcgcccccgucaagaccaagccccucuccaugcucuacgucgacaacggccgcguccuccucgaccaccacaaggacaugaucgucgaggagugcggcugccucuga

SEQ ID NO: 46740 - RNA, 699 nt, Artificial Sequence
  derived and/or modified sequence opt2 from NOG__Homo_sapiens__NP_005441
auggagcgcugccccucccucggcgucacccucuacgcccucgucgucguccucggccuccgcgccacccccgccggcggccagcacuaccuccacauccgccccgcccccuccgacaaccucccccucgucgaccucaucgagcaccccgaccccaucuucgaccccaaggagaaggaccucaacgagacccuccuccgcucccuccucggcggccacuacgaccccggcuucauggccaccuccccccccgaggaccgccccggcggcggcggcggcgccgccggcggcgccgaggaccucgccgagcucgaccagcuccuccgccagcgccccuccggcgccaugcccuccgagaucaagggccucgaguucuccgagggccucgcccagggcaagaagcagcgccucuccaagaagcuccgccgcaagcuccagauguggcucuggucccagaccuucugccccguccucuacgccuggaacgaccucggcucccgcuucuggccccgcuacgucaaggucggcuccugcuucuccaagcgcuccugcuccguccccgagggcauggucugcaagcccuccaaguccguccaccucaccguccuccgcuggcgcugccagcgccgcggcggccagcgcugcggcuggauccccauccaguaccccaucaucuccgagugcaagugcuccugcuga

SEQ ID NO: 46741 - RNA, 1614 nt, Artificial Sequence
  derived and/or modified sequence opt2 from NOL11__Homo_sapiens__NP_001290201
auguucaacucccgcauccucaccaaguacacccuccuccucggccaggacgagaacuccgucaucaaguccuucaccgccuccgucgaccgcaaguucaucucccucaugucccucuccuccgacggcugcaucuacgagacccucauccccauccgccccgccgaccccgagaagaaccagucccucgucaagucccuccuccucaaggccgucgucuccggcaacgcccgcaacggcgucgcccucaccgcccucgaccaggaccacgucgccguccucggcuccccccucgccgccuccaaggagugccucuccgucuggaacaucaaguuccagacccuccagaccuccaaggagcucccccagggcaccuccggccagcucugguacuacggcgagcaccucuucaugcuccacggcaagucccucaccgucauccccuacaagugcgaggucuccucccucgccggcgcccucggcaagcucaagcacucccaggaccccggcacccacgucgucucccacuucgucaacugggagaccccccagggcugcggccucggcuuccagaacuccgagcagucccgccgcauccuccgccgccgcaagaucgaggucucccuccagcccgaggucccccccuccaagcagcuccucuccaccaucaugaaggacuccgagaagcacaucgaggucgagguccgcaaguuccucgcccucaagcagacccccgacuuccacaccgucaucggcgacaccgucaccggccuccucgagcgcugcaaggccgagcccuccuucuacccccgcaacugccucaugcagcucauccagacccacguccucuccuacucccucugccccgaccucauggagaucgcccucaagaagaaggacguccagcuccuccagcucugccuccagcaguuccccgacauccccgaguccgucaccugcgccugccucaagaucuuccucuccaucggcgacgacucccuccaggagaccgacgucaacauggaguccgucuucgacuacuccaucaacuccguccacgacgagaagauggaggagcagaccgagauccuccagaacggcuucaaccccgaggaggacaagugcaacaacugcgaccaggagcucaacaagaagccccaggacgagaccaaggaguccaccuccugccccgucguccagaagcgcgccgcccuccucaacgccauccuccacuccgccuacuccgagaccuuccuccucccccaccucaaggacauccccgcccagcacaucacccucuuccucaaguaccucuacuuccucuaccucaagugcuccgagaacgccaccaugacccuccccggcauccacccccccacccucaaccagaucauggacuggaucugccuccuccucgacgccaacuucaccgucgucgucaugaugcccgaggccaagcgccuccucaucaaccucuacaagcucgucaagucccagaucuccgucuacuccgagcucaacaagaucgaggucuccuuccgcgagcuccagaagcucaaccaggagaagaacaaccgcggccucuacuccaucgagguccucgagcucuucuga

SEQ ID NO: 46742 - RNA, 627 nt, Artificial Sequence
  derived and/or modified sequence opt2 from NOL3__Homo_sapiens__NP_001263236
augggcaacgcccaggagcgccccuccgagaccaucgaccgcgagcgcaagcgccucgucgagacccuccaggccgacuccggccuccuccucgacgcccuccucgcccgcggcguccucaccggccccgaguacgaggcccucgacgcccuccccgacgccgagcgccgcguccgccgccuccuccuccucguccagggcaagggcgaggccgccugccaggagcuccuccgcugcgcccagcgcaccgccggcgcccccgaccccgccugggacuggcagcacgucggccccggcuaccgcgaccgcuccuacgacccccccugccccggccacuggacccccgaggcccccggcuccggcaccaccugccccggccucccccgcgccuccgaccccgacgaggccggcggccccgagggcuccgaggccguccaguccggcacccccgaggagcccgagcccgagcucgaggccgaggccuccaaggaggccgagcccgagcccgagcccgagcccgagcucgagcccgaggccgaggccgagcccgagcccgagcucgagcccgagcccgaccccgagcccgagcccgacuucgaggagcgcgacgaguccgaggacuccuga

SEQ ID NO: 46743 - RNA, 1725 nt, Artificial Sequence
  derived and/or modified sequence opt2 from NOL4__Homo_sapiens__NP_001185475
auggaguccgagcgcgacauguaccgccaguuccaggacuggugccuccgcaccuacggcgacuccggcaagaccaagaccgucacccgcaagaaguacgagcgcaucguccagcuccucaacggcuccgaguccuccuccaccgacaacgccaaguucaaguucugggucaaguccaagggcuuccagcucggccagcccgacgagguccgcggcggcggcggcggcgccaagcagguccucuacguccccgucaagaccaccgacggcgucggcgucgacgagaagcucucccuccgccgcgucgccgucgucgaggacuucuucgacaucaucuacuccaugcacgucgagaccggccccaacggcgagcagauccgcaagcacgccggccagaagcgcaccuacaaggccaucuccgaguccuacgccuuccucccccgcgaggccgucacccgcuuccucauguccugcuccgagugccagaagcgcaugcaccucaaccccgacggcaccgaccacaaggacaacggcaagccccccacccucgucaccuccaugaucgacuacaacaugcccaucaccauggccuacaugaagcacaugaagcuccagcuccucaacucccagcaggacgaggacgaguccuccaucgaguccgacgaguucgacauguccgacuccacccgcauguccgccgucaacuccgaccucuccuccaaccucgaggagcgcaugcaguccccccagaaccuccacggccagcaggacgacgacuccgccgccgaguccuucaacggcaacgagacccucggccacuccuccaucgccuccggcggcacccacucccgcgagaugggcgacuccaacuccgacggcaagaccggccucgagcaggacgagcagccccucaaccucuccgacuccccccucuccgcccagcucaccuccgaguaccgcaucgacgaccacaacuccaacggcaagaacaaguacaagaaccuccucaucuccgaccucaagauggagcgcgaggcccgcgagaacggcuccaagucccccgcccacuccuacuccuccuacgacuccggcaagaacgaguccgucgaccgcggcgccgaggaccucucccucaaccgcggcgacgaggacgaggacgaccacgaggaccacgacgacuccgagaaggucaacgagaccgacggcgucgaggccgagcgccucaaggccuucaacucccgccccauccccucccaccucaccuccgccgucgccgaguccauccucgccuccgccugcgaguccgagucccgcaacgccgccaagcgcaugcgccucgagcgccagcaggacgaguccgcccccgccgacaagcagugcaagcccgaggccacccaggccaccuacuccaccuccgccguccccggcucccaggacguccucuacaucaacggcaacggcaccuacuccuaccacuccuaccgcggccucggcggcggccuccucaaccucaacgacgccuccuccuccggccccaccgaccucuccaugaagcgccagcucgccaccuccuccggcuccuccuccuccuccaacucccgcccccagcucucccccaccgagaucaacgccguccgccagcucgucgccggcuaccgcgaguccgccgccuuccuccuccgcuccgccgacgagcucgagaaccucauccuccagcagaacuga

SEQ ID NO: 46744 - RNA, 3441 nt, Artificial Sequence
  derived and/or modified sequence opt2 from NOL6__Homo_sapiens__NP_075068
augggccccgcccccgccggcgagcagcuccgcggcgccaccggcgagcccgaggucauggagcccgcccucgagggcaccggcaaggagggcaagaaggccuccucccgcaagcgcacccucgccgagccccccgccaagggccuccuccagcccgucaagcucucccgcgccgagcucuacaaggagcccaccaacgaggagcucaaccgccuccgcgagaccgagauccucuuccacuccucccuccuccgccuccaggucgaggagcuccucaaggagguccgccucuccgagaagaagaaggaccgcaucgacgccuuccuccgcgaggucaaccagcgcgucguccgcguccccuccguccccgagaccgagcucaccgaccaggccuggcuccccgccggcguccgcgucccccuccaccagguccccuacgccgucaagggcugcuuccgcuuccucccccccgcccaggucaccgucgucggcuccuaccuccucggcaccugcauccgccccgacaucaacgucgacgucgcccucaccaugccccgcgagauccuccaggacaaggacggccucaaccagcgcuacuuccgcaagcgcgcccucuaccucgcccaccucgcccaccaccucgcccaggacccccucuucggcuccgucugcuucuccuacaccaacggcugccaccucaagcccucccuccuccuccgcccccgcggcaaggacgagcgccucgucaccguccgccuccaccccugccccccccccgacuucuuccgccccugccgccuccuccccaccaagaacaacguccgcuccgccugguaccgcggccagucccccgccggcgacggcucccccgagccccccaccccccgcuacaacaccuggguccuccaggacaccguccucgagucccaccuccagcuccucuccaccauccucuccuccgcccagggccucaaggacggcgucgcccuccucaaggucuggcuccgccagcgcgagcucgacaagggccagggcggcuucaccggcuuccucgucuccaugcucgucgucuuccucgucuccacccgcaagauccacaccaccauguccggcuaccagguccuccgcuccguccuccaguuccucgccaccaccgaccucaccgucaacggcaucucccucugccucuccuccgaccccucccuccccgcccucgccgacuuccaccaggccuucuccgucgucuuccucgacuccuccggccaccucaaccucugcgccgacgucaccgccuccaccuaccaccagguccagcacgaggcccgccucuccaugaugcuccucgacucccgcgccgacgacggcuuccaccuccuccucaugacccccaagcccaugauccgcgccuucgaccacguccuccaccuccgcccccucucccgccuccaggccgccugccaccgccucaagcucuggcccgagcuccaggacaacggcggcgacuacgucuccgccgcccucggcccccucaccacccuccucgagcagggccucggcgcccgccucaaccuccucgcccacucccgcccccccguccccgagugggacaucucccaggacccccccaagcacaaggacuccggcacccucacccucggccuccuccuccgccccgagggccucaccuccguccucgagcucggccccgaggccgaccagcccgaggccgccaaguuccgccaguucuggggcucccgcuccgagcuccgccgcuuccaggacggcgccauccgcgaggccgucgucugggaggccgccuccaugucccagaagcgccucaucccccaccaggucgucacccaccuccucgcccuccacgccgacauccccgagaccugcguccacuacgucggcggcccccucgacgcccucauccagggccucaaggagaccuccuccaccggcgaggaggcccucgucgccgccguccgcugcuacgacgaccucucccgccuccucuggggccucgagggccucccccucaccgucuccgccguccagggcgcccaccccguccuccgcuacaccgaggucuucccccccacccccguccgccccgccuucuccuucuacgagacccuccgcgagcgcuccucccuccucccccgccucgacaagcccugccccgccuacgucgagcccaugaccgucgucugccaccucgagggcuccggccaguggccccaggacgccgaggccguccagcgcguccgcgccgccuuccagcuccgccucgccgagcuccucacccagcagcacggccuccagugccgcgccaccgccacccacaccgacguccucaaggacggcuucgucuuccgcauccgcgucgccuaccagcgcgagccccagauccucaaggagguccagucccccgagggcaugaucucccuccgcgacaccgccgccucccuccgccucgagcgcgacacccgccagcucccccuccucaccuccgcccuccacggccuccagcagcagcaccccgccuucuccggcgucgcccgccucgccaagcgcuggguccgcgcccagcuccucggcgagggcuucgccgacgagucccucgaccucgucgccgccgcccucuuccuccaccccgagcccuucaccccccccuccuccccccaggucggcuuccuccgcuuccucuuccucgucuccaccuucgacuggaagaacaacccccucuucgucaaccucaacaacgagcucaccgucgaggagcaggucgagauccgcuccggcuuccucgccgcccgcgcccagcuccccgucauggucaucgucaccccccaggaccgcaagaacuccgucuggacccaggacggccccuccgcccagauccuccagcagcucgucguccucgccgccgaggcccuccccaugcucgagaagcagcucauggacccccgcggccccggcgacauccgcaccgucuuccgccccccccucgacaucuacgacguccucauccgccucuccccccgccacaucccccgccaccgccaggccgucgacucccccgccgccuccuucugccgcggccuccucucccagcccggccccuccucccucaugcccguccucggcuacgaccccccccagcucuaccucacccagcuccgcgaggccuucggcgaccucgcccucuucuucuacgaccagcacggcggcgaggucaucggcguccucuggaagcccaccuccuuccagccccagcccuucaaggccuccuccaccaagggccgcauggucaugucccgcggcggcgagcucgucaugguccccaacgucgaggccauccucgaggacuucgccguccucggcgagggccucguccagaccgucgaggcccgcuccgagcgcuggaccgucuga

SEQ ID NO: 46745 - RNA, 3300 nt, Artificial Sequence
  derived and/or modified sequence opt2 from NOL8__Homo_sapiens__NP_001243323
auguccguccucaacaagaccaaguggaagggcggcacccuccagauccagcucgccaaggaguccuuccuccaccgccucgcccaggagcgcgaggccgccaaggccaagaaggaggaguccaccaccggcaacgccaaccuccucgagaagaccggcggcgucgacuuccacaugaaggccguccccggcaccgagguccccggccacaagaacugggucgucuccaaguucggccgcguccuccccguccuccaccucaagaaccagcacaagcgcaagaucaucaaguacgaccccuccaaguacugccacaaccucaagaagaucggcgaggacuucuccaacaccauccccaucuccucccucaccugggagcucgagggcggcaacgaccccauguccaagaagcgccgcggcgaguucuccgacuuccacggcccccccaagaagaucaucaagguccagaaggacgaguccuccaccggcucccucgccauguccacccgcccccgccgcgucaucgagcgccccccccucacccagcagcaggccgcccagaagcgcaccugcgacuccaucacccccuccaaguccucccccguccccgucuccgacacccagaagcucaagaaccuccccuucaagaccuccggccucgagaccgccaagaagcgcaacuccaucuccgacgacgacaccgacuccgaggacgagcuccgcaugaugaucgccaaggaggagaaccuccagcgcaccacccagcccuccaucaacgaguccgaguccgaccccuucgaggucguccgcgacgacuucaaguccggcguccacaagcuccacucccucaucggccucggcaucaagaaccgcgucuccugccacgacuccgacgacgacaucaugcgcaacgaccgcgaguacgacuccggcgacaccgacgagaucaucgccaugaagaagaacgucgccaaggucaagaacuccaccgaguucucccagauggagaaguccaccaagaagaccuccuucaagaaccgcgagaacugcgagcucuccgaccacugcaucaagcuccagaagcgcaaguccaacgucgaguccgcccucucccacggccucaagucccucaaccgcaagucccccucccacuccuccuccuccgaggacgccgacuccgccuccgagcucgccgacuccgagggcggcgaggaguacaacgccaugaugaagaacugccuccgcgucaaccucacccucgccgaccucgagcagcucgccggcuccgaccucaagguccccaacgaggacaccaaguccgacggccccgagaccaccacccagugcaaguucgaccgcggcuccaagucccccaagacccccaccggccuccgccgcggccgccagugcauccgccccgccgagaucgucgccucccuccucgagggcgaggagaacaccugcggcaagcagaagcccaaggagaacaaccucaagcccaaguuccaggccuucaagggcgucggcugccucuacgagaaggaguccaugaagaagucccucaaggacuccgucgccuccaacaacaaggaccagaacuccaugaagcacgaggaccccuccaucaucuccauggaggacggcucccccuacgucaacggcucccucggcgaggucacccccugccagcacgccaagaaggccaacggccccaacuacauccagccccagaagcgccagaccaccuucgagucccaggaccgcaaggccgucucccccuccuccuccgagaagcgcuccaagaaccccaucucccgcccccucgagggcaagaagucccucucccucuccgccaagacccacaacaucggcuucgacaaggacuccugccacuccaccaccaagaccgaggccucccaggaggagcgcuccgacuccuccggccucaccucccucaagaagucccccaaggucuccuccaaggacacccgcgagaucaagaccgacuucucccucuccaucuccaacuccuccgacgucuccgccaaggacaagcacgccgaggacaacgagaagcgccucgccgcccucgaggcccgccagaaggccaaggagguccagaagaagcucguccacaacgcccucgccaaccucgacggccaccccgaggacaagcccacccacaucaucuucggcuccgacuccgagugcgagaccgaggagaccuccacccaggagcagucccaccccggcgaggagugggucaaggaguccaugggcaagaccuccggcaagcucuucgacuccuccgacgacgacgaguccgacuccgaggacgacuccaaccgcuucaagaucaagccccaguucgagggccgcgccggccagaagcucauggaccuccagucccacuucggcaccgacgaccgcuuccgcauggacucccgcuuccucgagaccgacuccgaggaggagcaggaggaggucaacgagaagaagaccgccgaggaggaggagcucgccgaggagaagaagaaggcccucaacgucguccaguccguccuccagaucaaccucuccaacuccaccaaccgcggcuccgucgccgccaagaaguucaaggacaucauccacuacgaccccaccaagcaggaccacgccaccuacgagcgcaagcgcgacgacaagcccaaggaguccaaggccaagcgcaagaagaagcgcgaggaggccgagaagcuccccgaggucuccaaggagauguacuacaacaucgccauggaccucaaggagaucuuccagaccaccaaguacaccuccgagaaggaggagggcacccccuggaacgaggacugcggcaaggagaagcccgaggagauccaggaccccgccgcccucaccuccgacgccgagcagcccuccggcuucaccuucuccuucuucgacuccgacaccaaggacaucaaggaggagaccuaccgcgucgagaccgucaagcccggcaagaucgucuggcaggaggacccccgccuccaggacuccuccuccgaggaggaggacgucaccgaggagaccgaccaccgcaacuccucccccggcgaggccucccuccucgagaaggagaccacccgcuucuucuucuucuccaagaacgacgagcgccuccagggcuccgaccucuucuggcgcggcgucggcuccaacaugucccgcaacuccugggaggcccgcaccaccaaccuccgcauggacugccgcaagaagcacaaggacgccaagcgcaagaugaagcccaaguga

SEQ ID NO: 46746 - RNA, 2130 nt, Artificial Sequence
  derived and/or modified sequence opt2 from NOLC1__Homo_sapiens__NP_001271317
auggccgacgccggcauccgccgcgucguccccuccgaccucuacccccucguccucggcuuccuccgcgacaaccagcucuccgaggucgccaacaaguucgccaaggccaccggcgccacccagcaggacgccaacgccuccucccuccucgacaucuacuccuucuggcucaaguccgccaagguccccgagcgcaagcuccaggccaacggccccgucgccaagaaggccaagaagaaggccuccuccuccgacuccgaggacuccuccgaggaggaggaggagguccagggcccccccgccaagaaggccgccguccccgccaagcgcgucggccucccccccggcaaggccgccgccaaggccuccgaguccuccuccuccgaggaguccuccgacgacgacgacgaggaggaccagaagaagcagcccguccagaagggcgucaagccccaggccaaggccgccaaggccccccccaagaaggccaaguccuccgacuccgacuccgacuccuccuccgaggacgagccccccaagaaccagaagcccaagaucacccccgucaccgucaaggcccagaccaaggccccccccaagcccgcccgcgccgcccccaagaucgccaacggcaaggccgccuccuccuccuccuccuccuccuccuccuccuccuccgacgacuccgaggaggagaaggccgccgccacccccaagaaggucuggaccaucaccuccguccgcgccgagaccguccccaagaagcaggucgucgccaaggcccccgucaaggccgccaccacccccacccgcaaguccuccuccuccgaggacuccuccuccgacgaggaggaggagcagaagaagcccaugaagaacaagcccggccccuacuccuccguccccccccccuccgcccccccccccaagaagucccucggcacccagccccccaagaaggccgucgagaagcagcagcccgucgaguccuccgaggacuccuccgacgaguccgacuccuccuccgaggaggagaagaagccccccaccaaggccgucgucuccaaggccaccaccaagcccccccccgccaagaaggccgccgaguccuccuccgacuccuccgacuccgacuccuccgaggacgacgaggcccccuccaagcccgccggcaccaccaagaacuccuccaacaagcccgccgucaccaccaagucccccgccgucaagcccgccgccgcccccaagcagcccgucggcggcggccagaagcuccucacccgcaaggccgacuccuccuccuccgaggaggaguccuccuccuccgaggaggagaagaccaagaagauggucgccaccaccaagcccaaggccaccgccaaggccgcccucucccuccccgccaagcaggccccccagggcucccgcgacuccuccuccgacuccgacuccuccuccuccgaggaggaggaggagaagaccuccaaguccgccgucaagaagaagccccagaaggucgccggcggcgccgcccccuccaagcccgccuccgccaagaagggcaaggccgaguccuccaacuccuccuccuccgacgacuccuccgaggaggaggaggagaagcucaagggcaagggcuccccccgcccccaggcccccaaggccaacggcaccuccgcccucaccgcccagaacggcaaggccgccaagaacuccgaggaggaggaggaggagaagaagaaggccgccgucgucgucuccaaguccggcucccucaagaagcgcaagcagaacgaggccgccaaggaggccgagaccccccaggccaagaagaucaagcuccagacccccaacaccuuccccaagcgcaagaagggcgagaagcgcgccuccucccccuuccgccgcguccgcgaggaggagaucgaggucgacucccgcgucgccgacaacuccuucgacgccaagcgcggcgccgccggcgacuggggcgagcgcgccaaccagguccucaaguucaccaagggcaaguccuuccgccacgagaagaccaagaagaagcgcggcuccuaccgcggcggcuccaucuccguccaggucaacuccaucaaguucgacuccgaguga

SEQ ID NO: 46747 - RNA, 2583 nt, Artificial Sequence
  derived and/or modified sequence opt2 from NOM1__Homo_sapiens__NP_612409
auggccgccucccgcuccgccggcgaggccggccccggcggcucccagggccgcgucguccgcaugaagcgccgcggcggccgcggcccccgccgcggccccgccggcggcggcgagaaggcccucaagcgccucaagcucgccgucgaggaguucguccacgccaccuccgagggcgaggcccccggcggcugcgagggccgcggcgcccccgucuccuuccgccccggcggccgcaagucccgcaaggagcuccgcaaggagaagcgccaccuccgcaaggcccgccgccuccagcgcaccgccggccccgagcagggccccggccucggcggccgcuccggcgccgaggaggccuccggccaccgccaggacaccgaggagcgcgcccgccccgcccccucccgcgaccccucccccccccgcaagccccgccccucccgcgucaaggccaaggccaccgccgccaccgccaagacccgccccuccgccgccgccaccgccgccgcccgcaagcgcgcccuccucgccgccaacgaggaggaggaccgcgagauccgcaagcucgagcgcugccucggccucaacaagcgcaagaagaaggacggcuccuccuccgucccccucuccuucgcccgcgacggccucgacuacauccucggcgcccucgaguccggcaagaacuccggccucuacgacuccuccggcgaggaggaggaggacgccggccagacccuccccgaguccgaccucgaguccgacucccaggacgaguccgaggaggaggaggagggcgacgucgagaaggagaagaaggcccaggaggccgaggcccaguccgaggacgacgacgaggacaccgaggaggagcagggcgaggagaaggagaagggcgcccaggagaagcgccgcggcaagcgcguccgcuucgccgaggacgaggagaaguccgagaacuccuccgaggacggcgacaucaccgacaagucccucugcggcuccggcgagaaguacauccccccccacguccgccaggccgaggagaccgucgacuucaagaagaaggaggagcucgagcgccucaagaagcacgucaagggccuccucaaccgccucuccgagcccaacauggccuccaucuccggccagcucgaggagcucuacauggcccacucccgcaaggacaugaacgacacccucaccuccgcccucaugggcgccugcgucaccgccuccgccaugcccucccgccucaugauggagcacguccuccucgucuccauccuccaccacaccgucggcaucgaggucggcgcccacuuccucgaggccgucguccgcaaguucgacgccaucuacaaguacggcuccgagggcaaggagugcgacaaccucuucaccgucaucgcccaccucuacaacuuccacgucguccagucccuccucaucuucgacauccucaagaagcucaucggcaccuucaccgagaaggacaucgagcucauccuccucaugcucaagaacgucggcuucucccuccgcaaggacgacgcccucucccucaaggagcucaucaccgaggcccagaccaaggccuccggcgccggcuccgaguuccaggaccagacccgcauccgcuucaugcucgagaccaugcucgcccucaagaacaacgacaugcgcaagauccccggcuacgaccccgagcccgucgagaagcuccgcaagcuccagcgcgcccucguccgcaacgccggcuccggcuccgagacccagcuccgcgucuccugggacuccguccucuccgccgagcagaccggccgcugguggaucgucggcuccgccugguccggcgcccccaugaucgacaacucccaccacacccaccuccagaagcagcucgucggcaccgucuccuccaagauccucgagcucgcccgcaagcagcgcaugaacaccgacauccgccgcaacaucuucugcaccaucaugaccuccgaggacuuccucgacgccuucgagaagcuccucaagcucggccucaaggaccagcaggagcgcgagaucauccacguccucauggacugcugccuccaggagaagaccuacaaccccuucuacgccuuccucgccuccaaguucugcgaguacgagcgccgcuuccagaugaccuuccaguucuccaucugggacaaguuccgcgaccucgagaaccuccccgccaccaacuucuccaaccucguccaccucgucgcccaccuccucaagaccaagucccucucccucuccauccucaaggucgucgaguucuccgagcucgacaagccccgcguccgcuuccuccgcaagguccucuccauccuccucauggagaccgaggucgaggaccucucccucaucuucacccgcgucuccgacaaccccaagcucggcguccuccgcgagggccucaagcucuucaucucccacuuccuccucaagaacgcccaggcccaccgcuccgccgacgaggccaacguccuccgcgagaaggccgaccucgccaccaagugccuccagggcaaggccucccuccgcauguga

SEQ ID NO: 46748 - RNA, 3669 nt, Artificial Sequence
  derived and/or modified sequence opt2 from NOMO1__Homo_sapiens__NP_055102
augcucgucggccagggcgccggcccccucggccccgccgucgucaccgccgccgucguccuccuccucuccggcgucggccccgcccacggcuccgaggacaucgucgucggcugcggcggcuucgucaaguccgacgucgagaucaacuacucccucaucgagaucaagcucuacaccaagcacggcacccucaaguaccagaccgacugcgcccccaacaacggcuacuucaugaucccccucuacgacaagggcgacuucauccucaagaucgagcccccccucggcugguccuucgagcccaccaccgucgagcuccacgucgacggcgucuccgacaucugcaccaagggcggcgacaucaacuucgucuucaccggcuucuccgucaacggcaagguccucuccaagggccagccccucggccccgccggcguccaggucucccuccgcaacaccggcaccgaggccaagauccaguccaccgucacccagcccggcggcaaguucgccuucuucaagguccuccccggcgacuacgagauccucgccacccaccccaccugggcccucaaggaggccuccaccaccguccgcgucaccaacuccaacgccaacgccgccuccccccucaucgucgccggcuacaacgucuccggcuccguccgcuccgacggcgagcccaugaagggcgucaaguuccuccucuucuccucccucgucaccaaggaggacguccucggcugcaacgucucccccguccccggcuuccagccccaggacgagucccucgucuaccucugcuacaccgucucccgcgaggacggcuccuucuccuucuacucccuccccuccggcggcuacaccgucauccccuucuaccgcggcgagcgcaucaccuucgacgucgcccccucccgccucgacuucaccgucgagcacgacucccucaagaucgagcccgucuuccacgucaugggcuucuccgucaccggccgcguccucaacggccccgagggcgacggcguccccgaggccgucgucacccucaacaaccagaucaaggucaagaccaaggccgacggcuccuuccgccucgagaacaucaccaccggcaccuacaccauccacgcccagaaggagcaccucuacuucgagaccgucaccaucaagaucgcccccaacaccccccagcucgccgacaucaucgccaccggcuucuccgucugcggccagaucuccaucauccgcuuccccgacaccgucaagcagaugaacaaguacaaggucguccucuccucccaggacaaggacaagucccucgucaccgucgagaccgacgcccacggcuccuucugcuucaaggccaagcccggcaccuacaagguccaggucaugguccccgaggccgagacccgcgccggccucacccucaagccccagaccuucccccucaccgucaccaaccgccccaugauggacgucgccuucguccaguuccucgccuccgucuccggcaaggucuccugccucgacaccugcggcgaccuccucgucacccuccagucccucucccgccagggcgagaagcgcucccuccagcucuccggcaaggucaacgccaugaccuucaccuucgacaacguccuccccggcaaguacaagaucuccaucaugcacgaggacuggugcuggaagaacaagucccucgaggucgagguccucgaggacgacauguccgccgucgaguuccgccagaccggcuacaugcuccgcugcucccucucccacgccaucacccucgaguucuaccaggacggcaacggccgcgagaacgucggcaucuacaaccucuccaagggcgucaaccgcuucugccucuccaagcccggcgucuacaaggucaccccccgcuccugccaccgcuucgagcaggccuucuacaccuacgacaccuccucccccuccauccucacccucaccgccauccgccaccacguccucggcaccaucaccaccgacaagaugauggacgucaccgucaccaucaaguccuccaucgacuccgagcccgcccucguccucggcccccucaaguccguccaggagcuccgccgcgagcagcagcucgccgagaucgaggcccgccgccaggagcgcgagaagaacggcaacgaggagggcgaggagcgcaugaccaagccccccguccaggagauggucgacgagcuccagggccccuucuccuacgacuucuccuacugggcccgcuccggcgagaagaucaccgucacccccuccuccaaggagcuccucuucuacccccccuccauggaggccgucgucuccggcgaguccugccccggcaagcucaucgagauccacggcaaggccggccucuuccucgagggccagauccaccccgagcucgagggcgucgagaucgucaucuccgagaagggcgccuccuccccccucaucaccgucuucaccgacgacaagggcgccuacuccgucggcccccuccacuccgaccucgaguacaccgucaccucccagaaggagggcuacguccucaccgccgucgagggcaccaucggcgacuucaaggccuacgcccucgccggcgucuccuucgagaucaaggccgaggacgaccagccccuccccggcguccuccucucccucuccggcggccucuuccgcuccaaccuccucacccaggacaacggcauccucaccuucuccaaccucucccccggccaguacuacuucaagcccaugaugaaggaguuccgcuucgagcccuccucccagaugaucgagguccaggagggccagaaccucaagaucaccaucaccggcuaccgcaccgccuacuccugcuacggcaccgucuccucccucaacggcgagcccgagcagggcgucgccauggaggccgucggccagaacgacugcuccaucuacggcgaggacaccgucaccgacgaggagggcaaguuccgccuccgcggccuccuccccggcugcgucuaccacguccagcucaaggccgagggcaacgaccacaucgagcgcgcccucccccaccaccgcgucaucgaggucggcaacaacgacaucgacgacgucaacaucaucgucuuccgccagaucaaccaguucgaccucuccggcaacgucaucaccuccuccgaguaccuccccacccucugggucaagcucuacaaguccgagaaccucgacaaccccauccagaccgucucccucggccagucccucuucuuccacuuccccccccuccuccgcgacggcgagaacuacgucguccuccucgacuccacccucccccgcucccaguacgacuacauccucccccaggucuccuucaccgccgucggcuaccacaagcacaucacccucaucuucaaccccacccgcaagcuccccgagcaggacaucgcccagggcuccuacaucgcccucccccucacccuccucguccuccucgccggcuacaaccacgacaagcucaucccccuccuccuccagcucaccucccgccuccagggcguccgcgcccucggccaggccgccuccgacaacuccggccccgaggacgccaagcgccaggccaagaagcagaagacccgccgcaccuga

SEQ ID NO: 46749 - RNA, 1416 nt, Artificial Sequence
  derived and/or modified sequence opt2 from NONO__Homo_sapiens__NP_001138881
augcaguccaacaagaccuucaaccucgagaagcagaaccacaccccccgcaagcaccaccagcaccaccaccagcagcagcaccaccagcagcagcagcagcagcccccccccccccccauccccgccaacggccagcaggccuccucccagaacgagggccucaccaucgaccucaagaacuuccgcaagcccggcgagaagaccuucacccagcgcucccgccucuucgucggcaaccucccccccgacaucaccgaggaggagaugcgcaagcucuucgagaaguacggcaaggccggcgaggucuucauccacaaggacaagggcuucggcuucauccgccucgagacccgcacccucgccgagaucgccaaggucgagcucgacaacaugccccuccgcggcaagcagcuccgcguccgcuucgccugccacuccgccucccucaccguccgcaaccucccccaguacgucuccaacgagcuccucgaggaggccuucuccgucuucggccaggucgagcgcgccgucgucaucgucgacgaccgcggccgccccuccggcaagggcaucgucgaguucuccggcaagcccgccgcccgcaaggcccucgaccgcugcuccgagggcuccuuccuccucaccaccuucccccgccccgucaccgucgagcccauggaccagcucgacgacgaggagggccuccccgagaagcucgucaucaagaaccagcaguuccacaaggagcgcgagcagcccccccgcuucgcccagcccggcuccuucgaguacgaguacgccaugcgcuggaaggcccucaucgagauggagaagcagcagcaggaccaggucgaccgcaacaucaaggaggcccgcgagaagcucgagauggagauggaggccgcccgccacgagcaccaggucaugcucaugcgccaggaccucaugcgccgccaggaggagcuccgccgcauggaggagcuccacaaccaggagguccagaagcgcaagcagcucgagcuccgccaggaggaggagcgccgccgccgcgaggaggagaugcgccgccagcaggaggagaugaugcgccgccagcaggagggcuucaagggcaccuuccccgacgcccgcgagcaggagauccgcaugggccagauggccaugggcggcgccaugggcaucaacaaccgcggcgccaugccccccgcccccguccccgccggcacccccgccccccccggccccgccaccaugaugcccgacggcacccucggccucaccccccccaccaccgagcgcuucggccaggccgccaccauggagggcaucggcgccaucggcggcaccccccccgccuucaaccgcgccgcccccggcgccgaguucgcccccaacaagcgccgccgcuacuga

SEQ ID NO: 46750 - RNA, 195 nt, Artificial Sequence
  derived and/or modified sequence opt2 from NOP10__Homo_sapiens__NP_061118
auguuccuccaguacuaccucaacgagcagggcgaccgcgucuacacccucaagaaguucgaccccaugggccagcagaccugcuccgcccaccccgcccgcuucucccccgacgacaaguacucccgccaccgcaucaccaucaagaagcgcuucaagguccucaugacccagcagccccgccccguccucuga

SEQ ID NO: 46751 - RNA, 2421 nt, Artificial Sequence
  derived and/or modified sequence opt2 from NOP14__Homo_sapiens__NP_001278908
auggccaaggccaagaaggucggcgcccgccgcaaggccuccggcgcccccgccggcgcccgcggcggccccgccaaggccaacuccaaccccuucgaggucaaggucaaccgccagaaguuccagauccucggccgcaagacccgccacgacgucggccuccccggcgucucccgcgcccgcgcccuccgcaagcgcacccagacccuccucaaggaguacaaggagcgcgacaaguccaacgucuuccgcgacaagcgcuucggcgaguacaacuccaacaugucccccgaggagaagaugaugaagcgcuucgcccucgagcagcagcgccaccacgagaagaaguccaucuacaaccucaacgaggacgaggagcucacccacuacggccagucccucgccgacaucgagaagcacaacgacaucgucgacuccgacuccgacgccgaggaccgcggcacccucuccgccgagcucaccgccgcccacuucggcggcggcggcggccuccuccacaagaagacccagcaggagggcgaggagcgcgagaagcccaagucccgcaaggagcucaucgaggagcucaucgccaaguccaagcaggagaagcgcgagcgccaggcccagcgcgaggacgcccucgagcucaccgagaagcucgaccaggacuggaaggagauccagacccuccucucccacaagacccccaaguccgagaaccgcgacaagaaggagaagcccaagcccgacgccuacgacaugaugguccgcgagcucggcuucgagaugaaggcccagcccuccaaccgcaugaagaccgaggccgagcucgccaaggaggagcaggagcaccuccgcaagcucgaggccgagcgccuccgccgcaugcucggcaaggacgaggacgagaacgucaagaagcccaagcacauguccgccgacgaccucaacgacggcuucguccucgacaaggacgaccgccgccuccucuccuacaaggacggcaagaugaacgucgaggaggacguccaggaggagcaguccaaggaggccuccgaccccgaguccaacgaggaggagggcgacuccuccggcggcgaggacaccgaggaguccgacucccccgacucccaccucgaccucgaguccaacgucgaguccgaggaggagaacgagaagcccgccaaggagcagcgccagacccccggcaagggccucaucuccggcaaggagcgcgccggcaaggccacccgcgacgagcuccccuacaccuucgccgcccccgaguccuacgaggagcuccgcucccuccuccucggccgcuccauggaggagcagcuccucgucgucgagcgcauccagaagugcaaccaccccucccucgccgagggcaacaaggccaagcucgagaagcucuucggcuuccuccucgaguacgucggcgaccucgccaccgacgacccccccgaccucaccgucaucgacaagcucgucguccaccucuaccaccucugccagauguuccccgaguccgccuccgacgccaucaaguucguccuccgcgacgccaugcacgagauggaggagaugaucgagaccaagggccgcgccgcccuccccggccucgacguccucaucuaccucaagaucaccggccuccucuuccccaccuccgacuucuggcaccccgucgucacccccgcccucgucugccucucccagcuccucaccaagugccccauccucucccuccaggacgucgucaagggccucuucgucugcugccucuuccucgaguacgucgcccucucccagcgcuucauccccgagcucaucaacuuccuccucggcauccucuacaucgccacccccaacaaggccucccagggcuccacccucguccaccccuuccgcgcccucggcaagaacuccgagcuccucgucgucuccgcccgcgaggacgucgccaccuggcagcaguccucccucucccuccgcugggccucccgccuccgcgcccccaccuccaccgaggccaaccacauccgccucuccugccucgccgucggccucgcccuccucaagcgcugcguccucauguacggcucccuccccuccuuccacgccaucaugggcccccuccaggcccuccucaccgaccaccucgccgacugcucccacccccaggagcuccaggagcucugccaguccacccucaccgagauggagucccagaagcagcucugccgcccccucaccugcgagaaguccaagcccgucccccucaagcucuucaccccccgccucgucuccaacucccgcccccaggucauccaccuccccuggccccccaacuaccgcugcgagccccagcaccccgccaagaaggucaucuucuuccgcgucaucaugcucuga

SEQ ID NO: 46752 - RNA, 699 nt, Artificial Sequence
  derived and/or modified sequence opt2 from NOP16__Homo_sapiens__NP_001243468
augcccaaggccaagggcaagacccgccgccagaaguucggcuacuccgucaaccgcaagcgccucaaccgcaacgcccgccgcaaggccgccccccgcaucgagugcucccacauccgccacgccugggaccacgccaaguccguccgccagaaccucgccgagaugggccucgccgucgaccccaaccgcgccgucccccuccgcaagcgcaaggucaaggccauggaggucgacaucgaggagcgccccaaggagcucguccgcaagcccuacguccucaacgaccucgaggccgaggccucccuccccgagaagaagggcaacacccucucccgcgaccucaucgacuacguccgcuacauggucgagaaccacggcgaggacuacaagcaguccggcaagaccuccuccauccucugccgccgcggccgcuggcgcugguccgacugguucaccucccagcucccccaggccgaggccucccccggccccgucaagcucgagcccggcugcaaggcccgccgcugcugcgucgcccccgaggagcucgcccgcucccacggcauccgccgccuccacacccacguccacaccccccgcuccggcgagggcaccguccuccgcggcuccaaccucuacuccuccggcggcucccgcaagucccagaaccuccucuucuccggcugggucauguga

SEQ ID NO: 46753 - RNA, 2427 nt, Artificial Sequence
  derived and/or modified sequence opt2 from NOP2__Homo_sapiens__NP_001028886
augggccgcaagcucgaccccaccaaggagaagcgcggccccggccgcaaggcccgcaagcagaagggcgccgagaccgagcucguccgcuuccuccccgccgucuccgacgagaacuccaagcgccucuccucccgcgcccgcaagcgcgccgccaagcgccgccucggcuccgucgaggcccccaagaccaacaagucccccgaggccaagccccuccccggcaagcuccccaagggcgccguccagaccgccggcaagaagggcccccagucccucuucaacgccccccgcggcaagaagcgccccgcccccggcuccgacgaggaggaggaggaggaggacuccgaggaggacggcauggucaaccacggcgaccucuggggcuccgaggacgacgccgacaccgucgacgacuacggcgccgacuccaacuccgaggacgaggaggagggcgaggcccuccuccccaucgagcgcgccgcccgcaagcagaaggcccgcgaggccgccgccggcauccagugguccgaggaggagaccgaggacgaggaggaggagaaggaggucacccccgaguccggcccccccaaggucgaggaggccgacggcggccuccagaucaacgucgacgaggagcccuucguccucccccccgccggcgagauggagcaggacgcccaggcccccgaccuccagcgcguccacaagcgcauccaggacaucgucggcauccuccgcgacuucggcgcccagcgcgaggagggccgcucccgcuccgaguaccucaaccgccucaagaaggaccucgccaucuacuacuccuacggcgacuuccuccucggcaagcucauggaccucuucccccucuccgagcucgucgaguuccucgaggccaacgaggucccccgccccgucacccuccgcaccaacacccucaagacccgccgccgcgaccucgcccaggcccucaucaaccgcggcgucaaccucgacccccucggcaagugguccaagaccggccucgucgucuacgacuccuccguccccaucggcgccacccccgaguaccucgccggccacuacaugcuccagggcgccuccuccaugcuccccgucauggcccucgccccccaggagcacgagcgcauccucgacaugugcugcgcccccggcggcaagaccuccuacauggcccagcucaugaagaacaccggcgucauccucgccaacgacgccaacgccgagcgccucaaguccgucgucggcaaccuccaccgccucggcgucaccaacaccaucaucucccacuacgacggccgccaguuccccaaggucgucggcggcuucgaccgcguccuccucgacgcccccugcuccggcaccggcgucaucuccaaggaccccgccgucaagaccaacaaggacgagaaggacauccuccgcugcgcccaccuccagaaggagcuccuccucuccgccaucgacuccgucaacgccaccuccaagaccggcggcuaccucgucuacugcaccugcuccaucaccgucgaggagaacgagugggucgucgacuacgcccucaagaagcgcaacguccgccucguccccaccggccucgacuucggccaggagggcuucacccgcuuccgcgagcgccgcuuccaccccucccuccgcuccacccgccgcuucuacccccacacccacaacauggacggcuucuucaucgccaaguucaagaaguucuccaacuccaucccccagucccagaccggcaacuccgagaccgccacccccaccaacgucgaccucccccaggucauccccaaguccgagaacuccucccagcccgccaagaaggccaagggcgccgccaagaccaagcagcagcuccagaagcagcagcaccccaagaaggccuccuuccagaagcucaacggcaucuccaagggcgccgacuccgagcucuccaccguccccuccgucaccaagacccaggccuccuccuccuuccaggacuccucccagcccgccggcaaggccgagggcauccgcgagcccaaggucaccggcaagcucaagcagcgcucccccaagcuccaguccuccaagaaggucgccuuccuccgccagaacgccccccccaagggcaccgacacccagacccccgccguccucucccccuccaagacccaggccacccucaagcccaaggaccaccaccagccccucggccgcgccaagggcgucgagaagcagcagcuccccgagcagcccuucgagaaggccgccuuccagaagcagaacgacacccccaagggcccccagccccccaccgucucccccauccgcuccucccgccccccccccgccaagcgcaagaagucccagucccgcggcaacucccagcuccuccucuccuga

SEQ ID NO: 46754 - RNA, 1785 nt, Artificial Sequence
  derived and/or modified sequence opt2 from NOP56__Homo_sapiens__NP_006383
augguccuccuccacguccucuucgagcacgccgucggcuacgcccuccucgcccucaaggaggucgaggagaucucccuccuccagccccaggucgaggaguccguccucaaccucggcaaguuccacuccaucguccgccucgucgccuucugccccuucgccuccucccaggucgcccucgagaacgccaacgccgucuccgagggcgucguccacgaggaccuccgccuccuccucgagacccaccuccccuccaagaagaagaagguccuccucggcgucggcgaccccaagaucggcgccgccauccaggaggagcucggcuacaacugccagaccggcggcgucaucgccgagauccuccgcggcguccgccuccacuuccacaaccucgucaagggccucaccgaccucuccgccugcaaggcccagcucggccucggccacuccuacucccgcgccaaggucaaguucaacgucaaccgcgucgacaacaugaucauccaguccaucucccuccucgaccagcucgacaaggacaucaacaccuucuccaugcgcguccgcgagugguacggcuaccacuuccccgagcucgucaagaucaucaacgacaacgccaccuacugccgccucgcccaguucaucggcaaccgccgcgagcucaacgaggacaagcucgagaagcucgaggagcucaccauggacggcgccaaggccaaggccauccucgacgccucccgcuccuccaugggcauggacaucuccgccaucgaccucaucaacaucgaguccuucuccucccgcgucgucucccucuccgaguaccgccagucccuccacaccuaccuccgcuccaagaugucccaggucgcccccucccucuccgcccucaucggcgaggccgucggcgcccgccucaucgcccacgccggcucccucaccaaccucgccaaguaccccgccuccaccguccagauccucggcgccgagaaggcccucuuccgcgcccucaagacccgcggcaacacccccaaguacggccucaucuuccacuccaccuucaucggccgcgccgccgccaagaacaagggccgcaucucccgcuaccucgccaacaagugcuccaucgccucccgcaucgacugcuucuccgagguccccaccuccgucuucggcgagaagcuccgcgagcaggucgaggagcgccucuccuucuacgagaccggcgagaucccccgcaagaaccucgacgucaugaaggaggccaugguccaggccgaggaggccgccgccgagaucacccgcaagcucgagaagcaggagaagaagcgccucaagaaggagaagaagcgccucgccgcccucgcccucgccuccuccgagaacuccuccuccacccccgaggagugcgaggagauguccgagaagcccaagaagaagaagaagcagaagccccaggaggucccccaggagaacggcauggaggaccccuccaucuccuucuccaagcccaagaagaagaaguccuucuccaaggaggagcucauguccuccgaccucgaggagaccgccggcuccaccuccauccccaagcgcaagaaguccacccccaaggaggagaccgucaacgaccccgaggaggccggccaccgcuccggcuccaagaagaagcgcaaguucuccaaggaggagcccgucuccuccggccccgaggaggccgucggcaaguccuccuccaagaagaagaagaaguuccacaaggccucccaggaggacuga

SEQ ID NO: 46755 - RNA, 1911 nt, Artificial Sequence
  derived and/or modified sequence opt2 from NOP9__Homo_sapiens__NP_777573
augggccagggcccccgcuccccccacaaggucggccgccgcuuccccgccggcggcaagcgcggccgcggcgccaagggcuccggccgcccccuccccggccgcaagcgccagcccuggcccccccccgacggccgcuccgagcccgcccccgacucccacccccaccucucccccgaggcccucggcuacuuccgccgcgcccucuccgcccucaaggaggcccccgagaccggcgaggagcgcgaccucaugguccacaacaucaugaaggaggucgagacccaggcccucgcccucuccaccaaccgcaccggcuccgagaugcuccaggagcuccucggcuucuccccccucaagccccucugccgcgucugggccgcccuccgcuccaaccuccgcaccgucgccugccaccgcugcggcguccacguccuccaguccgcccuccuccagcucccccgccuccucggcuccgccgccgaggaggaggaggaggaggaggaggacggcaaggacggccccaccgagacccucgaggagcucguccucggccucgccgccgaggucugcgacgacuuccucgucuacugcggcgacacccacggcuccuucgucguccgcacccuccuccagguccucggcggcaccauccucgaguccgagcgcgcccgcccccgcggcucccaguccuccgaggcccagaagacccccgcccaggagugcaagcccgccgacuucgagguccccgagaccuuccucaaccgccuccaggaccucuccuccuccuuccucaaggacaucgccgucuucaucaccgacaagaucuccuccuucugccuccaggucgcccuccagguccuccaccgcaagcucccccaguucugcgcccaccucugcaacgccgucaucggcuaccucuccacccgcggcuccuccgucgacggcuccccccuccuccucuuccuccgcgaccagaccuccucccgccuccucgagcagguccuccucguccucgagcccccccgccuccagucccucuucgaggagcaccuccagggccagcuccagacccucgccgcccaccccaucgccaacuucccccuccagcgccuccucgacgccgucaccacccccgagcuccucucccccgucuucgaggagcucucccccguccucgaggccguccucgcccagggccaccccggcgucgucaucgcccucgucggcgccugccgccgcgucggcgccuaccaggccaagguccuccagcuccuccucgaggccuuccacugcgccgagcccuccucccgccaggucgccugcgucccccucuucgccacccucauggccuacgaggucuacuacggccucaccgaggaggagggcgccguccccgccgagcaccaggucgccauggccgccgcccgcgcccucggcgacgucaccguccucggcucccuccuccuccagcaccuccuccacuucuccacccccggccucguccuccgcucccucggcgcccucaccggcccccagcuccucucccucgcccagucccccgccggcucccacguccucgacgccauccucaccucccccuccgucacccgcaagcuccgccgccgcguccuccagaaccucaagggccaguacgucgcccucgccugcucccgccacggcucccgcguccucgacgccaucugguccggcgccgcccuccgcgcccgcaaggagaucgccgccgagcucggcgagcagaaccaggagcucauccgcgaccccuucggccaccacgucgcccgcaacgucgcccucaccaccuuccucaagcgccgcgaggccugggagcagcagcagggcgccgucgccaagcgccgccgcgcccucaacuccauccucgaggacuga

SEQ ID NO: 46756 - RNA, 636 nt, Artificial Sequence
  derived and/or modified sequence opt2 from NOS1AP__Homo_sapiens__NP_001119532
augucccucuccucccucugccccgucuucuccgccgccgccuccucccuccagguccaccuccucaaggaccagcucgccgccgaggccgccgcccgccucgaggcccaggcccgcguccaccagcuccuccuccagaacaaggacaugcuccagcacaucucccuccucgucaagcagguccaggagcucgagcucaagcucuccggccagaacgccaugggcucccaggacucccuccucgagaucaccuuccgcuccggcgcccuccccguccucugcgaccccaccacccccaagcccgaggaccuccacucccccccccucggcgccggccucgccgacuucgcccaccccgccggcuccccccucggccgccgcgacugccucgucaagcucgagugcuuccgcuuccucccccccgaggacacccccccccccgcccagggcgaggcccuccucggcggccucgagcucaucaaguuccgcgaguccggcaucgccuccgaguacgaguccaacaccgacgaguccgaggagcgcgacuccuggucccaggaggagcucccccgccuccucaacguccuccagcgccaggagcucggcgacggccucgacgacgagaucgccgucuga

SEQ ID NO: 46757 - RNA, 4305 nt, Artificial Sequence
  derived and/or modified sequence opt2 from NOS1__Homo_sapiens__NP_000611
auggaggaccacauguucggcguccagcagauccagcccaacgucaucuccguccgccucuucaagcgcaaggucggcggccucggcuuccucgucaaggagcgcgucuccaagccccccgucaucaucuccgaccucauccgcggcggcgccgccgagcaguccggccucauccaggccggcgacaucauccucgccgucaacggccgcccccucgucgaccucuccuacgacuccgcccucgagguccuccgcggcaucgccuccgagacccacgucguccucauccuccgcggccccgagggcuucaccacccaccucgagaccaccuucaccggcgacggcacccccaagaccauccgcgucacccagccccucggcccccccaccaaggccgucgaccucucccaccagccccccgccggcaaggagcagccccucgccgucgacggcgccuccggccccggcaacggcccccagcacgccuacgacgacggccaggaggccggcucccucccccacgccaacggccucgccccccgcccccccggccaggaccccgccaagaaggccacccgcgucucccuccagggccgcggcgagaacaacgagcuccucaaggagaucgagcccguccucucccuccucaccuccggcucccgcggcgucaagggcggcgcccccgccaaggccgagaugaaggacaugggcauccaggucgaccgcgaccucgacggcaagucccacaagccccucccccucggcgucgagaacgaccgcgucuucaacgaccucuggggcaagggcaacguccccgucguccucaacaaccccuacuccgagaaggagcagccccccaccuccggcaagcagucccccaccaagaacggcucccccuccaagugcccccgcuuccucaaggucaagaacugggagaccgaggucguccucaccgacacccuccaccucaaguccacccucgagaccggcugcaccgaguacaucugcaugggcuccaucaugcaccccucccagcacgcccgccgccccgaggacguccgcaccaagggccagcucuucccccucgccaaggaguucaucgaccaguacuacuccuccaucaagcgcuucggcuccaaggcccacauggagcgccucgaggaggucaacaaggagaucgacaccaccuccaccuaccagcucaaggacaccgagcucaucuacggcgccaagcacgccuggcgcaacgccucccgcugcgucggccgcauccagugguccaagcuccaggucuucgacgcccgcgacugcaccaccgcccacggcauguucaacuacaucugcaaccacgucaaguacgccaccaacaagggcaaccuccgcuccgccaucaccaucuucccccagcgcaccgacggcaagcacgacuuccgcgucuggaacucccagcucauccgcuacgccggcuacaagcagcccgacggcuccacccucggcgaccccgccaacguccaguucaccgagaucugcauccagcagggcuggaagcccccccgcggccgcuucgacguccucccccuccuccuccaggccaacggcaacgaccccgagcucuuccagaucccccccgagcucguccucgagguccccauccgccaccccaaguucgagugguucaaggaccucggccucaagugguacggccuccccgccgucuccaacaugcuccucgagaucggcggccucgaguucuccgccugccccuucuccggcugguacaugggcaccgagaucggcguccgcgacuacugcgacaacucccgcuacaacauccucgaggaggucgccaagaagaugaaccucgacaugcgcaagaccuccucccucuggaaggaccaggcccucgucgagaucaacaucgccguccucuacuccuuccaguccgacaaggucaccaucgucgaccaccacuccgccaccgaguccuucaucaagcacauggagaacgaguaccgcugccgcggcggcugccccgccgacugggucuggaucgucccccccauguccggcuccaucacccccgucuuccaccaggagaugcucaacuaccgccucacccccuccuucgaguaccagcccgaccccuggaacacccacgucuggaagggcaccaacggcacccccaccaagcgccgcgccaucggcuucaagaagcucgccgaggccgucaaguucuccgccaagcucaugggccaggccauggccaagcgcgucaaggccaccauccucuacgccaccgagaccggcaagucccaggccuacgccaagacccucugcgagaucuucaagcacgccuucgacgccaaggucauguccauggaggaguacgacaucguccaccucgagcacgagacccucguccucgucgucaccuccaccuucggcaacggcgacccccccgagaacggcgagaaguucggcugcgcccucauggagaugcgccaccccaacuccguccaggaggagcgcaaguccuacaagguccgcuucaacuccgucuccuccuacuccgacucccagaaguccuccggcgacggccccgaccuccgcgacaacuucgaguccgccggcccccucgccaacguccgcuucuccgucuucggccucggcucccgcgccuacccccacuucugcgccuucggccacgccgucgacacccuccucgaggagcucggcggcgagcgcauccucaagaugcgcgagggcgacgagcucugcggccaggaggaggccuuccgcaccugggccaagaaggucuucaaggccgccugcgacgucuucugcgucggcgacgacgucaacaucgagaaggccaacaacucccucaucuccaacgaccgcuccuggaagcgcaacaaguuccgccucaccuucgucgccgaggcccccgagcucacccagggccucuccaacguccacaagaagcgcgucuccgccgcccgccuccucucccgccagaaccuccagucccccaaguccucccgcuccaccaucuucguccgccuccacaccaacggcucccaggagcuccaguaccagcccggcgaccaccucggcgucuuccccggcaaccacgaggaccucgucaacgcccucaucgagcgccucgaggacgccccccccgucaaccagauggucaaggucgagcuccucgaggagcgcaacaccgcccucggcgucaucuccaacuggaccgacgagcuccgccucccccccugcaccaucuuccaggccuucaaguacuaccucgacaucaccaccccccccaccccccuccagcuccagcaguucgccucccucgccaccuccgagaaggagaagcagcgccuccucguccucuccaagggccuccaggaguacgaggaguggaaguggggcaagaaccccaccaucgucgagguccucgaggaguuccccuccauccagaugcccgccacccuccuccucacccagcucucccuccuccagccccgcuacuacuccaucuccuccucccccgacauguaccccgacgagguccaccucaccgucgccaucgucuccuaccgcacccgcgacggcgagggccccauccaccacggcgucugcuccuccuggcucaaccgcauccaggccgacgagcucguccccugcuucguccgcggcgcccccuccuuccaccucccccgcaacccccagguccccugcauccucgucggccccggcaccggcaucgcccccuuccgcuccuucuggcagcagcgccaguucgacauccagcacaagggcaugaaccccugccccaugguccucgucuucggcugccgccaguccaagaucgaccacaucuaccgcgaggagacccuccaggccaagaacaagggcgucuuccgcgagcucuacaccgccuacucccgcgagcccgacaagcccaagaaguacguccaggacauccuccaggagcagcucgccgaguccgucuaccgcgcccucaaggagcagggcggccacaucuacgucugcggcgacgucaccauggccgccgacguccucaaggccauccagcgcaucaugacccagcagggcaagcucuccgccgaggacgccggcgucuucaucucccgcaugcgcgacgacaaccgcuaccacgaggacaucuucggcgucacccuccgcaccuacgaggucaccaaccgccuccgcuccgaguccaucgccuucaucgaggaguccaagaaggacaccgacgaggucuucuccuccuga

SEQ ID NO: 46758 - RNA, 3462 nt, Artificial Sequence
  derived and/or modified sequence opt2 from NOS2__Homo_sapiens__NP_000616
auggccugccccuggaaguuccucuucaagaccaaguuccaccaguacgccaugaacggcgagaaggacaucaacaacaacgucgagaaggcccccugcgccaccuccucccccgucacccaggacgaccuccaguaccacaaccucuccaagcagcagaacgaguccccccagccccucgucgagaccggcaagaagucccccgagucccucgucaagcucgacgccaccccccucuccuccccccgccacguccgcaucaagaacuggggcuccggcaugaccuuccaggacacccuccaccacaaggccaagggcauccucaccugccgcuccaaguccugccucggcuccaucaugacccccaagucccucacccgcggcccccgcgacaagcccaccccccccgacgagcuccucccccaggccaucgaguucgucaaccaguacuacggcuccuucaaggaggccaagaucgaggagcaccucgcccgcgucgaggccgucaccaaggagaucgagaccaccggcaccuaccagcucaccggcgacgagcucaucuucgccaccaagcaggccuggcgcaacgccccccgcugcaucggccgcauccagugguccaaccuccaggucuucgacgcccgcuccugcuccaccgcccgcgagauguucgagcacaucugccgccacguccgcuacuccaccaacaacggcaacauccgcuccgccaucaccgucuucccccagcgcuccgacggcaagcacgacuuccgcgucuggaacgcccagcucauccgcuacgccggcuaccagaugcccgacggcuccauccgcggcgaccccgccaacgucgaguucacccagcucugcaucgaccucggcuggaagcccaaguacggccgcuucgacgucgucccccucguccuccaggccaacggccgcgaccccgagcucuucgagaucccccccgaccucguccucgaggucgccauggagcaccccaaguacgagugguuccgcgagcucgagcucaagugguacgcccuccccgccgucgccaacaugcuccucgaggucggcggccucgaguuccccggcugccccuucaacggcugguacaugggcaccgagaucggcguccgcgacuucugcgacguccagcgcuacaacauccucgaggaggucggccgccgcaugggccucgagacccacaagcucgccucccucuggaaggaccaggccgucgucgagaucaacaucgccguccuccacuccuuccagaagcagaacgucaccaucauggaccaccacuccgccgccgaguccuucaugaaguacaugcagaacgaguaccgcucccgcggcggcugccccgccgacuggaucuggcucgucccccccauguccggcuccaucacccccgucuuccaccaggagaugcucaacuacguccucucccccuucuacuacuaccaggucgaggccuggaagacccacgucuggcaggacgagaagcgccgccccaagcgccgcgagaucccccucaagguccucgucaaggccguccucuucgccugcaugcucaugcgcaagaccauggccucccgcguccgcgucaccauccucuucgccaccgagaccggcaaguccgaggcccucgccugggaccucggcgcccucuucuccugcgccuucaaccccaaggucgucugcauggacaaguaccgccucuccugccucgaggaggagcgccuccuccucgucgucaccuccaccuucggcaacggcgacugccccggcaacggcgagaagcucaagaagucccucuucaugcucaaggagcucaacaacaaguuccgcuacgccgucuucggccucggcuccuccauguacccccgcuucugcgccuucgcccacgacaucgaccagaagcucucccaccucggcgccucccagcucacccccaugggcgagggcgacgagcucuccggccaggaggacgccuuccgcuccugggccguccagaccuucaaggccgccugcgagaccuucgacguccgcggcaagcagcacauccagauccccaagcucuacaccuccaacgucaccugggacccccaccacuaccgccucguccaggacucccagccccucgaccucuccaaggcccucuccuccaugcacgccaagaacgucuucaccaugcgccucaagucccgccagaaccuccagucccccaccuccucccgcgccaccauccucgucgagcucuccugcgaggacggccagggccucaacuaccuccccggcgagcaccucggcgucugccccggcaaccagcccgcccucguccagggcauccucgagcgcgucgucgacggccccaccccccaccagaccguccgccucgaggcccucgacgaguccggcuccuacugggucuccgacaagcgccucccccccugcucccucucccaggcccucaccuacuuccucgacaucaccaccccccccacccagcuccuccuccagaagcucgcccaggucgccaccgaggagcccgagcgccagcgccucgaggcccucugccagcccuccgaguacuccaaguggaaguucaccaacucccccaccuuccucgagguccucgaggaguuccccucccuccgcgucuccgccggcuuccuccucucccagcuccccauccucaagccccgcuucuacuccaucuccuccucccgcgaccacacccccaccgagauccaccucaccgucgccgucgucaccuaccacacccgcgacggccagggcccccuccaccacggcgucugcuccaccuggcucaacucccucaagccccaggaccccguccccugcuucguccgcaacgccuccggcuuccaccuccccgaggaccccucccaccccugcauccucaucggccccggcaccggcaucgcccccuuccgcuccuucuggcagcagcgccuccacgacucccagcacaagggcguccgcggcggccgcaugacccucgucuucggcugccgccgccccgacgaggaccacaucuaccaggaggagaugcucgagauggcccagaagggcguccuccacgccguccacaccgccuacucccgccuccccggcaagcccaaggucuacguccaggacauccuccgccagcagcucgccuccgagguccuccgcguccuccacaaggagcccggccaccucuacgucugcggcgacguccgcauggcccgcgacgucgcccacacccucaagcagcucgucgccgccaagcucaagcucaacgaggagcaggucgaggacuacuucuuccagcucaagucccagaagcgcuaccacgaggacaucuucggcgccgucuuccccuacgaggccaagaaggaccgcgucgccguccagcccuccucccucgagauguccgcccucuga

SEQ ID NO: 46759 - RNA, 3612 nt, Artificial Sequence
  derived and/or modified sequence opt2 from NOS3__Homo_sapiens__NP_000594
augggcaaccucaaguccgucgcccaggagcccggcccccccugcggccucggccucggccucggccucggccucugcggcaagcagggccccgccacccccgcccccgagcccucccgcgcccccgccucccuccucccccccgcccccgagcacuccccccccuccuccccccucacccagccccccgagggccccaaguucccccgcgucaagaacugggaggucggcuccaucaccuacgacacccucuccgcccaggcccagcaggacggccccugcaccccccgccgcugccucggcucccucgucuucccccgcaagcuccagggccgccccucccccggcccccccgcccccgagcagcuccucucccaggcccgcgacuucaucaaccaguacuacuccuccaucaagcgcuccggcucccaggcccacgagcagcgccuccaggaggucgaggccgaggucgccgccaccggcaccuaccagcuccgcgaguccgagcucgucuucggcgccaagcaggccuggcgcaacgccccccgcugcgucggccgcauccaguggggcaagcuccaggucuucgacgcccgcgacugccgcuccgcccaggagauguucaccuacaucugcaaccacaucaaguacgccaccaaccgcggcaaccuccgcuccgccaucaccgucuucccccagcgcugccccggccgcggcgacuuccgcaucuggaacucccagcucguccgcuacgccggcuaccgccagcaggacggcuccguccgcggcgaccccgccaacgucgagaucaccgagcucugcauccagcacggcuggacccccggcaacggccgcuucgacguccucccccuccuccuccaggcccccgacgacccccccgagcucuuccuccucccccccgagcucguccucgaggucccccucgagcaccccacccucgagugguucgccgcccucggccuccgcugguacgcccuccccgccgucuccaacaugcuccucgagaucggcggccucgaguuccccgccgcccccuucuccggcugguacauguccaccgagaucggcacccgcaaccucugcgacccccaccgcuacaacauccucgaggacgucgccgucugcauggaccucgacacccgcaccaccuccucccucuggaaggacaaggccgccgucgagaucaacgucgccguccuccacuccuaccagcucgccaaggucaccaucgucgaccaccacgccgccaccgccuccuucaugaagcaccucgagaacgagcagaaggcccgcggcggcugccccgccgacugggccuggaucgucccccccaucuccggcucccucacccccgucuuccaccaggagauggucaacuacuuccucucccccgccuuccgcuaccagcccgaccccuggaagggcuccgccgccaagggcaccggcaucacccgcaagaagaccuucaaggaggucgccaacgccgucaagaucuccgccucccucaugggcaccgucauggccaagcgcgucaaggccaccauccucuacggcuccgagaccggccgcgcccaguccuacgcccagcagcucggccgccucuuccgcaaggccuucgacccccgcguccucugcauggacgaguacgacgucgucucccucgagcacgagacccucguccucgucgucaccuccaccuucggcaacggcgacccccccgagaacggcgaguccuucgccgccgcccucauggagauguccggccccuacaacuccuccccccgccccgagcagcacaaguccuacaagauccgcuucaacuccaucuccugcuccgacccccucgucuccuccuggcgccgcaagcgcaaggaguccuccaacaccgacuccgccggcgcccucggcacccuccgcuucugcgucuucggccucggcucccgcgccuacccccacuucugcgccuucgcccgcgccgucgacacccgccucgaggagcucggcggcgagcgccuccuccagcucggccagggcgacgagcucugcggccaggaggaggccuuccgcggcugggcccaggccgccuuccaggccgccugcgagaccuucugcgucggcgaggacgccaaggccgccgcccgcgacaucuucucccccaagcgcuccuggaagcgccagcgcuaccgccucuccgcccaggccgagggccuccagcuccuccccggccucauccacguccaccgccgcaagauguuccaggccaccauccgcuccgucgagaaccuccaguccuccaaguccacccgcgccaccauccucguccgccucgacaccggcggccaggagggccuccaguaccagcccggcgaccacaucggcgucugcccccccaaccgccccggccucgucgaggcccuccucucccgcgucgaggacccccccgcccccaccgagcccgucgccgucgagcagcucgagaagggcucccccggcggccccccccccggcuggguccgcgacccccgccucccccccugcacccuccgccaggcccucaccuucuuccucgacaucaccuccccccccuccccccagcuccuccgccuccucuccacccucgccgaggagccccgcgagcagcaggagcucgaggcccucucccaggacccccgccgcuacgaggaguggaagugguuccgcugccccacccuccucgagguccucgagcaguuccccuccgucgcccuccccgccccccuccuccucacccagcucccccuccuccagccccgcuacuacuccgucuccuccgcccccuccacccaccccggcgagauccaccucaccgucgccguccucgccuaccgcacccaggacggccucggcccccuccacuacggcgucugcuccaccuggcucucccagcucaagcccggcgaccccguccccugcuucauccgcggcgcccccuccuuccgccucccccccgaccccucccuccccugcauccucgucggccccggcaccggcaucgcccccuuccgcggcuucuggcaggagcgccuccacgacaucgaguccaagggccuccagcccacccccaugacccucgucuucggcugccgcugcucccagcucgaccaccucuaccgcgacgagguccagaacgcccagcagcgcggcgucuucggccgcguccucaccgccuucucccgcgagcccgacaaccccaagaccuacguccaggacauccuccgcaccgagcucgccgccgagguccaccgcguccucugccucgagcgcggccacauguucgucugcggcgacgucaccauggccaccaacguccuccagaccguccagcgcauccucgccaccgagggcgacauggagcucgacgaggccggcgacgucaucggcguccuccgcgaccagcagcgcuaccacgaggacaucuucggccucacccuccgcacccaggaggucaccucccgcauccgcacccaguccuucucccuccaggagcgccagcuccgcggcgccguccccugggccuucgacccccccggcuccgacaccaacucccccuga

SEQ ID NO: 46760 - RNA, 906 nt, Artificial Sequence
  derived and/or modified sequence opt2 from NOSIP__Homo_sapiens__NP_057037
augacccgccacggcaagaacugcaccgccggcgccgucuacaccuaccacgagaagaagaaggacaccgccgccuccggcuacggcacccagaacauccgccucucccgcgacgccgucaaggacuucgacugcugcugccucucccuccagcccugccacgaccccgucgucacccccgacggcuaccucuacgagcgcgaggccauccucgaguacauccuccaccagaagaaggagaucgcccgccagaugaaggccuacgagaagcagcgcggcacccgccgcgaggagcagaaggagcuccagcgcgccgccucccaggaccacguccgcggcuuccucgagaaggaguccgccaucgucucccgcccccucaaccccuucaccgccaaggcccucuccggcaccucccccgacgacguccagcccggccccuccgucggcccccccuccaaggacaaggacaagguccuccccuccuucuggauccccucccucacccccgaggccaaggccaccaagcucgagaagcccucccgcaccgucaccugccccauguccggcaagccccuccgcauguccgaccucacccccguccacuucaccccccucgacuccuccgucgaccgcgucggccucaucacccgcuccgagcgcuacgucugcgccgucacccgcgacucccucuccaacgccacccccugcgccguccuccgccccuccggcgccgucgucacccucgagugcgucgagaagcucauccgcaaggacauggucgaccccgucaccggcgacaagcucaccgaccgcgacaucaucguccuccagcgcggcggcaccggcuucgccggcuccggcgucaagcuccaggccgagaagucccgccccgucaugcaggccuga

SEQ ID NO: 46761 - RNA, 1521 nt, Artificial Sequence
  derived and/or modified sequence opt2 from NOSTRIN__Homo_sapiens__NP_001034813
augcgcgacccccucaccgacugccccuacaacaaggucuacaagaaccucaaggaguucucccagaacggcgagaacuucugcaagcaggucaccuccguccuccagcagcgcgccaaccucgagaucuccuacgccaagggccuccagaagcucgccuccaagcucuccaaggcccuccagaacacccgcaaguccugcgucuccuccgccugggccugggccuccgagggcaugaaguccaccgccgaccuccaccagaagcucggcaaggccaucgagcucgaggccaucaagcccaccuaccagguccucaacguccaggagaagaagcgcaagucccucgacaacgaggucgagaagaccgccaaccucgucaucuccaacuggaaccagcagaucaaggccaagaagaagcucauggucuccaccaagaagcacgaggcccucuuccagcucgucgaguccuccaagcaguccaugaccgagaaggagaagcgcaagcuccucaacaagcucaccaaguccaccgagaagcucgagaaggaggacgagaacuacuaccagaagaacauggccggcuacuccacccgccucaagugggagaacacccucgagaacugcuaccaguccauccucgagcucgagaaggagcgcauccagcuccucugcaacaaccucaaccaguacucccagcacaucucccucuucggccagacccucaccaccugccacacccagauccacugcgccaucuccaagaucgacaucgagaaggacauccaggccgucauggaggagaccgccauccucuccaccgagaacaaguccgaguuccuccucaccgacuacuucgaggaggaccccaacuccgccauggacaaggagcgccgcaagucccuccucaagcccaagcuccuccgccuccagcgcgacaucgagaaggccuccaaggacaaggagggccucgagcgcaugcucaagaccuacuccuccaccuccuccuucuccgacgccaagucccagaaggacaccgccgcccucauggacgagaacaaccucaagcucgaccuccucgaggccaacuccuacaagcucuccuccaugcucgccgagcucgagcagcgcccccagcccucccaccccugcuccaacuccaucuuccgcuggcgcgagaaggagcacacccacuccuacgucaagaucucccgccccuuccucaugaagcgccucgagaacaucgucuccaaggccuccuccggcggccaguccaaccccggcuccuccacccccgcccccggcgccgcccagcucuccucccgccucugcaaggcccucuacuccuuccaggcccgccaggacgacgagcucaaccucgagaagggcgacaucgucaucauccacgagaagaaggagggcggcuggugguucggcucccucaacggcaagaagggccacuuccccgccgccuacgucgaggagcuccccuccaacgccggcaacaccgccaccaaggccuga

SEQ ID NO: 46762 - RNA, 7668 nt, Artificial Sequence
  derived and/or modified sequence opt2 from NOTCH1__Homo_sapiens__NP_060087
augcccccccuccucgccccccuccucugccucgcccuccuccccgcccucgccgcccgcggcccccgcugcucccagcccggcgagaccugccucaacggcggcaagugcgaggccgccaacggcaccgaggccugcgucugcggcggcgccuucgucggcccccgcugccaggaccccaaccccugccucuccacccccugcaagaacgccggcaccugccacgucgucgaccgccgcggcgucgccgacuacgccugcuccugcgcccucggcuucuccggcccccucugccucaccccccucgacaacgccugccucaccaaccccugccgcaacggcggcaccugcgaccuccucacccucaccgaguacaagugccgcugcccccccggcugguccggcaaguccugccagcaggccgaccccugcgccuccaaccccugcgccaacggcggccagugccuccccuucgaggccuccuacaucugccacugcccccccuccuuccacggccccaccugccgccaggacgucaacgagugcggccagaagcccggccucugccgccacggcggcaccugccacaacgaggucggcuccuaccgcugcgucugccgcgccacccacaccggccccaacugcgagcgccccuacguccccugcucccccucccccugccagaacggcggcaccugccgccccaccggcgacgucacccacgagugcgccugccuccccggcuucaccggccagaacugcgaggagaacaucgacgacugccccggcaacaacugcaagaacggcggcgccugcgucgacggcgucaacaccuacaacugccgcugcccccccgaguggaccggccaguacugcaccgaggacgucgacgagugccagcucaugcccaacgccugccagaacggcggcaccugccacaacacccacggcggcuacaacugcgucugcgucaacggcuggaccggcgaggacugcuccgagaacaucgacgacugcgccuccgccgccugcuuccacggcgccaccugccacgaccgcgucgccuccuucuacugcgagugcccccacggccgcaccggccuccucugccaccucaacgacgccugcaucuccaaccccugcaacgagggcuccaacugcgacaccaaccccgucaacggcaaggccaucugcaccugccccuccggcuacaccggccccgccugcucccaggacgucgacgagugcucccucggcgccaaccccugcgagcacgccggcaagugcaucaacacccucggcuccuucgagugccagugccuccagggcuacaccggcccccgcugcgagaucgacgucaacgagugcgucuccaaccccugccagaacgacgccaccugccucgaccagaucggcgaguuccagugcaucugcaugcccggcuacgagggcguccacugcgaggucaacaccgacgagugcgccuccucccccugccuccacaacggccgcugccucgacaagaucaacgaguuccagugcgagugccccaccggcuucaccggccaccucugccaguacgacgucgacgagugcgccuccacccccugcaagaacggcgccaagugccucgacggccccaacaccuacaccugcgucugcaccgagggcuacaccggcacccacugcgaggucgacaucgacgagugcgaccccgaccccugccacuacggcuccugcaaggacggcgucgccaccuucaccugccucugccgccccggcuacaccggccaccacugcgagaccaacaucaacgagugcuccucccagcccugccgccacggcggcaccugccaggaccgcgacaacgccuaccucugcuucugccucaagggcaccaccggccccaacugcgagaucaaccucgacgacugcgccuccucccccugcgacuccggcaccugccucgacaagaucgacggcuacgagugcgccugcgagcccggcuacaccggcuccaugugcaacaucaacaucgacgagugcgccggcaaccccugccacaacggcggcaccugcgaggacggcaucaacggcuucaccugccgcugccccgagggcuaccacgaccccaccugccucuccgaggucaacgagugcaacuccaaccccugcguccacggcgccugccgcgacucccucaacggcuacaagugcgacugcgaccccggcugguccggcaccaacugcgacaucaacaacaacgagugcgaguccaaccccugcgucaacggcggcaccugcaaggacaugaccuccggcuacgucugcaccugccgcgagggcuucuccggccccaacugccagaccaacaucaacgagugcgccuccaaccccugccucaaccagggcaccugcaucgacgacgucgccggcuacaagugcaacugccuccuccccuacaccggcgccaccugcgaggucguccucgcccccugcgcccccucccccugccgcaacggcggcgagugccgccaguccgaggacuacgaguccuucuccugcgucugccccaccggcuggcagggccagaccugcgaggucgacaucaacgagugcguccucucccccugccgccacggcgccuccugccagaacacccacggcggcuaccgcugccacugccaggccggcuacuccggccgcaacugcgagaccgacaucgacgacugccgccccaaccccugccacaacggcggcuccugcaccgacggcaucaacaccgccuucugcgacugccuccccggcuuccgcggcaccuucugcgaggaggacaucaacgagugcgccuccgaccccugccgcaacggcgccaacugcaccgacugcgucgacuccuacaccugcaccugccccgccggcuucuccggcauccacugcgagaacaacacccccgacugcaccgaguccuccugcuucaacggcggcaccugcgucgacggcaucaacuccuucaccugccucugcccccccggcuucaccggcuccuacugccagcacgacgucaacgagugcgacucccagcccugccuccacggcggcaccugccaggacggcugcggcuccuaccgcugcaccugcccccagggcuacaccggccccaacugccagaaccucguccacuggugcgacuccucccccugcaagaacggcggcaagugcuggcagacccacacccaguaccgcugcgagugccccuccggcuggaccggccucuacugcgacguccccuccgucuccugcgaggucgccgcccagcgccagggcgucgacgucgcccgccucugccagcacggcggccucugcgucgacgccggcaacacccaccacugccgcugccaggccggcuacaccggcuccuacugcgaggaccucgucgacgagugcucccccucccccugccagaacggcgccaccugcaccgacuaccucggcggcuacuccugcaagugcgucgccggcuaccacggcgucaacugcuccgaggagaucgacgagugccucucccaccccugccagaacggcggcaccugccucgaccuccccaacaccuacaagugcuccugcccccgcggcacccagggcguccacugcgagaucaacgucgacgacugcaacccccccgucgaccccgucucccgcucccccaagugcuucaacaacggcaccugcgucgaccaggucggcggcuacuccugcaccugcccccccggcuucgucggcgagcgcugcgagggcgacgucaacgagugccucuccaaccccugcgacgcccgcggcacccagaacugcguccagcgcgucaacgacuuccacugcgagugccgcgccggccacaccggccgccgcugcgaguccgucaucaacggcugcaagggcaagcccugcaagaacggcggcaccugcgccgucgccuccaacaccgcccgcggcuucaucugcaagugccccgccggcuucgagggcgccaccugcgagaacgacgcccgcaccugcggcucccuccgcugccucaacggcggcaccugcaucuccggcccccgcucccccaccugccucugccucggccccuucaccggccccgagugccaguuccccgccuccucccccugccucggcggcaaccccugcuacaaccagggcaccugcgagcccaccuccgagucccccuucuaccgcugccucugccccgccaaguucaacggccuccucugccacauccucgacuacuccuucggcggcggcgccggccgcgacaucccccccccccucaucgaggaggccugcgagcuccccgagugccaggaggacgccggcaacaaggucugcucccuccagugcaacaaccacgccugcggcugggacggcggcgacugcucccucaacuucaacgaccccuggaagaacugcacccagucccuccagugcuggaaguacuucuccgacggccacugcgacucccagugcaacuccgccggcugccucuucgacggcuucgacugccagcgcgccgagggccagugcaacccccucuacgaccaguacugcaaggaccacuucuccgacggccacugcgaccagggcugcaacuccgccgagugcgagugggacggccucgacugcgccgagcacguccccgagcgccucgccgccggcacccucgucgucgucguccucaugccccccgagcagcuccgcaacuccuccuuccacuuccuccgcgagcucucccgcguccuccacaccaacgucgucuucaagcgcgacgcccacggccagcagaugaucuuccccuacuacggccgcgaggaggagcuccgcaagcaccccaucaagcgcgccgccgagggcugggccgcccccgacgcccuccucggccaggucaaggccucccuccuccccggcggcuccgagggcggccgccgccgccgcgagcucgaccccauggacguccgcggcuccaucgucuaccucgagaucgacaaccgccagugcguccaggccuccucccagugcuuccaguccgccaccgacgucgccgccuuccucggcgcccucgccucccucggcucccucaacauccccuacaagaucgaggccguccaguccgagaccgucgagccccccccccccgcccagcuccacuucauguacgucgccgccgccgccuucguccuccucuucuucgucggcugcggcguccuccucucccgcaagcgccgccgccagcacggccagcucugguuccccgagggcuucaaggucuccgaggccuccaagaagaagcgccgcgagccccucggcgaggacuccgucggccucaagccccucaagaacgccuccgacggcgcccucauggacgacaaccagaacgaguggggcgacgaggaccucgagaccaagaaguuccgcuucgaggagcccgucguccuccccgaccucgacgaccagaccgaccaccgccaguggacccagcagcaccucgacgccgccgaccuccgcauguccgccauggcccccacccccccccagggcgaggucgacgccgacugcauggacgucaacguccgcggccccgacggcuucaccccccucaugaucgccuccugcuccggcggcggccucgagaccggcaacuccgaggaggaggaggacgcccccgccgucaucuccgacuucaucuaccagggcgccucccuccacaaccagaccgaccgcaccggcgagaccgcccuccaccucgccgcccgcuacucccgcuccgacgccgccaagcgccuccucgaggccuccgccgacgccaacauccaggacaacaugggccgcaccccccuccacgccgccgucuccgccgacgcccagggcgucuuccagauccucauccgcaaccgcgccaccgaccucgacgcccgcaugcacgacggcaccaccccccucauccucgccgcccgccucgccgucgagggcaugcucgaggaccucaucaacucccacgccgacgucaacgccgucgacgaccucggcaaguccgcccuccacugggccgccgccgucaacaacgucgacgccgccgucguccuccucaagaacggcgccaacaaggacaugcagaacaaccgcgaggagaccccccucuuccucgccgcccgcgagggcuccuacgagaccgccaagguccuccucgaccacuucgccaaccgcgacaucaccgaccacauggaccgccucccccgcgacaucgcccaggagcgcaugcaccacgacaucguccgccuccucgacgaguacaaccucguccgcuccccccagcuccacggcgccccccucggcggcacccccacccucucccccccccucugcucccccaacggcuaccucggcucccucaagcccggcguccagggcaagaagguccgcaagcccuccuccaagggccucgccugcggcuccaaggaggccaaggaccucaaggcccgccgcaagaagucccaggacggcaagggcugccuccucgacuccuccggcaugcucucccccgucgacucccucgaguccccccacggcuaccucuccgacgucgccucccccccccuccuccccucccccuuccagcagucccccuccgucccccucaaccaccuccccggcaugcccgacacccaccucggcaucggccaccucaacgucgccgccaagcccgagauggccgcccucggcggcggcggccgccucgccuucgagaccggccccccccgccucucccaccuccccgucgccuccggcaccuccaccguccucggcuccuccuccggcggcgcccucaacuucaccgucggcggcuccaccucccucaacggccagugcgaguggcucucccgccuccaguccggcaugguccccaaccaguacaacccccuccgcggcuccgucgcccccggcccccucuccacccaggcccccucccuccagcacggcauggucggcccccuccacuccucccucgccgccuccgcccucucccagaugauguccuaccagggccuccccuccacccgccucgccacccagccccaccucguccagacccagcagguccagccccagaaccuccagaugcagcagcagaaccuccagcccgccaacauccagcagcagcagucccuccagcccccccccccccccccccagccccaccucggcgucuccuccgccgccuccggccaccucggccgcuccuuccucuccggcgagcccucccaggccgacguccagccccucggccccuccucccucgccguccacaccauccucccccaggagucccccgcccuccccaccucccuccccuccucccucgucccccccgucaccgccgcccaguuccucaccccccccucccagcacuccuacuccucccccgucgacaacacccccucccaccagcuccagguccccgagcaccccuuccucacccccucccccgagucccccgaccagugguccuccuccuccccccacuccaacgucuccgacugguccgagggcgucuccuccccccccaccuccaugcagucccagaucgcccgcauccccgaggccuucaaguga

SEQ ID NO: 46763 - RNA, 7404 nt, Artificial Sequence
  derived and/or modified sequence opt2 from NOTCH2__Homo_sapiens__XP_011539821
augaacaccuaccucgucuccgccgucucccuccgcugcgucuccgucgagcgcuacaaggcccuccagugccgcgacggcuacgagcccugcgucaacgagggcaugugcgucaccuaccacaacggcaccggcuacugcaagugccccgagggcuuccucggcgaguacugccagcaccgcgaccccugcgagaagaaccgcugccagaacggcggcaccugcgucgcccaggccaugcucggcaaggccaccugccgcugcgccuccggcuucaccggcgaggacugccaguacuccaccucccaccccugcuucgucucccgccccugccucaacggcggcaccugccacaugcucucccgcgacaccuacgagugcaccugccaggucggcuucaccggcaaggagugccaguggaccgacgccugccucucccaccccugcgccaacggcuccaccugcaccaccgucgccaaccaguucuccugcaagugccucaccggcuucaccggccagaagugcgagaccgacgucaacgagugcgacauccccggccacugccagcacggcggcaccugccucaaccuccccggcuccuaccagugccagugcccccagggcuucaccggccaguacugcgacucccucuacguccccugcgcccccucccccugcgucaacggcggcaccugccgccagaccggcgacuucaccuucgagugcaacugccuccccggcuucgagggcuccaccugcgagcgcaacaucgacgacugccccaaccaccgcugccagaacggcggcgucugcgucgacggcgucaacaccuacaacugccgcugccccccccaguggaccggccaguucugcaccgaggacgucgacgagugccuccuccagcccaacgccugccagaacggcggcaccugcgccaaccgcaacggcggcuacggcugcgucugcgucaacggcugguccggcgacgacugcuccgagaacaucgacgacugcgccuucgccuccugcacccccggcuccaccugcaucgaccgcgucgccuccuucuccugcaugugccccgagggcaaggccggccuccucugccaccucgacgacgccugcaucuccaaccccugccacaagggcgcccucugcgacaccaacccccucaacggccaguacaucugcaccugcccccagggcuacaagggcgccgacugcaccgaggacgucgacgagugcgccauggccaacuccaaccccugcgagcacgccggcaagugcgucaacaccgacggcgccuuccacugcgagugccucaagggcuacgccggcccccgcugcgagauggacaucaacgagugccacuccgaccccugccagaacgacgccaccugccucgacaagaucggcggcuucaccugccucugcaugcccggcuucaagggcguccacugcgagcucgagaucaacgagugccaguccaaccccugcgucaacaacggccagugcgucgacaaggucaaccgcuuccagugccucugcccccccggcuucaccggccccgucugccagaucgacaucgacgacugcuccuccacccccugccucaacggcgccaagugcaucgaccaccccaacggcuacgagugccagugcgccaccggcuucaccggcguccucugcgaggagaacaucgacaacugcgaccccgaccccugccaccacggccagugccaggacggcaucgacuccuacaccugcaucugcaaccccggcuacaugggcgccaucugcuccgaccagaucgacgagugcuacuccucccccugccucaacgacggccgcugcaucgaccucgucaacggcuaccagugcaacugccagcccggcaccuccggcgucaacugcgagaucaacuucgacgacugcgccuccaaccccugcauccacggcaucugcauggacggcaucaaccgcuacuccugcgucugcucccccggcuucaccggccagcgcugcaacaucgacaucgacgagugcgccuccaaccccugccgcaagggcgccaccugcaucaacggcgucaacggcuuccgcugcaucugccccgagggcccccaccaccccuccugcuacucccaggucaacgagugccucuccaaccccugcauccacggcaacugcaccggcggccucuccggcuacaagugccucugcgacgccggcugggucggcaucaacugcgaggucgacaagaacgagugccucuccaaccccugccagaacggcggcaccugcgacaaccucgucaacggcuaccgcugcaccugcaagaagggcuucaagggcuacaacugccaggucaacaucgacgagugcgccuccaaccccugccucaaccagggcaccugcuucgacgacaucuccggcuacaccugccacugcguccuccccuacaccggcaagaacugccagaccguccucgcccccugcucccccaaccccugcgagaacgccgccgucugcaaggagucccccaacuucgaguccuacaccugccucugcgcccccggcuggcagggccagcgcugcaccaucgacaucgacgagugcaucuccaagcccugcaugaaccacggccucugccacaacacccagggcuccuacaugugcgagugcccccccggcuucuccggcauggacugcgaggaggacaucgacgacugccucgccaaccccugccagaacggcggcuccugcauggacggcgucaacaccuucuccugccucugccuccccggcuucaccggcgacaagugccagaccgacaugaacgagugccucuccgagcccugcaagaacggcggcaccugcuccgacuacgucaacuccuacaccugcaagugccaggccggcuucgacggcguccacugcgagaacaacaucaacgagugcaccgaguccuccugcuucaacggcggcaccugcgucgacggcaucaacuccuucuccugccucugccccgucggcuucaccggcuccuucugccuccacgagaucaacgagugcuccucccaccccugccucaacgagggcaccugcgucgacggccucggcaccuaccgcugcuccugcccccucggcuacaccggcaagaacugccagacccucgucaaccucugcucccgcucccccugcaagaacaagggcaccugcguccagaagaaggccgagucccagugccucugccccuccggcugggccggcgccuacugcgacguccccaacgucuccugcgacaucgccgccucccgccgcggcguccucgucgagcaccucugccagcacuccggcgucugcaucaacgccggcaacacccacuacugccagugcccccucggcuacaccggcuccuacugcgaggagcagcucgacgagugcgccuccaaccccugccagcacggcgccaccugcuccgacuucaucggcggcuaccgcugcgagugcguccccggcuaccagggcgucaacugcgaguacgaggucgacgagugccagaaccagcccugccagaacggcggcaccugcaucgaccucgucaaccacuucaagugcuccugcccccccggcacccgcggccuccucugcgaggagaacaucgacgacugcgcccgcggcccccacugccucaacggcggccagugcauggaccgcaucggcggcuacuccugccgcugccuccccggcuucgccggcgagcgcugcgagggcgacaucaacgagugccucuccaaccccugcuccuccgagggcucccucgacugcauccagcucaccaacgacuaccucugcgucugccgcuccgccuucaccggccgccacugcgagaccuucgucgacgucugcccccagaugcccugccucaacggcggcaccugcgccgucgccuccaacaugcccgacggcuucaucugccgcugcccccccggcuucuccggcgcccgcugccaguccuccugcggccaggucaagugccgcaagggcgagcagugcguccacaccgccuccggcccccgcugcuucugccccuccccccgcgacugcgaguccggcugcgccuccucccccugccagcacggcggcuccugccacccccagcgccagccccccuacuacuccugccagugcgccccccccuucuccggcucccgcugcgagcucuacaccgccccccccuccaccccccccgccaccugccucucccaguacugcgccgacaaggcccgcgacggcgucugcgacgaggccugcaacucccacgccugccagugggacggcggcgacugcucccucaccauggagaaccccugggccaacugcuccuccccccuccccugcugggacuacaucaacaaccagugcgacgagcucugcaacaccgucgagugccucuucgacaacuucgagugccagggcaacuccaagaccugcaaguacgacaaguacugcgccgaccacuucaaggacaaccacugcgaccagggcugcaacuccgaggagugcggcugggacggccucgacugcgccgccgaccagcccgagaaccucgccgagggcacccucgucaucgucguccucaugccccccgagcagcuccuccaggacgcccgcuccuuccuccgcgcccucggcacccuccuccacaccaaccuccgcaucaagcgcgacucccagggcgagcucauggucuaccccuacuacggcgagaaguccgccgccaugaagaagcagcgcaugacccgccgcucccuccccggcgagcaggagcaggaggucgccggcuccaaggucuuccucgagaucgacaaccgccagugcguccaggacuccgaccacugcuucaagaacaccgacgccgccgccgcccuccucgccucccacgccauccagggcacccucuccuacccccucgucuccgucgucuccgagucccucacccccgagcgcacccagcuccucuaccuccucgccgucgccgucgucaucauccucuucaucauccuccucggcgucaucauggccaagcgcaagcgcaagcacggcucccucuggcuccccgagggcuucacccuccgccgcgacgccuccaaccacaagcgccgcgagcccgucggccaggacgccgucggccucaagaaccucuccguccaggucuccgaggccaaccucaucggcaccggcaccuccgagcacugggucgacgacgagggcccccagcccaagaaggucaaggccgaggacgaggcccuccucuccgaggaggacgaccccaucgaccgccgccccuggacccagcagcaccucgaggccgccgacauccgccgcacccccucccucgcccucacccccccccaggccgagcaggaggucgacguccucgacgucaacguccgcggccccgacggcugcaccccccucaugcucgccucccuccgcggcggcuccuccgaccucuccgacgaggacgaggacgccgaggacuccuccgccaacaucaucaccgaccucgucuaccagggcgccucccuccaggcccagaccgaccgcaccggcgagauggcccuccaccucgccgcccgcuacucccgcgccgacgccgccaagcgccuccucgacgccggcgccgacgccaacgcccaggacaacaugggccgcugcccccuccacgccgccgucgccgccgacgcccagggcgucuuccagauccucauccgcaaccgcgucaccgaccucgacgcccgcaugaacgacggcaccaccccccucauccucgccgcccgccucgccgucgagggcauggucgccgagcucaucaacugccaggccgacgucaacgccgucgacgaccacggcaaguccgcccuccacugggccgccgccgucaacaacgucgaggccacccuccuccuccucaagaacggcgccaaccgcgacaugcaggacaacaaggaggagaccccccucuuccucgccgcccgcgagggcuccuacgaggccgccaagauccuccucgaccacuucgccaaccgcgacaucaccgaccacauggaccgccucccccgcgacgucgcccgcgaccgcaugcaccacgacaucguccgccuccucgacgaguacaacgucacccccuccccccccggcaccguccucaccuccgcccucucccccgucaucugcggccccaaccgcuccuuccucucccucaagcacacccccaugggcaagaagucccgccgccccuccgccaaguccaccaugcccaccucccuccccaaccucgccaaggaggccaaggacgccaagggcucccgccgcaagaagucccucuccgagaagguccagcucuccgaguccuccgucacccucucccccgucgacucccucgaguccccccacaccuacgucuccgacaccaccuccucccccaugaucaccucccccggcauccuccaggccucccccaaccccaugcucgccaccgccgccccccccgcccccguccacgcccagcacgcccucuccuucuccaaccuccacgagaugcagccccucgcccacggcgccuccaccguccuccccuccgucucccagcuccucucccaccaccacaucgucucccccggcuccggcuccgccggcucccucucccgccuccaccccguccccguccccgccgacuggaugaaccgcauggaggucaacgagacccaguacaacgagauguucggcaugguccucgcccccgccgagggcacccaccccggcaucgccccccagucccgcccccccgagggcaagcacaucaccaccccccgcgagccccucccccccaucgucaccuuccagcucauccccaagggcuccaucgcccagcccgccggcgccccccagccccaguccaccugcccccccgccgucgccggcccccuccccaccauguaccagauccccgagauggcccgccuccccuccgucgccuuccccaccgccaugaugccccagcaggacggccaggucgcccagaccauccuccccgccuaccaccccuuccccgccuccgucggcaaguaccccaccccccccucccagcacuccuacgccuccuccaacgccgccgagcgcacccccucccacuccggccaccuccagggcgagcaccccuaccucacccccucccccgagucccccgaccagugguccuccuccuccccccacuccgccuccgacugguccgacgucaccaccucccccacccccggcggcgccggcggcggccagcgcggccccggcacccacauguccgagcccccccacaacaacaugcaggucuacgccuga

SEQ ID NO: 46764 - RNA, 6966 nt, Artificial Sequence
  derived and/or modified sequence opt2 from NOTCH3__Homo_sapiens__NP_000426
augggccccggcgcccgcggccgccgccgccgccgccgccccaugucccccccccccccccccccccccguccgcgcccucccccuccuccuccuccucgccggccccggcgccgccgccccccccugccucgacggcucccccugcgccaacggcggccgcugcacccagcuccccucccgcgaggccgccugccucugcccccccggcugggucggcgagcgcugccagcucgaggaccccugccacuccggccccugcgccggccgcggcgucugccaguccuccgucgucgccggcaccgcccgcuucuccugccgcugcccccgcggcuuccgcggccccgacugcucccuccccgaccccugccucuccucccccugcgcccacggcgcccgcugcuccgucggccccgacggccgcuuccucugcuccugcccccccggcuaccagggccgcuccugccgcuccgacgucgacgagugccgcgucggcgagcccugccgccacggcggcaccugccucaacacccccggcuccuuccgcugccagugccccgccggcuacaccggcccccucugcgagaaccccgccguccccugcgcccccucccccugccgcaacggcggcaccugccgccaguccggcgaccucaccuacgacugcgccugccuccccggcuucgagggccagaacugcgaggucaacgucgacgacugccccggccaccgcugccucaacggcggcaccugcgucgacggcgucaacaccuacaacugccagugcccccccgaguggaccggccaguucugcaccgaggacgucgacgagugccagcuccagcccaacgccugccacaacggcggcaccugcuucaacacccucggcggccacuccugcgucugcgucaacggcuggaccggcgaguccugcucccagaacaucgacgacugcgccaccgccgucugcuuccacggcgccaccugccacgaccgcgucgccuccuucuacugcgccugccccaugggcaagaccggccuccucugccaccucgacgacgccugcgucuccaaccccugccacgaggacgccaucugcgacaccaaccccgucaacggccgcgccaucugcaccugcccccccggcuucaccggcggcgccugcgaccaggacgucgacgagugcuccaucggcgccaaccccugcgagcaccucggccgcugcgucaacacccagggcuccuuccucugccagugcggccgcggcuacaccggcccccgcugcgagaccgacgucaacgagugccucuccggccccugccgcaaccaggccaccugccucgaccgcaucggccaguucaccugcaucugcauggccggcuucaccggcaccuacugcgaggucgacaucgacgagugccaguccucccccugcgucaacggcggcgucugcaaggaccgcgucaacggcuucuccugcaccugccccuccggcuucuccggcuccaccugccagcucgacgucgacgagugcgccuccacccccugccgcaacggcgccaagugcgucgaccagcccgacggcuacgagugccgcugcgccgagggcuucgagggcacccucugcgaccgcaacgucgacgacugcucccccgaccccugccaccacggccgcugcgucgacggcaucgccuccuucuccugcgccugcgcccccggcuacaccggcacccgcugcgagucccaggucgacgagugccgcucccagcccugccgccacggcggcaagugccucgaccucgucgacaaguaccucugccgcugccccuccggcaccaccggcgucaacugcgaggucaacaucgacgacugcgccuccaaccccugcaccuucggcgucugccgcgacggcaucaaccgcuacgacugcgucugccagcccggcuucaccggcccccucugcaacgucgagaucaacgagugcgccuccucccccugcggcgagggcggcuccugcgucgacggcgagaacggcuuccgcugccucugcccccccggcucccuccccccccucugccucccccccucccaccccugcgcccacgagcccugcucccacggcaucugcuacgacgcccccggcggcuuccgcugcgucugcgagcccggcugguccggcccccgcugcucccagucccucgcccgcgacgccugcgagucccagcccugccgcgccggcggcaccugcuccuccgacggcaugggcuuccacugcaccugcccccccggcguccagggccgccagugcgagcuccucucccccugcacccccaaccccugcgagcacggcggccgcugcgaguccgcccccggccagcuccccgucugcuccugcccccagggcuggcagggcccccgcugccagcaggacgucgacgagugcgccggccccgcccccugcggcccccacggcaucugcaccaaccucgccggcuccuucuccugcaccugccacggcggcuacaccggccccuccugcgaccaggacaucaacgacugcgaccccaaccccugccucaacggcggcuccugccaggacggcgucggcuccuucuccugcuccugccuccccggcuucgccggcccccgcugcgcccgcgacgucgacgagugccucuccaaccccugcggccccggcaccugcaccgaccacgucgccuccuucaccugcaccugcccccccggcuacggcggcuuccacugcgagcaggaccuccccgacugcucccccuccuccugcuucaacggcggcaccugcgucgacggcgucaacuccuucuccugccucugccgccccggcuacaccggcgcccacugccagcacgaggccgaccccugccucucccgccccugccuccacggcggcgucugcuccgccgcccaccccggcuuccgcugcaccugccucgaguccuucaccggcccccagugccagacccucgucgacuggugcucccgccagcccugccagaacggcggccgcugcguccagaccggcgccuacugccucugcccccccggcugguccggccgccucugcgacauccgcucccuccccugccgcgaggccgccgcccagaucggcguccgccucgagcagcucugccaggccggcggccagugcgucgacgaggacuccucccacuacugcgucugccccgagggccgcaccggcucccacugcgagcaggaggucgaccccugccucgcccagcccugccagcacggcggcaccugccgcggcuacaugggcggcuacaugugcgagugccuccccggcuacaacggcgacaacugcgaggacgacgucgacgagugcgccucccagcccugccagcacggcggcuccugcaucgaccucgucgcccgcuaccucugcuccugcccccccggcacccucggcguccucugcgagaucaacgaggacgacugcggccccggccccccccucgacuccggcccccgcugccuccacaacggcaccugcgucgaccucgucggcggcuuccgcugcaccugcccccccggcuacaccggccuccgcugcgaggccgacaucaacgagugccgcuccggcgccugccacgccgcccacacccgcgacugccuccaggaccccggcggcggcuuccgcugccucugccacgccggcuucuccggcccccgcugccagaccguccucucccccugcgagucccagcccugccagcacggcggccagugccgccccucccccggccccggcggcggccucaccuucaccugccacugcgcccagcccuucuggggcccccgcugcgagcgcgucgcccgcuccugccgcgagcuccagugccccgucggcguccccugccagcagaccccccgcggcccccgcugcgccugcccccccggccucuccggccccuccugccgcuccuuccccggcuccccccccggcgccuccaacgccuccugcgccgccgcccccugccuccacggcggcuccugccgccccgccccccucgcccccuucuuccgcugcgccugcgcccagggcuggaccggcccccgcugcgaggcccccgccgccgcccccgaggucuccgaggagccccgcugcccccgcgccgccugccaggccaagcgcggcgaccagcgcugcgaccgcgagugcaacucccccggcugcggcugggacggcggcgacugcucccucuccgucggcgaccccuggcgccagugcgaggcccuccagugcuggcgccucuucaacaacucccgcugcgaccccgccugcuccucccccgccugccucuacgacaacuucgacugccacgccggcggccgcgagcgcaccugcaaccccgucuacgagaaguacugcgccgaccacuucgccgacggccgcugcgaccagggcugcaacaccgaggagugcggcugggacggccucgacugcgccuccgagguccccgcccuccucgcccgcggcguccucguccucaccguccuccucccccccgaggagcuccuccgcuccuccgccgacuuccuccagcgccucuccgccauccuccgcaccucccuccgcuuccgccucgacgcccacggccaggccauggucuuccccuaccaccgccccucccccggcuccgagccccgcgcccgccgcgagcucgcccccgaggucaucggcuccgucgucaugcucgagaucgacaaccgccucugccuccagucccccgagaacgaccacugcuuccccgacgcccaguccgccgccgacuaccucggcgcccucuccgccgucgagcgccucgacuuccccuacccccuccgcgacguccgcggcgagccccucgagccccccgagcccuccgucccccuccucccccuccucgucgccggcgccguccuccuccucgucauccucguccucggcgucauggucgcccgccgcaagcgcgagcacuccacccucugguuccccgagggcuucucccuccacaaggacgucgccuccggccacaagggccgccgcgagcccgucggccaggacgcccucggcaugaagaacauggccaagggcgagucccucaugggcgaggucgccaccgacuggauggacaccgagugccccgaggccaagcgccucaaggucgaggagcccggcaugggcgccgaggaggccgucgacugccgccaguggacccagcaccaccucgucgccgccgacauccgcgucgcccccgccauggcccucacccccccccagggcgacgccgacgccgacggcauggacgucaacguccgcggccccgacggcuucaccccccucaugcucgccuccuucugcggcggcgcccucgagcccaugcccaccgaggaggacgaggccgacgacaccuccgccuccaucaucuccgaccucaucugccagggcgcccagcucggcgcccgcaccgaccgcaccggcgagaccgcccuccaccucgccgcccgcuacgcccgcgccgacgccgccaagcgccuccucgacgccggcgccgacaccaacgcccaggaccacuccggccgcaccccccuccacaccgccgucaccgccgacgcccagggcgucuuccagauccucauccgcaaccgcuccaccgaccucgacgcccgcauggccgacggcuccaccgcccucauccucgccgcccgccucgccgucgagggcauggucgaggagcucaucgccucccacgccgacgucaacgccgucgacgagcucggcaaguccgcccuccacugggccgccgccgucaacaacgucgaggccacccucgcccuccucaagaacggcgccaacaaggacaugcaggacuccaaggaggagaccccccucuuccucgccgcccgcgagggcuccuacgaggccgccaagcuccuccucgaccacuucgccaaccgcgagaucaccgaccaccucgaccgccucccccgcgacgucgcccaggagcgccuccaccaggacaucguccgccuccucgaccagcccuccggcccccgcuccccccccggcccccacggccucggcccccuccucugcccccccggcgccuuccuccccggccucaaggccgcccaguccggcuccaagaagucccgccgcccccccggcaaggccggccucggcccccagggcccccgcggccgcggcaagaagcucacccucgccugccccggcccccucgccgacuccuccgucacccucucccccgucgacucccucgacuccccccgccccuucggcggcccccccgccucccccggcggcuucccccucgagggccccuacgccgccgccaccgccaccgccgucucccucgcccagcucggcggccccggccgcgccggccucggccgccagccccccggcggcugcguccucucccucggccuccucaaccccgucgccgucccccucgacugggcccgccuccccccccccgccccccccggccccuccuuccuccucccccucgcccccggcccccagcuccucaaccccggcacccccgucuccccccaggagcgccccccccccuaccucgccguccccggccacggcgaggaguaccccgccgccggcgcccacuccuccccccccaaggcccgcuuccuccgcguccccuccgagcaccccuaccucacccccucccccgagucccccgagcacugggccucccccuccccccccucccucuccgacugguccgaguccacccccucccccgccaccgccaccggcgccauggccaccaccaccggcgcccuccccgcccagccccucccccucuccguccccuccucccucgcccaggcccagacccagcucggcccccagcccgaggucacccccaagcgccagguccucgccuga

SEQ ID NO: 46765 - RNA, 6012 nt, Artificial Sequence
  derived and/or modified sequence opt2 from NOTCH4__Homo_sapiens__NP_004548
augcagccccccucccuccuccuccuccuccuccuccuccuccuccucugcgucuccgucguccgcccccgcggccuccucugcggcuccuuccccgagcccugcgccaacggcggcaccugccucucccucucccucggccagggcaccugccagugcgcccccggcuuccucggcgagaccugccaguuccccgaccccugccagaacgcccagcucugccagaacggcggcuccugccaggcccuccuccccgccccccucggccuccccuccucccccuccccccucacccccuccuuccucugcaccugccuccccggcuucaccggcgagcgcugccaggccaagcucgaggaccccugcccccccuccuucugcuccaagcgcggccgcugccacauccaggccuccggccgcccccagugcuccugcaugcccggcuggaccggcgagcagugccagcuccgcgacuucugcuccgccaaccccugcgucaacggcggcgucugccucgccaccuacccccagauccagugccacugcccccccggcuucgagggccacgccugcgagcgcgacgucaacgagugcuuccaggaccccggccccugccccaagggcaccuccugccacaacacccucggcuccuuccagugccucugccccgucggccaggagggcccccgcugcgagcuccgcgccggccccugccccccccgcggcugcuccaacggcggcaccugccagcucaugcccgagaaggacuccaccuuccaccucugccucugcccccccggcuucaucggccccgacugcgaggucaaccccgacaacugcgucucccaccagugccagaacggcggcaccugccaggacggccucgacaccuacaccugccucugccccgagaccuggaccggcugggacugcuccgaggacgucgacgagugcgagacccagggccccccccacugccgcaacggcggcaccugccagaacuccgccggcuccuuccacugcgucugcgucuccggcuggggcggcaccuccugcgaggagaaccucgacgacugcaucgccgccaccugcgcccccggcuccaccugcaucgaccgcgucggcuccuucuccugccucugcccccccggccgcaccggccuccucugccaccucgaggacaugugccucucccagcccugccacggcgacgcccagugcuccaccaacccccucaccggcuccacccucugccucugccagcccggcuacuccggccccaccugccaccaggaccucgacgagugccucauggcccagcagggccccucccccugcgagcacggcggcuccugccucaacacccccggcuccuucaacugccucugcccccccggcuacaccggcucccgcugcgaggccgaccacaacgagugccucucccagcccugccaccccggcuccaccugccucgaccuccucgccaccuuccacugccucugcccccccggccucgagggccagcucugcgaggucgagaccaacgagugcgccuccgcccccugccucaaccacgccgacugccacgaccuccucaacggcuuccagugcaucugccuccccggcuucuccggcacccgcugcgaggaggacaucgacgagugccgcuccucccccugcgccaacggcggccagugccaggaccagcccggcgccuuccacugcaagugccuccccggcuucgagggcccccgcugccagaccgaggucgacgagugccucuccgaccccugccccgucggcgccuccugccucgaccuccccggcgccuucuucugccucugccccuccggcuucaccggccagcucugcgaggucccccucugcgcccccaaccucugccagcccaagcagaucugcaaggaccagaaggacaaggccaacugccucugccccgacggcucccccggcugcgccccccccgaggacaacugcaccugccaccacggccacugccagcgcuccuccugcgucugcgacgucggcuggaccggccccgagugcgaggccgagcucggcggcugcaucuccgcccccugcgcccacggcggcaccugcuacccccagcccuccggcuacaacugcaccugccccaccggcuacaccggccccaccugcuccgaggagaugaccgccugccacuccggccccugccucaacggcggcuccugcaaccccucccccggcggcuacuacugcaccugcccccccucccacaccggcccccagugccagaccuccaccgacuacugcgucuccgcccccugcuucaacggcggcaccugcgucaaccgccccggcaccuucuccugccucugcgccaugggcuuccagggcccccgcugcgagggcaagcuccgccccuccugcgccgacucccccugccgcaaccgcgccaccugccaggacuccccccagggcccccgcugccucugccccaccggcuacaccggcggcuccugccagacccucauggaccucugcgcccagaagcccugcccccgcaacucccacugccuccagaccggccccuccuuccacugccucugccuccagggcuggaccggcccccucugcaaccucccccucuccuccugccagaaggccgcccucucccagggcaucgacgucuccucccucugccacaacggcggccucugcgucgacuccggccccuccuacuucugccacugcccccccggcuuccagggcucccucugccaggaccacgucaaccccugcgagucccgccccugccagaacggcgccaccugcauggcccagcccuccggcuaccucugccagugcgcccccggcuacgacggccagaacugcuccaaggagcucgacgccugccagucccagcccugccacaaccacggcaccugcacccccaagcccggcggcuuccacugcgccugcccccccggcuucgucggccuccgcugcgagggcgacgucgacgagugccucgaccagcccugccaccccaccggcaccgccgccugccacucccucgccaacgccuucuacugccagugccuccccggccacaccggccaguggugcgaggucgagaucgaccccugccacucccagcccugcuuccacggcggcaccugcgaggccaccgccggcuccccccucggcuucaucugccacugccccaagggcuucgagggccccaccugcucccaccgcgcccccuccugcggcuuccaccacugccaccacggcggccucugccuccccucccccaagcccggcuuccccccccgcugcgccugccucuccggcuacggcggccccgacugccucaccccccccgcccccaagggcugcggcccccccucccccugccucuacaacggcuccugcuccgagaccaccggccucggcggccccggcuuccgcugcuccugcccccacuccucccccggcccccgcugccagaagcccggcgccaagggcugcgagggccgcuccggcgacggcgccugcgacgccggcugcuccggccccggcggcaacugggacggcggcgacugcucccucggcguccccgaccccuggaagggcugccccucccacucccgcugcuggcuccucuuccgcgacggccagugccacccccagugcgacuccgaggagugccucuucgacggcuacgacugcgagaccccccccgccugcacccccgccuacgaccaguacugccacgaccacuuccacaacggccacugcgagaagggcugcaacaccgccgagugcggcugggacggcggcgacugccgccccgaggacggcgaccccgaguggggccccucccucgcccuccucgucguccucuccccccccgcccucgaccagcagcucuucgcccucgcccgcguccucucccucacccuccgcgucggccucuggguccgcaaggaccgcgacggccgcgacauggucuaccccuaccccggcgcccgcgccgaggagaagcucggcggcacccgcgaccccaccuaccaggagcgcgccgccccccagacccagccccucggcaaggagaccgacucccucuccgccggcuucgucgucgucaugggcgucgaccucucccgcugcggccccgaccaccccgccucccgcugccccugggaccccggccuccuccuccgcuuccucgccgccauggccgccgucggcgcccucgagccccuccuccccggcccccuccucgccguccacccccacgccggcaccgccccccccgccaaccagcuccccuggcccguccucugcucccccgucgccggcgucauccuccucgcccucggcgcccuccucguccuccagcucauccgccgccgccgccgcgagcacggcgcccucuggcucccccccggcuucacccgccgcccccgcacccaguccgccccccaccgccgccgccccccccucggcgaggacuccaucggccucaaggcccucaagcccaaggccgaggucgacgaggacggcgucgucaugugcuccggccccgaggagggcgaggaggucggccaggccgaggagaccggcccccccuccaccugccagcucuggucccucuccggcggcugcggcgcccucccccaggccgccaugcucacccccccccaggaguccgagauggaggcccccgaccucgacacccgcggccccgacggcgucaccccccucauguccgccgucugcugcggcgagguccaguccggcaccuuccagggcgccuggcucggcugccccgagcccugggagccccuccucgacggcggcgccugcccccaggcccacaccgucggcaccggcgagaccccccuccaccucgccgcccgcuucucccgccccaccgccgcccgccgccuccucgaggccggcgccaaccccaaccagcccgaccgcgccggccgcaccccccuccacgccgccgucgccgccgacgcccgcgaggucugccagcuccuccuccgcucccgccagaccgccgucgacgcccgcaccgaggacggcaccaccccccucaugcucgccgcccgccucgccgucgaggaccucgucgaggagcucaucgccgcccaggccgacgucggcgcccgcgacaaguggggcaagaccgcccuccacugggccgccgccgucaacaacgcccgcgccgcccgcucccuccuccaggccggcgccgacaaggacgcccaggacaaccgcgagcagaccccccucuuccucgccgcccgcgagggcgccgucgaggucgcccagcuccuccucggccucggcgccgcccgcgagcuccgcgaccaggccggccucgcccccgccgacgucgcccaccagcgcaaccacugggaccuccucacccuccucgagggcgccggcccccccgaggcccgccacaaggccacccccggccgcgaggccggccccuucccccgcgcccgcaccgucuccgucuccguccccccccacggcggcggcgcccucccccgcugccgcacccucuccgccggcgccggcccccgcggcggcggcgccugccuccaggcccgcaccugguccgucgaccucgccgcccgcggcggcggcgccuacucccacugccgcucccucuccggcgucggcgccggcggcggccccaccccccgcggccgccgcuucuccgccggcaugcgcggcccccgccccaaccccgccaucaugcgcggccgcuacggcgucgccgccggccgcggcggccgcgucuccaccgacgacuggcccugcgacugggucgcccucggcgccugcggcuccgccuccaacauccccauccccccccccugccucacccccucccccgagcgcggcuccccccagcucgacugcggcccccccgcccuccaggagaugcccaucaaccagggcggcgagggcaagaaguga

SEQ ID NO: 46766 - RNA, 1491 nt, Artificial Sequence
  derived and/or modified sequence opt2 from NOTUM__Homo_sapiens__NP_848588
augggccgcggcguccgcguccuccuccuccucucccuccuccacugcgccggcggcuccgagggccgcaagaccuggcgccgccgcggccagcagccccccccccccccccgcaccgaggccgcccccgccgccggccagcccgucgaguccuucccccucgacuucaccgccgucgagggcaacauggacuccuucauggcccaggucaagucccucgcccagucccucuaccccugcuccgcccagcagcucaacgaggaccuccgccuccaccuccuccucaacaccuccgucaccugcaacgacggcucccccgccggcuacuaccucaaggagucccgcggcucccgccgcuggcuccucuuccucgagggcggcugguacugcuucaaccgcgagaacugcgacucccgcuacgacaccaugcgccgccucauguccucccgcgacuggccccgcacccgcaccggcaccggcauccucuccucccagcccgaggagaaccccuacugguggaacgccaacauggucuucauccccuacugcuccuccgacgucugguccggcgccuccuccaaguccgagaagaacgaguacgccuucaugggcgcccucaucauccaggaggucguccgcgagcuccucggccgcggccucuccggcgccaagguccuccuccucgccggcuccuccgccggcggcaccggcguccuccucaacgucgaccgcgucgccgagcagcucgagaagcucggcuaccccgccauccagguccgcggccucgccgacuccggcugguuccucgacaacaagcaguaccgccacaccgacugcgucgacaccaucaccugcgcccccaccgaggccauccgccgcggcauccgcuacuggaacggcgucguccccgagcgcugccgccgccaguuccaggagggcgaggaguggaacugcuucuucggcuacaaggucuaccccacccuccgcugccccgucuucgucguccaguggcucuucgacgaggcccagcucaccgucgacaacguccaccucaccggccagcccguccaggagggccuccgccucuacauccagaaccucggccgcgagcuccgccacacccucaaggacguccccgccuccuucgcccccgccugccucucccacgagaucaucauccgcucccacuggaccgacguccaggucaagggcaccucccucccccgcgcccuccacugcugggaccgcucccuccacgacucccacaaggccuccaagaccccccucaagggcugccccguccaccucgucgacuccugccccuggccccacugcaaccccuccugccccaccguccgcgaccaguucaccggccaggagaugaacgucgcccaguuccucaugcacaugggcuucgacaugcagaccgucgcccagccccagggccucgagcccuccgagcuccucggcaugcucuccaacggcuccuga

SEQ ID NO: 46767 - RNA, 1524 nt, Artificial Sequence
  derived and/or modified sequence opt2 from NOVA1__Homo_sapiens__NP_002506
augauggccgccgcccccauccagcagaacggcacccacaccggcguccccaucgaccucgacccccccgacucccgcaagcgcccccucgaggccccccccgaggccggcuccaccaagcgcaccaacaccggcgaggacggccaguacuuccucaagguccucauccccuccuacgccgccggcuccaucaucggcaagggcggccagaccaucguccagcuccagaaggagaccggcgccaccaucaagcucuccaaguccaaggacuucuaccccggcaccaccgagcgcgucugccucauccagggcaccgucgaggcccucaacgccguccacggcuucaucgccgagaagauccgcgagaugccccagaacgucgccaagaccgagcccgucuccauccuccagccccagaccaccgucaaccccgaccgcaucaagcagacccuccccuccucccccaccaccaccaaguccucccccuccgaccccaugaccaccucccgcgccaaccaggucaagaucaucguccccaacuccaccgccggccucaucaucggcaagggcggcgccaccgucaaggccgucauggagcaguccggcgccuggguccagcucucccagaagcccgacggcaucaaccuccaggagcgcgucgucaccgucuccggcgagcccgagcagaaccgcaaggccgucgagcucaucauccagaagauccaggaggacccccaguccggcuccugccucaacaucuccuacgccaacgucaccggccccgucgccaacuccaaccccaccggcucccccuacgccaacaccgccgagguccuccccaccgccgccgccgccgccggccuccucggccacgccaaccucgccggcgucgccgccuuccccgccguccucuccggcuucaccggcaacgaccucgucgccaucaccuccgcccucaacacccucgccuccuacggcuacaaccucaacacccucggccucggccucucccaggccgccgccaccggcgcccucgccgccgccgccgccuccgccaaccccgccgccgccgccgccaaccuccucgccaccuacgccuccgaggccuccgccuccggcuccaccgccggcggcaccgccggcaccuucgcccucggcucccucgccgccgccaccgccgccaccaacggcuacuucggcgccgccuccccccucgccgccuccgccauccucggcaccgagaaguccaccgacggcuccaaggacgucgucgagaucgccguccccgagaaccucgucggcgccauccucggcaagggcggcaagacccucgucgaguaccaggagcucaccggcgcccgcauccagaucuccaagaagggcgaguucguccccggcacccgcaaccgcaaggucaccaucaccggcacccccgccgccacccaggccgcccaguaccucaucacccagcgcaucaccuacgagcagggcguccgcgccgccaacccccagaaggucggcuga

SEQ ID NO: 46768 - RNA, 1479 nt, Artificial Sequence
  derived and/or modified sequence opt2 from NOVA2__Homo_sapiens__NP_002507
auggagcccgaggcccccgacucccgcaagcgcccccucgagaccccccccgaggucgucugcaccaagcgcuccaacaccggcgaggagggcgaguacuuccucaagguccucauccccuccuacgccgccggcuccaucaucggcaagggcggccagaccaucguccagcuccagaaggagaccggcgccaccaucaagcucuccaaguccaaggacuucuaccccggcaccaccgagcgcgucugccucguccagggcaccgccgaggcccucaacgccguccacuccuucaucgccgagaagguccgcgagaucccccaggccaugaccaagcccgaggucgucaacauccuccagccccagaccaccaugaaccccgaccgcgccaagcaggccaagcucaucguccccaacuccaccgccggccucaucaucggcaagggcggcgccaccgucaaggccgucauggagcaguccggcgccuggguccagcucucccagaagcccgagggcaucaaccuccaggagcgcgucgucaccgucuccggcgagcccgagcagguccacaaggccgucuccgccaucguccagaagguccaggaggacccccaguccuccuccugccucaacaucuccuacgccaacgucgccggccccgucgccaacuccaaccccaccggcucccccuacgccucccccgccgacguccuccccgccgccgccgccgccuccgccgccgccgccuccggccuccucggccccgccggccucgccggcgucggcgccuuccccgccgcccuccccgccuucuccggcaccgaccuccucgccaucuccaccgcccucaacacccucgccuccuacggcuacaacaccaacucccucggccucggccucaacuccgccgccgccuccggcguccucgccgccgucgccgccggcgccaaccccgccgccgccgccgccgccaaccuccucgccuccuacgccggcgaggccggcgccggccccgccggcggcgccgcccccccccccccccccccccccggcgcccucggcuccuucgcccucgccgccgccgccaacggcuaccucggcgccggcgccggcggcggcgccggcggcggcggcggcccccucgucgccgccgccgccgccgccggcgccgccggcggcuuccucaccgccgagaagcucgccgccgaguccgccaaggagcucgucgagaucgccguccccgagaaccucgucggcgccauccucggcaagggcggcaagacccucgucgaguaccaggagcucaccggcgcccgcauccagaucuccaagaagggcgaguuccuccccggcacccgcaaccgccgcgucaccaucaccggcucccccgccgccacccaggccgcccaguaccucaucucccagcgcgucaccuacgagcagggcguccgcgccuccaacccccagaaggucggcuga

SEQ ID NO: 46769 - RNA, 1074 nt, Artificial Sequence
  derived and/or modified sequence opt2 from NOV__Homo_sapiens__NP_002505
augcaguccguccaguccaccuccuucugccuccgcaagcagugccucugccucaccuuccuccuccuccaccuccucggccaggucgccgccacccagcgcugccccccccagugccccggccgcugccccgccaccccccccaccugcgcccccggcguccgcgccguccucgacggcugcuccugcugccucgucugcgcccgccagcgcggcgaguccugcuccgaccucgagcccugcgacgaguccuccggccucuacugcgaccgcuccgccgaccccuccaaccagaccggcaucugcaccgccgucgagggcgacaacugcgucuucgacggcgucaucuaccgcuccggcgagaaguuccagcccuccugcaaguuccagugcaccugccgcgacggccagaucggcugcgucccccgcugccagcucgacguccuccuccccgagcccaacugccccgccccccgcaaggucgagguccccggcgagugcugcgagaaguggaucugcggccccgacgaggaggacucccucggcggccucacccucgccgccuaccgccccgaggccacccucggcgucgaggucuccgacuccuccgucaacugcaucgagcagaccaccgaguggaccgccugcuccaaguccugcggcaugggcuucuccacccgcgucaccaaccgcaaccgccagugcgagaugcucaagcagacccgccucugcaugguccgccccugcgagcaggagcccgagcagcccaccgacaagaagggcaagaagugccuccgcaccaagaagucccucaaggccauccaccuccaguucaagaacugcaccucccuccacaccuacaagccccgcuucugcggcgucugcuccgacggccgcugcugcaccccccacaacaccaagaccauccaggccgaguuccagugcucccccggccagaucgucaagaagcccgucauggucaucggcaccugcaccugccacaccaacugccccaagaacaacgaggccuuccuccaggagcucgagcucaagaccacccgcggcaagauguga

SEQ ID NO: 46770 - RNA, 1584 nt, Artificial Sequence
  derived and/or modified sequence opt2 from NOX1__Homo_sapiens__NP_001258744
augggcaacugggucgucaaccacugguucuccguccucuuccucgucgucuggcucggccucaacgucuuccucuucgucgacgccuuccucaaguacgagaaggccgacaaguacuacuacacccgcaagauccucggcuucugcucccgcacccuccgcaagcagcucgaccacaaccucaccuuccacaagcucgucgccuacaugaucugccuccacaccgccauccacaucaucgcccaccucuucaacuucgacugcuacucccgcucccgccaggccaccgacggcucccucgccuccauccucuccucccucucccacgacgagaagaagggcggcuccuggcucaaccccauccagucccgcaacaccaccgucgaguacgucaccuucaccuccaucgccggccucaccggcgucaucaugaccaucgcccucauccucauggucaccuccgccaccgaguucauccgccgcuccuacuucgaggucuucugguacacccaccaccucuucaucuucuacauccucggccucggcauccacggcaucggcggcaucguccgcggccagaccgaggaguccaugaacgagucccacccccgcaagugcgccgaguccuucgagaugugggacgaccgcgacucccacugccgccgccccaaguucgagggccacccccccgaguccuggaaguggauccucgcccccgucauccucuacaucugcgagcgcauccuccgcuucuaccgcucccagcagaaggucgucaucaccaaggucgucaugcaccccuccaagguccucgagcuccagaugaacaagcgcggcuucuccauggaggucggccaguacaucuucgucaacugccccuccaucucccuccucgaguggcaccccuucacccucaccuccgcccccgaggaggacuucuucuccauccacauccgcgccgccggcgacuggaccgagaaccucauccgcgccuucgagcagcaguacucccccaucccccgcaucgaggucgacggccccuucggcaccgccuccgaggacgucuuccaguacgaggucgccguccucgucggcgccggcaucggcgucacccccuucgccuccauccucaaguccaucugguacaaguuccagugcgccgaccacaaccucaagaccaagaagaucuacuucuacuggaucugccgcgagaccggcgccuucuccugguucaacaaccuccucaccucccucgagcaggagauggaggagcucggcaaggucggcuuccucaacuaccgccucuuccucaccggcugggacuccaacaucgucggccacgccgcccucaacuucgacaaggccaccgacaucgucaccggccucaagcagaagaccuccuucggccgccccaugugggacaacgaguucuccaccaucgccaccucccaccccaaguccgucgucggcgucuuccucugcggcccccgcacccucgccaagucccuccgcaagugcugccaccgcuacuccucccucgacccccgcaagguccaguucuacuucaacaaggagaacuucuga

SEQ ID NO: 46771 - RNA, 1707 nt, Artificial Sequence
  derived and/or modified sequence opt2 from NOX3__Homo_sapiens__NP_056533
augaugggcugcuggauccucaacgagggccucuccaccauccucguccucuccuggcucggcaucaacuucuaccucuucaucgacaccuucuacugguacgaggaggaggaguccuuccacuacacccgcgucauccucggcuccacccucgccugggcccgcgccuccgcccucugccucaacuucaacugcaugcucauccucauccccgucucccgcaaccucaucuccuucauccgcggcaccuccaucugcugccgcggccccuggcgccgccagcucgacaagaaccuccgcuuccacaagcucgucgccuacggcaucgccgucaacgccaccauccacaucgucgcccacuucuucaaccucgagcgcuaccacuggucccaguccgaggaggcccagggccuccucgccgcccucuccaagcucggcaacacccccaacgaguccuaccucaaccccguccgcaccuuccccaccaacaccaccaccgagcuccuccgcaccaucgccggcgucaccggccucgucaucucccucgcccucguccucaucaugaccuccuccaccgaguucauccgccaggccuccuacgagcucuucugguacacccaccacgucuucaucgucuucuuccucucccucgccauccacggcaccggccgcaucguccgcggccagacccaggacucccucucccuccacaacaucaccuucugccgcgaccgcuacgccgaguggcagaccgucgcccagugccccgucccccaguucuccggcaaggagcccuccgccuggaaguggauccucggccccgucguccucuacgccugcgagcgcaucauccgcuucuggcgcuuccagcaggaggucgucaucaccaaggucgucucccaccccuccggcguccucgagcuccacaugaagaagcgcggcuucaagauggcccccggccaguacauccucguccagugccccgccaucuccucccucgaguggcaccccuucacccucaccuccgccccccaggaggacuucuucuccguccacauccgcgccgccggcgacuggaccgccgcccuccucgaggccuucggcgccgagggccaggcccuccaggagcccuggucccucccccgccucgccgucgacggccccuucggcaccgcccucaccgacgucuuccacuaccccgucugcgucugcgucgccgccggcaucggcgucacccccuucgccgcccuccucaaguccaucugguacaagugcuccgaggcccagaccccccucaagcucuccaaggucuacuucuacuggaucugccgcgacgcccgcgccuucgagugguucgccgaccuccuccucucccucgagacccgcauguccgagcagggcaagacccacuuccucuccuaccacaucuuccucaccggcugggacgagaaccaggcccuccacaucgcccuccacugggacgagaacaccgacgucaucaccggccucaagcagaagaccuucuacggccgccccaacuggaacaacgaguucaagcagaucgccuacaaccaccccuccuccuccaucggcgucuucuucugcggccccaaggcccucucccgcacccuccagaagaugugccaccucuacuccuccgccgacccccgcggcguccacuucuacuacaacaaggaguccuucuga

SEQ ID NO: 46772 - RNA, 1617 nt, Artificial Sequence
  derived and/or modified sequence opt2 from NOX4__Homo_sapiens__NP_001137308
auggccgucuccuggcgcuccuggcucgccaacgagggcgucaagcaccucugccucuucaucuggcucuccaugaacguccuccucuucuggaagaccuuccuccucuacaaccagggccccgaguaccacuaccuccaccagaugcucggccucggccucugccucucccgcgccuccgccuccguccucaaccucaacugcucccucauccuccuccccaugugccgcacccuccucgccuaccuccgcggcucccagaagguccccucccgccgcacccgccgccuccucgacaagucccgcaccuuccacaucaccugcggcgucaccaucugcaucuucuccggcguccacgucgccgcccaccucgucaacgcccucaacuucuccgucaacuacuccgaggacuucgucgagcucaacgccgcccgcuaccgcgacgaggacccccgcaagcuccucuucaccaccguccccggccucaccggcgucugcauggucgucguccucuuccucaugaucaccgccuccaccuacgccauccgcgucuccaacuacgacaucuucugguacacccacaaccucuucuucgucuucuacaugcuccucacccuccacgucuccggcggccuccucaaguaccagaccaaccucgacacccacccccccggcugcaucucccucaaccgcaccuccucccagaacaucucccuccccgaguacuucuccgagcacuuccacgagcccuuccccgagggcuucuccaagcccgccgaguucacccagcacaaguucgucaagaucugcauggaggagccccgcuuccaggccaacuucccccagaccuggcucuggaucuccggcccccucugccucuacugcgccgagcgccucuaccgcuacauccgcuccaacaagcccgucaccaucaucuccgucaucucccaccccuccgacgucauggagauccgcauggucaaggagaacuucaaggcccgccccggccaguacaucacccuccacugccccuccgucuccgcccucgagaaccaccccuucacccucaccaugugccccaccgagaccaaggccaccuucggcguccaccucaagaucgucggcgacuggaccgagcgcuuccgcgaccuccuccucccccccuccucccaggacuccgagauccuccccuucauccagucccgcaacuaccccaaggacgacuggaagcccuacaagcuccgccgccucuacuucaucugggucugccgcgacauccaguccuuccgcugguucgccgaccuccucugcaugcuccacaacaaguucuggcaggagaaccgccccgacuacgucaacauccagcucuaccucucccagaccgacggcauccagaagaucaucggcgagaaguaccacgcccucaacucccgccucuucaucggccgcccccgcuggaagcuccucuucgacgagaucgccaaguacaaccgcggcaagaccgucggcgucuucugcugcggccccaacucccucuccaagacccuccacaagcucuccaaccagaacaacuccuacggcacccgcuucgaguacaacaaggaguccuucuccuga

SEQ ID NO: 46773 - RNA, 2214 nt, Artificial Sequence
  derived and/or modified sequence opt2 from NOX5__Homo_sapiens__NP_001171708
augaacaccuccggcgaccccgcccagaccggccccgagggcugccgcggcaccauguccgccgaggaggacgcccgcuggcuccgcugggucacccagcaguucaagaccaucgccggcgaggacggcgagaucucccuccaggaguucaaggccgcccuccacgucaaggaguccuucuucgccgagcgcuucuucgcccucuucgacuccgaccgcuccggcaccaucacccuccaggagcuccaggaggcccucacccuccucauccacggcucccccauggacaagcucaaguuccucuuccaggucuacgacaucgacggcuccggcuccaucgaccccgacgagcuccgcaccguccuccaguccugccuccgcgaguccgccaucucccuccccgacgagaagcucgaccagcucacccucgcccucuucgaguccgccgacgccgacggcaacggcgccaucaccuucgaggagcuccgcgacgagcuccagcgcuuccccggcgucauggagaaccucaccaucuccgccgcccacuggcucaccgcccccgccccccgcccccgcccccgccgcccccgccagcucacccgcgccuacuggcacaaccaccgcucccagcucuucugccucgccaccuacgccggccuccacguccuccucuucggccucgccgccuccgcccaccgcgaccucggcgccuccgucauggucgccaagggcugcggccagugccucaacuucgacugcuccuucaucgccguccucaugcuccgccgcugccucaccuggcuccgcgccaccuggcucgcccagguccucccccucgaccagaacauccaguuccaccagcucaugggcuacgucgucgucggccucucccucguccacaccgucgcccacaccgucaacuucguccuccaggcccaggccgaggccucccccuuccaguucugggagcuccuccucaccacccgccccggcaucggcuggguccacggcuccgccucccccaccggcgucgcccuccuccuccuccuccuccucauguucaucugcuccuccuccugcauccgccgcuccggccacuucgaggucuucuacuggacccaccucuccuaccuccucgucuggcuccuccucaucuuccacggccccaacuucuggaaguggcuccucguccccggcauccucuucuuccucgagaaggccaucggccucgccgucucccgcauggccgccgucugcaucauggaggucaaccuccuccccuccaaggucacccaccuccucaucaagcgcccccccuucuuccacuaccgccccggcgacuaccucuaccucaacauccccaccaucgcccgcuacgaguggcaccccuucaccaucuccuccgcccccgagcagaaggacaccaucuggcuccacauccgcucccagggccaguggaccaaccgccucuacgaguccuucaaggccuccgacccccucggccgcggcuccaagcgccucucccgcuccgucaccaugcgcaagucccagcgcuccuccaagggcuccgagauccuccucgagaagcacaaguucugcaacaucaagugcuacaucgacggccccuacggcacccccacccgccgcaucuucgccuccgagcacgccguccucaucggcgccggcaucggcaucacccccuucgccuccauccuccaguccaucauguaccgccaccagaagcgcaagcacaccugccccuccugccagcacuccuggaucgagggcguccaggacaacaugaagcuccacaaggucgacuucaucuggaucaaccgcgaccagcgcuccuucgagugguucgucucccuccucaccaagcucgagauggaccaggccgaggaggcccaguacggccgcuuccucgagcuccacauguacaugaccuccgcccucggcaagaacgacaugaaggccaucggccuccagauggcccucgaccuccucgccaacaaggagaagaaggacuccaucaccggccuccagacccgcacccagcccggccgccccgacugguccaaggucuuccagaaggucgccgccgagaagaagggcaagguccaggucuucuucugcggcucccccgcccucgccaagguccucaagggccacugcgagaaguucggcuuccgcuucuuccaggagaacuucuga

SEQ ID NO: 46774 - RNA, 1284 nt, Artificial Sequence
  derived and/or modified sequence opt2 from NOXA1__Homo_sapiens__NP_001242997
auggccucccucggcgaccucguccgcgccuggcaccucggcgcccaggccgucgaccgcggcgacugggcccgcgcccuccaccucuucuccggcguccccgccccccccgcccgccucugcuucaacgccggcugcguccaccuccucgccggcgaccccgaggccgcccuccgcgccuucgaccaggccgucaccaaggacaccugcauggccgucggcuucuuccagcgcggcgucgccaacuuccagcucgcccgcuuccaggaggcccucuccgacuucuggcucgcccucgagcagcuccgcggccacgccgccaucgacuacacccagcucggccuccgcuucaagcuccaggccugggagguccuccacaacgucgccuccgcccagugccagcucggccucuggaccgaggccgccuccucccuccgcgaggccauguccaaguggcccgagggcucccucaacggccucgacuccgcccucgaccagguccagggccccggcgccaaccacgacgcccgcucccucaucauggacuccccccgcgccggcacccaccagggcccccucgacgccgagaccgaggucggcgccgaccgcugcaccuccaccgccuaccaggagcagcgcccccaggucgagcaggucggcaagcaggccccccucucccccggccuccccgccaugggcggccccggccccggccccugcgaggaccccgccggcgccggcggcgccggcgccggcggcuccgagccccucgucaccgucaccguccagugcgccuucaccgucgcccuccgcgcccgccgcggcgccgaccucuccucccuccgcgcccuccucggccaggcccucccccaccaggcccagcucggccagcucuccuaccucgcccccggcgaggacggccacuggguccccauccccgaggaggagucccuccagcgcgccuggcaggacgccgccgccugcccccgcggccuccagcuccagugccgcggcgccggcggccgccccguccucuaccaggucgucgcccagcacuccuacuccgcccagggccccgaggaccucggcuuccgccagggcgacaccgucgacguccucugcgaggagcccgacgucccccucgccgucgaccaggccuggcucgagggccacugcgacggccgcaucggcaucuuccccaagugcuucgucguccccgccggcccccgcauguccggcgcccccggccgccucccccgcucccagcagggcgaccagcccuga

SEQ ID NO: 46775 - RNA, 1113 nt, Artificial Sequence
  derived and/or modified sequence opt2 from NOXO1__Homo_sapiens__NP_653204
auggccggcccccgcuaccccgucuccguccagggcgccgcccucguccagaucaagcgccuccagaccuucgccuucuccguccgcugguccgacggcuccgacaccuucguccgccgcuccugggacgaguuccgccagcucaagacccucaaggagaccuuccccgucgaggccggccuccuccgccgcuccgaccgcguccuccccaagcuccucgacgccccccuccucggccgcgucggccgcaccucccgcggccucgcccgccuccagcuccucgagaccuacucccgccgccuccucgccaccgccgagcgcgucgcccgcucccccaccaucaccggcuucuucgccccccagccccucgaccucgagcccgcccucccccccggcucccgcgucauccuccccacccccgaggagcagccccucucccgcgccgccggccgccucuccauccacucccucgaggcccagucccuccgcugccuccagcccuucugcacccaggacacccgcgaccgccccuuccaggcccaggcccaggagucccucgacguccuccuccgccaccccuccggcugguggcucgucgagaacgaggaccgccagaccgccugguuccccgcccccuaccucgaggaggccgcccccggccagggccgcgagggcggccccucccucggcuccuccggcccccaguucugcgccucccgcgccuacgaguccucccgcgccgacgagcucuccguccccgccggcgcccgcguccgcguccucgagaccuccgaccgcggcugguggcucugccgcuacggcgaccgcgccggccuccuccccgccguccuccuccgccccgagggccucggcgcccuccucuccggcaccggcuuccgcggcggcgacgaccccgccggcgaggcccgcggcuuccccgagcccucccaggccaccgcccccccccccaccguccccacccgccccucccccggcgccauccagucccgcugcugcaccgucacccgccgcgcccucgagcgccgcccccgccgccagggccgcccccgcggcugcgucgacuccgucccccaccccaccaccgagcaguga

SEQ ID NO: 46776 - RNA, 3471 nt, Artificial Sequence
  derived and/or modified sequence opt2 from NPAP1__Homo_sapiens__NP_061831
augggcaaccuccucuccaaguuccgccccggcugccgccgccgcccccuccccggccccggccgcggcgcccccgccccccucucccgcgacgccuccccccccggccgcgcccacuccguccccaccccccgccccuuccgcggccucuuccgccgcaacgcccgccgccgccccuccgccgccuccaucuucgucgcccccaagcgccccugcccccucccccgcgccgccgccgccccccucggcguccuccccgccgucggcuggggccucgccauccgcaagacccccaugcuccccgcccgcaaccccccccgcuucggccaccccuccuccguccgcauccccccccccucccgcauguucacccuccuccuccccuccccccgcgagcccgccgucaaggcccgcaagcccauccccgccacccuccucgaggagaccgaggucugggcccaggagggcccccgccgcgucaagaaggacgaggaccccguccagaucgagggcgaggacgacgagaagcgcaccccccucuccuccggcgaggccuccuccaccucccgcucccagggcacccagggcgacgucgccuccuuccgcugcucccccggcccccucgagggcaacgucuaccacaaguucuccgagaacuccauguccgagaaggcccaggccucccccgccuccuccugccucgagggccccgccaugcccuccacccacucccaggccggcugcgcccgccaccucggcaagcccgaccccgacgccaccgccccccccgagcccgccgucggcugcucccuccuccagcagaagcucgccgccgagguccucaacgaggagcccccccccuccucccucggccuccccaucccccucauguccggcaagcgcaugcccgacgagaagcccuucugcauccccccccgcuccgccgcccccccccgcgccgcccgcaaccgccccugcaagcgcaagauguccaucccccuccuccucccccucccccccucccucccccuccucugggaccgcggcgagcuccccccccccgccaagcuccccugccucuccgucgagggcgaccuccacacccucgagaagucccccgaguacaagcgcaacucccgcauccucgaggacaagaccgagaccaugaccaacuccuccaucacccagcccgcccccuccuucucccagcccguccagaccaccgacucccucccccucaccaccuacaccucccaggucuccgccccccuccccauccccgaccucgccgaccucgccaccggcccccucauccuccccauccccccccucuccaccacccccaagauggacgagaagaucgccuucaccauccccaacuccccccucgcccuccccgccgaccucguccccauccucggcgaccaguccaacgagaagggcggcuccuacaacuccgucgucggcgccgccccccucaccuccgacccccccaccccccccuccuccacccccuccuucaagccccccgucacccgcgagucccccaucuccaugugcgucgacuccccccccccccucuccuuccucacccuccuccccguccccuccaccggcaccuccgucaucaccuccaagcccaugaacuccaccuccgucaucuccaccgucaccaccaacgccuccgcccaccucaccucccagaccgccgucgaccccgaggucgucaacauggacaccaccgcccccucccaggucgucaucuucaccuccucccucuccucccgcgucuccucccuccccaacucccagauccacugcuccgccgagcagcgccaccccggcaagaccuccgucuacaccuccccccuccccuucaucuuccacaacaccacccccuccuucaaccagcucuucggcaaggaggccaccccccagcccaaguucgaggcccccgacggccagccccagaaggccucccuccccuccgccugcgucuuccucucccuccccaucauccccccccccgacaccuccacccucgucaacuccgccuccaccgccuccuccuccaagccccccaucgagaccaacgccaugcacaccaccccccccuccaaggccgucauccuccaguccgccuccgucuccaagaaguaccuccccuucuaccucggccuccccggcuccggcaacacccagcccuccggcaacaccgccuccguccagggcuccaccucccuccccgcccaguccguccgcgcccccgccaccgccuccaaccacccccucaaccccggcgccaccccccagcccaaguucggcgcccccgacggcccccagcagaagaccucccuccccuccgcccacgacuuccucucccuccccaucauggucccccccgacaccuccacccucgucuccuccgccuccgccgccucccucuccaagcccgccaucgacaccuccgacaugaacaccaccccccccuccaagaccgucauccuccaguccaccuucgucucccgcaaggaggaguacauccgcuucuacaugggccuccccggcuccggcaacacccuccacuccgacuccaucgccuccgcccaggucuccaccuccuuccccgcccaggccgaccgccgccccaccaccaccuccucccacccccucaacaccggcuccaucucccacuccacccucggcgccaccgacggccagcagaaguccgacuccuccuucauccucggcaaccccgccacccccgcccccgucaucggccucaccucccccuccguccagccccucuccggcuccaucaucccccccggcuucgccgagcucaccucccccuacaccgcccucggcacccccgucaacgccgagcccgucgagggccacaacgccuccgccuuccccaacggcaccgccaagaccuccggcuuccgcaucgccaccggcaugcccggcaccggcgacuccacccuccucgucggcaacaccauccccggcccccaggucaucaugggccccggcacccccauggacggcggcuccaucggcuucuccauguccgcccccggccccuccuccaccuccggcgagcucaacaucggccagggccaguccggcacccccuccaccaccuccgucuuccccuucggccaggccgccugggaccccaccggccacuccauggccgccgccccccagggcgccuccaacauccccgucuucggcuacaccuccgccgccgccuacauccccggccucgacccccccacccagaacuccugcuccggcaugggcggcgacggcacccgcuccaucgucggcggccccugcguccccgccuuccagcagugcauccuccagcacaccuggaccgagcgcaaguucuacaccuccuccacccacuacuacggccaggagaccuacguccgccgccacgucugcuuccagcuccccuga

SEQ ID NO: 46777 - RNA, 2475 nt, Artificial Sequence
  derived and/or modified sequence opt2 from NPAS2__Homo_sapiens__NP_002509
auggacgaggacgagaaggaccgcgccaagcgcgccucccgcaacaaguccgagaagaagcgccgcgaccaguucaacguccucaucaaggagcucuccuccaugcuccccggcaacacccgcaagauggacaagaccaccguccucgagaaggucaucggcuuccuccagaagcacaacgaggucuccgcccagaccgagaucugcgacauccagcaggacuggaagcccuccuuccucuccaacgaggaguucacccagcucaugcucgaggcccucgacggcuucaucaucgccgucaccaccgacggcuccaucaucuacgucuccgacuccaucaccccccuccucggccaccuccccuccgacgucauggaccagaaccuccucaacuuccuccccgagcaggagcacuccgaggucuacaagauccucuccucccacaugcucgucaccgacucccccucccccgaguaccucaaguccgacuccgaccucgaguucuacugccaccuccuccgcggcucccucaaccccaaggaguuccccaccuacgaguacaucaaguucgucggcaacuuccgcuccuacaacaacguccccucccccuccugcaacggcuucgacaacacccucucccgccccugccgcgucccccucggcaaggaggucugcuucaucgccaccguccgccucgccaccccccaguuccucaaggagaugugcaucgucgacgagccccucgaggaguucaccucccgccacucccucgaguggaaguuccucuuccucgaccaccgcgccccccccaucaucggcuaccuccccuucgagguccucggcaccuccggcuacgacuacuaccacaucgacgaccucgagcuccucgcccgcugccaccagcaccucaugcaguucggcaagggcaaguccugcugcuaccgcuuccucaccaagggccagcaguggaucuggcuccagacccacuacuacaucaccuaccaccaguggaacuccaagcccgaguucaucgucugcacccacuccgucgucuccuacgccgacguccgcgucgagcgccgccaggagcucgcccucgaggacccccccuccgaggcccuccacuccuccgcccucaaggacaagggcuccucccucgagccccgccagcacuucaacacccucgacgucggcgccuccggccucaacaccucccacucccccuccgccuccucccgcuccucccacaaguccucccacaccgccauguccgagcccaccuccacccccaccaagcucauggccgaggccuccacccccgcccucccccgcuccgccacccucccccaggagcuccccguccccggccucucccaggccgccaccaugcccgccccccuccccucccccuccuccugcgaccucacccagcagcuccucccccagaccguccuccaguccacccccgcccccauggcccaguucuccgcccaguucuccauguuccagaccaucaaggaccagcucgagcagcgcacccgcauccuccaggccaacauccgcuggcagcaggaggagcuccacaagauccaggagcagcucugccucguccaggacuccaacguccagauguuccuccagcagcccgccgucucccucuccuucuccuccacccagcgccccgaggcccagcagcagcuccagcagcgcuccgccgccgucacccagccccagcucggcgccggcccccagcuccccggccagaucuccuccgcccaggucaccucccagcaccuccuccgcgaguccuccgucaucuccacccagggccccaagcccaugcgcuccucccagcucaugcaguccuccggccgcuccggcuccucccucgucucccccuucuccuccgccaccgccgcccucccccccucccucaaccucaccacccccgccuccaccucccaggacgccucccagugccagcccucccccgacuucucccacgaccgccagcuccgccuccuccucucccagcccauccagcccaugaugcccggcuccugcgacgcccgccagcccuccgaggucucccgcaccggccgccaggucaaguacgcccagucccagaccgucuuccagaaccccgacgcccaccccgccaacuccuccuccgcccccaugcccguccuccucaugggccaggccguccuccaccccuccuuccccgccucccagcccuccccccuccagcccgcccaggcccgccagcagcccccccagcacuaccuccagguccaggcccccaccucccuccacuccgagcagcaggacucccuccuccucuccaccuacucccagcagcccggcacccucggcuacccccagcccccccccgcccagccccagccccuccgccccccccgccgcgucuccucccucuccgaguccuccggccuccagcagcccccccgcuga

SEQ ID NO: 46778 - RNA, 2802 nt, Artificial Sequence
  derived and/or modified sequence opt2 from NPAS3__Homo_sapiens__NP_001158221
auggcccccaccaagcccuccuuccagcaggaccccucccgccgcgagcgcaucaccgcccagcacccccuccccaaccaguccgagugccgcaagaucuaccgcuacgacggcaucuacugcgaguccaccuaccagaaccuccaggcccuccgcaaggagaagucccgcgacgccgcccgcucccgccgcggcaaggagaacuucgaguucuacgagcucgccaagcuccucccccuccccgccgccaucaccucccagcucgacaaggccuccaucauccgccucaccaucuccuaccucaagaugcgcgacuucgccaaccagggcgacccccccuggaaccuccgcauggagggccccccccccaacaccuccgucaaggucaucggcgcccagcgccgccgcucccccuccgcccucgccaucgaggucuucgaggcccaccucggcucccacauccuccagucccucgacggcuucgucuucgcccucaaccaggagggcaaguuccucuacaucuccgagaccgucuccaucuaccucggccucucccaggucgagcucaccggcuccuccgucuucgacuacguccaccccggcgaccacgucgagauggccgagcagcucggcaugaagcucccccccggccgcggccuccucucccagggcaccgccgaggacggcgccuccuccgccuccuccuccucccaguccgagacccccgagcccgucgaguccaccucccccucccuccucaccaccgacaacacccucgagcgcuccuucuucauccgcaugaaguccacccucaccaagcgcggcguccacaucaaguccuccggcuacaaggucauccacaucaccggccgccuccgccuccgcgucucccucucccacggccgcaccguccccucccagaucaugggccucgucgucgucgcccacgcccuccccccccccaccaucaacgagguccgcaucgacugccacauguucgucacccgcgucaacauggaccucaacaucaucuacugcgagaaccgcaucuccgacuacauggaccucacccccgucgacaucgucggcaagcgcugcuaccacuucauccacgccgaggacgucgagggcauccgccacucccaccucgaccuccucaacaagggccagugcgucaccaaguacuaccgcuggaugcagaagaacggcggcuacaucuggauccaguccuccgccaccaucgccaucaacgccaagaacgccaacgagaagaacaucaucugggucaacuaccuccucuccaaccccgaguacaaggacacccccauggacaucgcccagcucccccaccuccccgagaagaccuccgaguccuccgagaccuccgacuccgaguccgacuccaaggacaccuccggcaucaccgaggacaacgagaacuccaaguccgacgagaagggcaaccaguccgagaacuccgaggaccccgagcccgaccgcaagaaguccggcaacgccugcgacaacgacaugaacugcaacgacgacggccacuccuccuccaaccccgacucccgcgacuccgacgacuccuucgagcacuccgacuucgagaaccccaaggccggcgaggacggcuucggcgcccucggcgccaugcagaucaaggucgagcgcuacgucgaguccgaguccgaccuccgccuccagaacugcgagucccucaccuccgacuccgccaaggacuccgacuccgccggcgaggccggcgcccaggccuccuccaagcaccagaagcgcaagaagcgccgcaagcgccagaagggcggcuccgccucccgccgccgccucuccuccgccuccucccccggcggccucgacgccggccucgucgagcccccccgccuccucuccucccccaacuccgccuccguccucaagaucaagaccgagaucuccgagcccaucaacuucgacaacgacuccuccaucuggaacuacccccccaaccgcgagaucucccgcaacgagucccccuacuccaugaccaagccccccuccuccgagcacuuccccuccccccagggcggcggcggcggcggcggcggcggcggcggccuccacgucgccauccccgacuccguccucaccccccccggcgccgacggcgccgccgcccgcaagacccaguucggcgccuccgccaccgccgcccucgcccccgucgccuccgacccccucucccccccccucuccgccuccccccgcgacaagcaccccggcaacggcggcggcggcggcggcggcggcggcggcgccggcggcggcggccccuccgccuccaacucccuccucuacaccggcgaccucgaggcccuccagcgccuccaggccggcaacgucguccucccccucguccaccgcgucaccggcacccucgccgccaccuccaccgccgcccagcgcgucuacaccaccggcaccauccgcuacgcccccgccgaggucacccucgccaugcaguccaaccuccuccccaacgcccacgccgucaacuucgucgacgucaacucccccggcuucggccucgaccccaagacccccauggagaugcucuaccaccacguccaccgccucaacauguccggccccuucggcggcgccgucuccgccgccucccucacccagaugcccgccggcaacgucuucaccaccgccgagggccucuucuccacccuccccuuccccgucuacuccaacggcauccacgccgcccagacccucgagcgcaaggaggacuga

SEQ ID NO: 46779 - RNA, 2409 nt, Artificial Sequence
  derived and/or modified sequence opt2 from NPAS4__Homo_sapiens__NP_849195
auguaccgcuccaccaagggcgccuccaaggcccgccgcgaccagaucaacgccgagauccgcaaccucaaggagcuccucccccucgccgaggccgacaagguccgccucuccuaccuccacaucaugucccucgccugcaucuacacccgcaagggcgucuucuucgccggcggcaccccccucgccggccccaccggccuccucuccgcccaggagcucgaggacaucgucgccgcccuccccggcuuccuccucgucuucaccgccgagggcaagcuccucuaccucuccgaguccgucuccgagcaccucggccacuccauggucgaccucgucgcccagggcgacuccaucuacgacaucaucgaccccgccgaccaccucaccguccgccagcagcucacccuccccuccgcccucgacaccgaccgccucuuccgcugccgcuucaacaccuccaagucccuccgccgccaguccgccggcaacaagcucguccucauccgcggccgcuuccacgcccacccccccggcgccuacugggccggcaaccccgucuucaccgccuucugcgccccccucgagccccgcccccgccccggccccggccccggccccggccccgccucccucuuccucgccauguuccagucccgccacgccaaggaccucgcccuccucgacaucuccgaguccguccucaucuaccucggcuucgagcgcuccgagcuccucugcaaguccugguacggccuccuccaccccgaggaccucgcccacgccuccgcccagcacuaccgccuccucgccgaguccggcgacauccaggccgagauggucguccgccuccaggccaagaccggcggcugggccuggaucuacugccuccucuacuccgagggccccgagggccccaucaccgccaacaacuaccccaucuccgacauggaggccuggucccuccgccagcagcucaacuccgaggacacccaggccgccuacguccucggcacccccaccaugcuccccuccuuccccgagaacauccucucccaggaggagugcuccuccaccaacccccucuucaccgccgcccucggcgccccccgcuccaccuccuuccccuccgcccccgagcucuccgucgucuccgccuccgaggagcucccccgccccuccaaggagcucgacuucuccuaccucaccuuccccuccggccccgagcccucccuccaggccgagcucuccaaggaccucgucugcaccccccccuacaccccccaccagcccggcggcugcgccuuccucuucucccuccacgagcccuuccagacccaccuccccacccccuccuccacccuccaggagcagcucacccccuccaccgccaccuucuccgaccagcucacccccuccuccgccaccuuccccgacccccucaccuccccccuccagggccagcucaccgagaccuccguccgcuccuacgaggaccagcucacccccugcaccuccaccuuccccgaccagcuccuccccuccaccgccaccuuccccgagccccucggcucccccgcccacgagcagcucaccccccccuccaccgccuuccaggcccaccucgacucccccucccagaccuuccccgagcagcucucccccaaccccaccaagaccuacuucgcccaggagggcugcuccuuccucuacgagaagcucccccccucccccuccucccccggcaacggcgacugcacccuccucgcccucgcccagcuccgcggcccccucuccgucgacgucccccucguccccgagggccuccucacccccgaggccucccccgucaagcaguccuucuuccacuacuccgagaaggagcagaacgagaucgaccgccucauccagcagaucucccagcucgcccagggcauggaccgccccuucuccgccgaggccggcaccggcggccucgagccccucggcggccucgagccccucgacuccaaccucucccucuccggcgccggcccccccguccucucccucgaccucaagcccuggaagugccaggagcucgacuuccucgccgaccccgacaacauguuccucgaggagacccccgucgaggacaucuucauggaccucuccacccccgaccccuccgaggaguggggcuccggcgaccccgaggccgagggccccggcggcgcccccucccccugcaacaaccucucccccgaggaccacuccuuccucgaggaccucgccaccuacgagaccgccuucgagaccggcgucuccgccuuccccuacgacggcuucaccgacgagcuccaccagcuccagucccagguccaggacuccuuccacgaggacggcuccggcggcgagcccaccuucuga

SEQ ID NO: 46780 - RNA, 4284 nt, Artificial Sequence
  derived and/or modified sequence opt2 from NPAT__Homo_sapiens__NP_002510
augcuccuccccuccgacgucgcccgccucguccucggcuaccuccagcaggagaaccucaucuccaccugccagaccuucauccucgaguccuccgaccucaaggaguacgccgagcacugcaccgacgagggcuucauccccgccugccuccucucccucuucggcaagaaccucaccaccauccucaacgaguacgucgccaugaagaccaaggagaccuccaacaacguccccgccaucauguccucccucuggaagaagcucgaccacacccucucccagauccgcuccaugcaguccuccccccgcuucgccggcucccagcgcgcccgcacccgcaccggcaucgccgagaucaagcgccagcgcaagcucgccucccagaccgcccccgccuccgccgagcuccucacccuccccuaccucuccggccaguucaccaccccccccuccaccggcacccaggucacccgccccuccggccagaucuccgaccccucccgcuccuacuucgucgucgucaaccacucccagucccaggacaccgucaccaccggcgaggcccucaacgucauccccggcgcccaggagaagaaggcccacgccucccucaugucccccggccgccgcaaguccgagucccagcgcaaguccaccacccucuccggcccccacuccaccauccgcaacuuccaggaccccaacgccuucgccgucgagaagcagauggucaucgagaacgcccgcgagaagauccucuccaacaagucccuccaggagaagcucgccgagaacaucaacaaguuccucaccuccgacaacaacaucgcccagguccccaagcagaccgacaacaaccccaccgagcccgagaccuccaucgacgaguuccucggccuccccuccgagauccacauguccgaggaggccauccaggacauccucgagcagaccgaguccgaccccgccuuccaggcccucuucgaccucuucgacuacggcaagaccaagaacaacaagaacaucucccaguccaucuccucccagcccauggaguccaaccccuccaucguccucgccgacgagaccaaccucgccgucaagggcuccuucgagaccgaggaguccgacggccaguccggccagcccgccuucugcaccuccuaccagaacgacgacccccucaacgcccucaagaacuccaacaaccacgacguccuccgccaggaggaccaggagaacuucucccagaucuccaccuccauccagaagaaggccuucaagaccgccguccccaccgagcagaagugcgacaucgacaucaccuucgaguccguccccaaccucaacgacuucaaccagcgcggcaacuccaacgccgagugcaacccccacugcgccgagcucuacaccaaccagauguccaccgagaccgagauggccaucggcaucgagaagaacucccucuccuccaacguccccuccgagucccagcuccagcccgaccagcccgacauccccaucaccuccuucgucucccucggcugcgaggccaacaacgagaaccucauccucuccggcaaguccucccagcuccucucccaggacaccucccucaccggcaagcccuccaagaagucccaguucugcgagaacuccaacgacaccgucaagcucaagaucaacuuccacggcuccaaguccuccgacuccuccgagguccacaaguccaagaucgagaucaacguccucgagcccgucaugucccagcucuccaacugccaggacaacuccugccuccaguccgagauccuccccgucuccgucgaguccucccaccucaacgucuccggccaggucgagauccaccucggcgacucccucuccuccaccaagcagcccuccaacgacuccgccuccgucgagcucaaccacaccgagaacgaggcccaggccuccaaguccgagaacucccaggagcccuccuccuccgucaaggaggagaacaccaucuuccucucccucggcggcaacgccaacugcgagaaggucgcccucaccccccccgagggcacccccgucgagaacucccacucccucccccccgaguccgucugcuccuccgucggcgacucccaccccgagucccagaacaccgacgacaagcccuccuccaacaacuccgccgagaucgacgccuccaacaucgucucccucaaggucaucaucuccgacgaccccuucgucuccuccgacaccgagcucaccuccgccgucuccuccaucaacggcgagaaccuccccaccaucauccucuccucccccaccaagucccccaccaagaacgccgagcucgucaagugccucuccuccgaggagaccgucggcgccgucgucuacgccgaggucggcgacuccgccuccauggagcagucccuccucaccuucaaguccgaggacuccgccgucaacaacacccagaacgaggacggcaucgccuucuccgccaacgucacccccugcgucuccaaggacggcggcuacauccagcucaugcccgccaccuccaccgccuucggcaacuccaacaacauccucaucgccaccugcgucaccgaccccaccgcccucggcaccuccgucucccaguccaacgucgucguccuccccggcaacuccgcccccaugaccgcccagccccuccccccccagcuccagacccccccccgcuccaacuccgucuucgccgucaaccaggccgucucccccaacuucucccagggcuccgccaucaucaucgccucccccguccagcccguccuccagggcauggucggcaugauccccgucuccgucgucggccagaacggcaacaacuucuccacccccccccgccagguccuccacaugccccucaccgcccccgucugcaaccgcuccaucccccaguuccccgucccccccaagucccagaaggcccagggccuccgcaacaagcccugcaucggcaagcaggucaacaaccucgucgacuccuccggccacuccgucggcugccacgcccagaagaccgaggucuccgacaaguccaucgccaccgaccucggcaagaaguccgaggagaccaccguccccuuccccgaggaguccaucguccccgccgccaagcccugccaccgccgcguccucugcuucgacuccaccaccgcccccgucgccaacacccagggccccaaccacaagauggucucccagaacaaggagcgcaacgccgucuccuuccccaaccucgacucccccaacgucuccuccacccucaagccccccuccaacaacgccaucaagcgcgagaaggagaagcccccccuccccaagauccucuccaaguccgaguccgccaucucccgccacaccaccauccgcgagacccaguccgagaagaaggucucccccaccgagaucguccucgaguccuuccacaaggccaccgccaacaaggagaacgagcucugcuccgacgucgagcgccagaagaaccccgagaacuccaagcucuccaucggccagcagaacggcggccuccgcuccgagaaguccaucgccucccuccaggagaugaccaagaagcagggcaccuccuccaacaacaagaacguccucuccgucggcaccgccgucaaggaccucaagcaggagcagaccaaguccgccuccucccucaucaccaccgagaugcuccaggacauccagcgccacuccuccgucucccgccucgccgacuccuccgaccuccccgucccccgcacccccggcuccggcgccggcgagaagcacaaggaggagcccaucgacaucaucaaggcccccuccucccgccgcuucuccgaggacuccuccaccuccaaggucauggucccccccgucacccccgaccuccccgccugcucccccgccuccgagaccggcuccgagaacuccgucaacauggccgcccacacccucaugauccucucccgcgccgccaucucccgcaccaccuccgccaccccccucaaggacaacacccagcaguuccgcgccuccucccgcuccaccaccaagaagcgcaagaucgaggagcucgacgagcgcgagcgcaacucccgccccuccuccaagaaccucaccaacuccuccauccccaugaagaagaagaagaucaagaagaagaagcuccccuccuccuuccccgccggcauggacgucgacaaguuccuccucucccuccacuacgacgaguga

SEQ ID NO: 46781 - RNA, 378 nt, Artificial Sequence
  derived and/or modified sequence opt2 from NPB__Homo_sapiens__NP_683694
auggcccgcuccgccacccucgccgccgccgcccucgcccucugccuccuccucgccccccccggccucgccugguacaagcccgccgccggccacuccuccuacuccgucggccgcgccgccggccuccucuccggccuccgccgcucccccuacgcccgccgcucccagcccuaccgcggcgccgagccccccggcggcgccggcgccucccccgagcuccagcuccacccccgccuccgcucccucgccgucugcguccaggacgucgcccccaaccuccagcgcugcgagcgccuccccgacggccgcggcaccuaccagugcaaggccaacgucuuccucucccuccgcgccgccgacugccucgccgccuga

SEQ ID NO: 46782 - RNA, 987 nt, Artificial Sequence
  derived and/or modified sequence opt2 from NPBWR1__Homo_sapiens__NP_005276
auggacaacgccuccuucuccgagcccuggcccgccaacgccuccggccccgaccccgcccucuccugcuccaacgccuccacccucgccccccuccccgccccccucgccgucgccguccccgucgucuacgccgucaucugcgccgucggccucgccggcaacuccgccguccucuacguccuccuccgcgccccccgcaugaagaccgucaccaaccucuucauccucaaccucgccaucgccgacgagcucuucacccucguccuccccaucaacaucgccgacuuccuccuccgccaguggcccuucggcgagcucaugugcaagcucaucgucgccaucgaccaguacaacaccuucuccucccucuacuuccucaccgucauguccgccgaccgcuaccucgucguccucgccaccgccgagucccgccgcgucgccggccgcaccuacuccgccgcccgcgccgucucccucgccgucuggggcaucgucacccucgucguccuccccuucgccgucuucgcccgccucgacgacgagcagggccgccgccagugcguccucgucuucccccagcccgaggccuucugguggcgcgccucccgccucuacacccucguccucggcuucgccauccccgucuccaccaucugcguccucuacaccacccuccucugccgccuccacgccaugcgccucgacucccacgccaaggcccucgagcgcgccaagaagcgcgucaccuuccucgucgucgccauccucgccgucugccuccucugcuggacccccuaccaccucuccaccgucgucgcccucaccaccgaccucccccagaccccccucgucaucgccaucuccuacuucaucaccucccucuccuacgccaacuccugccucaaccccuuccucuacgccuuccucgacgccuccuuccgccgcaaccuccgccagcucaucaccugccgcgccgccgccuga

SEQ ID NO: 46783 - RNA, 3837 nt, Artificial Sequence
  derived and/or modified sequence opt2 from NPC1__Homo_sapiens__NP_000262
augaccgcccgcggccucgcccucggccuccuccuccuccuccucugccccgcccaggucuucucccaguccugcgucugguacggcgagugcggcaucgccuacggcgacaagcgcuacaacugcgaguacuccggcccccccaagccccuccccaaggacggcuacgaccucguccaggagcucugccccggcuucuucuucggcaacgucucccucugcugcgacguccgccagcuccagacccucaaggacaaccuccagcucccccuccaguuccucucccgcugccccuccugcuucuacaaccuccucaaccucuucugcgagcucaccugcuccccccgccagucccaguuccucaacgucaccgccaccgaggacuacgucgaccccgucaccaaccagaccaagaccaacgucaaggagcuccaguacuacgucggccaguccuucgccaacgccauguacaacgccugccgcgacgucgaggcccccuccuccaacgacaaggcccucggccuccucugcggcaaggacgccgacgccugcaacgccaccaacuggaucgaguacauguucaacaaggacaacggccaggcccccuucaccaucacccccgucuucuccgacuuccccguccacggcauggagcccaugaacaacgccaccaagggcugcgacgaguccgucgacgaggucaccgcccccugcuccugccaggacugcuccaucgucugcggccccaagccccagcccccccccccccccgcccccuggaccauccucggccucgacgccauguacgucaucauguggaucaccuacauggccuuccuccucgucuucuucggcgccuucuucgccgucuggugcuaccgcaagcgcuacuucgucuccgaguacacccccaucgacuccaacaucgccuucuccgucaacgccuccgacaagggcgaggccuccugcugcgaccccgucuccgccgccuucgagggcugccuccgccgccucuucacccgcuggggcuccuucugcguccgcaaccccggcugcgucaucuucuucucccucgucuucaucaccgccugcuccuccggccucgucuucguccgcgucaccaccaaccccgucgaccucugguccgcccccuccucccaggcccgccucgagaaggaguacuucgaccagcacuucggccccuucuuccgcaccgagcagcucaucauccgcgccccccucaccgacaagcacaucuaccagcccuaccccuccggcgccgacguccccuucggccccccccucgacauccagauccuccaccagguccucgaccuccagaucgccaucgagaacaucaccgccuccuacgacaacgagaccgucacccuccaggacaucugccucgccccccucucccccuacaacaccaacugcaccauccucuccguccucaacuacuuccagaacucccacuccguccucgaccacaagaagggcgacgacuucuucgucuacgccgacuaccacacccacuuccucuacugcguccgcgcccccgccucccucaacgacaccucccuccuccacgaccccugccucggcaccuucggcggccccgucuuccccuggcucguccucggcggcuacgacgaccagaacuacaacaacgccaccgcccucgucaucaccuuccccgucaacaacuacuacaacgacaccgagaagcuccagcgcgcccaggccugggagaaggaguucaucaacuucgucaagaacuacaagaaccccaaccucaccaucuccuucaccgccgagcgcuccaucgaggacgagcucaaccgcgaguccgacuccgacgucuucaccgucgucaucuccuacgccaucauguuccucuacaucucccucgcccucggccacaugaaguccugccgccgccuccucgucgacuccaaggucucccucggcaucgccggcauccucaucguccucuccuccgucgccugcucccucggcgucuucuccuacaucggccucccccucacccucaucgucaucgaggucauccccuuccucguccucgccgucggcgucgacaacaucuucauccucguccaggccuaccagcgcgacgagcgccuccagggcgagacccucgaccagcagcucggccgcguccucggcgaggucgcccccuccauguuccucuccuccuucuccgagaccgucgccuucuuccucggcgcccucuccgucaugcccgccguccacaccuucucccucuucgccggccucgccgucuucaucgacuuccuccuccagaucaccugcuucgucucccuccucggccucgacaucaagcgccaggagaagaaccgccucgacaucuucugcugcguccgcggcgccgaggacggcaccuccguccaggccuccgaguccugccucuuccgcuucuucaagaacuccuacuccccccuccuccucaaggacuggaugcgccccaucgucaucgccaucuucgucggcguccucuccuucuccaucgccguccucaacaaggucgacaucggccucgaccagucccucuccaugcccgacgacuccuacauggucgacuacuucaaguccaucucccaguaccuccacgccggcccccccgucuacuucguccucgaggagggccacgacuacaccuccuccaagggccagaacauggucugcggcggcaugggcugcaacaacgacucccucguccagcagaucuucaacgccgcccagcucgacaacuacacccgcaucggcuucgcccccuccuccuggaucgacgacuacuucgacugggucaagccccaguccuccugcugccgcgucgacaacaucaccgaccaguucugcaacgccuccgucgucgaccccgccugcguccgcugccgcccccucacccccgagggcaagcagcgcccccagggcggcgacuucaugcgcuuccuccccauguuccucuccgacaaccccaaccccaagugcggcaagggcggccacgccgccuacuccuccgccgucaacauccuccucggccacggcacccgcgucggcgccaccuacuucaugaccuaccacaccguccuccagaccuccgccgacuucaucgacgcccucaagaaggcccgccucaucgccuccaacgucaccgagaccaugggcaucaacggcuccgccuaccgcgucuuccccuacuccgucuucuacgucuucuacgagcaguaccucaccaucaucgacgacaccaucuucaaccucggcgucucccucggcgccaucuuccucgucaccaugguccuccucggcugcgagcucugguccgccgucaucaugugcgccaccaucgccaugguccucgucaacauguucggcgucauguggcucuggggcaucucccucaacgccgucucccucgucaaccucgucauguccugcggcaucuccgucgaguucugcucccacaucacccgcgccuucaccgucuccaugaagggcucccgcgucgagcgcgccgaggaggcccucgcccacaugggcuccuccgucuucuccggcaucacccucaccaaguucggcggcaucgucguccucgccuucgccaagucccagaucuuccagaucuucuacuuccgcauguaccucgccaugguccuccucggcgccacccacggccucaucuuccuccccguccuccucuccuacaucggccccuccgucaacaaggccaaguccugcgccaccgaggagcgcuacaagggcaccgagcgcgagcgccuccucaacuucuga

SEQ ID NO: 46784 - RNA, 3999 nt, Artificial Sequence
  derived and/or modified sequence opt2 from NPC1L1__Homo_sapiens__NP_001095118
auggccgaggccggccuccgcggcuggcuccucugggcccuccuccuccgccucgcccaguccgagcccuacaccaccauccaccagcccggcuacugcgccuucuacgacgagugcggcaagaaccccgagcucuccggcucccucaugacccucuccaacgucuccugccucuccaacacccccgcccgcaagaucaccggcgaccaccucauccuccuccagaagaucugcccccgccucuacaccggccccaacacccaggccugcugcuccgccaagcagcucgucucccucgaggccucccucuccaucaccaaggcccuccucacccgcugccccgccugcuccgacaacuucgucaaccuccacugccacaacaccugcucccccaaccagucccucuucaucaacgucacccgcgucgcccagcucggcgccggccagcuccccgccgucgucgccuacgaggccuucuaccagcacuccuucgccgagcaguccuacgacuccugcucccgcguccgcguccccgccgccgccacccucgccgucggcaccaugugcggcgucuacggcuccgcccucugcaacgcccagcgcuggcucaacuuccagggcgacaccggcaacggccucgccccccucgacaucaccuuccaccuccucgagcccggccaggccgucggcuccggcauccagccccucaacgagggcgucgcccgcugcaacgagucccagggcgacgacgucgccaccugcuccugccaggacugcgccgccuccugccccgccaucgcccgcccccaggcccucgacuccaccuucuaccucggccagaugcccggcucccucguccucaucaucauccucugcuccgucuucgccgucgucaccauccuccucgucggcuuccgcgucgcccccgcccgcgacaaguccaagauggucgaccccaagaagggcaccucccucuccgacaagcucuccuucuccacccacacccuccucggccaguucuuccagggcuggggcaccugggucgccuccuggccccucaccauccucguccucuccgucauccccgucgucgcccucgccgccggccucgucuucaccgagcucaccaccgaccccgucgagcucugguccgcccccaacucccaggcccgcuccgagaaggccuuccacgaccagcacuucggccccuucuuccgcaccaaccaggucauccucaccgcccccaaccgcuccuccuaccgcuacgacucccuccuccucggccccaagaacuucuccggcauccucgaccucgaccuccuccucgagcuccucgagcuccaggagcgccuccgccaccuccaggucuggucccccgaggcccagcgcaacaucucccuccaggacaucugcuacgccccccucaaccccgacaacaccucccucuacgacugcugcaucaacucccuccuccaguacuuccagaacaaccgcacccuccuccuccucaccgccaaccagacccucaugggccagaccucccaggucgacuggaaggaccacuuccucuacugcgccaacgccccccucaccuucaaggacggcaccgcccucgcccucuccugcauggccgacuacggcgcccccgucuuccccuuccucgccaucggcggcuacaagggcaaggacuacuccgaggccgaggcccucaucaugaccuucucccucaacaacuaccccgccggcgacccccgccucgcccaggccaagcucugggaggaggccuuccucgaggagaugcgcgccuuccagcgccgcauggccggcauguuccaggucaccuucauggccgagcgcucccucgaggacgagaucaaccgcaccaccgccgaggaccuccccaucuucgccaccuccuacaucgucaucuuccucuacaucucccucgcccucggcuccuacuccuccuggucccgcgucauggucgacuccaaggccacccucggccucggcggcgucgccgucguccucggcgccgucauggccgccaugggcuucuucuccuaccucggcauccgcuccucccucgucauccuccaggucguccccuuccucguccucuccgucggcgccgacaacaucuucaucuucguccucgaguaccagcgccucccccgccgccccggcgagccccgcgagguccacaucggccgcgcccucggccgcgucgcccccuccaugcuccucugcucccucuccgaggccaucugcuucuuccucggcgcccucacccccaugcccgccguccgcaccuucgcccucaccuccggccucgccgucauccucgacuuccuccuccagauguccgccuucgucgcccuccucucccucgacuccaagcgccaggaggccucccgccucgacgucugcugcugcgucaagccccaggagcuccccccccccggccagggcgagggccuccuccucggcuucuuccagaaggccuacgcccccuuccuccuccacuggaucacccgcggcgucguccuccuccucuuccucgcccucuucggcgucucccucuacuccaugugccacaucuccgucggccucgaccaggagcucgcccuccccaaggacuccuaccuccucgacuacuuccucuuccucaaccgcuacuucgaggucggcgcccccgucuacuucgucaccacccucggcuacaacuucuccuccgaggccggcaugaacgccaucugcuccuccgccggcugcaacaacuucuccuucacccagaagauccaguacgccaccgaguuccccgagcaguccuaccucgccauccccgccuccuccugggucgacgacuucaucgacuggcucacccccuccuccugcugccgccucuacaucuccggccccaacaaggacaaguucugccccuccaccgucaacucccucaacugccucaagaacugcauguccaucaccaugggcuccguccgccccuccgucgagcaguuccacaaguaccuccccugguuccucaacgaccgccccaacaucaagugccccaagggcggccucgccgccuacuccaccuccgucaaccucaccuccgacggccagguccucgccucccgcuucauggccuaccacaagccccucaagaacucccaggacuacaccgaggcccuccgcgccgcccgcgagcucgccgccaacaucaccgccgaccuccgcaagguccccggcaccgaccccgccuucgaggucuuccccuacaccaucaccaacgucuucuacgagcaguaccucaccauccuccccgagggccucuucaugcucucccucugccucguccccaccuucgccgucuccugccuccuccucggccucgaccuccgcuccggccuccucaaccuccucuccaucgucaugauccucgucgacaccgucggcuucauggcccucuggggcaucuccuacaacgccgucucccucaucaaccucgucuccgccgucggcauguccgucgaguucgucucccacaucacccgcuccuucgccaucuccaccaagcccaccuggcucgagcgcgccaaggaggccaccaucuccaugggcuccgccgucuucgccggcgucgccaugaccaaccuccccggcauccucguccucggccucgccaaggcccagcucauccagaucuucuucuuccgccucaaccuccucaucacccuccucggccuccuccacggccucgucuuccuccccgucauccucuccuacgucggccccgacgucaaccccgcccucgcccucgagcagaagcgcgccgaggaggccgucgccgccgucauggucgccuccugccccaaccaccccucccgcgucuccaccgccgacaacaucuacgucaaccacuccuucgagggcuccaucaagggcgccggcgccaucuccaacuuccuccccaacaacggccgccaguucuga

SEQ ID NO: 46785 - RNA, 456 nt, Artificial Sequence
  derived and/or modified sequence opt2 from NPC2__Homo_sapiens__NP_006423
augcgcuuccucgccgccaccuuccuccuccucgcccucuccaccgccgcccaggccgagcccguccaguucaaggacugcggcuccgucgacggcgucaucaaggaggucaacgucucccccugccccacccagcccugccagcucuccaagggccaguccuacuccgucaacgucaccuucaccuccaacauccaguccaaguccuccaaggccgucguccacggcauccucaugggcguccccguccccuuccccauccccgagcccgacggcugcaaguccggcaucaacugccccauccagaaggacaagaccuacuccuaccucaacaagcuccccgucaaguccgaguaccccuccaucaagcucgucgucgaguggcagcuccaggacgacaagaaccagucccucuucugcugggagauccccguccagaucgucucccaccucuga

SEQ ID NO: 46786 - RNA, 978 nt, Artificial Sequence
  derived and/or modified sequence opt2 from NPDC1__Homo_sapiens__NP_056207
auggccaccccccuccccccccccuccccccgccaccuccgccuccuccgccuccuccucuccggccucguccucggcgccgcccuccgcggcgccgccgccggccaccccgacgucgccgccugccccggcucccucgacugcgcccucaagcgccgcgcccgcugcccccccggcgcccacgccugcggccccugccuccagcccuuccaggaggaccagcagggccucugcgucccccgcaugcgccgcccccccggcggcggccgcccccagccccgccucgaggacgagaucgacuuccucgcccaggagcucgcccgcaaggaguccggccacuccacccccccccuccccaaggaccgccagcgccuccccgagcccgccacccucggcuucuccgcccgcggccagggccucgagcucggccuccccuccacccccggcacccccacccccaccccccacaccucccucggcucccccgucuccuccgaccccguccacauguccccccucgagccccgcggcggccagggcgacggccucgcccucguccucauccucgccuucugcgucgccggcgccgccgcccucuccgucgccucccucugcuggugccgccuccagcgcgagauccgccucacccagaaggccgacuacgccaccgccaaggcccccggcucccccgccgccccccgcaucucccccggcgaccagcgccucgcccaguccgccgagauguaccacuaccagcaccagcgccagcagaugcucugccucgagcgccacaaggagccccccaaggagcucgacaccgccuccuccgacgaggagaacgaggacggcgacuucaccgucuacgagugccccggccucgcccccaccggcgagauggagguccgcaacccccucuucgaccacgccgcccucuccgccccccuccccgcccccuccuccccccccgcccuccccuga

SEQ ID NO: 46787 - RNA, 1488 nt, Artificial Sequence
  derived and/or modified sequence opt2 from NPEPL1__Homo_sapiens__NP_001191801
auggagcuccacggcggcaaccgcggcggcuaccagcccaaggcccucgagcaguccggcugcuggcucuggcaggccgcccucuccacccucaaccccaaccccaccgacuccugcccccucuaccucaacuacgccaccgucgccgcccuccccugccgcgucucccgccacaacucccccuccgccgcccacuucaucacccgccucguccgcaccugccucccccccggcgcccaccgcugcaucgucauggucugcgagcagcccgaggucuucgccuccgccugcgcccucgcccgcgccuucccccucuucacccaccgcuccggcgccucccgccgccucgagaagaagaccgucaccgucgaguucuuccucgucggccaggacaacggccccgucgaggucuccacccuccagugccucgccaacgccaccgacggcguccgccucgccgcccgcaucgucgacacccccugcaacgagaugaacaccgacaccuuccucgaggagaucaacaaggucggcaaggagcucggcaucauccccaccaucauccgcgacgaggagcucaagacccgcggcuucggcggcaucuacggcgucggcaaggccgcccuccacccccccgcccucgccguccucucccacacccccgacggcgccacccagaccaucgccugggucggcaagggcaucgucuacgacaccggcggccucuccaucaagggcaagaccaccaugcccggcaugaagcgcgacugcggcggcgccgccgccguccucggcgccuuccgcgccgccaucaagcagggcuucaaggacaaccuccacgccgucuucugccucgccgagaacuccgucggccccaacgccacccgccccgacgacauccaccuccucuacuccggcaagaccgucgagaucaacaacaccgacgccgagggccgccucguccucgccgacggcgucuccuacgccugcaaggaccucggcgccgacaucauccucgacauggccacccucaccggcgcccagggcaucgccaccggcaaguaccacgccgccguccucaccaacuccgccgagugggaggccgccugcgucaaggccggccgcaagugcggcgaccucguccacccccucgucuacugccccgagcuccacuucuccgaguucaccuccgccgucgccgacaugaagaacuccgucgccgaccgcgacaacucccccuccuccugcgccggccucuucaucgccucccacaucggcuucgacuggcccggcgucuggguccaccucgacaucgccgcccccguccacgccggcgagcgcgccaccggcuucggcgucgcccuccuccucgcccucuucggccgcgccuccgaggacccccuccucaaccucgucuccccccucggcugcgaggucgacgucgaggagggcgaccucggccgcgacuccaagcgccgccgccucgucuga

SEQ ID NO: 46788 - RNA, 2760 nt, Artificial Sequence
  derived and/or modified sequence opt2 from NPEPPS__Homo_sapiens__NP_006301
auguggcucgccgccgccgcccccucccucgcccgccgccuccucuuccucggcccccccccccccccccuccuccuccucgucuucucccgcuccucccgccgccgccuccacucccucggccucgccgccaugcccgagaagcgccccuucgagcgccuccccgccgacgucucccccaucaacuacucccucugccucaagcccgaccuccucgacuucaccuucgagggcaagcucgaggccgccgcccagguccgccaggccaccaaccagaucgucaugaacugcgccgacaucgacaucaucaccgccuccuacgcccccgagggcgacgaggagauccacgccaccggcuucaacuaccagaacgaggacgagaaggucacccucuccuuccccuccacccuccagaccggcaccggcacccucaagaucgacuucgucggcgagcucaacgacaagaugaagggcuucuaccgcuccaaguacaccacccccuccggcgagguccgcuacgccgccgucacccaguucgaggccaccgacgcccgccgcgccuuccccugcugggacgagcccgccaucaaggccaccuucgacaucucccucgucguccccaaggaccgcgucgcccucuccaacaugaacgucaucgaccgcaagcccuaccccgacgacgagaaccucgucgaggucaaguucgcccgcacccccgucauguccaccuaccucgucgccuucgucgucggcgaguacgacuucgucgagacccgcuccaaggacggcgucugcguccgcgucuacacccccgucggcaaggccgagcagggcaaguucgcccucgaggucgccgccaagacccuccccuucuacaaggacuacuucaacguccccuacccccuccccaagaucgaccucaucgccaucgccgacuucgccgccggcgccauggagaacuggggccucgucaccuaccgcgagaccgcccuccucaucgaccccaagaacuccugcuccuccucccgccagugggucgcccucgucgucggccacgagcucgcccaccagugguucggcaaccucgucaccauggagugguggacccaccucuggcucaacgagggcuucgccuccuggaucgaguaccucugcgucgaccacugcuuccccgaguacgacaucuggacccaguucgucuccgccgacuacacccgcgcccaggagcucgacgcccucgacaacucccaccccaucgaggucuccgucggccaccccuccgaggucgacgagaucuucgacgccaucuccuacuccaagggcgccuccgucauccgcaugcuccacgacuacaucggcgacaaggacuucaagaagggcaugaacauguaccucaccaaguuccagcagaagaacgccgccaccgaggaccucugggagucccucgagaacgccuccggcaagcccaucgccgccgucaugaacaccuggaccaagcagaugggcuucccccucaucuacgucgaggccgagcaggucgaggacgaccgccuccuccgccucucccagaagaaguucugcgccggcggcuccuacgucggcgaggacugcccccaguggaugguccccaucaccaucuccaccuccgaggaccccaaccaggccaagcucaagauccucauggacaagcccgagaugaacgucguccucaagaacgucaagcccgaccagugggucaagcucaaccucggcaccgucggcuucuaccgcacccaguacuccuccgccaugcucgagucccuccuccccggcauccgcgaccucucccucccccccgucgaccgccucggccuccagaacgaccucuucucccucgcccgcgccggcaucaucuccaccgucgagguccucaaggucauggaggccuucgucaacgagcccaacuacaccgucugguccgaccucuccugcaaccucggcauccucuccacccuccucucccacaccgacuucuacgaggagauccaggaguucgucaaggacgucuucucccccaucggcgagcgccucggcugggaccccaagcccggcgagggccaccucgacgcccuccuccgcggccucguccucggcaagcucggcaaggccggccacaaggccacccucgaggaggcccgccgccgcuucaaggaccacgucgagggcaagcagauccucuccgccgaccuccgcucccccgucuaccucaccguccucaagcacggcgacggcaccacccucgacaucaugcucaagcuccacaagcaggccgacaugcaggaggagaagaaccgcaucgagcgcguccucggcgccacccuccuccccgaccucauccagaagguccucaccuucgcccucuccgaggagguccgcccccaggacaccgucuccgucaucggcggcgucgccggcggcuccaagcacggccgcaaggccgccuggaaguucaucaaggacaacugggaggagcucuacaaccgcuaccagggcggcuuccucaucucccgccucaucaagcucuccgucgagggcuucgccgucgacaagauggccggcgaggucaaggccuucuucgagucccaccccgcccccuccgccgagcgcaccauccagcagugcugcgagaacauccuccucaacgccgccuggcucaagcgcgacgccgaguccauccaccaguaccuccuccagcgcaaggccuccccccccaccgucuga

SEQ ID NO: 46789 - RNA, 342 nt, Artificial Sequence
  derived and/or modified sequence opt2 from NPFF__Homo_sapiens__NP_003708
auggacucccgccaggccgccgcccuccucguccuccuccuccucaucgacggcggcugcgccgagggccccggcggccagcaggaggaccagcucuccgccgaggaggacuccgagccccuccccccccaggacgcccagaccuccggcucccuccuccacuaccuccuccaggccauggagcgccccggccgcucccaggccuuccucuuccagccccagcgcuucggccgcaacacccagggcuccuggcgcaacgaguggcucuccccccgcgccggcgagggccucaacucccaguucuggucccucgccgccccccagcgcuucggcaagaaguga

SEQ ID NO: 46790 - RNA, 1272 nt, Artificial Sequence
  derived and/or modified sequence opt2 from NPFFR2__Homo_sapiens__NP_001138228
auguucaucaugaacgagaagugggacaccaacuccuccgagaacuggcaccccaucuggaacgucaacgacaccaagcaccaccucuacuccgacaucaacaucaccuacgucaacuacuaccuccaccagccccaggucgccgccaucuucaucaucuccuacuuccucaucuucuuccucugcaugaugggcaacaccgucgucugcuucaucgucaugcgcaacaagcacaugcacaccgucaccaaccucuucauccucaaccucgccaucuccgaccuccucgucggcaucuucugcaugcccaucacccuccucgacaacaucaucgccggcuggcccuucggcaacaccaugugcaagaucuccggccucguccagggcaucuccgucgccgccuccgucuucacccucgucgccaucgccgucgaccgcuuccagugcgucgucuaccccuucaagcccaagcucaccaucaagaccgccuucgucaucaucaugaucaucuggguccucgccaucaccaucaugucccccuccgccgucaugcuccacguccaggaggagaaguacuaccgcguccgccucaacucccagaacaagaccucccccgucuacuggugccgcgaggacuggcccaaccaggagaugcgcaagaucuacaccaccguccucuucgccaacaucuaccucgccccccucucccucaucgucaucauguacggccgcaucggcaucucccucuuccgcgccgccgucccccacaccggccgcaagaaccaggagcaguggcacgucgucucccgcaagaagcagaagaucaucaagaugcuccucaucgucgcccuccucuucauccucuccuggcucccccucuggacccucaugaugcucuccgacuacgccgaccucucccccaacgagcuccagaucaucaacaucuacaucuaccccuucgcccacuggcucgccuucggcaacuccuccgucaaccccaucaucuacggcuucuucaacgagaacuuccgccgcggcuuccaggaggccuuccagcuccagcucugccagaagcgcgccaagcccauggaggccuacgcccucaaggccaagucccacguccucaucaacaccuccaaccagcucguccaggaguccaccuuccagaacccccacggcgagacccuccucuaccgcaaguccgccgagaagccccagcaggagcucgucauggaggagcucaaggagaccaccaacuccuccgagaucuga

SEQ ID NO: 46791 - RNA, 2202 nt, Artificial Sequence
  derived and/or modified sequence opt2 from NPHP1__Homo_sapiens__NP_000263
augcucgcccgccgccagcgcgacccccuccaggcccuccgccgccgcaaccaggagcucaagcagcaggucgacucccuccucuccgagucccagcucaaggaggcccucgagcccaacaagcgccagcacaucuaccagcgcugcauccagcucaagcaggccaucgacgagaacaagaacgcccuccagaagcucuccaaggccgacgaguccgcccccgucgccaacuacaaccagcgcaaggaggaggagcacacccuccucgacaagcucacccagcagcuccagggccucgccgucaccaucucccgcgagaacaucaccgaggucggcgcccccaccgaggaggaggaggaguccgaguccgaggacuccgaggacuccggcggcgaggaggaggacgccgaggaggaggaggaggagaaggaggagaacgagucccacaagugguccaccggcgaggaguacaucgccgucggcgacuucaccgcccagcaggucggcgaccucaccuucaagaagggcgagauccuccucgucaucgagaagaagcccgacggcugguggaucgccaaggacgccaagggcaacgagggccucgucccccgcaccuaccucgagcccuacuccgaggaggaggagggccaggaguccuccgaggagggcuccgaggaggacgucgaggccgucgacgagaccgccgacggcgccgaggucaagcagcgcaccgacccccacugguccgccguccagaaggccaucuccgaggccggcaucuucugccucgucaaccacgucuccuucugcuaccucaucguccucaugcgcaaccgcauggagaccgucgaggacaccaacggcuccgagaccggcuuccgcgccuggaacguccagucccgcggccgcaucuuccucgucuccaagcccguccuccagcagaucaacaccgucgacguccucaccaccaugggcgccauccccgccggcuuccgccccuccacccucucccagcuccucgaggagggcaaccaguuccgcgccaacuacuuccuccagcccgagcucaugcccucccagcucgccuuccgcgaccucaugugggacgccaccgagggcaccauccgcucccgccccucccgcaucucccucauccucacccucugguccugcaagaugaucccccuccccggcauguccauccagguccucucccgccacguccgccucugccucuucgacggcaacaagguccucuccaacauccacaccguccgcgccaccuggcagcccaagaagcccaagaccuggaccuucuccccccaggucacccgcauccuccccugccuccucgacggcgacugcuucauccgcuccaacuccgccucccccgaccucggcauccucuucgagcucggcaucuccuacauccgcaacuccaccggcgagcgcggcgagcucuccugcggcugggucuuccucaagcucuucgacgccuccggcguccccauccccgccaagaccuacgagcucuuccucaacggcggcacccccuacgagaagggcaucgaggucgaccccuccaucucccgccgcgcccacggcuccgucuucuaccagaucaugaccaugcgccgccagccccagcuccucgucaagcuccgcucccucaaccgccgcucccgcaacguccucucccuccuccccgagacccucaucggcaacaugugcuccauccaccuccucaucuucuaccgccagauccucggcgacguccuccucaaggaccgcaugucccuccaguccaccgaccucaucucccaccccaugcucgccaccuuccccaugcuccucgagcagcccgacgucauggacgcccuccgcuccuccugggccggcaaggaguccacccucaagcgcuccgagaagcgcgacaaggaguuccucaaguccaccuuccuccucgucuaccacgacugcguccucccccuccuccacuccacccgccucccccccuuccgcugggccgaggaggagaccgagaccgcccgcuggaaggucaucaccgacuuccucaagcagaaccaggagaaccagggcgcccuccaggcccuccucucccccgacggcguccacgagcccuucgaccucuccgagcagaccuacgacuuccucggcgagaugcgcaagaacgccgucuga

SEQ ID NO: 46792 - RNA, 3993 nt, Artificial Sequence
  derived and/or modified sequence opt2 from NPHP3__Homo_sapiens__NP_694972
augggcaccgccuccucccucgucucccccgccggcggcgaggucaucgaggacaccuacggcgccggcggcggcgaggccugcgagauccccgucgaggucaagcccaaggcccgccuccuccgcaacuccuuccgccgcggcgccggcgccgccgccggcgccggccccggcucccucccccgcggcgucggcgccggcggccuccucggcgccuccuucaaguccaccggcuccuccguccccgagcucgaguacgccgccgccgaguacgagcgccuccgcaaggaguacgagaucuuccgcgucuccaagaaccaggagcuccucuccaugggccgccgcgaggccaagcucgacaccgagaacaagcgccuccgcgccgagcuccaggcccuccagaagaccuaccagaagauccuccgcgagaaggaguccgcccucgaggccaaguaccaggccauggagcgcgccgccaccuucgagcacgaccgcgacaaggucaagcgccaguucaagaucuuccgcgagaccaaggagaacgagauccaggaccuccuccgcgccaagcgcgagcucgaguccaagcuccagcgccuccaggcccagggcauccaggucuucgaccccggcgaguccgacuccgacgacaacugcaccgacgucaccgccgccggcacccagugcgaguacuggaccggcggcgcccucggcuccgagcccuccaucggcuccaugauccagcuccagcaguccuuccgcggccccgaguucgcccacuccuccaucgacgucgagggccccuucgccaacgucaaccgcgacgacugggacaucgccgucgccucccuccuccaggucaccccccucuucucccacucccucugguccaacaccguccgcugcuaccucaucuacaccgacgagacccagcccgagauggaccucuuccucaaggacuacucccccaagcucaagcgcaugugcgagaccaugggcuacuucuuccacgccgucuacuuccccaucgacgucgagaaccaguaccucaccguccgcaagugggagaucgagaaguccucccucgucauccucuucauccaccucacccuccccucccuccuccucgaggacugcgaggaggccuuccucaagaaccccgagggcaagccccgccucaucuuccaccgccucgaggacggcaaggucuccuccgacuccguccagcagcucaucgaccaggucuccaaccucaacaagaccuccaaggccaagaucaucgaccacuccggcgaccccgccgagggcgucuacaagaccuacaucugcgucgagaagaucaucaagcaggacauccucggcuucgagaacaccgaccucgagaccaaggaccucggcuccgaggacuccauccccgaggaggacgacuucggcgacguccucugggacauccacgacgagcaggagcagauggagaccuuccagcaggccuccaacuccgcccacgagcucggcuucgagaaguacuaccagcgccucaacgaccucgucgccgcccccgcccccauccccccccuccucgucuccggcggccccggcuccggcaagucccuccuccucuccaaguggauccagcuccagcagaagaacucccccaacacccucauccucucccacuucgucggccgccccauguccaccuccuccgaguccucccucaucaucaagcgccucacccucaagcucaugcagcacuccugguccgucuccgcccucacccucgaccccgccaagcuccucgaggaguucccccgcuggcucgagaagcucuccgcccgccaccagggcuccaucaucaucgucaucgacuccaucgaccagguccagcaggucgagaagcacaugaaguggcucaucgacccccuccccgucaacguccgcgucaucgucuccgucaacgucgagaccugcccccccgccuggcgccucuggcccacccuccaccucgacccccucucccccaaggacgccaaguccaucaucaucgccgagugccacuccgucgacaucaagcucuccaaggagcaggagaagaagcucgagcgccacugccgcuccgccaccaccugcaacgcccucuacgucacccucuucggcaagaugaucgcccgcgccggccgcgccggcaaccucgacaagauccuccaccagugcuuccagugccaggacacccucucccucuaccgccucguccuccacuccauccgcgaguccauggccaacgacgucgacaaggagcucaugaagcagauccucugccucgucaacgucucccacaacggcgucuccgaguccgagcucauggagcucuaccccgagauguccuggaccuuccucaccucccucauccacucccucuacaagaugugccuccucaccuacggcugcggccuccuccgcuuccagcaccuccaggccugggagaccguccgccucgaguaccucgagggccccaccgucaccuccuccuaccgccagaagcucaucaacuacuucacccuccagcucucccaggaccgcgucaccuggcgcuccgccgacgagcuccccuggcucuuccagcagcagggcuccaagcagaagcuccacgacugccuccucaaccucuucgucucccagaaccucuacaagcgcggccacuucgccgagcuccucuccuacuggcaguucgucggcaaggacaaguccgccauggccaccgaguacuucgacucccucaagcaguacgagaagaacugcgagggcgaggacaacauguccugccucgccgaccucuacgagacccucggccgcuuccucaaggaccucggccuccucucccaggccaucgucccccuccagcgcucccucgagauccgcgagaccgcccucgaccccgaccacccccgcgucgcccagucccuccaccagcucgccuccgucuacguccaguggaagaaguucggcaacgccgagcagcucuacaagcaggcccucgagaucuccgagaacgccuacggcgccgaccaccccuacaccgcccgcgagcucgaggcccucgccacccucuaccagaagcagaacaaguacgagcaggccgagcacuuccgcaagaaguccuucaagauccaccagaaggccaucaagaagaagggcaaccucuacggcuucgcccuccuccgccgccgcgcccuccagcucgaggagcucacccucggcaaggacacccccgacaacgcccgcacccucaacgagcucggcguccucuacuaccuccagaacaaccucgagaccgccgaccaguuccucaagcgcucccucgagaugcgcgagcgcguccucggccccgaccaccccgacugcgcccagucccucaacaaccucgccgcccucugcaacgagaagaagcaguacgacaaggccgaggagcucuacgagcgcgcccucgacauccgccgccgcgcccucgcccccgaccaccccucccucgccuacaccgucaagcaccucgccauccucuacaagaagaugggcaagcucgacaaggccgucccccucuacgagcucgccgucgagauccgccagaaguccuucggccccaagcaccccuccgucgccaccgcccucgucaaccucgccguccucuacucccagaugaagaagcacgucgaggcccucccccucuacgagcgcgcccucaagaucuacgaggacucccucggccgcaugcacccccgcgucggcgagacccucaagaaccucgccguccucuccuacgagggcggcgacuucgagaaggccgccgagcucuacaagcgcgccauggagaucaaggaggccgagaccucccuccucggcggcaaggcccccucccgccacuccuccuccggcgacaccuucucccucaagaccgcccacucccccaacgucuuccuccagcagggccagcgcuga

SEQ ID NO: 46793 - RNA, 2742 nt, Artificial Sequence
  derived and/or modified sequence opt2 from NPHP4__Homo_sapiens__NP_001278522
augcacccccgcucccucuccgucgcccccaagugguccggcggccuccccggcaaccacccccgcccccuccgcgaguucccccucgaggccggcaucucccaccucgaggccgaccucucccagaccucccucguccucgagaccuccaucgccgagcagcuccaggagcuccccuucaccccccuccacgcccccaucgucgucggcacccagacccgcuccuccgccggccagcccucccgcgccuccaugguccuccuccaguccuccggcuuccccgagauccucgacgccaacaagcagcccgccgaggccgucuccgccaccgagcccgucaccuucaacccccagaaggaggaguccgacugccuccaguccaacgagaugguccuccaguuccucgccuucucccgcgucgcccaggacugccgcggcaccuccuggcccaagaccgucuacuucaccuuccaguucuaccgcuucccccccgccaccaccccccgccuccagcucguccagcucgacgaggccggccagcccuccuccggcgcccucacccacauccucguccccgucucccgcgacggcaccuucgacgccggcucccccggcuuccagcuccgcuacauggucggccccggcuuccucaagcccggcgagcgccgcugcuucgcccgcuaccucgccguccagacccuccagaucgacgucugggacggcgacucccuccuccucaucggcuccgccgccguccagaugaagcaccuccuccgccagggccgccccgccguccaggccucccacgagcucgaggucgucgccaccgaguacgagcaggacaacauggucgucuccggcgacaugcucggcuucggccgcgucaagcccaucggcguccacuccgucgucaagggccgccuccaccucacccucgccaacgucggccaccccugcgagcagaagguccgcggcugcuccacccucccccccucccgcucccgcgucaucuccaacgacggcgccucccgcuucuccggcggcucccuccucaccaccggcuccucccgccgcaagcacgucguccaggcccagaagcucgccgacgucgacuccgagcucgccgccaugcuccucacccacgcccgccagggcaagggcccccaggacgucucccgcgaguccgacgccacccgccgccgcaagcucgagcgcaugcgcuccguccgccuccaggaggccggcggcgaccucggccgccgcggcaccuccguccucgcccagcaguccguccgcacccagcaccuccgcgaccuccaggucaucgccgccuaccgcgagcgcaccaaggccgaguccaucgccucccuccucucccucgccaucaccaccgagcacacccuccacgccacccucggcgucgccgaguucuucgaguucguccucaagaacccccacaacacccagcacaccgucaccgucgagaucgacaaccccgagcucuccgucaucgucgacucccaggaguggcgcgacuucaagggcgccgccggccuccacacccccgucgaggaggacauguuccaccuccgcggcucccucgccccccagcucuaccuccgcccccacgagaccgcccacguccccuucaaguuccaguccuucuccgccggccagcucgccaugguccaggccucccccggccucuccaacgagaagggcauggacgccgucucccccuggaaguccuccgccguccccaccaagcacgccaagguccucuuccgcgccuccggcggcaagcccaucgccguccucugccucaccgucgagcuccagccccacgucgucgaccaggucuuccgcuucuaccaccccgagcucuccuuccucaagaaggccauccgccucccccccuggcacaccuuccccggcgcccccgucggcaugcucggcgaggacccccccguccacguccgcugcuccgaccccaacgucaucugcgagacccagaacgucggccccggcgagccccgcgacaucuuccucaaggucgccuccggccccucccccgagaucaaggacuucuucgucaucaucuacuccgaccgcuggcucgccacccccacccagaccuggcaggucuaccuccacucccuccagcgcgucgacgucuccugcgucgccggccagcucacccgccucucccucguccuccgcggcacccagaccguccgcaagguccgcgccuucaccucccacccccaggagcucaagaccgaccccaagggcgucuucguccuccccccccgcggcguccaggaccuccacgucggcguccgcccccuccgcgccggcucccgcuucguccaccucaaccucgucgacgucgacugccaccagcucgucgccuccuggcucgucugccucugcugccgccagccccucaucuccaaggccuucgagaucaugcucgccgccggcgagggcaagggcgucaacaagcgcaucaccuacaccaaccccuaccccucccgccgcaccuuccaccuccacuccgaccaccccgagcuccuccgcuuccgcgaggacuccuuccaggucggcggcggcgagaccuacaccaucggccuccaguucgcccccucccagcgcgucggcgaggaggagauccucaucuacaucaacgaccacgaggacaagaacgaggaggccuucugcgucaaggucaucuaccaguga

SEQ ID NO: 46794 - RNA, 3726 nt, Artificial Sequence
  derived and/or modified sequence opt2 from NPHS1__Homo_sapiens__NP_004637
auggcccucggcaccacccuccgcgccucccuccuccuccucggccuccucaccgagggccucgcccagcucgccauccccgccuccgucccccgcggcuucugggcccuccccgagaaccucaccgucgucgagggcgccuccgucgagcuccgcugcggcgucuccacccccggcuccgccguccagugggccaaggacggccuccuccucggccccgacccccgcauccccggcuucccccgcuaccgccucgagggcgaccccgcccgcggcgaguuccaccuccacaucgaggccugcgaccucuccgacgacgccgaguacgagugccaggucggccgcuccgagaugggccccgagcucgucuccccccgcgucauccucuccauccucgucccccccaagcuccuccuccucacccccgaggccggcaccauggucaccugggucgccggccaggaguacgucgucaacugcgucuccggcgacgccaagcccgcccccgacaucaccauccuccucuccggccagaccaucuccgacaucuccgccaacgucaacgagggcucccagcagaagcucuucaccgucgaggccaccgcccgcgucaccccccgcuccuccgacaaccgccagcuccucgucugcgaggccuccucccccgcccucgaggcccccaucaaggccuccuucaccgucaacguccucuucccccccggcccccccgucaucgaguggcccggccucgacgagggccacguccgcgccggccagucccucgagcuccccugcgucgcccgcggcggcaacccccucgccacccuccaguggcucaagaacggccagcccgucuccaccgccuggggcaccgagcacacccaggccgucgcccgcuccguccucgucaugaccguccgccccgaggaccacggcgcccagcucuccugcgaggcccacaacuccgucuccgccggcacccaggagcacggcaucacccuccaggucaccuucccccccuccgccaucaucauccucggcuccgccucccagaccgagaacaagaacgucacccucuccugcgucuccaaguccucccgcccccgcguccuccuccgcugguggcucggcuggcgccagcuccuccccauggaggagaccgucauggacggccuccacggcggccacaucuccauguccaaccucaccuuccucgcccgccgcgaggacaacggccucacccucaccugcgaggccuucuccgaggccuucaccaaggagaccuucaagaagucccucauccucaacgucaaguaccccgcccagaagcucuggaucgagggcccccccgagggccagaagcuccgcgccggcacccgcguccgccucgucugccucgccaucggcggcaaccccgagcccucccucaugugguacaaggacucccgcaccgucaccgagucccgccucccccaggagucccgccgcguccaccucggcuccgucgagaaguccggcuccaccuucucccgcgagcucguccucgucaccggccccuccgacaaccaggccaaguucaccugcaaggccggccagcucuccgccuccacccagcucgccguccaguucccccccaccaacgucaccauccucgccaacgccuccgcccuccgccccggcgacgcccucaaccucaccugcgucuccgucuccuccaacccccccgucaaccucuccugggacaaggagggcgagcgccucgagggcgucgccgcccccccccgccgcgcccccuucaagggcuccgccgccgcccgcuccguccuccuccaggucuccucccgcgaccacggccagcgcgucaccugccgcgcccacuccgccgagcuccgcgagaccgucuccuccuucuaccgccucaacguccucuaccgccccgaguuccucggcgagcagguccucgucgucaccgccgucgagcagggcgaggcccuccuccccgucuccgucuccgccaaccccgcccccgaggccuucaacuggaccuuccgcggcuaccgccucucccccgccggcggcccccgccaccgcauccucuccuccggcgcccuccaccucuggaacgucacccgcgccgacgacggccucuaccagcuccacugccagaacuccgagggcaccgccgaggcccgccuccgccucgacguccacuacgcccccaccauccgcgcccuccaggaccccaccgaggucaacgucggcggcuccgucgacaucgucugcaccgucgacgccaaccccauccuccccggcauguucaacugggagcgccucggcgaggacgaggaggaccagucccucgacgacauggagaagaucucccgcggccccaccggccgccuccgcauccaccacgccaagcucgcccaggccggcgccuaccagugcaucgucgacaacggcgucgccccccccgcccgccgccuccuccgccucgucguccgcuucgccccccaggucgagcaccccaccccccucaccaaggucgccgccgccggcgacuccaccuccuccgccacccuccacugccgcgcccgcggcguccccaacaucgucuucaccuggaccaagaacggcgucccccucgaccuccaggacccccgcuacaccgagcacaccuaccaccagggcggcguccacuccucccuccucaccaucgccaacgucuccgccgcccaggacuacgcccucuucaccugcaccgccaccaacgcccucggcuccgaccagaccaacauccagcucgucuccaucucccgccccgacccccccuccggccucaaggucgucucccucaccccccacuccgucggccucgaguggaagcccggcuucgacggcggccucccccagcgcuucugcauccgcuacgaggcccucggcacccccggcuuccacuacgucgacgucguccccccccaggccaccaccuucacccucaccggccuccagcccuccacccgcuaccgcgucuggcuccucgccuccaacgcccucggcgacuccggccucgccgacaagggcacccagcuccccaucaccacccccggccuccaccagcccuccggcgagcccgaggaccagcuccccaccgagccccccuccggccccuccggccucccccuccuccccguccucuucgcccucggcggccuccuccuccucuccaacgccuccugcgucggcggcguccucuggcagcgccgccuccgccgccucgccgagggcaucuccgagaagaccgaggccggcuccgaggaggaccgcguccgcaacgaguacgaggagucccaguggaccggcgagcgcgacacccaguccuccaccgucuccaccaccgaggccgagcccuacuaccgcucccuccgcgacuucuccccccagcucccccccacccaggaggaggucuccuacucccgcggcuucaccggcgaggacgaggacauggccuuccccggccaccucuacgacgaggucgagcgcaccuacccccccuccggcgccuggggcccccucuacgacgagguccagaugggccccugggaccuccacuggcccgaggacaccuaccaggacccccgcggcaucuacgaccaggucgccggcgaccucgacacccucgagcccgacucccuccccuucgagcuccgcggccaccucgucuga

SEQ ID NO: 46795 - RNA, 948 nt, Artificial Sequence
  derived and/or modified sequence opt2 from NPHS2__Homo_sapiens__NP_001284504
auggagcgccgcgcccgcuccuccucccgcgagucccgcggccgcggcggccgcaccccccacaaggagaacaagcgcgccaaggccgagcgcuccggcggcggccgcggccgccaggaggccggccccgagcccuccggcuccggccgcgccggcacccccggcgagccccgcgcccccgccgccaccgucgucgacgucgacgagguccgcggcuccggcgaggagggcaccgaggucgucgcccuccucgaguccgagcgccccgaggagggcaccaaguccuccggccucggcgccugcgaguggcuccucguccucaucucccuccucuucaucaucaugaccuuccccuucuccaucugguucugcgucaaggucguccaggaguacgagcgcgucaucaucuuccgccucggccaccuccuccccggccgcgccaagggccccggccucuucuucuuccuccccugccucgacaccuaccacaaggucgaccuccgccuccagacccucgagauccccuuccacgaggucgcccucgacuccgucaccugcaucuggggcaucaaggucgagcgcaucgagaucaaggacguccgccuccccgccggccuccagcacucccucgccgucgaggccgaggcccagcgccaggccaagguccgcaugaucgccgccgaggccgagaaggccgccuccgagucccuccgcauggccgccgagauccucuccggcacccccgccgccguccagcuccgcuaccuccacacccuccagucccucuccaccgagaagcccuccaccgucguccucccccuccccuucgaccuccucaacugccucuccucccccuccaaccgcacccagggcucccuccccuuccccucccccuccaagcccgucgagccccucaaccccaagaagaaggacucccccaugcucuga

SEQ ID NO: 46796 - RNA, 906 nt, Artificial Sequence
  derived and/or modified sequence opt2 from NPL__Homo_sapiens__NP_001186979
augucccgcgcccccggcauccucgccuccuggcgccgcgcccccucccucuccguccagaagggcucccagaccgcccgccacaccugccaccccgaggucccccucggcaacugcuuccuccccgucuacaaggccuccccccucaccgucacccgccucugggccgagcgccucgaccaggucaucauccacgucggcgcccucucccucaaggagucccaggagcucgcccagcacgccgccgagaucggcgccgacggcaucgccgucaucgcccccuucuuccucaagcccuggaccaaggacauccucaucaacuuccucaaggaggucgccgccgccgcccccgcccuccccuucuacuacuaccacauccccgcccucaccggcgucaagauccgcgccgaggagcuccucgacggcauccucgacaagauccccaccuuccagggccucaaguucuccgacaccgaccuccucgacuucggccagugcgucgaccagaaccgccagcagcaguucgccuuccucuucggcgucgacgagcagcuccucuccgcccucgucaugggcgccaccggcgccgucggcuccaccuacaacuaccucggcaagaagaccaaccagaugcucgaggccuucgagcagaaggacuucucccucgcccucaacuaccaguucugcauccagcgcuucaucaacuucgucgucaagcucggcuucggcgucucccagaccaaggccaucaugacccucgucuccggcauccccaugggccccccccgccucccccuccagaaggccucccgcgaguucaccgacuccgccgaggccaagcucaagucccucgacuuccucuccuucaccgaccucaaggacggcaaccucgaggccggcuccuga

SEQ ID NO: 46797 - RNA, 1827 nt, Artificial Sequence
  derived and/or modified sequence opt2 from NPLOC4__Homo_sapiens__NP_060391
auggccgaguccaucaucauccgcguccagucccccgacggcgucaagcgcaucaccgccaccaagcgcgagaccgccgccaccuuccucaagaaggucgccaaggaguucggcuuccagaacaacggcuucuccgucuacaucaaccgcaacaagaccggcgagaucaccgccuccuccaacaagucccucaaccuccucaagaucaagcacggcgaccuccucuuccucuuccccuccucccucgccggccccuccuccgagauggagaccuccgucccccccggcuucaaggucuucggcgcccccaacgucgucgaggacgagaucgaccaguaccucuccaagcaggacggcaagaucuaccgcucccgcgacccccagcucugccgccacggcccccucggcaagugcguccacugcgucccccucgagcccuucgacgaggacuaccucaaccaccucgagccccccgucaagcacauguccuuccacgccuacauccgcaagcucaccggcggcgccgacaagggcaaguucgucgcccucgagaacaucuccugcaagaucaaguccggcugcgagggccaccuccccuggcccaacggcaucugcaccaagugccagcccuccgccaucacccucaaccgccagaaguaccgccacgucgacaacaucauguucgagaaccacaccgucgccgaccgcuuccucgacuucuggcgcaagaccggcaaccagcacuucggcuaccucuacggccgcuacaccgagcacaaggacaucccccucggcauccgcgccgaggucgccgccaucuacgagcccccccagaucggcacccagaacucccucgagcuccucgaggaccccaaggccgaggucgucgacgagaucgccgccaagcucggccuccgcaaggucggcuggaucuucaccgaccucgucuccgaggacacccgcaagggcaccguccgcuacucccgcaacaaggacaccuacuuccucuccuccgaggagugcaucaccgccggcgacuuccagaacaagcaccccaacaugugccgccucucccccgacggccacuucggcuccaaguucgucaccgccgucgccaccggcggccccgacaaccagguccacuucgagggcuaccaggucuccaaccagugcauggcccucguccgcgacgagugccuccuccccugcaaggacgcccccgagcucggcuacgccaaggaguccuccuccgagcaguacguccccgacgucuucuacaaggacgucgacaaguucggcaacgagaucacccagcucgcccgcccccuccccgucgaguaccucaucaucgacaucaccaccaccuuccccaaggaccccgucuacaccuucuccaucucccagaaccccuuccccaucgagaaccgcgacguccucggcgagacccaggacuuccacucccucgccaccuaccucucccagaacaccuccuccgucuuccucgacaccaucuccgacuuccaccuccuccucuuccucgucaccaacgaggucaugccccuccaggacuccaucucccuccuccucgaggccguccgcacccgcaacgaggagcucgcccagaccuggaagcgcuccgagcagugggccaccaucgagcagcucugcuccaccgucggcggccagcuccccggccuccacgaguacggcgccgucggcggcuccacccacaccgccaccgccgccaugugggccugccagcacugcaccuucaugaaccagcccggcaccggccacugcgagaugugcucccucccccgcaccuga

SEQ ID NO: 46798 - RNA, 780 nt, Artificial Sequence
  derived and/or modified sequence opt2 from NPM1__Homo_sapiens__NP_001032827
auggaggacuccauggacauggacauguccccccuccgcccccagaacuaccucuucggcugcgagcucaaggccgacaaggacuaccacuucaaggucgacaacgacgagaacgagcaccagcucucccuccgcaccgucucccucggcgccggcgccaaggacgagcuccacaucgucgaggccgaggccaugaacuacgagggcucccccaucaaggucacccucgccacccucaagauguccguccagcccaccgucucccucggcggcuucgagaucaccccccccgucguccuccgccucaagugcggcuccggccccguccacaucuccggccagcaccucgucgccgucgaggaggacgccgaguccgaggacgaggaggaggaggacgucaagcuccucuccaucuccggcaagcgcuccgcccccggcggcggcuccaaggucccccagaagaaggucaagcucgccgccgacgaggacgacgacgacgacgacgaggaggacgacgacgaggacgacgacgacgacgacuucgacgacgaggaggccgaggagaaggcccccgucaagaaguccauccgcgacacccccgccaagaacgcccagaaguccaaccagaacggcaaggacuccaagcccuccuccaccccccgcuccaagggccaggaguccuucaagaagcaggagaagacccccaagacccccaagggccccuccuccgucgaggacaucaaggccaagaugcaggccuccaucgagaaggcccacuga

SEQ ID NO: 46799 - RNA, 411 nt, Artificial Sequence
  derived and/or modified sequence opt2 from NPM2__Homo_sapiens__NP_001273610
augaaccucuccuccgccuccuccaccgaggagaaggccgucaccaccguccucuggggcugcgagcucucccaggagcgccgcaccuggaccuuccgcccccagcucgagggcaagcaguccugccgccuccuccuccacaccaucugccucggcgagaaggccaaggaggagaugcaccgcgucgagauccucccccccgccaaccaggaggacaagaagaugcagcccgucaccaucgccucccuccaggccuccguccuccccauggucuccauggucggcguccagcucuccccccccgucaccuuccagcuccgcgccggcuccggccccgucuuccucuccggccaggagcgcuacgagaagaaggccggcaagcgccgccgcggcaacaagucccagcgcuga

SEQ ID NO: 46800 - RNA, 1698 nt, Artificial Sequence
  derived and/or modified sequence opt2 from NPNT__Homo_sapiens__NP_001028219
auggacuuccuccucgcccucguccucgucuccucccucuaccuccaggccgccgccgaguucgacggccgcuggccccgccagaucgucuccuccaucggccucugccgcuacggcggccgcaucgacugcugcuggggcugggcccgccaguccuggggccagugccagcccgucugccagccccgcugcaagcacggcgagugcaucggccccaacaagugcaagugccaccccggcuacgccggcaagaccugcaaccaggaccucaacgagugcggccucaagccccgccccugcaagcaccgcugcaugaacaccuacggcuccuacaagugcuacugccucaacggcuacaugcucaugcccgacggcuccugcuccuccgcccucaccugcuccauggccaacugccaguacggcugcgacgucgucaagggccagauccgcugccagugccccucccccggccuccagcucgcccccgacggccgcaccugcgucgacgucgacgagugcgccaccggccgcgccuccugcccccgcuuccgccagugcgucaacaccuucggcuccuacaucugcaagugccacaagggcuucgaccucauguacaucggcggcaaguaccagugccacgacaucgacgagugcucccucggccaguaccagugcuccuccuucgcccgcugcuacaacauccgcggcuccuacaagugcaagugcaaggagggcuaccagggcgacggccucaccugcgucuacauccccaaggucaugaucgagcccuccggccccauccacguccccaagggcaacggcaccauccucaagggcgacaccggcaacaacaacuggauccccgacgucggcuccaccugguggccccccaagacccccuacaucccccccaucaucaccaaccgccccaccuccaagcccaccacccgccccacccccaagcccacccccauccccacccccccccccccccccccccuccccaccgagcuccgcaccccccucccccccaccacccccgagcgccccaccaccggccucaccaccaucgcccccgccgccuccaccccccccggcggcaucaccgucgacaaccgcguccagaccgacccccagaagccccgcggcgacgucuucaucccccgccagcccuccaacgaccucuucgagaucuucgagaucgagcgcggcgucuccgccgacgacgaggccaaggacgaccccggcguccucguccacuccugcaacuucgaccacggccucugcggcuggauccgcgagaaggacaacgaccuccacugggagcccauccgcgaccccgccggcggccaguaccucaccgucuccgccgccaaggcccccggcggcaaggccgcccgccucguccucccccucggccgccucaugcacuccggcgaccucugccucuccuuccgccacaaggucaccggccuccacuccggcacccuccaggucuucguccgcaagcacggcgcccacggcgccgcccucuggggccgcaacggcggccacggcuggcgccagacccagaucacccuccgcggcgccgacaucaaguccgucgucuucaagggcgagaagcgccgcggccacaccggcgagaucggccucgacgacgucucccucaagaagggccacugcuccgaggagcgcuga

SEQ ID NO: 46801 - RNA, 381 nt, Artificial Sequence
  derived and/or modified sequence opt2 from NPPC__Homo_sapiens__NP_077720
augcaccucucccagcuccucgccugcgcccuccuccucacccuccucucccuccgccccuccgaggccaagcccggcgccccccccaaggucccccgcaccccccccgccgaggagcucgccgagccccaggccgccggcggcggccagaagaagggcgacaaggcccccggcggcggcggcgccaaccucaagggcgaccgcucccgccuccuccgcgaccuccgcgucgacaccaagucccgcgccgccugggcccgccuccuccaggagcaccccaacgcccgcaaguacaagggcgccaacaagaagggccucuccaagggcugcuucggccucaagcucgaccgcaucggcuccauguccggccucggcugcuga

SEQ ID NO: 46802 - RNA, 3186 nt, Artificial Sequence
  derived and/or modified sequence opt2 from NPR1__Homo_sapiens__NP_000897
augcccggcccccgccgccccgccggcucccgccuccgccuccuccuccuccuccuccuccccccccuccuccuccuccuccgcggcucccacgccggcaaccucaccgucgccgucguccucccccucgccaacaccuccuaccccugguccugggcccgcgucggccccgccgucgagcucgcccucgcccaggucaaggcccgccccgaccuccuccccggcuggaccguccgcaccguccucggcuccuccgagaacgcccucggcgucugcuccgacaccgccgccccccucgccgccgucgaccucaagugggagcacaaccccgccgucuuccucggccccggcugcgucuacgccgccgcccccgucggccgcuucaccgcccacuggcgcgucccccuccucaccgccggcgcccccgcccucggcuucggcgucaaggacgaguacgcccucaccacccgcgccggccccuccuacgccaagcucggcgacuucgucgccgcccuccaccgccgccucggcugggagcgccaggcccucaugcucuacgccuaccgccccggcgacgaggagcacugcuucuuccucgucgagggccucuucaugcgcguccgcgaccgccucaacaucaccgucgaccaccucgaguucgccgaggacgaccucucccacuacacccgccuccuccgcaccaugccccgcaagggccgcgucaucuacaucugcuccucccccgacgccuuccgcacccucaugcuccucgcccucgaggccggccucugcggcgaggacuacgucuucuuccaccucgacaucuucggccagucccuccagggcggccagggccccgccccccgccgccccugggagcgcggcgacggccaggacgucuccgcccgccaggccuuccaggccgccaagaucaucaccuacaaggaccccgacaaccccgaguaccucgaguuccucaagcagcucaagcaccucgccuacgagcaguucaacuucaccauggaggacggccucgucaacaccauccccgccuccuuccacgacggccuccuccucuacauccaggccgucaccgagacccucgcccacggcggcaccgucaccgacggcgagaacaucacccagcgcauguggaaccgcuccuuccagggcgucaccggcuaccucaagaucgacuccuccggcgaccgcgagaccgacuucucccucugggacauggaccccgagaacggcgccuuccgcgucguccucaacuacaacggcaccucccaggagcucgucgccgucuccggccgcaagcucaacuggccccucggcuaccccccccccgacauccccaagugcggcuucgacaacgaggaccccgccugcaaccaggaccaccucuccacccucgagguccucgcccucgucggcucccucucccuccucggcauccucaucgucuccuucuucaucuaccgcaagaugcagcucgagaaggagcucgccuccgagcucuggcgcguccgcugggaggacgucgagcccuccucccucgagcgccaccuccgcuccgccggcucccgccucacccucuccggccgcggcuccaacuacggcucccuccucaccaccgagggccaguuccaggucuucgccaagaccgccuacuacaagggcaaccucgucgccgucaagcgcgucaaccgcaagcgcaucgagcucacccgcaagguccucuucgagcucaagcacaugcgcgacguccagaacgagcaccucacccgcuucgucggcgccugcaccgacccccccaacaucugcauccucaccgaguacugcccccgcggcucccuccaggacauccucgagaacgaguccaucacccucgacuggauguuccgcuacucccucaccaacgacaucgucaagggcaugcucuuccuccacaacggcgccaucugcucccacggcaaccucaaguccuccaacugcgucgucgacggccgcuucguccucaagaucaccgacuacggccucgaguccuuccgcgaccucgaccccgagcagggccacaccgucuacgccaagaagcucuggaccgcccccgagcuccuccgcauggccuccccccccguccgcggcucccaggccggcgacgucuacuccuucggcaucauccuccaggagaucgcccuccgcuccggcgucuuccacgucgagggccucgaccucucccccaaggagaucaucgagcgcgucacccgcggcgagcagccccccuuccgccccucccucgcccuccagucccaccucgaggagcucggccuccucaugcagcgcugcugggccgaggacccccaggagcgcccccccuuccagcagauccgccucacccuccgcaaguucaaccgcgagaacuccuccaacauccucgacaaccuccucucccgcauggagcaguacgccaacaaccucgaggagcucgucgaggagcgcacccaggccuaccucgaggagaagcgcaaggccgaggcccuccucuaccagauccucccccacuccgucgccgagcagcucaagcgcggcgagaccguccaggccgaggccuucgacuccgucaccaucuacuucuccgacaucgucggcuucaccgcccucuccgccgaguccacccccaugcaggucgucacccuccucaacgaccucuacaccugcuucgacgccgucaucgacaacuucgacgucuacaaggucgagaccaucggcgacgccuacauggucgucuccggccuccccguccgcaacggccgccuccacgccugcgaggucgcccgcauggcccucgcccuccucgacgccguccgcuccuuccgcauccgccaccgcccccaggagcagcuccgccuccgcaucggcauccacaccggccccgucugcgccggcgucgucggccucaagaugccccgcuacugccucuucggcgacaccgucaacaccgccucccgcauggaguccaacggcgaggcccucaagauccaccucuccuccgagaccaaggccguccucgaggaguucggcggcuucgagcucgagcuccgcggcgacgucgagaugaagggcaagggcaagguccgcaccuacuggcuccucggcgagcgcggcuccuccacccgcggcuga

SEQ ID NO: 46803 - RNA, 3144 nt, Artificial Sequence
  derived and/or modified sequence opt2 from NPR2__Homo_sapiens__NP_003986
auggcccuccccucccuccuccuccucgucgccgcccucgccggcggcguccgcccccccggcgcccgcaaccucacccucgccgucguccuccccgagcacaaccucuccuacgccugggccuggccccgcgucggccccgccgucgcccucgccgucgaggcccucggccgcgcccuccccgucgaccuccgcuucgucuccuccgagcucgagggcgccugcuccgaguaccucgccccccucuccgccgucgaccucaagcucuaccacgaccccgaccuccuccucggccccggcugcgucuaccccgccgccuccgucgcccgcuucgccucccacuggcgccucccccuccucaccgccggcgccgucgccuccggcuucuccgccaagaacgaccacuaccgcacccucguccgcaccggccccuccgcccccaagcucggcgaguucgucgucacccuccacggccacuucaacuggaccgcccgcgccgcccuccucuaccucgacgcccgcaccgacgaccgcccccacuacuucaccaucgagggcgucuucgaggcccuccagggcuccaaccucuccguccagcaccaggucuacgcccgcgagcccggcggccccgagcaggccacccacuucauccgcgccaacggccgcaucgucuacaucugcggcccccucgagaugcuccacgagauccuccuccaggcccagcgcgagaaccucaccaacggcgacuacgucuucuucuaccucgacgucuucggcgagucccuccgcgccggccccacccgcgccaccggccgccccuggcaggacaaccgcacccgcgagcaggcccaggcccuccgcgaggccuuccagaccguccucgucaucaccuaccgcgagccccccaaccccgaguaccaggaguuccagaaccgccuccucauccgcgcccgcgaggacuucggcgucgagcucggccccucccucaugaaccucaucgccggcugcuucuacgacggcauccuccucuacgccgagguccucaacgagaccauccaggagggcggcacccgcgaggacggccuccgcaucgucgagaagaugcagggccgccgcuaccacggcgucaccggccucgucgucauggacaagaacaacgaccgcgagaccgacuucguccucugggccaugggcgaccucgacuccggcgacuuccagcccgccgcccacuacuccggcgccgagaagcagaucugguggaccggccgccccauccccugggucaagggcgccccccccuccgacaacccccccugcgccuucgaccucgacgaccccuccugcgacaagaccccccucuccacccucgccaucgucgcccucggcaccggcaucaccuucaucauguucggcgucuccuccuuccucaucuuccgcaagcucaugcucgagaaggagcucgccuccaugcucuggcgcauccgcugggaggagcuccaguucggcaacuccgagcgcuaccacaagggcgccggcucccgccucacccucucccuccgcggcuccuccuacggcucccucaugaccgcccacggcaaguaccagaucuucgccaacaccggccacuucaagggcaacgucgucgccaucaagcacgucaacaagaagcgcaucgagcucacccgccagguccucuucgagcucaagcacaugcgcgacguccaguucaaccaccucacccgcuucaucggcgccugcaucgacccccccaacaucugcaucgucaccgaguacugcccccgcggcucccuccaggacauccucgagaacgacuccaucaaccucgacuggauguuccgcuacucccucaucaacgaccucgucaagggcauggccuuccuccacaacuccaucaucuccucccacggcucccucaaguccuccaacugcgucgucgacucccgcuucguccucaagaucaccgacuacggccucgccuccuuccgcuccaccgccgagcccgacgacucccacgcccucuacgccaagaagcucuggaccgcccccgagcuccucuccggcaacccccuccccaccaccggcaugcagaaggccgacgucuacuccuucggcaucauccuccaggagaucgcccuccgcuccggccccuucuaccucgagggccucgaccucucccccaaggagaucguccagaagguccgcaacggccagcgccccuacuuccgccccuccaucgaccgcacccagcucaacgaggagcucguccuccucauggagcgcugcugggcccaggaccccgccgagcgccccgacuucggccagaucaagggcuucauccgccgcuucaacaaggagggcggcaccuccauccucgacaaccuccuccuccgcauggagcaguacgccaacaaccucgagaagcucgucgaggagcgcacccaggccuaccucgaggagaagcgcaaggccgaggcccuccucuaccagauccucccccacuccgucgccgagcagcucaagcgcggcgagaccguccaggccgaggccuucgacuccgucaccaucuacuucuccgacaucgucggcuucaccgcccucuccgccgaguccacccccaugcaggucgucacccuccucaacgaccucuacaccugcuucgacgccaucaucgacaacuucgacgucuacaaggucgagaccaucggcgacgccuacauggucgucuccggccuccccggccgcaacggccagcgccacgcccccgagaucgcccgcauggcccucgcccuccucgacgccgucuccuccuuccgcauccgccaccgcccccacgaccagcuccgccuccgcaucggcguccacaccggccccgucugcgccggcgucgucggccucaagaugccccgcuacugccucuucggcgacaccgucaacaccgccucccgcauggaguccaacggccaggcccucaagauccacgucuccuccaccaccaaggacgcccucgacgagcucggcugcuuccagcucgagcuccgcggcgacgucgagaugaagggcaagggcaagaugcgcaccuacuggcuccucggcgagcgcaagggcccccccggccuccucuga

SEQ ID NO: 46804 - RNA, 1623 nt, Artificial Sequence
  derived and/or modified sequence opt2 from NPR3__Homo_sapiens__NP_000899
augcccucccuccucguccucaccuucucccccugcguccuccucggcugggcccuccucgccggcggcaccggcggcggcggcgucggcggcggcggcggcggcgccggcaucggcggcggccgccaggagcgcgaggcccuccccccccagaagaucgagguccucguccuccucccccaggacgacuccuaccucuucucccucacccgcguccgccccgccaucgaguacgcccuccgcuccgucgagggcaacggcaccggccgccgccuccucccccccggcacccgcuuccaggucgccuacgaggacuccgacugcggcaaccgcgcccucuucucccucgucgaccgcgucgccgccgcccgcggcgccaagcccgaccucauccucggccccgucugcgaguacgccgccgcccccgucgcccgccucgccucccacugggaccuccccaugcucuccgccggcgcccucgccgccggcuuccagcacaaggacuccgaguacucccaccucacccgcgucgcccccgccuacgccaagaugggcgagaugaugcucgcccucuuccgccaccaccacuggucccgcgccgcccucgucuacuccgacgacaagcucgagcgcaacugcuacuucacccucgagggcguccacgaggucuuccaggaggagggccuccacaccuccaucuacuccuucgacgagaccaaggaccucgaccucgaggacaucguccgcaacauccaggccuccgagcgcgucgucaucaugugcgccuccuccgacaccauccgcuccaucaugcucgucgcccaccgccacggcaugaccuccggcgacuacgccuucuucaacaucgagcucuucaacuccuccuccuacggcgacggcuccuggaagcgcggcgacaagcacgacuucgaggccaagcaggccuacuccucccuccagaccgucacccuccuccgcaccgucaagcccgaguucgagaaguucuccauggaggucaaguccuccgucgagaagcagggccucaacauggaggacuacgucaacauguucgucgagggcuuccacgacgccauccuccucuacguccucgcccuccacgagguccuccgcgccggcuacuccaagaaggacggcggcaagaucauccagcagaccuggaaccgcaccuucgagggcaucgccggccaggucuccaucgacgccaacggcgaccgcuacggcgacuucuccgucaucgccaugaccgacgucgaggccggcacccaggaggucaucggcgacuacuucggcaaggagggccgcuucgagaugcgccccaacgucaaguaccccuggggcccccucaagcuccgcaucgacgagaaccgcaucgucgagcacaccaacuccucccccugcaaguccugcggccucgaggaguccgccgucaccggcaucgucgucggcgcccuccucggcgccggccuccucauggccuucuacuucuuccgcaagaaguaccgcaucaccaucgagcgccgcacccagcaggaggaguccaaccucggcaagcaccgcgagcuccgcgaggacuccauccgcucccacuucuccgucgccuga

SEQ ID NO: 46805 - RNA, 1143 nt, Artificial Sequence
  derived and/or modified sequence opt2 from NPRL2__Homo_sapiens__NP_006536
augggcuccggcugccgcaucgagugcaucuucuucuccgaguuccaccccacccucggccccaagaucaccuaccagguccccgaggacuucaucucccgcgagcucuucgacaccguccaggucuacaucaucaccaagcccgagcuccagaacaagcucaucaccgucaccgccauggagaagaagcucaucggcugccccgucugcaucgagcacaagaaguacucccgcaacgcccuccucuucaaccucggcuucgucugcgacgcccaggccaagaccugcgcccucgagcccaucgucaagaagcucgccggcuaccucaccacccucgagcucgaguccuccuucgucuccauggaggaguccaagcagaagcucguccccaucaugaccauccuccucgaggagcucaacgccuccggccgcugcacccuccccaucgacgaguccaacaccauccaccucaaggucaucgagcagcgccccgacccccccgucgcccaggaguacgacguccccgucuucaccaaggacaaggaggacuucuucaacucccagugggaccucaccacccagcagauccuccccuacaucgacggcuuccgccacauccagaagaucuccgccgaggccgacgucgagcucaaccucguccgcaucgccauccagaaccuccucuacuacggcgucgucacccucgucuccauccuccaguacuccaacgucuacugccccacccccaagguccaggaccucgucgacgacaagucccuccaggaggccugccucuccuacgucaccaagcagggccacaagcgcgccucccuccgcgacgucuuccagcucuacugcucccucucccccggcaccaccguccgcgaccucaucggccgccacccccagcagcuccagcacgucgacgagcgcaagcucauccaguucggccucaugaagaaccucauccgccgccuccagaaguaccccguccgcgucacccgcgaggagcagucccaccccgcccgccucuacaccggcugccacuccuacgacgagaucugcugcaagaccggcauguccuaccacgagcucgacgagcgccucgagaacgaccccaacaucaucaucugcuggaaguga

SEQ ID NO: 46806 - RNA, 1173 nt, Artificial Sequence
  derived and/or modified sequence opt2 from NPRL3__Homo_sapiens__NP_001034565
auggccgacggcaacgagggcccccagucccccuuccaccacauccuccccaagugcaagcucgcccgcgaccucaaggaggccuacgacucccucugcaccuccggcgucguccgccuccacaucaacuccuggcucgaggucuccuucugccucccccacaagauccacuacgccgccuccucccucaucccccccgaggccaucgagcgcucccucaaggccauccgccccuaccacgcccuccuccuccucuccgacgagaagucccuccucggcgagcuccccaucgacugcucccccgcccucguccgcgucaucaagaccaccuccgccgucaagaaccuccagcagcucgcccaggacgccgaccucgcccuccuccaggucuuccagcucgccgcccaccucgucuacuggggcaaggccaucaucaucuacccccucugcgagaacaacgucuacaugcucucccccaacgccuccgucugccucuacuccccccucgccgagcaguucucccaccaguuccccucccacgaccuccccuccguccucgccaaguucucccuccccgucucccucuccgaguuccgcaacccccucgcccccgccguccaggagacccagcucauccagauggucgucuggaugcuccagcgccgccuccucauccagcuccacaccuacgucugccucauggccucccccuccgaggaggagccccgcccccgcgaggacgacguccccuucaccgcccgcgucggcggccgcucccucuccacccccaacgcccucuccuucggcucccccaccuccuccgacgacaugacccucaccucccccuccauggacaacuccuccgccgagcuccuccccuccggcgacuccccccucaaccagcgcaugaccgagaaccuccucgccucccucuccgagcacgagcgcgccgccauccucuccguccccgccgcccagaaccccgaggaccuccgcauguucgcccgccuccuccacuacuuccgcggccgccaccaccucgaggagaucauguacaacgagaacacccgccgcucccagcuccucaugcucuucgacaaguuccgcuccguccucgucgucaccacccacgaggaccccgucaucgccgucuuccaggcccuccuccccuga

SEQ ID NO: 46807 - RNA, 270 nt, Artificial Sequence
  derived and/or modified sequence opt2 from NPS__Homo_sapiens__NP_001025184
augaucuccuccgucaagcucaaccucauccucguccucucccucuccaccaugcacgucuucuggugcuaccccguccccuccuccaaggucuccggcaaguccgacuacuuccucauccuccucaacuccugccccacccgccucgaccgcuccaaggagcucgccuuccucaagcccauccucgagaagauguucgucaagcgcuccuuccgcaacggcgucggcaccggcaugaagaagaccuccuuccagcgcgccaaguccuga

SEQ ID NO: 46808 - RNA, 918 nt, Artificial Sequence
  derived and/or modified sequence opt2 from NPSR1__Homo_sapiens__NP_001287863
augcccgccaacuucaccgagggcuccuucgacuccuccggcaccggccagacccucgacuccucccccgucgccugcaccgagaccgucaccuucaccgaggucgucgagggcaaggaguggggcuccuucuacuacuccuucaagaccgagcagcucaucacccucuggguccucuucgucuucaccaucgucggcaacuccgucguccucuucuccaccuggcgccgcaagaagaagucccgcaugaccuucuucgucacccagcucgccaucaccgagaagcaggcccgcguccucaucgucaucgccuggucccucuccuuccucuucuccauccccacccucaucaucuucggcaagcgcacccucuccaacggcgagguccagugcugggcccucuggcccgacgacuccuacuggacccccuacaugaccaucgucgccuuccucgucuacuucaucccccucaccaucaucuccaucauguacggcaucgucauccgcaccaucuggaucaaguccaagaccuacgagaccgucaucuccaacugcuccgacggcaagcucugcuccuccuacaaccgcggccucaucuccaaggccaagaucaaggccaucaaguacuccaucaucaucauccucgccuucaucugcugcuggucccccuacuuccucuucgacauccucgacaacuucaaccuccuccccgacacccaggagcgcuucuacgccuccgucaucauccagaaccuccccgcccucaacuccgccaucaacccccucaucuacugcgucuucuccuccuccaucuccuuccccugccgcgagcagcgcucccaggacucccgcaugaccuuccgcgagcgcaccgagcgccacgagaugcagauccucuccaagcccgaguucaucuga

SEQ ID NO: 46809 - RNA, 1185 nt, Artificial Sequence
  derived and/or modified sequence opt2 from NPTN__Homo_sapiens__NP_001154835
auguccggcuccucccuccccuccgcccucgcccucucccuccuccucgucuccggcucccuccuccccggccccggcgccgcccagaacgccggcuucgucaagucccccauguccgagaccaagcucaccggcgacgccuucgagcucuacugcgacgucgucggcucccccacccccgagauccaguggugguacgccgaggucaaccgcgccgaguccuuccgccagcucugggacggcgcccgcaagcgccgcgucaccgucaacaccgccuacggcuccaacggcgucuccguccuccgcaucacccgccucacccucgaggacuccggcaccuacgagugccgcgccuccaacgaccccaagcgcaacgaccuccgccagaaccccuccaucaccuggauccgcgcccaggccaccaucuccguccuccagaagccccgcaucgucaccuccgaggaggucaucauccgcgacucccccguccuccccgucacccuccagugcaaccucaccuccuccucccacacccucaccuacuccuacuggaccaagaacggcgucgagcucuccgccacccgcaagaacgccuccaacauggaguaccgcaucaacaagccccgcgccgaggacuccggcgaguaccacugcgucuaccacuucgucuccgcccccaaggccaacgccaccaucgaggucaaggccgcccccgacaucaccggccacaagcgcuccgagaacaagaacgagggccaggacgccaccauguacugcaaguccgucggcuacccccaccccgacuggaucuggcgcaagaaggagaacggcaugcccauggacaucgucaacaccuccggccgcuucuucaucaucaacaaggagaacuacaccgagcucaacaucgucaaccuccagaucaccgaggaccccggcgaguacgagugcaacgccaccaacgccaucggcuccgccuccgucgucaccguccuccgcguccgcucccaccucgccccccucuggcccuuccucggcauccucgccgagaucaucauccucgucgucaucaucgucgucuacgagaagcgcaagcgccccgacgagguccccgacgccggccccaugaagaccaacuccaccaacaaccacaaggacaagaaccuccgccagcgcaacaccaacuga

SEQ ID NO: 46810 - RNA, 1299 nt, Artificial Sequence
  derived and/or modified sequence opt2 from NPTX1__Homo_sapiens__NP_002513
augcccgccggccgcgccgcccgcaccugcgcccuccucgcccucugccuccucggcgccggcgcccaggacuucggccccacccgcuucaucugcaccuccguccccgucgacgccgacaugugcgccgccuccgucgccgccggcggcgccgaggagcuccgcuccuccguccuccagcuccgcgagaccguccuccagcagaaggagaccauccucucccagaaggagaccauccgcgagcucaccgccaagcucggccgcugcgagucccaguccacccucgaccccggcgccggcgaggcccgcgccggcggcggccgcaagcagcccggcuccggcaagaacaccaugggcgaccucucccgcacccccgccgccgagacccucucccagcucggccagacccuccagucccucaagacccgccucgagaaccucgagcaguacucccgccucaacuccuccucccagaccaacucccucaaggaccuccuccaguccaagaucgacgagcucgagcgccagguccucucccgcgucaacacccucgaggagggcaagggcggcccccgcaacgacaccgaggagcgcgucaagaucgagaccgcccucaccucccuccaccagcgcaucuccgagcucgagaagggccagaaggacaaccgccccggcgacaaguuccagcucaccuucccccuccgcaccaacuacauguacgccaaggucaagaagucccuccccgagauguacgccuucaccgucugcauguggcucaaguccuccgccacccccggcgucggcacccccuucuccuacgccguccccggccaggccaacgagcucguccucaucgaguggggcaacaaccccauggagauccucaucaacgacaaggucgccaagcuccccuucgucaucaacgacggcaaguggcaccacaucugcgucaccuggaccacccgcgacggcgucugggaggccuaccaggacggcacccagggcggcuccggcgagaaccucgcccccuaccaccccaucaagccccagggcguccucguccucggccaggagcaggacacccucggcggcggcuucgacgccacccaggccuucgucggcgagcucgcccacuucaacaucugggaccgcaagcucacccccggcgaggucuacaaccucgccaccugcuccaccaaggcccucuccggcaacgucaucgccugggccgagucccacaucgagaucuacggcggcgccaccaaguggaccuucgaggccugccgccagaucaacuga

SEQ ID NO: 46811 - RNA, 1296 nt, Artificial Sequence
  derived and/or modified sequence opt2 from NPTX2__Homo_sapiens__NP_002514
augcucgcccuccucgccgccuccgucgcccucgccgucgccgccggcgcccaggacucccccgcccccggcucccgcuucgucugcaccgcccucccccccgaggccguccacgccggcugcccccuccccgccaugcccaugcagggcggcgcccagucccccgaggaggagcuccgcgccgccguccuccagcuccgcgagaccgucguccagcagaaggagacccucggcgcccagcgcgaggccauccgcgagcucaccggcaagcucgcccgcugcgagggccucgccggcggcaaggcccgcggcgccggcgccaccggcaaggacaccaugggcgaccucccccgcgaccccggccacgucgucgagcagcucucccgcucccuccagacccucaaggaccgccucgagucccucgagcaccagcuccgcgccaacgucuccaacgccggccuccccggcgacuuccgcgagguccuccagcagcgccucggcgagcucgagcgccagcuccuccgcaaggucgccgagcucgaggacgagaagucccuccuccacaacgagaccuccgcccaccgccagaagaccgaguccacccucaacgcccuccuccagcgcgucaccgagcucgagcgcggcaacuccgccuucaagucccccgacgccuucaaggucucccucccccuccgcaccaacuaccucuacggcaagaucaagaagacccuccccgagcucuacgccuucaccaucugccucuggcuccgcuccuccgccucccccggcaucggcacccccuucuccuacgccguccccggccaggccaacgagaucguccucaucgaguggggcaacaaccccaucgagcuccucaucaacgacaaggucgcccagcucccccucuucgucuccgacggcaaguggcaccacaucugcgucaccuggaccacccgcgacggcaugugggaggccuuccaggacggcgagaagcucggcaccggcgagaaccucgcccccuggcaccccaucaagcccggcggcguccucauccucggccaggagcaggacaccgucggcggccgcuucgacgccacccaggccuucgucggcgagcucucccaguucaacaucugggaccgcguccuccgcgcccaggagaucgucaacaucgccaacugcuccaccaacaugcccggcaacaucauccccugggucgacaacaacgucgacgucuucggcggcgccuccaaguggcccgucgagaccugcgaggagcgccuccucgaccucuga

SEQ ID NO: 46812 - RNA, 1503 nt, Artificial Sequence
  derived and/or modified sequence opt2 from NPTXR__Homo_sapiens__NP_055108
augaaguuccucgccguccuccucgccgccggcaugcucgccuuccucggcgccgucaucugcaucaucgccuccgucccccucgccgccucccccgcccgcgcccuccccggcggcgccgacaacgccuccgucgccuccggcgccgccgccucccccggcccccagcgcucccucuccgcccuccacggcgccggcggcuccgccggcccccccgcccuccccggcgcccccgccgccuccgcccacccccucccccccggcccccucuucucccgcuuccucugcaccccccucgccgccgccugccccuccggcgcccagcagggcgacgccgccggcgccgcccccggcgagcgcgaggagcuccuccuccuccaguccaccgccgagcagcuccgccagaccgcccuccagcaggaggcccgcauccgcgccgaccaggacaccauccgcgagcucaccggcaagcucggccgcugcgaguccggccucccccgcggccuccagggcgccggcccccgccgcgacaccauggccgacggccccugggacucccccgcccucauccucgagcucgaggacgccguccgcgcccuccgcgaccgcaucgaccgccucgagcaggagcuccccgcccgcgucaaccucuccgccgcccccgcccccgucuccgccguccccaccggccuccacuccaagauggaccagcucgagggccagcuccucgcccagguccucgcccucgagaaggagcgcgucgcccucucccacuccucccgccgccagcgccaggaggucgagaaggagcucgacguccuccagggccgcgucgccgagcucgagcacggcuccuccgccuacuccccccccgacgccuucaagaucuccauccccauccgcaacaacuacauguacgcccgcguccgcaaggcccuccccgagcucuacgccuucaccgccugcauguggcuccgcucccgcuccuccggcaccggccagggcacccccuucuccuacuccguccccggccaggccaacgagaucguccuccucgaggccggccacgagcccauggagcuccucaucaacgacaaggucgcccagcucccccucucccucaaggacaacggcuggcaccacaucugcaucgccuggaccacccgcgacggccucugguccgccuaccaggacggcgagcuccagggcuccggcgagaaccucgccgccuggcaccccaucaagccccacggcauccucauccucggccaggagcaggacacccucggcggccgcuucgacgccacccaggccuucgucggcgacaucgcccaguucaaccucugggaccacgcccucacccccgcccagguccucggcaucgccaacugcaccgccccccuccucggcaacguccuccccugggaggacaagcucgucgaggccuucggcggcgccaccaaggccgccuucgacgucugcaagggccgcgccaaggccuga

SEQ ID NO: 46813 - RNA, 591 nt, Artificial Sequence
  derived and/or modified sequence opt2 from NPVF__Homo_sapiens__NP_071433
auggagaucaucuccuccaagcucuucauccuccucacccucgccaccuccucccuccucaccuccaacaucuucugcgccgacgagcucgucauguccaaccuccacuccaaggagaacuacgacaaguacuccgagccccgcggcuaccccaagggcgagcgcucccucaacuucgaggagcucaaggacuggggccccaagaacgucaucaagauguccacccccgccgucaacaagaugccccacuccuucgccaaccucccccuccgcuucggccgcaacguccaggaggagcgcuccgccggcgccaccgccaaccucccccuccgcuccggccgcaacauggaggucucccucguccgccgcguccccaaccucccccagcgcuucggccgcaccaccaccgccaaguccgucugccgcaugcucuccgaccucugccagggcuccaugcacucccccugcgccaacgaccucuucuacuccaugaccugccagcaccaggagauccagaaccccgaccagaagcagucccgccgccuccucuucaagaagaucgacgacgccgagcucaagcaggagaaguga

SEQ ID NO: 46814 - RNA, 498 nt, Artificial Sequence
  derived and/or modified sequence opt2 from NPW__Homo_sapiens__NP_001092926
auggccuggcgccccggcgagcgcggcgcccccgccucccgcccccgccucgcccuccuccuccuccuccuccuccucccccuccccuccggcgccugguacaagcacgucgccuccccccgcuaccacaccgucggccgcgccgccggccuccucaugggccuccgccgcucccccuaccucuggcgccgcgcccuccgcgccgccgccggcccccucgcccgcgacacccucucccccgagcccgccgcccgcgaggccccccuccuccuccccuccuggguccaggagcucugggagacccgccgccgcuccucccaggccggcauccccguccgcgccccccgcuccccccgcgcccccgagcccgcccucgagcccgagucccucgacuucuccggcgccggccagcgccuccgccgcgacgucucccgccccgccgucgaccccgccgccaaccgccucggccuccccugccucgcccccggccccuucuga

SEQ ID NO: 46815 - RNA, 1155 nt, Artificial Sequence
  derived and/or modified sequence opt2 from NPY1R__Homo_sapiens__NP_000900
augaacuccacccucuucucccaggucgagaaccacuccguccacuccaacuucuccgagaagaacgcccagcuccucgccuucgagaacgacgacugccaccucccccucgccaugaucuucacccucgcccucgccuacggcgccgucaucauccucggcgucuccggcaaccucgcccucaucaucaucauccucaagcagaaggagaugcgcaacgucaccaacauccucaucgucaaccucuccuucuccgaccuccucgucgccaucaugugccuccccuucaccuucgucuacacccucauggaccacugggucuucggcgaggccaugugcaagcucaaccccuucguccagugcgucuccaucaccgucuccaucuucucccucguccucaucgccgucgagcgccaccagcucaucaucaacccccgcggcuggcgccccaacaaccgccacgccuacgucggcaucgccgucaucuggguccucgccgucgccuccucccuccccuuccucaucuaccaggucaugaccgacgagcccuuccagaacgucacccucgacgccuacaaggacaaguacgucugcuucgaccaguuccccuccgacucccaccgccucuccuacaccacccuccuccucguccuccaguacuucggcccccucugcuucaucuucaucugcuacuucaagaucuacauccgccucaagcgccgcaacaacaugauggacaagaugcgcgacaacaaguaccgcuccuccgagaccaagcgcaucaacaucaugcuccucuccaucgucgucgccuucgccgucugcuggcucccccucaccaucuucaacaccgucuucgacuggaaccaccagaucaucgccaccugcaaccacaaccuccucuuccuccucugccaccucaccgccaugaucuccaccugcgucaaccccaucuucuacggcuuccucaacaagaacuuccagcgcgaccuccaguucuucuucaacuucugcgacuuccgcucccgcgacgacgacuacgagaccaucgccauguccaccaugcacaccgacgucuccaagaccucccucaagcaggccucccccgucgccuucaagaagaucaacaacaacgacgacaacgagaagaucuga

SEQ ID NO: 46816 - RNA, 1146 nt, Artificial Sequence
  derived and/or modified sequence opt2 from NPY2R__Homo_sapiens__NP_000901
augggccccaucggcgccgaggccgacgagaaccagaccgucgaggagaugaaggucgagcaguacggcccccagaccaccccccgcggcgagcucguccccgaccccgagcccgagcucaucgacuccaccaagcucaucgagguccaggucguccucauccucgccuacugcuccaucauccuccucggcgucaucggcaacucccucgucauccacgucgucaucaaguucaaguccaugcgcaccgucaccaacuucuucaucgccaaccucgccgucgccgaccuccucgucaacacccucugccuccccuucacccucaccuacacccucaugggcgaguggaagaugggccccguccucugccaccucguccccuacgcccagggccucgccguccaggucuccaccaucacccucaccgucaucgcccucgaccgccaccgcugcaucgucuaccaccucgaguccaagaucuccaagcgcaucuccuuccucaucaucggccucgccuggggcaucuccgcccuccucgccuccccccucgccaucuuccgcgaguacucccucaucgagaucauccccgacuucgagaucgucgccugcaccgagaaguggcccggcgaggagaaguccaucuacggcaccgucuacucccucuccucccuccucauccucuacguccucccccucggcaucaucuccuucuccuacacccgcaucugguccaagcucaagaaccacgucucccccggcgccgccaacgaccacuaccaccagcgccgccagaagaccaccaagaugcucgucugcgucgucgucgucuucgccgucuccuggcucccccuccacgccuuccagcucgccgucgacaucgacucccagguccucgaccucaaggaguacaagcucaucuucaccgucuuccacaucaucgccaugugcuccaccuucgccaacccccuccucuacggcuggaugaacuccaacuaccgcaaggccuuccucuccgccuuccgcugcgagcagcgccucgacgccauccacuccgaggucuccgucaccuucaaggccaagaagaaccucgagguccgcaagaacuccggccccaacgacuccuucaccgaggccaccaacgucuga

SEQ ID NO: 46817 - RNA, 1362 nt, Artificial Sequence
  derived and/or modified sequence opt2 from NPY5R__Homo_sapiens__XP_011530316
auggacuccaagcaggacuacaacauggaccucgagcucgacgaguacuacaacaagacccucgccaccgagaacaacaccgccgccacccgcaacuccgacuuccccgucugggacgacuacaaguccuccgucgacgaccuccaguacuuccucaucggccucuacaccuucgucucccuccucggcuucaugggcaaccuccucauccucauggcccucaugaagaagcgcaaccagaagaccaccgucaacuuccucaucggcaaccucgccuucuccgacauccucgucguccucuucugcucccccuucacccucaccuccguccuccucgaccaguggauguucggcaaggucaugugccacaucaugcccuuccuccagugcgucuccguccucgucuccacccucauccucaucuccaucgccaucguccgcuaccacaugaucaagcaccccaucuccaacaaccucaccgccaaccacggcuacuuccucaucgccaccgucuggacccucggcuucgccaucugcuccccccuccccgucuuccacucccucgucgagcuccaggagaccuucggcuccgcccuccucuccucccgcuaccucugcgucgaguccuggcccuccgacuccuaccgcaucgccuucaccaucucccuccuccucguccaguacauccucccccucgucugccucaccgucucccacaccuccgucugccgcuccaucuccugcggccucuccaacaaggagaaccgccucgaggagaacgagaugaucaaccucacccuccaccccuccaagaaguccggcccccaggucaagcucuccggcucccacaagugguccuacuccuucaucaagaagcaccgccgccgcuacuccaagaagaccgccugcguccuccccgcccccgagcgccccucccaggagaaccacucccgcauccuccccgagaacuucggcuccguccgcucccagcucuccuccuccuccaaguucauccccggcguccccaccugcuucgagaucaagcccgaggagaacuccgacguccacgagcuccgcgucaagcgcuccgucacccgcaucaagaagcgcucccgcuccgucuucuaccgccucaccauccucauccucgucuucgccgucuccuggaugccccuccaccucuuccacgucgucaccgacuucaacgacaaccucaucuccaaccgccacuucaagcucgucuacugcaucugccaccuccucggcaugauguccugcugccucaaccccauccucuacggcuuccucaacaacggcaucaaggccgaccucgucucccucauccacugccuccacauguga

SEQ ID NO: 46818 - RNA, 294 nt, Artificial Sequence
  derived and/or modified sequence opt2 from NPY__Homo_sapiens__NP_000896
augcucggcaacaagcgccucggccucuccggccucacccucgcccucucccuccucgucugccucggcgcccucgccgaggccuaccccuccaagcccgacaaccccggcgaggacgcccccgccgaggacauggcccgcuacuacuccgcccuccgccacuacaucaaccucaucacccgccagcgcuacggcaagcgcuccucccccgagacccucaucuccgaccuccucaugcgcgaguccaccgagaacgucccccgcacccgccucgaggaccccgccaugugguga

SEQ ID NO: 46819 - RNA, 825 nt, Artificial Sequence
  derived and/or modified sequence opt2 from NQO1__Homo_sapiens__NP_000894
auggucggccgccgcgcccucaucguccucgcccacuccgagcgcaccuccuucaacuacgccaugaaggaggccgccgccgccgcccucaagaagaagggcugggaggucgucgaguccgaccucuacgccaugaacuucaaccccaucaucucccgcaaggacaucaccggcaagcucaaggaccccgccaacuuccaguaccccgccgaguccguccucgccuacaaggagggccaccucucccccgacaucgucgccgagcagaagaagcucgaggccgccgaccucgucaucuuccaguucccccuccagugguucggcguccccgccauccucaagggcugguucgagcgcgucuucaucggcgaguucgccuacaccuacgccgccauguacgacaagggccccuuccgcuccaagaaggccguccucuccaucaccaccggcggcuccggcuccauguacucccuccagggcauccacggcgacaugaacgucauccucuggcccauccaguccggcauccuccacuucugcggcuuccagguccucgagccccagcucaccuacuccaucggccacacccccgccgacgcccgcauccagauccucgagggcuggaagaagcgccucgagaacaucugggacgagaccccccucuacuucgcccccuccucccucuucgaccucaacuuccaggccggcuuccucaugaagaaggagguccaggacgaggagaagaacaagaaguucggccucuccgucggccaccaccucggcaaguccauccccaccgacaaccagaucaaggcccgcaaguga

SEQ ID NO: 46820 - RNA, 582 nt, Artificial Sequence
  derived and/or modified sequence opt2 from NQO2__Homo_sapiens__NP_001277151
auggccggcaagaagguccucaucgucuacgcccaccaggagcccaaguccuucaacggcucccucaagaacgucgccgucgacgagcucucccgccagggcugcaccgucaccgucuccgaccucuacgccaugaaccucgagccccgcgccaccgacaaggacaucaccggcacccucuccaaccccgaggucuucaacuacggcgucgagacccacgaggccuacaagcagcgcucccucgccuccgacaucaccgacgagcagaagaagguccgcgaggccgaccucgucaucuuccagggcaagcucgcccuccucuccgucaccaccggcggcaccgccgagauguacaccaagaccggcgucaacggcgacucccgcuacuuccucuggccccuccagcacggcacccuccacuucugcggcuucaagguccucgccccccagaucuccuucgcccccgagaucgccuccgaggaggagcgcaagggcauggucgccgccuggucccagcgccuccagaccaucuggaaggaggagcccauccccugcaccgcccacuggcacuucggccaguga

SEQ ID NO: 46821 - RNA, 1413 nt, Artificial Sequence
  derived and/or modified sequence opt2 from NR0B1__Homo_sapiens__NP_000466
auggccggcgagaaccaccaguggcagggcuccauccucuacaacaugcucauguccgccaagcagacccgcgccgcccccgaggcccccgagacccgccucgucgaccagugcuggggcugcuccugcggcgacgagcccggcgucggccgcgagggccuccucggcggccgcaacgucgcccuccucuaccgcugcugcuucugcggcaaggaccacccccgccagggcuccauccucuacuccaugcucaccuccgccaagcagaccuacgccgcccccaaggcccccgaggccacccucggccccugcuggggcugcuccugcggcuccgaccccggcgucggccgcgccggccuccccggcggccgccccgucgcccuccucuaccgcugcugcuucugcggcgaggaccacccccgccagggcuccauccucuacucccuccucaccuccuccaagcagacccacgucgcccccgccgcccccgaggcccgccccggcggcgccuggugggaccgcuccuacuucgcccagcgccccggcggcaaggaggcccuccccggcggccgcgccaccgcccuccucuaccgcugcugcuucugcggcgaggaccacccccagcagggcuccacccucuacugcguccccaccuccaccaaccaggcccaggccgcccccgaggagcgcccccgcgcccccuggugggacaccuccuccggcgcccuccgccccgucgcccucaaguccccccaggucgucugcgaggccgccuccgccggccuccucaagacccuccgcuucgucaaguaccuccccugcuuccagguccucccccucgaccagcagcucguccucguccgcaacugcugggccucccuccucaugcucgagcucgcccaggaccgccuccaguucgagaccgucgaggucuccgagcccuccaugcuccagaagauccucaccacccgccgccgcgagaccggcggcaacgagccccuccccguccccacccuccagcaccaccucgccccccccgccgaggcccgcaagguccccuccgccucccagguccaggccaucaagugcuuccucuccaagugcuggucccucaacaucuccaccaaggaguacgccuaccucaagggcaccguccucuucaaccccgacguccccggccuccagugcgucaaguacauccagggccuccaguggggcacccagcagauccucuccgagcacacccgcaugacccaccagggcccccacgaccgcuucaucgagcucaacuccacccucuuccuccuccgcuucaucaacgccaacgucaucgccgagcucuucuuccgccccaucaucggcaccgucuccauggacgacaugaugcucgagaugcucugcaccaagaucuga

SEQ ID NO: 46822 - RNA, 1845 nt, Artificial Sequence
  derived and/or modified sequence opt2 from NR1D1__Homo_sapiens__NP_068370
augaccacccucgacuccaacaacaacaccggcggcgucaucaccuacaucggcuccuccggcuccucccccucccgcaccucccccgagucccucuacuccgacaacuccaacggcuccuuccagucccucacccagggcugccccaccuacuucccccccucccccaccggcucccucacccaggaccccgcccgcuccuucggcuccaucccccccucccucuccgacgacggcucccccuccuccuccuccuccuccuccuccuccuccuccuccuucuacaacggcuccccccccggcucccuccaggucgccauggaggacuccucccgcgucucccccuccaaguccaccuccaacaucaccaagcucaacggcaugguccuccucugcaaggucugcggcgacgucgccuccggcuuccacuacggcguccacgccugcgagggcugcaagggcuucuuccgccgcuccauccagcagaacauccaguacaagcgcugccucaagaacgagaacugcuccaucguccgcaucaaccgcaaccgcugccagcagugccgcuucaagaagugccucuccgucggcaugucccgcgacgccguccgcuucggccgcauccccaagcgcgagaagcagcgcaugcucgccgagaugcaguccgccaugaaccucgccaacaaccagcucuccucccagugcccccucgagaccucccccacccagcaccccacccccggccccaugggccccucccccccccccgcccccguccccuccccccucgucggcuucucccaguucccccagcagcucacccccccccgcucccccucccccgagcccaccgucgaggacgucaucucccaggucgcccgcgcccaccgcgagaucuucaccuacgcccacgacaagcucggcuccucccccggcaacuucaacgccaaccacgccuccggcuccccccccgccaccaccccccaccgcugggagaaccagggcugcccccccgcccccaacgacaacaacacccucgccgcccagcgccacaacgaggcccucaacggccuccgccaggcccccuccuccuacccccccaccuggccccccggccccgcccaccacuccugccaccaguccaacuccaacggccaccgccucugccccacccacgucuacgccgcccccgagggcaaggcccccgccaacuccccccgccagggcaacuccaagaacguccuccucgccugccccaugaacauguacccccacggccgcuccggccgcaccguccaggagaucugggaggacuucuccauguccuucacccccgccguccgcgaggucgucgaguucgccaagcacauccccggcuuccgcgaccucucccagcacgaccaggucacccuccucaaggccggcaccuucgagguccucaugguccgcuucgccucccucuucaacgucaaggaccagaccgucauguuccucucccgcaccaccuacucccuccaggagcucggcgccaugggcaugggcgaccuccucuccgccauguucgacuucuccgagaagcucaacucccucgcccucaccgaggaggagcucggccucuucaccgccgucguccucgucuccgccgaccgcuccggcauggagaacuccgccuccgucgagcagcuccaggagacccuccuccgcgcccuccgcgcccucguccucaagaaccgcccccucgagaccucccgcuucaccaagcuccuccucaagcuccccgaccuccgcacccucaacaacaugcacuccgagaagcuccucuccuuccgcgucgacgcccaguga

SEQ ID NO: 46823 - RNA, 1740 nt, Artificial Sequence
  derived and/or modified sequence opt2 from NR1D2__Homo_sapiens__NP_005117
auggaggucaacgccggcggcgucaucgccuacaucuccuccuccuccuccgccuccucccccgccuccugccacuccgagggcuccgagaacuccuuccaguccuccuccuccuccguccccuccucccccaacuccuccaacuccgacaccaacggcaaccccaagaacggcgaccucgccaacaucgagggcauccucaagaacgaccgcaucgacugcuccaugaagaccuccaaguccuccgcccccggcaugaccaagucccacuccggcgucaccaaguucuccggcaugguccuccucugcaaggucugcggcgacgucgccuccggcuuccacuacggcguccacgccugcgagggcugcaagggcuucuuccgccgcuccauccagcagaacauccaguacaagaagugccucaagaacgagaacugcuccaucaugcgcaugaaccgcaaccgcugccagcagugccgcuucaagaagugccucuccgucggcaugucccgcgacgccguccgcuucggccgcauccccaagcgcgagaagcagcgcaugcucaucgagaugcaguccgccaugaagaccaugaugaacucccaguucuccggccaccuccagaacgacacccucgucgagcaccacgagcagaccgcccuccccgcccaggagcagcuccgccccaagccccagcucgagcaggagaacaucaaguccuccuccccccccuccuccgacuucgccaaggaggaggucaucggcauggucacccgcgcccacaaggacaccuucauguacaaccaggagcagcaggagaacuccgccgaguccaugcagccccagcgcggcgagcgcauccccaagaacauggagcaguacaaccucaaccacgaccacugcggcaacggccucuccucccacuuccccugcuccgagucccagcagcaccucaacggccaguucaagggccgcaacaucaugcacuaccccaacggccacgccaucugcaucgccaacggccacugcaugaacuucuccaacgccuacacccagcgcgucugcgaccgcguccccaucgacggcuucucccagaacgagaacaagaacuccuaccucugcaacaccggcggccgcaugcaccucgucugccccauguccaagucccccuacgucgacccccacaaguccggccacgagaucugggaggaguucuccauguccuucacccccgccgucaaggaggucgucgaguucgccaagcgcauccccggcuuccgcgaccucucccagcacgaccaggucaaccuccucaaggccggcaccuucgagguccucaugguccgcuucgccucccucuucgacgccaaggagcgcaccgucaccuuccucuccggcaagaaguacuccgucgacgaccuccacuccaugggcgccggcgaccuccucaacuccauguucgaguucuccgagaagcucaacgcccuccagcucuccgacgaggagaugucccucuucaccgccgucguccucgucuccgccgaccgcuccggcaucgagaacgucaacuccgucgaggcccuccaggagacccucauccgcgcccuccgcacccucaucaugaagaaccaccccaacgaggccuccaucuucaccaagcuccuccucaagcuccccgaccuccgcucccucaacaacaugcacuccgaggagcuccucgccuucaagguccaccccuga

SEQ ID NO: 46824 - RNA, 1095 nt, Artificial Sequence
  derived and/or modified sequence opt2 from NR1H2__Homo_sapiens__NP_001243576
auguccucccccaccaccuccucccucgacaccccccuccccggcaacggccccccccagcccggcgcccccuccuccucccccaccgucaaggaggagggccccgagcccuggcccggcggccccgaccccgacguccccggcaccgacgaggccuccuccgccugcuccaccgacuggggcguccucuccgaggagcagauccgcaagaagaagauccgcaagcagcagcagcaggagucccagucccagucccagucccccgucggcccccagggcuccuccuccuccgccuccggccccggcgccucccccggcggcuccgaggccggcucccagggcuccggcgagggcgagggcguccagcucaccgccgcccaggagcucaugauccagcagcucgucgccgcccagcuccagugcaacaagcgcuccuucuccgaccagcccaaggucacccccuggccccucggcgccgacccccagucccgcgacgcccgccagcagcgcuucgcccacuucaccgagcucgccaucaucuccguccaggagaucgucgacuucgccaagcagguccccggcuuccuccagcucggccgcgaggaccagaucgcccuccucaaggccuccaccaucgagaucaugcuccucgagaccgcccgccgcuacaaccacgagaccgagugcaucaccuuccucaaggacuucaccuacuccaaggacgacuuccaccgcgccggccuccaggucgaguucaucaaccccaucuucgaguucucccgcgccaugcgccgccucggccucgacgacgccgaguacgcccuccucaucgccaucaacaucuucuccgccgaccgccccaacguccaggagcccggccgcgucgaggcccuccagcagcccuacgucgaggcccuccucuccuacacccgcaucaagcgcccccaggaccagcuccgcuucccccgcaugcucaugaagcucgucucccuccgcacccucuccuccguccacuccgagcaggucuucgcccuccgccuccaggacaagaagcuccccccccuccucuccgagaucugggacguccacgaguga

SEQ ID NO: 46825 - RNA, 1164 nt, Artificial Sequence
  derived and/or modified sequence opt2 from NR1H3__Homo_sapiens__NP_001123573
augucccucuggcucggcgcccccguccccgacaucccccccgacuccgccgucgagcucuggaagcccggcgcccaggacgccuccucccaggcccagggcggcuccuccugcauccuccgcgaggaggcccgcaugccccacuccgccggcggcaccgccggcgucggccucgaggccgccgagcccaccgcccuccucacccgcgccgagccccccuccgagcccaccgagauccgcccccagaagcgcaagaagggccccgcccccaagaugcucggcaacgagcucugcuccgucugcggcgacaaggccuccggcuuccacuacaacguccucuccugcgagggcugcaagggcuucuuccgccgcuccgucaucaagggcgcccacuacaucugccacuccggcggccacugccccauggacaccuacaugcgccgcaagugccaggagugccgccuccgcaagugccgccaggccggcaugcgcgaggagugcguccucuccgaggagcagauccgccucaagaagcucaagcgccaggaggaggagcaggcccacgccaccucccuccccccccgcgccuccucccccccccagauccucccccagcucucccccgagcagcucggcaugaucgagaagcucgucgccgcccagcagcagugcaaccgccgcuccuucuccgaccgccuccgcgucaccgucaugcuccucgagaccucccgccgcuacaaccccggcuccgaguccaucaccuuccucaaggacuucuccuacaaccgcgaggacuucgccaaggccggccuccaggucgaguucaucaaccccaucuucgaguucucccgcgccaugaacgagcuccagcucaacgacgccgaguucgcccuccucaucgccaucuccaucuucuccgccgaccgccccaacguccaggaccagcuccaggucgagcgccuccagcacaccuacgucgaggcccuccacgccuacgucuccauccaccacccccacgaccgccucauguucccccgcaugcucaugaagcucgucucccuccgcacccucuccuccguccacuccgagcaggucuucgcccuccgccuccaggacaagaagcuccccccccuccucuccgagaucugggacguccacgaguga

SEQ ID NO: 46826 - RNA, 1278 nt, Artificial Sequence
  derived and/or modified sequence opt2 from NR1H4__Homo_sapiens__NP_001193907
augggcuccaagaugaaccucaucgagcacucccaccuccccaccaccgacgaguucuccuucuccgagaaccucuucggcguccucaccgagcaggucgccggcccccucggccagaaccucgaggucgagcccuacucccaguacuccaacguccaguucccccagguccagccccagaucuccuccuccuccuacuacuccaaccucggcuucuacccccagcagcccgaggagugguacucccccggcaucuacgagcuccgccgcaugcccgccgagacccucuaccagggcgagaccgaggucgccgagaugcccgucaccaagaagccccgcaugggcgccuccgccggccgcaucaagggcgacgagcucugcgucgucugcggcgaccgcgccuccggcuaccacuacaacgcccucaccugcgagggcugcaagggccuccucaccgagauccagugcaaguccaagcgccuccgcaagaacgucaagcagcacgccgaccagaccgucaacgaggacuccgagggccgcgaccuccgccaggucaccuccaccaccaaguccugccgcgagaagaccgagcucacccccgaccagcagacccuccuccacuucaucauggacuccuacaacaagcagcgcaugccccaggagaucaccaacaagauccucaaggaggaguucuccgccgaggagaacuuccucauccucaccgagauggccaccaaccacguccagguccucgucgaguucaccaagaagcuccccggcuuccagacccucgaccacgaggaccagaucgcccuccucaagggcuccgccgucgaggccauguuccuccgcuccgccgagaucuucaacaagaagcuccccuccggccacuccgaccuccucgaggagcgcauccgcaacuccggcaucuccgacgaguacaucacccccauguucuccuucuacaaguccaucggcgagcucaagaugacccaggaggaguacgcccuccucaccgccaucgucauccucucccccgaccgccaguacaucaaggaccgcgaggccgucgagaagcuccaggagccccuccucgacguccuccagaagcucugcaagauccaccagcccgagaacccccagcacuucgccugccuccucggccgccucaccgagcuccgcaccuucaaccaccaccacgccgagaugcucauguccuggcgcgucaacgaccacaaguucaccccccuccucugcgagaucugggacguccaguga

SEQ ID NO: 46827 - RNA, 1422 nt, Artificial Sequence
  derived and/or modified sequence opt2 from NR1I2__Homo_sapiens__NP_071285
augaccgucacccgcacccaccacuucaaggagggcucccuccgcgcccccgccaucccccuccacuccgccgccgccgagcucgccuccaaccacccccgcggccccgaggccaaccucgagguccgccccaaggaguccuggaaccacgccgacuucguccacugcgaggacaccgaguccguccccggcaagcccuccgucaacgccgacgaggaggucggcggcccccagaucugccgcgucugcggcgacaaggccaccggcuaccacuucaacgucaugaccugcgagggcugcaagggcuucuuccgccgcgccaugaagcgcaacgcccgccuccgcugccccuuccgcaagggcgccugcgagaucacccgcaagacccgccgccagugccaggccugccgccuccgcaagugccucgaguccggcaugaagaaggagaugaucauguccgacgaggccgucgaggagcgccgcgcccucaucaagcgcaagaaguccgagcgcaccggcacccagccccucggcguccagggccucaccgaggagcagcgcaugaugauccgcgagcucauggacgcccagaugaagaccuucgacaccaccuucucccacuucaagaacuuccgccuccccggcguccucuccuccggcugcgagcuccccgagucccuccaggcccccucccgcgaggaggccgccaaguggucccagguccgcaaggaccucugcucccucaaggucucccuccagcuccgcggcgaggacggcuccgucuggaacuacaagccccccgccgacuccggcggcaaggagaucuucucccuccucccccacauggccgacauguccaccuacauguucaagggcaucaucuccuucgccaaggucaucuccuacuuccgcgaccuccccaucgaggaccagaucucccuccucaagggcgccgccuucgagcucugccagcuccgcuucaacaccgucuucaacgccgagaccggcaccugggagugcggccgccucuccuacugccucgaggacaccgccggcggcuuccagcagcuccuccucgagcccaugcucaaguuccacuacaugcucaagaagcuccagcuccacgaggaggaguacguccucaugcaggccaucucccucuucucccccgaccgccccggcguccuccagcaccgcgucgucgaccagcuccaggagcaguucgccaucacccucaaguccuacaucgagugcaaccgcccccagcccgcccaccgcuuccucuuccucaagaucauggccaugcucaccgagcuccgcuccaucaacgcccagcacacccagcgccuccuccgcauccaggacauccaccccuucgccaccccccucaugcaggagcucuucggcaucaccggcuccuga

SEQ ID NO: 46828 - RNA, 1023 nt, Artificial Sequence
  derived and/or modified sequence opt2 from NR1I3__Homo_sapiens__NP_001070937
auggccucccgcgaggacgagcuccgcaacugcgucgucugcggcgaccaggccaccggcuaccacuucaacgcccucaccugcgagggcugcaagggcuucuuccgccgcaccgucuccaaguccaucggccccaccugccccuucgccggcuccugcgaggucuccaagacccagcgccgccacugccccgccugccgccuccagaagugccucgacgccggcaugcgcaaggacaugauccucuccgccgaggcccucgcccuccgccgcgccaagcaggcccagcgccgcgcccagcagacccccguccagcucuccaaggagcaggaggagcucauccgcacccuccucggcgcccacacccgccacaugggcaccauguucgagcaguucguccaguuccgcccccccgcccaccucuucauccaccaccagccccuccccacccucgcccccguccucccccucgucacccacuucgccgacaucaacaccuucaugguccuccaggucaucaaguucaccaaggaccuccccgucuuccgcucccuccccaucgaggaccagaucucccuccucaagggcgccgccgucgagaucugccacaucguccucaacaccaccuucugccuccagacccagaacuuccucugcggcccccuccgcuacaccaucgaggacggcgcccgcgucggcuuccaggucgaguuccucgagcuccucuuccacuuccacggcacccuccgcaagcuccagcuccaggagcccgaguacguccuccucgccgccauggcccucuucucccccgcccccuaccucaccgaccgccccggcgucacccagcgcgacgagaucgaccagcuccaggaggagauggcccucacccuccaguccuacaucaagggccagcagcgccgcccccgcgaccgcucccccggcacccccuggauccacugguccggcaagaugcucggccccaagaucggccccggcuccaagggcgcccaguggcuccaguga

SEQ ID NO: 46829 - RNA, 1404 nt, Artificial Sequence
  derived and/or modified sequence opt2 from NR2C1__Homo_sapiens__NP_001027458
auggccaccaucgaggagaucgcccaccagaucaucgagcagcagaugggcgagaucgucaccgagcagcagaccggccagaagauccagaucgucaccgcccucgaccacaacacccagggcaagcaguucauccucaccaaccacgacggcuccacccccuccaaggucauccucgcccgccaggacuccacccccggcaaggucuuccucaccacccccgacgccgccggcgucaaccagcucuucuucaccacccccgaccucuccgcccagcaccuccagcuccucaccgacaacucccccgaccagggccccaacaaggucuucgaccucugcgucgucugcggcgacaaggccuccggccgccacuacggcgccgucaccugcgagggcugcaagggcuucuucaagcgcuccauccgcaagaaccucgucuacuccugccgcggcuccaaggacugcaucaucaacaagcaccaccgcaaccgcugccaguacugccgccuccagcgcugcaucgccuucggcaugaagcaggacuccguccagugcgagcgcaagcccaucgaggucucccgcgagaaguccuccaacugcgccgccuccaccgagaagaucuacauccgcaaggaccuccgcuccccccucaccgccacccccaccuucgucaccgacuccgaguccacccgcuccaccggccuccucgacuccggcauguucaugaacauccaccccuccggcgucaagaccgaguccgccguccucaugaccuccgacaaggccgaguccugccagggcgaccucuccacccucgccaacgucgucaccucccucgccaaccucggcaagaccaaggaccucucccagaacuccaacgagauguccaugaucgagucccucuccaacgacgacaccucccucugcgaguuccaggagaugcagaccaacggcgacgucucccgcgccuucgacacccucgccaaggcccucaaccccggcgaguccaccgccugccaguccuccgucgccggcauggagggcuccguccaccucaucaccggcgacuccuccaucaacuacaccgagaaggagggcccccuccucuccgacucccacgucgccuuccgccucaccaugcccucccccaugcccgaguaccucaacguccacuacaucggcgaguccgccucccgccuccucuuccucuccaugcacugggcccucuccauccccuccuuccaggcccucggccaggagaacuccaucucccucgucaaggccuacuggaacgagcucuucacccucggccucgcccagugcuggcaggucaugaacgucgccaccauccucgccaccuucgucaacugccuccacaacucccuccagcaggccgagggcuga

SEQ ID NO: 46830 - RNA, 1791 nt, Artificial Sequence
  derived and/or modified sequence opt2 from NR2C2__Homo_sapiens__NP_001278623
augaccucccccuccccccgcauccagaucaucuccaccgacuccgccgucgccuccccccagcgcauccagaucgucaccgaccagcagaccggccagaagauccagaucgucaccgccgucgacgccuccggcucccccaagcagcaguucauccucaccucccccgacggcgccggcaccggcaaggucauccucgccucccccgagaccuccuccgccaagcagcucaucuucaccaccuccgacaaccucguccccggccgcauccagaucgucaccgacuccgccuccgucgagcgccuccucggcaagaccgacguccagcgcccccaggucgucgaguacugcgucgucugcggcgacaaggccuccggccgccacuacggcgccgucuccugcgagggcugcaagggcuucuucaagcgcuccguccgcaagaaccucaccuacuccugccgcuccaaccaggacugcaucaucaacaagcaccaccgcaaccgcugccaguucugccgccucaagaagugccucgagaugggcaugaagauggaguccguccaguccgagcgcaagcccuucgacguccagcgcgagaagcccuccaacugcgccgccuccaccgagaagaucuacauccgcaaggaccuccgcuccccccucaucgccacccccaccuucgucgccgacaaggacggcgcccgccagaccggccuccucgaccccggcaugcucgucaacauccagcagccccucauccgcgaggacggcaccguccuccucgccaccgacuccaaggccgagaccucccagggcgcccucggcacccucgccaacgucgucaccucccucgccaaccucuccgagucccucaacaacggcgacaccuccgagauccagcccgaggaccaguccgccuccgagaucacccgcgccuucgacacccucgccaaggcccucaacaccaccgacuccuccuccucccccucccucgccgacggcaucgacaccuccggcggcggcuccauccacgucaucucccgcgaccaguccacccccaucaucgaggucgagggcccccuccucuccgacacccacgucaccuucaagcucaccaugcccucccccaugcccgaguaccucaacguccacuacaucugcgaguccgccucccgccuccucuuccucuccaugcacugggcccgcuccauccccgccuuccaggcccucggccaggacugcaacaccucccucguccgcgccugcuggaacgagcucuucacccucggccucgcccagugcgcccaggucaugucccucuccaccauccucgccgccaucgucaaccaccuccagaacuccauccaggaggacaagcucuccggcgaccgcaucaagcaggucauggagcacaucuggaagcuccaggaguucugcaacuccauggccaagcucgacaucgacggcuacgaguacgccuaccucaaggccaucguccucuucucccccgaccaccccggccucaccuccaccucccagaucgagaaguuccaggagaaggcccagauggagcuccaggacuacguccagaagaccuacuccgaggacaccuaccgccucgcccgcauccucguccgccuccccgcccuccgccucauguccuccaacaucaccgaggagcucuucuucaccggccucaucggcaacgucuccaucgacuccaucauccccuacauccucaagauggagaccgccgaguacaacggccagaucaccggcgccucccucuga

SEQ ID NO: 46831 - RNA, 1269 nt, Artificial Sequence
  derived and/or modified sequence opt2 from NR2E1__Homo_sapiens__NP_001273031
auguuccgcgccggcgccgagggcgccgagaaggagcccuccccccgccccgagugccgcgccgaccccggccccggccucggcuucccccucggcuccggccuccccuggcccucccuccucgagucccccggcggccgcauccucgacauccccugcaaggucugcggcgaccgcuccuccggcaagcacuacggcgucuacgccugcgacggcugcuccggcuucuucaagcgcuccauccgccgcaaccgcaccuacgucugcaaguccggcaaccagggcggcugccccgucgacaagacccaccgcaaccagugccgcgccugccgccucaagaagugccucgaggucaacaugaacaaggacgccguccagcacgagcgcggcccccgcaccuccaccauccgcaagcaggucgcccucuacuuccgcggccacaaggaggagaacggcgccgccgcccacuuccccuccgccgcccuccccgcccccgccuucuucaccgccgucacccagcucgagccccacggccucgagcucgccgccgucuccaccacccccgagcgccagacccucgucucccucgcccagcccacccccaaguacccccacgaggucaacggcacccccauguaccucuacgaggucgccaccgaguccgucugcgaguccgccgcccgccuccucuucauguccaucaagugggccaaguccguccccgccuucuccacccucucccuccaggaccagcucaugcuccucgaggacgccuggcgcgagcucuucguccucggcaucgcccagugggccauccccgucgacgccaacacccuccucgccgucuccggcaugaacggcgacaacaccgacucccagaagcucaacaagaucaucuccgagauccaggcccuccaggaggucgucgcccgcuuccgccagcuccgccucgacgccaccgaguucgccugccucaagugcaucgucaccuucaaggccguccccacccacuccggcuccgagcuccgcuccuuccgcaacgccgccgccaucgccgcccuccaggacgaggcccagcucacccucaacuccuacauccacacccgcuaccccacccagcccugccgcuucggcaagcuccuccuccuccuccccgcccuccgcuccaucucccccuccaccaucgaggaggucuucuucaagaagaccaucggcaacguccccaucacccgccuccucuccgacauguacaaguccuccgacaucuga

SEQ ID NO: 46832 - RNA, 1233 nt, Artificial Sequence
  derived and/or modified sequence opt2 from NR2E3__Homo_sapiens__NP_055064
auggagacccgccccaccgcccucauguccuccaccgucgccgccgccgcccccgccgccggcgccgccucccgcaaggagucccccggccgcuggggccucggcgaggaccccaccggcgucucccccucccuccagugccgcgucugcggcgacuccuccuccggcaagcacuacggcaucuacgccugcaacggcugcuccggcuucuucaagcgcuccguccgccgccgccucaucuaccgcugccaggucggcgccggcaugugccccgucgacaaggcccaccgcaaccagugccaggccugccgccucaagaagugccuccaggccggcaugaaccaggacgccguccagaacgagcgccagccccgcuccaccgcccagguccaccucgacuccauggaguccaacaccgagucccgccccgagucccucgucgccccccccgcccccgccggccgcuccccccgcggccccacccccauguccgccgcccgcgcccucggccaccacuucauggccucccucaucaccgccgagaccugcgccaagcucgagcccgaggacgccgacgagaacaucgacgucaccuccaacgaccccgaguuccccuccucccccuacuccuccuccucccccugcggccucgacuccauccacgagaccuccgcccgccuccucuucauggccgucaagugggccaagaaccuccccgucuucuccucccuccccuuccgcgaccaggucauccuccucgaggaggccugguccgagcucuuccuccucggcgccauccaguggucccucccccucgacuccugcccccuccucgccccccccgaggccuccgccgccggcggcgcccagggccgccucacccucgccuccauggagacccgcguccuccaggagaccaucucccgcuuccgcgcccucgccgucgaccccaccgaguucgccugcaugaaggcccucguccucuucaagcccgagacccgcggccucaaggaccccgagcacgucgaggcccuccaggaccagucccaggucaugcucucccagcacuccaaggcccaccaccccucccagcccguccgcuucggcaagcuccuccuccuccuccccucccuccgcuucaucaccgccgagcgcaucgagcuccucuucuuccgcaagaccaucggcaacacccccauggagaagcuccucugcgacauguucaagaacuga

SEQ ID NO: 46833 - RNA, 1272 nt, Artificial Sequence
  derived and/or modified sequence opt2 from NR2F1__Homo_sapiens__NP_005645
auggccauggucgucuccuccuggcgcgacccccaggacgacgucgccggcggcaaccccggcggccccaaccccgccgcccaggccgcccgcggcggcggcggcggcgccggcgagcagcagcagcaggccggcuccggcgccccccacaccccccagacccccggccagcccggcgcccccgccacccccggcaccgccggcgacaagggccagggcccccccggcuccggccagucccagcagcacaucgagugcgucgucugcggcgacaaguccuccggcaagcacuacggccaguucaccugcgagggcugcaaguccuucuucaagcgcuccguccgccgcaaccucaccuacaccugccgcgccaaccgcaacugccccaucgaccagcaccaccgcaaccagugccaguacugccgccucaagaagugccucaaggucggcaugcgccgcgaggccguccagcgcggccgcaugccccccacccagcccaaccccggccaguacgcccucaccaacggcgacccccucaacggccacugcuaccucuccggcuacaucucccuccuccuccgcgccgagcccuaccccaccucccgcuacggcucccagugcaugcagcccaacaacaucaugggcaucgagaacaucugcgagcucgccgcccgccuccucuucuccgccgucgagugggcccgcaacauccccuucuuccccgaccuccagaucaccgaccaggucucccuccuccgccucaccugguccgagcucuucguccucaacgccgcccagugcuccaugccccuccacgucgccccccuccucgccgccgccggccuccacgccucccccauguccgccgaccgcgucgucgccuucauggaccacauccgcaucuuccaggagcaggucgagaagcucaaggcccuccacgucgacuccgccgaguacuccugccucaaggccaucguccucuucaccuccgacgccugcggccucuccgacgccgcccacaucgagucccuccaggagaagucccagugcgcccucgaggaguacguccgcucccaguaccccaaccagcccucccgcuucggcaagcuccuccuccgccuccccucccuccgcaccgucuccuccuccgucaucgagcagcucuucuucguccgccucgucggcaagacccccaucgagacccucauccgcgacaugcuccucuccggcuccuccuucaacuggcccuacauguccauccagugcuccuga

SEQ ID NO: 46834 - RNA, 846 nt, Artificial Sequence
  derived and/or modified sequence opt2 from NR2F2__Homo_sapiens__NP_001138627
augcaggccgucugggaccucgagcagggcaaguacggcuucgccguccagcgcggccgcaugccccccacccagcccacccacggccaguucgcccucaccaacggcgacccccucaacugccacuccuaccucuccggcuacaucucccuccuccuccgcgccgagcccuaccccaccucccgcuucggcucccagugcaugcagcccaacaacaucaugggcaucgagaacaucugcgagcucgccgcccgcaugcucuucuccgccgucgagugggcccgcaacauccccuucuuccccgaccuccagaucaccgaccaggucgcccuccuccgccucaccugguccgagcucuucguccucaacgccgcccagugcuccaugccccuccacgucgccccccuccucgccgccgccggccuccacgccucccccauguccgccgaccgcgucgucgccuucauggaccacauccgcaucuuccaggagcaggucgagaagcucaaggcccuccacgucgacuccgccgaguacuccugccucaaggccaucguccucuucaccuccgacgccugcggccucuccgacgucgcccacgucgagucccuccaggagaagucccagugcgcccucgaggaguacguccgcucccaguaccccaaccagcccacccgcuucggcaagcuccuccuccgccuccccucccuccgcaccgucuccuccuccgucaucgagcagcucuucuucguccgccucgucggcaagacccccaucgagacccucauccgcgacaugcuccucuccggcuccuccuucaacuggcccuacauggccauccaguga

SEQ ID NO: 46835 - RNA, 1215 nt, Artificial Sequence
  derived and/or modified sequence opt2 from NR2F6__Homo_sapiens__NP_005225
auggccauggucaccggcggcuggggcggccccggcggcgacaccaacggcgucgacaaggccggcggcuacccccgcgccgccgaggacgacuccgccuccccccccggcgccgccuccgacgccgagcccggcgacgaggagcgccccggccuccaggucgacugcgucgucugcggcgacaaguccuccggcaagcacuacggcgucuucaccugcgagggcugcaaguccuucuucaagcgcuccauccgccgcaaccucuccuacaccugccgcuccaaccgcgacugccagaucgaccagcaccaccgcaaccagugccaguacugccgccucaagaagugcuuccgcgucggcaugcgcaaggaggccguccagcgcggccgcaucccccacucccuccccggcgccgucgccgccuccuccggcuccccccccggcuccgcccucgccgccgucgccuccggcggcgaccucuuccccggccagcccgucuccgagcucaucgcccagcuccuccgcgccgagcccuaccccgccgccgccggccgcuucggcgccggcggcggcgccgccggcgccguccucggcaucgacaacgucugcgagcucgccgcccgccuccucuucuccaccgucgagugggcccgccacgcccccuucuuccccgagcuccccgucgccgaccaggucgcccuccuccgccucuccugguccgagcucuucguccucaacgccgcccaggccgcccucccccuccacaccgccccccuccucgccgccgccggccuccacgccgcccccauggccgccgagcgcgccgucgccuucauggaccagguccgcgccuuccaggagcaggucgacaagcucggccgccuccaggucgacuccgccgaguacggcugccucaaggccaucgcccucuucacccccgacgccugcggccucuccgaccccgcccacgucgagucccuccaggagaaggcccaggucgcccucaccgaguacguccgcgcccaguaccccucccagccccagcgcuucggccgccuccuccuccgccuccccgcccuccgcgccguccccgccucccucaucucccagcucuucuucaugcgccucgucggcaagacccccaucgagacccucauccgcgacaugcuccucuccggcuccaccuucaacuggcccuacggcuccggccaguga

SEQ ID NO: 46836 - RNA, 2334 nt, Artificial Sequence
  derived and/or modified sequence opt2 from NR3C1__Homo_sapiens__NP_001018085
auggacuccaaggagucccucacccccggccgcgaggagaaccccuccuccguccucgcccaggagcgcggcgacgucauggacuucuacaagacccuccgcggcggcgccaccgucaaggucuccgccuccucccccucccucgccgucgccucccaguccgacuccaagcagcgccgccuccucgucgacuuccccaagggcuccgucuccaacgcccagcagcccgaccucuccaaggccgucucccucuccaugggccucuacaugggcgagaccgagaccaaggucaugggcaacgaccucggcuucccccagcagggccagaucucccucuccuccggcgagaccgaccucaagcuccucgaggaguccaucgccaaccucaaccgcuccaccuccguccccgagaaccccaaguccuccgccuccaccgccgucuccgccgcccccaccgagaaggaguuccccaagacccacuccgacgucuccuccgagcagcagcaccucaagggccagaccggcaccaacggcggcaacgucaagcucuacaccaccgaccaguccaccuucgacauccuccaggaccucgaguucuccuccggcucccccggcaaggagaccaacgagucccccuggcgcuccgaccuccucaucgacgagaacugccuccucuccccccucgccggcgaggacgacuccuuccuccucgagggcaacuccaacgaggacugcaagccccucauccuccccgacaccaagcccaagaucaaggacaacggcgaccucguccucuccucccccuccaacgucacccucccccaggucaagaccgagaaggaggacuucaucgagcucugcacccccggcgucaucaagcaggagaagcucggcaccgucuacugccaggccuccuuccccggcgccaacaucaucggcaacaagauguccgccaucuccguccacggcgucuccaccuccggcggccagauguaccacuacgacaugaacaccgccucccucucccagcagcaggaccagaagcccaucuucaacgucaucccccccauccccgucggcuccgagaacuggaaccgcugccagggcuccggcgacgacaaccucaccucccucggcacccucaacuuccccggccgcaccgucuucuccaacggcuacuccucccccuccaugcgccccgacgucuccuccccccccuccuccuccuccaccgccaccaccggccccccccccaagcucugccucgucugcuccgacgaggccuccggcugccacuacggcguccucaccugcggcuccugcaaggucuucuucaagcgcgccgucgagggccagcacaacuaccucugcgccggccgcaacgacugcaucaucgacaagauccgccgcaagaacugccccgccugccgcuaccgcaagugccuccaggccggcaugaaccucgaggcccgcaagaccaagaagaagaucaagggcauccagcaggccaccaccggcgucucccaggagaccuccgagaaccccggcaacaagaccaucguccccgccacccucccccagcucacccccacccucgucucccuccucgaggucaucgagcccgagguccucuacgccggcuacgacuccuccguccccgacuccaccuggcgcaucaugaccacccucaacaugcucggcggccgccaggucaucgccgccgucaagugggccaaggccauccccggcuuccgcaaccuccaccucgacgaccagaugacccuccuccaguacuccuggauguuccucauggccuucgcccucggcuggcgcuccuaccgccaguccuccgccaaccuccucugcuucgcccccgaccucaucaucaacgagcagcgcaugacccuccccugcauguacgaccagugcaagcacaugcucuacgucuccuccgagcuccaccgccuccaggucuccuacgaggaguaccucugcaugaagacccuccuccuccucuccuccguccccaaggacggccucaagucccaggagcucuucgacgagauccgcaugaccuacaucaaggagcucggcaaggccaucgucaagcgcgagggcaacuccucccagaacuggcagcgcuucuaccagcucaccaagcuccucgacuccaugcacgaggucgucgagaaccuccucaacuacugcuuccagaccuuccucgacaagaccauguccaucgaguuccccgagaugcucgccgagaucaucaccaaccagauccccaaguacuccaacggcaacaucaagaagcuccucuuccaccagaaguga

SEQ ID NO: 46837 - RNA, 2955 nt, Artificial Sequence
  derived and/or modified sequence opt2 from NR3C2__Homo_sapiens__NP_000892
auggagaccaagggcuaccacucccuccccgagggccucgacauggagcgccgcuggggccaggucucccaggccgucgagcgcuccucccucggccccaccgagcgcaccgacgagaacaacuacauggagaucgucaacgucuccugcgucuccggcgccauccccaacaacuccacccagggcuccuccaaggagaagcaggagcuccuccccugccuccagcaggacaacaaccgccccggcauccucaccuccgacaucaagaccgagcucgaguccaaggagcucuccgccaccgucgccgaguccaugggccucuacauggacuccguccgcgacgccgacuacuccuacgagcagcagaaccagcagggcuccaugucccccgccaagaucuaccagaacgucgagcagcucgucaaguucuacaagggcaacggccaccgccccuccacccucuccugcgucaacaccccccuccgcuccuucauguccgacuccggcuccuccgucaacggcggcgucaugcgcgccgucgucaagucccccaucaugugccacgagaagucccccuccgucugcuccccccucaacaugaccuccuccgucugcucccccgccggcaucaacuccgucuccuccaccaccgccuccuucggcuccuuccccguccacucccccaucacccagggcaccccccucaccugcucccccaacgucgagaaccgcggcucccgcucccacucccccgcccacgccuccaacgucggcuccccccucuccuccccccucuccuccaugaaguccuccaucuccuccccccccucccacugcuccgucaagucccccgucuccucccccaacaacgucacccuccgcuccuccgucuccucccccgccaacaucaacaacucccgcugcuccgucuccucccccuccaacaccaacaaccgcuccacccucuccucccccgccgccuccaccgucggcuccaucugcucccccgucaacaacgccuucuccuacaccgccuccggcaccuccgccggcuccuccacccuccgcgacgucguccccucccccgacacccaggagaagggcgcccaggagguccccuuccccaagaccgaggaggucgaguccgccaucuccaacggcgucaccggccagcucaacaucguccaguacaucaagcccgagcccgacggcgccuucuccuccuccugccucggcggcaacuccaagaucaacuccgacuccuccuucuccguccccaucaagcaggaguccaccaagcacuccugcuccggcaccuccuucaagggcaaccccaccgucaaccccuuccccuucauggacggcuccuacuucuccuucauggacgacaaggacuacuacucccucuccggcauccucggcccccccguccccggcuucgacggcaacugcgagggcuccggcuuccccgucggcaucaagcaggagcccgacgacggcuccuacuaccccgaggccuccauccccuccuccgccaucgucggcgucaacuccggcggccaguccuuccacuaccgcaucggcgcccagggcaccaucucccucucccgcuccgcccgcgaccaguccuuccagcaccucuccuccuucccccccgucaacacccucgucgaguccuggaagucccacggcgaccucuccucccgccgcuccgacggcuaccccguccucgaguacauccccgagaacgucuccuccuccacccuccgcuccgucuccaccggcuccucccgccccuccaagaucugccucgucugcggcgacgaggccuccggcugccacuacggcgucgucaccugcggcuccugcaaggucuucuucaagcgcgccgucgagggccagcacaacuaccucugcgccggccgcaacgacugcaucaucgacaagauccgccgcaagaacugccccgccugccgccuccagaagugccuccaggccggcaugaaccucggcgcccgcaaguccaagaagcucggcaagcucaagggcauccacgaggagcagccccagcagcagcagcccccccccccccccccccccccccagucccccgaggagggcaccaccuacaucgcccccgccaaggagcccuccgucaacaccgcccucgucccccagcucuccaccaucucccgcgcccucacccccucccccgucaugguccucgagaacaucgagcccgagaucgucuacgccggcuacgacuccuccaagcccgacaccgccgagaaccuccucuccacccucaaccgccucgccggcaagcagaugauccaggucgucaagugggccaagguccuccccggcuucaagaaccucccccucgaggaccagaucacccucauccaguacuccuggaugugccucuccuccuucgcccucuccuggcgcuccuacaagcacaccaacucccaguuccucuacuucgcccccgaccucgucuucaacgaggagaagaugcaccaguccgccauguacgagcucugccagggcaugcaccagaucucccuccaguucguccgccuccagcucaccuucgaggaguacaccaucaugaagguccuccuccuccucuccaccauccccaaggacggccucaagucccaggccgccuucgaggagaugcgcaccaacuacaucaaggagcuccgcaagauggucaccaagugccccaacaacuccggccaguccuggcagcgcuucuaccagcucaccaagcuccucgacuccaugcacgaccucgucuccgaccuccucgaguucugcuucuacaccuuccgcgagucccacgcccucaaggucgaguuccccgccaugcucgucgagaucaucuccgaccagcuccccaaggucgaguccggcaacgccaagccccucuacuuccaccgcaaguga

SEQ ID NO: 46838 - RNA, 1836 nt, Artificial Sequence
  derived and/or modified sequence opt2 from NR4A1__Homo_sapiens__NP_001189162
auguggcucgccaaggccugcugguccauccaguccgagaugcccugcauccaggcccaguacggcacccccgcccccucccccggcccccgcgaccaccucgccuccgacccccucacccccgaguucaucaagcccaccauggaccucgccucccccgaggccgcccccgccgcccccaccgcccuccccuccuucuccaccuucauggacggcuacaccggcgaguucgacaccuuccucuaccagcuccccggcaccguccagcccugcuccuccgccuccuccuccgccuccuccaccuccuccuccuccgccaccucccccgccuccgccuccuucaaguucgaggacuuccaggucuacggcugcuaccccggcccccucuccggccccgucgacgaggcccucuccuccuccggcuccgacuacuacggcucccccugcuccgcccccucccccuccacccccuccuuccagcccccccagcucucccccugggacggcuccuucggccacuucucccccucccagaccuacgagggccuccgcgccuggaccgagcagcuccccaaggccuccggccccccccagccccccgccuucuucuccuucuccccccccaccggccccucccccucccucgcccaguccccccucaagcucuuccccucccaggccacccaccagcucggcgagggcgaguccuacuccaugcccaccgccuuccccggccucgcccccaccuccccccaccucgagggcuccggcauccucgacacccccgucaccuccaccaaggcccgcuccggcgcccccggcggcuccgagggccgcugcgccgucugcggcgacaacgccuccugccagcacuacggcguccgcaccugcgagggcugcaagggcuucuucaagcgcaccguccagaagaacgccaaguacaucugccucgccaacaaggacugccccgucgacaagcgccgccgcaaccgcugccaguucugccgcuuccagaagugccucgccgucggcauggucaaggaggucguccgcaccgacucccucaagggccgccgcggccgccuccccuccaagcccaagcagccccccgacgccucccccgccaaccuccucaccucccucguccgcgcccaccucgacuccggccccuccaccgccaagcucgacuacuccaaguuccaggagcucguccucccccacuucggcaaggaggacgccggcgacguccagcaguucuacgaccuccucuccggcucccucgaggucauccgcaagugggccgagaagauccccggcuucgccgagcucucccccgccgaccaggaccuccuccucgaguccgccuuccucgagcucuucauccuccgccucgccuaccgcuccaagcccggcgagggcaagcucaucuucugcuccggccucguccuccaccgccuccagugcgcccgcggcuucggcgacuggaucgacuccauccucgccuucucccgcucccuccacucccuccucgucgacguccccgccuucgccugccucuccgcccucguccucaucaccgaccgccacggccuccaggagccccgccgcgucgaggagcuccagaaccgcaucgccuccugccucaaggagcacgucgccgccgucgccggcgagccccagcccgccuccugccucucccgccuccucggcaagcuccccgagcuccgcacccucugcacccagggccuccagcgcaucuucuaccucaagcucgaggaccucgucccccccccccccaucaucgacaagaucuucauggacacccuccccuucuga

SEQ ID NO: 46839 - RNA, 1797 nt, Artificial Sequence
  derived and/or modified sequence opt2 from NR4A2__Homo_sapiens__NP_006177
augcccugcguccaggcccaguacggcuccuccccccagggcgccucccccgccucccaguccuacuccuaccacuccuccggcgaguacuccuccgacuuccucacccccgaguucgucaaguucuccauggaccucaccaacaccgagaucaccgccaccaccucccuccccuccuucuccaccuucauggacaacuacuccaccggcuacgacgucaagccccccugccucuaccagaugccccucuccggccagcaguccuccaucaaggucgaggacauccagaugcacaacuaccagcagcacucccaccuccccccccaguccgaggagaugaugccccacuccggcuccgucuacuacaagcccuccuccccccccacccccaccacccccggcuuccagguccagcacucccccaugugggacgaccccggcucccuccacaacuuccaccagaacuacgucgccaccacccacaugaucgagcagcgcaagacccccgucucccgccucucccucuucuccuucaagcaguccccccccggcacccccgucuccuccugccagaugcgcuucgacggcccccuccacguccccaugaaccccgagcccgccggcucccaccacgucgucgacggccagaccuucgccguccccaaccccauccgcaagcccgccuccaugggcuuccccggccuccagaucggccacgccucccagcuccucgacacccagguccccuccccccccucccgcggcucccccuccaacgagggccucugcgccgucugcggcgacaacgccgccugccagcacuacggcguccgcaccugcgagggcugcaagggcuucuucaagcgcaccguccagaagaacgccaaguacgucugccucgccaacaagaacugccccgucgacaagcgccgccgcaaccgcugccaguacugccgcuuccagaagugccucgccgucggcauggucaaggaggucguccgcaccgacucccucaagggccgccgcggccgccuccccuccaagcccaaguccccccaggagcccuccccccccuccccccccgucucccucaucuccgcccucguccgcgcccacgucgacuccaaccccgccaugaccucccucgacuacucccgcuuccaggccaaccccgacuaccagauguccggcgacgacacccagcacauccagcaguucuacgaccuccucaccggcuccauggagaucauccgcggcugggccgagaagauccccggcuucgccgaccuccccaaggccgaccaggaccuccucuucgaguccgccuuccucgagcucuucguccuccgccucgccuaccgcuccaaccccgucgagggcaagcucaucuucugcaacggcgucguccuccaccgccuccagugcguccgcggcuucggcgaguggaucgacuccaucgucgaguucuccuccaaccuccagaacaugaacaucgacaucuccgccuucuccugcaucgccgcccucgccauggucaccgagcgccacggccucaaggagcccaagcgcgucgaggagcuccagaacaagaucgucaacugccucaaggaccacgucaccuucaacaacggcggccucaaccgccccaacuaccucuccaagcuccucggcaagcuccccgagcuccgcacccucugcacccagggccuccagcgcaucuucuaccucaagcucgaggaccucguccccccccccgccaucaucgacaagcucuuccucgacacccuccccuucuga

SEQ ID NO: 46840 - RNA, 1881 nt, Artificial Sequence
  derived and/or modified sequence opt2 from NR4A3__Homo_sapiens__NP_008912
augcccugcguccaggcccaguacucccccuccccccccggcuccuccuacgccgcccagaccuacuccuccgaguacaccaccgagaucaugaaccccgacuacaccaagcucaccauggaccucggcuccaccgagaucaccgccaccgccaccaccucccuccccuccaucuccaccuucgucgagggcuacuccuccaacuacgagcucaagcccuccugcgucuaccagaugcagcgcccccucaucaaggucgaggagggccgcgcccccuccuaccaccaccaccaccaccaccaccaccaccaccaccaccaccaccagcagcagcaccagcagcccuccaucccccccgccuccucccccgaggacgagguccuccccuccaccuccauguacuucaagcaguccccccccuccacccccaccacccccgccuuccccccccaggccggcgcccucugggacgaggcccuccccuccgcccccggcugcaucgcccccggcccccuccucgacccccccaugaaggccguccccaccgucgccggcgcccgcuucccccucuuccacuucaagcccucccccccccacccccccgcccccucccccgccggcggccaccaccucggcuacgaccccaccgccgccgccgcccucucccucccccucggcgccgccgccgccgccggcucccaggccgccgcccucgagucccaccccuacggccucccccucgccaagcgcgccgccccccucgccuuccccccccucggccucacccccucccccaccgccuccucccuccucggcgagucccccucccuccccuccccccccucccgcuccuccuccuccggcgagggcaccugcgccgucugcggcgacaacgccgccugccagcacuacggcguccgcaccugcgagggcugcaagggcuucuucaagcgcaccguccagaagaacgccaaguacgucugccucgccaacaagaacugccccgucgacaagcgccgccgcaaccgcugccaguacugccgcuuccagaagugccucuccgucggcauggucaaggaggucguccgcaccgacucccucaagggccgccgcggccgccuccccuccaagcccaaguccccccuccagcaggagcccucccagcccuccccccccuccccccccaucugcaugaugaacgcccucguccgcgcccucaccgacuccaccccccgcgaccucgacuacucccgcuacugccccaccgaccaggccgccgccggcaccgacgccgagcacguccagcaguucuacaaccuccucaccgccuccaucgacgucucccgcuccugggccgagaagauccccggcuucaccgaccuccccaaggaggaccagacccuccucaucgaguccgccuuccucgagcucuucguccuccgccucuccauccgcuccaacaccgccgaggacaaguucgucuucugcaacggccucguccuccaccgccuccagugccuccgcggcuucggcgaguggcucgacuccaucaaggacuucucccucaaccuccagucccucaaccucgacauccaggcccucgccugccucuccgcccucuccaugaucaccgagcgccacggccucaaggagcccaagcgcgucgaggagcucugcaacaagaucaccuccucccucaaggaccaccaguccaagggccaggcccucgagcccaccgaguccaagguccucggcgcccucgucgagcuccgcaagaucugcacccucggccuccagcgcaucuucuaccucaagcucgaggaccucgucuccccccccuccaucaucgacaagcucuuccucgacacccuccccuucuga

SEQ ID NO: 46841 - RNA, 1386 nt, Artificial Sequence
  derived and/or modified sequence opt2 from NR5A1__Homo_sapiens__NP_004950
auggacuacuccuacgacgaggaccucgacgagcucugccccgucugcggcgacaaggucuccggcuaccacuacggccuccucaccugcgaguccugcaagggcuucuucaagcgcaccguccagaacaacaagcacuacaccugcaccgagucccaguccugcaagaucgacaagacccagcgcaagcgcugccccuucugccgcuuccagaagugccucaccgucggcaugcgccucgaggccguccgcgccgaccgcaugcgcggcggccgcaacaaguucggccccauguacaagcgcgaccgcgcccucaagcagcagaagaaggcccagauccgcgccaacggcuucaagcucgagaccggcccccccaugggcgucccccccccccccccccccgcccccgacuacguccucccccccucccuccacggccccgagcccaagggccucgccgccggcccccccgccggcccccucggcgacuucggcgcccccgcccuccccauggccguccccggcgcccacggcccccucgccggcuaccucuaccccgccuuccccggccgcgccaucaaguccgaguaccccgagcccuacgccucccccccccagcccggccuccccuacggcuaccccgagcccuucuccggcggccccaacguccccgagcucauccuccagcuccuccagcucgagcccgacgaggaccagguccgcgcccgcauccucggcugccuccaggagcccaccaagucccgccccgaccagcccgccgccuucggccuccucugccgcauggccgaccagaccuucaucuccaucgucgacugggcccgccgcugcauggucuucaaggagcucgaggucgccgaccagaugacccuccuccagaacugcugguccgagcuccucgucuucgaccacaucuaccgccagguccagcacggcaaggagggcuccauccuccucgucaccggccaggaggucgagcucaccaccgucgccacccaggccggcucccuccuccacucccucguccuccgcgcccaggagcucguccuccagcuccucgcccuccagcucgaccgccaggaguucgucugccucaaguucaucauccucuucucccucgaccucaaguuccucaacaaccacauccucgucaaggacgcccaggagaaggccaacgccgcccuccucgacuacacccucugccacuacccccacugcggcgacaaguuccagcagcuccuccucugccucgucgagguccgcgcccucuccaugcaggccaaggaguaccucuaccacaagcaccucggcaacgagaugccccgcaacaaccuccucaucgagaugcuccaggccaagcagaccuga

SEQ ID NO: 46842 - RNA, 1410 nt, Artificial Sequence
  derived and/or modified sequence opt2 from NR5A2__Homo_sapiens__NP_001263393
auggucaacuacuccuacgacgaggaccucgaggagcucugccccgucugcggcgacaaggucuccggcuaccacuacggccuccucaccugcgaguccugcaagggcuucuucaagcgcaccguccagaacaacaagcgcuacaccugcaucgagaaccagaacugccagaucgacaagacccagcgcaagcgcugccccuacugccgcuuccagaagugccucuccgucggcaugaagcucgaggccguccgcgccgaccgcaugcgcggcggccgcaacaaguucggccccauguacaagcgcgaccgcgcccucaagcagcagaagaaggcccucauccgcgccaacggccucaagcucgaggccaugucccaggucauccaggccaugcccuccgaccucaccaucuccuccgccauccagaacauccacuccgccuccaagggccucccccucaaccacgccgcccucccccccaccgacuacgaccgcucccccuucgucaccucccccaucuccaugaccaugcccccccacggcucccuccagggcuaccagaccuacggccacuuccccucccgcgccaucaaguccgaguaccccgaccccuacaccuccucccccgaguccaucaugggcuacuccuacauggacuccuaccagaccuccucccccgccuccaucccccaccucauccucgagcuccucaagugcgagcccgacgagccccagguccaggccaagaucauggccuaccuccagcaggagcaggccaaccgcuccaagcacgagaagcucuccaccuucggccucaugugcaagauggccgaccagacccucuucuccaucgucgagugggcccgcuccuccaucuucuuccgcgagcucaaggucgacgaccagaugaagcuccuccagaacugcugguccgagcuccucauccucgaccacaucuaccgccaggucguccacggcaaggagggcuccaucuuccucgucaccggccagcaggucgacuacuccaucaucgccucccaggccggcgccacccucaacaaccucaugucccacgcccaggagcucgucgccaagcuccgcucccuccaguucgaccagcgcgaguucgucugccucaaguuccucguccucuucucccucgacgucaagaaccucgagaacuuccagcucgucgagggcguccaggagcaggucaacgccgcccuccucgacuacaccaugugcaacuacccccagcagaccgagaaguucggccagcuccuccuccgccuccccgagauccgcgccaucuccaugcaggccgaggaguaccucuacuacaagcaccucaacggcgacguccccuacaacaaccuccucaucgagaugcuccacgccaagcgcgccuga

SEQ ID NO: 46843 - RNA, 1431 nt, Artificial Sequence
  derived and/or modified sequence opt2 from NR6A1__Homo_sapiens__NP_001265475
auggagcgcgacgagcccccccccuccggcggcggcggcggcggcggcuccgccggcuuccucgagccccccgccgcccuccccccccccccccgcaacggcuucugccaggacgagcucgccgagcucgaccccggcaccaacgaccgcgccgagcagcgcaccugccucaucugcggcgaccgcgccaccggccuccacuacggcaucaucuccugcgagggcugcaagggcuucuucaagcgcuccaucugcaacaagcgcgucuaccgcugcucccgcgacaagaacugcgucaugucccgcaagcagcgcaaccgcugccaguacugccgccuccucaagugccuccagaugggcaugaaccgcaaggccauccgcgaggacggcaugcccggcggccgcaacaaguccaucggccccguccagaucuccgaggaggagaucgagcgcaucauguccggccaggaguucgaggaggaggccaaccacugguccaaccacggcgacuccgaccacuccucccccggcaaccgcgccuccgaguccaaccagcccucccccggcuccacccucuccuccucccgcuccgucgagcucaacggcuucauggccuuccgcgagcaguacaugggcauguccguccccccccacuaccaguacaucccccaccucuucuccuacuccggccacuccccccuccucccccagcaggcccgcucccucgacccccaguccuacucccucauccaccagcuccucuccgccgaggaccucgagccccucggcacccccaugcucaucgaggacggcuacgccgucacccaggccgagcucuucgcccuccucugccgccucgccgacgagcuccucuuccgccagaucgccuggaucaagaagcuccccuucuucugcgagcucuccaucaaggacuacaccugccuccucuccuccaccuggcaggagcucauccuccucuccucccucaccgucuacuccaagcagaucuucggcgagcucgccgacgucaccgccaaguacucccccuccgacgaggagcuccaccgcuucuccgacgagggcauggaggucaucgagcgccucaucuaccucuaccacaaguuccaccagcucaaggucuccaacgaggaguacgccugcaugaaggccaucaacuuccucaaccaggacauccgcggccucaccuccgccucccagcucgagcagcucaacaagcgcuacugguacaucugccaggacuucaccgaguacaaguacacccaccagcccaaccgcuuccccgaccucaugaugugccuccccgagauccgcuacaucgccggcaagauggucaacgucccccucgagcagcucccccuccucuucaaggucguccuccacuccugcaagaccuccgucggcaaggaguga

SEQ ID NO: 46844 - RNA, 5088 nt, Artificial Sequence
  derived and/or modified sequence opt2 from NRAP__Homo_sapiens__NP_006166
augaacguccagcccugcucccgcugcggcuacggcgucuaccccgccgagaagaucuccugcaucgaccagaucuggcacaaggccugcuuccacugcgaggucugcaagaugaugcucuccgucaacaacuucgucucccaccagaagaagcccuacugccacgcccacaaccccaagaacaacaccuucaccuccgucuaccacaccccccucaaccucaacguccgcaccuuccccgaggccaucuccggcauccacgaccaggaggacggcgagcagugcaaguccgucuuccacugggacaugaaguccaaggacaaggagggcgcccccaaccgccagccccucgccaacgagcgcgccuacuggaccggcuacggcgagggcaacgccuggugccccggcgcccuccccgaccccgagaucguccgcauggucgaggcccgcaagucccucggcgaggaguacaccgaggacuacgagcagccccgcggcaagggcuccuuccccgccaugaucacccccgccuaccagcgcgccaagaaggccaaccagcucgccucccaggucgaguacaagcgcggccacgacgagcgcaucucccgcuucuccaccgucgucgacacccccgagcuccuccgcuccaaggccggcgcccagcuccaguccgacguccgcuacaccgaggacuacgagcagcagcgcggcaagggcuccuuccccgccaugaucacccccgccuaccagaucgccaagcgcgccaacgagcucgccuccgacguccgcuaccaccagcaguaccagaaggagaugcgcggcauggccggccccgccaucggcgccgagggcauccucacccgcgagugcgccgaccaguacggccagggcuaccccgaggaguacgaggagcaccgcggcaagggcuccuuccccgccaugaucacccccgccuaccagaacgccaagaaggcccacgagcucgccuccgacaucaaguaccgccaggacuucaacaagaugaagggcgccgcccacuaccacucccuccccgcccaggacaaccucguccucaagcaggcccaguccgucaacaagcucgucuccgagaacaaguacaaggagaacuaccagaaccacaugcgcggccgcuacgagggcgucggcauggaccgccgcacccuccacgccaugaaggucggcucccucgccuccaacgucgccuacaaggccgacuacaagcacgacaucgucgacuacaacuaccccgccacccucacccccuccuaccagaccgccaugaagcucgucccccucaaggacgccaacuaccgccaguccaucgacaagcucaaguacuccuccgucaccgacaccccccagaucguccaggccaagaucaacgcccagcagcucucccacgucaacuaccgcgccgacuacgagaagaacaagcucaacuacacccucccccaggacgucccccagcucgucaaggccaagaccaacgccaagcucuucuccgaggucaaguacaaggagggcugggagaagaccaagggcaagggcuucgagaugaagcucgacgccaugucccuccucgccgccaaggccuccggcgagcucgccuccaacaucaaguacaaggaggaguacgagaagaccaagggcaaggccaugggcaccgccgacucccgccuccuccacucccuccagaucgccaagauguccuccgaggucgaguacaagaagggcuucgaggaguccaagacccgcuuccaccuccccauggacauggucaacauccgccacgccaagaaggcccagacccucgccuccgaccucgacuaccgcaagaagcuccacgaguacaccguccuccccgaggacaugaagacccagugggccaagaaggccuacggccuccaguccgagcuccaguacaaggccgaccucgccuggaugaagggcgucggcuggcucaccgagggcucccucaaccucgagcaggccaagaaggccggccagcucgucuccgagaagaacuaccgccagcgcgucgacgagcucaaguucaccuccgucaccgacuccucccagauggagcacgccaagaagucccaggagcuccaguccggcgucgccuacaaggccggcaacgagcaguccguccaccaguacaccaucuccaaggacgagccccucuuccuccaggcccgcgccaacgccgccaaccucuccgagaagcucuacaaguccuccugggagaaccagaaggccaagggcuucgagcuccgccucgacucccucaccuuccucgccgccaaggccaagcgcgaccucgccuccgaggucaaguacaaggaggacuacgagcgcucccgcggcaagcucaucggcgccaaggacguccagggcgacucccagaugucccacucccuccagauguccaagcuccaguccgagcucgaguacaagaagggcuucgaggacaccaagucccagugccacgucucccucgacaugguccaccucguccacgcccgcaaggcccagcaccucgccaccgacgucggcuacaagaccgccgagcaccacuucaccgcccuccccaccgacaugaaggucgagugggccaagaaggccuacggccuccaguccgacaaccaguaccgcgccgacgucaaguggaugaagggcaugggcugggucgccaccggcucccucaacgucgagcaggccaagaaggccggcgagcucaucuccgagaagaaguaccgccagcaccccgacgcccucaaguucaccuccaucaaggacacccccgagaugguccaggcccgcaucuccuacacccaggccgucgaccgccucuaccgcgagcagggcgagaacaucaagcaccacuacacccccaccgccgaccuccccgagguccuccucgccaagcucaacgccaugaacaucuccgagacccgcuacaaggaguccugguccaagcuccgcgacggcggcuacaagcuccgccucgacgcccuccccuuccaggccgccaaggccuccggcgagaucaucuccgacuacaaguacaaggaggccuucgagaagaugaagggccagaugcucggcucccgcucccucgaggacgacaucucccucgcccacuccgucuacgccaccucccuccaguccgacgucaacuacaagaagggcuucgagcacuccaaggcccaguuccaccucccccucgacauggccgcccucguccacgccaagaaggcccagacccucgccuccaaccaggacuacaagcacccccucccccaguacaccucccucgccgaggaccuccgccucuccugcgccaagaaggcccacaagcuccaguccgagaaccucuaccgcuccgaccucaacuucaugcgcggcgucgccugcgucauccccggcacccucgagaucgagggccgcaagaaggccuccgagcucaucuccgaguccaaguaccgccagcacccccacuccuucaaguacaccgccgucaccgacacccccaaccuccuccacgccaaguucuccaaccagaucaccaacgagcgccucuacaaggccgccggcgaggacgcccgccacgaguacaccaugacccucggccuccccgaguucauccgcgccaagaccaacgccgccaaccucuccgacgcccgcuacaaggaguccuggcgcaaccuccgcgcccagggcuacaagcucaccaucgaggcccuccccuuccaggccgcccgcgccuccggcgacaucgccuccgacuuccucuaccgccacgacuucgucaaggagcgcggcaagcucaucggcccccaguccguccgcgacgacccccgcauccagcacugccgccgcaugggccagcuccaguccgagcuccaguaccgccgcggcgccaccuccucccaggcccaguuccaccuccccauggacaugguccaccucguccacgccaagaacgcccaggcccucgccuccgaccacgacuaccgcacccaguaccacaaguucaccgcccuccccgaggaccucaagauggccugggccaagaaggcccacgcccuccaguccgagcuccgcuacaaguccgaccucaucggcaugaagggcaucggcuggcucgcccuccgcuccccccagauggaguccgccaagaaggccggcgagcucaucuccgagaccaaguaccgcaagaagcccgacuccaucaaguucaccaccgucgucgacucccccgaccucguccacgccaagaacuccuacaugcacugcaacgagcgcauguaccgcuccggcgacgccgagucccuccaccgcuacacccucauccccgaccaccccgacuucacccgcgcccgccucaacgcccuccaccucuccgacaaggucuaccgcaacuccugggagcagacccgcgccggcuccuacgacuuccgccucgacgccauccccuuccagaccgcccgcgccucccgcgagaucgccuccgacuuccgcuacaaggaggccuuccuccgcgaccgcggccuccagaucggcuaccgcuccgucgacgacgacccccgcaugaagcacuuccucaacgucggccgccuccaguccgacaacgaguacaagaaggacuucgccaagucccgcucccaguuccacuccuccaccgaccagcccggccuccuccaggccaagcgcucccagcagcucgccuccgacguccacuaccgccagccccucccccagcccaccugcgaccccgagcagcucggccuccgccacgcccagaaggcccaccagcuccaguccgacgucaaguacaaguccgaccucaaccucacccgcggcgucggcuggaccccccccggcuccuacaaggucgagauggcccgccgcgccgccgagcucgccaacgcccgcggccucggccuccagggcgccuaccgcggcgccgaggccgucgaggccggcgaccaccaguccggcgaggucaaccccgacgccaccgagauccuccacgucaagaagaagaaggcccuccuccucuga

SEQ ID NO: 46845 - RNA, 345 nt, Artificial Sequence
  derived and/or modified sequence opt2 from NRARP__Homo_sapiens__NP_001004354
augucccaggccgagcucuccaccugcuccgccccccagacccagcgcaucuuccaggaggccguccgcaagggcaacacccaggagcuccagucccuccuccagaacaugaccaacugcgaguucaacgucaacuccuucggccccgagggccagaccgcccuccaccaguccgucaucgacggcaaccucgagcucgucaagcuccucgucaaguucggcgccgacauccgccucgccaaccgcgacggcugguccgcccuccacaucgccgccuucggcggccaccaggacaucguccucuaccucaucaccaaggccaaguacgccgccuccggccgcuga

SEQ ID NO: 46846 - RNA, 1608 nt, Artificial Sequence
  derived and/or modified sequence opt2 from NRBP1__Homo_sapiens__XP_005264331
auguccgagggcgagucccagaccguccucuccuccggcuccgaccccaaggucgaguccuccuccuccgcccccggccucaccuccgucuccccccccgucaccuccaccaccuccgccgccucccccgaggaggaggaggaguccgaggacgaguccgagauccucgaggagucccccugcggccgcuggcagaagcgccgcgaggaggucaaccagcgcaacguccccggcaucgacuccgccuaccucgccauggacaccgaggagggcgucgaggucgucuggaacgagguccaguucuccgagcgcaagaacuacaagcuccaggaggagaagguccgcgccgucuucgacaaccucauccagcucgagcaccucaacaucgucaaguuccacaaguacugggccgacaucaaggagaacaaggcccgcgucaucuucaucaccgaguacauguccuccggcucccucaagcaguuccucaagaagaccaagaagaaccacaagaccaugaacgagaaggccuggaagcgcuggugcacccagauccucuccgcccucuccuaccuccacuccugcgacccccccaucauccacggcaaccucaccugcgacaccaucuucauccagcacaacggccucaucaagaucggcuccgucgcccccgacaccaucaacaaccacgucaagaccugccgcgaggagcagaagaaccuccacuucuucgcccccgaguacggcgaggucaccaacgucaccaccgccgucgacaucuacuccuucggcaugugcgcccucgagauggccguccucgagauccagggcaacggcgaguccuccuacgucccccaggaggccaucuccuccgccauccagcuccucgaggacccccuccagcgcgaguucauccagaagugccuccaguccgagcccgcccgccgccccaccgcccgcgagcuccucuuccaccccgcccucuucgagguccccucccucaagcuccucgccgcccacugcaucgucggccaccagcacaugauccccgagaacgcccucgaggagaucaccaagaacauggacaccuccgccguccucgccgagauccccgccggccccggccgcgagcccguccagacccucuacucccagucccccgcccucgagcucgacaaguuccucgaggacguccgcaacggcaucuacccccucaccgccuucggccucccccgcccccagcagccccagcaggaggaggucaccucccccgucgucccccccuccgucaagacccccacccccgagcccgccgaggucgagacccgcaaggucguccucaugcagugcaacaucgaguccgucgaggagggcgucaagcaccaccucacccuccuccucaagcucgaggacaagcucaaccgccaccucuccugcgaccucaugcccaacgagaacauccccgagcucgccgccgagcucguccagcucggcuucaucuccgaggccgaccagucccgccucaccucccuccucgaggagacccucaacaaguucaacuucgcccgcaacuccacccucaacuccgccgccgucaccgucuccuccuga

SEQ ID NO: 46847 - RNA, 1506 nt, Artificial Sequence
  derived and/or modified sequence opt2 from NRBP2__Homo_sapiens__NP_848659
auggccgcccccgagcccgccccccgccgcgcccgcgagcgcgagcgcgagcgcgaggacgaguccgaggacgaguccgacauccucgaggagucccccugcggccgcuggcagaagcgccgcgagcaggucaaccagggcaacaugcccggccuccaguccaccuuccucgccauggacaccgaggagggcgucgaggucgucuggaacgagcuccacuucggcgaccgcaaggccuucgccgcccacgaggagaagauccagaccgucuucgagcagcucguccucgucgaccaccccaacaucgucaagcuccacaaguacuggcucgacaccuccgaggccugcgcccgcgucaucuucaucaccgaguacgucuccuccggcucccucaagcaguuccucaagaagaccaagaagaaccacaaggccaugaacgcccgcgccuggaagcgcuggugcacccagauccucuccgcccucuccuuccuccacgccugcuccccccccaucauccacggcaaccucaccuccgacaccaucuucauccagcacaacggccucaucaagaucggcuccgucuggcaccgcaucuucuccaacgcccuccccgacgaccuccgcucccccauccgcgccgagcgcgaggagcuccgcaaccuccacuucuucccccccgaguacggcgaggucgccgacggcaccgccgucgacaucuucuccuucggcaugugcgcccucgagauggccguccucgagauccagaccaacggcgacacccgcgucaccgaggaggccaucgcccgcgcccgccacucccucuccgaccccaacaugcgcgaguucauccucugcugccucgcccgcgaccccgcccgccgccccuccgcccacucccuccucuuccaccgcguccucuucgagguccacucccucaagcuccucgccgcccacugcuucauccagcaccaguaccucaugcccgagaacgucgucgaggagaagaccaaggccauggaccuccacgccguccucgccgagcucccccgcccccgccgccccccccuccaguggcgcuacuccgaggucuccuucauggagcucgacaaguuccucgaggacguccgcaacggcaucuacccccucaugaacuucgccgccacccgcccccucggccucccccgcguccucgcccccccccccgaggagguccagaaggccaagacccccacccccgagcccuucgacuccgagacccgcaaggucauccagaugcagugcaaccucgagcgcuccgaggacaaggcccgcuggcaccucacccuccuccucguccucgaggaccgccuccaccgccagcucaccuacgaccuccuccccaccgacuccgcccaggaccucgccuccgagcucguccacuacggcuuccuccacgaggacgaccgcaugaagcucgccgccuuccucgaguccaccuuccucaaguaccgcggcacccaggccuga

SEQ ID NO: 46848 - RNA, 3915 nt, Artificial Sequence
  derived and/or modified sequence opt2 from NRCAM__Homo_sapiens__NP_001032209
augcagcucaagaucaugcccaagaagaagcgccucuccgccggccgcgucccccucauccucuuccucugccagaugaucuccgcccucgaggucccccucgaccccaagcuccucgaggaccucguccagccccccaccaucacccagcagucccccaaggacuacaucaucgacccccgcgagaacaucgucauccagugcgaggccaagggcaagcccccccccuccuucuccuggacccgcaacggcacccacuucgacaucgacaaggacccccucgucaccaugaagcccggcaccggcacccucaucaucaacaucauguccgagggcaaggccgagaccuacgagggcgucuaccagugcaccgcccgcaacgagcgcggcgccgccgucuccaacaacaucgucguccgccccucccgcuccccccucuggaccaaggagaagcucgagcccaucacccuccaguccggccagucccucguccuccccugccgcccccccaucggccuccccccccccaucaucuucuggauggacaacuccuuccagcgccucccccaguccgagcgcgucucccagggccucaacggcgaccucuacuucuccaacguccuccccgaggacacccgcgaggacuacaucugcuacgcccgcuucaaccacacccagaccauccagcagaagcagcccaucuccgucaaggucaucuccgucgacgagcucaacgacaccaucgccgccaaccucuccgacaccgaguucuacggcgccaaguccucccgcgagcgcccccccaccuuccucacccccgagggcaacgccuccaacaaggaggagcuccgcggcaacguccucucccucgagugcaucgccgagggccuccccacccccaucaucuacugggccaaggaggacggcaugcuccccaagaaccgcaccgucuacaagaacuucgagaagacccuccagaucauccacgucuccgaggccgacuccggcaacuaccagugcaucgccaagaacgcccucggcgccauccaccacaccaucuccguccgcgucaaggccgcccccuacuggaucaccgccccccagaaccucguccucucccccggcgaggacggcacccucaucugccgcgccaacggcaaccccaagccccgcaucuccuggcucaccaacggcguccccaucgagaucgcccccgacgaccccucccgcaagaucgacggcgacaccaucaucuucuccaacguccaggagcgcuccuccgccgucuaccagugcaacgccuccaacgaguacggcuaccuccucgccaacgccuucgucaacguccucgccgagcccccccgcauccucacccccgccaacacccucuaccaggucaucgccaaccgccccgcccuccucgacugcgccuucuucggcuccccccuccccaccaucgagugguucaagggcgccaagggcuccgcccuccacgaggacaucuacguccuccacgagaacggcacccucgagauccccgucgcccagaaggacuccaccggcaccuacaccugcgucgcccgcaacaagcucggcauggccaagaacgagguccaccucgagaucaaggaccccaccuggaucgucaagcagcccgaguacgccgucguccagcgcggcuccauggucuccuucgagugcaaggucaagcacgaccacacccucucccucaccguccucuggcucaaggacaaccgcgagcuccccuccgacgagcgcuucaccgucgacaaggaccaccucgucgucgccgacgucuccgacgacgacuccggcaccuacaccugcgucgccaacaccacccucgacuccgucuccgccuccgccguccucuccgucgucgcccccacccccacccccgcccccgucuacgacguccccaacccccccuucgaccucgagcucaccgaccagcucgacaaguccguccagcucuccuggacccccggcgacgacaacaacucccccaucaccaaguucaucaucgaguacgaggacgccaugcacaagcccggccucuggcaccaccagaccgaggucuccggcacccagaccaccgcccagcucaagcucucccccuacgucaacuacuccuuccgcgucauggccgucaacuccaucggcaagucccuccccuccgaggccuccgagcaguaccucaccaaggccuccgagcccgacaagaaccccaccgccgucgagggccucggcuccgagcccgacaaccucgucaucaccuggaagccccucaacggcuucgaguccaacggccccggccuccaguacaaggucuccuggcgccagaaggacggcgacgacgaguggaccuccgucgucgucgccaacgucuccaaguacaucgucuccggcacccccaccuucguccccuaccucaucaagguccaggcccucaacgacaugggcuucgcccccgagcccgccgucgucaugggccacuccggcgaggaccuccccauggucgcccccggcaacguccgcgucaacgucgucaacuccacccucgccgagguccacugggaccccgucccccucaaguccauccgcggccaccuccagggcuaccgcaucuacuacuggaagacccaguccuccuccaagcgcaaccgccgccacaucgagaagaagauccucaccuuccagggcuccaagacccacggcaugcuccccggccucgagcccuucucccacuacacccucaacguccgcgucgucaacggcaagggcgagggccccgccucccccgaccgcgucuucaacacccccgagggcguccccuccgcccccuccucccucaagaucgucaaccccacccucgacucccucacccucgagugggacccccccucccaccccaacggcauccucaccgaguacacccucaaguaccagcccaucaacuccacccacgagcucggcccccucgucgaccucaagauccccgccaacaagacccgcuggacccucaagaaccucaacuucuccacccgcuacaaguucuacuucuacgcccagaccuccgccggcuccggcucccagaucaccgaggaggccgucaccaccgucgacgaggccggcauccucccccccgacgucggcgccggcaagguccaggccgucaacccccgcaucuccaaccucaccgccgccgccgccgagaccuacgccaacaucuccugggaguacgagggccccgagcacgucaacuucuacgucgaguacggcgucgccggcuccaaggaggaguggcgcaaggagaucgucaacggcucccgcuccuucuucggccucaagggccucaugcccggcaccgccuacaagguccgcgucggcgccgucggcgacuccggcuucgucuccuccgaggacgucuucgagaccggccccgccauggccucccgccaggucgacaucgccacccagggcugguucaucggccucaugugcgccgucgcccuccucauccucauccuccucaucgucugcuucauccgccgcaacaagggcggcaaguaccccgucaaggagaaggaggacgcccacgccgaccccgagauccagcccaugaaggaggacgacggcaccuucggcgaguacuccgacgccgaggaccacaagccccucaagaagggcucccgcacccccuccgaccgcaccgucaagaaggaggacuccgacgacucccucgucgacuacggcgagggcgucaacggccaguucaacgaggacggcuccuucaucggccaguacuccggcaagaaggagaaggagcccgccgagggcaacgaguccuccgaggcccccucccccgucaacgccaugaacuccuucgucuga

SEQ ID NO: 46849 - RNA, 3564 nt, Artificial Sequence
  derived and/or modified sequence opt2 from NRD1__Homo_sapiens__XP_011539823
augcuccgccgcgucaccgucgccgccgucugcgccacccgccgcaagcucugcgaggccggccgcgagcucgccgcccucuggggcaucgagacccgcggccgcugcgaggacuccgccgccgcccgccccuuccccauccucgccaugcccggccgcaacaaggccaaguccaccugcuccugccccgaccuccagcccaacggccaggaccucggcgagaacucccgcgucgcccgccucggcgccgacgaguccgaggaggagggccgccgcggcucccucuccaacgccggcgaccccgagaucgucaagucccccuccgaccccaagcaguaccgcuacaucaagcuccagaacggccuccaggcccuccucaucuccgaccucuccaacauggagggcaagaccggcaacaccaccgacgacgaggaggaggaggaggucgaggaggaggaggaggacgacgacgaggacuccggcgccgagaucgaggacgacgacgaggagggcuucgacgacgaggacgaguucgacgacgagcacgacgacgaccucgacaccgaggacaacgagcucgaggagcucgaggagcgcgccgaggcccgcaagaagaccaccgagaagcagcagcuccagucccucuuccuccucugguccaagcucaccgaccgccucugguucaaguccaccuacuccaagauguccuccacccuccucgucgagacccgcaaccucuacggcgucgucggcgccgagucccgcuccgcccccguccagcaccucgccggcuggcaggccgaggagcagcagggcgagaccgacaccguccucuccgccgccgcccucugcgucggcgucggcuccuucgccgaccccgacgaccuccccggccucgcccacuuccucgagcacauggucuucaugggcucccucaaguaccccgacgagaacggcuucgacgccuuccucaagaagcacggcggcuccgacaacgccuccaccgacugcgagcgcaccgucuuccaguucgacguccagcgcaaguacuucaaggaggcccucgaccgcugggcccaguucuucauccacccccucaugauccgcgacgccaucgaccgcgaggucgaggccgucgacuccggcaacgccgagacccucaagcacgagccccgcaagaacaacaucgacacccacgcccgccuccgcgaguucuggaugcgcuacuacuccucccacuacaugacccucgucguccaguccaaggagacccucgacacccucgagaagugggucaccgagaucuucucccagauccccaacaacggccucccccgccccaacuucggccaccucaccgaccccuucgacacccccgccuucaacaagcucuaccgcgucguccccauccgcaagauccacgcccucaccaucaccugggcccuccccccccagcagcagcacuaccgcgucaagccccuccacuacaucuccuggcucgucggccacgagggcaagggcuccauccucuccuuccuccgcaagaagugcugggcccucgcccucuucggcggcaacggcgagaccggcuucgagcagaacuccaccuacuccgucuucuccaucuccaucacccucaccgacgagggcuacgagcacuucuacgaggucgccuacaccgucuuccaguaccucaagaugcuccagaagcucggccccgagaagcgcaucuucgaggagauccgcaagaucgaggacaacgaguuccacuaccaggagcagaccgaccccgucgaguacgucgagaacaugugcgagaacaugcagcucuacccccuccaggacauccucaccggcgaccagcuccucuucgaguacaagcccgaggucaucggcgaggcccucaaccagcucgucccccagaaggccaaccucguccuccucuccggcgccaacgagggcaagugcgaccucaaggagaagugguucggcacccaguacuccaucgaggacaucgagaacuccugggccgagcucuggaacuccaacuucgagcucaaccccgaccuccaccuccccgccgagaacaaguacaucgccaccgacuucacccucaaggccuucgacugccccgagaccgaguaccccgucaagaucgucaacaccccccagggcugccucugguacaagaaggacaacaaguucaagauccccaaggccuacauccgcuuccaccucaucuccccccucauccagaaguccgccgccaacgucguccucuucgacaucuucgucaacauccucacccacaaccucgccgagcccgccuacgaggccgacgucgcccagcucgaguacaagcucgucgccggcgagcacggccucaucauccgcgucaagggcuucaaccacaagcucccccuccucuuccagcucaucaucgacuaccucgccgaguucaacuccacccccgccgucuucaccaugaucaccgagcagcucaagaagaccuacuucaacauccucaucaagcccgagacccucgccaaggacguccgccuccucauccucgaguacgcccgcugguccaugaucgacaaguaccaggcccucauggacggccucucccucgagucccuccucuccuucgucaaggaguucaagucccagcucuucgucgagggccucguccagggcaacgucaccuccaccgaguccauggacuuccucaaguacgucgucgacaagcucaacuucaagccccucgagcaggagaugcccguccaguuccaggucgucgagcuccccuccggccaccaccucugcaaggucaaggcccucaacaagggcgacgccaacuccgaggucaccgucuacuaccaguccggcacccgcucccuccgcgaguacacccucauggagcuccucgucaugcacauggaggagcccugcuucgacuuccuccgcaccaagcagacccucggcuaccacgucuaccccaccugccgcaacaccuccggcauccucggcuucuccgucaccgucggcacccaggccaccaaguacaacuccgaggucgucgacaagaagaucgaggaguuccucuccuccuucgaggagaagaucgagaaccucaccgaggaggccuucaacacccaggucaccgcccucaucaagcucaaggagugcgaggacacccaccucggcgaggaggucgaccgcaacuggaacgaggucgucacccagcaguaccucuucgaccgccucgcccacgagaucgaggcccucaaguccuucuccaaguccgaccucgucaacugguucaaggcccaccgcggccccggcuccaagaugcucuccguccacgucgucggcuacggcaaguacgagcucgaggaggacggcacccccuccuccgaggacuccaacuccuccugcgaggucaugcagcucaccuaccuccccaccuccccccuccucgccgacugcaucauccccaucaccgacauccgcgccuucaccaccacccucaaccuccuccccuaccacaagaucgucaaguga

SEQ ID NO: 46850 - RNA, 3495 nt, Artificial Sequence
  derived and/or modified sequence opt2 from NRDE2__Homo_sapiens__NP_060440
auggcccucuuccccgccuucgccggccucuccgaggcccccgacggcggcuccucccgcaaggagcucgacuggcucuccaaccccuccuucugcgucggcuccaucaccucccucucccagcagaccgaggccgcccccgcccacgucuccgagggccucccccucacccgcucccaccucaaguccgaguccuccgacgaguccgacaccaacaagaagcucaagcagaccucccgcaagaagaagaaggagaagaagaagaagcgcaagcaccagcaccacaagaagaccaagcgcaagcacggccccuccuccuccucccgcuccgagaccgacaccgacuccgagaaggacaagcccucccgcggcgucggcggcuccaagaaggaguccgaggagcccaaccagggcaacaacgccgccgccgacaccggccaccgcuucgucuggcucgaggacauccaggccgucaccggcgagaccuuccgcaccgacaagaagcccgaccccgccaacugggaguacaagucccucuaccgcggcgacaucgcccgcuacaagcgcaagggcgacuccugccucggcaucaaccccaagaagcagugcaucuccugggagggcaccuccaccgagaagaagcacucccgcaagcaggucgagcgcuacuucaccaagaaguccgucggccucaugaacaucgacggcgucgccaucuccuccaagaccgagccccccuccuccgagcccaucuccuucauccccgucaaggaccucgaggacgccgcccccgucaccaccuggcucaacccccucggcaucuacgaccaguccaccacccacuggcuccagggccagggcccccccgagcaggaguccaagcagcccgacgcccagcccgacuccgaguccgccgcccucaaggccaaggucgaggaguucaaccgccgcguccgcgagaacccccgcgacacccagcucuggauggccuucgucgccuuccaggacgaggucaugaagucccccggccucuacgccaucgaggagggcgagcaggagaagcgcaagcgcucccucaagcucauccucgagaagaagcucgccauccucgagcgcgccaucgaguccaaccaguccuccgucgaccucaagcucgccaagcucaagcucugcaccgaguucugggagcccuccacccucgucaaggaguggcagaagcucaucuuccuccaccccaacaacaccgcccucuggcagaaguaccuccucuucugccagucccaguucuccaccuucuccaucuccaagauccacucccucuacggcaagugccucuccacccucuccgccgucaaggacggcuccauccucucccaccccgcccuccccggcaccgaggaggccauguucgcccucuuccuccagcagugccacuuccuccgccaggccggccacuccgagaaggccaucucccucuuccaggccauggucgacuucaccuucuucaagcccgacuccgucaaggaccuccccaccaagggccaggucgaguucuucgagcccuucugggacuccggcgagccccgcgccggcgagaagggcgcccgcggcuggaaggccuggaugcaccagcaggagcgcggcggcugggucgucaucaaccccgacgaggacgacgacgagcccgaggaggacgaccaggagaucaaggacaagacccucccccgcuggcagaucuggcucgccgccgagcgcucccgcgaccagcgccacuggcgccccuggcgccccgacaagaccaagaagcagaccgaggaggacugcgaggaccccgagcgccagguccucuucgacgacaucggccagucccucauccgccucuccucccacgaccuccaguuccagcucgucgaggccuuccuccaguuccucggcguccccuccggcuucaccccccccgccuccugccucuaccucgccauggacgagaacuccaucuucgacaacggccucuacgacgagaagccccucaccuucuucaacccccucuucuccggcgccuccugcgucggccgcauggaccgccucggcuacccccgcuggacccgcggccagaaccgcgagggcgaggaguucauccgcaacgucuuccaccucgucaugccccucuucuccggcaaggagaagucccagcucugcuucuccuggcuccaguacgagaucgccaaggucaucuggugccuccacaccaagaacaagaagcgccucaagucccagggcaagaacugcaagaagcucgccaagaaccuccucaaggagcccgagaacugcaacaacuucugccucuggaagcaguacgcccaccucgaguggcuccucggcaacaccgaggacgcccgcaaggucuucgacaccgcccucggcauggccggcucccgcgagcucaaggacuccgaccucugcgagcucucccuccucuacgccgagcucgaggucgagcucucccccgagguccgccgcgccgccaccgcccgcgccguccacauccucaccaagcucaccgaguccucccccuacggccccuacaccggccagguccucgccguccacauccucaaggcccgcaaggccuacgagcacgcccuccaggacugccucggcgacuccugcgucuccaaccccgcccccaccgacuccugcucccgccucaucucccucgccaagugcuucaugcucuuccaguaccucaccaucggcaucgacgccgccguccagaucuacgagcaggucuucgccaagcucaacuccuccgucuuccccgagggcuccggcgagggcgacuccgccuccucccaguccuggaccuccguccucgaggccaucacccucaugcacaccucccuccuccgcuuccacaugaaggucuccgucuacccccucgccccccuccgcgaggcccucucccaggcccucaagcucuaccccggcaaccagguccucuggcgcuccuacguccagauccagaacaagucccacuccgccuccaagacccgccgcuucuucgacaccaucacccgcuccgccaagccccucgagcccuggcucuucgccaucgaggccgagaagcuccgcaagcgccucgucgagaccguccagcgccucgacggccgcgagauccacgccaccauccccgagaccggccucaugcaccgcauccaggcccucuucgagaacgccaugcgcuccgacuccggcucccagugcccccuccucuggcgcauguaccucaacuuccucgucucccucggcaacaaggagcgcuccaagggcgucuucuacaaggcccuccagaacugccccugggccaagguccucuaccucgacgccgucgaguacuuccccgacgagaugcaggagauccucgaccucaugaccgagaaggagcuccgcguccgccucccccucgaggagcucgagcuccuccucgaggacuga

SEQ ID NO: 46851 - RNA, 339 nt, Artificial Sequence
  derived and/or modified sequence opt2 from NREP__Homo_sapiens__NP_001135947
augaagggcgucuggaacuacuccgcccucucccgccgcgaggacgagacccgcacccagcgcucccgcaugaccgaccgcguccccugcuccaagugcuuccagguccacugccagaucuccguccucaacugcgucuacuaccccgagcucuucgucugggucucccaggagcccuuccccaacaaggacauggagggccgccuccccaagggccgccuccccguccccaaggaggucaaccgcaagaagaacgacgagaccaacgccgccucccucaccccccucggcuccuccgagcuccgcuccccccgcaucuccuaccuccacuucuucuga

SEQ ID NO: 46852 - RNA, 1569 nt, Artificial Sequence
  derived and/or modified sequence opt2 from NRF1__Homo_sapiens__NP_001280092
auggaggagcacggcgucacccagaccgagcacauggccaccaucgaggcccacgccgucgcccagcagguccagcagguccacgucgccaccuacaccgagcacuccaugcucuccgccgacgaggacucccccuccucccccgaggacaccuccuacgacgacuccgacauccucaacuccaccgccgccgacgaggucaccgcccaccucgccgccgccggccccgucggcauggccgccgccgccgccgucgccaccggcaagaagcgcaagcgcccccacgucuucgaguccaaccccuccauccgcaagcgccagcagacccgccuccuccgcaagcuccgcgccacccucgacgaguacaccacccgcgucggccagcaggccaucguccucugcaucucccccuccaagcccaaccccgucuucaaggucuucggcgccgccccccucgagaacgucguccgcaaguacaaguccaugauccucgaggaccucgaguccgcccucgccgagcacgcccccgccccccaggaggucaacuccgagcuccccccccucaccaucgacggcauccccgucuccgucgacaagaugacccaggcccagcuccgcgccuucauccccgagaugcucaaguacuccaccggccgcggcaagcccggcuggggcaaggaguccugcaagcccaucugguggcccgaggacauccccugggccaacguccgcuccgacguccgcaccgaggagcagaagcagcgcgucuccuggacccaggcccuccgcaccaucgucaagaacugcuacaagcagcacggccgcgaggaccuccucuacgccuucgaggaccagcagacccagacccaggccaccgccacccacuccaucgcccaccucguccccucccagaccgucguccagaccuucuccaaccccgacggcaccgucucccucauccaggucggcaccggcgccaccgucgccacccucgccgacgccuccgagcuccccaccaccgucaccgucgcccaggucaacuacuccgccgucgccgacggcgaggucgagcagaacugggccacccuccagggcggcgagaugaccauccagaccacccaggccuccgaggccacccaggccgucgccucccucgccgaggccgccgucgccgccucccaggagaugcagcagggcgccaccgucaccauggcccucaacuccgaggccgccgcccacgccgucgccacccucgccgaggccacccuccagggcggcggccagaucguccucuccggcgagaccgccgccgccgucggcgcccucaccggcguccaggacgccaacggccucuucauggccgaccgcgccggccgcaaguggauccucaccgacaaggccaccggccucguccagauccccgucuccauguaccagaccgucgucaccucccucgcccagggcaacggccccguccaggucgccauggcccccgucaccacccgcaucuccgacuccgccgucaccauggacggccaggccgucgaggucgucacccucgagcaguga

SEQ ID NO: 46853 - RNA, 1824 nt, Artificial Sequence
  derived and/or modified sequence opt2 from NRG1__Homo_sapiens__NP_001153467
augggcaagggccgcgccggccgcgucggcaccaccgcccuccccccccgccucaaggagaugaagucccaggaguccgccgccggcuccaagcucguccuccgcugcgagaccuccuccgaguacuccucccuccgcuucaagugguucaagaacggcaacgagcucaaccgcaagaacaagccccagaacaucaagauccagaagaagcccggcaaguccgagcuccgcaucaacaaggccucccucgccgacuccggcgaguacaugugcaaggucaucuccaagcucggcaacgacuccgccuccgccaacaucaccaucgucgaguccaacgagaucaucaccggcaugcccgccuccaccgagggcgccuacgucuccuccgccaccuccaccuccaccaccggcaccucccaccucgucaagugcgccgagaaggagaagaccuucugcgucaacggcggcgagugcuucauggucaaggaccucuccaaccccucccgcuaccucugcaagugccccaacgaguucaccggcgaccgcugccagaacuacgucauggccuccuucuacaagcaccucggcaucgaguucauggaggccgaggagcucuaccagaagcgcguccucaccaucaccggcaucugcaucgcccuccucgucgucggcaucaugugcgucgucgccuacugcaagaccaagaagcagcgcaagaagcuccacgaccgccuccgccagucccuccgcuccgagcgcaacaacaugaugaacaucgccaacggcccccaccaccccaaccccccccccgagaacguccagcucgucaaccaguacgucuccaagaacgucaucuccuccgagcacaucgucgagcgcgaggccgagaccuccuucuccaccucccacuacaccuccaccgcccaccacuccaccaccgucacccagacccccucccacuccugguccaacggccacaccgaguccauccucuccgagucccacuccgucaucgucauguccuccgucgagaacucccgccacuccucccccaccggcggcccccgcggccgccucaacggcaccggcggcccccgcgagugcaacuccuuccuccgccacgcccgcgagacccccgacuccuaccgcgacuccccccacuccgagcgcuacgucuccgccaugaccacccccgcccgcaugucccccgucgacuuccacacccccuccucccccaaguccccccccuccgagauguccccccccgucuccuccaugaccgucuccaugcccuccauggccgucucccccuucauggaggaggagcgcccccuccuccucgucacccccccccgccuccgcgagaagaaguucgaccaccacccccagcaguucuccuccuuccaccacaaccccgcccacgacuccaacucccuccccgccuccccccuccgcaucgucgaggacgaggaguacgagaccacccaggaguacgagcccgcccaggagcccgucaagaagcucgccaacucccgccgcgccaagcgcaccaagcccaacggccacaucgccaaccgccucgaggucgacuccaacaccuccucccaguccuccaacuccgaguccgagaccgaggacgagcgcgucggcgaggacacccccuuccucggcauccagaacccccucgccgccucccucgaggccacccccgccuuccgccucgccgacucccgcaccaaccccgccggccgcuucuccacccaggaggagauccaggcccgccucuccuccgucaucgccaaccaggaccccaucgccgucuga

SEQ ID NO: 46854 - RNA, 2355 nt, Artificial Sequence
  derived and/or modified sequence opt2 from NRG2__Homo_sapiens__NP_001171864
augcgccaggucugcugcuccgcccuccccccccccccccucgagaagggccgcugcuccuccuacuccgacuccuccuccuccuccuccgagcgcuccuccuccuccuccuccuccuccuccgaguccggcuccuccucccgcuccuccuccaacaacuccuccaucucccgccccgccgccccccccgagccccgcccccagcagcagccccagccccgcucccccgccgcccgccgcgccgccgcccgcucccgcgccgccgccgccggcggcaugcgccgcgaccccgcccccggcuucuccaugcuccucuucggcgucucccucgccugcuacucccccucccucaaguccguccaggaccaggccuacaaggcccccgucgucgucgagggcaagguccagggccucguccccgccggcggcuccuccuccaacuccacccgcgagccccccgccuccggccgcgucgcccucgucaagguccucgacaaguggccccuccgcuccggcggccuccagcgcgagcaggucaucuccgucggcuccugcgucccccucgagcgcaaccagcgcuacaucuucuuccucgagcccaccgagcagccccucgucuucaagaccgccuucgccccccucgacaccaacggcaagaaccucaagaaggaggucggcaagauccucugcaccgacugcgccacccgccccaagcucaagaagaugaagucccagaccggccaggucggcgagaagcagucccucaagugcgaggccgccgccggcaacccccagcccuccuaccgcugguucaaggacggcaaggagcucaaccgcucccgcgacauccgcaucaaguacggcaacggccgcaagaacucccgccuccaguucaacaaggucaaggucgaggacgccggcgaguacgucugcgaggccgagaacauccucggcaaggacaccguccgcggccgccucuacgucaacuccgaggccgaggagcucuaccagaagcgcguccucaccaucaccggcaucugcgucgcccuccucgucgucggcaucgucugcgucgucgccuacugcaagaccaagaagcagcgcaagcagaugcacaaccaccuccgccagaacaugugccccgcccaccagaaccgcucccucgccaacggccccucccacccccgccucgaccccgaggagauccagauggccgacuacaucuccaagaacguccccgccaccgaccacgucauccgccgcgagaccgagaccaccuucuccggcucccacuccugcucccccucccaccacugcuccaccgccacccccaccuccucccaccgccacgagucccacaccuggucccucgagcgcuccgagucccucaccuccgacucccaguccggcaucaugcucuccuccgucggcaccuccaagugcaacucccccgccugcgucgaggcccgcgcccgccgcgccgccgccuacaaccucgaggagcgccgccgcgccaccgccccccccuaccacgacuccgucgacucccuccgcgacuccccccacuccgagcgcuacgucuccgcccucaccacccccgcccgccucucccccgucgacuuccacuacucccucgccacccagguccccaccuucgagaucaccucccccaacuccgcccacgccgucucccucccccccgccgcccccaucuccuaccgccucgccgagcagcagccccuccuccgccaccccgccccccccggccccggccccggccccggccccggccccggccccggcgccgacaugcagcgcuccuacgacuccuacuacuaccccgccgccggccccggcccccgccgcggcaccugcgcccucggcggcucccucggcucccuccccgccucccccuuccgcauccccgaggacgacgaguacgagaccacccaggagugcgccccccccccccccccccgcccccgcgcccgcggcgccucccgccgcaccuccgccggcccccgccgcuggcgccgcucccgccucaacggccucgccgcccagcgcgcccgcgccgcccgcgacucccucucccucuccuccggcuccggcggcggcuccgccuccgccuccgacgacgacgccgacgacgccgacggcgcccucgccgccgaguccacccccuuccucggccuccgcggcgcccacgacgcccuccgcuccgacucccccccccucugccccgccgccgacucccgcaccuacuacucccucgacucccacuccacccgcgccuccucccgccacucccgcggcccccccccccgcgccaagcaggacuccgccccccucuga

SEQ ID NO: 46855 - RNA, 2091 nt, Artificial Sequence
  derived and/or modified sequence opt2 from NRG3__Homo_sapiens__NP_001010848
auguccgagggcgccgccgccgccuccccccccggcgccgccuccgccgccgccgccuccgccgaggagggcaccgccgccgccgccgccgccgccgccgccggcggcggccccgacggcggcggcgagggcgccgccgagcccccccgcgagcuccgcugcuccgacugcaucgucuggaaccgccagcagaccuggcucugcgucgucccccucuucaucggcuucaucggccucggccucucccucaugcuccucaaguggaucgucgucggcuccgucaaggaguacguccccaccgaccucgucgacuccaagggcaugggccaggaccccuucuuccucuccaagcccuccuccuuccccaaggccauggagaccaccaccaccaccaccuccaccaccucccccgccacccccuccgccggcggcgccgccuccucccgcacccccaaccgcaucuccacccgccucaccaccaucacccgcgcccccacccgcuuccccggccaccgcguccccauccgcgccuccccccgcuccaccaccgcccgcaacaccgccgcccccgccaccguccccuccaccaccgcccccuucuucuccuccuccacccucggcucccgcccccccguccccggcacccccuccacccaggccaugcccuccuggcccaccgccgccuacgccaccuccuccuaccuccacgacuccacccccuccuggacccucucccccuuccaggacgccgccuccuccuccuccuccuccuccuccuccgccaccaccaccacccccgagaccuccaccucccccaaguuccacaccaccaccuacuccaccgagcgcuccgagcacuucaagcccugccgcgacaaggaccucgccuacugccucaacgacggcgagugcuucgucaucgagacccucaccggcucccacaagcacugccgcugcaaggagggcuaccagggcguccgcugcgaccaguuccuccccaagaccgacuccauccucuccgaccccaccgaccaccucggcaucgaguucauggaguccgaggaggucuaccagcgccagguccucuccaucuccugcaucaucuucggcaucgucaucgucggcauguucugcgccgccuucuacuucaaguccaagaagcaggccaagcagauccaggagcagcucaaggucccccagaacggcaaguccuacucccucaaggccuccuccaccauggccaaguccgagaaccucgucaagucccacguccagcuccagaacuacuccaaggucgagcgccaccccgucaccgcccucgagaagaugauggaguccuccuucgucggcccccaguccuuccccgagguccccucccccgaccgcggcucccaguccgucaagcaccaccgcucccucuccuccugcugcucccccggccagcgcuccggcaugcuccaccgcaacgccuuccgccgcaccccccccuccccccgcucccgccucggcggcaucgucggccccgccuaccagcagcucgaggagucccgcauccccgaccaggacaccauccccugccagggcuacuccuccuccggccucaagacccagcgcaacaccuccaucaacaugcagcuccccucccgcgagaccaaccccuacuucaacucccucgagcagaaggaccucgucggcuacuccuccacccgcgccuccuccguccccaucauccccuccgucggccucgaggagaccugccuccagaugcccggcaucuccgaggucaaguccaucaaguggugcaagaacuccuacuccgccgacgucgucaacgucuccauccccgucuccgacugccucaucgccgagcagcaggaggucaagauccuccucgagaccguccaggagcagauccgcauccucaccgacgcccgccgcuccgaggacuacgagcucgccuccgucgagaccgaggacuccgccuccgagaacaccgccuuccucccccucucccccaccgccaaguccgagcgcgaggcccaguucguccuccgcaacgagauccagcgcgacuccgcccucaccaaguga

SEQ ID NO: 46856 - RNA, 348 nt, Artificial Sequence
  derived and/or modified sequence opt2 from NRG4__Homo_sapiens__NP_612640
augcccaccgaccacgaggagcccugcggccccucccacaaguccuucugccucaacggcggccucugcuacgucauccccaccauccccucccccuucugccgcugcgucgagaacuacaccggcgcccgcugcgaggaggucuuccuccccggcuccuccauccagaccaaguccaaccucuucgaggccuucgucgcccucgccguccucgucacccucaucaucggcgccuucuacuuccucugccgcaagggccacuuccagcgcgccuccuccguccaguacgacaucaaccucgucgagaccuccuccaccuccgcccaccacucccacgagcagcacuga

SEQ ID NO: 46857 - RNA, 237 nt, Artificial Sequence
  derived and/or modified sequence opt2 from NRGN__Homo_sapiens__NP_001119653
auggacugcugcaccgagaacgccugcuccaagcccgacgacgacauccucgacaucccccucgacgaccccggcgccaacgccgccgccgccaagauccaggccuccuuccgcggccacauggcccgcaagaagaucaaguccggcgagcgcggccgcaagggccccggccccggcggccccggcggcgccggcgucgcccgcggcggcgccggcggcggccccuccggcgacuga

SEQ ID NO: 46858 - RNA, 3477 nt, Artificial Sequence
  derived and/or modified sequence opt2 from NRIP1__Homo_sapiens__XP_005261122
augacccacggcgaggagcucggcuccgacguccaccaggacuccaucguccucaccuaccucgagggccuccucaugcaccaggccgccggcggcuccggcaccgccgucgacaagaaguccgccggccacaacgaggaggaccagaacuucaacaucuccggcuccgccuuccccaccugccaguccaacggccccguccucaacacccacaccuaccagggcuccggcaugcuccaccucaagaaggcccgccuccuccaguccuccgaggacuggaacgccgccaagcgcaagcgccucuccgacuccaucaugaaccucaacgucaagaaggaggcccuccucgccggcauggucgacuccguccccaagggcaagcaggacuccacccuccucgccucccuccuccaguccuucuccucccgccuccagaccgucgcccucucccagcagauccgccagucccucaaggagcagggcuacgcccucucccacgacucccucaaggucgagaaggaccuccgcugcuacggcgucgccuccucccaccucaagacccuccucaagaaguccaaggucaaggaccagaagcccgacaccaaccuccccgacgucaccaagaaccucauccgcgaccgcuucgccgaguccccccaccacgucggccaguccggcaccaaggucauguccgagccccucuccugcgccgcccgccuccaggccgucgccuccauggucgagaagcgcgccucccccgccaccucccccaagcccuccgucgccugcucccagcucgcccuccuccucuccuccgaggcccaccuccagcaguacucccgcgagcacgcccucaagacccagaacgccaaccaggccgccuccgagcgccucgccgccauggcccgccuccaggagaacggccagaaggacgucggcuccuaccagcuccccaagggcauguccucccaccucaacggccaggcccgcaccuccuccuccaagcucauggccuccaaguccuccgccaccgucuuccagaaccccaugggcaucauccccuccucccccaagaacgccggcuacaagaacucccucgagcgcaacaacaucaagcaggccgccaacaacucccuccuccuccaccuccucaagucccagaccauccccaagcccaugaacggccacucccacuccgagcgcggcuccaucuucgaggaguccuccacccccaccaccaucgacgaguacuccgacaacaaccccuccuucaccgacgacuccuccggcgacgaguccuccuacuccaacugcguccccaucgaccucuccugcaagcaccgcaccgagaaguccgaguccgaccagcccgucucccucgacaacuucacccagucccuccucaacaccugggaccccaagguccccgacgucgacaucaaggaggaccaggacaccuccaagaacuccaagcucaacucccaccagaaggucacccuccuccagcuccuccucggccacaagaacgaggagaacgucgagaagaacaccuccccccagggcguccacaacgacgucuccaaguucaacacccagaacuacgcccgcaccuccgucaucgagucccccuccaccaaccgcaccacccccgucuccacccccccccuccucaccuccuccaaggccggcucccccaucaaccucucccagcacucccucgucaucaaguggaacuccccccccuacgucugcuccacccaguccgagaagcucaccaacaccgccuccaaccacuccauggaccucaccaaguccaaggacccccccggcgagaagcccgcccagaacgagggcgcccagaacuccgccaccuucuccgccuccaagcuccuccagaaccucgcccagugcggcaugcaguccuccauguccgucgaggagcagcgccccuccaagcagcuccucaccggcaacaccgacaagcccaucggcaugaucgaccgccucaacuccccccuccucuccaacaagaccaacgccgucgaggagaacaaggccuucuccucccagcccaccggccccgagcccggccucuccggcuccgagaucgagaaccuccucgagcgccgcaccguccuccagcuccuccucggcaaccccaacaagggcaaguccgagaagaaggagaagaccccccuccgcgacgaguccacccaggagcacuccgagcgcgcccucuccgagcagauccucauggucaagaucaaguccgagcccugcgacgaccuccagauccccaacaccaacguccaccucucccacgacgccaaguccgcccccuuccucggcauggcccccgccguccagcgcuccgcccccgcccuccccgucuccgaggacuucaaguccgagcccgucuccccccaggacuucuccuucuccaagaacggccuccucucccgccuccuccgccagaaccaggacuccuaccucgccgacgacuccgaccgcucccaccgcaacaacgagauggcccuccucgaguccaagaaccucugcaugguccccaagaagcgcaagcucuacaccgagccccucgagaaccccuucaagaagaugaagaacaacaucgucgacgccgccaacaaccacuccgcccccgagguccucuacggcucccuccucaaccaggaggagcucaaguucucccgcaacgaccucgaguucaaguaccccgccggccacggcuccgccuccgaguccgagcaccgcuccugggcccgcgaguccaaguccuucaacguccucaagcagcuccuccucuccgagaacugcguccgcgaccucuccccccaccgcuccaacuccgucgccgacuccaagaagaagggccacaagaacaacgucaccaacuccaagcccgaguucuccaucuccucccucaacggccucauguacuccuccacccagcccuccuccugcauggacaaccgcaccuucuccuaccccggcgucgucaagacccccgucucccccaccuuccccgagcaccucggcugcgccggcucccgccccgaguccggccuccucaacggcugcuccaugcccuccgagaagggccccaucaagugggucaucaccgacgccgagaagaacgaguacgagaaggacuccccccgccucaccaagaccaaccccauccucuacuacaugcuccagaagggcggcaacuccgucaccucccgcgagacccaggacaaggacaucuggcgcgaggccuccuccgccgaguccgucucccaggucaccgccaaggaggagcuccuccccaccgccgagaccaaggccuccuucuucaaccuccgcucccccuacaacucccacaugggcaacaacgccucccgcccccacuccgccaacggcgaggucuacggccuccucggcuccguccucaccaucaagaaggaguccgaguga

SEQ ID NO: 46859 - RNA, 846 nt, Artificial Sequence
  derived and/or modified sequence opt2 from NRIP2__Homo_sapiens__NP_113662
augcucuucaucuucccccucucccuccccuggcgccccuccugcuggaaggaguccugcuccaccggccagcgccaggccggccgcucccgcgaggacuccgucacccccccccccuccucccccuggcccaccccccccgccggcgccauguccaccaagcaggaggcccgccgcgacgagggcgaggcccgcacccgcggccaggaggcccagcuccgcgaccgcgcccaccucucccagcagcgccgccucaagcaggccacccaguuccuccacaaggacuccgccgaccuccucccccucgacucccucaagcgccucggcaccuccaaggaccuccagccccgcuccgucauccagcgccgccucgucgagggcaaccccaacuggcuccagggcgagcccccccgcaugcaggaccucauccacggccaggagucccgccgcaagaccucccgcaccgagauccccgcccuccucgucaacugcaagugccaggaccagcuccuccgcgucgccgucgacaccggcacccaguacaaccgcaucuccgccggcugccucucccgccucggccucgagaagcgcguccucaaggccuccgccggcgaccucgcccccggcccccccacccaggucgagcagcucgagcuccagcucggccaggagaccgucgucugcuccgcccaggucgucgacgccgagucccccgaguucugccucggccuccagacccuccucucccucaagugcugcaucgaccucgagcacggcguccuccgccucaaggcccccuucuccgagcuccccuuccucccccucuaccaggagcccggccaguga

SEQ ID NO: 46860 - RNA, 4749 nt, Artificial Sequence
  derived and/or modified sequence opt2 from NRK__Homo_sapiens__NP_940867
auggccggccccggcggcuggcgcgaccgcgaggucaccgaccucggccaccuccccgaccccaccggcaucuucucccucgacaagaccaucggccucggcaccuacggccgcaucuaccucggccuccacgagaagaccggcgccuucaccgccgucaaggucaugaacgcccgcaagaccccccuccccgagaucggccgccgcguccgcgucaacaaguaccagaaguccgucggcuggcgcuacuccgacgaggaggaggaccuccgcaccgagcucaaccuccuccgcaaguacuccuuccacaagaacaucgucuccuucuacggcgccuucuucaagcucuccccccccggccagcgccaccagcucuggauggucauggagcucugcgccgccggcuccgucaccgacgucguccgcaugaccuccaaccagucccucaaggaggacuggaucgccuacaucugccgcgagauccuccagggccucgcccaccuccacgcccaccgcgucauccaccgcgacaucaagggccagaacguccuccucacccacaacgccgaggucaagcucgucgacuucggcgucuccgcccaggucucccgcaccaacggccgccgcaacuccuucaucggcacccccuacuggauggcccccgaggucaucgacugcgacgaggacccccgccgcuccuacgacuaccgcuccgacgucugguccgucggcaucaccgccaucgagauggccgagggcgcccccccccucugcaaccuccagccccucgaggcccucuucgucauccuccgcgaguccgcccccaccgucaaguccuccggcuggucccgcaaguuccacaacuucauggagaagugcaccaucaagaacuuccucuuccgccccaccuccgccaacaugcuccagcaccccuucguccgcgacaucaagaacgagcgccacgucgucgagucccucacccgccaccucaccggcaucaucaagaagcgccagaagaagggcaucccccucaucuucgagcgcgaggaggccaucaaggagcaguacaccguccgccgcuuccgcggccccuccugcacccacgagcuccuccgccuccccaccuccucccgcugccgcccccuccgcguccuccacggcgagcccucccagccccgcuggcuccccgaccgcgaggagccccagguccaggcccuccagcagcuccagggcgccgcccgcgucuucaugccccuccaggcccucgacuccgcccccaagccccucaagggccaggcccaggccccccagcgccuccagggcgccgcccgcgucuucaugccccuccaggcccaggucaaggccaaggccuccaagccccuccagaugcagaucaaggcccccccccgccuccgccgcgccgcccgcguccucaugccccuccaggcccagguccgcgccccccgccuccuccagguccagucccaggucuccaagaagcagcaggcccagacccagaccuccgagccccaggaccucgaccagguccccgaggaguuccagggccaggaccagguccccgagcagcagcgccagggccaggcccccgagcagcagcagcgccacaaccagguccccgagcaggagcucgagcagaaccaggcccccgagcagcccgagguccaggagcaggccgccgagcccgcccaggccgagaccgaggccgaggagcccgagucccuccgcgucaacgcccaggucuuccucccccuccucucccaggaccaccacguccuccucccccuccaccucgacacccagguccucauccccgucgagggccagaccgagggcuccccccaggcccaggccuggacccucgagcccccccaggccaucggcuccguccaggcccucaucgagggccucucccgcgaccuccuccgcgcccccaacuccaacaacuccaagccccucggcccccuccagacccucauggagaaccucuccuccaaccgcuucuacucccagcccgagcaggcccgcgagaagaaguccaaggucuccacccuccgccaggcccucgccaagcgccucucccccaagcgcuuccgcgccaaguccuccuggcgccccgagaagcucgagcucuccgaccucgaggcccgccgccagcgccgccagcgccgcugggaggacaucuucaaccagcacgaggaggagcuccgccaggucgacaaggacaaggaggacgaguccuccgacaacgacgaggucuuccacuccauccaggccgagguccagaucgagccccucaagcccuacaucuccaaccccaagaagaucgagguccaggagcgcucccccuccguccccaacaaccaggaccacgcccaccacgucaaguucuccuccuccgucccccagcgcucccuccucgagcaggcccagaagcccaucgacauccgccagcgcuccucccagaaccgccagaacuggcucgccgccuccgaguccuccuccgaggaggagucccccgucaccggccgccgcucccaguccuccccccccuacuccaccaucgaccagaagcuccucgucgacauccacguccccgacggcuucaaggucggcaagaucuccccccccgucuaccucaccaacgagugggucggcuacaacgcccucuccgagaucuuccgcaacgacuggcucacccccgcccccgucauccagccccccgaggaggacggcgacuacgucgagcucuacgacgccuccgccgacaccgacggcgacgacgacgacgaguccaacgacaccuucgaggacaccuacgaccacgccaacggcaacgacgaccucgacaaccaggucgaccaggccaacgacgucugcaaggaccacgacgacgacaacaacaaguucgucgacgacgucaacaacaacuacuacgaggcccccuccugcccccgcgccuccuacggccgcgacggcuccugcaagcaggacggcuacgacggcucccgcggcaaggaggaggccuaccgcggcuacggcucccacaccgccaaccgcucccacggcggcuccgccgccuccgaggacaacgccgccaucggcgaccaggaggagcacgccgccaacaucggcuccgagcgccgcggcuccgagggcgacggcggcaagggcgucguccgcaccuccgaggaguccggcgcccucggccucaacggcgaggagaacugcuccgagaccgacggccccggccucaagcgccccgccucccaggacuucgaguaccuccaggaggagcccggcggcggcaacgaggccuccaacgccaucgacuccggcgccgcccccuccgcccccgaccacgaguccgacaacaaggacaucuccgaguccuccacccaguccgacuucuccgccaaccacuccucccccuccaagggcuccggcauguccgccgacgccaacuucgccuccgccauccucuacgccggcuucgucgagguccccgaggagucccccaagcagcccuccgaggucaacgucaacccccucuacgucucccccgccugcaagaagccccucauccacauguacgagaaggaguucaccuccgagaucugcugcggcucccucuggggcgucaaccuccuccucggcacccgcuccaaccucuaccucauggaccgcuccggcaaggccgacaucaccaagcucauccgccgccgccccuuccgccagauccagguccucgagccccucaaccuccucaucaccaucuccggccacaagaaccgccuccgcgucuaccaccucaccuggcuccgcaacaagauccucaacaacgaccccgaguccaagcgccgccaggaggagaugcucaagaccgaggaggccugcaaggccaucgacaagcucaccggcugcgagcacuucuccguccuccagcacgaggagaccaccuacaucgccaucgcccucaaguccuccauccaccucuacgccugggcccccaaguccuucgacgaguccaccgccaucaaggucugcaucgaccaguccgccgacuccgagggcgacuacauguccuaccaggccuacauccgcauccucgccaagauccaggccgccgaccccgucaaccgcuucaagcgccccgacgagcuccuccaccuccucaagcucaaggucuuccccacccucgaccacaagcccgucaccgucgaccucgccaucggcuccgagaagcgccucaagaucuucuucuccuccgccgacggcuaccaccucaucgacgccgaguccgaggucauguccgacgucacccuccccaagaacccccucgagaucaucaucccccagaacaucaucauccuccccgacugccucggcaucggcaugaugcucaccuucaacgccgaggcccucuccgucgaggccaacgagcagcucuucaagaagauccucgagauguggaaggacauccccuccuccaucgccuucgagugcacccagcgcaccaccggcuggggccagaaggccaucgagguccgcucccuccagucccgcguccucgaguccgagcucaagcgccgcuccaucaagaagcuccgcuuccucugcacccgcggcgacaagcucuucuucaccuccacccuccgcaaccaccacucccgcgucuacuucaugacccucggcaagcucgaggagcuccaguccaacuacgacgucuga

SEQ ID NO: 46861 - RNA, 813 nt, Artificial Sequence
  derived and/or modified sequence opt2 from NRL__Homo_sapiens__XP_011535103
augggcaaccucgccgaggccgagucccgccgcgccccccucgccgccccccgcggccgcgcccagcgcaagguccacuccucccagcccuccucccgcauggcccucccccccuccccccucgccauggaguacgucaacgacuucgaccucaugaaguucgaggucaagcgcgagcccuccgagggccgccccggcccccccaccgccucccucggcuccacccccuacuccuccgucccccccucccccaccuucuccgagcccggcauggucggcgccaccgagggcacccgccccggccucgaggagcucuacuggcucgccacccuccagcagcagcucggcgccggcgaggcccucggccucucccccgaggaggccauggagcuccuccagggccagggccccguccccgucgacggcccccacggcuacuaccccggcucccccgaggagaccggcgcccagcacguccagcucgccgagcgcuucuccgacgccgcccucgucuccauguccguccgcgagcucaaccgccagcuccgcggcugcggccgcgacgaggcccuccgccucaagcagcgccgccgcacccucaagaaccgcggcuacgcccaggccugccgcuccaagcgccuccagcagcgccgcggccucgaggccgagcgcgcccgccucgccgcccagcucgacgcccuccgcgccgaggucgcccgccucgcccgcgagcgcgaccucuacaaggcccgcugcgaccgccucaccuccuccggccccggcuccggcgaccccucccaccucuuccucuga

SEQ ID NO: 46862 - RNA, 612 nt, Artificial Sequence
  derived and/or modified sequence opt2 from NRM__Homo_sapiens__NP_001257638
auggcccccgcccuccuccucauccccgccgcccucgccuccuucauccucgccuucggcaccggcgucgaguucguccgcuucaccucccuccgcccccuccucggcggcauccccgaguccggcggccccgacgcccgccagggcuggcucgccgcccuccaggaccgcuccauccucgccccccucgccugggaccucggccuccuccuccucuucgucggccagcacucccucauggccgccgagcgcgucaaggccuggaccucccgcuacuucggcguccuccagcgcucccucuacgucgccugcaccgcccucgcccuccaggucuacuaccacguccucggccucggcgagccccucgcccucaaguccccccgcgcccuccgccucuucucccaccuccgccaccccgucugcgucgagcuccucaccguccucugggucguccccacccucggcaccgaccgccuccuccucgccuuccuccucacccucuaccucggccucgcccacggccucgaccagcaggaccuccgcuaccuccgcgcccagcuccagcgcaagcuccaccuccucucccgcccccaggacggcgaggccgaguga

SEQ ID NO: 46863 - RNA, 429 nt, Artificial Sequence
  derived and/or modified sequence opt2 from NRN1__Homo_sapiens__NP_001265639
augggccucaagcucaacggccgcuacaucucccucauccucgccguccagaucgccuaccucguccaggccguccgcgccgccggcaagugcgacgccgucuucaagggcuucuccgacugccuccucaagcucggcgacuccauggccaacuacccccagggccucgacgacaagaccaacaucaagaccgucugcaccuacugggaggacuuccacuccugcaccgucaccgcccucaccgacugccaggagggcgccaaggacaugugggacaagcuccgcaaggaguccaagaaccucaacauccagggcucccucuucgagcucugcggcuccggcaacggcgccgccggcucccuccuccccgccuuccccguccuccucgucucccucuccgccgcccucgccaccuggcucuccuucuga

SEQ ID NO: 46864 - RNA, 1935 nt, Artificial Sequence
  derived and/or modified sequence opt2 from NRP1__Homo_sapiens__NP_001019799
auggagcgcggccucccccuccucugcgccguccucgcccucguccucgcccccgccggcgccuuccgcaacgacaagugcggcgacaccaucaagaucgagucccccggcuaccucaccucccccggcuacccccacuccuaccaccccuccgagaagugcgaguggcucauccaggcccccgaccccuaccagcgcaucaugaucaacuucaacccccacuucgaccucgaggaccgcgacugcaaguacgacuacgucgaggucuucgacggcgagaacgagaacggccacuuccgcggcaaguucugcggcaagaucgcccccccccccgucgucuccuccggccccuuccucuucaucaaguucgucuccgacuacgagacccacggcgccggcuucuccauccgcuacgagaucuucaagcgcggccccgagugcucccagaacuacaccacccccuccggcgucaucaagucccccggcuuccccgagaaguaccccaacucccucgagugcaccuacaucgucuucgcccccaagauguccgagaucauccucgaguucgaguccuucgaccucgagcccgacuccaacccccccggcggcauguucugccgcuacgaccgccucgagaucugggacggcuuccccgacgucggcccccacaucggccgcuacugcggccagaagacccccggccgcauccgcuccuccuccggcauccucuccauggucuucuacaccgacuccgccaucgccaaggagggcuucuccgccaacuacuccguccuccaguccuccgucuccgaggacuucaagugcauggaggcccucggcauggaguccggcgagauccacuccgaccagaucaccgccuccucccaguacuccaccaacugguccgccgagcgcucccgccucaacuaccccgagaacggcuggacccccggcgaggacuccuaccgcgaguggauccaggucgaccucggccuccuccgcuucgucaccgccgucggcacccagggcgccaucuccaaggagaccaagaagaaguacuacgucaagaccuacaagaucgacgucuccuccaacggcgaggacuggaucaccaucaaggagggcaacaagcccguccucuuccagggcaacaccaaccccaccgacgucgucgucgccgucuuccccaagccccucaucacccgcuucguccgcaucaagcccgccaccugggagaccggcaucuccaugcgcuucgaggucuacggcugcaagaucaccgacuaccccugcuccggcaugcucggcauggucuccggccucaucuccgacucccagaucaccuccuccaaccagggcgaccgcaacuggaugcccgagaacauccgccucgucaccucccgcuccggcugggcccucccccccgccccccacuccuacaucaacgaguggcuccagaucgaccucggcgaggagaagaucguccgcggcaucaucauccagggcggcaagcaccgcgagaacaaggucuucaugcgcaaguucaagaucggcuacuccaacaacggcuccgacuggaagaugaucauggacgacuccaagcgcaaggccaaguccuucgagggcaacaacaacuacgacacccccgagcuccgcaccuuccccgcccucuccacccgcuucauccgcaucuaccccgagcgcgccacccacggcggccucggccuccgcauggagcuccucggcugcgaggucgaggcccccaccgccggccccaccacccccaacggcaaccucgucgacgagugcgacgacgaccaggccaacugccacuccggcaccggcgacgacuuccagcucaccggcggcaccaccguccucgccaccgagaagcccaccgucaucgacuccaccauccaguccggcaucaaguga

SEQ ID NO: 46865 - RNA, 2781 nt, Artificial Sequence
  derived and/or modified sequence opt2 from NRP2__Homo_sapiens__NP_003863
auggacauguucccccucaccugggucuuccucgcccucuacuucucccgccaccagguccgcggccagcccgacccccccugcggcggccgccucaacuccaaggacgccggcuacaucaccucccccggcuacccccaggacuaccccucccaccagaacugcgaguggaucgucuacgcccccgagcccaaccagaagaucguccucaacuucaacccccacuucgagaucgagaagcacgacugcaaguacgacuucaucgagauccgcgacggcgacuccgaguccgccgaccuccucggcaagcacugcggcaacaucgccccccccaccaucaucuccuccggcuccaugcucuacaucaaguucaccuccgacuacgcccgccagggcgccggcuucucccuccgcuacgagaucuucaagaccggcuccgaggacugcuccaagaacuucaccucccccaacggcaccaucgagucccccggcuuccccgagaaguacccccacaaccucgacugcaccuucaccauccucgccaagcccaagauggagaucauccuccaguuccucaucuucgaccucgagcacgacccccuccaggucggcgagggcgacugcaaguacgacuggcucgacaucugggacggcaucccccacgucggcccccucaucggcaaguacugcggcaccaagacccccuccgagcuccgcuccuccaccggcauccucucccucaccuuccacaccgacauggccgucgccaaggacggcuucuccgcccgcuacuaccucguccaccaggagccccucgagaacuuccagugcaacgucccccucggcauggaguccggccgcaucgccaacgagcagaucuccgccuccuccaccuacuccgacggccgcuggaccccccagcagucccgccuccacggcgacgacaacggcuggacccccaaccucgacuccaacaaggaguaccuccaggucgaccuccgcuuccucaccaugcucaccgccaucgccacccagggcgccaucucccgcgagacccagaacggcuacuacgucaaguccuacaagcucgaggucuccaccaacggcgaggacuggauggucuaccgccacggcaagaaccacaaggucuuccaggccaacaacgacgccaccgaggucguccucaacaagcuccacgccccccuccucacccgcuucguccgcauccgcccccagaccuggcacuccggcaucgcccuccgccucgagcucuucggcugccgcgucaccgacgcccccugcuccaacaugcucggcaugcucuccggccucaucgccgacucccagaucuccgccuccuccacccaggaguaccucuggucccccuccgccgcccgccucgucuccucccgcuccggcugguucccccgcaucccccaggcccagcccggcgaggaguggcuccaggucgaccucggcacccccaagaccgucaagggcgucaucauccagggcgcccgcggcggcgacuccaucaccgccgucgaggcccgcgccuucguccgcaaguucaaggucuccuacucccucaacggcaaggacugggaguacauccaggacccccgcacccagcagcccaagcucuucgagggcaacaugcacuacgacacccccgacauccgccgcuucgaccccauccccgcccaguacguccgcgucuaccccgagcgcuggucccccgccggcaucggcaugcgccucgagguccucggcugcgacuggaccgacuccaagcccaccgucgagacccucggccccaccgucaaguccgaggagaccaccacccccuaccccaccgaggaggaggccaccgagugcggcgagaacugcuccuucgaggacgacaaggaccuccagcuccccuccggcuucaacugcaacuucgacuuccucgaggagcccugcggcuggauguacgaccacgccaaguggcuccgcaccaccugggccuccuccuccucccccaacgaccgcaccuuccccgacgaccgcaacuuccuccgccuccaguccgacucccagcgcgagggccaguacgcccgccucaucuccccccccguccaccucccccgcucccccgucugcauggaguuccaguaccaggccaccggcggccgcggcgucgcccuccaggucguccgcgaggccucccaggaguccaagcuccucugggucauccgcgaggaccagggcggcgaguggaagcacggccgcaucauccuccccuccuacgacauggaguaccagaucgucuucgagggcgucaucggcaagggccgcuccggcgagaucgccaucgacgacauccgcaucuccaccgacgucccccucgagaacugcauggagcccaucuccgccuucgccgucgacauccccgagauccacgagcgcgagggcuacgaggacgagaucgacgacgaguacgaggucgacugguccaacuccuccuccgccaccuccggcuccggcgcccccuccaccgacaaggagaaguccuggcucuacacccucgaccccauccucaucaccaucaucgccauguccucccucggcguccuccucggcgccaccugcgccggccuccuccucuacugcaccugcuccuacuccggccucuccucccgcuccugcaccacccucgagaacuacaacuucgagcucuacgacggccucaagcacaaggucaagaugaaccaccagaagugcugcuccgaggccuga

SEQ ID NO: 46866 - RNA, 588 nt, Artificial Sequence
  derived and/or modified sequence opt2 from NRSN1__Homo_sapiens__NP_542454
auguccuccugcuccaacgucugcggcucccgccaggcccaggccgccgccgagggcggcuaccagcgcuacggcguccgcuccuaccuccaccaguucuacgaggacugcaccgccuccaucugggaguacgaggacgacuuccagauccagcgcucccccaaccgcugguccuccgucuucuggaaggucggccucaucuccggcaccgucuucgucauccucggccucaccguccucgccgucggcuuccucgucccccccaagaucgaggccuucggcgaggccgacuucgucgucgucgacacccacgccguccaguucaacuccgcccucgacauguacaagcucgccggcgccguccucuucugcaucggcggcaccuccauggccggcugccuccucauguccgucuucgucaaguccuacuccaaggaggagaaguuccuccagcagaaguucaaggagcgcaucgccgacaucaaggcccacacccagcccgucaccaaggcccccggccccggcgagaccaagauccccgucacccucucccgcguccagaacguccagccccuccucgccaccuga

SEQ ID NO: 46867 - RNA, 615 nt, Artificial Sequence
  derived and/or modified sequence opt2 from NRSN2__Homo_sapiens__NP_079234
augaugcccuccugcaaccgcuccugcuccugcucccgcggccccuccgucgaggacggcaagugguacggcguccgcuccuaccuccaccucuucuacgaggacugcgccggcaccgcccucuccgacgaccccgagggcccccccguccucugcccccgccgccccuggcccucccucugcuggaagaucucccucuccuccggcacccuccuccuccuccucggcgucgccgcccucaccaccggcuacgccgucccccccaagcucgagggcaucggcgagggcgaguuccucguccucgaccagcgcgccgccgacuacaaccaggcccucggcaccugccgccucgccggcaccgcccucugcgucgccgccggcguccuccucgccaucugccucuucugggccaugaucggcuggcucucccaggacaccaaggccgagccccucgaccccgaggccgacucccacgucgaggucuucggcgacgagcccgagcagcagcucucccccaucuuccgcaacgccuccggccaguccugguucuccccccccgccucccccuucggccaguccuccguccagaccauccagcccaagcgcgacuccuga

SEQ ID NO: 46868 - RNA, 594 nt, Artificial Sequence
  derived and/or modified sequence opt2 from NRTN__Homo_sapiens__XP_011526343
augcagcgcuggaaggccgccgcccucgccuccguccucugcuccuccguccucuccaucuggaugugccgcgagggccuccuccucucccaccgccucggccccgcccucgucccccuccaccgccucccccgcacccucgacgcccgcaucgcccgccucgcccaguaccgcgcccuccuccagggcgcccccgacgccauggagcuccgcgagcucacccccugggccggccgcccccccggcccccgccgccgcgccggcccccgccgccgccgcgcccgcgcccgccucggcgcccgccccugcggccuccgcgagcucgagguccgcgucuccgagcucggccucggcuacgccuccgacgagaccguccucuuccgcuacugcgccggcgccugcgaggccgccgcccgcgucuacgaccucggccuccgccgccuccgccagcgccgccgccuccgccgcgagcgcguccgcgcccagcccugcugccgccccaccgccuacgaggacgaggucuccuuccucgacgcccacucccgcuaccacaccguccacgagcucuccgcccgcgagugcgccugcgucuga

SEQ ID NO: 46869 - RNA, 4644 nt, Artificial Sequence
  derived and/or modified sequence opt2 from NRXN1__Homo_sapiens__NP_001129131
augggcaccgcccuccuccagcgcggcggcugcuuccuccucugccucucccuccuccuccucggcugcugggccgagcucggcuccggccucgaguuccccggcgccgagggccaguggacccgcuuccccaaguggaacgccugcugcgaguccgagauguccuuccagcucaagacccgcuccgcccgcggccucguccucuacuucgacgacgagggcuucugcgacuuccucgagcucauccucacccgcggcggccgccuccagcucuccuucuccaucuucugcgccgagcccgccacccuccucgccgacacccccgucaacgacggcgccuggcacuccguccgcauccgccgccaguuccgcaacaccacccucuucaucgaccaggucgaggccaagugggucgaggucaaguccaagcgccgcgacaugaccgucuucuccggccucuucgucggcggccucccccccgagcuccgcgccgccgcccucaagcucacccucgccuccguccgcgagcgcgagcccuucaagggcuggauccgcgacguccgcgucaacuccucccagguccuccccgucgacuccggcgaggucaagcucgacgacgagccccccaacuccggcggcggcucccccugcgaggccggcgaggagggcgagggcggcgucugccucaacggcggcgucugcuccgucgucgacgaccaggccgucugcgacugcucccgcaccggcuuccgcggcaaggacugcucccaggagaucaaguucggccuccagugcguccuccccguccuccuccacgacaacgaccagggcaaguacugcugcaucaacaccgccaagccccucaccgagaaggacaacaacgucgagggccucgcccaccucaugaugggcgaccagggcaaguccaagggcaaggaggaguacaucgccaccuucaagggcuccgaguacuucugcuacgaccucucccagaaccccauccaguccuccuccgacgagaucacccucuccuucaagacccuccagcgcaacggccucaugcuccacaccggcaaguccgccgacuacgucaaccucgcccucaagaacggcgccgucucccucgucaucaaccucggcuccggcgccuucgaggcccucgucgagcccgucaacggcaaguucaacgacaacgccuggcacgacgucaaggucacccgcaaccuccgccagcacuccggcaucggccacgccauggucaacaagcuccacugcuccgucaccaucuccgucgacggcauccucaccaccaccggcuacacccaggaggacuacaccaugcucggcuccgacgacuucuucuacgucggcggcucccccuccaccgccgaccuccccggcucccccgucuccaacaacuucaugggcugccucaaggaggucgucuacaagaacaacgacguccgccucgagcucucccgccucgccaagcagggcgaccccaagaugaagauccacggcgucgucgccuucaagugcgagaacgucgccacccucgaccccaucaccuucgagacccccgaguccuucaucucccuccccaaguggaacgccaagaagaccggcuccaucuccuucgacuuccgcaccaccgagcccaacggccucauccucuucucccacggcaagccccgccaccagaaggacgccaagcacccccagaugaucaaggucgacuucuucgccaucgagaugcucgacggccaccucuaccuccuccucgacaugggcuccggcaccaucaagaucaaggcccuccucaagaaggucaacgacggcgagugguaccacgucgacuuccagcgcgacggccgcuccggcaccaucuccgucaacacccuccgcacccccuacaccgcccccggcgaguccgagauccucgaccucgacgacgagcucuaccucggcggccuccccgagaacaaggccggccucgucuuccccaccgaggucuggaccgcccuccucaacuacggcuacgucggcugcauccgcgaccucuucaucgacggccaguccaaggacauccgccagauggccgagguccaguccaccgccggcgucaagcccuccugcuccaaggagaccgccaagcccugccucuccaaccccugcaagaacaacggcaugugccgcgacggcuggaaccgcuacgucugcgacugcuccggcaccggcuaccucggccgcuccugcgagcgcgaggccaccguccucuccuacgacggcuccauguucaugaagauccagcuccccgucgucaugcacaccgaggccgaggacgucucccuccgcuuccgcucccagcgcgccuacggcauccucauggccaccaccucccgcgacuccgccgacacccuccgccucgagcucgacgccggccgcgucaagcucaccgucaaccucgacugcauccgcaucaacugcaacuccuccaagggccccgagacccucuucgccggcuacaaccucaacgacaacgaguggcacaccguccgcgucguccgccgcggcaagucccucaagcucaccgucgacgaccagcaggccaugaccggccagauggccggcgaccacacccgccucgaguuccacaacaucgagaccggcaucaucaccgagcgccgcuaccucuccuccguccccuccaacuucaucggccaccuccagucccucaccuucaacggcauggccuacaucgaccucugcaagaacggcgacaucgacuacugcgagcucaacgcccgcuucggcuuccgcaacaucaucgccgaccccgucaccuucaagaccaaguccuccuacgucgcccucgccacccuccaggccuacaccuccaugcaccucuucuuccaguucaagaccaccucccucgacggccucauccucuacaacuccggcgacggcaacgacuucaucgucgucgagcucgucaagggcuaccuccacuacgucuucgaccucggcaacggcgccaaccucaucaagggcuccuccaacaagccccucaacgacaaccaguggcacaacgucaugaucucccgcgacaccuccaaccuccacaccgucaagaucgacaccaagaucaccacccagaucaccgccggcgcccgcaaccucgaccucaaguccgaccucuacaucggcggcgucgccaaggagaccuacaagucccuccccaagcucguccacgccaaggagggcuuccagggcugccucgccuccgucgaccucaacggccgccuccccgaccucaucuccgacgcccucuucugcaacggccagaucgagcgcggcugcgagggccccuccaccaccugccaggaggacuccugcuccaaccagggcgucugccuccagcagugggacggcuucuccugcgacugcuccaugaccuccuucuccggcccccucugcaacgaccccggcaccaccuacaucuucuccaagggcggcggccagaucaccuacaaguggccccccaacgaccgccccuccacccgcgccgaccgccucgccaucggcuucuccaccguccagaaggaggccguccucguccgcgucgacuccuccuccggccucggcgacuaccucgagcuccacauccaccagggcaagaucggcgucaaguucaacgucggcaccgacgacaucgccaucgaggaguccaacgccaucaucaacgacggcaaguaccacgucguccgcuucacccgcuccggcggcaacgccacccuccaggucgacuccuggcccgucaucgagcgcuaccccgccggcaacaacgacaacgagcgccucgccaucgcccgccagcgcauccccuaccgccucggccgcgucgucgacgaguggcuccucgacaagggccgccagcucaccaucuucaacucccaggccaccaucaucaucggcggcaaggagcagggccagcccuuccagggccagcucuccggccucuacuacaacggccucaagguccucaacauggccgccgagaacgacgccaacaucgccaucgucggcaacguccgccucgucggcgagguccccuccuccaugaccaccgaguccaccgccaccgccaugcaguccgagauguccaccuccaucauggagaccaccaccacccucgccaccuccaccgcccgccgcggcaagccccccaccaaggagcccaucucccagaccaccgacgacauccucgucgccuccgccgagugccccuccgacgacgaggacaucgaccccugcgagcccuccuccggcggccucgccaaccccacccgcgccggcggccgcgagcccuaccccggcuccgccgaggucauccgcgaguccuccuccaccaccggcauggucgucggcaucgucgccgccgccgcccucugcauccucauccuccucuacgccauguacaaguaccgcaaccgcgacgagggcuccuaccacgucgacgagucccgcaacuacaucuccaacuccgcccaguccaacggcgccgucgucaaggagaagcagcccuccuccgccaaguccuccaacaagaacaagaagaacaaggacaaggaguacuacgucuga

SEQ ID NO: 46870 - RNA, 5139 nt, Artificial Sequence
  derived and/or modified sequence opt2 from NRXN2__Homo_sapiens__NP_055895
auggccuccggcucccgcuggcgccccaccccccccccccuccuccuccuccuccuccucgcccucgccgcccgcgccgacggccucgaguucggcggcggccccggccagugggcccgcuacgcccgcugggccggcgccgccuccuccggcgagcucuccuucucccuccgcaccaacgccacccgcgcccuccuccucuaccucgacgacggcggcgacugcgacuuccucgagcuccuccucgucgacggccgccuccgccuccgcuucacccucuccugcgccgagcccgccacccuccagcucgacacccccgucgccgacgaccgcuggcacaugguccuccucacccgcgacgcccgccgcaccgcccucgccgucgacggcgaggcccgcgccgccgagguccgcuccaagcgccgcgagaugcaggucgccuccgaccucuucgucggcggcaucccccccgacguccgccucuccgcccucacccucuccaccgucaaguacgagccccccuuccgcggccuccucgccaaccucaagcucggcgagcgcccccccgcccuccucggcucccagggccuccgcggcgccaccgccgacccccucugcgcccccgcccgcaaccccugcgccaacggcggccucugcaccguccucgcccccggcgaggucggcugcgacugcucccacaccggcuucggcggcaaguucugcuccgaggaggagcaccccauggagggccccgcccaccucacccucaacuccgaggucggcucccuccucuucuccgagggcggcgccggccgcggcggcgccggcgacguccaccagcccaccaagggcaaggaggaguucgucgccaccuucaagggcaacgaguucuucugcuacgaccucucccacaaccccauccaguccuccaccgacgagaucacccucgccuuccgcacccuccagcgcaacggccucaugcuccacaccggcaaguccgccgacuacgucaaccucucccucaaguccggcgccgucuggcucgucaucaaccucggcuccggcgccuucgaggcccucgucgagcccgucaacggcaaguucaacgacaacgccuggcacgacguccgcgucacccgcaaccuccgccagcacgccggcaucggccacgccauggucaacaagcuccacuaccucgucaccaucuccgucgacggcauccucaccaccaccggcuacacccaggaggacuacaccaugcucggcuccgacgacuucuucuacaucggcggcucccccaacaccgccgaccuccccggcucccccgucuccaacaacuucaugggcugccucaaggacgucgucuacaagaacaacgacuucaagcucgagcucucccgccucgccaaggagggcgaccccaagaugaagcuccagggcgaccucuccuuccgcugcgaggacgucgccgcccucgaccccgucaccuucgagucccccgaggccuucgucgcccucccccgcugguccgccaagcgcaccggcuccaucucccucgacuuccgcaccaccgagcccaacggccuccuccucuucucccagggccgccgcgccggcggcggcgccggcucccacuccuccgcccagcgcgccgacuacuucgccauggagcuccucgacggccaccucuaccuccuccucgacaugggcuccggcggcaucaagcuccgcgccuccucccgcaaggucaacgacggcgaguggugccacgucgacuuccagcgcgacggccgcaagggcuccaucuccgucaacucccgcuccacccccuuccucgccaccggcgacuccgagauccucgaccucgaguccgagcucuaccucggcggccuccccgagggcggccgcgucgaccucccccucccccccgaggucuggaccgccgcccuccgcgccggcuacgucggcugcguccgcgaccucuucaucgacggccgcucccgcgaccuccgcggccucgccgaggcccagggcgccgucggcgucgcccccuucugcucccgcgagacccucaagcagugcgccuccgcccccugccgcaacggcggcgucugccgcgagggcuggaaccgcuucaucugcgacugcaucggcaccggcuuccucggccgcgucugcgagcgcgaggccaccguccucuccuacgacggcuccauguacaugaagaucaugcuccccaacgccaugcacaccgaggccgaggacgucucccuccgcuucaugucccagcgcgccuacggccucaugauggccaccaccucccgcgaguccgccgacacccuccgccucgagcucgacggcggccagaugaagcucaccgucaaccucgacugccuccgcgucggcugcgcccccuccaagggccccgagacccucuucgccggccacaagcucaacgacaacgaguggcacaccguccgcgucguccgccgcggcaagucccuccagcucuccgucgacaacgucaccgucgagggccagauggccggcgcccacaugcgccucgaguuccacaacaucgagaccggcaucaugaccgagcgccgcuucaucuccgucguccccuccaacuucaucggccaccucuccggccucgucuucaacggccagcccuacauggaccagugcaaggacggcgacaucaccuacugcgagcucaacgcccgcuucggccuccgcgccaucgucgccgaccccgucaccuucaagucccgcuccuccuaccucgcccucgccacccuccaggccuacgccuccaugcaccucuucuuccaguucaagaccaccgcccccgacggccuccuccucuucaacuccggcaacggcaacgacuucaucgucaucgagcucgucaagggcuacauccacuacgucuucgaccucggcaacggccccucccucaugaagggcaacuccgacaagcccgucaacgacaaccaguggcacaacgucgucgucucccgcgaccccggcaacguccacacccucaagaucgacucccgcaccgucacccagcacuccaacggcgcccgcaaccucgaccucaagggcgagcucuacaucggcggccucuccaagaacauguucuccaaccuccccaagcucgucgccucccgcgacggcuuccagggcugccucgccuccgucgaccucaacggccgccuccccgaccucaucgccgacgcccuccaccgcaucggccaggucgagcgcggcugcgacggccccuccaccaccugcaccgaggaguccugcgccaaccagggcgucugccuccagcagugggacggcuucaccugcgacugcaccaugaccuccuacggcggccccgucugcaacgaccccggcaccaccuacaucuucggcaagggcggcgcccucaucaccuacaccuggccccccaacgaccgccccuccacccgcauggaccgccucgccgucggcuucuccacccaccagcgcuccgccguccucguccgcgucgacuccgccuccggccucggcgacuaccuccagcuccacaucgaccagggcaccgucggcgucaucuucaacgucggcaccgacgacaucaccaucgacgagcccaacgccaucgucuccgacggcaaguaccacgucguccgcuucacccgcuccggcggcaacgccacccuccaggucgacuccuggcccgucaacgagcgcuaccccgccggcaacuucgacaacgagcgccucgccaucgcccgccagcgcauccccuaccgccucggccgcgucgucgacgaguggcuccucgacaagggccgccagcucaccaucuucaacucccaggccgccaucaagaucggcggccgcgaccagggccgccccuuccagggccaggucuccggccucuacuacaacggccucaagguccucgcccucgccgccgaguccgaccccaacguccgcaccgagggccaccuccgccucgucggcgagggccccuccguccuccucuccgccgagaccaccgccaccacccuccucgccgacauggccaccaccaucauggagaccaccaccaccauggccaccaccaccacccgccgcggccgcucccccacccuccgcgacuccaccacccagaacaccgacgaccuccucgucgccuccgccgagugccccuccgacgacgaggaccucgaggagugcgagcccuccaccggcggcgagcucauccuccccaucaucaccgaggacucccucgaccccccccccgucgccacccgcucccccuucgucccccccccccccaccuucuaccccuuccucaccggcgucggcgccacccaggacacccuccccccccccgccgcccgccgcccccccuccggcggccccugccaggccgagcgcgacgacuccgacugcgaggagcccaucgaggccuccggcuucgccuccggcgaggucuucgacuccucccucccccccaccgacgacgaggacuucuacaccaccuucccccucgucaccgaccgcaccacccuccucuccccccgcaagcccgccccccgccccaaccuccgcaccgacggcgccaccggcgcccccggcguccucuucgcccccuccgcccccgcccccaaccuccccgccggcaagaugaaccaccgcgacccccuccagccccuccucgagaaccccccccucggccccggcgcccccaccuccuucgagccccgccgcccccccccccuccgccccggcgucaccuccgcccccggcuucccccaccuccccaccgccaaccccaccggccccggcgagcgcggcccccccggcgccgucgaggucauccgcgaguccuccuccaccaccggcauggucgucggcaucgucgccgccgccgcccucugcauccucauccuccucuacgccauguacaaguaccgcaaccgcgacgagggcuccuaccaggucgaccagucccgcaacuacaucuccaacuccgcccaguccaacggcgccgucgucaaggagaaggcccccgccgcccccaagacccccuccaaggccaagaagaacaaggacaaggaguacuacgucuga

SEQ ID NO: 46871 - RNA, 1380 nt, Artificial Sequence
  derived and/or modified sequence opt2 from NRXN3__Homo_sapiens__NP_001098720
augcaccuccgcauccacgcccgccgcucccccccccgccgccccgccuggacccucggcaucugguuccucuucuggggcugcaucgucuccuccgucugguccuccuccaacgucgccuccuccuccuccaccuccuccucccccggcucccacucccagcacgagcaccacuuccacggcuccaagcaccacuccguccccaucuccaucuaccgcucccccgucucccuccgcggcggccacgccggcgccaccuacaucuucggcaaguccggcggccucauccucuacaccuggcccgccaacgaccgccccuccacccgcuccgaccgccucgccgucggcuucuccaccaccgucaaggacggcauccucguccgcaucgacuccgcccccggccucggcgacuuccuccagcuccacaucgagcagggcaagaucggcgucgucuucaacaucggcaccgucgacaucuccaucaaggaggagcgcacccccgucaacgacggcaaguaccacgucguccgcuucacccgcaacggcggcaacgccacccuccaggucgacaacuggcccgucaacgagcacuaccccaccggcaacaccgacaacgagcgcuuccagauggucaagcagaagauccccuucaaguacaaccgccccgucgaggaguggcuccaggagaagggccgccagcucaccaucuucaacacccaggcccagaucgccaucggcggcaaggacaagggccgccucuuccagggccagcucuccggccucuacuacgacggccucaagguccucaacauggccgccgagaacaaccccaacaucaagaucaacggcuccguccgccucgucggcgagguccccuccauccucggcaccacccagaccaccuccaugccccccgagauguccaccaccgucauggagaccaccaccaccauggccaccaccaccacccgcaagaaccgcuccaccgccuccauccagcccaccuccgacgaccucgucuccuccgccgagugcuccuccgacgacgaggacuucgucgagugcgagcccuccaccgccaaccccaccgagcccggcauccgccgcguccccggcgccuccgaggucauccgcgaguccuccuccaccaccggcauggucgucggcaucgucgccgccgccgcccucugcauccucauccuccucuacgccauguacaaguaccgcaaccgcgacgagggcuccuaccaggucgacgagacccgcaacuacaucuccaacuccgcccaguccaacggcacccucaugaaggagaagcagcaguccuccaaguccggccacaagaagcagaagaacaaggaccgcgaguacuacgucuga

SEQ ID NO: 46872 - RNA, 783 nt, Artificial Sequence
  derived and/or modified sequence opt2 from NSA2__Homo_sapiens__NP_055701
augccccagaacgaguacaucgagcuccaccgcaagcgcuacggcuaccgccucgacuaccacgagaagaagcgcaagaaggagucccgcgaggcccacgagcgcuccaagaaggccaagaagaugaucggccucaaggccaagcucuaccacaagcagcgccacgccgagaagauccagaugaagaagaccaucaagaugcacgagaagcgcaacaccaagcagaagaacgacgagaagaccccccagggcgccguccccgccuaccuccucgaccgcgagggccagucccgcgccaagguccucuccaacaugaucaagcagaagcgcaaggagaaggccggcaagugggaggucccccuccccaagguccgcgcccagggcgagaccgagguccucaaggucauccgcaccggcaagcgcaagaagaaggccuggaagcgcauggucaccaaggucugcuucgucggcgacggcuucacccgcaagccccccaaguacgagcgcuucauccgccccaugggccuccgcuucaagaaggcccacgucacccaccccgagcucaaggccaccuucugccuccccauccucggcgucaagaagaaccccuccuccccccucuacaccacccucggcgucaucaccaagggcaccgucaucgaggucaacgucuccgagcucggccucgucacccagggcggcaaggucaucuggggcaaguacgcccaggucaccaacaaccccgagaacgacggcugcaucaacgccguccuccucgucuga

SEQ ID NO: 46873 - RNA, 7284 nt, Artificial Sequence
  derived and/or modified sequence opt2 from NSD1__Homo_sapiens__XP_005266018
augccccucaagacccgcaccgcccucuccgacgaccccgacuccuccaccuccacccucggcaacaugcucgagcuccccggcaccuccuccuccuccaccucccaggagcuccccuucugccagcccaagaagaaguccaccccccucaaguacgaggucggcgaccucaucugggccaaguucaagcgccgccccugguggcccugccgcaucugcuccgacccccucaucaacacccacuccaagaugaaggucuccaaccgccgccccuaccgccaguacuacgucgaggccuucggcgaccccuccgagcgcgccugggucgccggcaaggccaucgucauguucgagggccgccaccaguucgaggagcuccccguccuccgccgccgcggcaagcagaaggagaagggcuaccgccacaaggucccccagaagauccucuccaagugggaggccuccgucggccucgccgagcaguacgacguccccaagggcuccaagaaccgcaagugcauccccggcuccaucaagcucgacuccgaggaggacaugcccuucgaggacugcaccaacgaccccgaguccgagcacgaccuccuccucaacggcugccucaagucccucgccuucgacuccgagcacuccgccgacgagaaggagaagcccugcgccaagucccgcgcccgcaaguccuccgacaaccccaagcgcaccuccgucaagaagggccacauccaguucgaggcccacaaggacgagcgccgcggcaagauccccgagaaccucggccucaacuucaucuccggcgacaucuccgacacccaggccuccaacgagcucucccgcaucgccaacucccucaccggcuccaacaccgcccccggcuccuuccucuucuccuccugcggcaagaacaccgccaagaaggaguucgagaccuccaacggcgacucccuccucggccuccccgagggcgcccucaucuccaagugcucccgcgagaagaacaagccccagcgcucccucgucugcggcuccaaggucaagcucugcuacaucggcgccggcgacgaggagaagcgcuccgacuccaucuccaucugcaccaccuccgacgacggcuccuccgaccucgaccccaucgagcacuccuccgaguccgacaacuccguccucgagauccccgacgccuucgaccgcaccgagaacaugcucuccaugcagaagaacgagaagaucaaguacucccgcuucgccgccaccaacacccgcgucaaggccaagcagaagccccucaucuccaacucccacaccgaccaccucaugggcugcaccaaguccgccgagcccggcaccgagaccucccaggucaaccucuccgaccucaaggccuccacccucguccacaagccccaguccgacuucaccaacgacgcccucucccccaaguucaaccucuccuccuccaucuccuccgagaacucccucaucaagggcggcgccgccaaccaggcccuccuccacuccaaguccaagcagcccaaguuccgcuccaucaagugcaagcacaaggagaaccccgucauggccgagccccccgucaucaacgaggagugcucccucaagugcugcuccuccgacaccaagggcuccccccucgccuccaucuccaaguccggcaaggucgacggccucaagcuccucaacaacaugcacgagaagacccgcgacuccuccgacaucgagaccgccgucgucaagcacguccucuccgagcucaaggagcucuccuaccgcucccucggcgaggacgucuccgacuccggcaccuccaagcccuccaagccccuccucuucuccuccgccuccucccagaaccacauccccaucgagcccgacuacaaguucuccacccuccucaugaugcucaaggacaugcacgacuccaagaccaaggagcagcgccucaugaccgcccagaaccucgucuccuaccgcucccccggccgcggcgacugcuccaccaacucccccgucggcgucuccaagguccucgucuccggcggcuccacccacaacuccgagaagaagggcgacggcacccagaacuccgccaaccccucccccuccggcggcgacuccgcccucuccggcgagcucuccgccucccuccccggccuccucuccgacaagcgcgaccuccccgccuccggcaagucccgcuccgacugcgucacccgccgcaacugcggccgcuccaagcccuccuccaagcuccgcgacgccuucuccgcccagauggucaagaacaccgucaaccgcaaggcccucaagaccgagcgcaagcgcaagcucaaccagcuccccuccgucacccucgacgccguccuccagggcgaccgcgagcgcggcggcucccuccgcggcggcgccgaggaccccuccaaggaggacccccuccagaucaugggccaccucaccuccgaggacggcgaccacuucuccgacguccacuucgacuccaaggucaagcaguccgaccccggcaagaucuccgagaagggccucuccuucgagaacggcaagggccccgagcucgacuccgucaugaacuccgagaacgacgagcucaacggcgucaaccaggucguccccaagaagcgcuggcagcgccucaaccagcgccgcaccaagccccgcaagcgcaugaaccgcuucaaggagaaggagaacuccgagugcgccuuccgcguccuccuccccuccgaccccguccaggagggccgcgacgaguuccccgagcaccgcacccccuccgccuccauccucgaggagccccucaccgagcagaaccacgccgacugccucgacuccgccggcccccgccucaacgucugcgacaaguccuccgccuccaucggcgacauggagaaggagcccggcauccccucccucaccccccaggccgagcuccccgagcccgccguccgcuccgagaagaagcgccuccgcaagcccuccaaguggcuccucgaguacaccgaggaguacgaccagaucuucgcccccaagaagaagcagaagaagguccaggagcagguccacaaggucuccucccgcugcgaggaggagucccuccucgcccgcggccgcuccuccgcccagaacaagcaggucgacgagaacucccucaucuccaccaaggaggagccccccguccucgagcgcgaggcccccuuccucgagggcccccucgcccaguccgagcucggcggcggccacgccgagcucccccagcucacccucuccguccccgucgcccccgaggucuccccccgccccgcccucgaguccgaggagcuccucgucaagacccccggcaacuacgaguccaagcgccagcgcaagcccaccaagaagcuccucgaguccaacgaccucgaccccggcuucaugcccaagaagggcgaccucggccucuccaagaagugcuacgaggccggccaccucgagaacggcaucaccgaguccugcgccaccuccuacuccaaggacuucggcggcggcaccaccaagaucuucgacaagccccgcaagcgcaagcgccagcgccacgccgccgccaagaugcagugcaagaaggucaagaacgacgacuccuccaaggagauccccggcuccgagggcgagcucaugccccaccgcaccgccaccucccccaaggagaccgucgaggagggcgucgagcacgaccccggcaugcccgccuccaagaagaugcagggcgagcgcggcggcggcgccgcccucaaggagaacgucugccagaacugcgagaagcucggcgagcuccuccucugcgaggcccagugcugcggcgccuuccaccucgagugccucggccucaccgagaugccccgcggcaaguucaucugcaacgagugccgcaccggcauccacaccugcuucgucugcaagcaguccggcgaggacgucaagcgcugccuccucccccucugcggcaaguucuaccacgaggagugcguccagaaguacccccccaccgucaugcagaacaagggcuuccgcugcucccuccacaucugcaucaccugccacgccgccaaccccgccaacgucuccgccuccaagggccgccucaugcgcugcguccgcugccccgucgccuaccacgccaacgacuucugccucgccgccggcuccaagauccucgccuccaacuccaucaucugccccaaccacuucaccccccgccgcggcugccgcaaccacgagcacgucaacgucuccuggugcuucgucugcuccgagggcggcucccuccucugcugcgacuccugccccgccgccuuccaccgcgagugccucaacaucgacauccccgagggcaacugguacugcaacgacugcaaggccggcaagaagccccacuaccgcgagaucgucugggucaaggucggccgcuaccgcugguggcccgccgagaucugccacccccgcgccguccccuccaacaucgacaagaugcgccacgacgucggcgaguuccccguccucuucuucggcuccaacgacuaccucuggacccaccaggcccgcgucuuccccuacauggagggcgacgucuccuccaaggacaagaugggcaagggcgucgacggcaccuacaagaaggcccuccaggaggccgccgcccgcuucgaggagcucaaggcccagaaggagcuccgccagcuccaggaggaccgcaagaacgacaagaagcccccccccuacaagcacaucaaggucaaccgccccaucggccgcguccagaucuucaccgccgaccucuccgagaucccccgcugcaacugcaaggccaccgacgagaaccccugcggcaucgacuccgagugcaucaaccgcaugcuccucuacgagugccaccccaccgucugccccgccggcggccgcugccagaaccagugcuucuccaagcgccaguaccccgaggucgagaucuuccgcacccuccagcgcggcuggggccuccgcaccaagaccgacaucaagaagggcgaguucgucaacgaguacgucggcgagcucaucgacgaggaggagugccgcgcccgcauccgcuacgcccaggagcacgacaucaccaacuucuacaugcucacccucgacaaggaccgcaucaucgacgccggccccaagggcaacuacgcccgcuucaugaaccacugcugccagcccaacugcgagacccagaagugguccgucaacggcgacacccgcgucggccucuucgcccucuccgacaucaaggccggcaccgagcucaccuucaacuacaaccucgagugccucggcaacggcaagaccgucugcaagugcggcgcccccaacugcuccggcuuccucggcguccgccccaagaaccagcccaucgccaccgaggagaaguccaagaaguucaagaagaagcagcagggcaagcgccgcacccagggcgagaucaccaaggagcgcgaggacgagugcuucuccugcggcgacgccggccagcucgucuccugcaagaagcccggcugccccaaggucuaccacgccgacugccucaaccucaccaagcgccccgccggcaagugggagugccccuggcaccagugcgacaucugcggcaaggaggccgccuccuucugcgagaugugccccuccuccuucugcaagcagcaccgcgagggcaugcucuucaucuccaagcucgacggccgccucuccugcaccgagcacgaccccugcggccccaacccccucgagcccggcgagauccgcgaguacguccccccccccgucccccucccccccggccccuccacccaccucgccgagcaguccaccggcauggccgcccaggcccccaagauguccgacaagccccccgccgacaccaaccagaugcucucccucuccaagaaggcccucgccggcaccugccagcgcccccuccuccccgagcgcccccucgagcgcaccgacucccgcccccagccccucgacaagguccgcgaccucgccggcuccggcaccaagucccagucccucgucuccucccagcgcccccucgaccgcccccccgccgucgccggcccccgcccccagcucuccgacaagcccucccccgucaccucccccuccuccucccccuccguccgcucccagccccucgagcgcccccucggcaccgccgacccccgccucgacaaguccaucggcgccgccuccccccgcccccagucccucgagaagaccuccguccccaccggccuccgccuccccccccccgaccgccuccucaucaccuccucccccaagccccagaccuccgaccgccccaccgacaagccccacgccucccucucccagcgccuccccccccccgagaagguccucuccgccgucguccagacccucgucgccaaggagaaggcccuccgccccgucgaccagaacacccaguccaagaaccgcgccgcccucgucauggaccucaucgaccucaccccccgccagaaggagcgcgccgccuccccccaccaggucaccccccaggccgacgagaagaugcccguccucgaguccuccuccuggcccgccuccaagggccucggccacaugccccgcgccgucgagaagggcugcgucuccgacccccuccagaccuccggcaaggccgccgcccccuccgaggaccccuggcaggccgucaagucccucacccaggcccgccuccucucccagccccccgccaaggccuuccucuacgagcccaccacccaggccuccggccgcgccuccgccggcgccgagcagacccccggcccccucucccagucccccggccucgucaagcaggccaagcagauggucggcggccagcagcuccccgcccucgccgccaaguccggccaguccuuccgcucccucggcaaggcccccgccucccuccccaccgaggagaagaagcucgucaccaccgagcagucccccugggcccucggcaaggccuccucccgcgccggccucuggcccaucgucgccggccagacccucgcccaguccugcugguccgccggcuccacccagacccucgcccagaccugcuggucccucggccgcggccaggaccccaagcccgagcagaacacccuccccgcccucaaccaggcccccuccucccacaagugcgccgaguccgagcagaaguga

SEQ ID NO: 46874 - RNA, 1122 nt, Artificial Sequence
  derived and/or modified sequence opt2 from NSDHL__Homo_sapiens__XP_011529480
auggagcccgccgucuccgagcccaugcgcgaccaggucgcccgcacccaccucaccgaggacacccccaaggucaacgccgacaucgagaaggucaaccagaaccaggccaagcgcugcaccgucaucggcggcuccggcuuccucggccagcacauggucgagcagcuccucgcccgcggcuacgccgucaacgucuucgacauccagcagggcuucgacaacccccagguccgcuucuuccucggcgaccucugcucccgccaggaccucuaccccgcccucaagggcgucaacaccgucuuccacugcgccucccccccccccuccuccaacaacaaggagcucuucuaccgcgucaacuacaucggcaccaagaacgucaucgagaccugcaaggaggccggcguccagaagcucauccucaccuccuccgccuccgucaucuucgagggcgucgacaucaagaacggcaccgaggaccuccccuacgccaugaagcccaucgacuacuacaccgagaccaagauccuccaggagcgcgccguccucggcgccaacgaccccgagaagaacuuccucaccaccgccauccgcccccacggcaucuucggcccccgcgacccccagcucguccccauccucaucgaggccgcccgcaacggcaagaugaaguucgucaucggcaacggcaagaaccucgucgacuucaccuucgucgagaacgucguccacggccacauccucgccgccgagcagcucucccgcgacuccacccucggcggcaaggccuuccacaucaccaacgacgagcccauccccuucuggaccuuccucucccgcauccucaccggccucaacuacgaggcccccaaguaccacauccccuacugggucgccuacuaccucgcccuccuccucucccuccucgucauggucaucucccccgucauccagcuccagcccaccuucacccccaugcgcgucgcccucgccggcaccuuccacuacuacuccugcgagcgcgccaagaaggccaugggcuaccagccccucgucaccauggacgacgccauggagcgcaccguccaguccuuccgccaccuccgccgcgucaaguga

SEQ ID NO: 46875 - RNA, 2235 nt, Artificial Sequence
  derived and/or modified sequence opt2 from NSF__Homo_sapiens__NP_006169
auggccggccgcuccaugcaggccgcccgcugccccaccgacgagcucucccucaccaacugcgccgucgucaacgagaaggacuuccaguccggccagcacgucaucguccgcaccucccccaaccaccgcuacaccuucacccucaagacccaccccuccgucguccccggcuccaucgccuucucccucccccagcgcaagugggccggccucuccaucggccaggagaucgaggucucccucuacaccuucgacaaggccaagcagugcaucggcaccaugaccaucgagaucgacuuccuccagaagaaguccaucgacuccaaccccuacgacaccgacaagauggccgccgaguucauccagcaguucaacaaccaggccuucuccgucggccagcagcucgucuucuccuucaacgagaagcucuucggccuccucgucaaggacaucgaggccauggaccccuccauccucaagggcgagcccgccaccggcaagcgccagaagaucgaggucggccucgucgucggcaacucccaggucgccuucgagaaggccgagaacuccucccucaaccucaucggcaaggccaagaccaaggagaaccgccaguccaucaucaaccccgacuggaacuucgagaagaugggcaucggcggccucgacaaggaguucuccgacaucuuccgccgcgccuucgccucccgcgucuucccccccgagaucgucgagcagaugggcugcaagcacgucaagggcauccuccucuacggcccccccggcugcggcaagacccuccucgcccgccagaucggcaagaugcucaacgcccgcgagcccaaggucgucaacggccccgagauccucaacaaguacgucggcgaguccgaggccaacauccgcaagcucuucgccgacgccgaggaggagcagcgccgccucggcgccaacuccggccuccacaucaucaucuucgacgagaucgacgccaucugcaagcagcgcggcuccauggccggcuccaccggcguccacgacaccgucgucaaccagcuccucuccaagaucgacggcgucgagcagcucaacaacauccucgucaucggcaugaccaaccgccccgaccucaucgacgaggcccuccuccgccccggccgccucgaggucaagauggagaucggccuccccgacgagaagggccgccuccagauccuccacauccacaccgcccgcaugcgcggccaccagcuccucuccgccgacgucgacaucaaggagcucgccgucgagaccaagaacuucuccggcgccgagcucgagggccucguccgcgccgcccaguccaccgccaugaaccgccacaucaaggccuccaccaaggucgaggucgacauggagaaggccgagucccuccaggucacccgcggcgacuuccucgccucccucgagaacgacaucaagcccgccuucggcaccaaccaggaggacuacgccuccuacaucaugaacggcaucaucaaguggggcgaccccgucacccgcguccucgacgacggcgagcuccucguccagcagaccaagaacuccgaccgcaccccccucgucuccguccuccucgagggccccccccacuccggcaagaccgcccucgccgccaagaucgccgaggaguccaacuuccccuucaucaagaucugcucccccgacaagaugaucggcuucuccgagaccgccaagugccaggccaugaagaagaucuucgacgacgccuacaagucccagcucuccugcgucgucgucgacgacaucgagcgccuccucgacuacguccccaucggcccccgcuucuccaaccucguccuccaggcccuccucguccuccucaagaaggcccccccccagggccgcaagcuccucaucaucggcaccaccucccgcaaggacguccuccaggagauggagaugcucaacgccuucuccaccaccauccacguccccaacaucgccaccggcgagcagcuccucgaggcccucgagcuccucggcaacuucaaggacaaggagcgcaccaccaucgcccagcaggucaagggcaagaaggucuggaucggcaucaagaagcuccucaugcucaucgagaugucccuccagauggaccccgaguaccgcguccgcaaguuccucgcccuccuccgcgaggagggcgccuccccccucgacuucgacuga

SEQ ID NO: 46876 - RNA, 1119 nt, Artificial Sequence
  derived and/or modified sequence opt2 from NSFL1C__Homo_sapiens__NP_001193665
auggccgccgagcgccaggaggcccuccgcgaguucgucgccgucaccggcgccgaggaggaccgcgcccgcuucuuccucgaguccgccggcugggaccuccagaucgcccucgccuccuucuacgaggacggcggcgacgaggacaucgucaccaucucccaggccacccccuccuccgucucccgcggcaccgcccccuccgacaaccgcgucaccuccuuccgcgaccucauccacgaccaggacgaggacgaggaggaggaggagggccagcgcucccgcuucuacgccggcggcuccgagcgcuccggccagcagaucgucggccccccccgcaagaagucccccaacgagcucgucgacgaccucuucaagggcgccaaggagcacggcgccgucgccgucgagcgcgucaccaagucccccggcgagaccuccaagccccgccccuucgccggcggcggcuaccgccucggcgccgcccccgaggaggaguccgccuacgucgccggcgagaagcgccagcacuccucccaggacguccacgucguccucaagcucuggaaguccggcuucucccucgacaacggcgagcuccgcuccuaccaggaccccuccaacgcccaguuccucgaguccauccgccgcggcgagguccccgccgagcuccgccgccucgcccacggcggccaggucaaccucgacauggaggaccaccgcgacgaggacuucgucaagcccaagggcgccuucaaggccuucaccggcgagggccagaagcucggcuccaccgccccccagguccucuccaccuccucccccgcccagcaggccgagaacgaggccaaggccuccuccuccauccucaucgacgaguccgagcccaccaccaacauccagauccgccucgccgacggcggccgccucguccagaaguucaaccacucccaccgcaucuccgacauccgccucuucaucgucgacgcccgccccgccauggccgccaccuccuucauccucaugaccaccuuccccaacaaggagcucgccgacgagucccagacccucaaggaggccaaccuccucaacgccgucaucguccagcgccucaccuga

SEQ ID NO: 46877 - RNA, 558 nt, Artificial Sequence
  derived and/or modified sequence opt2 from NSG1__Homo_sapiens__NP_001274692
auggucaagcucggcaacaacuucgccgagaagggcaccaagcagccccuccucgaggacggcuucgacaccaucccccucaugaccccccucgacgucaaccagcuccaguuccccccccccgacaaggucgucgucaagaccaagaccgaguacgagcccgaccgcaagaagggcaaggcccgccccccccagaucgccgaguucaccgucuccaucaccgagggcgucaccgagcgcuucaaggucuccguccucguccucuucgcccucgccuuccucaccugcgucgucuuccucgucgucuacaaggucuacaaguacgaccgcgccugccccgacggcuucguccucaagaacacccagugcauccccgagggccucgaguccuacuacgccgagcaggacuccuccgcccgcgagaaguucuacaccgucaucaaccacuacaaccucgccaagcaguccaucacccgcuccgucucccccuggauguccguccucuccgaggagaagcucuccgagcaggagaccgaggccgccgagaaguccgccuga

SEQ ID NO: 46878 - RNA, 2847 nt, Artificial Sequence
  derived and/or modified sequence opt2 from NSMAF__Homo_sapiens__NP_001138244
augaccggccaggcccgcuuccaccgcggcgccgaggccugccgcgccauccgccagugccgcucccgccgcccccgcgccgcccaccccgagggccgcgccggcuccggccgcggcucccgccacgccucccccggcguccgccgcggcggcuucucccuccuccuccucaaccucgaggaguacuacuucgagcagcaccgcgccaaccacauccuccacaagggcucccaccacgagcgcaagauccgcggcucccucaagaucugcuccaaguccgucaucuucgagcccgacuccaucucccagcccaucaucaagaucccccuccgcgacugcaucaagaucggcaagcacggcgagaacggcgccaaccgccacuucaccaaggccaaguccggcggcaucucccucaucuucucccaggucuacuucaucaaggagcacaacgucgucgcccccuacaagaucgagcgcggcaagauggaguacgucuucgagcucgacguccccggcaaggucgaggacgucgucgagacccuccuccagcuccaccgcgccuccugccucgacaagcucggcgaccagaccgccaugaucaccgccauccuccagucccgccucgcccgcaccuccuucgacaagaaccgcuuccagaacaucuccgagaagcuccacauggagugcaaggccgagauggucaccccccucgucaccaaccccggccacgucugcaucaccgacaccaaccucuacuuccagccccucaacggcuaccccaagcccgucguccagaucacccuccaggacguccgccgcaucuacaagcgccgccacggccucaugccccucggccucgaggucuucugcaccgaggacgaccucugcuccgacaucuaccucaaguucuacgagccccaggaccgcgacgaccucuacuucuacaucgccaccuaccucgagcaccacgucgccgagcacaccgccgaguccuacaugcuccaguggcagcgcggccaccucuccaacuaccaguaccuccuccaccucaacaaccucgccgaccgcuccugcaacgaccucucccaguaccccgucuuccccuggaucauccacgacuacuccuccuccgagcucgaccucuccaaccccggcaccuuccgcgaccucuccaagcccgucggcgcccucaacaaggagcgccucgagcgccuccucacccgcuaccaggagaugcccgagcccaaguucauguacggcucccacuacuccucccccggcuacguccucuucuaccucguccgcaucgcccccgaguacaugcucugccuccagaacggccgcuucgacaacgccgaccgcauguucaacuccaucgccgagaccuggaagaacugccucgacggcgccaccgacuucaaggagcucauccccgaguucuacggcgacgacgucuccuuccucgucaacucccucaagcucgaccucggcaagcgccagggcggccagauggucgacgacgucgagcucccccccugggccuccucccccgaggacuuccuccagaaguccaaggacgcccucgaguccaacuacgucuccgagcaccuccacgaguggaucgaccucaucuucggcuacaagcagaagggcuccgacgccgucggcgcccacaacgucuuccacccccucaccuacgagggcggcgucgaccucaacuccauccaggaccccgacgagaaggucgccaugcucacccagauccucgaguucggccagacccccaagcagcucuucgucaccccccacccccgccgcaucacccccaaguucaagucccucucccagaccuccuccuacaacgccuccauggccgacucccccggcgaggaguccuucgaggaccucaccgaggaguccaagacccucgccuggaacaacaucaccaagcuccagcuccacgagcacuacaagauccacaaggaggccgucaccggcaucaccgucucccgcaacggcuccuccgucuucaccaccucccaggacuccacccucaagauguucuccaaggaguccaagaugcuccagcgcuccaucuccuucuccaacauggcccucuccuccugccuccuccuccccggcgacgccaccgucaucaccuccuccugggacaacaacgucuacuucuacuccaucgccuucggccgccgccaggacacccucaugggccacgacgacgccgucuccaagaucugcuggcacgacaaccgccucuacuccgccuccugggacuccaccgucaaggucugguccggcguccccgccgagaugcccggcaccaagcgccaccacuucgaccuccucgccgagcucgagcacgacgucuccgucgacaccaucucccucaacgccgccuccacccuccucgucuccggcaccaaggagggcaccgucaacaucugggaccucaccaccgccacccucaugcaccagauccccugccacuccggcaucgucugcgacaccgccuucucccccgacucccgccacguccucuccaccggcaccgacggcugccucaacgucaucgacguccagaccggcaugcucaucuccuccaugaccuccgacgagccccagcgcugcuucgucugggacggcaacuccguccucuccggcucccaguccggcgagcuccucgucugggaccuccucggcgccaagaucuccgagcgcauccagggccacaccggcgccgucaccugcaucuggaugaacgagcagugcuccuccaucaucaccggcggcgaggaccgccagaucaucuucuggaagcuccaguacuga

SEQ ID NO: 46879 - RNA, 744 nt, Artificial Sequence
  derived and/or modified sequence opt2 from NSMCE2__Homo_sapiens__NP_775956
augcccggccgcuccuccuccaacuccggcuccaccggcuucaucuccuucuccggcgucgaguccgcccucuccucccucaagaacuuccaggccugcaucaacuccggcauggacaccgccuccuccgucgcccucgaccucgucgagucccagaccgaggucuccuccgaguacuccauggacaaggccauggucgaguucgccacccucgaccgccagcucaaccacuacgucaaggccguccaguccaccaucaaccacgucaaggaggagcgccccgagaagauccccgaccucaagcuccucgucgagaagaaguuccucgcccuccaguccaagaacuccgacgccgacuuccagaacaacgagaaguucguccaguucaagcagcagcucaaggagcucaagaagcagugcggccuccaggccgaccgcgaggccgacggcaccgagggcgucgacgaggacaucaucgucacccagucccagaccaacuucaccugccccaucaccaaggaggagaugaagaagcccgucaagaacaaggucugcggccacaccuacgaggaggacgccaucguccgcaugaucgagucccgccagaagcgcaagaagaaggccuacugcccccagaucggcugcucccacaccgacauccgcaaguccgaccucauccaggacgaggcccuccgccgcgccaucgagaaccacaacaagaagcgccaccgccacuccgaguga

SEQ ID NO: 46880 - RNA, 1593 nt, Artificial Sequence
  derived and/or modified sequence opt2 from NSMF__Homo_sapiens__NP_001124441
augggcgccgccgccucccgccgccgcgcccuccgcuccgaggccauguccuccgucgccgccaagguccgcgccgcccgcgccuucggcgaguaccucucccagucccaccccgagaaccgcaacggcgccgaccaccuccucgccgacgccuacuccggccacgacggcucccccgagaugcagcccgccccccagaacaagcgccgccucucccucgucuccaacggcugcuacgagggcucccucuccgaggagcccuccauccgcaagcccgccggcgagggcccccagccccgcgucuacaccaucuccggcgagcccgcccuccuccccucccccgaggccgaggccaucgagcucgccgucgucaagggccgccgccagcgccacccccaccaccacucccagccccuccgcgccucccccggcggcucccgcgaggacgucucccgccccugccaguccugggccggcucccgccagggcuccaaggagugccccggcugcgcccagcucgcccccggccccaccccccgcgccuucggccucgaccagcccccccuccccgagaccuccggccgccgcaagaagcucgagcgcauguacuccgucgaccgcgucuccgacgacauccccauccgcaccugguuccccaaggagaaccucuucuccuuccagaccgccaccaccaccaugcaggccaucuccgucuuccgcggcuacgccgagcgcaagcgccgcaagcgcgagaacgacuccgccuccgucauccagcgcaacuuccgcaagcaccuccgcauggucggcucccgccgcgucaaggcccagaccuucgccgagcgccgcgagcgcuccuucucccgcuccugguccgaccccacccccaugaaggccgacaccucccacgacucccgcgacuccuccgaccuccaguccucccacugcacccucgacgaggccuucgaggaccucgacugggacaccgagaagggccucgaggccgucgccugcgacaccgagggcuucgucccccccaaggucaugcucaucuccuccaagguccccaaggccgaguacauccccaccaucauccgccgcgacgaccccuccaucauccccauccucuacgaccacgagcacgccaccuucgaggacauccucgaggagaucgagcgcaagcucaacgucuaccacaagggcgccaagaucuggaagaugcucaucuucugccagggcggccccggccaccucuaccuccucaagaacaaggucgccaccuucgccaaggucgagaaggaggaggacaugauccacuucuggaagcgccucucccgccucauguccaaggucaaccccgagcccaacgucauccacaucaugggcugcuacauccucggcaaccccaacggcgagaagcucuuccagaaccuccgcacccucaugacccccuaccgcgucaccuucgaguccccccucgagcucuccgcccagggcaagcagaugaucgagaccuacuucgacuuccgccucuaccgccucuggaagucccgccagcacuccaagcuccucgacuucgacgacguccucuga

SEQ ID NO: 46881 - RNA, 1515 nt, Artificial Sequence
  derived and/or modified sequence opt2 from NSRP1__Homo_sapiens__NP_001248396
augaagcagaccaagcucgagauccagaaggcccucgccgaggacgccaccgucuacgaguacgacuccaucuacgacgagaugcagaagaagaaggaggagaacaaccccaagcuccuccucggcaaggaccgcaagcccaaguacauccacaaccuccucaaggccgucgagauccgcaagaaggagcaggagaagcgcauggagaagaagauccagcgcgagcgcgagauggagaagggcgaguucgacgacaaggaggccuucgucaccuccgccuacaagaagaagcuccaggagcgcgccgaggaggaggagcgcgagaagcgcgccgccgcccucgaggccugccucgacgucaccaagcagaaggaccucuccggcuucuaccgccaccuccucaaccaggccgucggcgaggaggagguccccaagugcuccuuccgcgaggcccgcuccggcaucaaggaggagaagucccgcggcuucuccaacgaggucuccuccaagaaccgcaucccccaggagaagugcauccuccagaccgacgucaaggucgaggagaaccccgacgccgacuccgacuucgacgccaaguccuccgccgacgacgagaucgaggagacccgcgucaacugccgccgcgagaaggucaucgagacccccgagaacgacuucaagcaccaccgcucccagaaccacucccgcucccccuccgaggagcgcggccacuccacccgccaccacaccaagggcucccgcaccucccgcggccacgagaagcgcgaggaccagcaccagcagaagcagucccgcgaccaggagaaccacuacaccgaccgcgacuaccgcaaggagcgcgacucccaccgccaccgcgaggccucccaccgcgacucccacuggaagcgccacgagcaggaggacaagccccgcgcccgcgaccagcgcgagcgcuccgaccgcgucuggaagcgcgagaaggaccgcgagaaguacucccagcgcgagcaggagcgcgaccgccagcagaacgaccagaaccgccccuccgagaagggcgagaaggaggagaaguccaaggccaaggaggagcacaugaagguccgcaaggagcgcuacgagaacaacgacaaguaccgcgaccgcgagaagcgcgaggucggcguccaguccuccgagcgcaaccaggaccgcaaggaguccucccccaacucccgcgccaaggacaaguuccucgaccaggagcgcuccaacaagaugcgcaacauggccaaggacaaggagcgcaaccaggagaagcccuccaacuccgaguccucccucggcgccaagcaccgccucaccgaggagggccaggagaagggcaaggagcaggagcgcccccccgaggccgucuccaaguucgccaagcgcaacaacgaggagaccgucauguccgcccgcgaccgcuaccucgcccgccagauggcccgcgucaacgccaagaccuacaucgagaaggaggacgacuga

SEQ ID NO: 46882 - RNA, 2199 nt, Artificial Sequence
  derived and/or modified sequence opt2 from NSUN2__Homo_sapiens__NP_001180384
augggccgccgcucccgcggccgccgccuccagcagcagcagcgccccgaggacgccgaggacggcgccgagggcggcggcaagcgcggcgaggccggcugggagggcggcuaccccgagaucgucaaggagaacaagcucuucgagcacuacuaccaggagcucaagaucguccccgagggcgaguggggccaguucauggacgcccuccgcgagccccuccccgccacccuccgcaucaccggcuacaagcgcuaccccgaggagcucgccuggcacaccaaccucucccgcaagauccuccgcaaguccccccaccucgagaaguuccaccaguuccucgucuccgagaccgaguccggcaacaucucccgccaggaggccgucuccaugauccccccccuccuccucaacguccgcccccaccacaagauccucgacaugugcgccgcccccggcuccaagaccacccagcucaucgagaugcuccacgccgacaugaacguccccuuccccgagggcuucgucaucgccaacgacgucgacaacaagcgcugcuaccuccucguccaccaggccaagcgccucuccucccccugcaucauggucgucaaccacgacgccuccuccaucccccgccuccagaucgacgucgacggccgcaaggagauccucuucuacgaccgcauccucugcgacguccccugcuccggcgacggcaccaugcgcaagaacaucgacgucuggaagaaguggaccacccucaacucccuccagcuccacggccuccagcuccgcaucgccacccgcggcgccgagcagcucgccgagggcggccgcauggucuacuccaccugcucccucaaccccaucgaggacgaggccgucaucgccucccuccucgagaaguccgagggcgcccucgagcucgccgacgucuccaacgagcuccccggccucaaguggaugcccggcaucacccaguggaaggucaugaccaaggacggccagugguucaccgacugggacgccgucccccacucccgccacacccagauccgccccaccauguucccccccaaggaccccgagaagcuccaggccaugcaccucgagcgcugccuccgcauccucccccaccaccagaacaccggcggcuucuucgucgccguccucgucaagaaguccuccaugcccuggaacaagcgccagcccaagcuccagggcaaguccgccgagacccgcgaguccacccagcucucccccgccgaccucaccgagggcaagcccaccgaccccuccaagcucgagucccccuccuucaccggcaccggcgacaccgagaucgcccacgccaccgaggaccucgagaacaacggcuccaagaaggacggcgucugcggccccccccccuccaagaagaugaagcucuucggcuucaaggaggaccccuucgucuucauccccgaggacgacccccucuucccccccaucgagaaguucuacgcccucgaccccuccuucccccgcaugaaccuccucacccgcaccaccgagggcaagaagcgccagcucuacauggucuccaaggagcuccgcaacguccuccucaacaacuccgagaagaugaaggucaucaacaccggcaucaaggucuggugccgcaacaacuccggcgaggaguucgacugcgccuuccgccucgcccaggagggcaucuacacccucuaccccuucaucaacucccgcaucaucaccgucuccauggaggacgucaagauccuccucacccaggagaaccccuucuuccgcaagcucuccuccgagaccuacucccaggccaaggaccucgccaagggcuccaucguccucaaguacgagcccgacuccgccaaccccgacgcccuccagugccccaucguccucugcggcuggcgcggcaaggccuccauccgcaccuucguccccaagaacgagcgccuccacuaccuccgcaugaugggccucgagguccucggcgagaagaagaaggagggcgucauccucaccaacgaguccgccgccuccaccggccagcccgacaacgacgucaccgagggccagcgcgccggcgagcccaacucccccgacgccgaggaggccaacucccccgacgucaccgccggcugcgaccccgccggcguccaccccccccgcuga

SEQ ID NO: 46883 - RNA, 1023 nt, Artificial Sequence
  derived and/or modified sequence opt2 from NSUN3__Homo_sapiens__NP_071355
augcucacccagcucaaggccaaguccgagggcaagcucgccaagcagaucugcaaggucguccucgaccacuucgagaagcaguacuccaaggagcucggcgacgccuggaacaccguccgcgagauccucaccucccccuccugcuggcaguacgccguccuccucaaccgcuucaacuaccccuucgagcucgagaaggaccuccaccucaagggcuaccacacccucucccagggcucccuccccaacuaccccaaguccgucaagugcuaccucucccgcacccccggccgcauccccuccgagcgccaccagaucggcaaccucaagaaguacuaccuccucaacgccgccucccuccuccccguccucgcccucgagcuccgcgacggcgagaagguccucgaccucugcgccgcccccggcggcaaguccaucgcccuccuccagugcgccugccccggcuaccuccacugcaacgaguacgacucccuccgccuccgcuggcuccgccagacccucgaguccuucaucccccagccccucaucaacgucaucaaggucuccgagcucgacggccgcaagaugggcgacgcccagcccgagauguucgacaagguccucgucgacgcccccugcuccaacgaccgcuccuggcucuucuccuccgacucccagaaggccuccugccgcaucucccagcgccgcaaccucccccuccuccagaucgagcuccuccgcuccgccaucaaggcccuccgccccggcggcauccucgucuacuccaccugcacccucuccaaggccgagaaccaggacgucaucuccgagauccucaacucccacggcaacaucaugcccauggacaucaagggcaucgcccgcaccugcucccacgacuucaccuucgcccccaccggccaggagugcggccuccucgucauccccgacaagggcaaggccuggggccccauguacgucgccaagcucaagaaguccugguccaccggcaagugguga

SEQ ID NO: 46884 - RNA, 1413 nt, Artificial Sequence
  derived and/or modified sequence opt2 from NSUN5__Homo_sapiens__NP_001161819
augggccucuacgccgccgccgccggcguccucgccggcgucgagucccgccagggcuccaucaagggccucgucuacuccuccaacuuccagaacgucaagcagcucuacgcccucgucugcgagacccagcgcuacuccgccguccucgacgccgucaucgccuccgccggccuccuccgcgccgagaagaagcuccgcccccaccucgccaagguccucgucuacgagcuccuccucggcaagggcuuccgcggcggcggcggccgcuggaaggcccuccucggccgccaccaggcccgccucaaggccgagcucgcccgccucaagguccaccgcggcgucucccgcaacgaggaccuccucgaggucggcucccgccccggccccgccucccagcucccccgcuucguccgcgucaacacccucaagaccugcuccgacgacgucgucgacuacuucaagcgccagggcuucuccuaccagggccgcgccuccucccucgacgaccuccgcgcccucaagggcaagcacuuccuccucgacccccucaugcccgagcuccucgucuuccccgcccagaccgaccuccacgagcacccccucuaccgcgccggccaccucauccuccaggaccgcgccuccugccuccccgccaugcuccucgaccccccccccggcucccacgucaucgacgccugcgccgcccccggcaacaagaccucccaccucgccgcccuccucaagaaccagggcaagaucuucgccuucgaccucgacgccaagcgccucgccuccauggccacccuccucgcccgcgccggcgucuccugcugcgagcucgccgaggaggacuuccucgccgucucccccuccgacccccgcuaccacgagguccacuacauccuccucgaccccuccugcuccggcuccggcaugcccucccgccagcucgaggagcccggcgccggcacccccucccccguccgccuccacgcccucgccggcuuccagcagcgcgcccucugccacgcccucaccuuccccucccuccagcgccucgucuacuccaccugcucccucugccaggaggagaacgaggacgucguccgcgacgcccuccagcagaaccccggcgccuuccgccucgcccccgcccuccccgccuggccccaccgcggccucuccaccuuccccggcgccgagcacugccuccgcgccucccccgagaccacccucuccuccggcuucuucgucgccgucaucgagcgcgucgagguccccucccucaccggccaguccaucuccacccgcacccacacccagcccucccccaaggagaaggaggagaccgccaagucccgcucccgcugccuccacaccgcccuccacaucgccgaggcccccggcuga

SEQ ID NO: 46885 - RNA, 2157 nt, Artificial Sequence
  derived and/or modified sequence opt2 from NSUN7__Homo_sapiens__NP_078953
augcucaacuccaccggcgagcucgaguucuccaacgaggaggaccccgagaucaucucccagcucaccucccucccccucuccggcggcaaguccuccgccggcguccccgagaagaccggcuaccccgacuccgucuacgucauggccgccaacaucuuccagggcauccgcaucgagaaguccgcccagaagguccucaucaaguacggcaacgagccccuccgcucccucuccgaguccgaggaccaguccuuccagcgccucuccuacgagcucgccuucuccgcccucaaguaccaggacauccucgagaccauccucaucgacuccugcaucuuccccuccaccaccauccccgaccaccucuccucccucaucaucgucaugcucuacgacuuccaggaccgcaaguuccagacccgcguccucuccgacaacgaggagcccaucuccgagguccaggaggucgagaaccuccucaacuccuucaagaucaagcucgccgccgcccucgcccgcugccgcaucaagcacgacgcccucuccaucuaccacauccuccccgagaccguccgcaagcaggagcuccgcgccuccacccucccccucuacgccuggaucaacaccugcaagaucucccccgaggaggucuacaacaaccucaagcgccgcggcuacaacaaggucaaguccguccuccacaucgacgacaaggucuucgccgucgaccagcacugcuacgacguccucaucuuccccucccaccucaagaacgaccucaucaacaucgaccucuucaaggacuacaagcucaucuuccaggacaagucccgcucccucgccguccacuccgucaaggcccuccucaacauggacgacgacguccucauggucaacaccggcuccugguacaccgucucccacauguccauccucaccaacaacaacaccuccaaggucuucgucugcggcguccagucccaggccaaggaccccgaccucaagacccucuucaccaagaucggcugcaagaacaucgagauccuccacgagaaguucaucaacaucgaguccaaggaccaccgccuccagaaggucaaggucauccuccuccucccccgcugcuccggccucggcgucuccaaccccgucgaguucauccucaacgagcacgaggacaccgaguuccucaaggaccacucccagggcggcaucuccgucgacaagcuccacguccucgcccagcagcaguacgagcagcucacccacgccaugaaguucaccaaggcccaggccgucgucuacugcaccugcuccgucuuccccgaggagaacgaggccgucgucaagaaggcccucgaguuccaggaccucggcaacaagggccagcccuaccgccucuccccccccguccucccccucugcucccucaaggagauccagcucuccaccgacaaguucuuccgcauggagcccuccgagaucaccaacggcugcuuccucuccauccucacccgcgagcgcgaccccuccgagaccgucuccgucaacgacguccucgcccgcgccgccgccaagggccuccucgacggcaucgagcucggcaaguccuccaagcgcgagaagaagaagaagaaguccaagaccucccucaccaagggcgccaccaccgacaacggcauccagaugaagaucgccgaguuccucaaccgcgagaccaaggccuccgccaaccucuccgagaccgucaccaagcccccccucccccagaagaacaccgcccaggucggcgccuccucccagacccgcaagcccaacaagcucgccccccaccccgccguccccgccuucgucaagaacaccugccccucccgcccccgcgagcgccagacccacuuccuccgcccccgccccgaggaccgcauggucgcccucaagcccaucgagaucguccucccccccgucuucaugcccuucuccuccccccagggcauccgcucccgcaugcccacccagcaccucuacugccgcugggucgcccccaaggcccucguccccaccugccuccccacccacucccucucccgcaaggaggagaagcccaaggacgacacccccuccucccuccuccgccccccccgccgcuggcucuga

SEQ ID NO: 46886 - RNA, 1833 nt, Artificial Sequence
  derived and/or modified sequence opt2 from NT5C1B__Homo_sapiens__NP_001002006
augucccagaccucccucaagcagaagaagaacgagcccggcaugcgcuccuccaaggagucccucgaggccgagaagcgcaaggaguccgacaagaccggcguccgccucuccaaccagaugcgccgcgccgucaaccccaaccacucccuccgcugcugccccuuccagggccacuccuccugccgccgcugccucugcgccgccgagggcaccgcccucggccccugccacaccauccgcaucuacauccacaugugccuccucugggagcagggccagcagaucaccaugaugcgcggcucccaggaguccucccuccgcaagaccgacucccgcggcuaccucguccgcucccaguggucccgcaucucccgcucccccuccaccaaggcccccuccaucgacgagccccgcucccgcaacaccuccgccaagcuccccuccuccuccaccuccucccgcacccccuccaccucccccucccuccacgacuccuccccccccccccucuccggccagcccucccuccagccccccgccuccccccagcucccccgcucccucgacucccgcccccccaccccccccgagcccgaccccggcucccgccgcuccaccaagaugcaggagaaccccgaggccugggcccagggcaucguccgcgagauccgccagacccgcgacucccagccccucgaguacucccgcaccucccccaccgaguggaaguccuccucccagcgccgcggcaucuaccccgccuccacccagcucgaccgcaacucccucuccgagcagcagcagcagcagcgcgaggacgaggacgacuacgaggccgccuacugggccuccaugcgcuccuucuacgagaagaaccccuccugcucccgccccuggccccccaagcccaagaacgccaucaccaucgcccucuccuccugcgcccucuucaacauggucgacggccgcaagaucuacgagcaggagggccucgagaaguacauggaguaccagcucaccaacgagaacgucauccucacccccggccccgccuuccgcuucgucaaggcccuccaguacgucaacgcccgccuccgcgaccucuaccccgacgagcaggaccucuucgacaucguccucaugaccaacaaccacgcccaggucggcguccgccucaucaacuccgucaaccacuacggccuccucaucgaccgcuucugccucaccggcggcaaggaccccaucggcuaccucaaggccuaccucaccaaccucuacaucgccgccgacuccgagaagguccaggaggccauccaggagggcaucgccuccgccaccauguucgacggcgccaaggacauggccuacugcgacacccagcuccgcgucgccuucgacggcgacgccguccucuucuccgacgaguccgagcacuucaccaaggagcacggccucgacaaguucuuccaguacgacacccucugcgaguccaagccccucgcccagggcccccucaagggcuuccucgaggaccucggccgccuccagaagaaguucuacgccaagaacgagcgccuccucugccccauccgcaccuaccucgucaccgcccgcuccgccgccuccuccggcgcccgcguccucaagacccuccgccgcuggggccucgagaucgacgaggcccucuuccucgccggcgcccccaagucccccauccucgucaagauccgcccccacaucuucuucgacgaccacauguuccacaucgagggcgcccagcgccucggcuccaucgccgccuacggcuucaacaagaaguucuccuccuga

SEQ ID NO: 46887 - RNA, 1953 nt, Artificial Sequence
  derived and/or modified sequence opt2 from NT5C1B-RDH14__Homo_sapiens__NP_001186032
augucccagaccucccucaagcagaagaagaacgagcccggcaugcgcuccuccaaggagucccucgaggccgagaagcgcaaggaguccgacaagaccggcguccgccucuccaaccagggcucccaggaguccucccuccgcaagaccgacucccgcggcuaccucguccgcucccaguggucccgcaucucccgcucccccuccaccaaggcccccuccaucgacgagccccgcucccgcaacaccuccgccaaggucgagcuccccuccuccuccaccuccucccgcacccccuccaccucccccucccuccacgacuccuccccccccccccucuccggccagcccucccuccagccccccgccuccccccagcucccccgcucccucgacucccgcccccccaccccccccgagcccgaccccggcucccgccgcuccaccaagaugcaggagaaccccgaggccugggcccagggcaucguccgcgagauccgccagacccgcgacucccagccccucgaguacucccgcaccucccccaccgaguggaaguccuccucccagcgccgcggcaucuaccccgccuccacccagcucgaccgcaacucccucuccgagcagcagcagcagcagcgcgaggacgaggacgacuacgaggccgccuacugggccuccaugcgcuccuucuacgagaagaaccccuccugcucccgccccuggccccccaagcccaagaacgccaucaccaucgcccucuccuccugcgcccucuucaacauggucgacggccgcaagaucuacgagcaggagggccucgagaaguacauggaguaccagcucaccaacgagaacgucauccucacccccggccccgccuuccgcuucgucaaggcccuccaguacgucaacgcccgccuccgcgaccucuaccccgacgagcaggaccucuucgacaucguccucaugaccaacaaccacgcccaggucggcguccgccucaucaacuccgucaaccacuacggccuccucaucgaccgcuucugccucaccggcggcaaggaccccaucggcuaccucaaggccuaccucaccaaccucuacaucgccgccgacuccgagaagguccaggaggccauccaggagggcaucgccuccgccaccauguucgacggcgccaaggacauggccuacugcgacacccagcuccgcgucgccuucgacggcgacgccguccucuucuccgacgaguccgagcacuucaccaaggagcacggccucgacaaguucuuccaguacgacacccucugcgaguccaagccccucgcccaggaggagccccgccucgacguccucaucaacaacgccggcaucuuccagugccccuacaugaagaccgaggacggcuucgagaugcaguucggcgucaaccaccucggccacuuccuccucaccaaccuccuccucggccuccucaaguccuccgcccccucccgcaucgucgucgucuccuccaagcucuacaaguacggcgacaucaacuucgacgaccucaacuccgagcaguccuacaacaaguccuucugcuacucccgcuccaagcucgccaacauccucuucacccgcgagcucgcccgccgccucgagggcaccaacgucaccgucaacguccuccaccccggcaucguccgcaccaaccucggccgccacauccacaucccccuccucgucaagccccucuucaaccucgucuccugggccuucuucaagacccccgucgagggcgcccagaccuccaucuaccucgccuccucccccgaggucgagggcgucuccggccgcuacuucggcgacugcaaggaggaggagcuccuccccaaggccauggacgaguccgucgcccgcaagcucugggacaucuccgaggucauggucggccuccucaaguga

SEQ ID NO: 46888 - RNA, 1686 nt, Artificial Sequence
  derived and/or modified sequence opt2 from NT5C2__Homo_sapiens__NP_036361
auguccaccuccugguccgaccgccuccagaacgccgccgacaugcccgccaacauggacaagcacgcccucaagaaguaccgccgcgaggccuaccaccgcgucuucgucaaccgcucccucgccauggagaagaucaagugcuucggcuucgacauggacuacacccucgccgucuacaagucccccgaguacgagucccucggcuucgagcucaccgucgagcgccucgucuccaucggcuacccccaggagcuccucuccuucgccuacgacuccaccuuccccacccgcggccucgucuucgacacccucuacggcaaccuccucaaggucgacgccuacggcaaccuccucgucugcgcccacggcuucaacuucauccgcggccccgagacccgcgagcaguaccccaacaaguucauccagcgcgacgacaccgagcgcuucuacauccucaacacccucuucaaccuccccgagaccuaccuccucgccugccucgucgacuucuucaccaacugcccccgcuacaccuccugcgagaccggcuucaaggacggcgaccucuucauguccuaccgcuccauguuccaggacguccgcgacgccgucgacuggguccacuacaagggcucccucaaggagaagaccgucgagaaccucgagaaguacgucgucaaggacggcaagcucccccuccuccucucccgcaugaaggaggucggcaaggucuuccucgccaccaacuccgacuacaaguacaccgacaagaucaugaccuaccucuucgacuucccccacggccccaagcccggcuccucccaccgccccuggcaguccuacuucgaccucauccucgucgacgcccgcaagccccucuucuucggcgagggcaccguccuccgccaggucgacaccaagaccggcaagcucaagaucggcaccuacaccggcccccuccagcacggcaucgucuacuccggcggcuccuccgacaccaucugcgaccuccucggcgccaagggcaaggacauccucuacaucggcgaccacaucuucggcgacauccucaaguccaagaagcgccagggcuggcgcaccuuccucgucauccccgagcucgcccaggagcuccacgucuggaccgacaaguccucccucuucgaggagcuccagucccucgacaucuuccucgccgagcucuacaagcaccucgacuccuccuccaacgagcgccccgacaucuccuccauccagcgccgcaucaagaaggucacccacgacauggacaugugcuacggcaugaugggcucccucuuccgcuccggcucccgccagacccucuucgccucccaggucaugcgcuacgccgaccucuacgccgccuccuucaucaaccuccucuacuaccccuucuccuaccucuuccgcgccgcccacguccucaugccccacgaguccaccgucgagcacacccacgucgacaucaacgagauggaguccccccucgccacccgcaaccgcaccuccgucgacuucaaggacaccgacuacaagcgccaccagcucacccgcuccaucuccgagaucaagccccccaaccucuucccccucgccccccaggagaucacccacugccacgacgaggacgacgacgaggaggaggaggaggaggaggaguga

SEQ ID NO: 46889 - RNA, 1011 nt, Artificial Sequence
  derived and/or modified sequence opt2 from NT5C3A__Homo_sapiens__NP_001002010
augcgcgcccccuccauggaccgcgccgccgucgcccgcgucggcgccgucgccuccgccuccgucugcgcccucgucgccggcgucguccucgcccaguacaucuucacccucaagcgcaagaccggccgcaagaccaagaucaucgagaugaugcccgaguuccagaaguccuccguccgcaucaagaaccccacccgcgucgaggagaucaucugcggccucaucaagggcggcgccgccaagcuccagaucaucaccgacuucgacaugacccucucccgcuucuccuacaagggcaagcgcugccccaccugccacaacaucaucgacaacugcaagcucgucaccgacgagugccgcaagaagcuccuccagcucaaggagaaguacuacgccaucgaggucgaccccguccucaccgucgaggagaaguaccccuacauggucgagugguacaccaagucccacggccuccucguccagcaggcccuccccaaggccaagcucaaggagaucgucgccgaguccgacgucaugcucaaggagggcuacgagaacuucuucgacaagcuccagcagcacuccauccccgucuucaucuucuccgccggcaucggcgacguccucgaggaggucauccgccaggccggcgucuaccaccccaacgucaaggucgucuccaacuucauggacuucgacgagaccggcguccucaagggcuucaagggcgagcucauccacgucuucaacaagcacgacggcgcccuccgcaacaccgaguacuucaaccagcucaaggacaacuccaacaucauccuccucggcgacucccagggcgaccuccgcauggccgacggcgucgccaacgucgagcacauccucaagaucggcuaccucaacgaccgcgucgacgagcuccucgagaaguacauggacuccuacgacaucguccucguccaggacgagucccucgaggucgccaacuccauccuccagaagauccucuga

SEQ ID NO: 46890 - RNA, 486 nt, Artificial Sequence
  derived and/or modified sequence opt2 from NT5C__Homo_sapiens__NP_001239306
auggcccgcuccguccgcguccucgucgacauggacggcguccucgccgacuucgaggccggccuccuccgcggcuuccgccgccgcuuccccgaggagccccacgucccccucgagcagcgccgcggcuuccucgcccgcgagcaguaccgcgcccuccgccccgaccucgccgacaaggucgccuccgucuacgaggcccccggcuucuuccucgaccucgagcccauccccggcgcccucgacgccguccgcgagaugaacgaccuccccgacacccaggucuucaucugcaccuccccccuccucaaguaccaccacugcgucggcgagaaggaggagacccccuccugggagcacauccucuucaccugcugccacaaccgccaccucguccucccccccacccgccgccgccuccucuccugguccgacaacuggcgcgagauccucgacuccaagcgcggcgccgcccagcgcgaguga

SEQ ID NO: 46891 - RNA, 1368 nt, Artificial Sequence
  derived and/or modified sequence opt2 from NT5DC1__Homo_sapiens__NP_689942
auggcccagcacuucucccucgccgccugcgacgucgucggcuucgaccucgaccacacccucugccgcuacaaccuccccgaguccgccccccucaucuacaacuccuucgcccaguuccucgucaaggagaagggcuacgacaaggagcuccucaacgucacccccgaggacugggacuucugcugcaagggccucgcccucgaccucgaggacggcaacuuccucaagcucgccaacaacggcaccguccuccgcgccucccacggcaccaagaugaugacccccgagguccucgccgaggccuacggcaagaaggaguggaagcacuuccucuccgacaccggcauggccugccgcuccggcaaguacuacuucuacgacaacuacuucgaccuccccggcgcccuccucugcgcccgcgucgucgacuaccucaccaagcucaacaacggccagaagaccuucgacuucuggaaggacaucgucgccgccauccagcacaacuacaagauguccgccuucaaggagaacugcggcaucuacuuccccgagaucaagcgcgaccccggccgcuaccuccacuccugccccgaguccgucaagaaguggcuccgccagcucaagaacgccggcaagauccuccuccucaucaccuccucccacuccgacuacugccgccuccucugcgaguacauccucggcaacgacuucaccgaccucuucgacaucgucaucaccaacgcccucaagcccggcuucuucucccaccuccccucccagcgccccuuccgcacccucgagaacgacgaggagcaggaggcccuccccucccucgacaagcccggcugguacucccagggcaacgccguccaccucuacgagcuccucaagaagaugaccggcaagcccgagcccaaggucgucuacuucggcgacuccaugcacuccgacaucuuccccgcccgccacuacuccaacugggagaccguccucauccucgaggagcuccgcggcgacgagggcacccgcucccagcgccccgaggaguccgagccccucgagaagaagggcaaguacgagggccccaaggccaagccccucaacaccuccuccaagaaguggggcuccuucuucaucgacuccguccucggccucgagaacaccgaggacucccucgucuacaccugguccugcaagcgcaucuccaccuacuccaccaucgccauccccuccaucgaggccaucgccgagcucccccucgacuacaaguucacccgcuucuccuccuccaacuccaagaccgccggcuacuaccccaaccccccccucguccucuccuccgacgagacccucaucuccaaguga

SEQ ID NO: 46892 - RNA, 1647 nt, Artificial Sequence
  derived and/or modified sequence opt2 from NT5DC3__Homo_sapiens__NP_001026871
augaccauggccgccgccgccgucgucgcccgcggcgccggcgcccgcgccgccaccgccgccgcccuccgcggcggcugcggcaccgccgcccgcggccgccccugcgccggccccgcccgcccccucugcaccgcccccggcaccgcccccgacaugaagcgcuaccucugggagcgcuaccgcgaggccaagcgcuccaccgaggagcucguccccuccaucauguccaaccuccucaaccccgacgccaucuucuccaacaacgagaugucccucuccgacaucgagaucuacggcuucgacuacgacuacacccucgucuucuacuccaagcaccuccacacccucaucuucaacgccgcccgcgaccuccucaucaacgagcaccgcuaccccgccgagauccgcaaguacgaguacgaccccaacuucgccauccgcggccuccacuacgacguccagcgcgccguccucaugaagaucgacgccuuccacuacauccagcucggcaccgucuaccgcggccucuccgucguccccgacgaggaggucaucgagauguacgagggcucccacgucccccucgagcagauguccgacuucuacggcaaguccucccacggcaacaccaugaagcaguucauggacaucuucucccuccccgagaugacccuccucuccugcgucaacgaguacuuccucaagaacaacaucgacuacgagcccguccaccucuacaaggacgucaaggacuccauccgcgacguccacaucaagggcaucauguaccgcgccaucgaggccgacaucgagaaguacaucugcuacgccgagcagacccgcgccguccucgccaagcucgccgaccacggcaagaagauguuccucaucaccaacucccccuccuccuucgucgacaagggcauguccuacaucgucggcaaggacuggcgcgaccucuucgacgucgucaucguccaggccgagaagcccaacuucuucaacgacaagcgccgccccuuccgcaagaugaacgagaagggcguccuccucugggacaagauccacaagcuccagaagggccagaucuacaagcagggcaaccucuacgaguuccucaagcucaccggcuggcgcggcucccgcguccucuacuucggcgaccacaucuacuccgaccucgccgaccucacccucaagcacggcuggcgcaccggcgccaucauccccgagcuccgcuccgagcucaagaucaugaacaccgagcaguacauccagaccaugaccuggcuccagacccucaccggccuccucgagcagaugcagguccaccgcgacgccgagucccagcucguccuccaggaguggaagaaggagcgcaaggagaugcgcgagaugaccaaguccuucuucaacgcccaguucggcucccucuuccgcaccgaccagaaccccaccuacuuccuccgccgccucucccgcuucgccgacaucuacauggccucccucuccugccuccucaacuacgacgucucccacaccuucuacccccgccgcaccccccuccagcacgagcuccccgccugguccgagcgcccccccaccuucggcaccccccuccuccaggaggcccaggccaaguga

SEQ ID NO: 46893 - RNA, 1575 nt, Artificial Sequence
  derived and/or modified sequence opt2 from NT5E__Homo_sapiens__NP_001191742
augugcccccgcgccgcccgcgcccccgccacccuccuccucgcccucggcgccguccucuggcccgccgccggcgccugggagcucaccauccuccacaccaacgacguccacucccgccucgagcagaccuccgaggacuccuccaagugcgucaacgccucccgcugcaugggcggcgucgcccgccucuucaccaagguccagcagauccgccgcgccgagcccaacguccuccuccucgacgccggcgaccaguaccagggcaccaucugguucaccgucuacaagggcgccgaggucgcccacuucaugaacgcccuccgcuacgacgccauggcccucggcaaccacgaguucgacaacggcgucgagggccucaucgagccccuccucaaggaggccaaguuccccauccucuccgccaacaucaaggccaagggcccccucgccucccagaucuccggccucuaccuccccuacaagguccuccccgucggcgacgaggucgucggcaucgucggcuacaccuccaaggagacccccuuccucuccaaccccggcaccaaccucgucuucgaggacgagaucaccgcccuccagcccgaggucgacaagcucaagacccucaacgucaacaagaucaucgcccucggccacuccggcuucgagauggacaagcucaucgcccagaagguccgcggcgucgacgucgucgucggcggccacuccaacaccuuccucuacaccggcaacccccccuccaaggagguccccgccggcaaguaccccuucaucgucaccuccgacgacggccgcaagguccccgucguccaggccuacgccuucggcaaguaccucggcuaccucaagaucgaguucgacgagcgcggcaacgucaucuccucccacggcaaccccauccuccucaacuccuccauccccgaggaccccuccaucaaggccgacaucaacaaguggcgcaucaagcucgacaacuacuccacccaggagcucggcaagaccaucgucuaccucgacggcuccucccaguccugccgcuuccgcgagugcaacaugggcaaccucaucugcgacgccaugaucaacaacaaccuccgccacaccgacgagauguucuggaaccacgucuccaugugcauccucaacggcggcggcauccgcucccccaucgacgagcgcaacaacggcauccacgucgucuacgaccucucccgcaagcccggcgaccgcgucgucaagcucgacguccucugcaccaagugccgcguccccuccuacgacccccucaagauggacgaggucuacaaggucauccuccccaacuuccucgccaacggcggcgacggcuuccagaugaucaaggacgagcuccuccgccacgacuccggcgaccaggacaucaacgucgucuccaccuacaucuccaagaugaaggucaucuaccccgccgucgagggccgcaucaaguucuccaccggcucccacugccacggcuccuucucccucaucuuccucucccucugggccgucaucuucguccucuaccaguga

SEQ ID NO: 46894 - RNA, 687 nt, Artificial Sequence
  derived and/or modified sequence opt2 from NT5M__Homo_sapiens__NP_064586
augauccgccucggcggcuggugcgcccgccgccucugcuccgccgccguccccgccggccgccgcggcgccgccggcggccucggccucgccggcggccgcgcccuccgcguccucgucgacauggacggcguccucgccgacuucgagggcggcuuccuccgcaaguuccgcgcccgcuuccccgaccagcccuucaucgcccucgaggaccgccgcggcuucugggucuccgagcaguacggccgccuccgccccggccucuccgagaaggccaucuccaucugggaguccaagaacuucuucuucgagcucgagccccuccccggcgccgucgaggccgucaaggagauggccucccuccagaacaccgacgucuucaucugcaccucccccaucaagauguucaaguacugccccuacgagaaguacgccugggucgagaaguacuucggccccgacuuccucgagcagaucguccucacccgcgacaagaccgucgucuccgccgaccuccucaucgacgaccgccccgacaucaccggcgccgagcccacccccuccugggagcacguccucuucaccgccugccacaaccagcaccuccagcuccagcccccccgccgccgccuccacuccugggccgacgacuggaaggccauccucgacuccaagcgccccugcuga

SEQ ID NO: 46895 - RNA, 933 nt, Artificial Sequence
  derived and/or modified sequence opt2 from NTAN1__Homo_sapiens__NP_775745
augccccuccucgucgagggccgccgcguccgccucccccaguccgccggcgaccucguccgcgcccaccccccccucgaggagcgcgcccgccuccuccgcggccaguccguccagcaggucggcccccagggccuccucuacguccagcagcgcgagcucgccgucaccucccccaaggacggcuccaucuccauccucggcuccgacgacgccaccaccugccacaucgucguccuccgccacaccggcaacggcgccaccugccucacccacugcgacggcaccgacaccaaggccgaggucccccucaucaugaacuccaucaaguccuucuccgaccacgcccagugcggccgccucgagguccaccucgucggcggcuucuccgacgaccgccagcucucccagaagcucacccaccagcuccucuccgaguucgaccgccaggaggacgacauccaccucgucacccucugcgucaccgagcucaacgaccgcgaggagaacgagaaccacuuccccgucaucuacggcaucgccgucaacaucaagaccgccgagaucuaccgcgccuccuuccaggaccgcggccccgaggagcagcuccgcgccgcccgcacccucgccggcggccccaugaucuccaucuacgacgccgagaccgagcagcuccgcaucggccccuacuccuggacccccuucccccacgucgacuucuggcuccaccaggacgacaagcagauccucgagaaccucuccaccuccccccucgccgagcccccccacuucgucgagcacauccgcuccacccucauguuccucaagaagcaccccucccccgcccacacccucuucuccggcaacaaggcccuccucuacaagaagaacgaggacggccucugggagaagaucuccucccccggcuccuga

SEQ ID NO: 46896 - RNA, 813 nt, Artificial Sequence
  derived and/or modified sequence opt2 from NTF3__Homo_sapiens__NP_001096124
auggucaccuucgccaccauccuccaggucaacaaggucauguccauccucuucuacgucaucuuccucgccuaccuccgcggcauccagggcaacaacauggaccagcgcucccuccccgaggacucccucaacucccucaucaucaagcucauccaggccgacauccucaagaacaagcucuccaagcagauggucgacgucaaggagaacuaccaguccacccuccccaaggccgaggccccccgcgagcccgagcgcggcggccccgccaaguccgccuuccagcccgucaucgccauggacaccgagcuccuccgccagcagcgccgcuacaacuccccccgcguccuccucuccgacuccaccccccucgagccccccccccucuaccucauggaggacuacgucggcucccccgucgucgccaaccgcaccucccgccgcaagcgcuacgccgagcacaagucccaccgcggcgaguacuccgucugcgacuccgagucccucugggucaccgacaaguccuccgccaucgacauccgcggccaccaggucaccguccucggcgagaucaagaccggcaacucccccgucaagcaguacuucuacgagacccgcugcaaggaggcccgccccgucaagaacggcugccgcggcaucgacgacaagcacuggaacucccagugcaagaccucccagaccuacguccgcgcccucaccuccgagaacaacaagcucgucggcuggcgcuggauccgcaucgacaccuccugcgucugcgcccucucccgcaagaucggccgcaccuga

SEQ ID NO: 46897 - RNA, 663 nt, Artificial Sequence
  derived and/or modified sequence opt2 from NTF4__Homo_sapiens__XP_011525310
augcgccaccacacccgcguccuccgcgagaugcucccccuccccuccugcucccuccccauccuccuccucuuccuccuccccuccguccccaucgagucccagcccccccccuccacccucccccccuuccucgcccccgagugggaccuccucuccccccgcgucguccucucccgcggcgcccccgccggccccccccuccucuuccuccucgaggccggcgccuuccgcgaguccgccggcgcccccgccaaccgcucccgccgcggcgucuccgagaccgcccccgccucccgccgcggcgagcucgccgucugcgacgccgucuccggcugggucaccgaccgccgcaccgccgucgaccuccgcggccgcgaggucgagguccucggcgagguccccgccgccggcggcuccccccuccgccaguacuucuucgagacccgcugcaaggccgacaacgccgaggagggcggccccggcgccggcggcggcggcugccgcggcgucgaccgccgccacugggucuccgagugcaaggccaagcaguccuacguccgcgcccucaccgccgacgcccagggccgcgucggcuggcgcuggauccgcaucgacaccgccugcgucugcacccuccucucccgcaccggccgcgccuga

SEQ ID NO: 46898 - RNA, 939 nt, Artificial Sequence
  derived and/or modified sequence opt2 from NTHL1__Homo_sapiens__NP_002519
augugcuccccccaggaguccggcaugaccgcccucuccgcccgcaugcucacccgcucccgcucccucggccccggcgccggcccccgcggcugccgcgaggagcccggcccccuccgccgccgcgaggccgccgccgaggcccgcaagucccacucccccgucaagcgcccccgcaaggcccagcgccuccgcgucgccuacgagggcuccgacuccgagaagggcgagggcgccgagccccucaagguccccgucugggagccccaggacuggcagcagcagcucgucaacauccgcgccaugcgcaacaagaaggacgcccccgucgaccaccucggcaccgagcacugcuacgacuccuccgccccccccaagguccgccgcuaccagguccuccucucccucaugcucuccucccagaccaaggaccaggucaccgccggcgccaugcagcgccuccgcgcccgcggccucaccgucgacuccauccuccagaccgacgacgccacccucggcaagcucaucuaccccgucggcuucuggcgcuccaaggucaaguacaucaagcagaccuccgccauccuccagcagcacuacggcggcgacauccccgccuccgucgccgagcucgucgcccuccccggcgucggccccaagauggcccaccucgccauggccgucgccuggggcaccgucuccggcaucgccgucgacacccacguccaccgcaucgccaaccgccuccgcuggaccaagaaggccaccaagucccccgaggagacccgcgccgcccucgaggaguggcucccccgcgagcucuggcacgagaucaacggccuccucgucggcuucggccagcagaccugccuccccguccacccccgcugccacgccugccucaaccaggcccucugccccgccgcccagggccucuga

SEQ ID NO: 46899 - RNA, 1035 nt, Artificial Sequence
  derived and/or modified sequence opt2 from NTM__Homo_sapiens__NP_001041674
augaagaccauccagcccaagaugcacaacuccaucuccugggccaucuucaccggccucgccgcccucugccucuuccagggcguccccguccgcuccggcgacgccaccuuccccaaggccauggacaacgucaccguccgccagggcgaguccgccacccuccgcugcaccaucgacaaccgcgucacccgcgucgccuggcucaaccgcuccaccauccucuacgccggcaacgacaaguggugccucgacccccgcgucguccuccucuccaacacccagacccaguacuccaucgagauccagaacgucgacgucuacgacgagggccccuacaccugcuccguccagaccgacaaccaccccaagaccucccgcguccaccucaucguccaggucucccccaagaucgucgagaucuccuccgacaucuccaucaacgagggcaacaacaucucccucaccugcaucgccaccggccgccccgagcccaccgucaccuggcgccacaucucccccaaggccgucggcuucgucuccgaggacgaguaccucgagauccagggcaucacccgcgagcaguccggcgacuacgagugcuccgccuccaacgacgucgccgcccccgucguccgccgcgucaaggucaccgucaacuacccccccuacaucuccgaggccaagggcaccggcguccccgucggccagaagggcacccuccagugcgaggccuccgccguccccuccgccgaguuccagugguacaaggacgacaagcgccucaucgagggcaagaagggcgucaaggucgagaaccgccccuuccucuccaagcucaucuucuucaacgucuccgagcacgacuacggcaacuacaccugcgucgccuccaacaagcucggccacaccaacgccuccaucaugcucuucggccccggcgccgucuccgaggucuccaacggcaccucccgccgcgccggcugcgucuggcuccucccccuccucguccuccaccuccuccucaaguucuga

SEQ ID NO: 46900 - RNA, 1815 nt, Artificial Sequence
  derived and/or modified sequence opt2 from NTN1__Homo_sapiens__XP_006721658
augaugcgcgccgucugggaggcccucgccgcccucgccgccgucgccugccucgucggcgccguccgcggcggccccggccucuccauguucgccggccaggccgcccagcccgaccccugcuccgacgagaacggccacccccgccgcugcauccccgacuucgucaacgccgccuucggcaaggacguccgcgucuccuccaccugcggccgcccccccgcccgcuacugcgucgucuccgagcgcggcgaggagcgccuccgcuccugccaccucugcaacgccuccgaccccaagaaggcccacccccccgccuuccucaccgaccucaacaacccccacaaccucaccugcuggcaguccgagaacuaccuccaguucccccacaacgucacccucacccucucccucggcaagaaguucgaggucaccuacgucucccuccaguucugcuccccccgccccgaguccauggccaucuacaaguccauggacuacggccgcaccuggguccccuuccaguucuacuccacccagugccgcaagauguacaaccgcccccaccgcgcccccaucaccaagcagaacgagcaggaggccgucugcaccgacucccacaccgacaugcgcccccucuccggcggccucaucgccuucuccacccucgacggccgccccuccgcccacgacuucgacaacucccccguccuccaggacugggucaccgccaccgacauccgcgucgccuucucccgccuccacaccuucggcgacgagaacgaggacgacuccgagcucgcccgcgacuccuacuucuacgccgucuccgaccuccaggucggcggccgcugcaagugcaacggccacgccgcccgcugcguccgcgaccgcgacgacucccucgucugcgacugccgccacaacaccgccggccccgagugcgaccgcugcaagcccuuccacuacgaccgccccuggcagcgcgccaccgcccgcgaggccaacgagugcgucgccugcaacugcaaccuccacgcccgccgcugccgcuucaacauggagcucuacaagcucuccggccgcaaguccggcggcgucugccucaacugccgccacaacaccgccggccgccacugccacuacugcaaggagggcuacuaccgcgacaugggcaagcccaucacccaccgcaaggccugcaaggccugcgacugccaccccgucggcgccgccggcaagaccugcaaccagaccaccggccagugccccugcaaggacggcgucaccggcaucaccugcaaccgcugcgccaagggcuaccagcagucccgcucccccaucgcccccugcaucaagauccccgucgccccccccaccaccgccgccuccuccgucgaggagcccgaggacugcgacuccuacugcaaggccuccaagggcaagcucaagaucaacaugaagaaguacugcaagaaggacuacgccguccagauccacauccucaaggccgacaaggccggcgacugguggaaguucaccgucaacaucaucuccgucuacaagcagggcaccucccgcauccgccgcggcgaccagucccucuggauccgcucccgcgacaucgccugcaagugccccaagaucaagccccucaagaaguaccuccuccucggcaacgccgaggacucccccgaccaguccggcaucgucgccgacaaguccucccucgucauccaguggcgcgacaccugggcccgccgccuccgcaaguuccagcagcgcgagaagaagggcaagugcaagaaggccuga

SEQ ID NO: 46901 - RNA, 1887 nt, Artificial Sequence
  derived and/or modified sequence opt2 from NTN4__Homo_sapiens__NP_067052
augggcuccugcgcccgccuccuccuccucuggggcugcaccgucgucgccgccggccucuccggcgucgccggcgucuccucccgcugcgagaaggccugcaacccccgcaugggcaaccucgcccucggccgcaagcucugggccgacaccaccugcggccagaacgccaccgagcucuacugcuucuacuccgagaacaccgaccucaccugccgccagcccaagugcgacaagugcaacgccgccuacccccaccucgcccaccuccccuccgccauggccgacuccuccuuccgcuucccccgcaccugguggcaguccgccgaggacguccaccgcgagaagauccagcucgaccucgaggccgaguucuacuucacccaccucaucgucauguucaaguccccccgccccgccgccaugguccucgaccgcucccaggacuucggcaagaccuggaagcccuacaaguacuucgccaccaacugcuccgccaccuucggccucgaggacgacgucgucaagaagggcgccaucugcaccuccaaguacuccucccccuuccccugcaccggcggcgaggucaucuucaaggcccucuccccccccuacgacaccgagaaccccuacuccgccaagguccaggagcagcucaagaucaccaaccuccgcguccagcuccucaagcgccaguccugccccugccagcgcaacgaccucaacgaggagccccagcacuucacccacuacgccaucuacgacuucaucgucaagggcuccugcuucugcaacggccacgccgaccagugcauccccguccacggcuuccgccccgucaaggcccccggcaccuuccacaugguccacggcaagugcaugugcaagcacaacaccgccggcucccacugccagcacugcgccccccucuacaacgaccgccccugggaggccgccgacggcaagaccggcgcccccaacgagugccgcaccugcaagugcaacggccacgccgacaccugccacuucgacgucaacgucugggaggccuccggcaaccgcuccggcggcgucugcgacgacugccagcacaacaccgagggccaguacugccagcgcugcaagcccggcuucuaccgcgaccuccgccgccccuucuccgcccccgacgccugcaagcccugcuccugccaccccgucggcuccgccguccuccccgccaacuccgucaccuucugcgaccccuccaacggcgacugccccugcaagcccggcgucgccggccgccgcugcgaccgcugcauggucggcuacuggggcuucggcgacuacggcugccgccccugcgacugcgccggcuccugcgaccccaucaccggcgacugcaucuccucccacaccgacaucgacugguaccacgagguccccgacuuccgccccguccacaacaaguccgagcccgccugggagugggaggacgcccagggcuucuccgcccuccuccacuccggcaagugcgagugcaaggagcagacccucggcaacgccaaggccuucugcggcaugaaguacuccuacguccucaagaucaagauccucuccgcccacgacaagggcacccacgucgaggucaacgucaagaucaagaagguccucaaguccaccaagcucaagaucuuccgcggcaagcgcacccucuaccccgaguccuggaccgaccgcggcugcaccugccccauccucaaccccggccucgaguaccucgucgccggccacgaggacauccgcaccggcaagcucaucgucaacaugaaguccuucguccagcacuggaagcccucccucggccgcaaggucauggacauccucaagcgcgagugcaaguga

SEQ ID NO: 46902 - RNA, 1578 nt, Artificial Sequence
  derived and/or modified sequence opt2 from NTNG1__Homo_sapiens__XP_011539324
auguaccucucccgcuuccucuccauccacgcccucugggucaccgucuccuccgucaugcagcccuacccccucgucuggggccacuacgaccucugcaagacccagaucuacaccgaggagggcaaggucugggacuacauggccugccagcccgaguccaccgacaugaccaaguaccucaaggucaagcucgacccccccgacaucaccugcggcgacccccccgagaccuucugcgccaugggcaaccccuacaugugcaacaacgagugcgacgccuccacccccgagcucgcccacccccccgagcucauguucgacuucgagggccgccaccccuccaccuucuggcaguccgccaccuggaaggaguaccccaagccccuccaggucaacaucacccucuccugguccaagaccaucgagcucaccgacaacaucgucaucaccuucgaguccggccgccccgaccagaugauccucgagaagucccucgacuacggccgcaccuggcagcccuaccaguacuacgccaccgacugccucgacgccuuccacauggaccccaaguccgucaaggaccucucccagcacaccguccucgagaucaucugcaccgaggaguacuccaccggcuacaccaccaacuccaagaucauccacuucgagaucaaggaccgcuucgccuucuucgccggcccccgccuccgcaacauggccucccucuacggccagcucgacaccaccaagaagcuccgcgacuucuucaccgucaccgaccuccgcauccgccuccuccgccccgccgucggcgagaucuucgucgacgagcuccaccucgcccgcuacuucuacgccaucuccgacaucaagguccgcggccgcugcaagugcaaccuccacgccaccgucugcgucuacgacaacuccaagcucaccugcgagugcgagcacaacaccaccggccccgacugcggcaagugcaagaagaacuaccagggccgccccuggucccccggcuccuaccuccccauccccaagggcaccgccaacaccugcauccccuccaucuccuccaucggcaacccccccaaguucaaccgcaucuggcccaacaucuccucccucgaggucuccaaccccaagcaggucgcccccaagcucgcccucuccaccgucuccuccguccaggucgccaaccacaagcgcgagugcuacugcaacccccucggcuccauccacgaccgcugcaacggcuccggcuucugcgagugcaagaccggcaccaccggccccaagugcgacgagugccuccccggcaacuccuggcacuacggcugccagcccaacgucugcgacaacgagcuccuccacugccagaacggcggcaccugccacaacaacguccgcugccucugccccgccgccuacaccggcauccucugcgagaagcuccgcugcgaggaggccggcuccugcggcuccgacuccggccagggcgcccccccccacggcucccccgcccuccuccuccucaccacccuccucggcaccgccuccccccucgucuucuga

SEQ ID NO: 46903 - RNA, 1593 nt, Artificial Sequence
  derived and/or modified sequence opt2 from NTNG2__Homo_sapiens__NP_115925
augcuccaccuccucgcccucuuccuccacugccucccccucgccuccggcgacuacgacaucugcaaguccugggucaccaccgacgagggccccaccugggaguucuacgccugccagcccaaggucaugcgccucaaggacuacgucaaggucaaggucgagcccuccggcaucaccugcggcgacccccccgagcgcuucugcucccacgagaaccccuaccucugcuccaacgagugcgacgccuccaaccccgaccucgcccaccccccccgccucauguucgacaaggaggaggagggccucgccaccuacuggcaguccaucaccuggucccgcuaccccuccccccucgaggccaacaucacccucuccuggaacaagaccgucgagcucaccgacgacgucgucaugaccuucgaguacggccgccccaccgucaugguccucgagaagucccucgacaacggccgcaccuggcagcccuaccaguucuacgccgaggacugcauggaggccuucggcauguccgcccgccgcgcccgcgacauguccuccuccuccgcccaccgcguccucugcaccgaggaguacucccgcugggccggcuccaagaaggagaagcacguccgcuucgagguccgcgaccgcuucgccaucuucgccggccccgaccuccgcaacauggacaaccucuacacccgccucgaguccgccaagggccucaaggaguucuucacccucaccgaccuccgcaugcgccuccuccgccccgcccucggcggcaccuacguccagcgcgagaaccucuacaaguacuucuacgccaucuccaacaucgaggucaucggccgcugcaagugcaaccuccacgccaaccucugcuccaugcgcgagggcucccuccagugcgagugcgagcacaacaccaccggccccgacugcggcaagugcaagaagaacuuccgcacccgcuccuggcgcgccggcuccuaccucccccucccccacggcucccccaacgccugcgccaccgccggcuccuucggcaacugcgagugcuacggccacuccaaccgcugcuccuacaucgacuuccucaacgucgucaccugcgucuccugcaagcacaacacccgcggccagcacugccagcacugccgccucggcuacuaccgcaacggcuccgccgagcucgacgacgagaacgucugcaucgagugcaacugcaaccagaucggcuccguccacgaccgcugcaacgagaccggcuucugcgagugccgcgagggcgccgccggccccaagugcgacgacugccuccccacccacuacuggcgccagggcugcuaccccaacgucugcgacgacgaccagcuccucugccagaacggcggcaccugccuccagaaccagcgcugcgccugcccccgcggcuacaccggcguccgcugcgagcagccccgcugcgaccccgccgacgacgacggcggccucgacugcgaccgcgcccccggcgccgccccccgccccgccacccuccucggcugccuccuccuccucggccucgccgcccgccucggccgcuga

SEQ ID NO: 46904 - RNA, 573 nt, Artificial Sequence
  derived and/or modified sequence opt2 from NTPCR__Homo_sapiens__NP_115700
auggcccgccacgucuuccucaccggcccccccggcgucggcaagaccacccucauccacaaggccuccgagguccucaaguccuccggcguccccgucgacggcuucuacaccgaggagguccgccagggcggccgccgcaucggcuucgacgucgucacccucuccggcacccgcggcccccucucccgcgucggccucgagcccccccccggcaagcgcgagugccgcgucggccaguacgucgucgaccucaccuccuucgagcagcucgcccuccccguccuccgcaacgccgacugcuccuccggccccggccagcgcgucugcgucaucgacgagaucggcaagauggagcucuucucccagcucuucauccaggccguccgccagacccucuccacccccggcaccaucauccucggcaccauccccguccccaagggcaagccccucgcccucgucgaggagauccgcaaccgcaaggacgucaaggucuucaacgucaccaaggagaaccgcaaccaccuccuccccgacaucgucaccugcguccaguccucccgcaaguga

SEQ ID NO: 46905 - RNA, 2283 nt, Artificial Sequence
  derived and/or modified sequence opt2 from NTRK1__Homo_sapiens__NP_001007793
augaaggaggccgcccucaucugccucgcccccuccgucccccccauccucaccgucaaguccugggacaccaugcagcuccgcgccgcccgcucccgcugcaccaaccuccucgccgccuccuacaucgagaaccagcagcaccuccagcaccucgagcuccgcgaccuccgcggccucggcgagcuccgcaaccucaccaucgucaaguccggccuccgcuucgucgcccccgacgccuuccacuucaccccccgccucucccgccucaaccucuccuucaacgcccucgagucccucuccuggaagaccguccagggccucucccuccaggagcucguccucuccggcaacccccuccacugcuccugcgcccuccgcuggcuccagcgcugggaggaggagggccucggcggcguccccgagcagaagcuccagugccacggccagggcccccucgcccacaugcccaacgccuccugcggcguccccacccucaagguccagguccccaacgccuccgucgacgucggcgacgacguccuccuccgcugccaggucgagggccgcggccucgagcaggccggcuggauccucaccgagcucgagcaguccgccaccgucaugaaguccggcggccuccccucccucggccucacccucgccaacgucaccuccgaccucaaccgcaagaacgucaccugcugggccgagaacgacgucggccgcgccgaggucuccguccaggucaacgucuccuuccccgccuccguccagcuccacaccgccgucgagaugcaccacuggugcauccccuucuccgucgacggccagcccgcccccucccuccgcuggcucuucaacggcuccguccucaacgagaccuccuucaucuucaccgaguuccucgagcccgccgccaacgagaccguccgccacggcugccuccgccucaaccagcccacccacgucaacaacggcaacuacacccuccucgccgccaaccccuucggccaggccuccgccuccaucauggccgccuucauggacaaccccuucgaguucaaccccgaggaccccauccccgacaccaacuccaccuccggcgaccccgucgagaagaaggacgagacccccuucggcgucuccgucgccgucggccucgccgucuucgccugccucuuccucuccacccuccuccucguccucaacaagugcggccgccgcaacaaguucggcaucaaccgccccgccguccucgcccccgaggacggccucgccaugucccuccacuucaugacccucggcggcuccucccucucccccaccgagggcaagggcuccggccuccagggccacaucaucgagaacccccaguacuucuccgacgccugcguccaccacaucaagcgccgcgacaucguccucaagugggagcucggcgagggcgccuucggcaaggucuuccucgccgagugccacaaccuccuccccgagcaggacaagaugcucgucgccgucaaggcccucaaggaggccuccgaguccgcccgccaggacuuccagcgcgaggccgagcuccucaccaugcuccagcaccagcacaucguccgcuucuucggcgucugcaccgagggccgcccccuccucauggucuucgaguacaugcgccacggcgaccucaaccgcuuccuccgcucccacggccccgacgccaagcuccucgccggcggcgaggacgucgcccccggcccccucggccucggccagcuccucgccgucgccucccaggucgccgccggcauggucuaccucgccggccuccacuucguccaccgcgaccucgccacccgcaacugccucgucggccagggccucgucgucaagaucggcgacuucggcaugucccgcgacaucuacuccaccgacuacuaccgcgucggcggccgcaccaugcuccccauccgcuggaugccccccgaguccauccucuaccgcaaguucaccaccgaguccgacgucugguccuucggcgucguccucugggagaucuucaccuacggcaagcagcccugguaccagcucuccaacaccgaggccaucgacugcaucacccagggccgcgagcucgagcgcccccgcgccugcccccccgaggucuacgccaucaugcgcggcugcuggcagcgcgagccccagcagcgccacuccaucaaggacguccacgcccgccuccaggcccucgcccaggccccccccgucuaccucgacguccucggcuga

SEQ ID NO: 46906 - RNA, 1662 nt, Artificial Sequence
  derived and/or modified sequence opt2 from NTRK2__Homo_sapiens__NP_001018075
auguccuccuggauccgcuggcacggccccgccauggcccgccucuggggcuucugcuggcucgucgucggcuucuggcgcgccgccuucgccugccccaccuccugcaagugcuccgccucccgcaucuggugcuccgaccccucccccggcaucgucgccuucccccgccucgagcccaacuccgucgaccccgagaacaucaccgagaucuucaucgccaaccagaagcgccucgagaucaucaacgaggacgacgucgaggccuacgucggccuccgcaaccucaccaucgucgacuccggccucaaguucgucgcccacaaggccuuccucaagaacuccaaccuccagcacaucaacuucacccgcaacaagcucaccucccucucccgcaagcacuuccgccaccucgaccucuccgagcucauccucgucggcaaccccuucaccugcuccugcgacaucauguggaucaagacccuccaggaggccaaguccucccccgacacccaggaccucuacugccucaacgaguccuccaagaacaucccccucgccaaccuccagauccccaacugcggccuccccuccgccaaccucgccgcccccaaccucaccgucgaggagggcaaguccaucacccucuccugcuccgucgccggcgaccccguccccaacauguacugggacgucggcaaccucgucuccaagcacaugaacgagaccucccacacccagggcucccuccgcaucaccaacaucuccuccgacgacuccggcaagcagaucuccugcgucgccgagaaccucgucggcgaggaccaggacuccgucaaccucaccguccacuucgcccccaccaucaccuuccucgagucccccaccuccgaccaccacuggugcauccccuucaccgucaagggcaaccccaagcccgcccuccagugguucuacaacggcgccauccucaacgaguccaaguacaucugcaccaagauccacgucaccaaccacaccgaguaccacggcugccuccagcucgacaaccccacccacaugaacaacggcgacuacacccucaucgccaagaacgaguacggcaaggacgagaagcagaucuccgcccacuucaugggcuggcccggcaucgacgacggcgccaaccccaacuaccccgacgucaucuacgaggacuacggcaccgccgccaacgacaucggcgacaccaccaaccgcuccaacgagauccccuccaccgacgucaccgacaagaccggccgcgagcaccucuccgucuacgccgucgucgucaucgccuccgucgucggcuucugccuccucgucaugcucuuccuccucaagcucgcccgccacuccaaguucggcaugaaggacuucuccugguucggcuucggcaaggucaagucccgccagggcgucggccccgccuccgucaucuccaacgacgacgacuccgccuccccccuccaccacaucuccaacggcuccaacacccccuccuccuccgagggcggccccgacgccgucaucaucggcaugaccaagauccccgucaucgagaacccccaguacuucggcaucaccaacucccagcucaagcccgacaccuggccccgcggcucccccaagaccgccuga

SEQ ID NO: 46907 - RNA, 1839 nt, Artificial Sequence
  derived and/or modified sequence opt2 from NTRK3__Homo_sapiens__NP_001007157
auggacgucucccucugccccgccaagugcuccuucuggcgcaucuuccuccucggcuccgucuggcucgacuacgucggcuccguccucgccugccccgccaacugcgucugcuccaagaccgagaucaacugccgccgccccgacgacggcaaccucuucccccuccucgagggccaggacuccggcaacuccaacggcaacgccuccaucaacaucaccgacaucucccgcaacaucaccuccauccacaucgagaacuggcgcucccuccacacccucaacgccgucgacauggagcucuacaccggccuccagaagcucaccaucaagaacuccggccuccgcuccauccagccccgcgccuucgccaagaacccccaccuccgcuacaucaaccucuccuccaaccgccucaccacccucuccuggcagcucuuccagacccucucccuccgcgagcuccagcucgagcagaacuucuucaacugcuccugcgacauccgcuggaugcagcucuggcaggagcagggcgaggccaagcucaacucccagaaccucuacugcaucaacgccgacggcucccagcucccccucuuccgcaugaacaucucccagugcgaccuccccgagaucuccgucucccacgucaaccucaccguccgcgagggcgacaacgccgucaucaccugcaacggcuccggcuccccccuccccgacgucgacuggaucgucaccggccuccaguccaucaacacccaccagaccaaccucaacuggaccaacguccacgccaucaaccucacccucgucaacgucaccuccgaggacaacggcuucacccucaccugcaucgccgagaacgucgucggcauguccaacgccuccgucgcccucaccgucuacuaccccccccgcgucgucucccucgaggagcccgagcuccgccucgagcacugcaucgaguucgucguccgcggcaaccccccccccacccuccacuggcuccacaacggccagccccuccgcgaguccaagaucauccacgucgaguacuaccaggagggcgagaucuccgagggcugccuccucuucaacaagcccacccacuacaacaacggcaacuacacccucaucgccaagaacccccucggcaccgccaaccagaccaucaacggccacuuccucaaggagcccuuccccgaguccaccgacaacuucauccucuucgacgaggucucccccaccccccccaucaccgucacccacaagcccgaggaggacaccuucggcgucuccaucgccgucggccucgccgccuucgccugcguccuccucgucguccucuucgucaugaucaacaaguacggccgccgcuccaaguucggcaugaagggccccgucgccgucaucuccggcgaggaggacuccgccuccccccuccaccacaucaaccacggcaucaccacccccuccucccucgacgccggccccgacaccgucgucaucggcaugacccgcauccccgucaucgagaacccccaguacuuccgccagggccacaacugccacaagcccgacaccugggucuucuccaacaucgacaaccacggcauccucaaccucaaggacaaccgcgaccaccucguccccuccacccacuacaucuacgaggagcccgagguccaguccggcgaggucuccuacccccgcucccacggcuuccgcgagaucaugcucaaccccaucucccuccccggccacuccaagccccucaaccacggcaucuacgucgaggacgucaacgucuacuucuccaagggccgccacggcuucuga

SEQ ID NO: 46908 - RNA, 513 nt, Artificial Sequence
  derived and/or modified sequence opt2 from NTS__Homo_sapiens__NP_006174
augauggccggcaugaagauccagcucgucugcaugcuccuccucgccuucuccuccuggucccucugcuccgacuccgaggaggagaugaaggcccucgaggccgacuuccucaccaacaugcacaccuccaagaucuccaaggcccacguccccuccuggaagaugacccuccucaacgucugcucccucgucaacaaccucaacucccccgccgaggagaccggcgagguccacgaggaggagcucgucgcccgccgcaagcuccccaccgcccucgacggcuucucccucgaggccaugcucaccaucuaccagcuccacaagaucugccacucccgcgccuuccagcacugggagcucauccaggaggacauccucgacaccggcaacgacaagaacggcaaggaggaggucaucaagcgcaagauccccuacauccucaagcgccagcucuacgagaacaagccccgccgccccuacauccucaagcgcgacuccuacuacuacuga

SEQ ID NO: 46909 - RNA, 1257 nt, Artificial Sequence
  derived and/or modified sequence opt2 from NTSR1__Homo_sapiens__NP_002522
augcgccucaacuccuccgcccccggcacccccggcacccccgccgccgaccccuuccagcgcgcccaggccggccucgaggaggcccuccucgcccccggcuucggcaacgccuccggcaacgccuccgagcgcguccucgccgcccccuccuccgagcucgacgucaacaccgacaucuacuccaagguccucgucaccgccgucuaccucgcccucuucgucgucggcaccgucggcaacaccgucaccgccuucacccucgcccgcaagaagucccuccagucccuccaguccaccguccacuaccaccucggcucccucgcccucuccgaccuccucacccuccuccucgccaugcccgucgagcucuacaacuucaucuggguccaccaccccugggccuucggcgacgccggcugccgcggcuacuacuuccuccgcgacgccugcaccuacgccaccgcccucaacgucgccucccucuccgucgagcgcuaccucgccaucugccaccccuucaaggccaagacccucaugucccgcucccgcaccaagaaguucaucuccgccaucuggcucgccuccgcccuccucgccguccccaugcucuucaccaugggcgagcagaaccgcuccgccgacggccagcacgccggcggccucgucugcacccccaccauccacaccgccaccgucaaggucgucauccaggucaacaccuucauguccuucaucuuccccauggucgucaucuccguccucaacaccaucaucgccaacaagcucaccgucaugguccgccaggccgccgagcagggccaggucugcaccgucggcggcgagcacuccaccuucuccauggccaucgagcccggccgcguccaggcccuccgccacggcguccgcguccuccgcgccgucgucaucgccuucgucgucugcuggcuccccuaccacguccgccgccucauguucugcuacaucuccgacgagcaguggacccccuuccucuacgacuucuaccacuacuucuacauggucaccaacgcccucuucuacgucuccuccaccaucaaccccauccucuacaaccucgucuccgccaacuuccgccacaucuuccucgccacccucgccugccucugccccgucuggcgccgccgccgcaagcgccccgccuucucccgcaaggccgacuccgucuccuccaaccacacccucuccuccaacgccacccgcgagacccucuacuga

SEQ ID NO: 46910 - RNA, 1233 nt, Artificial Sequence
  derived and/or modified sequence opt2 from NTSR2__Homo_sapiens__NP_036476
auggagaccuccuccccccgccccccccgccccuccuccaaccccggccucucccucgacgcccgccucggcgucgacacccgccucugggccaagguccucuucaccgcccucuacgcccucaucugggcccucggcgccgccggcaacgcccucuccguccacgucguccucaaggcccgcgccggccgcgccggccgccuccgccaccacguccucucccucgcccucgccggccuccuccuccuccucgucggcguccccgucgagcucuacuccuucgucugguuccacuaccccugggucuucggcgaccucggcugccgcggcuacuacuucguccacgagcucugcgccuacgccaccguccucuccgucgccggccucuccgccgagcgcugccucgccgucugccagccccuccgcgcccgcucccuccucaccccccgccgcacccgcuggcucgucgcccucuccugggccgccucccucggccucgcccuccccauggccgucaucaugggccagaagcacgagcucgagaccgccgacggcgagcccgagcccgccucccgcgucugcaccguccucgucucccgcaccgcccuccaggucuucauccaggucaacguccucgucuccuucguccucccccucgcccucaccgccuuccucaacggcgucaccgucucccaccuccucgcccucugcucccagguccccuccaccuccacccccggcuccuccacccccucccgccucgagcuccucuccgaggagggccuccucuccuucaucgucuggaagaagaccuucauccagggcggccaggucucccucguccgccacaaggacguccgccgcauccgcucccuccagcgcuccguccagguccuccgcgccaucgucgucauguacgucaucugcuggcuccccuaccacgcccgccgccucauguacugcuacguccccgacgacgccuggaccgacccccucuacaacuucuaccacuacuucuacauggucaccaacacccucuucuacgucuccuccgccgucaccccccuccucuacaacgccgucuccuccuccuuccgcaagcucuuccucgaggccgucuccucccucugcggcgagcaccaccccaugaagcgccucccccccaagccccagucccccacccucauggacaccgccuccggcuucggcgacccccccgagacccgcaccuga

SEQ ID NO: 46911 - RNA, 1986 nt, Artificial Sequence
  derived and/or modified sequence opt2 from NUAK1__Homo_sapiens__NP_055655
auggagggcgccgccgcccccgucgccggcgaccgccccgaccucggccucggcgcccccggcuccccccgcgaggccgucgccggcgccaccgccgcccucgagccccgcaagccccacggcgucaagcgccaccaccacaagcacaaccucaagcaccgcuacgagcuccaggagacccucggcaagggcaccuacggcaaggucaagcgcgccaccgagcgcuucuccggccgcgucgucgccaucaaguccauccgcaaggacaagaucaaggacgagcaggacaugguccacauccgccgcgagaucgagaucauguccucccucaaccacccccacaucaucuccaucuacgaggucuucgagaacaaggacaagaucgucaucaucauggaguacgccuccaagggcgagcucuacgacuacaucuccgagcgccgccgccucuccgagcgcgagacccgccacuucuuccgccagaucgucuccgccguccacuacugccacaagaacggcgucguccaccgcgaccucaagcucgagaacauccuccucgacgacaacugcaacaucaagaucgccgacuucggccucuccaaccucuaccagaaggacaaguuccuccagaccuucugcggcuccccccucuacgccucccccgagaucgucaacggccgccccuaccgcggccccgaggucgacuccugggcccucggcguccuccucuacacccucgucuacggcaccaugcccuucgacggcuucgaccacaagaaccucauccgccagaucuccuccggcgaguaccgcgagcccacccagcccuccgacgcccgcggccucauccgcuggaugcucauggucaaccccgaccgccgcgccaccaucgaggacaucgccaaccacuggugggucaacuggggcuacaaguccuccgucugcgacugcgacgcccuccacgacuccgaguccccccuccucgcccgcaucaucgacuggcaccaccgcuccaccggccuccaggccgacaccgaggccaagaugaagggccucgccaagcccaccaccuccgaggucaugcucgagcgccagcgcucccucaagaaguccaagaaggagaacgacuucgcccaguccggccaggacgccguccccgagucccccuccaagcucuccuccaagcgccccaagggcauccucaagaagcgcuccaacuccgagcaccgcucccacuccaccggcuucaucgagggcgucgucggccccgcccuccccuccaccuucaagauggagcaggaccucugccgcaccggcguccuccuccccuccucccccgaggccgagguccccggcaagcucucccccaagcaguccgccaccaugcccaagaagggcauccucaagaagacccagcagcgcgaguccggcuacuacuccucccccgagcgcuccgaguccuccgagcuccucgacuccaacgacgucaugggcuccuccauccccucccccuccccccccgaccccgcccgcgucaccucccacucccucuccugccgccgcaagggcauccucaagcacuccuccaaguacuccgccggcaccauggaccccgcccucgucucccccgagaugcccacccucgagucccucuccgagcccggcguccccgccgagggccucucccgcuccuacucccgccccuccuccgucaucuccgacgacuccguccucuccuccgacuccuucgaccuccucgaccuccaggagaaccgccccgcccgccagcgcauccgcuccugcgucuccgccgagaacuuccuccagauccaggacuucgagggccuccagaaccgcccccgcccccaguaccucaagcgcuaccgcaaccgccucgccgacuccuccuucucccuccucaccgacauggacgacgucacccaggucuacaagcaggcccucgagaucugcuccaagcucaacuga

SEQ ID NO: 46912 - RNA, 2019 nt, Artificial Sequence
  derived and/or modified sequence opt2 from NUAK2__Homo_sapiens__NP_112214
augcucugcuucaccgcccgcuccggcaccgccgucgccccccgccccggcgccggccccgucccccgcgccuccgcccuccccgcccagcccaccgacucccccgccgcccucgcccaccuccuccucgccauggagucccucgucuucgcccgccgcuccggccccacccccuccgccgccgagcucgcccgcccccucgccgagggccucaucaagucccccaagccccucaugaagaagcaggccgucaagcgccaccaccacaagcacaaccuccgccaccgcuacgaguuccucgagacccucggcaagggcaccuacggcaaggucaagaaggcccgcgaguccuccggccgccucgucgccaucaaguccauccgcaaggacaagaucaaggacgagcaggaccucaugcacauccgccgcgagaucgagaucauguccucccucaaccacccccacaucaucgccauccacgaggucuucgagaacuccuccaagaucgucaucgucauggaguacgccucccgcggcgaccucuacgacuacaucuccgagcgccagcagcucuccgagcgcgaggcccgccacuucuuccgccagaucgucuccgccguccacuacugccaccagaaccgcgucguccaccgcgaccucaagcucgagaacauccuccucgacgccaacggcaacaucaagaucgccgacuucggccucuccaaccucuaccaccagggcaaguuccuccagaccuucugcggcuccccccucuacgccucccccgagaucgucaacggcaagcccuacaccggccccgaggucgacuccuggucccucggcguccuccucuacauccucguccacggcaccaugcccuucgacggccacgaccacaagauccucgucaagcagaucuccaacggcgccuaccgcgagccccccaagcccuccgacgccugcggccucauccgcuggcuccucauggucaaccccacccgccgcgccacccucgaggacgucgccucccacuggugggucaacuggggcuacgccacccgcgucggcgagcaggaggccccccacgagggcggccaccccggcuccgacuccgcccgcgccuccauggccgacuggcuccgccgcuccucccgcccccuccucgagaacggcgccaaggucugcuccuucuucaagcagcacgcccccggcggcggcuccaccacccccggccucgagcgccagcacucccucaagaagucccgcaaggagaacgacauggcccagucccuccacuccgacaccgccgacgacaccgcccaccgccccggcaaguccaaccucaagcuccccaagggcauccucaagaagaaggucuccgccuccgccgagggcguccaggaggacccccccgagcucucccccauccccgccucccccggccaggccgccccccuccuccccaagaagggcauccucaagaagccccgccagcgcgaguccggcuacuacuccucccccgagcccuccgaguccggcgagcuccucgacgccggcgacgucuucgucuccggcgaccccaaggagcagaagcccccccaggccuccggccuccuccuccaccgcaagggcauccucaagcucaacggcaaguucucccagaccgcccucgagcucgccgcccccaccaccuucggcucccucgacgagcucgcccccccccgcccccucgcccgcgccucccgccccuccggcgccgucuccgaggacuccauccucuccuccgaguccuucgaccagcucgaccuccccgagcgccuccccgagcccccccuccgcggcugcgucuccgucgacaaccucaccggccucgaggagccccccuccgagggccccggcuccugccuccgccgcuggcgccaggacccccucggcgacuccugcuucucccucaccgacugccaggaggucaccgccaccuaccgccaggcccuccgcgucugcuccaagcucaccuga

SEQ ID NO: 46913 - RNA, 1920 nt, Artificial Sequence
  derived and/or modified sequence opt2 from NUB1__Homo_sapiens__NP_001230280
augaagaccaacggcggccgcugccgcauccgcgcccucugcuggucccgccgcgaguggcgcggcgccggcauggcccagaagaaguaccuccaggccaagcucacccaguuccuccgcgaggaccgcauccagcucuggaagccccccuacaccgacgagaacaagaaggucggccucgcccucaaggaccucgccaagcaguacuccgaccgccucgagugcugcgagaacgaggucgagaaggucaucgaggagauccgcugcaaggccaucgagcgcggcaccggcaacgacaacuaccgcaccaccggcaucgccaccaucgaggucuuccuccccccccgccucaagaaggaccgcaagaaccuccucgagacccgccuccacaucaccggccgcgagcuccgcuccaagaucgccgagaccuucggccuccaggagaacuacaucaagaucgucaucaacaagaagcagcuccagcucggcaagacccucgaggagcagggcgucgcccacaacgucaaggccaugguccucgagcucaagcaguccgaggaggacgcccgcaagaacuuccagcucgaggaggaggagcagaacgaggccaagcucaaggagaagcagauccagcgcaccaagcgcggccucgagauccucgccaagcgcgccgccgagaccgucgucgaccccgagaugacccccuaccucgacaucgccaaccagaccggccgcuccauccgcaucccccccuccgagcgcaaggcccucaugcucgccaugggcuaccacgagaagggccgcgccuuccucaagcgcaaggaguacggcaucgcccuccccugccuccucgacgccgacaaguacuucugcgagugcugccgcgagcuccucgacaccgucgacaacuacgccguccuccagcucgacaucgucuggugcuacuuccgccucgagcagcucgagugccucgacgacgccgagaagaagcucaaccucgcccagaagugcuucaagaacugcuacggcgagaaccaccagcgccucguccacaucaagggcaacugcggcaaggagaagguccucuuccuccgccucuaccuccuccagggcauccgcaacuaccacuccggcaacgacgucgaggccuacgaguaccucaacaaggcccgccagcucuucaaggagcucuacaucgaccccuccaaggucgacaaccuccuccagcucggcuucaccgcccaggaggcccgccucggccuccgcgccugcgacggcaacgucgaccacgccgccacccacaucaccaaccgccgcgaggagcucgcccagauccgcaaggaggagaaggagaagaagcgccgccgccucgagaacauccgcuuccucaagggcaugggcuacuccacccacgccgcccagcagguccuccacgccgccuccggcaaccucgacgaggcccucaagauccuccucuccaacccccagaugugguggcucaacgacuccaaccccgagaccgacaaccgccaggagucccccucccaggagaacaucgaccgccucgucuacaugggcuucgacgcccucgucgccgaggccgcccuccgcgucuuccgcggcaacguccagcucgccgcccagacccucgcccacaacggcggcucccucccccccgagcucccccucucccccgaggacucccucuccccccccgccaccucccccuccgacuccgccggcaccuccuccgccuccaccgacgaggacauggagaccgaggccgucaacgagauccucgaggacauccccgagcacgaggaggacuaccucgacuccacccucgaggacgaggagaucaucaucgccgaguaccucuccuacgucgagaaccgcaaguccgccaccaagaagaacuga

SEQ ID NO: 46914 - RNA, 930 nt, Artificial Sequence
  derived and/or modified sequence opt2 from NUBP1__Homo_sapiens__NP_001265435
auggaggaggucccccacgacugccccggcgccgacuccgcccaggccggccgcggcgccuccugccagggcugccccaaccagcgccucugcgccuccggcgccggcgccacccccgacaccgccaucgaggagaucaaggagaagaugaagaccgucaagcacaagauccucguccucuccggcaagggcggcgucggcaaguccaccuucuccgcccaccucgcccacggccucgccgaggacgagaacacccagaucgcccuccucgacaucgacaucugcggccccuccauccccaagaucaugggccucgagggcgagcaguacgucgaggacaaccucggcgucauguccgucggcuuccuccucuccucccccgacgacgccgucaucuggcgcggccccaagaagaacggcaugaucaagcaguuccuccgcgacgucgacuggggcgaggucgacuaccucaucgucgacaccccccccggcaccuccgacgagcaccucuccgucguccgcuaccucgccaccgcccacaucgacggcgccgucaucaucaccaccccccaggaggucucccuccaggacguccgcaaggagaucaacuucugccgcaaggucaagcuccccaucaucggcgucgucgagaacauguccggcuucaucugccccaagugcaagaaggagucccagaucuucccccccaccaccggcggcgccgagcucaugugccaggaccucgaggucccccuccucggccgcgucccccucgacccccucaucggcaagaacugcgacaagggccaguccuucuucaucgacgcccccgacucccccgccacccucgccuaccgcuccaucauccagcgcauccaggaguucugcaaccuccaccaguccaaggaggagaaccucaucuccuccuga

SEQ ID NO: 46915 - RNA, 816 nt, Artificial Sequence
  derived and/or modified sequence opt2 from NUBP2__Homo_sapiens__NP_036357
auggaggccgccgccgagcccggcaaccucgccggcguccgccacaucauccucguccucuccggcaagggcggcgucggcaaguccaccaucuccaccgagcucgcccucgcccuccgccacgccggcaagaaggucggcauccucgacgucgaccucugcggccccuccaucccccgcaugcucggcgcccagggccgcgccguccaccagugcgaccgcggcugggcccccgucuuccucgaccgcgagcaguccaucucccucauguccgucggcuuccuccucgagaagcccgacgaggccgucgucuggcgcggccccaagaagaacgcccucaucaagcaguucgucuccgacgucgccuggggcgagcucgacuaccucgucgucgacaccccccccggcaccuccgacgagcacauggccaccaucgaggcccuccgccccuaccagccccucggcgcccucgucgucaccaccccccaggccgucuccgucggcgacguccgccgcgagcucaccuucugccgcaagaccggccuccgcgucaugggcaucgucgagaacauguccggcuucaccugcccccacugcaccgagugcaccuccgucuucucccgcggcggcggcgaggagcucgcccagcucgccggcguccccuuccucggcuccgucccccucgaccccgcccucaugcgcacccucgaggagggccacgacuucauccaggaguuccccggcucccccgccuucgccgcccucaccuccaucgcccagaagauccucgacgccacccccgccugccuccccuga

SEQ ID NO: 46916 - RNA, 672 nt, Artificial Sequence
  derived and/or modified sequence opt2 from NUBPL__Homo_sapiens__NP_001188502
auguccaaggccaucggccuccucgacgucgacgucuacggccccuccguccccaagaugaugaaccucaagggcaaccccgagcucucccaguccaaccucaugcgcccccuccucaacuacggcaucgccugcauguccaugggcuuccucgucgaggaguccgagcccgucgucuggcgcggccucauggucauguccgccaucgagaagcuccuccgccaggucgacuggggccagcucgacuaccucgucgucgacaugccccccggcaccggcgacguccagcucuccgucucccagaacauccccaucaccggcgccgucaucgucuccaccccccaggacaucgcccucauggacgcccacaagggcgccgagauguuccgccgcguccacguccccguccucggccucguccagaacauguccgucuuccagugccccaagugcaagcacaagacccacaucuucggcgccgacggcgcccgcaagcucgcccagacccucggccucgagguccucggcgacaucccccuccaccucaacauccgcgaggccuccgacaccggccagcccaucgucuucucccagcccgaguccgacgaggccaaggccuaccuccgcaucgccgucgaggucguccgccgccuccccucccccuccgaguga

SEQ ID NO: 46917 - RNA, 1386 nt, Artificial Sequence
  derived and/or modified sequence opt2 from NUCB1__Homo_sapiens__NP_006175
augccccccuccggcccccgcggcacccuccuccuccucccccuccuccuccuccuccuccuccgcgccguccucgccgucccccucgagcgcggcgcccccaacaaggaggagacccccgccaccgagucccccgacaccggccucuacuaccaccgcuaccuccaggaggucaucgacguccucgagaccgacggccacuuccgcgagaagcuccaggccgccaacgccgaggacaucaaguccggcaagcucucccgcgagcucgacuucgucucccaccacguccgcaccaagcucgacgagcucaagcgccaggaggucucccgccuccgcaugcuccucaaggccaagauggacgccgagcaggaccccaacguccaggucgaccaccucaaccuccucaagcaguucgagcaccucgacccccagaaccagcacaccuucgaggcccgcgaccucgagcuccucauccagaccgccacccgcgaccucgcccaguacgacgccgcccaccacgaggaguucaagcgcuacgagaugcucaaggagcacgagcgccgccgcuaccucgagucccucggcgaggagcagcgcaaggaggccgagcgcaagcucgaggagcagcagcgccgccaccgcgagcaccccaaggucaacguccccggcucccaggcccagcucaaggaggucugggaggagcucgacggccucgaccccaaccgcuucaaccccaagaccuucuucauccuccacgacaucaacuccgacggcguccucgacgagcaggagcucgaggcccucuucaccaaggagcucgagaaggucuacgaccccaagaacgaggaggacgacaugcgcgagauggaggaggagcgccuccgcaugcgcgagcacgucaugaagaacgucgacaccaaccaggaccgccucgucacccucgaggaguuccucgccuccacccagcgcaaggaguucggcgacaccggcgagggcugggagaccgucgagaugcaccccgccuacaccgaggaggagcuccgccgcuucgaggaggagcucgccgcccgcgaggccgagcucaacgccaaggcccagcgccucucccaggagaccgaggcccucggccgcucccagggccgccucgaggcccagaagcgcgagcuccagcaggccguccuccacauggagcagcgcaagcagcagcagcagcagcagcagggccacaaggcccccgccgcccaccccgagggccagcucaaguuccaccccgacaccgacgacguccccguccccgcccccgccggcgaccagaaggaggucgacaccuccgagaagaagcuccucgagcgccuccccgaggucgaggucccccagcaccucuga

SEQ ID NO: 46918 - RNA, 1263 nt, Artificial Sequence
  derived and/or modified sequence opt2 from NUCB2__Homo_sapiens__NP_005004
augcgcuggcgcaccauccuccuccaguacugcuuccuccucaucaccugccuccucaccgcccucgaggccguccccaucgacaucgacaagaccaagguccagaacauccaccccgucgaguccgccaagaucgagccccccgacaccggccucuacuacgacgaguaccucaagcaggucaucgacguccucgagaccgacaagcacuuccgcgagaagcuccagaaggccgacaucgaggagaucaaguccggccgccucuccaaggagcucgaccucgucucccaccacguccgcaccaagcucgacgagcucaagcgccaggaggucggccgccuccgcaugcucaucaaggccaagcucgacucccuccaggacaucggcauggaccaccaggcccuccucaagcaguucgaccaccucaaccaccucaaccccgacaaguucgaguccaccgaccucgacaugcucaucaaggccgccaccuccgaccucgagcacuacgacaagacccgccacgaggaguucaagaaguacgagaugaugaaggagcacgagcgccgcgaguaccucaagacccucaacgaggagaagcgcaaggaggaggaguccaaguucgaggagaugaagaagaagcacgagaaccaccccaaggucaaccaccccggcuccaaggaccagcucaaggaggucugggaggagaccgacggccucgaccccaacgacuucgaccccaagaccuucuucaagcuccacgacgucaacuccgacggcuuccucgacgagcaggagcucgaggcccucuucaccaaggagcucgagaaggucuacgaccccaagaacgaggaggacgacauggucgagauggaggaggagcgccuccgcaugcgcgagcacgucaugaacgaggucgacaccaacaaggaccgccucgucacccucgaggaguuccucaaggccaccgagaagaaggaguuccucgagcccgacuccugggagacccucgaccagcagcaguucuucaccgaggaggagcucaaggaguacgagaacaucaucgcccuccaggagaacgagcucaagaagaaggccgacgagcuccagaagcagaaggaggagcuccagcgccagcacgaccagcucgaggcccagaagcucgaguaccaccaggucauccagcagauggagcagaagaagcuccagcagggcaucccccccuccggccccgccggcgagcucaaguucgagccccacaucuga

SEQ ID NO: 46919 - RNA, 732 nt, Artificial Sequence
  derived and/or modified sequence opt2 from NUCKS1__Homo_sapiens__NP_073568
augucccgccccguccgcaaccgcaaggucgucgacuacucccaguuccaggaguccgacgacgccgacgaggacuacggccgcgacuccggcccccccaccaagaagauccgcuccuccccccgcgaggccaagaacaagcgccgcuccggcaagaacucccaggaggacuccgaggacuccgaggacaaggacgucaagaccaagaaggacgacucccacuccgccgaggacuccgaggacgagaaggaggaccacaagaacguccgccagcagcgccaggccgccuccaaggccgccuccaagcagcgcgagaugcucauggaggacgucggcuccgaggaggagcaggaggaggaggacgaggcccccuuccaggagaaggacuccggcuccgacgaggacuuccucauggaggacgacgacgacuccgacuacggcuccuccaagaagaagaacaagaagauggucaagaaguccaagcccgagcgcaaggagaagaagaugcccaagccccgccucaaggccaccgucacccccucccccgucaagggcaagggcaaggucggccgccccaccgccuccaaggccuccaaggagaagacccccucccccaaggaggaggacgaggagcccgaguccccccccgagaagaagaccuccaccucccccccccccgagaaguccggcgacgagggcuccgaggacgaggcccccuccggcgaggacuga

SEQ ID NO: 46920 - RNA, 1665 nt, Artificial Sequence
  derived and/or modified sequence opt2 from NUDCD1__Homo_sapiens__NP_001121683
augcucuaccuccagggcugguccaugcccgccgucgccgaggucaagcuccgcgacgaccaguacacccucgagcacaugcacgccuucggcauguacaacuaccuccacugcgacuccugguaccaggacuccgucuacuacaucgacacccucggccgcaucaugaaccucaccgucaugcucgacaccgcccucggcaagccccgcgaggucuuccgccuccccaccgaccucaccgccugcgacaaccgccucugcgccuccauccacuucuccuccuccaccugggucacccucuccgacggcaccggccgccucuacgucaucggcaccggcgagcgcggcaacuccgccuccgagaagugggagaucauguucaacgaggagcucggcgaccccuucaucaucauccacuccaucucccuccucaacgccgaggagcacuccaucgccacccuccuccuccgcaucgagaaggaggagcucgacaugaagggcuccggcuucuacgucucccucgagugggucaccaucuccaagaagaaccaggacaacaagaaguacgagaucaucaagcgcgacauccuccgcggcaaguccgucccccacuacgccgccaucgagcccgacggcaacggccucaugaucgucuccuacaagucccucaccuucguccaggccggccaggaccucgaggagaacauggacgaggacaucuccgagaagaucaaggagccccucuacuacuggcagcagaccgaggacgaccucaccgucaccauccgccuccccgaggacuccaccaaggaggacauccagauccaguuccuccccgaccacaucaacaucguccucaaggaccaccaguuccucgagggcaagcucuacuccuccaucgaccacgaguccuccaccuggaucaucaaggaguccaacucccucgagaucucccucaucaagaagaacgagggccucaccuggcccgagcucgucaucggcgacaagcagggcgagcucauccgcgacuccgcccagugcgccgccaucgccgagcgccucaugcaccucaccuccgaggagcucaaccccaaccccgacaaggagaagccccccugcaacgcccaggagcucgaggagugcgacaucuucuucgaggaguccuccucccucugccgcuucgacggcaacacccucaagaccacccacgucgucaaccucggcuccaaccaguaccucuucuccgucaucgucgaccccaaggagaugcccugcuucugccuccgccacgacgucgacgcccuccucuggcagccccacuccuccaagcaggacgacaugugggagcacaucgccaccuucaacgcccucggcuacguccaggccuccaagcgcgacaagaaguucuucgccugcgcccccaacuacuccuacgccgcccucugcgagugccuccgccgcgucuucaucuaccgccagcccgcccccauguccaccguccucuacaaccgcaaggagggccgccaggucggccaggucgccaagcagcaggucgccucccucgagaccaacgaccccauccucggcuuccaggccaccaacgagcgccucuucguccucaccaccaagaaccucuuccucaucaaggucaacaccgagaacuga

SEQ ID NO: 46921 - RNA, 1086 nt, Artificial Sequence
  derived and/or modified sequence opt2 from NUDCD3__Homo_sapiens__NP_056147
auggagaccggcgccgccgagcucuacgaccaggcccuccucggcauccuccagcacgucggcaacguccaggacuuccuccgcguccucuucggcuuccucuaccgcaagaccgacuucuaccgccuccuccgccaccccuccgaccgcaugggcuucccccccggcgccgcccaggcccucguccuccaggucuucaagaccuucgaccacauggcccgccaggacgacgagaagcgccgccaggagcucgaggagaagauccgccgcaaggaggaggaggaggccaagaccgucuccgccgccgccgccgagaaggagcccguccccguccccguccaggagaucgagaucgacuccaccaccgagcucgacggccaccaggaggucgagaagguccagccccccggccccgucaaggagauggcccacggcucccaggaggccgaggcccccggcgccgucgccggcgccgccgaggucccccgcgagccccccauccucccccgcauccaggagcaguuccagaagaaccccgacuccuacaacggcgccguccgcgagaacuacaccuggucccaggacuacaccgaccucgagguccgcguccccguccccaagcacgucgucaagggcaagcaggucuccgucgcccucuccuccuccuccauccgcgucgccaugcucgaggagaacggcgagcgcguccucauggagggcaagcucacccacaagaucaacaccgaguccucccucuggucccucgagcccggcaagugcguccucgucaaccucuccaaggucggcgaguacugguggaacgccauccucgagggcgaggagcccaucgacaucgacaagaucaacaaggagcgcuccauggccaccgucgacgaggaggagcaggccguccucgaccgccucaccuucgacuaccaccagaagcuccagggcaagccccagucccacgagcucaagguccacgagaugcucaagaagggcugggacgccgagggcucccccuuccgcggccagcgcuucgaccccgccauguucaacaucucccccggcgccguccaguucuga

SEQ ID NO: 46922 - RNA, 1008 nt, Artificial Sequence
  derived and/or modified sequence opt2 from NUDC__Homo_sapiens__XP_011538831
augaucuccaacuaccgcaacggcuccgagcucgucugcuucaacuccggcgucggcugcuuccucaucggcugcgacugggccuucaccguccucgucaacaccuucuucuccuuccuccgccgcaagaccgacuucuucaucggcggcgaggagggcauggccgagaagcucaucacccagaccuucucccaccacaaccagcucgcccagaagacccgccgcgagaagcgcgcccgccaggaggccgagcgccgcgagaaggccgagcgcgccgcccgccucgccaaggaggccaaguccgagaccuccggcccccagaucaaggagcucaccgacgaggaggccgagcgccuccagcucgagaucgaccagaagaaggacgccgagaaccacgaggcccagcucaagaacggcucccucgacucccccggcaagcaggacaccgaggaggacgaggaggaggacgagaaggacaagggcaagcucaagcccaaccucggcaacggcgccgaccuccccaacuaccgcuggacccagacccucuccgagcucgaccucgccguccccuucugcgucaacuuccgccucaagggcaaggacauggucgucgacauccagcgccgccaccuccgcgucggccucaagggccagcccgccaucaucgacggcgagcucuacaacgaggucaaggucgaggaguccuccuggcucaucgaggacggcaaggucgucaccguccaccucgagaagaucaacaagauggagugguggucccgccucgucuccuccgaccccgagaucaacaccaagaagaucaaccccgagaacuccaagcucuccgaccucgacuccgagacccgcuccauggucgagaagaugauguacgaccagcgccagaaguccaugggccuccccaccuccgacgagcagaagaagcaggagauccucaagaaguucauggaccagcaccccgagauggacuucuccaaggccaaguucaacuga

SEQ ID NO: 46923 - RNA, 495 nt, Artificial Sequence
  derived and/or modified sequence opt2 from NUDT10__Homo_sapiens__NP_001291892
augaagugcaagcccaaccagacccgcaccuacgaccccgagggcuucaagaagcgcgccgccugccucugcuuccgcuccgagcgcgaggacgagguccuccucgucuccuccucccgcuaccccgaccgcuggaucguccccggcggcggcauggagcccgaggaggagcccggcggcgccgccguccgcgaggucuacgaggaggccggcgucaagggcaagcucggccgccuccucggcgucuucgagcagaaccaggaccccaagcaccgcaccuacgucuacguccucaccgucaccgagcuccucgaggacugggaggacuccgucuccaucggccgcaagcgcgagugguucaaggucgaggacgccaucaagguccuccagugccacaagcccguccacgccgaguaccucgagaagcucaagcucggcggcucccccaccaacggcaacuccauggcccccuccucccccgacuccgaccccuga

SEQ ID NO: 46924 - RNA, 495 nt, Artificial Sequence
  derived and/or modified sequence opt2 from NUDT11__Homo_sapiens__NP_060629
augaagugcaagcccaaccagacccgcaccuacgaccccgagggcuucaagaagcgcgccgccugccucugcuuccgcuccgagcgcgaggacgagguccuccucgucuccuccucccgcuaccccgaccgcuggaucguccccggcggcggcauggagcccgaggaggagcccggcggcgccgccguccgcgaggucuacgaggaggccggcgucaagggcaagcucggccgccuccucggcgucuucgagcagaaccaggaccgcaagcaccgcaccuacgucuacguccucaccgucaccgagcuccucgaggacugggaggacuccgucuccaucggccgcaagcgcgagugguucaaggucgaggacgccaucaagguccuccagugccacaagcccguccacgccgaguaccucgagaagcucaagcucggcggcucccccaccaacggcaacuccauggcccccuccucccccgacuccgaccccuga

SEQ ID NO: 46925 - RNA, 495 nt, Artificial Sequence
  derived and/or modified sequence opt2 from NUDT15__Homo_sapiens__NP_060753
augaccgccuccgcccagccccgcggccgccgccccggcgucggcgucggcgucgucgucaccuccugcaagcacccccgcugcguccuccucggcaagcgcaagggcuccgucggcgccggcuccuuccagcuccccggcggccaccucgaguucggcgagaccugggaggagugcgcccagcgcgagaccugggaggaggccgcccuccaccucaagaacguccacuucgccuccgucgucaacuccuucaucgagaaggagaacuaccacuacgucaccauccucaugaagggcgaggucgacgucacccacgacuccgagcccaagaacgucgagcccgagaagaacgaguccugggaguggguccccugggaggagcuccccccccucgaccagcucuucuggggccuccgcugccucaaggagcagggcuacgaccccuucaaggaggaccucaaccaccucgucggcuacaagggcaaccaccucuga

SEQ ID NO: 46926 - RNA, 1128 nt, Artificial Sequence
  derived and/or modified sequence opt2 from NUDT19__Homo_sapiens__NP_001099040
auguccuccucccuccgccccggccccucccgcuggcgccgcgccgccuccaucguccucgccgccggcuggucccgccccgagaccgccaccccccccucccgccccccccccgccgagggcuuccgccuccuccuccuccagcgcuccccccaccagggcuucaugcccggcgcccacgucuucuccggcggcguccucgacgccgccgaccgcuccgccgacuggcucggccucuucgccccccaccacggccccccccgcuucggccucggccccgcccccuucucccgcaccgccuuccccucccuccccgacaccgacgaccacaagaccgacaacaccggcacccuccccgaggacgucgccuuccgcaucugcgccguccgcgaggccuucgaggaggccggcguccuccuccuccgcccccgcaccuccccccccggccccgcccccggccccggccucgcccucgagcccccccccggccucgccuccuggcgcgaccgcguccgccaggacccccgccacuuccuccgccucugcgcccaccucgacugcacccccgacaucugggcccuccacaacugguccgccuggcucacccccuuccuccgcggcaccacccgccgcuucgacaccgccuucuuccucugcugccuccgcgagcccccccccgucuaccccgaccucgccgaggucgucggcuaccagugguccucccccuccgaggccaccgaguccuuccucuccaaggagaucuggcucccccccccccaguucuacgagguccgccgccucgccaacuucgccucccucuccgaccuccacaaguucugccucggccgcgcccucgagggccucgagcgcuggcuccccaucauccuccucaccgccgacggcaugguccaccuccuccccggcgacgagcucuaccucgaggacuccgacuuccucgagaaccucauguccaccgagaagaagaccgaggagaucaugaaggagggcaagcaguuccaccgcaucgucaccuaccaccgccaccucuacgacauccacgucaccguccagcccaaguacaagcacgucuaccccaagaacuccgucguccgcaagucccaccucuga

SEQ ID NO: 46927 - RNA, 471 nt, Artificial Sequence
  derived and/or modified sequence opt2 from NUDT1__Homo_sapiens__NP_945191
augggcgccucccgccucuacacccucguccucguccuccagccccagcgcguccuccucggcaugaagaagcgcggcuucggcgccggccgcuggaacggcuucggcggcaagguccaggagggcgagaccaucgaggacggcgcccgccgcgagcuccaggaggaguccggccucaccgucgacgcccuccacaaggucggccagaucgucuucgaguucgucggcgagcccgagcucauggacguccacgucuucugcaccgacuccauccagggcacccccgucgaguccgacgagaugcgccccugcugguuccagcucgaccagauccccuucaaggacauguggcccgacgacuccuacugguucccccuccuccuccagaagaagaaguuccacggcuacuucaaguuccagggccaggacaccauccucgacuacacccuccgcgaggucgacaccgucuga

SEQ ID NO: 46928 - RNA, 684 nt, Artificial Sequence
  derived and/or modified sequence opt2 from NUDT21__Homo_sapiens__NP_008937
auguccgucgucccccccaaccgcucccagaccggcuggccccgcggcgucacccaguucggcaacaaguacauccagcagaccaagccccucacccucgagcgcaccaucaaccucuacccccucaccaacuacaccuucggcaccaaggagccccucuacgagaaggacuccuccgucgccgcccgcuuccagcgcaugcgcgaggaguucgacaagaucggcaugcgccgcaccgucgagggcguccucaucguccacgagcaccgccucccccacguccuccuccuccagcucggcaccaccuucuucaagcuccccggcggcgagcucaaccccggcgaggacgaggucgagggccucaagcgccucaugaccgagauccucggccgccaggacggcguccuccaggacugggucaucgacgacugcaucggcaacugguggcgccccaacuucgagcccccccaguaccccuacauccccgcccacaucaccaagcccaaggagcacaagaagcucuuccucguccagcuccaggagaaggcccucuucgccguccccaagaacuacaagcucgucgccgccccccucuucgagcucuacgacaacgcccccggcuacggccccaucaucuccucccucccccagcuccucucccgcuucaacuucaucuacaacuga

SEQ ID NO: 46929 - RNA, 444 nt, Artificial Sequence
  derived and/or modified sequence opt2 from NUDT2__Homo_sapiens__NP_671702
auggcccuccgcgccugcggccucaucaucuuccgccgcugccucauccccaaggucgacaacaacgccaucgaguuccuccuccuccaggccuccgacggcauccaccacuggaccccccccaagggccacgucgagcccggcgaggacgaccucgagaccgcccuccgcgagacccaggaggaggccggcaucgaggccggccagcucaccaucaucgagggcuucaagcgcgagcucaacuacgucgcccgcaacaagcccaagaccgucaucuacuggcucgccgaggucaaggacuacgacgucgagauccgccucucccacgagcaccaggccuaccgcuggcucggccucgaggaggccugccagcucgcccaguucaaggagaugaaggccgcccuccaggagggccaccaguuccucugcuccaucgaggccuga

SEQ ID NO: 46930 - RNA, 519 nt, Artificial Sequence
  derived and/or modified sequence opt2 from NUDT3__Homo_sapiens__NP_006694
augaugaagcucaaguccaaccagacccgcaccuacgacggcgacggcuacaagaagcgcgccgccugccucugcuuccgcuccgaguccgaggaggagguccuccucgucuccuccucccgccaccccgaccgcuggaucguccccggcggcggcauggagcccgaggaggagcccuccgucgccgccguccgcgaggucugcgaggaggccggcgucaagggcacccucggccgccucgucggcaucuucgagaaccaggagcgcaagcaccgcaccuacgucuacguccucaucgucaccgagguccucgaggacugggaggacuccgucaacaucggccgcaagcgcgagugguucaagaucgaggacgccaucaagguccuccaguaccacaagcccguccaggccuccuacuucgagacccuccgccagggcuacuccgccaacaacggcacccccgucgucgccaccaccuacuccgucuccgcccaguccuccauguccggcauccgcuga

SEQ ID NO: 46931 - RNA, 951 nt, Artificial Sequence
  derived and/or modified sequence opt2 from NUDT6__Homo_sapiens__NP_009014
augcgccagccccucuccuggggccgcuggcgcgccaugcucgcccgcaccuacggccccggccccuccgccggcuaccgcugggccuccggcgcccagggcuacguccgcaacccccccgucggcgccugcgaccuccagggcgagcucgaccgcuucggcggcaucuccguccgccucgcccgccucgacgcccucgaccgccucgacgccgccgccuuccagaagggccuccaggccgccguccagcaguggcgcuccgagggccgcaccgccgucuggcuccacauccccauccuccagucccgcuucaucgcccccgccgccucccucggcuucugcuuccaccacgccgaguccgacuccuccacccucacccucuggcuccgcgagggccccucccgccuccccggcuacgccucccaccaggucggcgucgccggcgccgucuucgacgaguccacccgcaagauccucgucguccaggaccgcaacaagcucaagaacauguggaaguuccccggcggccucuccgagcccgaggaggacaucggcgacaccgccguccgcgaggucuucgaggagaccggcaucaaguccgaguuccgcuccguccucuccauccgccagcagcacaccaaccccggcgccuucggcaaguccgacauguacaucaucugccgccucaagcccuacuccuucaccaucaacuucugccaggaggagugccuccgcugcgaguggauggaccucaacgaccucgccaagaccgagaacaccacccccaucaccucccgcgucgcccgccuccuccucuacggcuaccgcgagggcuucgacaagaucgaccucaccgucgaggagcuccccgccgucuacaccggccucuucuacaagcucuaccacaaggagcuccccgagaacuacaagaccaugaagggcaucgacuga

SEQ ID NO: 46932 - RNA, 717 nt, Artificial Sequence
  derived and/or modified sequence opt2 from NUDT7__Homo_sapiens__NP_001099133
augucccgccucggccuccccgaggagcccguccgcaacucccuccucgacgacgccaaggcccgccuccgcaaguacgacaucggcggcaaguacucccaccuccccuacaacaaguacuccguccuccucccccucgucgccaaggagggcaagcuccaccuccucuucaccguccgcuccgagaagcuccgccgcgcccccggcgaggucugcuuccccggcggcaagcgcgaccccaccgacauggacgacgccgccaccgcccuccgcgaggcccaggaggaggucggccuccgcccccaccaggucgaggucgucugcugccucguccccugccucaucgacaccgacacccucaucacccccuucgucggccucaucgaccacaacuuccaggcccagcccaaccccgccgaggucaaggacgucuuccucgucccccucgccuacuuccuccacccccagguccacgaccagcacuacgucacccgccucggccaccgcuucaucaaccacaucuucgaguacaccaaccccgaggacggcgucaccuaccagaucaagggcaugaccgccaaccucgccguccucgucgccuucaucauccucgagaagaagcccaccuucgagguccaguucaaccucaacgacguccucgccuccuccgaggagcucuuccucaagguccacaagaaggccaccucccgccucuga

SEQ ID NO: 46933 - RNA, 1395 nt, Artificial Sequence
  derived and/or modified sequence opt2 from NUF2__Homo_sapiens__NP_663735
auggagacccucuccuucccccgcuacaacgucgccgagaucgucauccacauccgcaacaagauccucaccggcgccgacggcaagaaccucaccaagaacgaccucuaccccaaccccaagcccgagguccuccacaugaucuacaugcgcgcccuccagaucgucuacggcauccgccucgagcacuucuacaugaugcccgucaacuccgaggucauguacccccaccucauggagggcuuccuccccuucuccaaccucgucacccaccucgacuccuuccuccccaucugccgcgucaacgacuucgagaccgccgacauccucugccccaaggccaagcgcaccucccgcuuccucuccggcaucaucaacuucauccacuuccgcgaggccugccgcgagaccuacauggaguuccucuggcaguacaaguccuccgccgacaagaugcagcagcucaacgccgcccaccaggaggcccucaugaagcucgagcgccucgacuccguccccgucgaggagcaggaggaguucaagcagcucuccgacggcauccaggagcuccagcagucccucaaccaggacuuccaccagaagaccaucguccuccaggagggcaacucccagaagaaguccaacaucuccgagaagaccaagcgccucaacgagcucaagcucuccgucgucucccucaaggagauccaggagucccucaagaccaagaucgucgacucccccgagaagcucaagaacuacaaggagaagaugaaggacaccguccagaagcucaagaacgcccgccaggaggucgucgagaaguacgagaucuacggcgacuccgucgacugccuccccuccugccagcucgagguccagcucuaccagaagaagauccaggaccucuccgacaaccgcgagaagcucgccuccauccucaaggagucccucaaccucgaggaccagaucgaguccgacgaguccgagcucaagaagcucaagaccgaggagaacuccuucaagcgccucaugaucgucaagaaggagaagcucgccaccgcccaguucaagaucaacaagaagcacgaggacgucaagcaguacaagcgcaccgucaucgaggacugcaacaagguccaggagaagcgcggcgccgucuacgagcgcgucaccaccaucaaccaggagauccagaagaucaagcucggcauccagcagcucaaggacgccgccgagcgcgagaagcucaagucccaggagaucuuccucaaccucaagaccgcccucgagaaguaccacgacggcaucgagaaggccgccgaggacuccuacgccaagaucgacgagaagaccgccgagcucaagcgcaagauguucaagauguccaccuga

SEQ ID NO: 46934 - RNA, 1488 nt, Artificial Sequence
  derived and/or modified sequence opt2 from NUFIP1__Homo_sapiens__NP_036477
auggccgagcccaccuccgacuucgagacccccaucggcuggcacgccucccccgagcucacccccacccucggcccccucuccgacaccgcccccccccgcgacuccuggauguucugggccaugcuccccccccccccccccccccucaccuccucccuccccgccgccggcuccaagcccuccuccgagucccagccccccauggaggcccagucccuccccggcgcccccccccccuucgacgcccagauccuccccggcgcccagccccccuucgacgcccaguccccccucgacucccagccccagcccuccggccagcccuggaacuuccacgccuccaccuccugguacuggcgccaguccuccgaccgcuucccccgccaccagaaguccuucaaccccgccgucaagaacuccuacuacccccgcaaguacgacgccaaguucaccgacuucucccucccccccucccgcaagcagaagaagaagaagcgcaaggagcccgucuuccacuucuucugcgacaccugcgaccgcggcuucaagaaccaggagaaguacgacaagcacauguccgagcacaccaagugccccgagcucgacugcuccuucaccgcccacgagaagaucguccaguuccacuggcgcaacaugcacgcccccggcaugaagaagaucaagcucgacacccccgaggagaucgcccgcuggcgcgaggagcgccgcaagaacuaccccacccucgccaacaucgagcgcaagaagaagcucaagcucgagaaggagaagcgcggcgccguccucaccaccacccaguacggcaagaugaagggcaugucccgccacucccagauggccaagauccgcucccccggcaagaaccacaaguggaagaacgacaacucccgccagcgcgccgucaccggcuccggcucccaccucugcgaccucaagcucgagggcccccccgaggccaacgccgacccccucggcguccucaucaacuccgacuccgaguccgacaaggaggagaagccccagcacuccgucauccccaaggaggucacccccgcccucugcucccucauguccuccuacggcucccucuccggcuccgaguccgagcccgaggagacccccaucaagaccgaggccgacguccucgccgagaaccagguccucgacuccuccgcccccaagucccccucccaggacgucaaggccaccguccgcaacuucuccgaggccaaguccgagaaccgcaagaaguccuucgagaagaccaaccccaagcgcaagaaggacuaccacaacuaccagacccucuucgagccccgcacccaccaccccuaccuccucgagaugcuccucgcccccgacauccgccacgagcgcaacgucauccuccagugcguccgcuacaucaucaagaaggacuucuucggccucgacaccaacuccgccaaguccaaggacgucuga

SEQ ID NO: 46935 - RNA, 2088 nt, Artificial Sequence
  derived and/or modified sequence opt2 from NUFIP2__Homo_sapiens__NP_065823
auggaggagaagcccggccagccccagccccagcaccaccacucccaccaccacccccaccaccacccccagcagcagcagcagcagccccaccaccaccaccacuacuacuucuacaaccacucccacaaccaccaccaccaccaccaccaccagcagccccaccaguaccuccagcacggcgccgagggcucccccaaggcccagcccaagccccucaagcacgagcagaagcacacccuccagcagcaccaggagacccccaagaagaagaccggcuacggcgagcucaacggcaacgccggcgagcgcgagaucucccucaagaaccucuccuccgacgaggccaccaaccccaucucccgcguccucaacggcaaccagcaggucgucgacaccucccucaagcagaccgucaaggccaacaccuucggcaaggccggcaucaagaccaagaacuucauccagaagaacuccauggacaagaagaacggcaaguccuacgagaacaaguccggcgagaaccaguccgucgacaaguccgacaccauccccauccccaacggcgucgucaccaacaacuccggcuacaucaccaacggcuacaugggcaagggcgccgacaacgacggcuccggcuccgaguccggcuacaccacccccaagaagcgcaaggcccgccgcaacuccgccaagggcugcgagaaccucaacaucguccaggacaagaucaugcagcaggagaccuccguccccacccucaagcagggccucgagaccuucaagcccgacuacuccgagcagaagggcaaccgcgucgacggcuccaagcccaucuggaaguacgagaccggccccggcggcaccucccgcggcaagcccgccgucggcgacaugcuccgcaaguccuccgacuccaagcccggcgucuccuccaagaaguucgacgaccgccccaagggcaagcacgccuccgccgucgccuccaaggaggacuccuggacccucuucaagcccccccccgucuuccccgucgacaacuccuccgccaagaucguccccaagaucuccuacgccuccaaggucaaggagaaccucaacaagaccauccagaacuccuccgucucccccaccuccuccuccuccuccuccuccuccaccggcgagacccagacccaguccuccucccgccucucccagguccccauguccgcccucaaguccgucaccuccgccaacuucuccaacggccccguccucgccggcaccgacggcaacgucuacccccccggcggccagccccuccucaccaccgccgccaacacccucacccccaucuccuccggcaccgacuccguccuccaggacaugucccucaccuccgccgccgucgagcagaucaagaccucccucuucaucuaccccuccaacaugcagaccaugcuccucuccaccgcccaggucgaccuccccucccagaccgaccagcagaaccucggcgacaucuuccagaaccaguggggccucuccuucaucaacgagcccuccgccggccccgagaccgucaccggcaaguccuccgagcacaaggucauggaggucaccuuccagggcgaguaccccgccacccucgucucccagggcgccgagaucauccccuccggcaccgagcaccccgucuuccccaaggccuacgagcucgagaagcgcaccuccccccagguccucggcuccauccucaaguccggcaccaccuccgaguccggcgcccucucccucgagcccucccacaucggcgaccuccagaaggccgacaccuccucccagggcgcccucgucuuccucuccaaggacuacgagaucgagucccagaacccccucgccucccccaccaacacccuccucggcuccgccaaggagcagcgcuaccagcgcggccucgagcgcaacgacuccuggggcuccuucgaccuccgcgccgccaucgucuaccacaccaaggagauggaguccaucuggaaccuccagaagcaggaccccaagcgcaucaucaccuacaacgaggccauggacucccccgaccaguga

SEQ ID NO: 46936 - RNA, 2391 nt, Artificial Sequence
  derived and/or modified sequence opt2 from NUGGC__Homo_sapiens__NP_001010906
auggccgagaccaaggacgucuucggccaggagccccaccccgucgaggacgaccucuacaaggagcgcacccgcaagcgccgcaaguccgaccgcgaccagcgcuuccgcgccuuccccuccauggagcaguccgcccucaaggaguacgagaagcucgagucccgcacccgccgcguccucuccaacaccuaccagaagcucauccaguccgucuuccucgacgacuccauccccaacggcgucaaguaccucaucaaccgccuccucgcccucaucgagaagcccaccgucgaccccaucuacaucgcccucuucggcuccaccggcgccggcaaguccucccucaucaacgccaucauccagcaggccauguuccuccccgucuccggcgaguccaucugcaccuccugcaucguccaggucuccuccggcugcugcguccaguacgaggccaagauccaccuccucuccgaccaggaguggcgcgaggagcucaagaaccucaccaagcuccuccaccgcaccgaggagcucucccgcgaggaggccgacgccuggaaccgcgacgaggccgucgaggaggccaccuggaagcuccagaugaucuacggcaacggcgccgaguccaagaacuacgaggagcuccuccgcgccaagcccaagcgcaagauccccaccucccgcgucaucacccucaaggccgaggaggccgaggagcucuccaucaagcucgaccccuacauccgcacccagcgccgcgacugggacggcgaggccgccgagaugcgcaucuggccccucaucaagcacgucgaggucacccuccccaaguccgaccucauccccgagggcgucguccucgucgacauccccggcaccggcgacuucaacuccaagcgcgacgagauguggaagaagaccaucgacaagugcuccgucaucugggucaucuccgacaucgagcgcgucuccggcggccaggcccacgaggaccuccucaacgaguccaucaaggccugccagcgcggcuucugccgcgacgucgcccucgucgucaccaagauggacaagcuccaccuccccgaguaccuccgcgagcgcaaggccggcaaccaggccauccagucccagcgcgaggccguccucgagcgcaacgagaugaucaagcuccagcgcacccgcauccucaaggagaagcucaagcgcaagcuccccgccgacuucaagguccucgaggccuccgaccucgucuacaccgucuccgcccaggaguacuggcagcaggcccuccucaccgaggaggagaccgagauccccaagcuccgcgaguacauccgcaagucccuccucgacaagaagaagcgcaccgucaccaaguacgucaccgaggccuucggccuccuccuccucaccgacuccuucaacuccacccagaaccuccccaacgagcaccuccacauguccguccuccgccgcuucgccgaggagaaggucgagcuccucgagaaggccaucgcccagugcuucgccugcauggagcagccccuccaggagggcguccgcaccgcccgcaccuccuaccgcugcauccuccgcgccugccucguccgcuccaagggcaaccagggcuuccaccagacccucaaggccgucugccucaagaacggcaucuacgccucccgcacccucgcccgcaucgaccucaacgaggcccucacccagcccgucuacgaccagaucgaccccgucuucggcuccaucuuccgcaccggcaagcccaccggcuccgcccucaugccccacaucgacgccuucaagcagucccuccaggagaagaugaccgagaucggcauccgcuccggcuggaaguacgacuccugcaagaagaacuuccucauccaggagaucuccgccauccucggcggccucgaggaccacauccuccgccgcaagcgccgcaucuacgagucccucaccgccuccguccaguccgaccucaagcucugcuacgaggaggccgcccagaucaccggcaagaaggccugcgagcgcaugaaggacgccauccgccgcggcgucgaccgccaggucgccgagggcauguucgagcgcgcccaggagcgcaugcagcaccaguuccagcagcucaagaccggcaucgucgagaaggucaagggcuccaucaccaccaugcucgcccucgccuccucccagggcgacggccucuacaaggagcucgccgacgucggcuccgaguacaaggagauggagaagcuccaccgcucccuccgcgaggucgccgagaacgcccgccuccgcaagggcaugcaggaguuccuccuccgcgccucccccuccaaggccggcccccccggcaccucccucuga

SEQ ID NO: 46937 - RNA, 6306 nt, Artificial Sequence
  derived and/or modified sequence opt2 from NUMA1__Homo_sapiens__NP_001273490
augacccuccacgccacccgcggcgccgcccuccucuccugggucaacucccuccacgucgccgaccccgucgaggccguccuccagcuccaggacugcuccaucuucaucaagaucaucgaccgcauccacggcaccgaggagggccagcagauccucaagcagcccgucuccgagcgccucgacuucgucugcuccuuccuccagaagaaccgcaagcaccccuccucccccgagugccucgucuccgcccagaagguccucgagggcuccgagcucgagcucgccaagaugaccaugcuccuccucuaccacuccaccauguccuccaaguccccccgcgacugggagcaguucgaguacaagauccaggccgagcucgccgucauccucaaguucguccucgaccacgaggacggccucaaccucaacgaggaccucgagaacuuccuccagaaggcccccguccccuccaccugcuccuccaccuuccccgaggagcucuccccccccucccaccaggccaagcgcgagauccgcuuccucgagcuccagaaggucgccuccuccuccuccggcaacaacuuccucuccggcucccccgccucccccaugggcgacauccuccagaccccccaguuccagaugcgccgccucaagaagcagcucgccgacgagcgcuccaaccgcgacgagcucgagcucgagcucgccgagaaccgcaagcuccucaccgagaaggacgcccagaucgccaugaugcagcagcgcaucgaccgccucgcccuccucaacgagaagcaggccgccuccccccucgagcccaaggagcucgaggagcuccgcgacaagaacgagucccucaccaugcgccuccacgagacccucaagcagugccaggaccucaagaccgagaagucccagauggaccgcaagaucaaccagcucuccgaggagaacggcgaccucuccuucaagcuccgcgaguucgccucccaccuccagcagcuccaggacgcccucaacgagcucaccgaggagcacuccaaggccacccaggaguggcucgagaagcaggcccagcucgagaaggagcucuccgccgcccuccaggacaagaagugccucgaggagaagaacgagauccuccagggcaagcucucccagcucgaggagcaccucucccagcuccaggacaaccccccccaggagaagggcgagguccucggcgacguccuccagcucgagacccucaagcaggaggccgccacccucgccgccaacaacacccagcuccaggcccgcgucgagaugcucgagaccgagcgcggccagcaggaggccaagcuccucgccgagcgcggccacuucgaggaggagaagcagcagcucuccucccucaucaccgaccuccaguccuccaucuccaaccucucccaggccaaggaggagcucgagcaggccucccaggcccacggcgcccgccucaccgcccaggucgccucccucaccuccgagcucaccacccucaacgccaccauccagcagcaggaccaggagcucgccggccucaagcagcaggccaaggagaagcaggcccagcucgcccagacccuccagcagcaggagcaggccucccagggccuccgccaccaggucgagcagcucuccuccucccucaagcagaaggagcagcagcucaaggaggucgccgagaagcaggaggccacccgccaggaccacgcccagcagcucgccaccgccgccgaggagcgcgaggccucccuccgcgagcgcgacgccgcccucaagcagcucgaggcccucgagaaggagaaggccgccaagcucgagauccuccagcagcagcuccaggucgccaacgaggcccgcgacuccgcccagaccuccgucacccaggcccagcgcgagaaggccgagcucucccgcaaggucgaggagcuccaggccugcgucgagaccgcccgccaggagcagcacgaggcccaggcccaggucgccgagcucgagcuccagcuccgcuccgagcagcagaaggccaccgagaaggagcgcgucgcccaggagaaggaccagcuccaggagcagcuccaggcccucaaggagucccucaaggucaccaagggcucccucgaggaggagaagcgccgcgccgccgacgcccucgaggagcagcagcgcugcaucuccgagcucaaggccgagacccgcucccucgucgagcagcacaagcgcgagcgcaaggagcucgaggaggagcgcgccggccgcaagggccucgaggcccgccuccagcagcucggcgaggcccaccaggccgagaccgagguccuccgccgcgagcucgccgaggccauggccgcccagcacaccgccgaguccgagugcgagcagcucgucaaggaggucgccgccuggcgcgagcgcuacgaggacucccagcaggaggaggcccaguacggcgccauguuccaggagcagcucaugacccucaaggaggagugcgagaaggcccgccaggagcuccaggaggccaaggagaaggucgccggcaucgagucccacuccgagcuccagaucucccgccagcagaacgagcucgccgagcuccacgccaaccucgcccgcgcccuccagcagguccaggagaaggagguccgcgcccagaagcucgccgacgaccucuccacccuccaggagaagauggccgccaccuccaaggaggucgcccgccucgagacccucguccgcaaggccggcgagcagcaggagaccgccucccgcgagcucgucaaggagcccgcccgcgccggcgaccgccagcccgaguggcucgaggagcagcagggccgccaguucugcuccacccaggccgcccuccaggccauggagcgcgaggccgagcagaugggcaacgagcucgagcgccuccgcgccgcccucauggagucccagggccagcagcaggaggagcgcggccagcaggagcgcgaggucgcccgccucacccaggagcgcggccgcgcccaggccgaccucgcccucgagaaggccgcccgcgccgagcucgagaugcgccuccagaacgcccucaacgagcagcgcgucgaguucgccacccuccaggaggcccucgcccacgcccucaccgagaaggagggcaaggaccaggagcucgccaagcuccgcggccucgaggccgcccagaucaaggagcucgaggagcuccgccagaccgucaagcagcucaaggagcagcucgccaagaaggagaaggagcacgccuccggcuccggcgcccaguccgaggccgccggccgcaccgagcccaccggccccaagcucgaggcccuccgcgccgaggucuccaagcucgagcagcagugccagaagcagcaggagcaggccgacucccucgagcgcucccucgaggccgagcgcgccucccgcgccgagcgcgacuccgcccucgagacccuccagggccagcucgaggagaaggcccaggagcucggccacucccaguccgcccucgccuccgcccagcgcgagcucgccgccuuccgcaccaagguccaggaccacuccaaggccgaggacgaguggaaggcccaggucgcccgcggccgccaggaggccgagcgcaagaacucccucaucuccucccucgaggaggaggucuccauccucaaccgccagguccucgagaaggagggcgaguccaaggagcucaagcgccucgucauggccgaguccgagaagucccagaagcucgaggagcgccuccgccuccuccaggccgagaccgccuccaacuccgcccgcgccgccgagcgcuccuccgcccuccgcgaggagguccagucccuccgcgaggaggccgagaagcagcgcgucgccuccgagaaccuccgccaggagcucaccucccaggccgagcgcgccgaggagcucggccaggagcucaaggccuggcaggagaaguucuuccagaaggagcaggcccucuccacccuccagcucgagcacaccuccacccaggcccucgucuccgagcuccuccccgccaagcaccucugccagcagcuccaggccgagcaggccgccgccgagaagcgccaccgcgaggagcucgagcaguccaagcaggccgccggcggccuccgcgccgagcuccuccgcgcccagcgcgagcucggcgagcucaucccccuccgccagaaggucgccgagcaggagcgcaccgcccagcagcuccgcgccgagaaggccuccuacgccgagcagcucuccaugcucaagaaggcccacggccuccucgccgaggagaaccgcggccucggcgagcgcgccaaccucggccgccaguuccucgaggucgagcucgaccaggcccgcgagaaguacguccaggagcucgccgccguccgcgccgacgccgagacccgccucgccgagguccagcgcgaggcccaguccaccgcccgcgagcucgaggucaugaccgccaaguacgagggcgccaaggucaagguccucgaggagcgccagcgcuuccaggaggagcgccagaagcucaccgcccaggucgaggagcucuccaagaagcucgccgacuccgaccaggccuccaagguccagcagcagaagcucaaggccguccaggcccagggcggcgagucccagcaggaggcccagcgccuccaggcccagcucaacgagcuccaggcccagcucucccagaaggagcaggccgccgagcacuacaagcuccagauggagaaggccaagacccacuacgacgccaagaagcagcagaaccaggagcuccaggagcagcuccgcucccucgagcagcuccagaaggagaacaaggagcuccgcgccgaggccgagcgccucggccacgagcuccagcaggccggccucaagaccaaggaggccgagcagaccugccgccaccucaccgcccagguccgcucccucgaggcccaggucgcccacgccgaccagcagcuccgcgaccucggcaaguuccaggucgccaccgacgcccucaagucccgcgagccccaggccaagccccagcucgaccucuccaucgacucccucgaccucuccugcgaggagggcaccccccucuccaucaccuccaagcucccccgcacccagcccgacggcaccuccguccccggcgagcccgccucccccaucucccagcgccucccccccaaggucgagucccucgagucccucuacuucacccccauccccgcccgcucccaggccccccucgaguccucccucgacucccucggcgacgucuuccucgacuccggccgcaagacccgcuccgcccgccgccgcaccacccagaucaucaacaucaccaugaccaagaagcucgacgucgaggagcccgacuccgccaacuccuccuucuacuccacccgcuccgcccccgccucccaggccucccuccgcgccaccuccuccacccagucccucgcccgccucggcucccccgacuacggcaacuccgcccuccucucccuccccggcuaccgccccaccacccgcuccuccgcccgccgcucccaggccggcgucuccuccggcgccccccccggccgcaacuccuucuacaugggcaccugccaggacgagcccgagcagcucgacgacuggaaccgcaucgccgagcuccagcagcgcaaccgcgucugccccccccaccucaagaccugcuacccccucgagucccgccccucccucucccucggcaccaucaccgacgaggagaugaagaccggcgacccccaggagacccuccgccgcgccuccaugcagcccauccagaucgccgagggcaccggcaucaccacccgccagcagcgcaagcgcgucucccucgagccccaccagggccccggcacccccgaguccaagaaggccaccuccugcuucccccgccccaugaccccccgcgaccgccacgagggccgcaagcaguccaccaccgaggcccagaagaaggccgcccccgccuccaccaagcaggccgaccgccgccaguccauggccuucuccauccucaacacccccaagaagcucggcaacucccuccuccgccgcggcgccuccaagaaggcccucuccaaggccucccccaacacccgcuccggcacccgccgcuccccccgcaucgccaccaccaccgccuccgccgccaccgccgccgccaucggcgccaccccccgcgccaagggcaaggccaagcacuga

SEQ ID NO: 46938 - RNA, 1779 nt, Artificial Sequence
  derived and/or modified sequence opt2 from NUMB__Homo_sapiens__NP_001005745
augaacaagcuccgccaguccuuccgccgcaagaaggacgucuacguccccgaggccucccgcccccaccaguggcagaccgacgaggagggcguccgcaccggcaagugcuccuuccccgucaaguaccucggccacgucgaggucgacgagucccgcggcaugcacaucugcgaggacgccgucaagcgccucaaggccaccggcaagaaggccgucaaggccguccucugggucuccgccgacggccuccgcgucgucgacgagaagaccaaggaccucaucgucgaccagaccaucgagaaggucuccuucugcgcccccgaccgcaacuucgaccgcgccuucuccuacaucugccgcgacggcaccacccgccgcuggaucugccacugcuucauggccgucaaggacaccggcgagcgccucucccacgccgucggcugcgccuucgccgccugccucgagcgcaagcagaagcgcgagaaggagugcggcgucaccgccaccuucgacgccucccgcaccaccuucacccgcgagggcuccuuccgcgucaccaccgccaccgagcaggccgagcgcgaggagaucaugaagcagaugcaggacgccaagaaggccgagaccgacaagaucgucgucggcuccuccgucgcccccggcaacaccgcccccucccccuccucccccaccucccccaccuccgacgccaccaccucccucgagaugaacaacccccacgccaucccccgccgccacgcccccaucgagcagcucgcccgccagggcuccuuccgcggcuuccccgcccucucccagaagaugucccccuucaagcgccagcucucccuccgcaucaacgagcuccccuccaccaugcagcgcaagaccgacuuccccaucaagaacgccguccccgaggucgagggcgaggccgaguccaucuccucccucugcucccagaucaccaacgccuucuccacccccgaggaccccuucuccuccgcccccaugaccaagcccgucaccgucgucgccccccagucccccaccuuccagggcaccgaguggggccaguccuccggcgccgccucccccggccucuuccaggccggccaccgccgcacccccuccgaggccgaccgcuggcucgaggaggucuccaaguccguccgcgcccagcagccccaggccuccgccgccccccuccagcccguccuccagccccccccccccaccgccaucucccagcccgccucccccuuccagggcaacgccuuccucaccucccagcccguccccgucggcgucguccccgcccuccagcccgccuucguccccgcccaguccuaccccgucgccaacggcaugcccuaccccgcccccaacguccccgucgucggcaucacccccucccagauggucgccaacgucuucggcaccgccggccacccccaggccgcccacccccaccagucccccucccucguccgccagcagaccuucccccacuacgaggccuccuccgccaccaccucccccuucuucaagccccccgcccagcaccucaacggcuccgccgccuucaacggcgucgacgacggccgccucgccuccgccgaccgccacaccgagguccccaccggcaccugccccgucgaccccuucgaggcccagugggccgcccucgagaacaaguccaagcagcgcaccaaccccucccccaccaaccccuucuccuccgaccuccagaagaccuucgagaucgagcucuga

SEQ ID NO: 46939 - RNA, 1707 nt, Artificial Sequence
  derived and/or modified sequence opt2 from NUMBL__Homo_sapiens__NP_001276909
augaacaagcuccgccagucccuccgccgccgcaagcccgccuacguccccgaggccucccgcccccaccaguggcaggccgacgaggacgccguccgcaagggcaccugcuccuuccccguccgcuaccucggccacgucgaggucgaggagucccgcggcaugcacgucugcgaggacgccgucaagaagcucaaggccaugggccgcaaguccgucaaguccguccucugggucuccgccgacggccuccgcgucgucgacgacaagaccaaggaccuccucgucgaccagaccaucgagaaggucuccuucugcgcccccgaccgcaaccucgacaaggccuucuccuacaucugccgcgacggcaccacccgccgcuggaucugccacugcuuccucgcccucaaggacuccggcgagcgccucucccacgccgucggcugcgccuucgccgccugccucgagcgcaagcagcgccgcgagaaggagugcggcgucaccgccgccuucgacgccucccgcaccuccuucgcccgcgagggcuccuuccgccucuccggcggcggccgccccgccgagcgcgaggcccccgacaagaagaaggccgaggccgccgccgcccccaccgucgcccccggccccgcccagcccggccacgucucccccacccccgccaccaccucccccggcgagaagggcgaggccggcacccccgucgccgccggcaccaccgccgccgccaucccccgccgccacgccccccucgagcagcucguccgccagggcuccuuccgcggcuuccccgcccucucccagaagaacucccccuucaagcgccagcucucccuccgccucaacgagcuccccuccacccuccagcgccgcaccgacuuccaggucaagggcaccguccccgagauggagccccccggcgccggcgacuccgacuccaucaacgcccucugcacccagaucuccuccuccuucgccuccgccggcgcccccgcccccggccccccccccgccaccaccggcaccuccgccuggggcgagcccuccgucccccccgccgccgccuuccagcccggccacaagcgcacccccuccgaggccgagcgcuggcucgaggaggucucccaggucgccaaggcccagcagcagcagcagcagcagcagcagcagcagcagcagcagcagcagcagcagcagcaggccgccuccgucgcccccguccccaccaugccccccgcccuccagcccuuccccgcccccgucggccccuucgacgccgcccccgcccaggucgccgucuuccucccccccccccacaugcagccccccuucguccccgccuaccccggccucggcuacccccccaugccccgcguccccgucgucggcaucacccccucccagauggucgccaacgccuucugcuccgccgcccagcuccagccccagcccgccacccuccucggcaaggccggcgccuuccccccccccgccauccccuccgcccccggcucccaggcccgcccccgccccaacggcgcccccuggccccccgagcccgcccccgcccccgcccccgagcucgaccccuucgaggcccagugggccgcccucgagggcaaggccaccgucgagaagcccuccaaccccuucuccggcgaccuccagaagaccuucgagaucgagcucuga

SEQ ID NO: 46940 - RNA, 4521 nt, Artificial Sequence
  derived and/or modified sequence opt2 from NUP153__Homo_sapiens__NP_001265138
auggccuccggcgccggcggcgucggcggcggcggcggcggcaagauccgcacccgccgcugccaccagggccccaucaagcccuaccagcagggccgccagcagcaccagggcauccucucccgcgucaccgaguccgucaagaacaucguccccggcuggcuccagcgcuacuucaacaagaacgaggacgucugcuccugcuccaccgacaccuccgaggucccccgcuggcccgagaacaaggaggaccaccucgucuacgccgacgaggaguccuccaacaucaccgacggccgcaucacccccgagcccgccgucuccaacaccgaggagcccuccaccaccuccaccgccuccaacuaccccgacguccucacccgccccucccuccaccgcucccaccucaacuucuccaugcucgagucccccgcccuccacugccagcccuccaccuccuccgccuuccccaucggcuccuccggcuucucccucgucaaggagaucaaggacuccaccucccagcacgacgacgacaacaucuccaccaccuccggcuucuccucccgcgccuccgacaaggacaucaccgucuccaagaacaccucccuccccccccucuggucccccgaggccgagcgcucccacucccucucccagcacaccgccaccuccuccaagaagcccgccuucaaccucuccgccuucggcacccucucccccucccucggcaacuccuccauccucaagaccucccagcucggcgacucccccuucuaccccggcaagaccaccuacggcggcgccgccgccgccguccgccaguccaagcuccgcaacacccccuaccaggcccccguccgccgccagaugaaggccaagcagcucuccgcccaguccuacggcgucaccuccuccaccgcccgccgcauccuccagucccucgagaagauguccuccccccucgccgacgccaagcgcauccccuccaucgucuccuccccccucaacuccccccucgaccgcuccggcaucgacaucaccgacuuccaggccaagcgcgagaaggucgacucccaguacccccccguccagcgccucaugacccccaagcccgucuccaucgccaccaaccgcuccgucuacuucaagcccucccucacccccuccggcgaguuccgcaagaccaaccagcgcaucgacaacaagugcuccaccggcuacgagaagaacaugacccccggccagaaccgcgagcagcgcgaguccggcuucuccuaccccaacuucucccuccccgccgccaacggccucuccuccggcgucggcggcggcggcggcaagaugcgccgcgagcgcacccgcuucgucgccuccaagccccucgaggaggagcgccagggccucaccguccuccccaagcucaucuccuccuccugcgcccaggccaucauccccuccuggccccucaagguccuccgccuccaggagauggagguccccguccuccccaagaucucccuccccaucaccuccuccucccuccccaccuucaacuucuccucccccgagaucaccaccuccucccccucccccaucaacuccucccaggcccucaccaacaagguccagaugaccucccccuccuccaccggcucccccauguucaaguucuccucccccaucgucaaguccaccgaggccaacguccucccccccuccuccaucggcuucaccuucuccguccccgucgccaagaccgccgagcucuccggcuccuccuccacccucgagcccaucaucuccuccuccgcccaccacgucaccaccgucaacuccaccaacugcaagaagaccccccccgaggacugcgagggccccuuccgccccgccgagauccucaaggagggcuccguccucgacauccucaagucccccggcuucgccucccccaagaucgacuccgucgccgcccagcccaccgccaccucccccgucgucuacacccgccccgccaucuccuccuucuccuccuccggcaucggcuucggcgagucccucaaggccggcuccuccuggcagugcgacaccugccuccuccagaacaaggucaccgacaacaagugcaucgccugccaggccgccaagcucuccccccgcgacaccgccaagcagaccggcaucgagacccccaacaaguccggcaagaccacccucuccgccuccggcaccggcuucggcgacaaguucaagcccgucaucggcaccugggacugcgacaccugccucguccagaacaagcccgaggccaucaagugcgucgccugcgagacccccaagcccggcaccugcgucaagcgcgcccucacccucaccgucgucuccgaguccgccgagaccaugaccgccuccuccuccuccugcaccgucaccaccggcacccucggcuucggcgacaaguucaagcgccccaucggcuccugggagugcuccgucugcugcgucuccaacaacgccgaggacaacaagugcgucuccugcauguccgagaagcccggcuccuccguccccgccuccuccuccuccaccguccccgucucccuccccuccggcggcucccucggccucgagaaguucaagaagcccgagggcuccugggacugcgagcucugccucguccagaacaaggccgacuccaccaagugccucgccugcgaguccgccaagcccggcaccaaguccggcuucaagggcuucgacaccuccuccuccuccuccaacuccgccgccuccuccuccuucaaguucggcgucuccuccuccuccuccggccccucccagacccucaccuccaccggcaacuucaaguucggcgaccagggcggcuucaagaucggcgucuccuccgacuccggcuccaucaaccccauguccgagggcuucaaguucuccaagcccaucggcgacuucaaguucggcgucuccuccgaguccaagcccgaggaggucaagaaggacuccaagaacgacaacuucaaguucggccucuccuccggccucuccaaccccgucucccucacccccuuccaguucggcgucuccaaccucggccaggaggagaagaaggaggagcuccccaaguccuccuccgccggcuucuccuucggcaccggcgucaucaacuccacccccgcccccgccaacaccaucgucaccuccgagaacaaguccuccuucaaccucggcaccaucgagaccaaguccgccuccgucgcccccuucaccugcaagaccuccgaggccaagaaggaggagaugcccgccaccaagggcggcuucuccuucggcaacgucgagcccgccucccuccccuccgccuccgucuucguccucggccgcaccgaggagaagcagcaggagcccgucaccuccaccucccucgucuucggcaagaaggccgacaacgaggagcccaagugccagcccgucuucuccuucggcaacuccgagcagaccaaggacgagaacuccuccaaguccaccuucuccuucuccaugaccaagcccuccgagaaggaguccgagcagcccgccaaggccaccuucgccuucggcgcccagaccuccaccaccgccgaccagggcgccgccaagcccgucuucuccuuccucaacaacuccuccuccuccuccuccacccccgccaccuccgccggcggcggcaucuucggcuccuccaccuccuccuccaacccccccgucgccaccuucgucuucggccaguccuccaaccccgucuccuccuccgccuucggcaacaccgccgaguccuccaccucccagucccuccucuucucccaggacuccaagcucgccaccaccuccuccaccggcaccgccgucacccccuucgucuucggccccggcgccuccuccaacaacaccaccaccuccggcuucggcuucggcgccaccaccaccuccuccuccgccggcuccuccuucgucuucggcaccggccccuccgcccccuccgccucccccgccuucggcgccaaccagacccccaccuucggccagucccagggcgccucccagcccaacccccccggcuucggcuccaucuccuccuccaccgcccucuuccccaccggcucccagcccgccccccccaccuucggcaccgucuccuccuccucccagccccccgucuucggccagcagcccucccaguccgccuucggcuccggcaccacccccaacuccuccuccgccuuccaguucggcuccuccaccaccaacuucaacuucaccaacaacucccccuccggcgucuucaccuucggcgccaacuccuccacccccgccgccuccgcccagcccuccggcuccggcggcuuccccuucaaccagucccccgccgccuucaccgucggcuccaacggcaagaacgucuucuccuccuccggcaccuccuucuccggccgcaagaucaagaccgccguccgccgccgcaaguga

SEQ ID NO: 46941 - RNA, 3984 nt, Artificial Sequence
  derived and/or modified sequence opt2 from NUP155__Homo_sapiens__NP_001265241
augcccuccucccuccucggcgccgccaugcccgccuccaccuccgccgccgcccuccaggaggcccucgagaacgccggccgccucaucgaccgccagcuccaggaggaccgcauguaccccgaccucuccgagcuccucauggucuccgcccccaacaaccccaccgucuccggcauguccgacauggacuacccccuccagggccccggccuccucuccguccccaaccuccccgagaucuccuccauccgccgcgucccccucccccccgagcucgucgagcaguucggccacaugcagugcaacugcaugaugggcgucuucccccccaucucccgcgccuggcucaccaucgacuccgacaucuucauguggaacuacgaggacggcggcgaccucgccuacuucgacggccucuccgagaccauccucgccgucggccucgucaagcccaaggccggcaucuuccagccccacguccgccaccuccucguccucgccacccccgucgacaucgucauccucggccucuccuacgccaaccuccagaccggcuccggcguccucaacgacucccucuccggcggcaugcagcuccuccccgacccccucuacucccuccccaccgacaacaccuaccuccucaccaucaccuccaccgacaacggccgcaucuuccucgccggcaaggacggcugccucuacgaggucgccuaccaggccgaggccggcugguucucccagcgcugccgcaagaucaaccacuccaaguccucccucuccuuccucguccccucccuccuccaguucaccuucuccgaggacgaccccauccuccagaucgccaucgacaacucccgcaacauccucuacacccgcuccgagaagggcgucauccaggucuacgaccucggccaggacggccagggcaugucccgcgucgccuccgucucccagaacgccaucgucuccgccgccggcaacaucgcccgcaccaucgaccgcuccgucuucaagcccaucguccagaucgccgucaucgagaacuccgagucccucgacugccagcuccucgccgucacccacgccggcguccgccucuacuucuccaccugccccuuccgccagccccucgcccgccccaacacccucacccucguccacguccgccucccccccggcuucuccgccuccuccaccgucgagaagcccuccaagguccaccgcgcccucuacuccaagggcauccuccucauggccgccuccgagaacgaggacaacgacauccucuggugcgucaaccacgacaccuuccccuuccagaagcccaugauggagacccagaugaccgccggcgucgacggccacuccugggcccucuccgccaucgacgagcucaaggucgacaagaucaucaccccccucaacaaggaccacauccccaucaccgacucccccgucgucguccagcagcacaugcucccccccaagaaguucguccuccucuccgcccagggcucccucauguuccacaagcuccgccccgucgaccagcuccgccaccuccucgucuccaacgucggcggcgacggcgaggagaucgagcgcuucuucaagcuccaccaggaggaccaggccugcgccaccugccucauccucgccugcuccaccgccgccugcgaccgcgaggucuccgccugggccacccgcgccuucuuccgcuacggcggcgaggcccagaugcgcuuccccaccacccuccccccccccuccaacgucggccccauccucggcucccccgucuacuccuccucccccguccccuccggcucccccuaccccaaccccuccuuccucggcacccccucccacggcauccagccccccgccauguccacccccgucugcgcccucggcaaccccgccacccaggccaccaacauguccugcgucaccggccccgagaucgucuacuccggcaagcacaacggcaucugcaucuacuucucccgcaucaugggcaacaucugggacgccucccucgucgucgagcgcaucuucaaguccggcaaccgcgagaucaccgccaucgaguccuccguccccugccagcuccucgaguccguccuccaggagcucaagggccuccaggaguuccucgaccgcaacucccaguucgccggcggcccccucggcaaccccaacaccaccgccaagguccagcagcgccucaucggcuucaugcgccccgagaacggcaacccccagcagaugcagcaggagcuccagcgcaaguuccacgaggcccagcucuccgagaagaucucccuccaggccauccagcagcucguccgcaaguccuaccaggcccucgcccucuggaagcuccucugcgagcaccaguucaccaucaucgucgccgagcuccagaaggccaacgagcuccuccagcgcucccgccagguccagaacaagaccgagaaggagcgcaugcuccgcgagucccucaaggaguaccagaagaucuccaaccaggucgaccucuccaacgucugcgcccaguaccgccagguccgcuucuacgagggcgucgucgagcucucccucaccgccgccgagaagaaggacccccagggccucggccuccacuucuacaagcacggcgagcccgaggaggacaucgucggccuccaggccuuccaggagcgccucaacuccuacaagugcaucaccgacacccuccaggagcucgucaaccaguccaaggccgccccccagucccccuccguccccaagaagcccggcccccccguccucuccuccgaccccaacaugcucuccaacgaggaggccggccaccacuucgagcagaugcucaagcucucccagcgcuccaaggacgagcucuucuccaucgcccucuacaacuggcucauccaggucgaccucgccgacaagcuccuccaggucgccucccccuuccucgagccccaccucguccgcauggccaaggucgaccagaaccgcguccgcuacauggaccuccucuggcgcuacuacgagaagaaccgcuccuucuccaacgccgcccgcguccucucccgccucgccgacaugcacuccaccgagaucucccuccagcagcgccucgaguacaucgcccgcgccauccucuccgccaaguccuccaccgccaucuccuccaucgccgccgacggcgaguuccuccacgagcucgaggagaagauggaggucgcccgcauccagcuccagauccaggagacccuccagcgccaguacucccaccacuccuccguccaggacgccgucucccagcucgacuccgagcucauggacaucaccaagcucuacggcgaguucgccgaccccuucaagcucgccgagugcaagcucgccaucauccacugcgccggcuacuccgaccccauccucguccagacccucuggcaggacaucaucgagaaggagcucuccgacuccgucacccucuccuccuccgaccgcaugcacgcccucucccucaagaucguccuccucggcaagaucuacgccggcaccccccgcuucuucccccucgacuucaucguccaguuccucgagcagcaggucugcacccucaacugggacgucggcuucgucauccagaccaugaacgagaucggcgucccccucccccgccuccucgaggucuacgaccagcucuucaagucccgcgaccccuucuggaaccgcaugaagaagccccuccaccuccucgacugcauccacguccuccucauccgcuacgucgagaaccccucccagguccucaacugcgagcgccgccgcuucaccaaccucugccucgacgccgucugcggcuaccucgucgagcuccaguccauguccuccuccgucgccguccaggccaucaccggcaacuucaagucccuccaggccaagcucgagcgccuccacuga

SEQ ID NO: 46942 - RNA, 6039 nt, Artificial Sequence
  derived and/or modified sequence opt2 from NUP205__Homo_sapiens__NP_055950
auggccaccccccucgccgucaacuccgccgccucccucuggggccccuacaaggacaucuggcacaaggucggcaacgcccucuggcgccgccagcccgaggccguccaccuccucgacaagauccucaagaagcacaagcccgacuucaucucccucuucaagaacccccccaagaacguccagcagcacgagaagguccagaaggccuccaccgagggcgucgccauccagggccagcagggcacccgccuccuccccgagcagcucaucaaggaggccuucauccucuccgaccucuucgacaucggcgagcucgccgccgucgagcuccuccucgccggcgagcaccagcagccccacuuccccggccucacccgcggccucgucgccguccuccucuacugggacggcaagcgcugcaucgccaacucccucaaggcccucauccagucccgccgcggcaagaccuggacccucgagcucucccccgagcucgccuccaugaccacccgcuucaccgacgagcucauggagcagggccucaccuacaagguccucacccucgucucccagaucgacgucaacaacgaguucgagaagcuccagcgcgagcgcggccucggcuccgagaagcaccgcaaggaggucuccgaccucaucaaggagugccgccagucccucgccgagucccucuucgccugggccugccaguccccccucggcaaggaggacacccuccuccucaucggccaccucgagcgcgucaccgucgaggccaacggcucccucgacgccgucaaccucgcccuccucauggcccuccucuacugcuucgacaucuccuucaucgagcaguccaccgaggagcgcgacgacaugauccaccagcucccccuccucaccgagaagcaguacaucgccaccauccacucccgccuccaggacucccagcucuggaagcuccccggccuccaggccaccguccgccucgccugggcccucgcccuccgcggcaucucccagcuccccgacgucaccgcccucgccgaguucaccgaggccgacgaggccauggccgagcucgccaucgccgacaacgucuuccucuuccucauggaguccgucgucgucuccgaguacuucuaccaggaggaguucuacauccgccgcguccacaaccucaucaccgacuuccucgcccucaugcccaugaaggucaagcagcuccgcaaccgcgccgacgaggacgcccgcaugauccacauguccaugcagaugggcaacgagccccccaucucccuccgccgcgaccucgagcaccucaugcuccucaucggcgagcucuacaagaagaaccccuuccaccucgagcucgcccucgaguacuggugccccaccgagccccuccagacccccaccaucaugggcuccuaccucggcgucgcccaccagcgccccccccagcgccaggucguccucuccaaguucguccgccagaugggcgaccuccucccccccaccaucuacauccccuaccucaagaugcuccagggccucgccaacggcccccagugcgcccacuacugcuucucccuccucaaggucaacggcuccucccacgucgagaacauccagggcgccggcggcucccccgucuccugggagcacuucuuccacucccucaugcucuaccacgagcaccuccgcaaggaccuccccuccgccgacuccguccaguaccgccaccuccccucccgcggcaucacccagaaggagcaggacggccucaucgccuuccuccagcucaccuccaccaucaucaccugguccgagaacgcccgccucgcccucugcgagcacccccaguggacccccgucgucgucauccucggccuccuccagugcuccaucccccccguccucaaggccgagcuccucaagacccucgccgccuucggcaagucccccgagaucgccgccucccucuggcagucccucgaguacacccagauccuccagaccguccgcauccccucccagcgccaggccaucggcaucgaggucgagcucaacgagaucgagucccgcugcgaggaguacccccucacccgcgccuucugccagcucaucuccacccucgucgaguccuccuuccccuccaaccucggcgccggccuccgcccccccggcuucgaccccuaccuccaguuccuccgcgacuccgucuuccuccgcuuccgcacccgcgccuaccgccgcgccgccgagaagugggaggucgccgaggucguccucgaggucuucuacaagcuccuccgcgacuacgagccccagcucgaggacuucgucgaccaguucgucgagcuccagggcgaggagaucaucgccuacaagccccccggcuucucccucauguaccaccuccucaacgagucccccaugcucgagcucgcccucucccuccucgaggagggcgucaagcagcucgacaccuacgcccccuuccccggcaagaagcaccucgagaaggccguccagcacugccucgcccuccucaaccucacccuccagaaggagaaccucuucauggaccuccuccgcgagucccagcucgcccucaucgucugcccccucgagcagcuccuccagggcaucaacccccgcaccaagaaggccgacaacgucgucaacaucgcccgcuaccucuaccacggcaacaccaaccccgagcucgccuucgaguccgccaagauccucugcugcaucuccugcaacuccaacauccagaucaagcucgucggcgacuucacccacgaccaguccaucucccagaagcucauggccggcuucgucgagugccucgacugcgaggacgccgaggaguucguccgccucgaggagggcuccgagcucgagaagaagcucgucgccauccgccacgagacccgcauccacauccucaaccuccucaucaccucccucgagugcaacccccccaaccucgcccucuaccuccucggcuucgagcucaagaagcccgucuccaccaccaaccuccaggaccccggcguccucggcugcccccgcaccugccuccacgccauccucaacauccucgagaagggcaccgagggccgcaccggccccgucgccguccgcgaguccccccagcucgccgagcucugcuaccaggucaucuaccagcucugcgccugcuccgacaccuccggccccaccaugcgcuaccuccgcaccucccaggacuuccucuucucccagcuccaguaccuccccuucuccaacaaggaguacgagaucuccaugcucaaccagauguccuggcucaugaagaccgccuccaucgagcuccgcgucaccucccucaaccgccagcgcucccacacccagcgccuccuccaccuccuccucgacgacaugcccgucaagcccuacuccgacggcgagggcggcaucgaggacgagaaccgcuccgucuccggcuuccuccacuucgacaccgccaccaagguccgccgcaagauccucaacauccucgacuccaucgacuucucccaggagauccccgagccccuccagcucgacuucuucgaccgcgcccagaucgagcaggucaucgccaacugcgagcacaagaaccuccgcggccagaccgucugcaacgucaagcuccuccaccgcguccucgucgccgaggucaacgcccuccagggcauggccgccaucggccagcgcccccuccucauggaggagaucuccaccguccuccaguacgucgucggccgcaacaagcuccuccagugccuccacgccaagcgccacgcccucgaguccuggcgccagcucgucgagaucauccucaccgccugcccccaggaccucauccaggccgaggaccgccagcucaucauccgcgacauccuccaggacguccacgacaagauccucgacgacgaggccgcccaggagcucaugcccgucgucgccggcgccgucuucacccucaccgcccaccucucccaggccguccucaccgagcagaagcagaccuccguccucggccccgccgaggcccacuacgccuucaugcucgacuccugcuucaccucccccccccccgaggagaacccccucgucggcuucgccuccaucggcgacuccucccucuacaucauccucaagaagcuccucgacuucauccucaagaccggcggcggcuuccagcgcguccgcacccaccucuacggcucccuccucuacuaccuccagaucgcccagcgccccgacgagcccgacacccucgaggccgccaagaagaccaugugggagcgccucaccgcccccgaggacgucuucuccaagcuccagcgcgagaacaucgccaucaucgaguccuacggcgccgcccucauggaggucgucugccgcgacgccugcgacggccacgagaucggccgcaugcucgcccucgcccuccucgaccgcaucgucuccgucgacaagcagcagcaguggcuccucuaccucuccaacuccggcuaccucaagguccucgucgacucccucgucgaggacgaccgcacccuccagucccuccucaccccccagcccccccuccucaaggcccucuacaccuacgaguccaagauggccuuccucacccgcgucgccaagauccagcagggcgcccucgagcuccuccgcuccggcgucaucguccgccucgcccagugccaggucuacgacaugcgccccgagaccgacccccaguccauguucggcaugcgcgacccccccauguucauccccacccccgucgaccgcuaccgccagauccuccuccccgcccuccagcucugccaggucauccucaccuccuccauggcccagcaccuccaggccgccggccagguccuccaguuccucaucucccacuccgacaccauccaggccauccuccgcugccaggacgucuccgccggcucccuccaggagcucgcccuccucaccggcaucaucuccaaggccgcccuccccggcauccucuccgagcucgacgucgacgucaacgagggcucccucauggagcuccagggccacaucggccgcuuccagcgccagugccucggccuccucucccgcuucggcggcuccgaccgccuccgccaguucaaguuccaggacgacaacgucgagggcgacaaggucuccaagaaggacgagaucgagcucgccaugcagcagaucugcgccaacgucauggaguacugccagucccucaugcuccaguccucccccaccuuccagcacgccgucugccucuucacccccucccucuccgagaccgucaaccgcgacggcccccgccaggacacccaggcccccgucguccccuacuggcgccuccccggccucggcaucaucaucuaccuccucaagcaguccgccaacgacuucuucuccuacuacgacucccaccgccaguccgucuccaagcuccagaacgucgagcagcucccccccgacgagaucaaggagcucugccaguccgucaugcccgccggcgucgacaagaucuccaccgcccagaaguacguccucgcccgccgccgccucgucaaggucaucaacaaccgcgccaagcuccucucccucugcuccuucaucaucgagaccugccucuucauccucuggcgccaccucgaguacuaccuccuccacugcaugcccaccgacucccaggacucccucuucgccucccgcacccucuucaagucccgccgccuccaggacuccuucgccuccgagaccaaccucgacuuccgcuccggccucgccaucgucucccagcacgaccucgaccagcuccaggccgacgccaucaacgccuucggcgagucccuccagaagaagcuccucgacaucgagggccucuacuccaagguccgcucccgcuacuccuucauccaggcccucguccgccgcauccgcggccuccuccgcaucucccgcaacuga

SEQ ID NO: 46943 - RNA, 5664 nt, Artificial Sequence
  derived and/or modified sequence opt2 from NUP210__Homo_sapiens__NP_079199
auggccgcccgcggccgcggccuccuccuccucacccucuccguccuccucgccgccggccccuccgccgccgccgccaagcucaacauccccaagguccuccuccccuucacccgcgccacccgcgucaacuucacccucgaggccuccgagggcugcuaccgcuggcucuccacccgccccgaggucgccuccaucgagccccucggccucgacgagcagcagugcucccagaaggccgucguccaggcccgccucacccagcccgcccgccucaccuccaucaucuucgccgaggacaucaccaccggccagguccuccgcugcgacgccaucgucgaccucauccacgacauccagaucgucuccaccacccgcgagcucuaccucgaggacuccccccucgagcucaagauccaggcccucgacuccgagggcaacaccuucuccacccucgccggccucgucuucgaguggaccaucgucaaggacuccgaggccgaccgcuucuccgacucccacaacgcccuccgcauccucaccuuccucgaguccaccuacaucccccccuccuacaucuccgagauggagaaggccgccaagcagggcgacaccauccucgucuccggcaugaagaccggcuccuccaagcucaaggcccgcauccaggaggccgucuacaagaacguccgccccgccgagguccgccuccucauccucgagaacauccuccucaaccccgccuacgacgucuaccucauggucggcaccuccauccacuacaagguccagaagauccgccagggcaagaucaccgagcucuccaugcccuccgaccaguacgagcuccagcuccagaacuccauccccggccccgagggcgaccccgcccgccccgucgccguccucgcccaggacaccuccauggucaccgcccuccagcucggccaguccucccucguccucggccaccgcuccauccgcaugcagggcgccucccgccuccccaacuccaccaucuacgucgucgagcccggcuaccucggcuucaccguccaccccggcgaccgcuggguccucgagaccggccgccucuacgagaucaccaucgaggucuucgacaaguucuccaacaaggucuacgucuccgacaacauccgcaucgagaccguccuccccgccgaguucuucgagguccucuccuccucccagaacggcuccuaccaccgcauccgcgcccucaagcgcggccagaccgccaucgacgccgcccucaccuccgucgucgaccaggacggcggcguccacauccuccagguccccgucuggaaccagcaggaggucgagauccacauccccaucacccucuaccccuccauccucaccuuccccuggcagcccaagaccggcgccuaccaguacaccauccgcgcccacggcggcuccggcaacuucuccugguccuccuccucccaccucgucgccaccgucaccgucaagggcgucaugaccaccggcuccgacaucggcuucuccgucauccaggcccacgacguccagaacccccuccacuucggcgagaugaaggucuacgucaucgagccccacuccauggaguucgcccccugccaggucgaggcccgcgucggccaggcccucgagcucccccuccgcaucuccggccucaugcccggcggcgccuccgaggucgucacccucuccgacugcucccacuucgaccucgccgucgaggucgagaaccagggcgucuuccagccccuccccggccgccucccccccggcuccgagcacugcuccggcauccgcgucaaggccgaggcccagggcuccaccacccuccucgucuccuaccgccacggccacguccaccucuccgccaagaucaccaucgccgccuaccucccccucaaggccgucgaccccuccuccgucgcccucgucacccucggcuccuccaaggagaugcucuucgagggcggcccccgccccuggauccucgagcccuccaaguucuuccagaacgucaccgccgaggacaccgacuccaucggccucgcccucuucgccccccacuccucccgcaacuaccagcagcacuggauccucgucaccugccaggcccucggcgagcaggucaucgcccucuccgucggcaacaagcccucccucaccaaccccuuccccgccgucgagcccgccgucgucaaguucgucugcgccccccccucccgccucacccucgcccccgucuacaccuccccccagcucgacauguccugcccccuccuccagcagaacaagcaggucguccccgucuccucccaccgcaacccccgccucgaccucgccgccuacgaccaggagggccgccgcuucgacaacuucuccucccucuccauccagugggaguccacccgccccguccucgccuccaucgagcccgagcuccccaugcagcucgucucccaggacgacgaguccggccagaagaagcuccacggccuccaggccauccucguccacgaggccuccggcaccaccgccaucaccgccaccgccaccggcuaccaggagucccaccucuccuccgcccgcaccaagcagccccacgacccccucgucccccucuccgccuccaucgagcucauccucgucgaggacguccgcgucucccccgaggaggucaccaucuacaaccaccccggcauccaggccgagcuccgcauccgcgagggcuccggcuacuucuuccucaacaccuccaccgccgacgucgucaaggucgccuaccaggaggcccgcggcgucgccaugguccacccccuccuccccggcuccuccaccaucaugauccacgaccucugccucgucuuccccgcccccgccaaggccgucgucuacgucuccgacauccaggagcucuacauccgcgucgucgacaaggucgagaucggcaagaccgucaaggccuacguccgcguccucgaccuccacaagaagcccuuccucgccaaguacuuccccuucauggaccucaagcuccgcgccgccucccccaucaucacccucgucgcccucgacgaggcccucgacaacuacaccaucaccuuccucauccgcggcgucgccaucggccagaccucccucaccgccuccgucaccaacaaggccggccagcgcaucaacuccgccccccagcagaucgaggucuucccccccuuccgccucaugccccgcaaggucacccuccucaucggcgccaccaugcaggucaccuccgagggcggcccccagccccaguccaacauccucuucuccaucuccaacgaguccgucgcccucgucuccgccgccggccucguccagggccucgccaucggcaacggcaccgucuccggccucguccaggccgucgacgccgagaccggcaaggucgucaucaucucccaggaccucguccaggucgagguccuccuccuccgcgccguccgcauccgcgcccccaucaugcgcaugcgcaccggcacccagaugcccaucuacgucaccggcaucaccaaccaccagaaccccuucuccuucggcaacgccguccccggccucaccuuccacugguccgucaccaagcgcgacguccucgaccuccgcggccgccaccacgaggccuccauccgccuccccucccaguacaacuucgccaugaacguccucggccgcgucaagggccgcaccggccuccgcgucgucgucaaggccgucgaccccaccuccggccagcucuacggccucgcccgcgagcucuccgacgagauccagguccaggucuucgagaagcuccagcuccucaaccccgagaucgaggccgagcagauccucaugucccccaacuccuacaucaagcuccagaccaaccgcgacggcgccgccucccucuccuaccgcguccucgacggccccgagaagguccccgucguccacgucgacgagaagggcuuccucgccuccggcuccaugaucggcaccuccaccaucgaggucaucgcccaggagcccuucggcgccaaccagaccaucaucgucgccgucaaggucucccccgucuccuaccuccgcgucuccaugucccccguccuccacacccagaacaaggaggcccucgucgccgucccccucggcaugaccgucaccuucaccguccacuuccacgacaacuccggcgacgucuuccacgcccacuccuccguccucaacuucgccaccaaccgcgacgacuucguccagaucggcaagggccccaccaacaacaccugcgucguccgcaccgucuccgucggccucacccuccuccgcgucugggacgccgagcaccccggccucuccgacuucaugccccuccccguccuccaggccaucucccccgagcucuccggcgccauggucgucggcgacguccucugccucgccaccguccucaccucccucgagggccucuccggcaccugguccuccuccgccaacuccauccuccacaucgaccccaagaccggcgucgccgucgcccgcgccgucggcuccgucaccgucuacuacgaggucgccggccaccuccgcaccuacaaggaggucgucgucuccgucccccagcgcaucauggcccgccaccuccaccccauccagaccuccuuccaggaggccaccgccuccaaggucaucgucgccgucggcgaccgcuccuccaaccuccgcggcgagugcacccccacccagcgcgaggucauccaggcccuccaccccgagacccucaucuccugccagucccaguucaagcccgccgucuucgacuuccccucccaggacgucuucaccgucgagccccaguucgacaccgcccucggccaguacuucugcuccaucaccaugcaccgccucaccgacaagcagcgcaagcaccucuccaugaagaagaccgcccucgucgucuccgccucccucuccuccucccacuucuccaccgagcaggucggcgccgagguccccuucucccccggccucuucgccgaccaggccgagauccuccucuccaaccacuacaccuccuccgagauccgcgucuucggcgcccccgagguccucgagaaccucgaggucaaguccggcucccccgccguccucgccuucgccaaggagaaguccuucggcuggcccuccuucaucaccuacaccgucggcguccucgaccccgccgccggcucccagggcccccucuccaccacccucaccuucuccucccccgucaccaaccaggccaucgccauccccgucaccgucgccuucgucgucgaccgccgcggccccggccccuacggcgccucccucuuccagcacuuccucgacuccuaccaggucauguucuucacccucuucgcccuccucgccggcaccgccgucaugaucaucgccuaccacaccgucugcaccccccgcgaccucgccguccccgccgcccucaccccccgcgccucccccggccacuccccccacuacuucgccgccuccucccccaccucccccaacgcccucccccccgcccgcaaggccuccccccccuccggccucuggucccccgccuacgccucccacuga

SEQ ID NO: 46944 - RNA, 6273 nt, Artificial Sequence
  derived and/or modified sequence opt2 from NUP214__Homo_sapiens__NP_005076
augggcgacgagauggacgccaugauccccgagcgcgagaugaaggacuuccaguuccgcgcccucaagaagguccgcaucuucgacucccccgaggagcuccccaaggagcgcuccucccuccucgccgucuccaacaaguacggccucgucuucgccggcggcgccuccggccuccagaucuuccccaccaagaaccuccucauccagaacaagcccggcgacgaccccaacaagaucgucgacaagguccagggccuccucguccccaugaaguuccccauccaccaccucgcccucuccugcgacaaccucacccucuccgccugcaugauguccuccgaguacggcuccaucaucgccuucuucgacguccgcaccuucuccaacgaggccaagcagcagaagcgccccuucgccuaccacaagcuccucaaggacgccggcggcauggucaucgacaugaaguggaaccccaccguccccuccauggucgccgucugccucgccgacggcuccaucgccguccuccaggucaccgagaccgucaaggucugcgccacccuccccuccaccgucgccgucaccuccgucugcuggucccccaagggcaagcagcucgccgucggcaagcagaacggcaccgucguccaguaccuccccacccuccaggagaagaaggucauccccugcccccccuucuacgaguccgaccaccccguccgcguccucgacguccucuggaucggcaccuacgucuucgccaucgucuacgccgccgccgacggcacccucgagaccucccccgacgucgucauggcccuccuccccaagaaggaggagaagcaccccgagaucuucgucaacuucauggagcccugcuacggcuccugcaccgagcgccagcaccacuacuaccucuccuacaucgaggagugggaccucguccucgccgccuccgccgccuccaccgaggucuccauccucgcccgccaguccgaccagaucaacugggaguccuggcuccucgaggacuccucccgcgccgagcuccccgucaccgacaaguccgacgacucccuccccaugggcgucgucgucgacuacaccaaccaggucgagaucaccaucuccgacgagaagacccucccccccgcccccguccucaugcuccucuccaccgacggcguccucugccccuucuacaugaucaaccagaaccccggcgucaagucccucaucaagacccccgagcgccucucccucgagggcgagcgccagcccaagucccccggcuccacccccaccacccccaccuccucccaggccccccagaagcucgacgccuccgccgccgccgcccccgccucccucccccccuccucccccgccgcccccaucgccaccuucucccuccuccccgccggcggcgcccccaccgucuucuccuucggcuccuccucccucaaguccuccgccaccgucaccggcgagccccccuccuacuccuccggcuccgacuccuccaaggccgcccccggccccggccccuccaccuucuccuucgucccccccuccaaggccucccucgcccccacccccgccgccucccccgucgcccccuccgccgccuccuucuccuucggcuccuccggcuucaagcccacccucgaguccacccccguccccuccgucuccgcccccaacaucgccaugaagcccuccuucccccccuccaccuccgccgucaaggucaaccucuccgagaaguucaccgccgccgccaccuccacccccgucuccuccucccaguccgccccccccaugucccccuucuccuccgccuccaagcccgccgccuccggcccccucucccaccccaccccccucuccgccccccccuccuccgucccccucaaguccuccguccuccccucccccuccggccgcuccgcccagggcuccuccucccccguccccuccaugguccagaaguccccccgcaucaccccccccgccgccaagcccggcuccccccaggccaagucccuccagcccgccgucgccgagaagcagggccaccaguggaaggacuccgaccccgucauggccggcaucggcgaggagaucgcccacuuccagaaggagcucgaggagcucaaggcccgcaccuccaaggccugcuuccaggucggcaccuccgaggagaugaagaugcuccgcaccgaguccgacgaccuccacaccuuccuccucgagaucaaggagaccaccgagucccuccacggcgacaucuccucccucaagaccacccuccucgagggcuucgccggcgucgaggaggcccgcgagcagaacgagcgcaaccgcgacuccggcuaccuccaccuccucuacaagcgcccccucgaccccaaguccgaggcccagcuccaggagauccgccgccuccaccaguacgucaaguucgccguccaggacgucaacgacguccucgaccucgagugggaccagcaccucgagcagaagaagaagcagcgccaccuccucguccccgagcgcgagacccucuucaacacccucgccaacaaccgcgagaucaucaaccagcagcgcaagcgccucaaccaccucgucgacucccuccagcagcuccgccucuacaagcagaccucccucuggucccucuccuccgccguccccucccaguccuccauccacuccuucgacuccgaccucgagucccucugcaacgcccuccucaagaccaccaucgagucccacaccaagucccuccccaagguccccgccaagcucucccccaugaagcaggcccagcuccgcaacuuccucgccaagcgcaagaccccccccguccgcuccaccgcccccgccucccucucccgcuccgccuuccucucccagcgcuacuacgaggaccucgacgaggucuccuccaccuccuccgucucccagucccucgaguccgaggacgcccgcaccuccugcaaggacgacgaggccgucguccaggccccccgccacgcccccgucguccgcacccccuccauccagcccucccuccucccccacgccgcccccuucgccaagucccaccucguccacggcuccucccccggcgucaugggcaccuccgucgccaccuccgccuccaagaucaucccccagggcgccgacuccaccaugcucgccaccaagaccgucaagcacggcgcccccucccccucccaccccaucuccgccccccaggccgccgccgccgccgcccuccgccgccagauggccucccaggcccccgccgucaacacccucaccgaguccacccucaagaacgucccccaggucgucaacguccaggagcucaagaacaaccccgccacccccuccaccgccaugggcuccuccguccccuacuccaccgccaagaccccccaccccguccucacccccgucgccgccaaccaggccaagcagggcucccucaucaacucccucaagcccuccggccccacccccgccuccggccagcucuccuccggcgacaaggccuccggcaccgccaagaucgagaccgccgucaccuccacccccuccgccuccggccaguucuccaagcccuucuccuucucccccuccggcaccggcuucaacuucggcaucaucacccccacccccuccuccaacuucaccgccgcccagggcgccacccccuccaccaaggaguccucccagcccgacgccuucuccuccggcggcggcuccaagcccuccuacgaggccauccccgaguccuccccccccuccggcaucaccuccgccuccaacaccacccccggcgagcccgccgccuccuccucccgccccgucgcccccuccggcaccgcccucuccaccaccuccuccaagcucgagaccccccccuccaagcucggcgagcuccucuuccccuccucccucgccggcgagacccucggcuccuucuccggccuccgcgucggccaggccgacgacuccaccaagcccaccaacaaggccuccuccaccucccucaccuccacccagcccaccaagaccuccggcguccccuccggcuucaacuucaccgccccccccguccucggcaagcacaccgagccccccgucaccuccuccgccaccaccaccuccgucgccccccccgccgccaccuccaccuccuccaccgccgucuucggcucccuccccgucaccuccgccggcuccuccggcgucaucuccuucggcggcaccucccucuccgccggcaagaccuccuucuccuucggcucccagcagaccaacuccaccgucccccccuccgcccccccccccaccaccgccgccaccccccuccccaccuccuuccccacccucuccuucggcucccuccucuccuccgccaccacccccucccuccccauguccgccggccgcuccaccgaggaggccaccuccuccgcccuccccgagaagcccggcgacuccgaggucuccgccuccgccgccucccuccucgaggagcagcaguccgcccagcucccccaggcccccccccagaccuccgacuccgucaagaaggagcccguccucgcccagcccgccgucuccaacuccggcaccgccgccuccuccaccucccucgucgcccucuccgccgaggccacccccgccaccaccggcguccccgacgcccgcaccgaggccgucccccccgccuccuccuucuccguccccggccagaccgccgucaccgccgccgccaucuccuccgccggccccgucgccgucgagaccuccuccacccccaucgccuccuccaccaccuccaucgucgcccccggccccuccgccgaggccgccgccuucggcaccgucaccuccggcuccuccgucuucgcccagccccccgccgccuccuccuccuccgccuucaaccagcucaccaacaacaccgccaccgcccccuccgccacccccgucuucggccaggucgccgccuccaccgcccccucccucuucggccagcagaccggcuccaccgccuccaccgccgccgccaccccccaggucuccuccuccggcuucuccucccccgccuucggcaccaccgcccccggcgucuucggccagaccaccuucggccaggccuccgucuucggccaguccgccuccuccgccgccuccgucuucuccuucucccagcccggcuucuccuccguccccgccuucggccagcccgccuccuccacccccaccuccaccuccggcuccgucuucggcgccgccuccuccaccuccuccuccuccuccuucuccuucggccaguccucccccaacaccggcggcggccucuucggccaguccaacgcccccgccuucggccagucccccggcuucggccagggcggcuccgucuucggcggcaccuccgccgccaccaccaccgccgccaccuccggcuucuccuucugccaggccuccggcuucggcuccuccaacaccggcuccgucuucggccaggccgccuccaccggcggcaucgucuucggccagcaguccuccuccuccuccggcuccgucuucggcuccggcaacaccggccgcggcggcggcuucuucuccggccucggcggcaagcccucccaggacgccgccaacaagaaccccuucuccuccgccuccggcggcuucggcuccaccgccaccuccaacaccuccaaccucuucggcaacuccggcgccaagaccuucggcggcuucgccuccuccuccuucggcgagcagaagcccaccggcaccuucuccuccggcggcggcuccgucgccucccagggcuucggcuucuccucccccaacaagaccggcggcuucggcgccgcccccgucuucggcuccccccccaccuucggcggcucccccggcuucggcggcguccccgccuucggcuccgcccccgccuucaccuccccccucggcuccaccggcggcaaggucuucggcgagggcaccgccgccgccuccgccggcggcuucggcuucggcuccuccuccaacaccaccuccuucggcacccucgccucccagaacgcccccaccuucggcucccucucccagcagaccuccggcuucggcacccaguccuccggcuucuccggcuucggcuccggcaccggcggcuucuccuucggcuccaacaacuccuccguccagggcuucggcggcuggcgcuccuga

SEQ ID NO: 46945 - RNA, 930 nt, Artificial Sequence
  derived and/or modified sequence opt2 from NUP35__Homo_sapiens__NP_001274513
augaugcucggcucccccaccucccccaagcccggcgucaacgcccaguuccuccccggcuuccucaugggcgaccuccccgcccccgucaccccccagccccgcuccaucuccggccccuccgucggcgucauggagaugcgcuccccccuccucgccggcggcucccccccccagcccgucguccccgcccacaaggacaaguccggcgccccccccguccgcuccaucuacgacgacaucuccucccccggccucggcuccaccccccucaccucccgccgccagcccaacaucuccgucaugcaguccccccucgucggcgucaccuccacccccggcaccggccaguccauguucucccccgccuccaucggccagccccgcaagaccacccucucccccgcccagcucgaccccuucuacacccagggcgacucccucaccuccgaggaccaccucgacgacuccugggucaccgucuucggcuucccccaggccuccgccuccuacauccuccuccaguucgcccaguacggcaacauccucaagcacgucauguccaacaccggcaacuggaugcacauccgcuaccaguccaagcuccaggcccgcaaggcccucuccaaggacggccgcaucuucggcgaguccaucaugaucggcgucaagcccugcaucgacaaguccgucauggaguccuccgaccgcugcgcccucuccucccccucccucgccuucaccccccccaucaagacccucggcacccccacccagcccggcuccaccccccgcaucuccaccaugcgcccccucgccaccgccuacaaggccuccaccuccgacuaccaggucaucuccgaccgccagacccccaagaaggacgagucccucgucuccaaggccauggaguacauguucggcugguga

SEQ ID NO: 46946 - RNA, 981 nt, Artificial Sequence
  derived and/or modified sequence opt2 from NUP37__Homo_sapiens__NP_076962
augaagcaggacgccucccgcaacgccgccuacaccgucgacugcgaggacuacguccacgucgucgaguucaaccccuucgagaacggcgacuccggcaaccucaucgccuacggcggcaacaacuacgucgucaucggcaccugcaccuuccaggaggaggaggccgacgucgagggcauccaguacaagacccuccgcaccuuccaccacggcguccgcgucgacggcaucgccuggucccccgagacccgccucgacucccucccccccgucaucaaguucugcaccuccgccgccgacaugaagauccgccucuucaccuccgaccuccaggacaagaacgaguacaagguccucgagggccacaccgacuucaucaacggccucgucuucgaccccaaggagggccaggagaucgccuccgucuccgacgaccacaccugccgcaucuggaaccucgagggcguccagaccgcccacuucguccuccacucccccggcauguccgucugcuggcaccccgaggagaccuucaagcucauggucgccgagaagaacggcaccauccgcuucuacgaccuccucgcccagcaggccauccucucccucgaguccgagcaggucccccucauguccgcccacuggugccucaagaacaccuucaaggucggcgccgucgccggcaacgacuggcucaucugggacaucacccgcuccuccuacccccagaacaagcgccccguccacauggaccgcgccugccucuuccgcugguccaccaucuccgagaaccucuucgccaccaccggcuaccccggcaagauggccucccaguuccagauccaccaccucggccacccccagcccauccucaugggcuccgucgccgucggcuccggccucuccuggcaccgcacccucccccucugcgucaucggcggcgaccacaagcuccucuucugggucaccgaggucuga

SEQ ID NO: 46947 - RNA, 1143 nt, Artificial Sequence
  derived and/or modified sequence opt2 from NUP43__Homo_sapiens__NP_942590
auggaggagaucuacgccaaguucgucucccagaagaucuccaagacccgcuggcgcccccucccccccggcucccuccagaccgccgagaccuucgccaccggcuccugggacaacgaggagaacuacaucucccucugguccaucggcgacuucggcaaccucgacuccgacggcggcuucgagggcgaccaccagcuccucugcgacauccgccaccacggcgacgucauggaccuccaguucuucgaccaggagcgcaucgucgccgccuccuccaccggcugcgucaccgucuuccuccaccaccccaacaaccagacccucuccgucaaccagcaguggaccaccgcccacuaccacaccggccccggcucccccuccuacuccuccgcccccugcaccggcgucgucugcaacaaccccgagaucgucaccgucggcgaggacggccgcaucaaccucuuccgcgccgaccacaaggaggccguccgcaccaucgacaacgccgacuccuccacccuccacgccgucaccuuccuccgcacccccgagauccucaccgucaacuccaucggccagcucaagaucugggacuuccgccagcagggcaacgagcccucccagauccucucccucaccggcgaccgcgucccccuccacugcgucgaccgccaccccaaccagcagcacgucgucgccaccggcggccaggacggcaugcucuccaucugggacguccgccagggcaccaugcccgucucccuccucaaggcccacgaggccgagaugugggagguccacuuccaccccuccaaccccgagcaccucuucaccugcuccgaggacggcucccucuggcacugggacgccuccaccgacguccccgagaaguccucccucuuccaccagggcggccgcuccuccaccuuccucucccacuccaucuccaaccaggccaacguccaccaguccgucaucuccuccuggcucuccaccgaccccgccaaggaccgcaucgagaucaccucccuccuccccucccgcucccucuccgucaacacccucgacguccucggccccugccucgucugcggcaccgacgccgaggccaucuacgucacccgccaccucuucuccuga

SEQ ID NO: 46948 - RNA, 1323 nt, Artificial Sequence
  derived and/or modified sequence opt2 from NUP50__Homo_sapiens__XP_005261370
auggccuccgaggagguccucaagaaccgcgccaucaagaaggccaagcgccgcaacgucggcuucgaguccgacaccggcggcgccuucaagggcuucaagggccucgucguccccuccggcggcggccgcuucuccggcuucggcuccggcgccggcggcaagccccucgagggccucuccaacggcaacaacaucaccuccgccccccccuucgccuccgccaaggccgccgccgaccccaaggucgccuucggcucccucgccgccaacggccccaccacccucgucgacaaggucuccaaccccaagaccaacggcgacucccagcagcccuccuccuccggccucgccuccuccaaggccugcgucggcaacgccuaccacaagcagcucgccgcccucaacugcuccguccgcgacuggaucgucaagcacgucaacaccaacccccucugcgaccucacccccaucuucaaggacuacgagaaguaccucgccaacaucgagcagcagcacggcaacuccggccgcaacuccgaguccgaguccaacaaggucgccgccgagacccagucccccucccucuucggcuccaccaagcuccagcaggaguccaccuuccucuuccacggcaacaagaccgaggacacccccgacaagaagauggaggucgccuccgagaagaagaccgaccccuccucccucggcgccaccuccgccuccuucaacuucggcaagaaggucgacuccuccguccucggcucccucuccuccgucccccucaccggcuucuccuucucccccggcaacuccucccucuucggcaaggacaccacccaguccaagcccgucuccucccccuuccccaccaagccccucgagggccaggccgagggcgacuccggcgagugcaagggcggcgacgaggaggagaacgacgagccccccaaggucgucgucaccgaggucaaggaggaggacgccuucuacuccaagaagugcaagcucuucuacaagaaggacaacgaguucaaggagaagggcaucggcacccuccaccucaagcccaccgccaaccagaagacccagcuccucguccgcgccgacaccaaccucggcaacauccuccucaacguccucaucccccccaacaugcccugcacccgcaccggcaagaacaacguccucaucgucugcguccccaacccccccaucgacgagaagaacgccaccaugcccgucaccaugcucauccgcgucaagaccuccgaggacgccgacgagcuccacaagauccuccucgagaagaaggacgccuga

SEQ ID NO: 46949 - RNA, 1569 nt, Artificial Sequence
  derived and/or modified sequence opt2 from NUP62__Homo_sapiens__NP_001180286
auguccggcuucaacuucggcggcaccggcgcccccaccggcggcuucaccuucggcaccgccaagaccgccaccaccacccccgccaccggcuucuccuucuccaccuccggcaccggcggcuucaacuucggcgcccccuuccagcccgccaccuccacccccuccaccggccucuucucccucgccacccagacccccgccacccagaccaccggcuucaccuucggcaccgccacccucgccuccggcggcaccggcuucucccucggcaucggcgccuccaagcucaaccucuccaacaccgccgccacccccgccauggccaaccccuccggcuucggccucggcuccuccaaccucaccaacgccaucuccuccaccgucaccuccucccagggcaccgcccccaccggcuucgucuucggccccuccaccaccuccgucgcccccgccaccaccuccggcggcuucuccuucaccggcggcuccaccgcccagcccuccggcuucaacaucggcuccgccggcaacuccgcccagcccaccgcccccgccacccuccccuucacccccgccacccccgccgccaccaccgccggcgccacccagcccgccgcccccacccccaccgccaccaucaccuccaccggccccucccucuucgccuccaucgccaccgcccccaccuccuccgccaccaccggccucucccucugcacccccgucaccaccgccggcgcccccaccgccggcacccagggcuucucccucaaggcccccggcgccgccuccggcaccuccaccaccaccuccaccgccgccaccgccaccgccaccaccaccuccuccuccuccaccaccggcuucgcccucaaccucaagccccucgcccccgccggcauccccuccaacaccgccgccgccgucaccgccccccccggccccggcgccgccgccggcgccgccgccuccuccgccaugaccuacgcccagcucgagucccucaucaacaaguggucccucgagcucgaggaccaggagcgccacuuccuccagcaggccacccaggucaacgccugggaccgcacccucaucgagaacggcgagaagaucaccucccuccaccgcgaggucgagaaggucaagcucgaccagaagcgccucgaccaggagcucgacuucauccucucccagcagaaggagcucgaggaccuccucuccccccucgaggagcucgucaaggagcaguccggcaccaucuaccuccagcacgccgacgaggagcgcgagaagaccuacaagcucgccgagaacaucgacgcccagcucaagcgcauggcccaggaccucaaggacaucaucgagcaccucaacaccuccggcgcccccgccgacaccuccgacccccuccagcagaucugcaagauccucaacgcccacauggacucccuccaguggaucgaccagaacuccgcccuccuccagcgcaaggucgaggaggucaccaaggucugcgagggccgccgcaaggagcaggagcgcuccuuccgcaucaccuucgacuga

SEQ ID NO: 46950 - RNA, 1833 nt, Artificial Sequence
  derived and/or modified sequence opt2 from NUP85__Homo_sapiens__NP_001290205
augguccccuccugccccuucaucuacaucauccgcaaggacgucgacgucuacucccagauccuccgcaagcucuucaacgagucccacggcaucuuccucggccuccagcgcaucgacgaggagcucaccggcaagucccgcaagucccagcucguccgcgucuccaagaacuaccgcuccgucauccgcgccugcauggaggagaugcaccaggucgccaucgccgccaaggaccccgccaacggccgccaguucuccucccaggucuccauccucuccgccauggagcucaucuggaaccucugcgagauccucuucaucgaggucgcccccgccggcccccuccuccuccaccuccucgacuggguccgccuccacgucugcgaggucgacucccucuccgccgacguccucggcuccgagaaccccuccaagcacgacuccuucuggaaccucgucaccauccucguccuccagggccgccucgacgaggcccgccagaugcucuccaaggaggccgacgccucccccgccuccgccggcaucugccgcaucaugggcgaccucaugcgcaccaugcccauccucucccccggcaacacccagacccucaccgagcucgagcucaaguggcagcacuggcacgaggagugcgagcgcuaccuccaggacuccaccuucgccaccuccccccaccucgagucccuccucaagaucaugcucggcgacgaggccgcccuccucgagcagaaggagcuccucuccaacugguaccacuuccucgucacccgccuccucuacuccaaccccaccgucaagcccaucgaccuccacuacuacgcccaguccucccucgaccucuuccucggcggcgaguccucccccgagccccucgacaacauccuccucgccgccuucgaguucgacauccaccaggucaucaaggagugcuccaucgcccucuccaacuggugguucgucgcccaccucaccgaccuccucgaccacugcaagcuccuccagucccacaaccucuacuucggcuccaacaugcgcgaguuccuccuccucgaguacgccuccggccucuucgcccaccccucccucuggcagcucggcgucgacuacuucgacuacugccccgagcucggccgcgucucccucgagcuccacaucgagcgcaucccccucaacaccgagcagaaggcccucaagguccuccgcaucugcgagcagcgccagaugaccgagcagguccgcuccaucugcaagauccucgccaugaaggccguccgcaacaaccgccucggcuccgcccucuccugguccauccgcgccaaggacgccgccuucgccacccucgucuccgaccgcuuccuccgcgacuacugcgagcgcggcugcuucuccgaccucgaccucaucgacaaccucggccccgccaugaugcucuccgaccgccucaccuuccucggcaaguaccgcgaguuccaccgcauguacggcgagaagcgcuucgccgacgccgccucccuccuccucucccucaugaccucccgcaucgccccccgcuccuucuggaugacccuccucaccgacgcccucccccuccucgagcagaagcaggucaucuucuccgccgagcagaccuacgagcucaugcgcugccucgaggaccucaccucccgccgccccguccacggcgaguccgacaccgagcagcuccaggacgacgacaucgagaccaccaaggucgagaugcuccgccucucccucgcccgcaaccucgcccgcgccaucauccgcgagggcucccucgagggcuccuga

SEQ ID NO: 46951 - RNA, 2226 nt, Artificial Sequence
  derived and/or modified sequence opt2 from NUP88__Homo_sapiens__NP_002523
auggccgccgccgagggccccgucggcgacggcgagcucuggcagaccuggcuccccaaccacgucgucuuccuccgccuccgcgagggccucaagaaccagucccccaccgaggccgagaagcccgccuccuccucccuccccuccuccccccccccccagcuccucacccgcaacgucgucuucggccucggcggcgagcucuuccucugggacggcgaggacuccuccuuccucgucguccgccuccgcggccccuccggcggcggcgaggagcccgcccucucccaguaccagcgccuccucugcaucaaccccccccucuucgagaucuaccagguccuccucucccccacccagcaccacgucgcccucaucggcaucaagggccucaugguccucgagcuccccaagcgcuggggcaagaacuccgaguucgagggcggcaaguccaccgucaacugcuccaccacccccgucgccgagcgcuucuucaccuccuccaccucccucacccucaagcacgccgccugguaccccuccgagauccucgacccccacgucguccuccucaccuccgacaacgucauccgcaucuacucccuccgcgagccccagacccccaccaacgucaucauccucuccgaggccgaggaggagucccucguccucaacaagggccgcgccuacaccgccucccucggcgagaccgccgucgccuucgacuucggcccccucgccgccguccccaagacccucuucggccagaacggcaaggacgaggucgucgccuacccccucuacauccucuacgagaacggcgagaccuuccucaccuacaucucccuccuccacucccccggcaacaucggcaagcuccucggcccccuccccaugcaccccgccgccgaggacaacuacggcuacgacgccugcgccguccucugccuccccugcguccccaacauccucgucaucgccaccgaguccggcaugcucuaccacugcgucguccucgagggcgaggaggaggacgaccacaccuccgagaaguccugggacucccgcaucgaccucauccccucccucuacgucuucgagugcgucgagcucgagcucgcccucaagcucgccuccggcgaggacgaccccuucgacuccgacuucuccugccccgucaagcuccaccgcgaccccaagugccccucccgcuaccacugcacccacgaggccggcguccacuccgucggccucaccuggauccacaagcuccacaaguuccucggcuccgacgaggaggacaaggacucccuccaggagcucuccaccgagcagaagugcuucgucgagcacauccucugcaccaagccccuccccugccgccagcccgcccccauccgcggcuucuggaucguccccgacauccucggccccaccaugaucugcaucaccuccaccuacgagugccucaucuggccccuccucuccaccguccaccccgccucccccccccuccucugcacccgcgaggacgucgaggucgccgaguccccccuccgcguccucgccgagacccccgacuccuucgagaagcacauccgcuccauccuccagcgcuccgucgccaaccccgccuuccucaaggccuccgagaaggacaucgcccccccccccgaggagugccuccagcuccucucccgcgccacccaggucuuccgcgagcaguacauccucaagcaggaccucgccaaggaggagauccagcgccgcgucaagcuccucugcgaccagaagaagaagcagcucgaggaccucuccuacugccgcgaggagcgcaagucccuccgcgagauggccgagcgccucgccgacaaguacgaggaggccaaggagaagcaggaggacaucaugaaccgcaugaagaagcuccuccacuccuuccacuccgagcuccccguccucuccgacuccgagcgcgacaugaagaaggagcuccagcucauccccgaccagcuccgccaccucggcaacgccaucaagcaggucaccaugaagaaggacuaccagcagcagaagauggagaagguccucucccuccccaagcccaccaucauccucuccgccuaccagcgcaagugcauccaguccauccucaaggaggagggcgagcacauccgcgagauggucaagcagaucaacgacauccgcaaccacgucaacuucuga

SEQ ID NO: 46952 - RNA, 2460 nt, Artificial Sequence
  derived and/or modified sequence opt2 from NUP93__Homo_sapiens__XP_005256320
auggacaccgagggcuucggcgagcuccuccagcaggccgagcagcucgccgccgagaccgagggcaucuccgagcucccccacgucgagcgcaaccuccaggagauccagcaggccggcgagcgccuccgcucccgcacccucacccgcaccucccaggagaccgccgacgucaaggccuccguccuccucggcucccgcggccucgacaucucccacaucucccagcgccucgagucccucuccgccgccaccaccuucgagccccucgagcccgucaaggacaccgacauccagggcuuccucaagaacgagaaggacaacgcccuccucuccgccaucgaggagucccgcaagcgcaccuucggcauggccgaggaguaccaccgcgaguccaugcucgucgagugggagcaggucaagcagcgcauccuccacacccuccucgccuccggcgaggacgcccucgacuucacccaggaguccgagcccuccuacaucuccgacgucggcccccccggccgcuccucccucgacaacaucgagauggccuacgcccgccagaucuacaucuacaacgagaagaucgucaacggccaccuccagcccaaccucgucgaccucugcgccuccgucgccgagcucgacgacaaguccaucuccgacauguggaccauggucaagcagaugaccgacguccuccucacccccgccaccgacgcccucaagaaccgcuccuccgucgagguccgcauggaguucguccgccaggcccucgccuaccucgagcaguccuacaagaacuacacccucgucaccgucuucggcaaccuccaccaggcccagcucggcggcguccccggcaccuaccagcucguccgcuccuuccucaacaucaagcuccccgccccccuccccggccuccaggacggcgaggucgagggccaccccgucugggcccucaucuacuacugcaugcgcugcggcgaccuccucgccgccucccaggucgucaaccgcgcccagcaccagcucggcgaguucaagaccugguuccaggaguacaugaacuccaaggaccgccgccucucccccgccaccgagaacaagcuccgccuccacuaccgccgcgcccuccgcaacaacaccgaccccuacaagcgcgccgucuacugcaucaucggccgcugcgacgucaccgacaaccaguccgaggucgccgacaagaccgaggacuaccucuggcucaagcucaaccaggucugcuucgacgacgacggcaccuccuccccccaggaccgccucacccucucccaguuccagaagcagcuccucgaggacuacggcgagucccacuucaccgucaaccagcagcccuuccucuacuuccagguccucuuccucaccgcccaguucgaggccgccgucgccuuccucuuccgcauggagcgccuccgcugccacgccguccacgucgcccucguccucuucgagcucaagcuccuccucaaguccuccggccaguccgcccagcuccucucccacgagcccggcgacccccccugccuccgccgccucaacuucguccgccuccucaugcucuacacccgcaaguucgaguccaccgacccccgcgaggcccuccaguacuucuacuuccuccgcgacgagaaggacucccagggcgagaacauguuccuccgcugcgucuccgagcucgucaucgagucccgcgaguucgacaugauccucggcaagcucgagaacgacggcucccgcaagcccggcgucaucgacaaguucaccuccgacaccaagcccaucaucaacaaggucgccuccgucgccgagaacaagggccucuucgaggaggccgccaagcucuacgaccucgccaagaacgccgacaagguccucgagcucaugaacaagcuccucucccccgucgucccccagaucuccgccccccaguccaacaaggagcgccucaagaacauggcccucuccaucgccgagcgcuaccgcgcccagggcaucuccgccaacaaguucgucgacuccaccuucuaccuccuccucgaccucaucaccuucuucgacgaguaccacuccggccacaucgaccgcgccuucgacaucaucgagcgccucaagcucgucccccucaaccaggaguccgucgaggagcgcgucgccgccuuccgcaacuucuccgacgagauccgccacaaccucuccgagguccuccucgccaccaugaacauccucuucacccaguucaagcgccucaagggcaccucccccuccuccuccucccgcccccagcgcgucaucgaggaccgcgacucccagcuccgcucccaggcccgcacccucaucaccuucgccggcaugauccccuaccgcaccuccggcgacaccaacgcccgccucguccagauggagguccucaugaacuga

SEQ ID NO: 46953 - RNA, 2814 nt, Artificial Sequence
  derived and/or modified sequence opt2 from NUP98__Homo_sapiens__NP_005378
auguucaacaaguccuucggcacccccuucggcggcggcaccggcggcuucggcaccaccuccaccuucggccagaacaccggcuucggcaccaccuccggcggcgccuucggcaccuccgccuucggcuccuccaacaacaccggcggccucuucggcaacucccagaccaagcccggcggccucuucggcaccuccuccuucucccagcccgccaccuccaccuccaccggcuucggcuucggcaccuccaccggcaccgccaacacccucuucggcaccgccuccaccggcaccucccucuucuccucccagaacaacgccuucgcccagaacaagcccaccggcuucggcaacuucggcaccuccaccuccuccggcggccucuucggcaccaccaacaccaccuccaaccccuucggcuccaccuccggcucccucuucggccccuccuccuucaccgccgcccccaccggcaccaccaucaaguucaacccccccaccggcaccgacaccauggucaaggccggcgucuccaccaacaucuccaccaagcaccagugcaucaccgccaugaaggaguacgaguccaagucccucgaggagcuccgccucgaggacuaccaggccaaccgcaagggcccccagaaccaggucggcgccggcaccaccaccggccucuucggcuccucccccgccaccuccuccgccaccggccucuucuccuccuccaccaccaacuccggcuucgccuacggccagaacaagaccgccuucggcaccuccaccaccggcuucggcaccaaccccggcggccucuucggccagcagaaccagcagaccaccucccucuucuccaagcccuucggccaggccaccaccacccagaacaccggcuucuccuucggcaacaccuccaccaucggccagcccuccaccaacaccaugggccucuucggcgucacccaggccucccagcccggcggccucuucggcaccgccaccaacaccuccaccggcaccgccuucggcaccggcaccggccucuucggccagaccaacaccggcuucggcgccgucggcuccacccucuucggcaacaacaagcucaccaccuucggcuccuccaccaccuccgcccccuccuucggcaccaccuccggcggccucuucggcaacaagcccacccucacccucggcaccaacaccaacaccuccaacuucggcuucggcaccaacaccuccggcaacuccaucuucggcuccaagcccgcccccggcacccucggcaccggccucggcgccggcuucggcaccgcccucggcgccggccaggccucccucuucggcaacaaccagcccaagaucggcggcccccucggcaccggcgccuucggcgcccccggcuucaacaccaccaccgccacccucggcuucggcgccccccaggcccccgucgcccucaccgaccccaacgccuccgccgcccagcaggccguccuccagcagcacaucaacucccucaccuacucccccuucggcgacuccccccucuuccgcaaccccauguccgaccccaagaagaaggaggagcgccucaagcccaccaaccccgccgcccagaaggcccucaccacccccacccacuacaagcucaccccccgccccgccacccgcguccgccccaaggcccuccagaccaccggcaccgccaagucccaccucuucgacggccucgacgacgacgagcccucccucgccaacggcgccuucaugcccaagaaguccaucaagaagcucguccucaagaaccucaacaacuccaaccucuucucccccgucaaccgcgacuccgagaaccucgccucccccuccgaguaccccgagaacggcgagcgcuucuccuuccucuccaagcccgucgacgagaaccaccagcaggacggcgacgaggacucccucgucucccacuucuacaccaaccccaucgccaagcccaucccccagacccccgaguccgccggcaacaagcacuccaacuccaacuccgucgacgacaccaucgucgcccucaacaugcgcgccgcccuccgcaacggccucgagggcuccuccgaggagaccuccuuccacgacgagucccuccaggacgaccgcgaggagaucgagaacaacuccuaccacaugcaccccgccggcaucauccucaccaaggucggcuacuacaccauccccuccauggacgaccucgccaagaucaccaacgagaagggcgagugcaucgucuccgacuucaccaucggccgcaagggcuacggcuccaucuacuucgagggcgacgucaaccucaccaaccucaaccucgacgacaucguccacauccgccgcaaggaggucgucgucuaccucgacgacaaccagaagccccccgucggcgagggccucaaccgcaaggccgaggucacccucgacggcgucuggcccaccgacaagaccucccgcugccucaucaagucccccgaccgccucgccgacaucaacuacgagggccgccucgaggccgucucccgcaagcagggcgcccaguucaaggaguaccgccccgagaccggcuccugggucuucaaggucucccacuucuccaaguacggccuccaggacuccgacgaggaggaggaggagcaccccuccaagaccuccaccaagaagcucaagaccgccccccucccccccgccucccagaccaccccccuccagauggcccucaacggcaagcccgccccccccccccaggucgagaagaagggccaguga

SEQ ID NO: 46954 - RNA, 1272 nt, Artificial Sequence
  derived and/or modified sequence opt2 from NUPL2__Homo_sapiens__NP_031368
auggccaucugccaguucuuccuccagggccgcugccgcuucggcgaccgcugcuggaacgagcaccccggcgcccgcggcgccggcggcggccgccagcagccccagcagcagcccuccggcaacaaccgccgcggcuggaacaccaccucccagcgcuacuccaacgucauccagcccuccuccuucuccaaguccacccccuggggcggcucccgcgaccaggagaagcccuacuucuccuccuucgacuccggcgccuccaccaaccgcaaggagggcuucggccucuccgagaaccccuucgccucccucucccccgacgagcagaaggacgagaagaagcuccucgagggcaucgucaaggacauggaggucugggaguccuccggccaguggauguucuccgucuacucccccgucaagaagaagcccaacaucuccggcuucaccgacaucucccccgaggagcuccgccucgaguaccacaacuuccucaccuccaacaaccuccaguccuaccucaacuccguccagcgccucaucaaccaguggcgcaaccgcgucaacgagcucaagucccucaacaucuccaccaaggucgcccuccucuccgacgucaaggacggcgucaaccaggccgcccccgccuucggcuucggcuccucccaggccgccaccuucaugucccccggcuuccccgucaacaacuccuccuccgacaacgcccagaacuucuccuucaagaccaacuccggcuucgccgccgccuccuccggcucccccgccggcuucggcuccucccccgccuucggcgccgccgccuccaccuccuccggcaucuccaccuccgcccccgccuucggcuucggcaagcccgaggucaccuccgccgccuccuucuccuucaagucccccgccgccuccuccuucggcucccccggcuucuccggccuccccgccucccucgccaccggccccguccgcgcccccgucgcccccgccuucggcggcggcuccuccgucgccggcuucggcucccccggcucccacucccacaccgccuucuccaagcccuccuccgacaccuucggcaacuccuccaucuccaccucccucuccgccuccuccuccaucaucgccaccgacaacguccucuucaccccccgcgacaagcucaccgucgaggagcucgagcaguuccaguccaagaaguucacccucggcaagaucccccucaagccccccccccucgagcuccucaacgucuga

SEQ ID NO: 46955 - RNA, 303 nt, Artificial Sequence
  derived and/or modified sequence opt2 from NUPR1__Homo_sapiens__NP_001035948
auggccaccuucccccccgccaccuccgccccccagcagccccccggccccgaggacgaggacuccucccucgacgaguccgaccucuacucccucgcccacuccuaccucggcccccucaucaugcccaugcccaccuccccccucacccccgcccucgucaccggcggcggcggccgcaagggccgcaccaagcgcgaggccgccgccaacaccaaccgccccucccccggcggccacgagcgcaagcucgucaccaagcuccagaacuccgagcgcaagaagcgcggcgcccgccgcuga

SEQ ID NO: 46956 - RNA, 882 nt, Artificial Sequence
  derived and/or modified sequence opt2 from NUS1__Homo_sapiens__NP_612468
augaccggccucuacgagcucgucuggcgcguccuccacgcccuccucugccuccaccgcacccucaccuccuggcuccgcguccgcuucggcaccuggaacuggaucuggcgccgcugcugccgcgccgccuccgccgccguccucgccccccucggcuucacccuccgcaagccccccgccgucggccgcaaccgccgccaccaccgccacccccgcggcggcuccugccucgccgccgcccaccaccgcaugcgcuggcgcgccgacggccgcucccucgagaagcuccccguccacaugggccucgucaucaccgaggucgagcaggagcccuccuucuccgacaucgccucccucgucgucuggugcauggccgucggcaucuccuacaucuccgucuacgaccaccagggcaucuucaagcgcaacaacucccgccucauggacgagauccucaagcagcagcaggagcuccucggccucgacugcuccaaguacucccccgaguucgccaacuccaacgacaaggacgaccagguccucaacugccaccucgccgucaagguccucucccccgaggacggcaaggccgacaucguccgcgccgcccaggacuucugccagcucgucgcccagaagcagaagcgccccaccgaccucgacgucgacacccucgccucccuccucuccuccaacggcugccccgaccccgaccucguccucaaguucggccccgucgacuccacccucggcuuccuccccuggcacauccgccucaccgagaucgucucccuccccucccaccucaacaucuccuacgaggacuucuucuccgcccuccgccaguacgccgccugcgagcagcgccucggcaaguga

SEQ ID NO: 46957 - RNA, 1320 nt, Artificial Sequence
  derived and/or modified sequence opt2 from NUSAP1__Homo_sapiens__NP_001230071
augaucauccccucccucgaggagcucgacucccucaaguacuccgaccuccagaaccucgccaagucccucggccuccgcgccaaccuccgcgccaccaagcuccucaaggcccucaagggcuacaucaagcacgaggcccgcaagggcaacgagaaccaggacgagucccagaccuccgccuccuccugcgacgagaccgagauccagaucuccaaccaggaggaggccgagcgccagccccucggccacgucaccaagacccgccgccgcugcaagaccguccgcgucgaccccgacucccagaaccacuccgagaucaagaucuccaaccccaccgaguuccagaaccacgagaagcaggagucccaggaccuccgcgccaccgccaagguccccuccccccccgacgagcaccaggaggccgagaacgccgucuccuccggcaaccgcgacuccaagguccccuccgagggcaagaagucccucuacaccgacgaguccuccaagcccggcaagaacaagcgcaccgccaucaccacccccaacuucaagaagcuccacgaggcccacuucaaggagauggaguccaucgaccaguacaucgagcgcaagaagaagcacuucgaggagcacaacuccaugaacgagcucaagcagcccaucaacaagggcggcguccgcacccccguccccccccgcggccgccucuccgucgccuccacccccaucucccagcgccgcucccagggccgcuccugcggccccgccucccaguccacccucggccucaagggcucccucaagcgcuccgccaucuccgccgccaagaccggcguccgcuucuccgccgccaccaaggacaacgagcacaagcgcucccucaccaagacccccgcccgcaaguccgcccacgucaccgucuccggcggcacccccaagggcgaggccguccucggcacccacaagcucaagaccaucaccggcaacuccgccgccgucaucacccccuucaagcucaccaccgaggccacccagacccccgucuccaacaagaagcccgucuucgaccucaaggccucccucucccgcccccucaacuacgagccccacaagggcaagcucaagcccuggggccaguccaaggagaacaacuaccucaaccagcacgucaaccgcaucaacuucuacaagaagaccuacaagcagccccaccuccagaccaaggaggagcagcgcaagaagcgcgagcaggagcgcaaggagaagaaggccaagguccucggcaugcgccgcggccucauccucgccgaggacuga

SEQ ID NO: 46958 - RNA, 384 nt, Artificial Sequence
  derived and/or modified sequence opt2 from NUTF2__Homo_sapiens__XP_005255828
augggcgacaagcccaucugggagcagaucggcuccuccuucauccagcacuacuaccagcucuucgacaacgaccgcacccagcucggcgccaucuacaucgacgccuccugccucaccugggagggccagcaguuccagggcaaggccgccaucgucgagaagcucuccucccuccccuuccagaagauccagcacuccaucaccgcccaggaccaccagcccacccccgacuccugcaucaucuccauggucgucggccagcucaaggccgacgaggaccccaucaugggcuuccaccagauguuccuccucaagaacaucaacgacgccugggucugcaccaacgacauguuccgccucgcccuccacaacuucggcuga

SEQ ID NO: 46959 - RNA, 3483 nt, Artificial Sequence
  derived and/or modified sequence opt2 from NUTM1__Homo_sapiens__NP_001271221
auggucgucacccucggccccggccccgacugccucauccucgaggccucccgccagccccagcucguccccaagcccgagcgcauggccuccgacggcgccuccgcccuccccggccccgacauguccaugaagcccuccgccgcccucucccccucccccgcccuccccuuccucccccccaccuccgacccccccgaccaccccccccgcgagccccccccccagcccaucaugcccuccgucuucucccccgacaacccccucaugcucuccgccuuccccuccucccuccucgucaccggcgacggcggccccugccucuccggcgccggcgccggcaaggucaucgucaaggucaagaccgagggcggcuccgccgagcccucccagacccagaacuucauccucacccagaccgcccucaacuccaccgcccccggcacccccugcggcggccucgagggccccgccccccccuucgucaccgccuccaacgucaagaccauccuccccuccaaggccgucggcgucucccaggagggcccccccggccuccccccccagccccccccccccgucgcccagcucguccccaucgucccccucgagaaggccuggcccggcccccacggcaccaccggcgagggcggccccgucgccacccucuccaagcccucccucggcgaccgcuccaagaucuccaaggacgucuacgagaacuuccgccaguggcagcgcuacaaggcccucgcccgccgccaccucucccagucccccgacaccgaggcccucuccugcuuccucauccccguccuccgcucccucgcccgccucaagcccaccaugacccucgaggagggccucccccucgccguccaggagugggagcacaccuccaacuucgaccgcaugaucuucuacgagauggccgagcgcuucauggaguucgaggccgaggagaugcagauccagaacacccagcucaugaacggcucccagggccucucccccgccaccccccucaagcucgacccccucggcccccucgccuccgaggucugccagcagcccgucuacauccccaagaaggccgccuccaagacccgcgccccccgccgccgccagcgcaaggcccagcgcccccccgcccccgaggcccccaaggagaucccccccgaggccgucaaggaguacgucgacaucauggaguggcucgucggcacccaccucgccaccggcgaguccgacggcaagcaggaggaggagggccagcagcaggaggaggagggcauguaccccgaccccggccuccucuccuacaucaacgagcucugcucccagaaggucuucgucuccaaggucgaggccgucauccacccccaguuccucgccgaccuccucucccccgagaagcagcgcgacccccucgcccucaucgaggagcucgagcaggaggagggccucacccucgcccagcucguccagaagcgccucauggcccucgaggaggaggaggacgccgaggccccccccuccuucuccggcgcccagcucgacuccucccccuccggcuccgucgaggacgaggacggcgacggccgccuccgccccucccccggccuccagggcgccggcggcgccgccugccucggcaaggucuccuccuccggcaagcgcgcccgcgagguccacggcggccaggagcaggcccucgacuccccccgcggcaugcaccgcgacggcaacacccuccccucccccuccuccugggaccuccagcccgagcucgccgccccccagggcacccccggcccccucggcgucgagcgccgcggcuccggcaaggucaucaaccaggucucccuccaccaggacggccaccucggcggcgccggcccccccggccacugccucgucgccgaccgcaccuccgaggcccucccccucugcuggcagggcggcuuccagcccgaguccacccccucccucgacgccggccucgccgagcucgccccccuccagggccagggccucgagaagcagguccucggccuccagaagggccagcagaccggcggccgcggcguccucccccagggcaaggagccccucgccguccccugggagggcuccuccggcgccauguggggcgacgaccgcggcacccccauggcccaguccuacgaccagaaccccuccccccgcgccgccggcgagcgcgacgacgucugccucucccccggcgucuggcucuccuccgagauggacgccgucggccucgagcuccccguccagaucgaggaggucaucgaguccuuccaggucgagaagugcgucaccgaguaccaggagggcugccagggccucggcucccgcggcaacaucucccucggccccggcgagacccucguccccggcgacaccgaguccuccgucauccccugcggcggcaccgucgccgccgccgcccucgagaagcgcaacuacugcucccuccccggcccccuccgcgccaacucccccccccuccgcuccaaggagaaccaggagcaguccugcgagaccgucggccaccccuccgaccucugggccgagggcugcuucccccuccucgaguccggcgacuccacccucggcuccuccaaggagacccucccccccaccugccagggcaaccuccucaucaugggcaccgaggacgccuccucccuccccgaggccucccaggaggccggcucccgcggcaacuccuucuccccccuccucgagaccaucgagcccgucaacauccucgacgucaaggacgacugcggccuccagcuccgcgucuccgaggacaccugcccccucaacguccacuccuacgacccccagggcgagggccgcgucgaccccgaccucuccaagcccaagaaccucgccccccuccaggagucccaggaguccuacaccaccggcacccccaaggccaccuccucccaccagggccucggcuccacccucccccgccgcggcacccgcaacgccaucgucccccgcgagaccuccgucuccaagacccaccgcuccgccgaccgcgccaagggcaaggagaagaagaagaaggaggccgaggaggaggacgaggagcucuccaacuucgccuaccuccucgccuccaagcucucccucuccccccgcgagcacccccucuccccccaccacgccuccggcggccagggcucccagcgcgccucccaccuccuccccgccggcgccaagggccccuccaagcuccccuaccccgucgccaaguccggcaagcgcgcccucgccggcggccccgcccccaccgagaagaccccccacuccggcgcccagcucggcgucccccgcgagaagccccucgcccucggcgucguccgccccucccagccccgcaagcgccgcugcgacuccuucgucaccggccgccgcaagaagcgccgccgcucccaguga

SEQ ID NO: 46960 - RNA, 2637 nt, Artificial Sequence
  derived and/or modified sequence opt2 from NUTM2A__Homo_sapiens__XP_011538424
auggaggucaagggccccuccggccgcuccuucugcugcgaguccgagggccaguucaaguccugccucaagcgccacacccccucccuccuccuccccuccuccuggaagggcaacuccggcuccugccucauggccaaggcccuccaccgcaugucccccacccccaacuccugcccccucccccucccccucugccgcauguccggcguccucugcucccgcaaccucuucaccuucaaguucucccucuuccagcucgacuccggcgccuccggcgagcccggccacucccucggccucacccucggcuucucccacugcggcaacugccagaccgccgucgucuccgcccagcccgagggcauggccuccaacggcgccuaccccgcccucggccccggcgucaccgccaaccccggcaccucccucuccgucuucaccgcccuccccuucaccacccccgcccccggccccgcccacggcccccuccucgucaccgccggcgccccccccggcggcccccucguccucuccacccuccccuccaccccccucgucaccgagcaggacggcugcggccccuccggcgccggcgccuccaacgucuucguccagaugcgcaccgaggucggccccgucaaggccgcccaggcccagacccucguccucacccaggccccccucgucuggcaggcccccggcgcccucugcggcggcgucgucugcccccccccccuccuccucgccgccgcccccgucguccccgucauggccgcccaggucgucggcggcacccaggccugcgagggcggcuggucccagggccucccccucccccccccccccccccccgccgcccagcucccccccaucgucucccagggcaacgccggccccuggccccagggcgcccacggcgagggcucccucgccuccucccaggccaaggccccccccgacgacuccugcaacccccgcuccgucuacgagaacuuccgccucuggcagcacuacaagccccucgcccgccgccaccucccccagucccccgacaccgaggcccucuccugcuuccucauccccguccuccgcucccucgcccgccgcaagcccaccaugacccucgaggagggccucuggcgcgccaugcgcgaguggcagcacaccuccaacuucgaccgcaugaucuucuacgagauggccgagaaguuccucgaguucgaggccgaggaggagaugcagauccagaagucccaguggaugaagggcccccagugccuccccccccccgccaccccccgccucgagccccgcggcccccccgcccccgaggucgucaagcagcccgucuaccuccccuccaaggccggccccaaggcccccaccgccugccucccccccccccgcccccagcgccccgucaccaaggcccgccgcccccccccccgcccccaccgccgcgccgagaccaaggcccgccucccccccccccgcccccagcgccccgccgagaccaagguccccgaggagaucccccccgaggucguccaggaguacgucgacaucauggaggagcuccucggccccucccucggcgccaccggcgagcccgagaagcagcgcgaggagggcgaggucaagcagccccaggaggaggacuggaccccccccgaccccggccuccucuccuacaccgacaagcucugcucccagaaggacuucgucaccaaggucgaggccgucauccacccccaguuccucgaggagcuccucucccccgacccccagauggacuuccucgcccucucccaggagcucgagcaggaggagggccucacccucgcccagcucgucgagaagcgccuccucccccucaaggagaagcagcacgcccgcgccgcccccucccgcggcaccgcccgccucgacuccuccuccuccaaguucgccgccggccagggcgccgagcgcgacguccccgucccccagcagggcgucggcauggagaccugccccccccagaccaccgcccgcgacucccagggccgcggccgcgcccacaccggcauggcccgcuccaaggacuccgucguccuccucggcugccaggacucccccggccuccgcgccgcccgccccaccucccccccccaggaccaccgccccaccugccccggcgucggcaccaaggacgcccucgaccuccccggcggcucccccguccgcgagucccacggccucgcccagggcuccuccgaggaggaggagcuccccucccucgccuuccuccucggcucccagcacaagcuccuccccugguggcucccccagucccccguccccgccuccggccuccucucccccgagaaguggggcccccagggcacccaccaguuccccuccgccgagcgccgcggccucaaccucgcccccucccccgccaacaaggccaagaagcgcccccucuucggcucccucucccccgccgagaagaccccccaccccggccccggccuccgcgucuccggcgagcagucccucaccuggggccucggcggccccucccagucccagaagcgcaagggcgacccccucgucucccgcaaggagaagaagcagcgcugcucccaguga

SEQ ID NO: 46961 - RNA, 2637 nt, Artificial Sequence
  derived and/or modified sequence opt2 from NUTM2B__Homo_sapiens__XP_005270192
auggaggucaagggccccuccggccgcuccuucugcugcgaguccgagggccaguucaaguccugccucaagcgccacacccccucccuccuccuccccuccuccuggaagggcaacuccggcuccugccucauggccgaggcccuccaccgcaccucccccacccccaacuccugcccccucccccucccccucugccgcauguccggcguccucugcucccgcaaccucuucaccuucaaguucucccucuuccagcucgacuccggcgccuccggcgagcccggccacucccucggccucacccucggcuucuccuacugcggcaacugccagaccgccgucgucuccgcccagcccgagggcauggccuccaacggcgccuaccccguccucggccccggcgucaccgccaaccccggcaccucccucuccgucuucaccgcccuccccuucaccacccccgcccccggccccgcccacggcccccuccucgucaccgccggcgccccccccggcggcccccucguccucuccaccuuccccuccaccccccucgucaccgagcaggacggcugcggccccuccggcgccggcgccuccaacgucuucguccagaugcgcaccgaggucggccccgucaaggccgcccaggcccagacccucguccucacccaggccccccucgucuggcaggcccccggcgcccucugcggcggcgucgucugcccccccccccuccuccucgccgccgcccccgucguccccgucauggccgcccaggucgucggcggcacccaggccugcgagggcggcuggucccagggccucccccucccccccccccccccccccgccgcccagcucccccccaucgucucccagggcaacgccggccccuggccccagggcgcccacggcgaguccucccucgccuccucccaggccaaggccccccccgacgacuccugcaacccccgcuccgucuacgagaacuuccgccucuggcagcacuacaagccccucgcccgccgccaccucccccagucccccgacaccgaggcccucuccugcuuccucauccccguccuccgcucccucgcccgccgcaagcccaccaugacccucgaggagggccucuggcgcgccaugcgcgaguggcagcacaccuccaacuucgaccgcaugaucuucuacgagauggccgagaaguuccucgaguucgaggccgaggaggagaugcagauccagaagucccaguggaugaagggcccccagugccuccccccccccgccaccccccgccucgagccccgcggcccccccgcccccgaggucgucaagcagcccgucuaccuccccuccaaggccggccccaaggcccccaccgccugccucccccccccccgcccccagcgccccgucaccaaggcccgccgcccccccccccgcccccaccgccgcgccgagaccaaggcccgccucccccccccccgcccccagcgccccgccgagaccaagguccccgaggagaucccccccgaggucguccaggaguacgucgacaucauggaggagcuccucggccccucccucggcgccaccggcgagcccgagaagcagcgcgaggagggcaaggucaagcagccccaggaggaggacuggaccccccccgaccccggccuccucuccuacaucgacaagcucugcucccagaaggacuucgucaccaaggucgaggccgucauccacccccaguuccucgaggagcuccucucccccgacccccagauggacuuccucgcccucucccaggaccucgagcaggaggagggccucacccucgcccagcucgucgagaagcgccuccccccccucaaggagaagcagcacgcccgcgccgcccccucccgcggcaccgcccgccucgacuccuccuccuccaaguucgccgccggccagggcgccgagcgcgacguccccgacccccagcagggcgucggcauggagaccugccccccccagaugaccgcccgcgacucccagggccgcggccgcgcccacaccggcauggcccgcuccgaggacuccgucguccuccucggcugccaggacucccccggccuccgcgccgccuggcccaccucccccccccaggaccaccgccccaccugccccggcgucggcaccaaggacgcccucgaccuccccggcggcucccccguccgcgagucccacggccucgcccagggcuccuccgaggaggaggagcuccccucccucgccuuccuccucggcucccagcacaagcuccuccccugguggcucccccagucccccguccccgccuccggccuccucucccccgagaaguggggcccccagggcacccaccagucccccuccgccgagcgccgcggccucaaccucgcccccucccccgccaacaaggccaagaagcgcccccucuucggcucccucucccccgccgagaagacccccuaccccggccccggccuccgcgucuccggcgagcagucccucaccuggggccucggcggccccucccagucccagaagcgcaagggcgacccccucgucucccgcaaggagaagaagcagcacugcucccaguga

SEQ ID NO: 46962 - RNA, 2004 nt, Artificial Sequence
  derived and/or modified sequence opt2 from NVL__Homo_sapiens__NP_001230075
augaagcgcaagggcaagcucaagaacaagggcuccaagcgcaagaaggaggaccuccaggaggucgacggcgagaucgaggccguccuccagaagaaggccaaggcccgcggccucgaguuccagaucuccaacgucaaguucgaggacgucggcggcaacgacaugacccucaaggaggucugcaagaugcucauccacaugcgccaccccgaggucuaccaccaccucggcgucguccccccccgcggcguccuccuccacggcccccccggcugcggcaagacccuccucgcccacgccaucgccggcgccgagugcuccggcaugaucaccgcccacugcuccuucgacuucuccggcuccaacgacccccccgccuccgccucccaggagcucgaccuccccauccucaaggucgccgcccccgagaucgucuccggcgucuccggcgaguccgagcagaagcuccgcgagcucuucgagcaggccgucuccaacgcccccugcaucaucuucaucgacgagaucgacgccaucacccccaagcgcgaggucgccuccaaggacauggagcgccgcaucgucgcccagcuccucaccugcauggacgaccucaacaacgucgccgccaccgcccgcguccucgucaucggcgccaccaaccgccccgacucccucgaccccgcccuccgccgcgccggccgcuucgaccgcgagaucugccucggcauccccgacgaggccucccgcgagcgcauccuccagacccucugccgcaagcuccgccucccccaggccuucgacuucugccaccucgcccaccucacccccggcuucgucggcgccgaccucauggcccucugccgcgaggccgccaugugcgccgucaaccgcguccucaugaagcuccaggagcagcagaagaagaaccccgagauggaggaccuccccuccaagggcguccaggaggagcgccucggcaccgagcccaccuccgagacccaggacgagcuccagcgccuccucggccuccuccgcgaccaggacccccucuccgaggagcagaugcagggccucugcaucgagcucaacgacuucaucgucgcccucuccuccguccagcccuccgccaagcgcgagggcuucgucaccguccccaacgucaccugggccgacaucggcgcccucgaggacauccgcgaggagcucaccauggccauccucgcccccguccgcaaccccgaccaguucaaggcccucggccucgucacccccgccggcguccuccucgccggcccccccggcugcggcaagacccuccucgccaaggccgucgccaacgaguccggccucaacuucaucuccgucaagggccccgagcuccucaacauguacgucggcgaguccgagcgcgccguccgccaggucuuccagcgcgccaagaacuccgcccccugcgucaucuucuucgacgaggucgacgcccucugcccccgccgcuccgaccgcgagaccggcgccuccguccgcgucgucaaccagcuccucaccgagauggacggccucgaggcccgccagcaggucuucaucauggccgccaccaaccgccccgacaucaucgaccccgccauccuccgccccggccgccucgacaagacccucuucgucggccuccccccccccgccgaccgccucgccauccucaagaccaucaccaagaacggcaccaagcccccccucgacgccgacgucaaccucgaggccaucgccggcgaccuccgcugcgacugcuacaccggcgccgaccucuccgcccucguccgcgaggccuccaucugcgcccuccgccaggagauggcccgccagaaguccggcaacgagaagggcgagcucaaggucucccacaagcacuucgaggaggccuucaagaagguccgcuccuccaucuccaagaaggaccagaucauguacgagcgccuccaggagucccucucccgcuga

SEQ ID NO: 46963 - RNA, 4299 nt, Artificial Sequence
  derived and/or modified sequence opt2 from NWD1__Homo_sapiens__NP_001007526
augcagcgcggcaagcccugccgcgcccuccccacccucaagugccagaccuucugccagcgccacggccucauguucgaggucgucgaccuccgcuggggcauccgcaacaucgaggccaccgaccaccucaccaccgagcucugccucgaggaggucgaccgcugcuggaagaccuccaucggccccgccuucgucgcccucaucggcgaccaguacggccccugccucauccccucccgcaucgacgagaaggagugggagguccuccgcgaccaccucaccgcccgccccuccgaccucgagcucgucgcccgcuacuuccagcgcgacgagaacgccuucccccccaccuacguccuccaggcccccggcaccggcgaggccugcgagcccgaggaggccacccucaccuccguccuccgcuccggcgcccaggaggcccgccgccucggccucaucacccaggagcaguggcagcacuaccaccgcuccgucaucgagugggagaucgagcgcucccuccucuccuccgaggaccgcgagcagggcgccaccgucuuccuccgcgagauccaggaccuccacaagcacauccucgaggacugcgcccuccgcauggucgaccgccucgccgacggcugccucgacgccgacgcccagaaccuccucuccucccucaagucccacaucaccgacaugcaccccggcguccucaagacccaccgccuccccuggucccgcgaccucgucaaccccaagaacaagacccacgccugcuaccucaaggagcucggcgagcaguucgucguccgcgccaaccaccagguccucacccgccuccgcgagcucgacaccgccggccaggagcucgccuggcucuaccaggagauccgccaccaccucuggcaguccuccgaggucauccagaccuucugcggccgccaggagcuccucgcccgccucggccagcagcuccgccacgacgacuccaagcagcacaccccccucguccucuucggcccccccggcaucggcaagaccgcccucaugugcaagcucgccgagcagaugccccgccuccucggccacaagaccgucaccguccuccgccuccucggcaccucccagauguccuccgacgcccgcggccuccucaaguccaucugcuuccaggucugccucgccuacggccucccccucccccccgcccagguccucgacgcccacacccgcgucguccaguucuuccacacccuccuccacaccgucuccugccgcaacuucgagucccucguccuccuccucgacgccauggacgaccucgacuccguccgccacgcccgccgcguccccuggcucccccucaacugccccccccgcguccaccucauccucuccgccugcuccggcgcccucggcguccucgacacccuccagcgcguccuccucgaccccgaggccuacugggaggucaagccccucuccggcaaccagggccagcagaugauccagcuccuccucgccgccgcccgccgcacccucucccccguccacaccgaccuccucugggccucccuccccgagugcggcaaccccggccgccuccgccucgccuucgaggaggcccgcaagugggccuccuucaccguccccgucccccucgccaccaccgccgaggaggccacccaccagcucugcacccgccucgagcagacccacggccagcuccucgucgcccacguccucggcuacaucgucuccucccgccacggccucuccgaggccgagcucaaggacguccucucccucgacgacgagguccuccaggacgucuaccgcgacuggaccccccccuccaaggagcuccuccgcuuccccccccuccucuggguccgccuccgccgcgaccucggcuacuaccucgcccgccgccccgucgacggcuucacccuccucgccaucgcccaccgccagcucgucgaggucguccgcgagcgcuaccucuccggcuccgagcgcgccaagcgccacggcguccucgccgacuucuucuccggcaccuggucccagggcaccaagaagcucaucacccucccccucgucggcaagccccucaaccucgaccgcaaggucgccccccagccccucugguucucccacaccgucgccaaccuccgcaagcucaaggagcuccccuaccaccuccuccacuccggccgccucgaggagcucaagcaggagguccucggcuccauguccuggaucuccugccgcggcaucuccggcggcaucgaggaccuccucgacgacuucgaccucugcgccccccaccucgacucccccgaggucggccucguccgcgaggcccuccagcucugccgccccgccgucgagcuccgcggcauggagcgcucccuccucuacaccgagcuccucgcccgccuccacuucuucgccaccucccaccccgcccucgucggccagcucugccagcaggcccaguccugguuccagcucugcgcccaccccguccucgucccccucggcggcuuccuccagccccccggcggcccccuccgcgccacccucuccggcugccacaagggcaucaccgccauggccuggggcgucgaggagaagcuccucgucaucggcacccaggacggcaucauggccgucugggacauggaggagcagcacgucauccacaugcucaccggccacaccggcgagguccgcugcgucaagaucuucgccaagggcacccucgccaacuccgccuccaaggacuacacccuccaccucuggaaccuccucuccggccaggagaaguucaccaucugggacggcggcuccaagaaccccgccgagccccagaucuggaaccuccacgucgacgaggcccacaaggucgucuacuccgccuccggcuccaagaucaacgccuggaaccucgagaccgccgagcccgucuuccacauccucggcgacgccuccgaccccuggaugugcauggccguccucgccucccaggccacccuccucaccgucucccgcgacggcgucgucucccucugguccuccgccaccggcaagcuccagggcaagcagcacauguccuccaucaaggaggagacccccaccugcgccgucuccguccagaagcagggcaagcucgucaccggcuucuccaacggcuccaucucccucgucuccuccaagggcgaccgccuccucgagaagcuccccgacgccguccgcuuccucgucgucuccgaggacgagucccuccucgccgccggcuucggccgcuccguccgcaucuuccucgccgacucccgcggcuuccgccgcuucauggccauggaccucgagcacgaggacauggucgagaccgccgucuucggcaccgagaacaaccucaucaucaccggcucccucgacgcccucauccaggucuggucccucuccgagcagggcacccuccucgacauccucgagggcgucggcgcccccgucucccuccucgcccgcggcggcgcccucgucgccuccgccuccccccaguccuccuccuucaaggucugggaccucuccgacgcccaccgcucccgcguccccgcccccuuccucgaccgcaccggccucaccgccgucucccacaacggcuccuacgucuacuuccccaagaucggcgacaagaacaaggucaccaucugggaccucgccgagggcgaggagcaggacucccucgacaccuccuccgagauccgcugccucgaggucgccgagcagcgcaagcuccucuucaccggccucgucuccggcgucguccucgucuucccccucaacucccgccaggacgucaucugcauccccccccccgaggcccgcaaggccaucaacugcaugucccucuccaagugcgaggaccgccucgccaucgccuacgacaacaucguccucguccucgacaucaccuccggcgaccccugccccgucaucgacggcccccgcuacaccuucuacacccagcuccccgagacccucuccuccgucgccauccucaccgacuaccgcgucgucuacuccaugaccaacggcgaccucuuccucuacgagugcgccaccuccaaggccuucccccucgagacccaccgcucccgcgucgccugcgucgaggucucccacaaggagcagcucgucgucuccggcuccgaggacgcccuccucugccucugggaccuccaggcccgcaaguggaaguucgagauguccuacaccgcccccugcuga

SEQ ID NO: 46964 - RNA, 1071 nt, Artificial Sequence
  derived and/or modified sequence opt2 from NXF1__Homo_sapiens__NP_001074960
auggccgacgagggcaaguccuacuccgagcacgacgacgagcgcgucaacuucccccagcgcaagaagaagggccgcggccccuuccgcuggaaguacggcgagggcaaccgccgcuccggccgcggcggcuccggcauccgcuccucccgccucgaggaggacgacggcgacgucgccauguccgacgcccaggacggcccccgcguccgcuacaaccccuacaccacccgccccaaccgccgcggcgacaccuggcacgaccgcgaccgcauccacgucaccguccgccgcgaccgcgccccccccgagcgcggcggcgccggcaccucccaggacggcaccuccaagaacugguucaagaucaccauccccuacggccgcaaguacgacaaggccuggcuccucuccaugauccaguccaagugcuccguccccuucacccccaucgaguuccacuacgagaacacccgcgcccaguucuucgucgaggacgccuccaccgccuccgcccucaaggccgucaacuacaagauccucgaccgcgagaaccgccgcaucuccaucaucaucaacuccuccgcccccccccacaccauccucaacgagcucaagcccgagcaggucgagcagcucaagcucaucauguccaagcgcuacgacggcucccagcaggcccucgaccucaagggccuccgcuccgaccccgaccucgucgcccagaacaucgacgucguccucaaccgccgcuccugcauggccgccacccuccgcaucaucgaggagaacauccccgagcuccucucccucaaccucuccaacaaccgccucuaccgccucgacgacauguccuccaucguccagaaggcccccaaccucaagauccucaaccucuccggcaacgagcucaaguccgagcgcgagcucgacaagaucaagggccucaagcucgaggagcucuggcucgacggcaacucccucugcgacaccuuccgcgaccaguccaccuacauccgcuccgucgucgccugcgucuccccccccggcgaccuccacccccucggcggcuga

SEQ ID NO: 46965 - RNA, 1881 nt, Artificial Sequence
  derived and/or modified sequence opt2 from NXF2B__Homo_sapiens__NP_001093156
augugcuccacccucaagaagugcggcaccuaccgcaccgaggucgccgagugccacgaccacggcuccaccuuccagggccgcaagaagggcggcuccuccuuccgcgacaacuucgacaagcgcuccugccacuacgagcacggcggcuacgagcgcccccccucccacugccaggagaacgacggcuccgucgagaugcgcgacguccacaaggaccagcagcuccgccacacccccuacuccauccgcugcgagcgccgcaugaaguggcacuccgaggacgagauccgcaucaccaccuggcgcaaccgcaagccccccgagcgcaagaugucccagaacacccaggacggcuacacccgcaacugguucaaggucaccauccccuacggcaucaaguacgacaaggccuggcucaugaacuccauccagucccacugcuccgaccgcuucacccccgucgacuuccacuacguccgcaaccgcgccugcuucuucguccaggacgccuccgccgccuccgcccucaaggacgucuccuacaagaucuacgacgacgagaaccagaagaucugcaucuucgucaaccacuccaccgcccccuacuccgucaagaacaagcucaagcccggccagauggagaugcucaagcucaccaugaacaagcgcuacaacgucucccagcaggcccucgaccuccagaaccuccgcuucgaccccgaccucaugggccgcgacaucgacaucauccucaaccgccgcaacugcauggccgccacccucaagaucaucgagcgcaacuuccccgagcuccucucccucaaccucugcaacaacaagcucuaccagcucgacggccucuccgacaucaccgagaaggcccccaaggucaagacccucaaccucuccaagaacaagcucgaguccgccugggagcucggcaaggucaagggccucaagcucgaggagcucuggcucgagggcaacccccucugcuccaccuucuccgaccaguccgccuacgucuccgccauccgcgacugcuuccccaagcuccuccgccucgacggccgcgagcucuccgcccccgucaucgucgacaucgacuccuccgagaccaugaagcccugcaaggagaacuucaccggcuccgagacccucaagcaccucguccuccaguuccuccagcaguacuacuccaucuacgacuccggcgaccgccagggccuccucggcgccuaccacgacgaggccugcuucucccucgccauccccuucgaccccaaggacuccgcccccuccucccucugcaaguacuucgaggacucccgcaacaugaagacccucaaggaccccuaccucaagggcgagcuccuccgccgcaccaagcgcgacaucgucgacucccucuccgcccuccccaagacccagcacgaccucuccuccauccucgucgacgucuggugccagaccgagcgcaugcucugcuucuccgucaacggcgucuucaaggaggucgagggccagucccagggcuccguccucgccuucacccgcaccuucaucgccacccccggcuccuccuccucccucugcaucgucaacgacgagcucuucguccgcgacgccuccccccaggagacccaguccgccuucuccauccccgucuccacccucuccuccuccuccgagcccucccucucccaggagcagcaggagaugguccaggccuucuccgcccaguccggcaugaagcucgaguggucccagaagugccuccaggacaacgaguggaacuacacccgcgccggccaggccuucaccaugcuccagaccgagggcaagauccccgccgaggccuucaagcagaucuccuga

SEQ ID NO: 46966 - RNA, 1596 nt, Artificial Sequence
  derived and/or modified sequence opt2 from NXF3__Homo_sapiens__NP_071335
augucccuccccuccggccacaccaccggccacaccgaccaggucguccagcgccgcgcccgcugcugggacaucuaccagcgccgcuucuccucccgcuccgagcccgucaaccccggcaugcacuccuccucccaccagcagcaggacggcgacgccgccaugcacggcgcccacauggacucccccguccgcuacacccccuacaccaucucccccuacaaccgcaagggcuccuuccgcaagcaggaccagacccacgucaacauggagcgcgagcagaagccccccgagcgccgcauggagggcaacaugcccgacggcacccucggcuccugguucaagaucaccguccccuucggcaucaaguacaacgagaaguggcuccucaaccucauccagaacgagugcuccguccccuucguccccgucgaguuccacuacgagaacaugcacgccuccuucuucgucgagaacgccuccaucgccuacgcccucaagaacgucuccggcaagaucugggacgaggacaacgagaagaucuccaucuucgucaaccccgccggcaucccccacuucguccaccgcgagcucaaguccgagaaggucgagcagaucaagcucgccaugaaccagcagugcgacgucucccaggaggcccucgacauccagcgccuccccuucuaccccgacauggucaaccgcgacaccaagauggccuccaacccccgcaagugcauggccgccucccucgacguccacgaggagaacauccccaccgucauguccgccggcgagauggacaaguggaagggcaucgagcccggcgagaagugcgccgaccgcucccccgucugcaccaccuucuccgacaccuccuccaacaucaacuccauccucgagcucuuccccaagcuccucugccucgacggccagcaguccccccgcgccacccucugcggcaccgaggcccacaagcgccuccccaccugcaagggcuccuucuucggcuccgagaugcucaagaaccucguccuccaguuccuccagcaguacuaccucaucuacgacuccggcgaccgccagggccuccucuccgccuaccacgacgaggccugcuucucccucuccauccccuucaaccccgaggacuccgcccccuccuccuucugcaaguucuucaaggacucccgcaacaucaagauccucaaggaccccuaccuccgcggcgagcuccucaagcacaccaagcucgacaucgucgacucccucuccgcccuccccaagacccagcacgaccucuccuccuuccucgucgacaugugguaccagaccgaguggaugcucugcuucuccgucaacggcgucuucaaggaggucgagggccagucccagggcuccguccucgccuucacccgcaccuucaucgccacccccggcuccuccuccucccucugcaucgucaacgacaagcucuucguccgcgacaccucccaccagggcacccaguccgcccucuucacccucguccccaccgccuucuccuccuccguccccgccuucucccaggagcagcagaagaugcuccccuccuga

SEQ ID NO: 46967 - RNA, 1098 nt, Artificial Sequence
  derived and/or modified sequence opt2 from NXF5__Homo_sapiens__NP_116564
augcgccgcaacacccaggacgagaacaugcgcaagugguucaaggucaccauccccuacggcaucaaguacgacaaggccuggcucaugaacuccauccaguccaacugcuccguccccuucacccccgucgacuuccacuacauccgcaaccgcgccugcuucuucguccaggucgccuccgccgccuccgcccucaaggacgucuccuacaagaucuacgacgacgagaaccagaagaucugcaucuucgucucccacuucaccgcccccuacuccgucaagaacaagcucaagcccggccagauggagaugcucaagcucaccaugaacaagcgcuacaacgucucccagcaggcccucgaccuccagaaccuccgcuucgaccccgaccucaugggccgcgacaucgacaucauccucaaccgccgcaacugcauggccgccacccucaagaucaccgagcgcaacuuccccgagcuccucucccucaaccucugcaacaacaagcucuaccagcucgacggccucuccgacaucaccgagaaggcccccaaggucaagacccucaaccucuccaagaacaagcucgaguccgccugggagcucggcaaggucaagggccucaagcucgaggagcucuggcucgagggcaacccccucugcuccaccuucuccgaccaguccgccuacgucuccgccauccgcgacugcuuccccaagcuccuccgccucgacggccgcgagcucuccgcccccgucaucgucgacaucgacuccuccgagaccaugaagcccugcaaggagaacuucaccggcuccgagacccucaagcaccucguccuccaguuccuccagcaguccaaccucugcaaguacuucaaggacucccgcaacaucaagauccucaaggaccccuaccuccagcgcaagcuccucaagcacaccaagugcccccgcaacgucgacucccucuccgcccuccccgagacccagcacgacuucaccuccauccucgucgacaugugguaccagaccgucaacaccugcuuccucccccgcgccggccccgagucccagucccuccgcccccucuga

SEQ ID NO: 46968 - RNA, 984 nt, Artificial Sequence
  derived and/or modified sequence opt2 from NXN__Homo_sapiens__NP_001192248
auggccgacgucucccuccaccgcaaccccgccacccucaagcucuggaacaaguaccgcaucuccaacauccccucccucaucuuccucgacgccaccaccggcaaggucgucugccgcaacggccuccucgucauccgcgacgaccccgagggccucgaguuccccuggggccccaagcccuuccgcgaggucaucgccggcccccuccuccgcaacaacggccagucccucgaguccuccucccucgagggcucccacgucggcgucuacuucuccgcccacuggugcccccccugccgcucccucacccgcguccucgucgaguccuaccgcaagaucaaggaggccggccagaacuucgagaucaucuucgucuccgccgaccgcuccgaggaguccuucaagcaguacuucuccgagaugcccuggcucgccguccccuacaccgacgaggcccgccgcucccgccucaaccgccucuacggcauccagggcauccccacccucaucaugcucgacccccagggcgaggucaucacccgccagggccgcgucgagguccucaacgacgaggacugccgcgaguuccccuggcaccccaagcccguccucgagcucuccgacuccaacgccgcccagcucaacgagggccccugccucguccucuucgucgacuccgaggacgacggcgaguccgaggccgccaagcagcucauccagcccaucgccgagaagaucaucgccaaguacaaggccaaggaggaggaggccccccuccucuucuucgucgccggcgaggacgacaugaccgacucccuccgcgacuacaccaaccuccccgaggccgccccccuccucaccauccucgacauguccgcccgcgccaaguacgucauggacgucgaggagaucacccccgccaucgucgaggccuucgucaacgacuuccucgccgagaagcucaagcccgagcccaucuga

SEQ ID NO: 46969 - RNA, 639 nt, Artificial Sequence
  derived and/or modified sequence opt2 from NXNL1__Homo_sapiens__NP_612463
auggccucccucuucuccggccgcauccucauccgcaacaacuccgaccaggacgagcucgacaccgaggccgaggucucccgccgccucgagaaccgccucguccuccucuucuucggcgccggcgccugcccccagugccaggccuucguccccauccucaaggacuucuucguccgccucaccgacgaguucuacguccuccgcgccgcccagcucgcccucgucuacgucucccaggacuccaccgaggagcagcaggaccucuuccucaaggacaugcccaagaaguggcucuuccuccccuucgaggacgaccuccgccgcgaccucggccgccaguucuccgucgagcgccuccccgccgucgucguccucaagcccgacggcgacguccucacccgcgacggcgccgacgagauccagcgccucggcaccgccugcuucgccaacuggcaggaggccgccgagguccucgaccgcaacuuccagcuccccgaggaccucgaggaccaggagccccgcucccucaccgagugccuccgccgccacaaguaccgcgucgagaaggccgcccgcggcggccgcgaccccggcggcggcggcggcgaggagggcggcgccggcggccucuucuga

SEQ ID NO: 46970 - RNA, 471 nt, Artificial Sequence
  derived and/or modified sequence opt2 from NXNL2__Homo_sapiens__NP_001155097
auggucgacauccucggcgagcgccaccucgucaccugcaagggcgccaccgucgaggccgaggccgcccuccagaacaaggucgucgcccucuacuucgccgccgcccgcugcgcccccucccgcgacuucaccccccuccucugcgacuucuacaccgcccucgucgccgaggcccgccgccccgcccccuucgaggucgucuucgucuccgccgacggcuccucccaggagaugcucgacuucaugcgcgagcuccacggcgccuggcucgcccuccccuuccacgaccccuaccgccacgagcuccgcaagcgcuacaacgucaccgccauccccaagcucgucaucgucaagcagaacggcgaggucaucaccaacaagggccgcaagcagauccgcgagcgcggccucgccugcuuccaggacugggucgaggccgccgacaucuuccagaacuucuccgucuga

SEQ ID NO: 46971 - RNA, 1218 nt, Artificial Sequence
  derived and/or modified sequence opt2 from NXPE1__Homo_sapiens__NP_689528
auguccucccccgcccucaccgccggcgccuccggcaaggucauggacuucaacaacggcaccuaccucgucuccuucacccucuucugggagggccaggucucccucucccuccuccucauccaccccuccgagggcgccuccgcccucuggcgcgcccgcaaccagggcuacgacaagaucaucuucaagggcaaguucgucaacggcaccucccacgucuucaccgagugcggccucacccucaacuccaacgccgagcucugcgaguaccucgacgaccgcgaccaggaggccuucuacugcaugaagccccagcacaugcccugcgaggcccucaccuacaugaccacccgcaaccgcgaggucuccuaccucaccgacaaggagaacucccucuuccaccgcuccaaggucggcgucgagaugaugaaggaccgcaagcacaucgacgucaccaacugcaacaagcgcgagaagaucgaggagaccugccaggucggcaugaagccccccguccccggcggcuacacccuccagggcaaguggaucaccaccuucugcaaccagguccagcucgacaccaucaagaucaacggcugccucaagggcaagcucaucuaccuccucggcgacuccacccuccgccaguggaucuacuacuuccccaaggucgucaagacccucaaguucuucgaccuccacgagaccggcaucuucaagaagcaccuccuccucgacgccgagcgccacacccagauccaguggaagaagcacuccuaccccuucgucaccuuccagcucuacucccucaucgaccacgacuacaucccccgcgagaucgaccgccucuccggcgacaagaacaccgccaucgucaucaccuucggccagcacuuccgccccuuccccaucgacaucuucauccgccgcgccaucggcguccagaaggccaucgagcgccucuuccuccgcucccccgccaccaaggucaucaucaagaccgagaacauccgcgagaugcacaucgagaccgagcgcuucggcgacuuccacggcuacauccacuaccucaucaugaaggacaucuucaaggaccucaacgucggcaucaucgacgccugggacaugaccaucgccuacggcaccgacaccauccacccccccgaccacgucaucggcaaccagaucaacauguuccucaacuacaucugcuga

SEQ ID NO: 46972 - RNA, 1680 nt, Artificial Sequence
  derived and/or modified sequence opt2 from NXPE2__Homo_sapiens__NP_872301
auggucgagaagauccucauccaccgcauccucacccucuuccccaacgccaucgcccgcaagcuccuccucaugcucaccuucauccucaucuucuggaucaucuaccucgccuccaaggaccacaccaaguucuccuucaaccucgagaaccacaucauccucaaccagggcaacaucuucaagaaguacucccacuccgagaccccccucugccccgccgucucccccaaggagaccgagcuccgcaucaaggacaucauggagaagcucgaccagcagauccccccccgccccuucacccacgucaacaccaccaccuccgccacccacuccaccgccaccauccucaacccccaggacaccuacugccgcggcgaccagcucgacauccuccucgagguccgcgaccaccucggccaccgcaagcaguacggcggcgacuuccuccgcgcccgcauguacuccaccgcccucauggccggcgccuccggcaaggucaccgacuucaacaacggcaccuaccucgucuccuucacccucuucugggagggccaggucucccucucccuccuccucauccaccccuccgagggcgucuccgcccucuggcgcgcccgcaaccagggcugcgaccgcaucaucuucaccggccucuucgccaaccgcuccuccaacgucuucaccgagugcggccucacccucaacaccaacgccgagcucugccaguacauggacgaccgcgaccaggaggccuucuacugcguccgcccccagcacaugcccugcgaggcccucacccacaugaccacccgcacccgcaacaucuccuaccucuccaaggaggaguggcgccucuuccaccgcuccaacaucggcgucgagaugaugaagaacuucacccccaucgaggucauccccugcaacaaguccgagaacaucaagaagaacugccagaucggcaugaagacccccuuccccuccggcuacacccucaagaagauguggaucaccgccuucugcaagcagaucaaguucaacgagaccaagaacaucaacgacugccucgagcgcaagcucaucuaccucaugggcgacuccacccuccaccaguggaucuacuaccuccagaaggccgucaagacccucaaguacuucgaccaccacggcgccggcaucuucaagacccacguccuccucgacgucgagcgccacauccucauccaguggaagaagcacggccaccccuucgucaccaagaagcucuucuccgucaaggacgagaacuacaucccccgcgagaucgaccaggucgccggcgacaagaacaccgccaucgucaucacccucggccagcacuuccgccccuuccccaucaacaucuucauccgccgcgccaucaacauccagaaggccaucgagcgccucuuccuccgcucccccgagaccaaggucauccucaagaccgagaacacccgcgagaucgagcagaacgccgagauguucuccgacuuccacggcuacauccagaaccucaucauccgcgacaucuucgucgaccucaacgucggcaucaucgacgccugggacaugaccaucgccuacugcaccaacaacgcccacccccccgacuacgucauccagaaccagaucggcauguuccucaacuacaucugcuga

SEQ ID NO: 46973 - RNA, 1635 nt, Artificial Sequence
  derived and/or modified sequence opt2 from NXPE4__Homo_sapiens__NP_001071107
augaagaucuccaugaucaacuacaagucccuccucgcccuccucuucauccucgccuccuggaucaucuucaccgucuuccagaacuccaccaaggucugguccgcccucaaccucuccaucucccuccacuacuggaacaacuccaccaagucccucuuccccaagaccccccucaucucccucaagccccucaccgagaccgagcuccgcaucaaggagaucaucgagaagcucgaccagcagauccccccccgccccuucacccacgucaacaccaccaccuccgccacccacuccaccgccaccauccucaacccccgcgacaccuacugccgcggcgaccagcuccacauccuccucgagguccgcgaccaccucggccgccgcaagcaguacggcggcgacuuccuccgcgcccgcauguccucccccgcccucauggccggcgccuccggcaaggucaccgacuucaacaacggcaccuaccucgucuccuucacccucuucugggagggccaggucucccucucccuccuccucauccaccccuccgagggcgucuccgcccucugguccgcccgcaaccagggcuacgaccgcgucaucuucaccggccaguucgucaacggcaccucccagguccacuccgagugcggccucauccucaacaccaacgccgagcucugccaguaccucgacaaccgcgaccaggagggcuucuacugcguccgcccccagcacaugcccugcgccgcccucacccacauguacuccaagaacaagaaggucuccuaccucuccaagcaggagaagucccucuucgagcgcuccaacgucggcgucgagaucauggagaaguucaacaccaucuccgucuccaagugcaacaaggagaccgucgccaugaaggagaagugcaaguucggcaugaccuccaccauccccuccggccacgucuggcgcaacaccuggaaccccgucuccugcucccucgccaccgucaagaugaaggagugccuccgcggcaagcucaucuaccucaugggcgacuccaccauccgccaguggauggaguacuucaaggccuccaucaacacccucaaguccgucgaccuccacgaguccggcaagcuccagcaccagcucgccgucgaccucgaccgcaacaucaacauccaguggcagaaguacugcuacccccucaucggcuccaugaccuacuccgucaaggagauggaguaccucacccgcgccaucgaccgcaccggcggcgagaagaacaccgucaucgucaucucccucggccagcacuuccgccccuuccccaucgacgucuucauccgccgcgcccucaacguccacaaggccauccagcaccuccuccuccgcucccccgacaccauggucaucaucaagaccgagaacauccgcgagauguacaacgacgccgagcgcuucuccgacuuccacggcuacauccaguaccucaucaucaaggacaucuuccaggaccucuccgucuccaucaucgacgccugggacaucaccaucgccuacggcaccaacaacguccaccccccccagcacgucgucggcaaccagaucaacauccuccucaacuacaucugcuga

SEQ ID NO: 46974 - RNA, 816 nt, Artificial Sequence
  derived and/or modified sequence opt2 from NXPH1__Homo_sapiens__NP_689958
augcaggccgccugcugguacguccucuuccuccuccagcccaccgucuaccucgucaccugcgccaaccucaccaacggcggcaaguccgagcuccucaaguccggcuccuccaaguccacccucaagcacaucuggaccgaguccuccaaggaccucuccaucucccgccuccucucccagaccuuccgcggcaaggagaacgacaccgaccucgaccuccgcuacgacacccccgagcccuacuccgagcaggaccucugggacuggcuccgcaacuccaccgaccuccaggagccccgcccccgcgccaagcgccgccccaucgucaagaccggcaaguucaagaagauguucggcuggggcgacuuccacuccaacaucaagaccgucaagcucaaccuccucaucaccggcaagaucgucgaccacggcaacggcaccuucuccgucuacuuccgccacaacuccaccggccagggcaacgucuccgucucccucgucccccccaccaagaucgucgaguucgaccucgcccagcagaccgucaucgacgccaaggacuccaaguccuucaacugccgcaucgaguacgagaaggucgacaaggccaccaagaacacccucugcaacuacgaccccuccaagaccugcuaccaggagcagacccagucccacgucuccuggcucugcuccaagcccuucaaggucaucugcaucuacaucuccuucuacuccaccgacuacaagcucguccagaaggucugccccgacuacaacuaccacuccgacacccccuacuuccccuccggcuga

SEQ ID NO: 46975 - RNA, 795 nt, Artificial Sequence
  derived and/or modified sequence opt2 from NXPH2__Homo_sapiens__NP_009157
augcgccuccgcccccucccccucgucgucguccccggccuccuccagcuccucuucugcgacuccaaggaggucguccacgccaccgagggccucgacugggaggacaaggacgcccccggcacccucgucggcaacgucguccacucccgcaucaucuccccccuccgccucuucgucaagcagucccccguccccaagcccggccccauggccuacgccgacuccauggagaacuucugggacuggcucgccaacaucaccgagauccaggagccccucgcccgcaccaagcgccgccccaucgucaagaccggcaaguucaagaagauguucggcuggggcgacuuccacuccaacaucaagaccgucaagcucaaccuccucaucaccggcaagaucgucgaccacggcaacggcaccuucuccgucuacuuccgccacaacuccaccggccucggcaacgucuccgucucccucgucccccccuccaaggucgucgaguucgaggucuccccccaguccacccucgagaccaaggaguccaaguccuucaacugccgcaucgaguacgagaagaccgaccgcgccaagaagaccgcccucugcaacuucgaccccuccaagaucugcuaccaggagcagacccagucccacgucuccuggcucugcuccaagcccuucaaggucaucugcaucuacaucgccuucuacuccgucgacuacaagcucguccagaaggucugccccgacuacaacuaccacuccgagacccccuaccucuccuccggcuga

SEQ ID NO: 46976 - RNA, 423 nt, Artificial Sequence
  derived and/or modified sequence opt2 from NXT1__Homo_sapiens__XP_011527532
auggccuccgucgacuucaagaccuacgucgaccaggccugccgcgccgccgaggaguucgucaacgucuacuacaccaccauggacaagcgccgccgccuccucucccgccucuacaugggcaccgccacccucgucuggaacggcaacgccgucuccggccaggagucccucuccgaguucuucgagaugcuccccuccuccgaguuccagaucuccgucgucgacugccagcccguccacgacgaggccacccccucccagaccaccguccucgucgucaucugcggcuccgucaaguucgagggcaacaagcagcgcgacuucaaccagaacuucauccucaccgcccaggccucccccuccaacaccgucuggaagaucgccuccgacugcuuccgcuuccaggacugggccuccuga

SEQ ID NO: 46977 - RNA, 429 nt, Artificial Sequence
  derived and/or modified sequence opt2 from NXT2__Homo_sapiens__NP_001229546
auggccaccucccucgacuucaagaccuacgucgaccaggccugccgcgccgccgaggaguucgucaacaucuacuacgagaccauggacaagcgccgccgcgcccucacccgccucuaccucgacaaggccacccucaucuggaacggcaacgccgucuccggccucgacgcccucaacaacuucuucgacacccuccccuccuccgaguuccaggucaacaugcucgacugccagcccguccacgagcaggccacccagucccagaccaccguccucgucgucaccuccggcaccgucaaguucgacggcaacaagcagcacuucuucaaccagaacuuccuccucaccgcccaguccacccccaacaacaccgucuggaagaucgccuccgacugcuuccgcuuccaggacugguccuccuccuga

SEQ ID NO: 46978 - RNA, 1962 nt, Artificial Sequence
  derived and/or modified sequence opt2 from NYAP2__Homo_sapiens__NP_065915
augaucuccuccaagaugauguccuccaaccccgaggaggacccccucgacaccuuccuccaguacaucgaggacaugggcaugaaggccuacgacggccucgucauccagaacgccuccgacaucgcccgcgagaacgaccgccuccgcaacgagaccaaccucgccuaccucaaggagaagaacgagaagcgccgccgccaggaggaggccaucaagcgcaucggcggcgaggucggccgcggccacgagggcuccuacgucggcaagcacuuccgcaugggcuucaugaccaugcccgccccccaggaccgccucccccaccccugcuccuccggcuucuccguccgcucccagucccuccacuccgucggcggcaccgacgacgacuccuccugcggcucccgccgccagcccccccccaagcccaagcgcgaccccuccaccaagcucuccaccuccuccgagaccgucuccuccaccgccgccuccaaguccggcaagacccccgagcgcaccgaggccuccgccaagccccgcccccacuccgacgaguacuccaagaagauccccccccccaagcccaagcgcaaccccaacacccagcucuccaccuccuucgacgagaccuacaucaagaagcacggcccccgccgcaccucccucccccgcgacuccucccucucccagaugggcucccccgccggcgaccccgaggaggaggagcccgucuacaucgagauggucggcaacauccuccgcgacuuccgcaaggaggacgacgaccaguccgaggccgucuacgaggagaugaaguaccccaucuucgacgaccucggccaggacgccaagugcgacuucgaccaccacuccugcuccucccagugcgccacccccaccguccccgaccucgacuucgccaaggccuccguccccugcccccccaagggccuccucugcgacauccccccccccuuccccaaccuccucucccaccgccccccccuccucgucuucccccccgcccccguccacugcucccccaacuccgacgaguccccccucaccccccucgaggucaccaagcuccccguccucgagaacgucuccuacaugaagcagcccgccggcgccucccccuccacccuccccucccacguccccggccacgccaagcucgagaaggagcaggccgccgcccucggccccgccuccgccacccccgcccucuccuccuccccccccccccccuccacccucuaccgcacccaguccccccacggcuaccccaagucccacuccaccucccccucccccgucuccaugggccgcucccucaccccccucucccucaagcgccccccccccuacgacgccguccacuccggcucccucucccgcuccucccccuccgucccccacuccaccccccgccccgucucccaggacggcgccaagauggucaacgccgccgucaacaccuacggcgccgcccccggcggcucccgcucccgcacccccaccuccccccucgaggagcucaccucccucuucuccuccggccgcucccuccuccgcaaguccuccuccggccgccgcuccaaggagcccgccgagaaguccaccgaggagcucaagguccgcucccacuccaccgagccccuccccaagcucgacaacaaggagcgcggccaccacggcgccuccuccucccgcgagcccgucaaggcccaggagugggacggcacccccggcacccccgucgucaccucccgccucggccgcugcuccgucucccccacccuccucgccggcaaccacuccuccgagcccaaggucuccugcaagcucggccgcuccgccuccaccuccggcguccccccccccuccgucaccccccuccgccaguccuccgaccuccagcagucccagguccccuccucccucgccaaccgcgacuga

SEQ ID NO: 46979 - RNA, 1446 nt, Artificial Sequence
  derived and/or modified sequence opt2 from NYX__Homo_sapiens__NP_072089
augaagggccgcggcaugcucguccuccuccuccacgccgucguccucggccuccccuccgccugggccgucggcgccugcgcccgcgccugccccgccgccugcgccugcuccaccgucgagcgcggcugcuccguccgcugcgaccgcgccggccuccuccgcguccccgccgagcuccccugcgaggccgucuccaucgaccucgaccgcaacggccuccgcuuccucggcgagcgcgccuucggcacccuccccucccuccgccgccucucccuccgccacaacaaccucuccuucaucacccccggcgccuucaagggccucccccgccucgccgagcuccgccucgcccacaacggcgaccuccgcuaccuccacgcccgcaccuucgccgcccucucccgccuccgccgccucgaccucgccgccugccgccucuucuccguccccgagcgccuccucgccgagcuccccgcccuccgcgagcucgccgccuucgacaaccucuuccgccgcguccccggcgcccuccgcggccucgccaaccucacccacgcccaccucgagcgcggccgcaucgaggccgucgccuccuccucccuccagggccuccgccgccuccgcucccucucccuccaggccaaccgcguccgcgccguccacgccggcgccuucggcgacugcggcguccucgagcaccuccuccucaacgacaaccuccucgccgagcuccccgccgacgccuuccgcggccuccgccgccuccgcacccucaaccucggcggcaacgcccucgaccgcgucgcccgcgccugguucgccgaccucgccgagcucgagcuccucuaccucgaccgcaacuccaucgccuucgucgaggagggcgccuuccagaaccucuccggccuccucgcccuccaccucaacggcaaccgccucaccguccucgccugggucgccuuccagcccggcuucuuccucggccgccucuuccucuuccgcaaccccuggugcugcgacugccgccucgaguggcuccgcgacuggauggagggcuccggccgcgucaccgacguccccugcgccucccccggcuccgucgccggccucgaccucucccaggucaccuucggccgcuccuccgacggccucugcgucgaccccgaggagcucaaccucaccaccuccucccccggccccucccccgagcccgccgccaccaccgucucccgcuucuccucccuccucuccaagcuccucgccccccgcguccccgucgaggaggccgccaacaccaccggcggccucgccaacgccucccucuccgacucccucuccucccgcggcgucggcggcgccggccgccagcccugguuccuccucgccuccugccuccuccccuccgucgcccagcacgucgucuucggccuccagauggacuga

SEQ ID NO: 46980 - RNA, 459 nt, Artificial Sequence
  derived and/or modified sequence opt2 from OARD1__Homo_sapiens__NP_659500
auggccuccucccucaacgaggaccccgagggcucccgcaucaccuacgucaagggcgaccucuucgccugccccaagaccgacucccucgcccacugcaucuccgaggacugccgcaugggcgccggcaucgccguccucuucaagaagaaguucggcggcguccaggagcuccucaaccagcagaagaaguccggcgaggucgccguccucaagcgcgacggccgcuacaucuacuaccucaucaccaagaagcgcgccucccacaagcccaccuacgagaaccuccagaagucccucgaggccaugaagucccacugccucaagaacggcgucaccgaccucuccaugccccgcaucggcugcggccucgaccgccuccagugggagaacgucuccgccaugaucgaggaggucuucgaggccaccgacaucaagaucaccgucuacacccucuga

SEQ ID NO: 46981 - RNA, 1245 nt, Artificial Sequence
  derived and/or modified sequence opt2 from OAS1__Homo_sapiens__NP_001027581
augauggaccuccgcaacacccccgccaagucccucgacaaguucaucgaggacuaccuccuccccgacaccugcuuccgcaugcagaucaaccacgccaucgacaucaucugcggcuuccucaaggagcgcugcuuccgcggcuccuccuaccccgucugcgucuccaaggucgucaagggcggcuccuccggcaagggcaccacccuccgcggccgcuccgacgccgaccucgucgucuuccucuccccccucaccaccuuccaggaccagcucaaccgccgcggcgaguucauccaggagauccgccgccagcucgaggccugccagcgcgagcgcgccuucuccgucaaguucgagguccaggccccccgcuggggcaacccccgcgcccucuccuucguccucuccucccuccagcucggcgagggcgucgaguucgacguccuccccgccuucgacgcccucggccagcucaccggcggcuacaagcccaacccccagaucuacgucaagcucaucgaggagugcaccgaccuccagaaggagggcgaguucuccaccugcuucaccgagcuccagcgcgacuuccucaagcagcgccccaccaagcucaagucccucauccgccucgucaagcacugguaccagaacugcaagaagaagcucggcaagcuccccccccaguacgcccucgagcuccucaccgucuacgccugggagcgcggcuccaugaagacccacuucaacaccgcccagggcuuccgcaccguccucgagcucgucaucaacuaccagcagcucugcaucuacuggaccaaguacuacgacuucaagaaccccaucaucgagaaguaccuccgccgccagcucaccaagccccgccccgucauccucgaccccgccgaccccaccggcaaccucggcggcggcgaccccaagggcuggcgccagcucgcccaggaggccgaggccuggcucaacuaccccugcuucaagaacugggacggcucccccgucuccuccuggauccuccucacccagcacacccccggcuccauccaccccaccggccgccgcggccucgaccuccaccacccccucaacgccuccgccuccuggggcaagggccuccagugcuaccucgaccaguuccuccacuuccaggucggccuccucauccagcgcggccaguccuccuccgucuccuggugcaucauccaggaccgcacccaggucuccuga

SEQ ID NO: 46982 - RNA, 519 nt, Artificial Sequence
  derived and/or modified sequence opt2 from OAS2__Homo_sapiens__NP_001027903
augggcaacggcgagucccagcucuccuccguccccgcccagaagcucggcugguucauccaggaguaccucaagcccuacgaggagugccagacccucaucgacgagauggucaacaccaucugcgacguccuccaggagcccgagcaguucccccucguccagggcgucgccaucggcggcuccuacggccgcaagaccguccuccgcggcaacuccgacggcacccucguccucuucuucuccgaccucaagcaguuccaggaccagaagcgcucccagcgcgacauccucgacaagaccggcgacaagcucaaguucugccucuucaccaaguggcucaagaacaacuucgagauccagaagucccucgacggcuucaccauccaggucuucaccaagaaccagcgcaucuccuucgagguccucgccgccuucaacgcccucuccaagcacugcugggucuccggcgagaagucccagcgcuccggcugccagaccgcccucugcaaccucuga

SEQ ID NO: 46983 - RNA, 3264 nt, Artificial Sequence
  derived and/or modified sequence opt2 from OAS3__Homo_sapiens__NP_006178
auggaccucuacuccacccccgccgccgcccucgaccgcuucgucgcccgccgccuccagccccgcaaggaguucgucgagaaggcccgccgcgcccucggcgcccucgccgccgcccuccgcgagcgcggcggccgccucggcgccgccgccccccgcguccucaagaccgucaagggcggcuccuccggccgcggcaccgcccucaagggcggcugcgacuccgagcucgucaucuuccucgacugcuucaaguccuacgucgaccagcgcgcccgccgcgccgagauccucuccgagaugcgcgccucccucgaguccugguggcagaaccccguccccggccuccgccucaccuuccccgagcaguccguccccggcgcccuccaguuccgccucaccuccgucgaccucgaggacuggauggacgucucccucguccccgccuucaacguccucggccaggccggcuccggcgucaagcccaagccccaggucuacuccacccuccucaacuccggcugccagggcggcgagcacgccgccugcuucaccgagcuccgccgcaacuucgucaacauccgccccgccaagcucaagaaccucauccuccucgucaagcacugguaccaccaggucugccuccagggccucuggaaggagacccucccccccgucuacgcccucgagcuccucaccaucuucgccugggagcagggcugcaagaaggacgccuucucccucgccgagggccuccgcaccguccucggccucauccagcagcaccagcaccucugcgucuucuggaccgucaacuacggcuucgaggaccccgccgucggccaguuccuccagcgccagcucaagcgcccccgccccgucauccucgaccccgccgaccccaccugggaccucggcaacggcgccgccuggcacugggaccuccucgcccaggaggccgccuccugcuacgaccaccccugcuuccuccgcggcaugggcgaccccguccaguccuggaagggccccggccucccccgcgccggcugcuccggccucggccaccccauccagcucgaccccaaccagaagacccccgagaacuccaagucccucaacgccgucuacccccgcgccggcuccaagccccccuccugccccgcccccggccccaccggcgccgccuccaucguccccuccguccccggcauggcccucgaccucucccagauccccaccaaggagcucgaccgcuucauccaggaccaccucaagcccuccccccaguuccaggagcaggucaagaaggccaucgacaucauccuccgcugccuccacgagaacugcguccacaaggccucccgcgucuccaagggcggcuccuucggccgcggcaccgaccuccgcgacggcugcgacgucgagcucaucaucuuccucaacugcuucaccgacuacaaggaccagggcccccgccgcgccgagauccucgacgagaugcgcgcccagcucgaguccugguggcaggaccagguccccucccucucccuccaguuccccgagcagaacguccccgaggcccuccaguuccagcucgucuccaccgcccucaaguccuggaccgacgucucccuccuccccgccuucgacgccgucggccagcucuccuccggcaccaagcccaacccccaggucuacucccgccuccucaccuccggcugccaggagggcgagcacaaggccugcuucgccgagcuccgccgcaacuucaugaacauccgccccgucaagcucaagaaccucauccuccucgucaagcacugguaccgccaggucgccgcccagaacaagggcaagggccccgcccccgccucccucccccccgccuacgcccucgagcuccucaccaucuucgccugggagcagggcugccgccaggacugcuucaacauggcccagggcuuccgcaccguccucggccucguccagcagcaccagcagcucugcgucuacuggaccgucaacuacuccaccgaggaccccgccaugcgcaugcaccuccucggccagcuccgcaagccccgcccccucguccucgaccccgccgaccccaccuggaacgucggccacggcuccugggagcuccucgcccaggaggccgccgcccucggcaugcaggccugcuuccucucccgcgacggcaccuccguccagcccugggacgucaugcccgcccuccucuaccagacccccgccggcgaccucgacaaguucaucuccgaguuccuccagcccaaccgccaguuccucgcccaggucaacaaggccgucgacaccaucugcuccuuccucaaggagaacugcuuccgcaacucccccaucaaggucaucaaggucgucaagggcggcuccuccgccaagggcaccgcccuccgcggccgcuccgacgccgaccucgucgucuuccucuccugcuucucccaguucaccgagcagggcaacaagcgcgccgagaucaucuccgagauccgcgcccagcucgaggccugccagcaggagcgccaguucgaggucaaguucgaggucuccaagugggagaacccccgcguccucuccuucucccucaccucccagaccaugcucgaccaguccgucgacuucgacguccuccccgccuucgacgcccucggccagcucgucuccggcucccgccccuccucccaggucuacgucgaccucauccacuccuacuccaacgccggcgaguacuccaccugcuucaccgagcuccagcgcgacuucaucaucucccgccccaccaagcucaagucccucauccgccucgucaagcacugguaccagcagugcaccaagaucuccaagggccgcggcucccuccccccccagcacggccucgagcuccucaccgucuacgccugggagcagggcggcaaggacucccaguucaacauggccgagggcuuccgcaccguccucgagcucgucacccaguaccgccagcucugcaucuacuggaccaucaacuacaacgccaaggacaagaccgucggcgacuuccucaagcagcagcuccagaagccccgccccaucauccucgaccccgccgaccccaccggcaaccucggccacaacgcccgcugggaccuccucgccaaggaggccgccgccugcaccuccgcccucugcugcaugggccgcaacggcauccccauccagcccuggcccgucaaggccgccgucuga

SEQ ID NO: 46984 - RNA, 1545 nt, Artificial Sequence
  derived and/or modified sequence opt2 from OASL__Homo_sapiens__NP_003724
auggcccucaugcaggagcucuacuccacccccgccucccgccucgacuccuucgucgcccaguggcuccagccccaccgcgaguggaaggaggagguccucgacgccguccgcaccgucgaggaguuccuccgccaggagcacuuccagggcaagcgcggccucgaccaggacguccgcguccucaaggucgucaaggucggcuccuucggcaacggcaccguccuccgcuccacccgcgaggucgagcucgucgccuuccucuccugcuuccacuccuuccaggaggccgccaagcaccacaaggacguccuccgccucaucuggaagaccauguggcagucccaggaccuccucgaccucggccucgaggaccuccgcauggagcagcgcguccccgacgcccucgucuucaccauccagacccgcggcaccgccgagcccaucaccgucaccaucguccccgccuaccgcgcccucggccccucccuccccaacucccagcccccccccgaggucuacgucucccucaucaaggccugcggcggccccggcaacuucugccccuccuucuccgagcuccagcgcaacuucgucaagcaccgccccaccaagcucaagucccuccuccgccucgucaagcacugguaccagcaguacgucaaggcccgcuccccccgcgccaaccuccccccccucuacgcccucgagcuccucaccaucuacgccugggagaugggcaccgaggaggacgagaacuucaugcucgacgagggcuucaccaccgucauggaccuccuccucgaguacgaggucaucugcaucuacuggaccaaguacuacacccuccacaacgccaucaucgaggacugcguccgcaagcagcucaagaaggagcgccccaucauccucgaccccgccgaccccacccucaacgucgccgagggcuaccgcugggacaucgucgcccagcgcgccucccagugccucaagcaggacugcugcuacgacaaccgcgagaaccccaucuccuccuggaacgucaagcgcgcccgcgacauccaccucaccgucgagcagcgcggcuaccccgacuucaaccucaucgucaaccccuacgagcccauccgcaaggucaaggagaagauccgccgcacccgcggcuacuccggccuccagcgccucuccuuccagguccccggcuccgagcgccagcuccucuccucccgcugcucccucgccaaguacggcaucuucucccacacccacaucuaccuccucgagaccauccccuccgagauccaggucuucgucaagaaccccgacggcggcuccuacgccuacgccaucaaccccaacuccuucauccucggccucaagcagcagaucgaggaccagcagggccuccccaagaagcagcagcagcucgaguuccagggccagguccuccaggacuggcucggccucggcaucuacggcauccaggacuccgacacccucauccucuccaagaagaagggcgaggcccucuuccccgccuccuga

SEQ ID NO: 46985 - RNA, 906 nt, Artificial Sequence
  derived and/or modified sequence opt2 from OAT__Homo_sapiens__NP_001165285
augaacaccggcgucgaggccggcgagaccgccugcaagcucgcccgcaaguggggcuacaccgucaagggcauccagaaguacaaggccaagaucgucuucgccgccggcaacuucuggggccgcacccucuccgccaucuccuccuccaccgaccccaccuccuacgacggcuucggccccuucaugcccggcuucgacaucauccccuacaacgaccuccccgcccucgagcgcgcccuccaggaccccaacgucgccgccuucauggucgagcccauccagggcgaggccggcgucgucguccccgaccccggcuaccucaugggcguccgcgagcucugcacccgccaccagguccucuucaucgccgacgagauccagaccggccucgcccgcaccggccgcuggcucgccgucgacuacgagaacguccgccccgacaucguccuccucggcaaggcccucuccggcggccucuaccccgucuccgccguccucugcgacgacgacaucaugcucaccaucaagcccggcgagcacggcuccaccuacggcggcaacccccucggcugccgcgucgccaucgccgcccucgagguccucgaggaggagaaccucgccgagaacgccgacaagcucggcaucauccuccgcaacgagcucaugaagcuccccuccgacgucgucaccgccguccgcggcaagggccuccucaacgccaucgucaucaaggagaccaaggacugggacgccuggaaggucugccuccgccuccgcgacaacggccuccucgccaagcccacccacggcgacaucauccgcuucgcccccccccucgucaucaaggaggacgagcuccgcgaguccaucgagaucaucaacaagaccauccucuccuucuga

SEQ ID NO: 46986 - RNA, 681 nt, Artificial Sequence
  derived and/or modified sequence opt2 from OAZ1__Homo_sapiens__NP_001287949
auggucaaguccucccuccagcgcauccucaacucccacugcuucgcccgcgagaaggagggcgacaagcccuccgccaccauccacgccucccgcaccaugccccuccucucccuccacucccgcggcggcuccuccuccgagcgcgucucccuccacugcugcuccaaccccggccccggcccccgcuggugcuccgacgccccccaccccccccucaagauccccggcggccgcggcaacucccagcgcgaccacaaccucuccgccaaccucuucuacuccgacgaccgccucaacgucaccgaggagcucaccuccaacgacaagacccgcauccucaacguccagucccgccucaccgacgccaagcgcaucaacuggcgcaccguccucuccggcggcucccucuacaucgagauccccggcggcgcccuccccgagggcuccaaggacuccuucgccguccuccucgaguucgccgaggagcagcuccgcgccgaccacgucuucaucugcuuccacaagaaccgcgaggaccgcgccgcccuccuccgcaccuucuccuuccucggcuucgagaucguccgccccggccacccccucguccccaagcgccccgacgccugcuucauggccuacaccuucgagcgcgaguccuccggcgaggaggaggaguga

SEQ ID NO: 46987 - RNA, 570 nt, Artificial Sequence
  derived and/or modified sequence opt2 from OAZ2__Homo_sapiens__NP_002528
augaucaacacccaggacuccuccauccucccccucuccaacugcccccagcuccagugcugccgccacaucguccccggcccccucuggugcuccgacgccccccacccccucuccaagauccccggcggccgcggcggcggccgcgaccccucccucuccgcccucaucuacaaggacgagaagcucaccgucacccaggaccuccccgucaacgacggcaagccccacaucguccacuuccaguacgaggucaccgaggucaaggucuccuccugggacgccguccucuccucccagucccucuucgucgagauccccgacggccuccucgccgacggcuccaaggagggccuccucgcccuccucgaguucgccgaggagaagaugaaggucaacuacgucuucaucugcuuccgcaagggccgcgaggaccgcgccccccuccucaagaccuucuccuuccucggcuucgagaucguccgccccggccaccccugcguccccucccgccccgacgucauguucauggucuacccccucgaccagaaccucuccgacgaggacuga

SEQ ID NO: 46988 - RNA, 1107 nt, Artificial Sequence
  derived and/or modified sequence opt2 from OBFC1__Homo_sapiens__XP_006718039
augcagcccggcuccucccgcugcgaggaggagacccccucccuccucuggggccucgaccccgucuuccucgccuucgccaagcucuacauccgcgacauccucgacaugaaggagucccgccagguccccggcgucuuccucuacaacggccaccccaucaagcaggucgacguccucggcaccgucaucggcguccgcgagcgcgacgccuucuacuccuacggcgucgacgacuccaccggcgucaucaacugcaucugcuggaagaagcucaacaccgaguccgucuccgccgcccccuccgccgcccgcgagcucucccucaccucccagcucaagaagcuccaggagaccaucgagcagaagaccaagaucgagaucggcgacaccauccgcguccgcggcuccauccgcaccuaccgcgaggagcgcgagauccacgccaccaccuacuacaaggucgacgaccccgucuggaacauccagaucgcccgcaugcucgagcuccccaccaucuaccgcaaggucuacgaccagcccuuccacuccuccgcccucgagaaggaggaggcccucuccaaccccggcgcccucgaccuccccucccucaccucccuccucuccgagaaggccaaggaguuccucauggagaaccgcguccaguccuucuaccagcaggagcucgagauggucgagucccuccucucccucgccaaccagcccgucauccacuccgccuccuccgaccaggucaacuucaagaaggacaccaccuccaaggccauccacuccaucuucaagaacgccauccagcuccuccaggagaagggccucgucuuccagaaggacgacggcuucgacaaccucuacuacgucacccgcgaggacaaggaccuccaccgcaagauccaccgcaucauccagcaggacugccagaagcccaaccacauggagaagggcugccacuuccuccacauccucgccugcgcccgccucuccauccgccccggccucuccgaggccguccuccagcagguccucgagcuccucgaggaccaguccgacaucgucuccaccauggagcacuacuacaccgccuucuga

SEQ ID NO: 46989 - RNA, 687 nt, Artificial Sequence
  derived and/or modified sequence opt2 from OBP2A__Homo_sapiens__NP_001280118
augaagacccucuuccucggcgucacccucggccucgccgccgcccucuccuucacccucgaggaggaggacaucaccggcaccugguacgucaaggccauggucgucgacaaggacuuccccgaggaccgccgcccccgcaaggucucccccgucaaggucaccgcccucggcggcggcaaccucgaggccaccuucaccuucaugcgcgaggaccgcugcauccagaagaagauccucaugcgcaagaccgaggagcccggcaaguucuccgccuacggcggccgcaagcucaucuaccuccaggagcuccccggcaccgacgacuacgucuucuacugcaaggaccagcgccgcggcggccuccgcuacaugggcaagcucgucgccuccgcccccugccgcgccgucccccucuccccccccuggcucaccuggcccccccaccuccaggucggcauccucauccccaccuggcgccccuggaagaaccuccgcaacuggugcuccacccgcgacucccgccgccgcaccuucuccugccccugccgccgcgaggccgccuucuccaacacccgccagccccccggccuccaccuccaguccccccccuaccaccagacccagucccccgaccaccucgaccuccccuccucccacgaccccucccuccucccccccaccuga

SEQ ID NO: 46990 - RNA, 23907 nt, Artificial Sequence
  derived and/or modified sequence opt2 from OBSCN__Homo_sapiens__NP_001092093
auggaccagccccaguucuccggcgccccccgcuuccucacccgccccaaggccuucgucgucuccgucggcaaggacgccacccucuccugccagaucgucggcaaccccaccccccaggucuccugggagaaggaccagcagcccgucgccgccggcgcccgcuuccgccucgcccaggacggcgaccucuaccgccucaccauccucgaccucgcccucggcgacuccggccaguacgucugccgcgcccgcaacgccaucggcgaggccuucgccgccgucggccuccaggucgacgccgaggccgccugcgccgagcaggccccccacuuccuccuccgccccaccuccauccgcguccgcgagggcuccgaggccaccuuccgcugccgcgucggcggcuccccccgccccgccgucuccugguccaaggacggccgccgccucggcgagcccgacggcccccgcguccgcgucgaggagcucggcgaggccuccgcccuccgcauccgcgccgcccgcccccgcgacggcggcaccuacgagguccgcgccgagaacccccucggcgccgccuccgccgccgccgcccucgucgucgacuccgacgccgccgacaccgccucccgccccggcaccuccaccgccgcccuccucgcccaccuccagcgccgccgcgaggccaugcgcgccgagggcgcccccgccuccccccccuccaccggcacccgcaccugcaccgucaccgagggcaagcacgcccgccucuccugcuacgucaccggcgagcccaagcccgagaccgucuggaagaaggacggccagcucgucaccgagggccgccgccacgucgucuacgaggacgcccaggagaacuucguccucaagauccucuucugcaagcaguccgaccgcggccucuacaccugcaccgccuccaaccucgucggccagaccuacuccuccguccucgucgucguccgcgagcccgccguccccuucaagaagcgccuccaggaccucgagguccgcgagaaggaguccgccaccuuccucugcgaggucccccagcccuccaccgaggccgccugguucaaggaggagacccgccucugggccuccgccaaguacggcaucgaggaggagggcaccgagcgccgccucaccguccgcaacgucuccgccgacgacgacgccgucuacaucugcgagacccccgagggcucccgcaccgucgccgagcucgccguccagggcaaccuccuccgcaagcucccccgcaagaccgccguccgcgucggcgacaccgccauguucugcgucgagcucgccguccccgucggccccguccacuggcuccgcaaccaggaggaggucgucgccggcggccgcgucgccaucuccgccgagggcacccgccacacccucaccaucucccagugcugccucgaggacgucggccaggucgccuucauggccggcgacugccagaccuccacccaguucugcgucuccgccccccgcaagcccccccuccagccccccgucgaccccgucgucaaggcccgcauggaguccuccgucauccucuccugguccccccccccccacggcgagcgccccgucaccaucgacggcuaccucgucgagaagaagaagcucggcaccuacaccuggauccgcugccacgaggccgagugggucgccacccccgagcucaccgucgccgacgucgccgaggagggcaacuuccaguuccgcgucuccgcccucaacuccuucggccagucccccuaccucgaguuccccggcaccguccaccucgcccccaagcucgccguccgcaccccccucaaggccguccaggccgucgagggcggcgaggucaccuucuccgucgaccucaccgucgccuccgccggcgagugguuccucgacggccaggcccucaaggccuccuccgucuacgagauccacugcgaccgcacccgccacacccucaccauccgcgagguccccgccucccuccacggcgcccagcucaaguucgucgccaacggcaucgaguccuccauccgcauggagguccgcgccgcccccggccucaccgccaacaagccccccgccgccgccgcccgcgagguccucgcccgccuccacgaggaggcccagcuccucgccgagcucuccgaccaggccgccgccgucaccuggcucaaggacggccgcacccucucccccggccccaaguacgagguccaggccuccgccggccgccgcguccuccucguccgcgacgucgcccgcgacgacgccggccucuacgagugcgucucccgcggcggccgcaucgccuaccagcucuccguccagggccucgcccgcuuccuccacaaggacauggccggcuccugcgucgacgccgucgccggcggccccgcccaguucgagugcgagaccuccgaggcccacguccacguccacugguacaaggacggcauggagcucggccacuccggcgagcgcuuccuccaggaggacgucggcacccgccaccgccucgucgccgccaccgucacccgccaggacgagggcaccuacuccugccgcgucggcgaggacuccgucgacuuccgccuccgcgucuccgagcccaaggucgucuucgccaaggagcagcucgcccgccgcaagcuccaggccgaggccggcgccuccgccacccucuccugcgaggucgcccaggcccagaccgaggucaccugguacaaggacggcaagaagcucuccuccuccuccaaggucugcauggaggccaccggcugcacccgccgccucgucguccagcaggccggccaggccgacgccggcgaguacuccugcgaggccggcggccagcgccucuccuuccaccucgacgucaaggagcccaaggucgucuucgccaaggaccaggucgcccacuccgagguccaggccgaggccggcgccuccgccacccucuccugcgaggucgcccaggcccagaccgaggucaugugguacaaggacggcaagaagcucuccuccucccucaagguccacgucgaggccaagggcugccgccgccgccucgucguccagcaggccggcaagaccgacgccggcgacuacuccugcgaggcccgcggccagcgcgucuccuuccgccuccacaucaccgagcccaagaugauguucgccaaggagcaguccguccacaacgagguccaggccgaggccggcgccuccgccaugcucuccugcgaggucgcccaggcccagaccgaggucaccugguacaaggacggcaagaagcucuccuccuccuccaaggucggcauggaggucaagggcugcacccgccgccucguccucccccaggccggcaaggccgacgccggcgaguacuccugcgaggccggcggccagcgcgucuccuuccaccuccacaucaccgagcccaagggcgucuucgccaaggagcaguccguccacaacgagguccaggccgaggccggcaccaccgccaugcucuccugcgaggucgcccagccccagaccgaggucaccugguacaaggacggcaagaagcucuccuccuccuccaagguccgcauggaggucaagggcugcacccgccgccucgucguccagcaggucggcaaggccgacgccggcgaguacuccugcgaggccggcggccagcgcgucuccuuccagcuccacaucaccgagcccaaggccgucuucgccaaggagcagcucguccacaacgagguccgcaccgaggccggcgccuccgccacccucuccugcgaggucgcccaggcccagaccgaggucaccugguacaaggacggcaagaagcucuccuccuccuccaagguccgcaucgaggccgccggcugcaugcgccagcucgucguccagcaggccggccaggccgacgccggcgaguacaccugcgaggccggcggccagcgccucuccuuccaccucgacgucuccgagcccaaggccgucuucgccaaggagcagcucgcccaccgcaagguccaggccgaggccggcgccaucgccacccucuccugcgaggucgcccaggcccagaccgaggucaccugguacaaggacggcaagaagcucuccuccuccuccaagguccgcauggaggccgucggcugcacccgccgccucgucguccagcaggccugccaggccgacaccggcgaguacuccugcgaggccggcggccagcgccucuccuucucccucgacgucgccgagcccaaggucgucuucgccaaggagcagcccguccaccgcgagguccaggcccaggccggcgccuccaccacccucuccugcgaggucgcccaggcccagaccgaggucaugugguacaaggacggcaagaagcucuccuucuccuccaagguccgcauggaggccgucggcugcacccgccgccucgucguccagcaggccggccaggccgucgccggcgaguacuccugcgaggccggcucccagcgccucuccuuccaccuccacgucgccgagcccaaggccgucuucgccaaggagcagcccgccucccgcgagguccaggccgaggccggcaccuccgccacccucuccugcgaggucgcccaggcccagaccgaggucaccugguacaaggacggcaagaagcucuccuccuccuccaagguccgcauggaggccgucggcugcacccgccgccucgucguccaggaggccggccaggccgacgccggcgaguacuccugcaaggccggcgaccagcgccucuccuuccaccuccacgucgccgagcccaaggucgucuucgccaaggagcagcccgcccaccgcgagguccaggccgaggccggcgccuccgccacccucuccugcgaggucgcccaggcccagaccgaggucaccugguacaaggacggcaagaagcucuccuccuccuccaagguccgcgucgaggccgucggcugcacccgccgccucgucguccagcaggccggccaggccgaggccggcgaguacuccugcgaggccggcggccagcagcucuccuuccgccuccaggucgccgagcucgagccccagaucuccgagcgccccugccgccgcgagccccucgucgucaaggagcacgaggacaucauccucaccgccacccucgccacccccuccgccgccaccgucaccuggcucaaggacggcgucgagauccgccgcuccaagcgccacgagaccgccucccagggcgacacccacacccucaccguccacggcgcccagguccucgacuccgccaucuacuccugccgcgucggcgccgagggccaggacuuccccguccaggucgaggaggucgccgccaaguucugccgccuccucgagcccgucugcggcgagcucggcggcaccgucacccucgccugcgagcucucccccgccugcgccgaggucgucuggcgcugcggcaacacccagcuccgcgucggcaagcgcuuccagauggucgccgagggccccguccgcucccucaccguccucggccuccgcgccgaggacgccggcgaguacgucugcgagucccgcgacgaccacaccuccgcccagcucaccgucuccgucccccgcgucgucaaguucauguccggccucuccaccgucgucgccgaggagggcggcgaggccaccuuccagugcgucgucucccccuccgacgucgccgucgucugguuccgcgacggcgcccuccuccagcccuccgagaaguucgccaucucccaguccggcgccucccacucccucaccaucuccgaccucguccucgaggacgccggccagaucaccgucgaggccgagggcgccuccuccuccgccgcccuccgcguccgcgaggcccccguccucuucaagaagaagcucgagccccagaccgucgaggagcgcuccuccgucacccucgaggucgagcucacccgccccuggcccgagcuccgcuggacccgcaacgccaccgcccucgcccccggcaagaacgucgagauccacgccgagggcgcccgccaccgccucguccuccacaacgucggcuucgccgaccgcggcuucuucggcugcgagacccccgacgacaagacccaggccaagcucaccgucgagaugcgccagguccgccucguccgcggccuccaggccgucgaggcccgcgagcagggcaccgccaccauggagguccagcucucccacgccgacgucgacggcuccuggacccgcgacggccuccgcuuccagcagggccccaccugccaccucgccguccgcggccccaugcacacccucacccucuccggccuccgccccgaggacuccggccucauggucuucaaggccgagggcguccacaccuccgcccgccucgucgucaccgagcuccccgucuccuucucccgcccccuccaggacgucgucaccaccgagaaggagaaggucacccucgagugcgagcucucccgccccaacgucgacguccgcuggcucaaggacggcgucgagcuccgcgccggcaagaccauggccaucgccgcccagggcgccugccgcucccucaccaucuaccgcugcgaguucgccgaccagggcgucuacgucugcgacgcccacgacgcccaguccuccgccuccgucaagguccagggccgcaccuacacccucaucuaccgccgcguccucgccgaggacgccggcgagauccaguucgucgccgagaacgccgagucccgcgcccagcuccgcgucaaggagcuccccgucacccucguccgcccccuccgcgacaagaucgccauggagaagcaccgcggcguccucgagugccaggucucccgcgccuccgcccagguccgcugguucaagggcucccaggagcuccagcccggccccaaguacgagcucgucuccgacggccucuaccgcaagcucaucaucuccgacguccacgccgaggacgaggacaccuacaccugcgacgccggcgacgucaagaccuccgcccaguucuucgucgaggagcaguccaucaccaucguccgcggccuccaggacgucaccgucauggagcccgcccccgccugguucgagugcgagaccuccauccccuccguccgcccccccaaguggcuccucggcaagaccguccuccaggccggcggcaacgucggccucgagcaggagggcaccguccaccgccucaugcuccgccgcaccugcuccaccaugaccggccccguccacuucaccgucggcaagucccgcuccuccgcccgccucgucgucuccgacauccccgucguccucacccgcccccucgagcccaagaccggccgcgagcuccaguccgucguccucuccugcgacuuccgccccgcccccaaggccguccagugguacaaggacgacaccccccucucccccuccgagaaguucaagaugucccucgagggccagauggccgagcuccgcauccuccgccucaugcccgccgacgccggcgucuaccgcugccaggccggcuccgcccacuccuccaccgaggucaccgucgaggcccgcgaggucaccgucaccggcccccuccaggacgccgaggccaccgaggagggcugggccuccuucuccugcgagcucucccacgaggacgaggaggucgaguggucccucaacggcaugccccucuacaacgacuccuuccacgagaucucccacaagggccgccgccacacccucguccucaaguccauccagcgcgccgacgccggcaucguccgcgccuccucccucaaggucuccaccuccgcccgccucgagguccgcgucaagcccgucgucuuccucaaggcccucgacgaccucuccgccgaggagcgcggcacccucgcccuccagugcgaggucuccgaccccgaggcccacgucgucuggcgcaaggacggcguccagcucggccccuccgacaaguacgacuuccuccacaccgccggcacccgcggccucgucguccacgacgucucccccgaggacgccggccucuacaccugccacgucggcuccgaggagacccgcgcccgcguccgcguccacgaccuccacgucggcaucaccaagcgccucaagaccauggagguccucgagggcgaguccugcuccuucgagugcguccucucccacgaguccgccuccgaccccgccauguggaccgucggcggcaagaccgucggcuccuccucccgcuuccaggccacccgccagggccgcaaguacauccucgucguccgcgaggccgcccccuccgacgccggcgaggucgucuucuccguccgcggccucaccuccaaggccucccucaucguccgcgagcgccccgccgccaucaucaagccccucgaggaccagugggucgcccccggcgaggacgucgagcuccgcugcgagcucucccgcgccggcacccccguccacuggcucaaggaccgcaaggccauccgcaagucccagaaguacgacgucgucugcgagggcaccauggccaugcucgucauccgcggcgccucccucaaggacgccggcgaguacaccugcgaggucgaggccuccaaguccaccgccucccuccacgucgaggagaaggccaacugcuucaccgaggagcucaccaaccuccaggucgaggagaagggcaccgccgucuucaccugcaagaccgagcaccccgccgccaccgucaccuggcgcaagggccuccucgagcuccgcgccuccggcaagcaccagcccucccaggagggccucacccuccgccucaccaucuccgcccucgagaaggccgacuccgacaccuacaccugcgacaucggccaggcccagucccgcgcccagcuccucguccagggccgccgcguccacaucaucgaggaccucgaggacgucgacguccaggagggcuccuccgccaccuuccgcugccgcaucucccccgccaacuacgagcccguccacugguuccucgacaagaccccccuccacgccaacgagcucaacgagaucgacgcccagcccggcggcuaccacguccucacccuccgccagcucgcccucaaggacuccggcaccaucuacuucgaggccggcgaccagcgcgccuccgccgcccuccgcgucaccgagaagcccuccgucuucucccgcgagcucaccgacgccaccaucaccgagggcgaggaccucacccucgucugcgagaccuccaccugcgacauccccgucugcuggaccaaggacggcaagacccuccgcggcuccgcccgcugccagcucucccacgagggccaccgcgcccagcuccucaucaccggcgccacccuccaggacuccggccgcuacaagugcgaggccggcggcgccugcuccuccuccaucguccgcguccacgcccgccccguccgcuuccaggaggcccucaaggaccucgagguccucgagggcggcgccgccacccuccgcugcguccucuccuccgucgccgcccccgucaaguggugcuacggcaacaacguccuccgccccggcgacaaguacucccuccgccaggagggcgccaugcucgagcucgucguccgcaaccuccgcccccaggacuccggccgcuacuccugcuccuucggcgaccagaccaccuccgccacccucaccgucaccgcccuccccgcccaguucaucggcaagcuccgcaacaaggaggccaccgagggcgccaccgccacccuccgcugcgagcucuccaaggccgcccccgucgaguggcgcaagggcuccgagacccuccgcgacggcgaccgcuacugccuccgccaggacggcgccaugugcgagcuccagauccgcggccucgccauggucgacgccgccgaguacuccugcgucugcggcgaggagcgcaccuccgccucccucaccauccgccccaugcccgcccacuucaucggccgccuccgccaccaggaguccaucgagggcgccaccgccacccuccgcugcgagcucuccaaggccgcccccgucgaguggcgcaagggccgcgagucccuccgcgacggcgaccgccacucccuccgccaggacggcgccgucugcgagcuccagaucugcggccucgccgucgccgacgccggcgaguacuccugcgucugcggcgaggagcgcaccuccgccacccucaccgucaaggcccuccccgccaaguucaccgagggccuccgcaacgaggaggccgucgagggcgccaccgccaugcucuggugcgagcucuccaaggucgcccccgucgaguggcgcaagggccccgagaaccuccgcgacggcgaccgcuacauccuccgccaggagggcacccgcugcgagcuccagaucugcggccucgccauggccgacgccggcgaguaccucugcgucugcggccaggagcgcaccuccgccacccucaccauccgcgcccuccccgcccgcuucaucgaggacgucaagaaccaggaggcccgcgagggcgccaccgccguccuccagugcgagcucaacuccgccgcccccgucgaguggcgcaagggcuccgagacccuccgcgacggcgaccgcuacucccuccgccaggacggcaccaagugcgagcuccagauccgcggccucgccauggccgacaccggcgaguacuccugcgucugcggccaggagcgcaccuccgccaugcucaccguccgcgcccuccccaucaaguucaccgagggccuccgcaacgaggaggccaccgagggcgccaccgccguccuccgcugcgagcucuccaagauggcccccgucgagugguggaagggccacgagacccuccgcgacggcgaccgccacucccuccgccaggacggcgcccgcugcgagcuccagauccgcggccucgucgccgaggacgccggcgaguaccucugcaugugcggcaaggagcgcaccuccgccaugcucaccguccgcgccaugcccuccaaguucaucgagggccuccgcaacgaggaggccaccgagggcgacaccgccacccucuggugcgagcucuccaaggccgcccccgucgaguggcgcaagggccacgagacccuccgcgacggcgaccgccacucccuccgccaggacggcucccgcugcgagcuccagauccgcggccucgccgucgucgacgccggcgaguacuccugcgucugcggccaggagcgcaccuccgccacccucaccguccgcgcccuccccgcccgcuucaucgaggacgucaagaaccaggaggcccgcgagggcgccaccgccguccuccagugcgagcucuccaaggccgcccccgucgaguggcgcaagggcuccgagacccuccgcggcggcgaccgcuacucccuccgccaggacggcacccgcugcgagcuccagauccacggccucuccgucgccgacaccggcgaguacuccugcgucugcggccaggagcgcaccuccgccacccucaccguccgcgccccccagcccgucuuccgcgagccccuccagucccuccaggccgaggagggcuccaccgccacccuccagugcgagcucuccgagcccaccgccaccgucgucugguccaagggcggccuccagcuccaggccaacggccgccgcgagccccgccuccagggcugcaccgccgagcucguccuccaggaccuccagcgcgaggacaccggcgaguacaccugcaccugcggcucccaggccaccuccgccacccucaccgucaccgccgcccccguccgcuuccuccgcgagcuccagcaccaggaggucgacgagggcggcaccgcccaccucugcugcgagcucucccgcgccggcgccuccgucgaguggcgcaagggcucccuccagcucuuccccugcgccaaguaccagaugguccaggacggcgccgccgccgagcuccucguccgcggcgucgagcaggaggacgccggcgacuacaccugcgacaccggccacacccaguccauggccucccucuccguccgcgucccccgccccaaguucaagacccgccuccagucccucgagcaggagaccggcgacaucgcccgccucugcugccagcucuccgacgccgaguccggcgccgucguccaguggcucaaggagggcgucgagcuccacgccggccccaaguacgagaugcgcucccagggcgccacccgcgagcuccucauccaccagcucgaggccaaggacaccggcgaguacgccugcgucaccggcggccagaagaccgccgccucccuccgcgucaccgagcccgaggucaccaucguccgcggccucgucgacgccgaggucaccgccgacgaggacgucgaguucuccugcgaggucucccgcgccggcgccaccggcguccaguggugccuccagggccucccccuccaguccaacgaggucaccgaggucgccguccgcgacggccgcauccacacccuccgccucaagggcgucacccccgaggacgccggcaccgucuccuuccaccucggcaaccacgccuccuccgcccagcucaccguccgcgcccccgaggucaccauccucgagccccuccaggacguccagcucuccgagggccaggacgccuccuuccagugccgccucucccgcgccuccggccaggaggcccgcugggcccucggcggcgucccccuccaggccaacgagaugaacgacaucaccgucgagcagggcacccuccaccuccucacccuccacaaggucacccucgaggacgccggcaccgucuccuuccacgucggcaccugcuccuccgaggcccagcucaaggucaccgccaagaacaccgucguccgcggccucgagaacgucgaggcccucgagggcggcgaggcccucuucgagugccagcucucccagcccgaggucgccgcccacaccuggcuccucgacgacgagcccguccacaccuccgagaacgccgaggucgucuucuucgagaacggccuccgccaccuccuccuccucaagaaccuccgcccccaggacuccugccgcgucaccuuccucgccggcgacauggucaccuccgccuuccucaccguccgcggcuggcgccucgagauccucgagccccucaagaacgccgccguccgcgccggcgcccaggccugcuucaccugcacccucuccgaggccguccccgucggcgaggccuccugguacaucaacggcgccgccguccagcccgacgacuccgacuggaccgucaccgccgacggcucccaccacgcccuccuccuccgcuccgcccagccccaccacgccggcgaggucaccuucgccugccgcgacgccgucgccuccgcccgccucaccguccucggccuccccgacccccccgaggacgccgaggucgucgcccgcuccucccacaccgucacccucuccugggccgcccccauguccgacggcggcggcggccucugcggcuaccgcgucgaggucaaggagggcgccaccggccaguggcgccucugccacgagcucguccccggccccgagugcgucgucgacggccucgcccccggcgagaccuaccgcuuccgcgucgccgccgucggccccgucggcgccggcgagcccguccaccucccccagaccguccgccucgccgagccccccaagcccguccccccccagcccuccgcccccgagucccgccaggucgccgccggcgaggacgucucccucgagcucgaggucgucgccgaggccggcgaggucaucuggcacaagggcauggagcgcauccagcccggcggccgcuucgaggucgucucccagggccgccagcagaugcucgucaucaagggcuucaccgccgaggaccagggcgaguaccacugcggccucgcccagggcuccaucugccccgccgccgccaccuuccaggucgcccucucccccgccuccgucgacgaggccccccagcccucccucccccccgaggccgcccaggagggcgaccuccaccuccucugggaggcccucgcccgcaagcgccgcaugucccgcgagcccacccucgacuccaucuccgagcuccccgaggaggacggccgcucccagcgccucccccaggaggccgaggaggucgcccccgaccucuccgagggcuacuccaccgccgacgagcucgcccgcaccggcgacgccgaccucucccacaccuccuccgacgacgagucccgcgccggcacccccucccucgucaccuaccucaagaaggccggccgccccggcaccuccccccucgccuccaaggucggcgcccccgccgcccccuccgucaagccccagcagcagcaggagccccucgccgccguccgccccccccucggcgaccucuccaccaaggaccucggcgaccccuccauggacaaggccgccgucaagauccaggccgccuucaagggcuacaagguccgcaaggagaugaagcagcaggagggccccauguucucccacaccuucggcgacaccgaggcccaggucggcgacgcccuccgccucgagugcgucgucgccuccaaggccgacguccgcgcccgcuggcucaaggacggcgucgagcucaccgacggccgccaccaccacaucgaccagcucggcgacggcaccugcucccuccucaucaccggccucgaccgcgccgacgccggcugcuacaccugccaggucuccaacaaguucggccaggucacccacuccgccugcgucgucgucuccggcuccgaguccgaggccgaguccuccuccggcggcgagcucgacgacgccuuccgccgcgccgcccgccgccuccaccgccucuuccgcaccaagucccccgccgaggucuccgacgaggagcucuuccucuccgccgacgagggccccgccgagcccgaggagcccgccgacuggcagaccuaccgcgaggacgagcacuucaucugcauccgcuucgaggcccucaccgaggcccgccaggccgucacccgcuuccaggagauguucgccacccucggcaucggcgucgagaucaagcucgucgagcagggcccccgccgcgucgagaugugcaucuccaaggagacccccgcccccgucgucccccccgagccccuccccucccuccucaccuccgacgccgcccccgucuuccucaccgagcuccagaaccaggagguccaggacggcuaccccgucuccuucgacugcgucgucaccggccagcccaugcccuccguccgcugguucaaggacggcaagcuccucgaggaggacgaccacuacaugaucaacgaggaccagcagggcggccaccagcucaucaucaccgccgucguccccgccgacaugggcgucuaccgcugccucgccgagaacuccaugggcgucuccuccaccaaggccgagcuccgcgucgaccucaccuccaccgacuacgacaccgccgccgacgccaccgaguccuccuccuacuucuccgcccagggcuaccucuccucccgcgagcaggagggcaccgaguccaccaccgacgagggccagcucccccaggucgucgaggagcuccgcgaccuccaggucgcccccggcacccgccucgccaaguuccagcucaaggucaagggcuaccccgccccccgccucuacugguucaaggacggccagccccucaccgccuccgcccacauccgcaugaccgacaagaagauccuccacacccucgagaucaucuccgucacccgcgaggacuccggccaguacgccgccuacaucuccaacgccaugggcgccgccuacuccuccgcccgccuccucguccgcggccccgacgagcccgaggagaagcccgccuccgacguccacgagcagcucguccccccccgcaugcucgagcgcuucacccccaagaaggucaagaagggcuccuccaucaccuucuccgucaaggucgagggccgccccguccccaccguccacuggcuccgcgaggaggccgagcgcggcguccucuggaucggccccgacacccccggcuacaccgucgccuccuccgcccagcagcacucccucguccuccucgacgucggccgccagcaccagggcaccuacaccugcaucgccuccaacgccgccggccaggcccucugcuccgccucccuccacgucuccggccuccccaaggucgaggagcaggagaaggucaaggaggcccucaucuccaccuuccuccagggcaccacccaggccaucuccgcccagggccucgagaccgccuccuucgccgaccucggcggccagcgcaaggaggagccccucgccgccaaggaggcccucggccaccucucccucgccgaggucggcaccgaggaguuccuccagaagcucaccucccagaucaccgagauggucuccgccaagaucacccaggccaagcuccagguccccggcggcgacuccgacgaggacuccaagacccccuccgccuccccccgccacggccgcucccgccccuccuccuccauccaggaguccuccuccgaguccgaggacggcgacgcccgcggcgagaucuucgacaucuacgucgucaccgccgacuaccucccccucggcgccgagcaggacgccaucacccuccgcgagggccaguacgucgagguccucgacgccgcccacccccuccgcuggcucguccgcaccaagcccaccaaguccucccccucccgccagggcugggucucccccgccuaccucgaccgccgccucaagcucucccccgaguggggcgccgccgaggcccccgaguuccccggcgaggccgucuccgaggacgaguacaaggcccgccucuccuccgucauccaggagcuccucuccuccgagcaggccuucgucgaggagcuccaguuccuccagucccaccaccuccagcaccucgagcgcugcccccacguccccaucgccgucgccggccagaaggccgucaucuuccgcaacguccgcgacaucggccgcuuccacuccuccuuccuccaggagcuccagcagugcgacaccgacgacgacgucgccaugugcuucaucaagaaccaggccgccuucgagcaguaccucgaguuccucgucggccgcguccaggccgaguccgucgucgucuccaccgccauccaggaguucuacaagaaguacgccgaggaggcccuccucgccggcgaccccucccagccccccccccccccccuccagcacuaccucgagcagcccgucgagcgcguccagcgcuaccaggcccuccucaaggagcucauccgcaacaaggcccgcaaccgccagaacugcgcccuccucgagcaggccuacgccgucgucuccgcccucccccagcgcgccgagaacaagcuccacgucucccucauggagaacuaccccggcacccuccaggcccucggcgagcccauccgccagggccacuucaucgucugggagggcgcccccggcgcccgcaugcccuggaagggccacaaccgccacgucuuccucuuccgcaaccaccucgucaucugcaagccccgccgcgacucccgcaccgacaccgucuccuacgucuuccgcaacaugaugaagcucuccuccaucgaccucaacgaccaggucgagggcgacgaccgcgccuucgaggucuggcaggagcgcgaggacuccguccgcaaguaccuccuccaggcccgcaccgccaucaucaaguccuccugggucaaggagaucugcggcauccagcagcgccucgcccuccccgucuggcgcccccccgacuucgaggaggagcucgccgacugcaccgccgagcucggcgagaccgucaagcucgccugccgcgucaccggcacccccaagcccgucaucuccugguacaaggacggcaaggccguccaggucgacccccaccacauccucaucgaggaccccgacggcuccugcgcccucauccucgacucccucaccggcgucgacuccggccaguacaugugcuucgccgccuccgccgccggcaacugcuccacccucggcaagauccucguccagguccccccccgcuucgucaacaagguccgcgccucccccuucgucgagggcgaggacgcccaguucaccugcaccaucgagggcgcccccuacccccagauccgcugguacaaggacggcgcccuccucaccaccggcaacaaguuccagacccucuccgagccccgcuccggccuccucguccucgucauccgcgccgccuccaaggaggaccucggccucuacgagugcgagcucgucaaccgccucggcuccgcccgcgccuccgccgagcuccgcauccagucccccaugcuccaggcccaggagcagugccaccgcgagcagcucgucgccgccgucgaggacaccacccucgagcgcgccgaccaggaggucaccuccguccucaagcgccuccucggccccaaggcccccggccccuccaccggcgaccucaccggccccggccccugcccccgcggcgcccccgcccuccaggagaccggcucccagccccccgucaccggcaccuccgaggcccccgccguccccccccgcgucccccagccccuccuccacgagggccccgagcaggagcccgaggccaucgcccgcgcccaggaguggaccguccccauccgcauggagggcgccgccuggcccggcgccggcaccggcgagcuccucugggacguccacucccacgucguccgcgagaccacccagcgcaccuacaccuaccaggccaucgacacccacaccgcccgcccccccuccaugcaggucaccaucgaggacguccaggcccagaccggcggcaccgcccaguucgaggccaucaucgagggcgacccccagcccuccgucaccugguacaaggacuccguccagcucgucgacuccacccgccucucccagcagcaggagggcaccaccuacucccucguccuccgccacgucgccuccaaggacgccggcgucuacaccugccucgcccagaacaccggcggccagguccucugcaaggccgagcuccucguccucggcggcgacaacgagcccgacuccgagaagcagucccaccgccgcaagcuccacuccuucuacgaggucaaggaggagaucggccgcggcgucuucggcuucgucaagcgcguccagcacaagggcaacaagauccucugcgccgccaaguucaucccccuccgcucccgcacccgcgcccaggccuaccgcgagcgcgacauccucgccgcccucucccacccccucgucaccggccuccucgaccaguucgagacccgcaagacccucauccucauccucgagcucugcuccuccgaggagcuccucgaccgccucuaccgcaagggcgucgucaccgaggccgaggucaaggucuacauccagcagcucgucgagggccuccacuaccuccacucccacggcguccuccaccucgacaucaagcccuccaacauccucaugguccaccccgcccgcgaggacaucaagaucugcgacuucggcuucgcccagaacaucacccccgccgagcuccaguucucccaguacggcucccccgaguucgucucccccgagaucauccagcagaaccccgucuccgaggccuccgacaucugggccaugggcgucaucuccuaccucucccucaccugcuccucccccuucgccggcgaguccgaccgcgccacccuccucaacguccucgagggccgcgucuccugguccucccccauggccgcccaccucuccgaggacgccaaggacuucaucaaggccacccuccagcgcgccccccaggcccgccccuccgccgcccagugccucucccaccccugguuccucaaguccaugcccgccgaggaggcccacuucaucaacaccaagcagcucaaguuccuccucgcccgcucccgcuggcagcgcucccucauguccuacaaguccauccucgucaugcgcuccauccccgagcuccuccgcggcccccccgacucccccucccucggcgucgcccgccaccucugccgcgacaccggcggcuccuccuccuccuccuccuccuccgacaacgagcucgcccccuucgcccgcgccaagucccucccccccucccccgucacccacuccccccuccuccacccccgcggcuuccuccgccccuccgccucccuccccgaggaggccgaggccuccgagcgcuccaccgaggcccccgccccccccgccucccccgagggcgccggcccccccgccgcccagggcugcgucccccgccacuccgucauccgcucccucuucuaccaccaggccggcgagucccccgagcacggcgcccucgcccccggcucccgccgccaccccgcccgccgccgccaccuccucaagggcggcuacaucgccggcgcccuccccggccuccgcgagccccucauggagcaccgcguccucgaggaggaggccgcccgcgaggagcaggccacccuccucgccaaggcccccuccuucgagaccgcccuccgccuccccgccuccggcacccaccucgcccccggccacucccacucccucgagcacgacucccccuccaccccccgccccuccuccgaggccugcggcgaggcccagcgccuccccuccgcccccuccggcggcgcccccauccgcgacaugggccacccccagggcuccaagcagcuccccuccaccggcggccaccccggcaccgcccagcccgagcgccccucccccgacucccccuggggccagcccgcccccuucugccaccccaagcagggcuccgccccccaggagggcugcuccccccaccccgccgucgcccccugcccccccggcuccuucccccccggcuccugcaaggaggccccccucguccccuccucccccuuccucggccagccccaggccccccccgcccccgccaaggccucccccccccucgacuccaagaugggccccggcgacaucucccuccccggccgccccaagcccggccccugcuccucccccggcuccgccucccaggccuccuccucccaggucuccucccuccgcgucggcuccucccaggucggcaccgagcccggccccucccucgacgccgagggcuggacccaggaggccgaggaccucuccgacuccacccccacccuccagcgcccccaggagcaggccaccaugcgcaaguucucccucggcggccgcggcggcuacgccggcgucgccggcuacggcaccuucgccuucggcggcgacgccggcggcaugcucggccagggccccaugugggcccgcaucgccugggccgucucccaguccgaggaggaggagcaggaggaggcccgcgccgagucccaguccgaggagcagcaggaggcccgcgccgaguccccccucccccaggucuccgcccgccccguccccgaggucggccgcgcccccacccgcuccucccccgagcccacccccugggaggacaucggccaggucucccucguccagauccgcgaccucuccggcgacgccgaggccgccgacaccaucucccucgacaucuccgaggucgaccccgccuaccucaaccucuccgaccucuacgacaucaaguaccuccccuucgaguucaugaucuuccgcaagguccccaaguccgcccagcccgagccccccucccccauggccgaggaggagcucgccgaguuccccgagcccaccuggcccuggcccggcgagcucggcccccacgccggccucgagaucaccgaggaguccgaggacgucgacgcccuccucgccgaggccgccgucggccgcaagcgcaagugguccucccccucccgcucccucuuccacuuccccggccgccaccucccccucgacgagcccgccgagcucggccuccgcgagcgcgucaaggccuccgucgagcacaucucccgcauccucaagggccgccccgagggccucgagaaggagggccccccccgcaagaagcccggccucgccuccuuccgccucuccggccucaaguccugggaccgcgcccccaccuuccuccgcgagcucuccgacgagaccgucguccucggccaguccgucacccucgccugccaggucuccgcccagcccgccgcccaggccaccugguccaaggacggcgccccccucgaguccuccucccgcguccucaucuccgccacccucaagaacuuccagcuccucaccauccucgucgucgucgccgaggaccucggcgucuacaccugcuccgucuccaacgcccucggcaccgucaccaccaccggcguccuccgcaaggccgagcgccccuccuccucccccugccccgacaucggcgaggucuacgccgacggcguccuccucgucuggaagcccgucgaguccuacggccccgucaccuacaucguccagugcucccucgagggcggcuccuggaccacccucgccuccgacaucuucgacugcugcuaccucaccuccaagcucucccgcggcggcaccuacaccuuccgcaccgccugcgucuccaaggccggcaugggccccuacuccucccccuccgagcagguccuccucggcggccccucccaccucgccuccgaggaggagucccagggccgcuccgcccagccccuccccuccaccaagaccuucgccuuccagacccagauccagcgcggccgcuucuccgucguccgccagugcugggagaaggccuccggccgcgcccucgccgccaagaucauccccuaccaccccaaggacaagaccgccguccuccgcgaguacgaggcccucaagggccuccgccacccccaccucgcccagcuccacgccgccuaccucuccccccgccaccucguccucauccucgagcucugcuccggccccgagcuccuccccugccucgccgagcgcgccuccuacuccgaguccgaggucaaggacuaccucuggcagaugcucuccgccacccaguaccuccacaaccagcacauccuccaccucgaccuccgcuccgagaacaugaucaucaccgaguacaaccuccucaaggucgucgaccucggcaacgcccagucccucucccaggagaagguccuccccuccgacaaguucaaggacuaccucgagaccauggcccccgagcuccucgagggccagggcgccgucccccagaccgacaucugggccaucggcgucaccgccuucaucaugcucuccgccgaguaccccgucuccuccgagggcgcccgcgaccuccagcgcggccuccgcaagggccucguccgccucucccgcugcuacgccggccucuccggcggcgccgucgccuuccuccgcuccacccucugcgcccagcccuggggccgccccugcgccuccuccugccuccagugccccuggcucaccgaggagggccccgccugcucccgccccgcccccgucaccuuccccaccgcccgccuccgcgucuucguccgcaaccgcgagaagcgccgcgcccuccucuacaagcgccacaaccucgcccagguccgcuga

SEQ ID NO: 46991 - RNA, 3078 nt, Artificial Sequence
  derived and/or modified sequence opt2 from OBSL1__Homo_sapiens__NP_001166879
augaaggccuccuccggcgaccagggcuccccccccugcuuccuccgcuucccccgccccguccgcgucgucuccggcgccgaggccgagcucaagugcgucguccucggcgagcccccccccgucgucgucugggagaagggcggccagcagcucgccgccuccgagcgccucuccuuccccgccgacggcgccgagcacggccuccuccucaccgccgcccuccccaccgacgccggcgucuacgucugccgcgcccgcaacgccgccggcgaggccuacgccgccgccgccgucaccguccucgagccccccgccuccgaccccgagcuccagcccgccgagcgcccccuccccucccccggcuccggcgagggcgcccccgucuuccucaccggcccccgcucccaguggguccuccgcggcgccgaggucguccucaccugccgcgccggcggccuccccgagcccacccucuacugggagaaggacggcauggcccucgacgaggucugggacuccucccacuucgcccuccagcccggccgcgccgaggacggccccggcgccucccucgcccuccgcauccucgccgcccgccuccccgacuccggcgucuacgucugccacgcccgcaacgcccacggccacgcccaggccggcgcccuccuccagguccaccagccccccgaguccccccccgccgaccccgacgaggcccccgcccccgucgucgagccccucaagugcgcccccaagaccuucugggucaacgagggcaagcacgccaaguuccgcugcuacgucaugggcaagcccgagcccgagaucgaguggcacugggagggccgcccccuccuccccgaccgccgccgccucauguaccgcgaccgcgacggcggcuucguccucaagguccucuacugccaggccaaggaccgcggccucuacgucugcgccgcccgcaacuccgccggccagacccucuccgccguccagcuccacgucaaggagccccgccuccgcuucacccgcccccuccaggacgucgagggccgcgagcacggcaucgccguccucgagugcaagguccccaacucccgcauccccaccgccugguuccgcgaggaccagcgccuccuccccugccgcaaguacgagcagaucgaggagggcaccguccgccgccucaucauccaccgccucaaggccgacgacgacggcaucuaccucugcgagaugcgcggccgcguccgcaccgucgccaacgucaccgucaagggccccauccucaagcgccucccccgcaagcucgacguccucgagggcgagaacgccguccuccucgucgagacccucgaggccggcgucgagggccgcuggucccgcgacggcgaggagcuccccgucaucugccaguccuccuccggccacaugcacgcccucguccuccccggcgucacccgcgaggacgccggcgaggucaccuucucccucggcaacucccgcaccaccacccuccuccgcgucaagugcgucaagcacuccccccccggcccccccauccucgccgagauguucaagggccacaagaacaccguccuccucaccuggaagccccccgagcccgcccccgagacccccuucaucuaccgccucgagcgccaggaggucggcuccgaggacuggauccagugcuucuccaucgagaaggccggcgccgucgagguccccggcgacugcguccccuccgagggcgacuaccgcuuccgcaucugcaccgucuccggccacggccgcuccccccacgucgucuuccacggcuccgcccaccucguccccaccgcccgccucgucgccggccucgaggacguccaggucuacgacggcgaggacgccgucuucucccucgaccucuccaccaucauccagggcaccugguuccucaacggcgaggagcucaaguccaacgagcccgagggccaggucgagcccggcgcccuccgcuaccgcaucgagcagaagggccuccagcaccgccucauccuccacgccgucaagcaccaggacuccggcgcccucgucggcuucuccugccccggcguccaggacuccgccgcccucaccauccaggagucccccguccacauccucuccccccaggaccgcgucucccucaccuucaccaccuccgagcgcgucguccucaccugcgagcucucccgcgucgacuuccccgccaccugguacaaggacggccagaaggucgaggaguccgagcuccucgucgucaagauggacggccgcaagcaccgccucauccuccccgaggccaagguccaggacuccggcgaguucgagugccgcaccgagggcgucuccgccuucuucggcgucaccguccaggacccccccguccacaucgucgacccccgcgagcacgucuucguccacgccaucaccuccgagugcgucaugcucgccugcgaggucgaccgcgaggacgcccccguccgcugguacaaggacggccaggaggucgaggaguccgacuucgucguccucgagaacgagggcccccaccgccgccucguccuccccgccacccagcccuccgacggcggcgaguuccagugcgucgccggcgacgagugcgccuacuucaccgucaccaucaccgacgucuccuccuggaucgucuaccccuccggcaaggucuacgucgccgccguccgccucgagcgcgucguccucaccugcgagcucugccgccccugggccgagguccgcuggaccaaggacggcgaggaggucgucgagucccccgcccuccuccuccagaaggaggacaccguccgccgccucguccuccccgccguccagcucgaggacuccggcgaguaccucugcgagaucgacgacgaguccgccuccuucaccgucaccgucaccgaguccuaccagucccaggacuccuccaacaacaaccccgagcucugcguccuccucaagaagcccaagacccgccgccucuggucccgcuucccccccuggcgccgcaccgccggcaccgaguga

SEQ ID NO: 46992 - RNA, 1434 nt, Artificial Sequence
  derived and/or modified sequence opt2 from OC90__Homo_sapiens__NP_001073868
augaucgccuuccuccucaccuccguccucaugaucccccacgccggcggccacccccucgacaccccccaccucccccaggagcucccccccggccuccccaacaacaucaacaucaccuucuucuccggcauguucaagaacgucgaguccgucgccgagaucuucgacugccucggcccccacuucaccuggcuccaggccgucuucaccaacuuccccguccucauccaguucgucaacggcaugaagugcgucgccggccucugcccccgcgacuucgaggacuacggcugcaccugccgcuucgagauggagggccuccccgucgacgaguccgacuccugcugcuuccagcaccgccgcugcuacgaggaggccgccgagauggacugccuccaggaccccgccaagcucuccaccgaggucaacugcgucuccaagaagaucaucugcgaguccaaggacaacugcgagcaccuccucugcaccugcgacaaggccgccaucgagugccucgcccgcuccucccucaacuccucccucaaccuccucgacaccuccuucugccucgcccagacccccgagaccaccaucaaggaggaccucaccacccuccucccccgcgucguccccgucgagcccaccgacaccucccucaccgcccucuccggcgaggaggccggccacgaccaggagggcgucggcgccgcccgcgccaccuccccccccggcuccgccgagaucgucgccacccgcgucaccgccaagaucgucacccucguccccgccggcaucaagucccucggccucgccgucuccuccgucgagaacgaccccgaggagaccaccgagaaggccugcgaccgcuucaccuuccuccaccucggcuccggcgacaacaugcaggucaugccccagcucggcgagaugcucuucugccucaccucccgcugccccgaggaguucgaguccuacggcugcuacugcggccaggagggccgcggcgagccccgcgacgaccucgaccgcugcugccucucccaccacugcugccucgagcagguccgccgccucggcugccuccucgagcgccuccccuggucccccgucgucugcgucgaccacacccccaagugcggcggccagucccucugcgagaagcuccucugcgccugcgaccagaccgccgccgagugcaugaccuccgccuccuucaaccagucccucaagucccccucccgccucggcugccccggccagcccgccgccugcgaggacucccuccaccccguccccgccgcccccacccucggcuccuccuccgaggaggacuccgaggaggaccccccccaggaggaccucggccgcgccaagcgcuuccuccgcaagucccucggcccccucggcaucggcccccuccacggccgcuga

SEQ ID NO: 46993 - RNA, 2517 nt, Artificial Sequence
  derived and/or modified sequence opt2 from OCA2__Homo_sapiens__NP_000266
augcaccucgagggccgcgacggccgccgcuaccccggcgcccccgccgucgagcuccuccagaccuccguccccuccggccucgccgagcucgucgccggcaagcgccgccucccccgcggcgccggcggcgccgaccccucccacuccugcccccgcggcgccgccggccaguccuccugggcccccgccggccaggaguucgccuccuuccucaccaagggccgcucccacuccucccucccccagauguccuccucccgcuccaaggacuccugcuucaccgagaacaccccccuccuccgcaacucccuccaggagaagggcucccgcugcauccccgucuaccaccccgaguucaucaccgccgaggaguccugggaggacuccuccgccgacugggagcgccgcuaccuccucucccgcgaggucuccggccucuccgccuccgccuccuccgagaagggcgaccuccucgacuccccccacauccgccuccgccucuccaagcuccgccgcugcguccaguggcucaaggucaugggccucuucgccuucgucguccucugcuccauccucuucucccucuaccccgaccagggcaagcucuggcagcuccucgcccucuccccccucgagaacuacuccgucaaccucuccucccacgucgacuccacccuccuccaggucgaccucgccggcgcccucgucgccuccggccccucccgccccggccgcgaggagcacaucgucgucgagcucacccaggccgacgcccucggcucccgcuggcgccgcccccagcaggucacccacaacuggaccgucuaccucaacccccgccgcuccgagcacuccgucaugucccgcaccuucgagguccucacccgcgagaccgucuccaucuccauccgcgccucccuccagcagacccaggccgucccccuccucauggcccaccaguaccuccgcggcuccgucgagacccaggucaccaucgccaccgccauccucgccggcgucuacgcccucaucaucuucgagaucguccaccgcacccucgccgccaugcucggcucccucgccgcccucgccgcccucgccgucaucggcgaccgccccucccucacccacgucgucgaguggaucgacuucgagacccucgcccuccucuucggcaugaugauccucgucgccaucuucuccgagaccggcuucuucgacuacugcgccgucaaggccuaccgccucucccgcggccgcgucugggccaugaucaucaugcucugccucaucgccgccguccucuccgccuuccucgacaacgucaccaccaugcuccucuucacccccgucaccauccgccucugcgagguccucaaccucgacccccgccagguccucaucgccgaggucaucuucaccaacaucggcggcgccgccaccgccaucggcgacccccccaacgucaucaucgucuccaaccaggagcuccgcaagaugggccucgacuucgccggcuucaccgcccacauguucaucggcaucugccucguccuccucgucugcuucccccuccuccgccuccucuacuggaaccgcaagcucuacaacaaggagcccuccgagaucgucgagcucaagcacgagauccacgucuggcgccucaccgcccagcgcaucucccccgccucccgcgaggagaccgccguccgccgccuccuccucggcaagguccucgcccucgagcaccuccucgcccgccgccuccacaccuuccaccgccagaucucccaggaggacaagaacugggagaccaacauccaggagcuccagaagaagcaccgcaucuccgacggcauccuccucgccaagugccucaccguccucggcuucgucaucuucauguucuuccucaacuccuucguccccggcauccaccucgaccucggcuggaucgccauccucggcgccaucuggcuccucauccucgccgacauccacgacuucgagaucauccuccaccgcgucgagugggccacccuccucuucuucgccgcccucuucguccucauggaggcccucgcccaccuccaccucaucgaguacgucggcgagcagaccgcccuccucaucaagaugguccccgaggagcagcgccucaucgccgccaucguccucgucgucugggucuccgcccucgccuccucccucaucgacaacauccccuucaccgccaccaugauccccguccuccucaaccucucccacgaccccgaggucggccuccccgcccccccccucauguacgcccucgccuucggcgccugccucggcggcaacggcacccucaucggcgccuccgccaacgucgucugcgccggcaucgccgagcagcacggcuacggcuucuccuucauggaguucuuccgccucggcuuccccaugauggucgucuccugcaccgucggcaugugcuaccuccucgucgcccacgucgucgucggcuggaacuga

SEQ ID NO: 46994 - RNA, 738 nt, Artificial Sequence
  derived and/or modified sequence opt2 from OCIAD1__Homo_sapiens__NP_001073308
augaacggccgcgccgacuuccgcgagcccaacgccgaggucccccgccccaucccccacaucggccccgacuacauccccaccgaggaggagcgccgcgucuucgccgagugcaacgacgaguccuucugguuccgcuccgucccccucgccgccaccuccaugcucaucacccagggccucaucuccaagggcauccucuccucccaccccaaguacggcuccauccccaagcucauccucgccugcaucaugggcuacuucgccggcaagcucuccuacgucaagaccugccaggagaaguucaagaagcucgagaacuccccccucggcgaggcccuccgcuccggccaggcccgccgcuccuccccccccggccacuacuaccagaaguccaaguacgacuccuccgucuccggccaguccuccuucgucaccucccccgccgccgacaacaucgagaugcucccccacuacgagcccauccccuucuccuccuccaugaacgaguccgcccccaccggcaucaccgaccacaucguccagggccccgaccccaaccucgaggagucccccaagcgcaagaacaucaccuacgaggagcuccgcaacaagaaccgcgaguccuacgaggucucccucacccagaagaccgaccccuccguccgccccaugcacgagcgcguccccaagaaggaggucaaggucaacaaguacggcgacaccugggacgaguga

SEQ ID NO: 46995 - RNA, 465 nt, Artificial Sequence
  derived and/or modified sequence opt2 from OCIAD2__Homo_sapiens__NP_001014446
auggccuccgccuccgcccgcggcaaccaggacaaggacgcccacuuccccccccccuccaagcagucccuccucuucugccccaaguccaagcuccacauccaccgcgccgagaucuccaagaucaugcgcgagugccaggaggaguccuucuggaagcgcgcccuccccuucucccucgucuccaugcucgucacccagggccucgucuaccagggcuaccucgccgccaacucccgcuucggcucccuccccaaggucgcccucgccggccuccucggcuucggccucggcaaggucuccuacaucggcgucugccaguccaaguuccacuucuucgaggaccagcuccgcggcgccggcuucggcccccagcacaaccgccacugccuccucaccugcgaggagugcaagaucaagcacggccucuccgagaagggcgacucccagcccuccgccuccuga

SEQ ID NO: 46996 - RNA, 135 nt, Artificial Sequence
  derived and/or modified sequence opt2 from OCLM__Homo_sapiens__NP_071770
augggcauguaccccccccuccuccucaagaucuaccucucccgccacaucuccauccucuucuaccucaagauccucuacaaguccggcaucaucuggcucuccugguacuccuucauccuccucguccucuga

SEQ ID NO: 46997 - RNA, 1569 nt, Artificial Sequence
  derived and/or modified sequence opt2 from OCLN__Homo_sapiens__NP_001192183
auguccucccgcccccucgagucccccccccccuaccgccccgacgaguucaagcccaaccacuacgcccccuccaacgacaucuacggcggcgagaugcacguccgccccaugcucucccagcccgccuacuccuucuaccccgaggacgagauccuccacuucuacaaguggaccuccccccccggcgucauccgcauccucuccaugcucaucaucgucaugugcaucgccaucuucgccugcgucgccuccacccucgccugggaccgcggcuacggcaccucccuccucggcggcuccgucggcuaccccuacggcggcuccggcuucggcuccuacggcuccggcuacggcuacggcuacggcuacggcuacggcuacggcggcuacaccgacccccgcgccgccaagggcuucaugcucgccauggccgccuucugcuucaucgccgcccucgucaucuucgucaccuccgucauccgcuccgagaugucccgcacccgccgcuacuaccucuccgucaucaucgucuccgccauccucggcaucauggucuucaucgccaccaucgucuacaucaugggcgucaaccccaccgcccaguccuccggcucccucuacggcucccagaucuacgcccucugcaaccaguucuacacccccgccgccaccggccucuacgucgaccaguaccucuaccacuacugcgucgucgacccccaggaggccaucgccaucguccucggcuucaugaucaucgucgccuucgcccucaucaucuucuucgccgucaagacccgccgcaagauggaccgcuacgacaaguccaacauccucugggacaaggagcacaucuacgacgagcagccccccaacgucgaggagugggucaagaacgucuccgccggcacccaggacguccccuccccccccuccgacuacgucgagcgcgucgacucccccauggccuacuccuccaacggcaaggucaacgacaagcgcuucuaccccgaguccuccuacaaguccacccccguccccgaggucguccaggagcucccccucaccucccccgucgacgacuuccgccagccccgcuacuccuccggcggcaacuucgagacccccuccaagcgcgcccccgccaagggccgcgccggccgcuccaagcgcaccgagcaggaccacuacgagaccgacuacaccaccggcggcgaguccugcgacgagcucgaggaggacuggauccgcgaguacccccccaucaccuccgaccagcagcgccagcucuacaagcgcaacuucgacaccggccuccaggaguacaagucccuccaguccgagcucgacgagaucaacaaggagcucucccgccucgacaaggagcucgacgacuaccgcgaggaguccgaggaguacauggccgccgccgacgaguacaaccgccucaagcaggucaagggcuccgccgacuacaaguccaagaagaaccacugcaagcagcucaaguccaagcucucccacaucaagaagauggucggcgacuacgaccgccagaagaccuga

SEQ ID NO: 46998 - RNA, 330 nt, Artificial Sequence
  derived and/or modified sequence opt2 from OCM2__Homo_sapiens__NP_006179
auguccaucaccgacguccucuccgccgacgacaucgccgccgcccuccaggagugccaggaccccgacaccuucgagccccagaaguucuuccagaccuccggccucuccaagauguccgccucccaggucaaggacgucuuccgcuucaucgacaacgaccaguccggcuaccucgacgaggaggagcucaaguucuuccuccagaaguucgaguccggcgcccgcgagcucaccgaguccgagaccaagucccucauggccgccgccgacaacgacggcgacggcaagaucggcgccgaggaguuccaggagaugguccacuccuga

SEQ ID NO: 46999 - RNA, 330 nt, Artificial Sequence
  derived and/or modified sequence opt2 from OCM__Homo_sapiens__XP_011513787
auguccaucaccgacguccucuccgccgacgacaucgccgccgcccuccaggagugccgcgaccccgacaccuucgagccccagaaguucuuccagaccuccggccucuccaagauguccgccaaccaggucaaggacgucuuccgcuucaucgacaacgaccaguccggcuaccucgacgaggaggagcucaaguucuuccuccagaaguucgaguccggcgcccgcgagcucaccgaguccgagaccaagucccucauggccgccgccgacaacgacggcgacggcaagaucggcgccgaggaguuccaggagaugguccacuccuga

SEQ ID NO: 47000 - RNA, 2706 nt, Artificial Sequence
  derived and/or modified sequence opt2 from OCRL__Homo_sapiens__NP_000267
auggagcccccccuccccgucggcgcccagccccucgccaccgucgagggcauggagaugaagggcccccuccgcgagcccugcgcccucacccucgcccagcgcaacggccaguacgagcucaucauccagcuccacgagaaggagcagcacguccaggacaucauccccaucaacucccacuuccgcugcguccaggaggccgaggagacccuccucaucgacaucgccuccaacuccggcugcaagauccgcguccagggcgacuggauccgcgagcgccgcuucgagauccccgacgaggagcacugccucaaguuccucuccgccguccucgccgcccagaaggcccagucccagcuccucguccccgagcagaaggacuccuccuccugguaccagaagcucgacaccaaggacaagcccuccgucuucuccggccuccucggcuucgaggacaacuucuccuccaugaaccucgacaagaagaucaacucccagaaccagcccaccggcauccaccgcgagcccccccccccccccuucuccgucaacaagaugcucccccgcgagaaggaggccuccaacaaggagcagcccaaggucaccaacaccaugcgcaagcucuucguccccaacacccaguccggccagcgcgagggccucaucaagcacauccucgccaagcgcgagaaggaguacgucaacauccagaccuuccgcuucuucgucggcaccuggaacgucaacggccagucccccgacuccggccucgagcccuggcucaacugcgaccccaacccccccgacaucuacugcaucggcuuccaggagcucgaccucuccaccgaggccuucuucuacuucgaguccgucaaggagcaggagugguccauggccgucgagcgcggccuccacuccaaggccaaguacaagaagguccagcucguccgccucgucggcaugaugcuccucaucuucgcccgcaaggaccagugccgcuacauccgcgacaucgccaccgagaccgucggcaccggcaucaugggcaagaugggcaacaagggcggcgucgccguccgcuucgucuuccacaacaccaccuucugcaucgucaacucccaccucgccgcccacgucgaggacuucgagcgccgcaaccaggacuacaaggacaucugcgcccgcauguccuucgucguccccaaccagacccucccccagcucaacaucaugaagcacgaggucgucaucuggcucggcgaccucaacuaccgccucugcaugcccgacgccaacgaggucaagucccucaucaacaagaaggaccuccagcgccuccucaaguucgaccagcucaacauccagcgcacccagaagaaggccuucgucgacuucaacgagggcgagaucaaguucauccccaccuacaaguacgacuccaagaccgaccgcugggacuccuccggcaagugccgcguccccgccuggugcgaccgcauccucuggcgcggcaccaacgucaaccagcucaacuaccgcucccacauggagcucaagaccuccgaccacaagcccgucuccgcccucuuccacaucggcgucaaggucgucgacgagcgccgcuaccgcaaggucuucgaggacuccguccgcaucauggaccgcauggagaacgacuuccuccccucccucgagcucucccgccgcgaguucgucuucgagaacgucaaguuccgccagcuccagaaggagaaguuccagaucuccaacaacggccagguccccugccacuucuccuucauccccaagcucaacgacucccaguacugcaagcccuggcuccgcgccgagcccuucgagggcuaccucgagcccaacgagaccgucgacaucucccucgacgucuacgucuccaaggacuccgucaccauccucaacuccggcgaggacaagaucgaggacauccucguccuccaccucgaccgcggcaaggacuacuuccucaccaucuccggcaacuaccuccccuccugcuucggcaccucccucgaggcccucugccgcaugaagcgccccauccgcgagguccccgucaccaagcucaucgaccucgaggaggacuccuuccucgagaaggagaagucccuccuccagauggucccccucgacgagggcgccuccgagcgcccccuccagguccccaaggagaucuggcuccucgucgaccaccucuucaaguacgccugccaccaggaggaccucuuccagacccccggcaugcaggaggagcuccagcagaucaucgacugccucgacaccuccauccccgagaccauccccggcuccaaccacuccgucgccgaggcccuccucaucuuccucgaggcccuccccgagcccgucaucugcuacgagcucuaccagcgcugccucgacuccgccuacgacccccgcaucugccgccaggucaucucccagcucccccgcugccaccgcaacgucuuccgcuaccucauggccuuccuccgcgagcuccucaaguucuccgaguacaacuccgucaacgccaacaugaucgccacccucuucaccucccuccuccuccgccccccccccaaccucauggcccgccagacccccuccgaccgccagcgcgccauccaguuccuccucggcuuccuccucggcuccgaggaggacuga

SEQ ID NO: 47001 - RNA, 840 nt, Artificial Sequence
  derived and/or modified sequence opt2 from ODAM__Homo_sapiens__NP_060325
augaagaucaucauccuccucggcuuccucggcgccacccucuccgccccccucaucccccagcgccucauguccgccuccaacuccaacgagcuccuccucaaccucaacaacggccagcuccucccccuccagcuccagggcccccucaacuccuggaucccccccuucuccggcauccuccagcagcagcagcaggcccagauccccggccucucccaguucucccucuccgcccucgaccaguucgccggccuccuccccaaccagaucccccucaccggcgaggccuccuucgcccagggcgcccaggccggccaggucgacccccuccagcuccagacccccccccagacccagcccggccccucccacgucaugcccuacgucuucuccuucaagaugccccaggagcagggccagauguuccaguacuaccccgucuacaugguccuccccugggagcagccccagcagaccgucccccgcuccccccagcagacccgccagcagcaguacgaggagcagauccccuucuacgcccaguucggcuacaucccccagcucgccgagcccgccaucuccggcggccagcagcagcucgccuucgacccccagcucggcaccgcccccgagaucgccgucauguccaccggcgaggagauccccuaccuccagaaggaggccaucaacuuccgccacgacuccgccggcgucuucaugcccuccaccucccccaagcccuccaccaccaacgucuucaccuccgccgucgaccagaccaucacccccgagcuccccgaggagaaggacaagaccgacucccuccgcgagcccuga

SEQ ID NO: 47002 - RNA, 999 nt, Artificial Sequence
  derived and/or modified sequence opt2 from ODC1__Homo_sapiens__NP_001274117
augaugaccuucgacuccgaggucgagcucaugaaggucgcccgcgcccaccccaaggccaagcucguccuccgcaucgccaccgacgacuccaaggccgucugccgccucuccgucaaguucggcgccacccuccgcaccucccgccuccuccucgagcgcgccaaggagcucaacaucgacgucgucggcgucuccuuccacgucggcuccggcugcaccgaccccgagaccuucguccaggccaucuccgacgcccgcugcgucuucgacaugggcgccgaggucggcuucuccauguaccuccucgacaucggcggcggcuuccccggcuccgaggacgucaagcucaaguucgaggagaucaccggcgucaucaaccccgcccucgacaaguacuuccccuccgacuccggcguccgcaucaucgccgagcccggccgcuacuacgucgccuccgccuucacccucgccgucaacaucaucgccaagaagaucguccucaaggagcagaccggcuccgacgacgaggacgaguccuccgagcagaccuucauguacuacgucaacgacggcgucuacggcuccuucaacugcauccucuacgaccacgcccacgucaagccccuccuccagaagcgccccaagcccgacgagaaguacuacuccuccuccaucuggggccccaccugcgacggccucgaccgcaucgucgagcgcugcgaccuccccgagaugcacgucggcgacuggaugcucuucgagaacaugggcgccuacaccgucgccgccgccuccaccuucaacggcuuccagcgccccaccaucuacuacgucauguccggccccgccuggcagcucaugcagcaguuccagaaccccgacuucccccccgaggucgaggagcaggacgccuccacccuccccgucuccugcgccugggaguccggcaugaagcgccaccgcgccgccugcgccuccgccuccaucaacgucuga

SEQ ID NO: 47003 - RNA, 753 nt, Artificial Sequence
  derived and/or modified sequence opt2 from ODF1__Homo_sapiens__NP_077721
auggccgcccucuccugccuccucgacuccguccgccgcgacaucaagaaggucgaccgcgagcuccgccagcuccgcugcaucgacgaguucuccacccgcugccucugcgaccucuacaugcaccccuacugcugcugcgaccuccaccccuaccccuacugccucugcuacuccaagcgcucccgcuccugcggccucugcgaccucuaccccugcugccucugcgacuacaagcucuacugccuccgccccucccuccgcucccucgagcgcaaggccauccgcgccaucgaggacgagaagcgcgagcucgccaagcuccgccgcaccaccaaccgcauccucgccuccuccugcugcuccuccaacauccucggcuccgucaacgucugcggcuucgagcccgaccaggucaagguccgcgucaaggacggcaaggucugcgucuccgccgagcgcgagaaccgcuacgacugccucggcuccaagaaguacuccuacaugaacaucugcaaggaguucucccucccccccugcgucgacgagaaggacgucaccuacuccuacggccucggcuccugcgucaagaucgagucccccugcuaccccugcaccucccccugcucccccugcucccccugcucccccugcaaccccugcucccccugcaaccccugcucccccuacgaccccugcaaccccugcuaccccugcggcucccgcuucuccugccgcaagaugauccucuga

SEQ ID NO: 47004 - RNA, 762 nt, Artificial Sequence
  derived and/or modified sequence opt2 from ODF3B__Homo_sapiens__NP_001014440
augggcuccgacgccugggucggccucuggcgcccccaccgcccccgcggccccaucgccgcccacuacggcggccccggccccaaguacaagcucccccccaacaccggcuacgcccuccacgaccccucccgcccccgcgcccccgccuucaccuucggcgcccgcuuccccacccagcagaccaccugcggccccggccccggccaccucguccccgcccgcaugaccguccgcggcaccgacggcgcccccgccuacuccaucuacggccgcccccgccgcuccgcccccuuccucacccccggccccggccgcuacuuccccgagcgcgccggcaacgccaccuaccccuccgccccccgccacaccaucgccccccgcaacuggggcguccaggccgagcagcagucccccggccccgccgccuacaccguccccucccuccucggcccccgcgucaucggcaaggucuccgcccccaccugcuccaucuacggccgccgcgccgccggcuccuucuucgaggaccucuccaagacccccggccccugcgccuaccaggucgucucccccggcgucuacaagucccgcgccccccaguucaccauccucgcccgcaccucccucccccaggacaacacccgcaagcccggccccgccgccuacaacgucgaccagcaccgcaagccccgcggcugguccuucggcauccgccacuccgacuaccucgccccccucgucaccgacgccgacaacuga

SEQ ID NO: 47005 - RNA, 774 nt, Artificial Sequence
  derived and/or modified sequence opt2 from ODF4__Homo_sapiens__NP_694552
auggacgccgaguacuccggcaacgaguucccccgcuccgagggcgagcgcgaccagcaccagcgccccggcaaggagcgcaaguccggcgaggccggcuggggcaccggcgagcucggccaggacggccgccuccucuccuccacccucucccucuccuccaaccgcucccucggccagcgccagaacuccccccuccccuuccaguggcgcaucacccacuccuuccgcuggauggcccagguccucgccuccgagcucucccucgucgccuucauccuccuccucgucgucgccuucuccaagaaguggcucgaccucucccgcucccucuucuaccagcgcuggcccgucgacgucuccaaccgcauccacaccuccgcccacgucauguccaugggccuccuccacuucuacaagucccgcuccugcuccgaccucgagaacggcaaggucaccuucaucuucuccacccucaugcucuuccccaucaacaucuggaucuucgagcucgagcgcaacgucuccauccccaucggcugguccuacuucaucggcuggcucguccucauccucuacuucaccugcgccauccucugcuacuucaaccacaaguccuucuggucccucauccucucccaccccuccggcgccgucuccugcuccuccuccuucggcuccgucgaggaguccccccgcgcccagaccaucaccgacacccccaucacccaggagggcguccucgaccccgagcagaaggacacccacgucuga

SEQ ID NO: 47006 - RNA, 855 nt, Artificial Sequence
  derived and/or modified sequence opt2 from OFCC1__Homo_sapiens__XP_011513347
auggccaagggcgagaaggccgaguccggcgucgacaacaccgccggccucuccgagaaggagacccagaagaacccccgcgcccccauggacgaggccgacgucaaguccgccgcccacuccucccagggcuccauccccaagaagaucggccccugcuccauggacuacgaccccaaccuccucgaggaggacgacgagcuccacucccagggcgacucccucaccgaccacuccgucaagggcaaguccaccgucuggcgcaucggcgaggccgaggacuacucccaggacaucuccuaccucgaggagcucgaggagcaccgcuucuccgucugcugcuccuccgucgccgacucccgcuacggcgacuucuucaagcaccuccacuucguccucgucuccgccuccuccgagcuccagcucucccaguggcagucccagggcuucugguacaucauccuccucauguucuuccucugguuccuccgccucuaccuccacuaccucggccaguggcucuuccuccaggccaucuccacccccgucaccaaguuccacuucucccuccacaucgucgagcucugcuaccccaccuccucccuccacaucggcgaggagcuccccgucgucgucaugggcccccucaugcucaacgccauccuccuccuccucguccucauccgcuggggcugccagcuccucuucgccuccugccccgacguccucuccaagcucaucaucaccaugggccucuggaccauccucgacccccucgccgucuucauccucgacacccuccucggcgacaacaaggucaccgucgccucccgcaucgacgagcaggagauguga

SEQ ID NO: 47007 - RNA, 3039 nt, Artificial Sequence
  derived and/or modified sequence opt2 from OFD1__Homo_sapiens__NP_003602
augauggcccaguccaacauguucaccgucgccgacguccucucccaggacgagcuccgcaagaagcucuaccagaccuucaaggaccgcggcauccucgacacccucaagacccagcuccgcaaccagcucauccacgagcucaugcaccccguccucuccggcgagcuccagccccgcuccaucuccgucgagggcuccucccuccucaucggcgccuccaacucccucgucgccgaccaccuccagcgcugcggcuacgaguacucccucuccgucuucuuccccgaguccggccucgccaaggagaaggucuucaccaugcaggaccuccuccagcucaucaagaucaaccccaccuccucccucuacaagucccucgucuccggcuccgacaaggagaaccagaagggcuuccucaugcacuuccucaaggagcucgccgaguaccaccaggccaaggaguccugcaacauggagacccagaccuccuccaccuucaaccgcgacucccucgccgagaagcuccagcucaucgacgaccaguucgccgacgccuacccccagcgcaucaaguucgagucccucgagaucaagcucaacgaguacaagcgcgagaucgaggagcagcuccgcgccgagaugugccagaagcucaaguucuucaaggacaccgagaucgccaagaucaagauggaggccaagaagaaguacgagaaggagcucaccauguuccagaacgacuucgagaaggccugccaggccaaguccgaggcccucguccuccgcgagaaguccacccucgagcgcauccacaagcaccaggagaucgagaccaaggagaucuacgcccagcgccagcuccuccucaaggacauggaccuccuccgcggccgcgaggccgagcucaagcagcgcgucgaggccuucgagcucaaccagaagcuccaggaggagaagcacaaguccaucaccgaggcccuccgccgccaggagcagaacaucaaguccuucgaggagaccuacgaccgcaagcucaagaacgagcuccucaaguaccagcucgagcucaaggacgacuacaucauccgcaccaaccgccucaucgaggacgagcgcaagaacaaggagaaggccguccaccuccaggaggagcucaucgccaucaacuccaagaaggaggagcucaaccaguccgucaaccgcgucaaggagcucgagcucgagcucgaguccgucaaggcccagucccucgccaucaccaagcagaaccacaugcucaacgagaaggucaaggagauguccgacuacucccuccucaaggaggagaagcucgagcuccucgcccagaacaagcuccucaagcagcagcucgaggagucccgcaacgagaaccuccgccuccucaaccgccucgcccagcccgcccccgagcucgccgucuuccagaaggagcuccgcaaggccgagaaggccaucgucgucgagcacgaggaguucgaguccugccgccaggcccuccacaagcagcuccaggacgagaucgagcacuccgcccagcucaaggcccagauccucggcuacaaggccuccgucaagucccucaccacccaggucgccgaccucaagcuccagcucaagcagacccagaccgcccucgagaacgaggucuacugcaaccccaagcaguccgucaucgaccgcuccgucaacggccucaucaacggcaacgucguccccugcaacggcgagaucuccggcgacuuccucaacaaccccuucaagcaggagaacguccucgcccgcauggucgccucccgcaucaccaacuaccccaccgccugggucgagggcuccucccccgacuccgaccucgaguucgucgccaacaccaaggcccgcgucaaggagcuccagcaggaggccgagcgccucgagaaggccuuccgcuccuaccaccgccgcgucaucaagaacuccgccaaguccccccucgccgccaaguccccccccucccuccaccuccucgaggccuucaagaacaucaccuccuccucccccgagcgccacaucuucggcgaggaccgcgucgucuccgagcagccccaggucggcacccucgaggagcgcaacgacgucgucgaggcccucaccggcuccgccgccucccgccuccgcggcggcaccuccucccgccgccucuccuccaccccccuccccaaggccaagcgcucccucgaguccgagauguaccucgagggccucggccgcucccacaucgccucccccucccccugccccgaccgcaugccccuccccucccccaccgagucccgccacucccucuccaucccccccgucuccuccccccccgagcagaaggucggccucuaccgccgccagaccgagcuccaggacaaguccgaguucuccgacgucgacaagcucgccuucaaggacaacgaggaguucgaguccuccuucgaguccgccggcaacaugccccgccagcucgagaugggcggccucucccccgccggcgacaugucccacgucgacgccgccgccgccgccgucccccucuccuaccagcaccccuccgucgaccagaagcagaucgaggagcagaaggaggaggagaagauccgcgagcagcaggucaaggagcgccgccagcgcgaggagcgccgccaguccaaccuccaggagguccucgagcgcgagcgccgcgagcucgagaagcucuaccaggagcgcaagaugaucgaggagucccucaagaucaagaucaagaaggagcucgagauggagaacgagcucgagauguccaaccaggagaucaaggacaaguccgcccacuccgagaacccccucgagaaguacaugaagaucauccagcaggagcaggaccaggaguccgccgacaaguccuccaagaagaugguccaggagggcucccucgucgacacccuccaguccuccgacaaggucgagucccucaccggcuucucccacgaggagcucgacgacuccugguga

SEQ ID NO: 47008 - RNA, 1284 nt, Artificial Sequence
  derived and/or modified sequence opt2 from OGDH__Homo_sapiens__NP_001003941
auguuccaccuccgcaccugcgccgccaagcuccgcccccucaccgccucccagaccgucaagaccuucucccagaaccgccccgccgccgcccgcaccuuccagcagauccgcugcuacuccgcccccgucgccgccgagcccuuccucuccggcaccuccuccaacuacgucgaggagauguacugcgccuggcucgagaaccccaaguccguccacaaguccugggacaucuucuuccgcaacaccaacgccggcgccccccccggcaccgccuaccaguccccccucccccucucccgcggcucccucgccgccgucgcccacgcccagucccucgucgaggcccagcccaacgucgacaagcucgucgaggaccaccucgccguccagucccucauccgcgccuaccagauccgcggccaccacgucgcccagcucgacccccucggcauccucgacgccgaccucgacuccuccguccccgccgacaucaucuccuccaccgacaagcucggcuucuacggccucgacgaguccgaccucgacaaggucuuccaccuccccaccaccaccuucaucggcggccaggaguccgcccucccccuccgcgagaucauccgccgccucgagauggccuacugccagcacaucggcgucgaguucauguucaucaacgaccucgagcagugccaguggauccgccagaaguucgagacccccggcaucaugcaguucaccaacgaggagaagcgcacccuccucgcccgccucguccgcuccacccgcuucgaggaguuccuccagcgcaagugguccuccgagaagcgcuucggccucgagggcugcgagguccucauccccgcccucaagaccaucaucgacaaguccuccgagaacggcgucgacuacgucaucaugggcaugccccaccgcggccgccucaacguccucgccaacgucauccgcaaggagcucgagcagaucuucugccaguucgacuccaagcucgaggccgccgacgagggcuccggcgacgucaaguaccaccucggcauguaccaccgccgcaucaaccgcgucaccgaccgcaacaucacccucucccucgucgccaaccccucccaccucgaggccgccgaccccgucgucaugggcaagaccaaggccgagcaguucuacugcggcgacaccgagggcaagaagguccgcccccgcgagcgccgcgcccgccagaucgucaaggcccccugcuccuccauggaguuccgcucccccaccuga

SEQ ID NO: 47009 - RNA, 2862 nt, Artificial Sequence
  derived and/or modified sequence opt2 from OGDHL__Homo_sapiens__NP_001137468
augucccagcuccgccuccuccccucccgccucggcguccaggccgcccgccuccucgccgcccacgacguccccgucuucggcuggcgcucccgcuccuccggcccccccgccaccuuccccuccuccaagggcggcggcggcuccuccuacauggaggagauguacuucgccuggcucgagaacccccaguccguccacaagauccgcggccaccacgucgcccagcucgacccccucggcauccucgacgccgaccucgacuccuucguccccuccgaccucaucaccaccaucgacaagcucgccuucuacgaccuccaggaggccgaccucgacaaggaguuccagcuccccaccaccaccuucaucggcggcuccgagaacacccucucccuccgcgagaucauccgccgccucgagaacaccuacugccagcacaucggccucgaguucauguucaucaacgacgucgagcagugccaguggauccgccagaaguucgagacccccggcgucaugcaguucuccuccgaggagaagcgcacccuccucgcccgccucguccgcuccaugcgcuucgaggacuuccucgcccgcaagugguccuccgagaagcgcuucggccucgagggcugcgaggucaugauccccgcccucaagaccaucaucgacaaguccuccgagaugggcaucgagaacgucauccucggcaugccccaccgcggccgccucaacguccucgccaacgucauccgcaaggaccucgagcagaucuucugccaguucgaccccaagcucgaggccgccgacgagggcuccggcgacgucaaguaccaccucggcauguaccacgagcgcaucaaccgcgucaccaaccgcaacaucacccucucccucgucgccaaccccucccaccucgaggccgucgaccccgucguccagggcaagaccaaggccgagcaguucuaccgcggcgacgcccagggcaagaaggucauguccauccucguccacggcgacgccgccuucgccggccagggcgucgucuacgagaccuuccaccucuccgaccuccccuccuacaccaccaacggcaccguccacgucgucgucaacaaccagaucggcuucaccaccgacccccgcauggcccgcuccucccccuaccccaccgacgucgcccgcgucgucaacgcccccaucuuccacgucaacgccgacgaccccgaggccgucaucuacgucugcuccgucgccgccgaguggcgcaacaccuucaacaaggacgucgucgucgaccucgucugcuaccgccgccgcggccacaacgagauggacgagcccauguucacccagccccucauguacaagcagauccaccgccagguccccguccucaagaaguacgccgacaagcucaucgccgagggcaccgucacccuccaggaguucgaggaggagaucgccaaguacgaccgcaucugcgaggaggccuacggccgcuccaaggacaagaagauccuccacaucaagcacuggcucgacucccccuggcccggcuucuucaacgucgacggcgagcccaaguccaugaccugccccgccaccggcauccccgaggacaugcucacccacaucggcuccgucgccuccuccgucccccucgaggacuucaagauccacaccggccucucccgcauccuccgcggccgcgccgacaugaccaagaaccgcaccgucgacugggcccucgccgaguacauggccuucggcucccuccucaaggagggcauccacguccgccucuccggccaggacgucgagcgcggcaccuucucccaccgccaccacguccuccacgaccaggaggucgaccgccgcaccugcguccccaugaaccaccucuggcccgaccaggcccccuacaccgucugcaacuccucccucuccgaguacggcguccucggcuucgagcucggcuacgccauggccucccccaacgcccucguccucugggaggcccaguucggcgacuuccacaacaccgcccagugcaucaucgaccaguucaucuccaccggccaggccaaguggguccgccacaacggcaucguccuccuccucccccacggcauggagggcaugggccccgagcacuccuccgcccgccccgagcgcuuccuccagauguccaacgacgacuccgacgccuaccccgccuucaccaaggacuucgaggucucccagcucuacgacugcaacuggaucgucgucaacugcuccacccccgccaacuacuuccacguccuccgccgccagauccuccuccccuuccgcaagccccucaucaucuucacccccaagucccuccuccgccaccccgaggccaaguccuccuucgaccagauggucuccggcaccuccuuccagcgcgucauccccgaggacggcgccgccgcccgcgcccccgagcagguccagcgccucaucuucugcaccggcaaggucuacuacgaccucgucaaggagcgcuccucccaggaccucgaggagaaggucgccaucacccgccucgagcagaucucccccuuccccuucgaccucaucaagcaggaggccgagaaguaccccggcgccgagcucgccuggugccaggaggagcacaagaacaugggcuacuacgacuacaucuccccccgcuucaugaccauccuccgccgcgcccgccccaucugguacgucggccgcgaccccgccgccgcccccgccaccggcaaccgcaacacccaccucgucucccucaagaaguuccucgacaccgccuucaaccuccaggccuucgagggcaagaccuucuga

SEQ ID NO: 47010 - RNA, 1629 nt, Artificial Sequence
  derived and/or modified sequence opt2 from OGFOD1__Homo_sapiens__NP_060703
augaacggcaagcgccccgccgagcccggccccgcccgcgucggcaagaagggcaagaaggaggucauggccgaguucuccgacgccgucaccgaggagacccucaagaagcaggucgccgaggccuggucccgccgcacccccuucucccacgaggucaucgucauggacauggaccccuuccuccacugcgucauccccaacuucauccagucccaggacuuccucgagggccuccagaaggagcucaugaaccucgacuuccacgagaaguacaacgaccucuacaaguuccagcaguccgacgaccucaagaagcgccgcgagccccacaucuccacccuccgcaagauccucuucgaggacuuccgcuccuggcucuccgacaucuccaagaucgaccucgaguccaccaucgacauguccugcgccaaguacgaguucaccgacgcccuccucugccacgacgacgagcucgagggccgccgcaucgccuucauccucuaccucgucccccccugggaccgcuccaugggcggcacccucgaccucuacuccaucgacgagcacuuccagcccaagcagaucgucaagucccucauccccuccuggaacaagcucgucuucuucgaggucucccccgucuccuuccaccaggucuccgagguccucuccgaggagaagucccgccucuccaucuccggcugguuccacggccccucccucacccgcccccccaacuacuucgagccccccaucccccgcuccccccacaucccccaggaccacgagauccucuacgacuggaucaaccccaccuaccucgacauggacuaccagguccagauccaggaggaguucgaggaguccuccgagauccuccucaaggaguuccucaagcccgagaaguucaccaaggucugcgaggcccucgagcacggccacgucgagugguccucccgcggcccccccaacaagcgcuucuacgagaaggccgaggaguccaagcuccccgagauccucaaggagugcaugaagcucuuccgcuccgaggcccucuuccuccuccucuccaacuucaccggccucaagcuccacuuccucgcccccuccgaggaggacgagaugaacgacaagaaggaggccgagaccaccgacaucaccgaggagggcaccucccacuccccccccgagcccgagaacaaccagauggccaucuccaacaacucccagcaguccaacgagcagaccgaccccgagcccgaggagaacgagaccaagaaggaguccuccguccccaugugccagggcgagcuccgccacuggaagaccggccacuacacccucauccacgaccacuccaaggccgaguucgcccucgaccucauccucuacugcggcugcgagggcugggagcccgaguacggcggcuucaccuccuacaucgccaagggcgaggacgaggagcuccucaccgucaaccccgaguccaacucccucgcccucgucuaccgcgaccgcgagacccucaaguucgucaagcacaucaaccaccgcucccucgagcagaagaagaccuuccccaaccgcaccggcuucugggacuucuccuucaucuacuacgaguga

SEQ ID NO: 47011 - RNA, 2034 nt, Artificial Sequence
  derived and/or modified sequence opt2 from OGFR__Homo_sapiens__NP_031372
auggacgaccccgacugcgacuccaccugggaggaggacgaggaggacgccgaggacgccgaggacgaggacugcgaggacggcgaggccgccggcgcccgcgacgccgacgccggcgacgaggacgaggaguccgaggagccccgcgccgcccgccccuccuccuuccagucccgcaugaccggcucccgcaacuggcgcgccacccgcgacaugugccgcuaccgccacaacuaccccgaccucgucgagcgcgacugcaacggcgacacccccaaccucuccuucuaccgcaacgagauccgcuuccuccccaacggcugcuucaucgaggacauccuccagaacuggaccgacaacuacgaccuccucgaggacaaccacuccuacauccaguggcucuucccccuccgcgagcccggcgucaacuggcacgccaagccccucacccuccgcgaggucgaggucuucaaguccucccaggagauccaggagcgccucguccgcgccuacgagcucaugcucggcuucuacggcauccgccucgaggaccgcggcaccggcaccgucggccgcgcccagaacuaccagaagcgcuuccagaaccucaacuggcgcucccacaacaaccuccgcaucacccgcauccucaagucccucggcgagcucggccucgagcacuuccaggccccccucguccgcuucuuccucgaggagacccucguccgccgcgagcuccccggcguccgccaguccgcccucgacuacuucauguucgccguccgcugccgccaccagcgccgccagcucguccacuucgccugggagcacuuccgcccccgcugcaaguucgucuggggcccccaggacaagcuccgccgcuucaagcccuccucccucccccacccccucgagggcucccgcaaggucgaggaggagggcucccccggcgaccccgaccacgaggccuccacccagggccgcaccugcggccccgagcacuccaagggcggcggccgcgucgacgagggcccccagccccgcuccgucgagccccaggacgccggcccccucgagcgcucccagggcgacgaggccggcggccacggcgaggaccgccccgagccccucucccccaaggaguccaagaagcgcaagcucgagcucucccgccgcgagcagccccccaccgagcccggcccccaguccgccuccgaggucgagaagaucgcccucaaccucgagggcugcgcccucucccagggcucccuccgcaccggcacccaggaggucggcggccaggaccccggcgaggccguccagcccugccgccagccccucggcgcccgcgucgccgacaagguccgcaagcgccgcaaggucgacgagggcgccggcgacuccgccgccgucgccuccggcggcgcccagacccucgcccucgccggcucccccgcccccuccggccaccccaaggccggccacuccgagaacggcgucgaggaggacaccgagggccgcaccggccccaaggagggcacccccggcucccccuccgagacccccggccccucccccgccggccccgccggcgacgagcccgccgagucccccuccgagacccccggcccccgccccgccggccccgccggcgacgagcccgccgagucccccuccgagacccccggcccccgccccgccggccccgccggcgacgagcccgccgagucccccuccgagacccccggccccucccccgccggccccacccgcgacgagcccgccgagucccccuccgagacccccggcccccgccccgccggccccgccggcgacgagcccgccgagucccccuccgagacccccggcccccgccccgccggccccgccggcgacgagcccgccgagucccccuccgagacccccggccccucccccgccggccccacccgcgacgagcccgccaaggccggcgaggccgccgagcuccaggacgccgaggucgaguccuccgccaaguccggcaagcccuga

SEQ ID NO: 47012 - RNA, 1038 nt, Artificial Sequence
  derived and/or modified sequence opt2 from OGG1__Homo_sapiens__NP_002533
augcccgcccgcgcccuccucccccgccgcaugggccaccgcacccucgccuccacccccgcccucugggccuccauccccugcccccgcuccgagcuccgccucgaccucguccuccccuccggccaguccuuccgcuggcgcgagcagucccccgcccacugguccggcguccucgccgaccaggucuggacccucacccagaccgaggagcagcuccacugcaccgucuaccgcggcgacaagucccaggccucccgccccacccccgacgagcucgaggccguccgcaaguacuuccagcucgacgucacccucgcccagcucuaccaccacuggggcuccgucgacucccacuuccaggaggucgcccagaaguuccagggcguccgccuccuccgccaggaccccaucgagugccucuucuccuucaucugcuccuccaacaacaacaucgcccgcaucaccggcauggucgagcgccucugccaggccuucggcccccgccucauccagcucgacgacgucaccuaccacggcuuccccucccuccaggcccucgccggccccgaggucgaggcccaccuccgcaagcucggccucggcuaccgcgcccgcuacgucuccgccuccgcccgcgccauccucgaggagcagggcggccucgccuggcuccagcagcuccgcgaguccuccuacgaggaggcccacaaggcccucugcauccuccccggcgucggcaccaaggucgccgacugcaucugccucauggcccucgacaagccccaggccguccccgucgacguccacauguggcacaucgcccagcgcgacuacuccuggcaccccaccaccucccaggccaagggccccuccccccagaccaacaaggagcucggcaacuucuuccgcucccucuggggccccuacgccggcugggcccaggccguccucuucuccgccgaccuccgccagucccgccacgcccaggagccccccgccaagcgccgcaagggcuccaagggccccgagggcuga

SEQ ID NO: 47013 - RNA, 897 nt, Artificial Sequence
  derived and/or modified sequence opt2 from OGN__Homo_sapiens__NP_054776
augaagacccuccaguccacccuccuccuccuccuccucgucccccucaucaagcccgccccccccacccagcaggacucccgcaucaucuacgacuacggcaccgacaacuucgaggaguccaucuucucccaggacuacgaggacaaguaccucgacggcaagaacaucaaggagaaggagaccgucaucauccccaacgagaagucccuccagcuccagaaggacgaggccaucaccccccucccccccaagaaggagaacgacgagaugcccaccugccuccucugcgucugccucuccggcuccgucuacugcgaggaggucgacaucgacgccguccccccccuccccaaggaguccgccuaccucuacgcccgcuucaacaagaucaagaagcucaccgccaaggacuucgccgacauccccaaccuccgccgccucgacuucaccggcaaccucaucgaggacaucgaggacggcaccuucuccaagcucucccuccucgaggagcucucccucgccgagaaccagcuccucaagcuccccguccucccccccaagcucacccucuucaacgccaaguacaacaagaucaagucccgcggcaucaaggccaacgccuucaagaagcucaacaaccucaccuuccucuaccucgaccacaacgcccucgaguccgucccccucaaccuccccgagucccuccgcgucauccaccuccaguucaacaacaucgccuccaucaccgacgacaccuucugcaaggccaacgacaccuccuacauccgcgaccgcaucgaggagauccgccucgagggcaaccccaucguccucggcaagcaccccaacuccuucaucugccucaagcgccuccccaucggcuccuacuucuga

SEQ ID NO: 47014 - RNA, 3141 nt, Artificial Sequence
  derived and/or modified sequence opt2 from OGT__Homo_sapiens__NP_858058
auggccuccuccgucggcaacgucgccgacuccaccgagcccaccaagcgcaugcucuccuuccagggccucgccgagcucgcccaccgcgaguaccaggccggcgacuucgaggccgccgagcgccacugcaugcagcucuggcgccaggagcccgacaacaccggcguccuccuccuccucuccuccauccacuuccagugccgccgccucgaccgcuccgcccacuucuccacccucgccaucaagcagaacccccuccucgccgaggccuacuccaaccucggcaacgucuacaaggagcgcggccagcuccaggaggccaucgagcacuaccgccacgcccuccgccucaagcccgacuucaucgacggcuacaucaaccucgccgccgcccucgucgccgccggcgacauggagggcgccguccaggccuacgucuccgcccuccaguacaaccccgaccucuacugcguccgcuccgaccucggcaaccuccucaaggcccucggccgccucgaggaggccaaggccugcuaccucaaggccaucgagacccagcccaacuucgccgucgccugguccaaccucggcugcgucuucaacgcccagggcgagaucuggcucgccauccaccacuucgagaaggccgucacccucgaccccaacuuccucgacgccuacaucaaccucggcaacguccucaaggaggcccgcaucuucgaccgcgccgucgccgccuaccuccgcgcccucucccucucccccaaccacgccgucguccacggcaaccucgccugcgucuacuacgagcagggccucaucgaccucgccaucgacaccuaccgccgcgccaucgagcuccagccccacuuccccgacgccuacugcaaccucgccaacgcccucaaggagaagggcuccgucgccgaggccgaggacugcuacaacaccgcccuccgccucugccccacccacgccgacucccucaacaaccucgccaacaucaagcgcgagcagggcaacaucgaggaggccguccgccucuaccgcaaggcccucgaggucuuccccgaguucgccgccgcccacuccaaccucgccuccguccuccagcagcagggcaagcuccaggaggcccucaugcacuacaaggaggccauccgcaucucccccaccuucgccgacgccuacuccaacaugggcaacacccucaaggagaugcaggacguccagggcgcccuccagugcuacacccgcgccauccagaucaaccccgccuucgccgacgcccacuccaaccucgccuccauccacaaggacuccggcaacauccccgaggccaucgccuccuaccgcaccgcccucaagcucaagcccgacuuccccgacgccuacugcaaccucgcccacugccuccagaucgucugcgacuggaccgacuacgacgagcgcaugaagaagcucgucuccaucgucgccgaccagcucgagaagaaccgccuccccuccguccacccccaccacuccaugcucuacccccucucccacggcuuccgcaaggccaucgccgagcgccacggcaaccucugccucgacaagaucaacguccuccacaagccccccuacgagcaccccaaggaccucaagcucuccgacggccgccuccgcgucggcuacgucuccuccgacuucggcaaccaccccaccucccaccucaugcaguccauccccggcaugcacaaccccgacaaguucgaggucuucugcuacgcccucucccccgacgacggcaccaacuuccgcgucaaggucauggccgaggccaaccacuucaucgaccucucccagauccccugcaacggcaaggccgccgaccgcauccaccaggacggcauccacauccucgucaacaugaacggcuacaccaagggcgcccgcaacgagcucuucgcccuccgccccgcccccauccaggccauguggcucggcuaccccggcaccuccggcgcccucuucauggacuacaucaucaccgaccaggagaccucccccgccgaggucgccgagcaguacuccgagaagcucgccuacaugccccacaccuucuucaucggcgaccacgccaacauguucccccaccucaagaagaaggccgucaucgacuucaaguccaacggccacaucuacgacaaccgcaucguccucaacggcaucgaccucaaggccuuccucgacucccuccccgacgucaagaucgucaagaugaagugccccgacggcggcgacaacgccgacuccuccaacaccgcccucaacaugcccgucauccccaugaacaccaucgccgaggccgucaucgagaugaucaaccgcggccagauccagaucaccaucaacggcuucuccaucuccaacggccucgccaccacccagaucaacaacaaggccgccaccggcgaggaggucccccgcaccaucaucgucaccacccgcucccaguacggccuccccgaggacgccaucgucuacugcaacuucaaccagcucuacaagaucgaccccuccacccuccagaugugggccaacauccucaagcgcguccccaacuccguccucuggcuccuccgcuuccccgccgucggcgagcccaacauccagcaguacgcccagaacaugggccucccccagaaccgcaucaucuucucccccgucgcccccaaggaggagcacguccgccgcggccagcucgccgacgucugccucgacaccccccucugcaacggccacaccaccggcauggacguccucugggccggcacccccauggucaccaugcccggcgagacccucgccucccgcgucgccgccucccagcucaccugccucggcugccucgagcucaucgccaagaaccgccaggaguacgaggacaucgccgucaagcucggcaccgaccucgaguaccucaagaagguccgcggcaaggucuggaagcagcgcaucuccuccccccucuucaacaccaagcaguacaccauggagcucgagcgccucuaccuccagaugugggagcacuacgccgccggcaacaagcccgaccacaugaucaagcccgucgaggucaccgaguccgccuga

SEQ ID NO: 47015 - RNA, 690 nt, Artificial Sequence
  derived and/or modified sequence opt2 from OIP5__Homo_sapiens__NP_009211
auggccgcccagccccuccgccaccgcucccgcugcgccacccccccccgcggcgacuucugcggcggcaccgagcgcgccaucgaccaggccuccuucaccaccuccauggagugggacacccaggucgucaagggcuccuccccccucggccccgccggccucggcgccgaggagcccgccgccggcccccagcuccccuccuggcuccagcccgagcgcugcgccgucuuccagugcgcccagugccacgccguccucgccgacuccguccaccucgccugggaccucucccgcucccucggcgccgucgucuucucccgcgucaccaacaacgucguccucgaggcccccuuccucgucggcaucgagggcucccucaagggcuccaccuacaaccuccucuucugcggcuccugcggcauccccgucggcuuccaccucuacuccacccacgccgcccucgccgcccuccgcggccacuucugccucuccuccgacaagauggucugcuaccuccucaagaccaaggccaucgucaacgccuccgagauggacauccagaacgucccccucuccgagaagaucgccgagcucaaggagaagaucguccucacccacaaccgccucaagucccucaugaagauccucuccgaggucacccccgaccaguccaagcccgagaacuga

SEQ ID NO: 47016 - RNA, 1638 nt, Artificial Sequence
  derived and/or modified sequence opt2 from OIT3__Homo_sapiens__NP_689848
augccccccuuccuccuccucaccugccucuucaucaccggcaccuccgucucccccgucgcccucgaccccugcuccgccuacaucucccucaacgagcccuggcgcaacaccgaccaccagcucgacgagucccagggccccccccucugcgacaaccacgucaacggcgagugguaccacuucaccggcauggccggcgacgccaugcccaccuucugcauccccgagaaccacugcggcacccacgcccccgucuggcucaacggcucccacccccucgagggcgacggcaucguccagcgccaggccugcgccuccuucaacggcaacugcugccucuggaacaccaccgucgaggucaaggccugccccggcggcuacuacgucuaccgccucaccaagcccuccgucugcuuccacgucuacugcggccacuucuacgacaucugcgacgaggacugccacggcuccugcuccgacaccuccgagugcaccugcgcccccggcaccguccucggccccgaccgccagaccugcuucgacgagaacgagugcgagcagaacaacggcggcugcuccgagaucugcgucaaccucaagaacuccuaccgcugcgagugcggcgucggccgcguccuccgcuccgacggcaagaccugcgaggacgucgagggcugccacaacaacaacggcggcugcucccacuccugccucggcuccgagaagggcuaccagugcgagugcccccgcggccucguccucuccgaggacaaccacaccugccagguccccguccucugcaaguccaacgccaucgaggucaacaucccccgcgagcucgucggcggccucgagcucuuccucaccaacaccuccugccgcggcgucuccaacggcacccacgucaacauccucuucucccucaagaccugcggcaccgucgucgacgucgucaacgacaagaucgucgccuccaaccucgucaccggccuccccaagcagacccccggcuccuccggcgacuucaucauccgcaccuccaagcuccucauccccgucaccugcgaguucccccgccucuacaccaucuccgagggcuacguccccaaccuccgcaacuccccccucgagaucaugucccgcaaccacggcaucuuccccuucacccucgagaucuucaaggacaacgaguucgaggagcccuaccgcgaggcccuccccacccucaagcuccgcgacucccucuacuucggcaucgagcccgucguccacgucuccggccucgagucccucgucgaguccugcuucgccacccccaccuccaagaucgacgagguccucaaguacuaccucauccgcgacggcugcgucuccgacgacuccgucaagcaguacaccucccgcgaccaccucgccaagcacuuccagguccccgucuucaaguucgucggcaaggaccacaaggaggucuuccuccacugccgcguccucgucugcggcguccucgacgagcgcucccgcugcgcccagggcugccaccgccgcaugcgccgcggcgccggcggcgaggacuccgccggccuccagggccagacccucaccggcggccccauccgcaucgacugggaggacuga

SEQ ID NO: 47017 - RNA, 717 nt, Artificial Sequence
  derived and/or modified sequence opt2 from OLA1__Homo_sapiens__NP_001011708
augaucggccccaucaucgacaagcucgagaaggucgccguccgcggcggcgacaagaagcucaagcccgaguacgacaucaugugcaaggucaaguccugggucaucgaccagaagaagcccguccgcuucuaccacgacuggaacgacaaggagaucgagguccucaacaagcaccucuuccucaccuccaagcccauggucuaccucgucaaccucuccgagaaggacuacauccgcaagaagaacaaguggcucaucaagaucaaggagugggucgacaaguacgaccccggcgcccucgucauccccuucuccggcgcccucgagcucaagcuccaggagcucuccgccgaggagcgccagaaguaccucgaggccaacaugacccaguccgcccuccccaagaucaucaaggccggcuucgccgcccuccagcucgaguacuucuucaccgccggccccgacgagguccgcgccuggaccauccgcaagggcaccaaggccccccaggccgccggcaagauccacaccgacuucgagaagggcuucaucauggccgaggucaugaaguacgaggacuucaaggaggagggcuccgagaacgccgucaaggccgccggcaaguaccgccagcagggccgcaacuacaucgucgaggacggcgacaucaucuucuucaaguucaacaccccccagcagcccaagaagaaguga

SEQ ID NO: 47018 - RNA, 1458 nt, Artificial Sequence
  derived and/or modified sequence opt2 from OLFM1__Homo_sapiens__NP_001269540
auguccgucccccuccucaagaucggcgucguccucuccaccauggccaugaucaccaacuggaugucccagacccuccccucccucgucggccucaacaccaccaagcucuccgccgccggcggcggcacccucgaccgcuccaccggcguccuccccaccaaccccgaggaguccuggcaggucuacuccuccgcccaggacuccgagggccgcugcaucugcaccgucgucgccccccagcagaccaugugcucccgcgacgcccgcaccaagcagcuccgccagcuccucgagaagguccagaacaugucccaguccaucgagguccucgaccgccgcacccagcgcgaccuccaguacgucgagaagauggagaaccagaugaagggccucgaguccaaguucaagcaggucgaggagucccacaagcagcaccucgcccgccaguucaaggccaucaaggccaagauggacgagcuccgcccccucauccccguccucgaggaguacaaggccgacgccaagcucguccuccaguucaaggaggagguccagaaccucaccuccguccucaacgagcuccaggaggagaucggcgccuacgacuacgacgagcuccagucccgcgucuccaaccucgaggagcgccuccgcgccugcaugcagaagcucgccugcggcaagcucaccggcaucuccgaccccgucaccgucaagaccuccggcucccgcuucggcuccuggaugaccgacccccucgcccccgagggcgacaaccgcgucugguacauggacggcuaccacaacaaccgcuucguccgcgaguacaaguccauggucgacuucaugaacaccgacaacuucaccucccaccgccucccccaccccugguccggcaccggccaggucgucuacaacggcuccaucuacuucaacaaguuccagucccacaucaucauccgcuucgaccucaagaccgagaccauccucaagacccgcucccucgacuacgccggcuacaacaacauguaccacuacgccuggggcggccacuccgacaucgaccucauggucgacgaguccggccucugggccgucuacgccaccaaccagaacgccggcaacaucgucgucucccgccucgaccccgucucccuccagacccuccagaccuggaacaccuccuaccccaagcgcuccgccggcgaggccuucaucaucugcggcacccucuacgucaccaacggcuacuccggcggcaccaagguccacuacgccuaccagaccaacgccuccaccuacgaguacaucgacauccccuuccagaacaaguacucccacaucuccaugcucgacuacaaccccaaggaccgcgcccucuacgccuggaacaacggccaccagauccucuacaacgucacccucuuccacgucauccgcuccgacgagcucuga

SEQ ID NO: 47019 - RNA, 1365 nt, Artificial Sequence
  derived and/or modified sequence opt2 from OLFM2__Homo_sapiens__NP_477512
auguggccccucaccgucccccccccccuccuccuccuccucugcuccggccucgccggccagacccucuuccagaaccccgaggagggcuggcagcucuacaccuccgcccaggcccccgacggcaagugcaucugcaccgccgucauccccgcccaguccaccugcucccgcgacggccgcucccgcgagcuccgccagcucauggagaagguccagaacgucucccaguccauggagguccucgagcuccgcaccuaccgcgaccuccaguacguccgcggcauggagacccucaugcgcucccucgacgcccgccuccgcgccgccgacggcucccucuccgccaaguccuuccaggagcucaaggaccgcaugaccgagcuccucccccucuccuccguccucgagcaguacaaggccgacacccgcaccaucguccgccuccgcgaggagguccgcaaccucuccggcucccucgccgccauccaggaggagaugggcgccuacggcuacgaggaccuccagcagcgcgucauggcccucgaggcccgccuccacgccugcgcccagaagcucggcugcggcaagcucaccggcgucuccaaccccaucaccguccgcgccaugggcucccgcuucggcuccuggaugaccgacaccauggcccccuccgccgacucccgcgucugguacauggacggcuacuacaagggccgccgcguccucgaguuccgcacccucggcgacuucaucaagggccagaacuucauccagcaccuccucccccagcccugggccggcaccggccacgucgucuacaacggcucccucuucuacaacaaguaccaguccaacgucgucgucaaguaccacuuccgcucccgcuccguccucguccagcgcucccuccccggcgccggcuacaacaacaccuuccccuacuccuggggcggcuucuccgacauggacuucauggucgacgaguccggccucugggccgucuacaccaccaaccagaacgccggcaacaucgucgucucccgccucgacccccacacccucgaggucaugcgcuccugggacaccggcuaccccaagcgcuccgccggcgaggccuucaugaucugcggcguccucuacgucaccaacucccaccucgccggcgccaaggucuacuucgccuacuucaccaacaccuccuccuacgaguacaccgacguccccuuccacaaccaguacucccacaucuccaugcucgacuacaacccccgcgagcgcgcccucuacaccuggaacaacggccaccagguccucuacaacgucacccucuuccacgucaucuccaccuccggcgaccccuga

SEQ ID NO: 47020 - RNA, 1533 nt, Artificial Sequence
  derived and/or modified sequence opt2 from OLFM4__Homo_sapiens__NP_006409
augcgccccggccucuccuuccuccucgcccuccucuucuuccucggccaggccgccggcgaccucggcgacgucggcccccccauccccucccccggcuucuccuccuuccccggcgucgacuccuccuccuccuucuccuccuccucccgcuccggcuccuccuccucccgcucccucggcuccggcggcuccgucucccagcucuucuccaacuucaccggcuccgucgacgaccgcggcaccugccagugcuccgucucccuccccgacaccaccuuccccgucgaccgcgucgagcgccucgaguucaccgcccacguccucucccagaaguucgagaaggagcucuccaagguccgcgaguacguccagcucaucuccgucuacgagaagaagcuccucaaccucaccguccgcaucgacaucauggagaaggacaccaucuccuacaccgagcucgacuucgagcucaucaaggucgaggucaaggagauggagaagcucgucauccagcucaaggaguccuucggcggcuccuccgagaucgucgaccagcucgaggucgagauccgcaacaugacccuccucgucgagaagcucgagacccucgacaagaacaacguccucgccauccgccgcgagaucgucgcccucaagaccaagcucaaggagugcgaggccuccaaggaccagaacacccccgucguccaccccccccccacccccggcuccugcggccacggcggcgucgucaacaucuccaagcccuccgucguccagcucaacuggcgcggcuucuccuaccucuacggcgccuggggccgcgacuacuccccccagcaccccaacaagggccucuacugggucgccccccucaacaccgacggccgccuccucgaguacuaccgccucuacaacacccucgacgaccuccuccucuacaucaacgcccgcgagcuccgcaucaccuacggccagggcuccggcaccgccgucuacaacaacaacauguacgucaacauguacaacaccggcaacaucgcccgcgucaaccucaccaccaacaccaucgccgucacccagacccuccccaacgccgccuacaacaaccgcuucuccuacgccaacgucgccuggcaggacaucgacuucgccgucgacgagaacggccucugggucaucuacuccaccgaggccuccaccggcaacauggucaucuccaagcucaacgacaccacccuccagguccucaacaccugguacaccaagcaguacaagcccuccgccuccaacgccuucauggucugcggcguccucuacgccacccgcaccaugaacacccgcaccgaggagaucuucuacuacuacgacaccaacaccggcaaggagggcaagcucgacaucgucaugcacaagaugcaggagaagguccaguccaucaacuacaaccccuucgaccagaagcucuacgucuacaacgacggcuaccuccucaacuacgaccucuccguccuccagaagccccaguga

SEQ ID NO: 47021 - RNA, 2253 nt, Artificial Sequence
  derived and/or modified sequence opt2 from OLFML2B__Homo_sapiens__NP_056256
auggccaagccccgccuccucguccucuacuucgcccucaucgucguccccgccugggucuccuccaucguccucaccggcaccuccgagccccccgacgcccagaccgucgcccccgccgaggacgagacccuccagaacgaggccgacaaccaggagaacguccucucccagcuccucggcgacuacgacaaggucaaggccauguccgagggcuccgacugccagugcaagugcgucguccgcccccucggccgcgacgccugccagcgcaucaacgccggcgccucccgcaaggaggacuucuacaccgucgagaccaucaccuccggcuccuccugcaagugcgccugcgucgccccccccuccgcccucaaccccugcgagggcgacuuccgccuccagaagcuccgcgaggccgacucccaggaccucaagcucuccaccaucaucgacaugcucgagggcgccuucuacggccucgaccuccucaagcuccacuccgucaccaccaagcucgucggccgcgucgacaagcucgaggaggaggucuccaagaaccucaccaaggagaacgagcagaucaaggaggacauggaggagauccgcaccgagaugaacaagcgcggcaaggagaacugcuccgagaacauccucgacuccaugcccgacauccgcuccgcccuccagcgcgacgccgccgccgccuacgcccaccccgaguacgaggagcgcuuccuccaggaggagaccgucucccagcagaucaacuccaucgagcuccuccagacccgcccccucgcccuccccgaggucgucaagucccagcgcccccuccagcgccagguccaccuccgcggccgccccgccucccagcccaccgucauccgcggcaucaccuacuacaaggccaaggucuccgaggaggagaacgacaucgaggagcagcaggacgaguucuucuccggcgacaacggcgucgaccuccucaucgaggaccagcuccuccgccacaacggccucaugaccuccgucacccgccgccccgccgccacccgccagggccacuccaccgccgucaccuccgaccucaacgcccgcaccgcccccugguccuccgcccucccccagcccuccaccuccgaccccuccaucgccaaccacgccuccgucggccccacccuccagaccaccuccgucucccccgaccccacccgcgaguccguccuccagcccuccccccagguccccgccaccaccgucgcccacaccgccacccagcagcccgccgcccccgccccccccgccgucuccccccgcgaggcccucauggaggccaugcacaccguccccgucccccccaccaccguccgcaccgacucccucggcaaggacgcccccgccggcuggggcaccacccccgccucccccacccucucccccgaggaggaggacgacauccgcaacgucaucggccgcugcaaggacacccucuccaccaucaccggccccaccacccagaacaccuacggccgcaacgagggcgccuggaugaaggacccccucgccaaggacgagcgcaucuacgucaccaacuacuacuacggcaacacccucgucgaguuccgcaaccucgagaacuucaagcagggccgcugguccaacuccuacaagcuccccuacuccuggaucggcaccggccacgucgucuacaacggcgccuucuacuacaaccgcgccuucacccgcaacaucaucaaguacgaccucaagcagcgcuacgucgccgccugggccaugcuccacgacgucgccuacgaggaggccacccccuggcgcuggcagggccacuccgacgucgacuucgccgucgacgagaacggccucuggcucaucuaccccgcccucgacgacgagggcuucucccaggaggucaucguccucuccaagcucaacgccgccgaccucuccacccagaaggagaccaccuggcgcaccggccuccgccgcaacuucuacggcaacugcuucgucaucugcggcguccucuacgccgucgacuccuacaaccagcgcaacgccaacaucuccuacgccuucgacacccacaccaacacccagaucgucccccgccuccucuucgagaacgaguacuccuacaccacccagaucgacuacaaccccaaggaccgccuccucuacgccugggacaacggccaccaggucaccuaccacgucaucuucgccuacuga

SEQ ID NO: 47022 - RNA, 816 nt, Artificial Sequence
  derived and/or modified sequence opt2 from OLIG1__Homo_sapiens__NP_620450
auguacuacgccgucucccaggcccgcgucaacgccguccccggcaccaugcuccgcccccagcgccccggcgaccuccagcucggcgccucccucuacgagcucgucggcuaccgccagccccccuccuccuccuccuccuccaccuccuccaccuccuccaccuccuccuccuccaccaccgccccccuccuccccaaggccgcccgcgagaagcccgaggcccccgccgagccccccggccccggccccggcuccggcgcccaccccggcggcuccgcccgccccgacgccaaggaggagcagcagcagcagcuccgccgcaagaucaacucccgcgagcgcaagcgcaugcaggaccucaaccucgccauggacgcccuccgcgaggucauccuccccuacuccgccgcccacugccagggcgcccccggccgcaagcucuccaagaucgccacccuccuccucgcccgcaacuacauccuccuccucggcuccucccuccaggagcuccgccgcgcccucggcgagggcgccggccccgccgccccccgccuccuccucgccggccucccccuccucgccgccgcccccggcuccguccuccucgcccccggcgccgucggcccccccgacgcccuccgccccgccaaguaccucucccucgcccucgacgagccccccugcggccaguucgcccuccccggcggcggcgccggcggccccggccucugcaccugcgccgucugcaaguucccccaccucguccccgccucccucggccucgccgccguccaggcccaguucuccaaguga

SEQ ID NO: 47023 - RNA, 972 nt, Artificial Sequence
  derived and/or modified sequence opt2 from OLIG2__Homo_sapiens__XP_005260965
auggacuccgacgccucccucgucuccucccgccccuccucccccgagcccgacgaccucuuccuccccgcccgcuccaagggcuccuccggcuccgccuucaccggcggcaccgucuccuccuccacccccuccgacugcccccccgagcucuccgccgagcuccgcggcgccaugggcuccgccggcgcccaccccggcgacaagcucggcggcuccggcuucaaguccuccuccuccuccaccuccuccuccaccuccuccgccgccgccuccuccaccaagaaggacaagaagcagaugaccgagcccgagcuccagcagcuccgccucaagaucaacucccgcgagcgcaagcgcaugcacgaccucaacaucgccauggacggccuccgcgaggucaugcccuacgcccacggccccuccguccgcaagcucuccaagaucgccacccuccuccucgcccgcaacuacauccucaugcucaccaacucccucgaggagaugaagcgccucgucuccgagaucuacggcggccaccacgccggcuuccaccccuccgccugcggcggccucgcccacuccgccccccuccccgccgccaccgcccaccccgccgccgccgcccacgccgcccaccaccccgccguccaccaccccauccucccccccgccgccgccgccgccgccgccgccgccgccgccgccgccgucuccuccgccucccuccccggcuccggccuccccuccgucggcuccauccgccccccccacggccuccucaagucccccuccgccgccgccgccgccccccucggcggcggcggcggcggcuccggcgccuccggcggcuuccagcacuggggcggcaugcccugccccugcuccaugugccaggucccccccccccaccaccacgucuccgccaugggcgccggcucccucccccgccucaccuccgacgccaaguga

SEQ ID NO: 47024 - RNA, 819 nt, Artificial Sequence
  derived and/or modified sequence opt2 from OLIG3__Homo_sapiens__NP_786923
augaacuccgacuccuccuccgucuccucccgcgccuccucccccgacauggacgagauguaccuccgcgaccaccaccaccgccaccaccaccaccaggagucccgccucaacuccgucuccuccacccagggcgacaugaugcagaagaugcccggcgagucccucucccgcgccggcgccaaggccgccggcgaguccuccaaguacaagaucaagaagcagcucuccgagcaggaccuccagcagcuccgccucaagaucaacggccgcgagcgcaagcgcaugcacgaccucaaccucgccauggacggccuccgcgaggucaugcccuacgcccacggccccuccguccgcaagcucuccaagaucgccacccuccuccucgcccgcaacuacauccucaugcucaccuccucccucgaggagaugaagcgccucgucggcgagaucuacggcggccaccacuccgccuuccacugcggcaccgucggccacuccgccggccaccccgcccacgccgccaacuccguccaccccguccaccccauccucggcggcgcccucuccuccggcaacgccuccuccccccucuccgccgccucccuccccgccaucggcaccauccgccccccccacucccuccucaaggcccccuccaccccccccgcccuccagcucggcuccggcuuccagcacugggccggccuccccugccccugcaccaucugccagaugcccccccccccccaccucuccgcccucuccaccgccaacauggcccgccucuccgccgaguccaaggaccuccucaaguga

SEQ ID NO: 47025 - RNA, 546 nt, Artificial Sequence
  derived and/or modified sequence opt2 from OLR1__Homo_sapiens__NP_001166103
augaccuucgacgaccucaagauccagaccgucaaggaccagcccgacgagaaguccaacggcaagaaggccaagggccuccaguuccucuacucccccugguggugccucgccgccgccacccucggcguccucugccucggccucgucgucaccaucaugguccucggcaugcagcucucccaggucuccgaccuccucacccaggagcaggccaaccucacccaccagaagaagaagcucgagggccagaucuccgcccgccagcaggccgaggaggccucccaggaguccgagaacgagcucaaggagaugaucgagacccucgcccgcaagcucaacgagaaguccaaggagcagauggagcuccaccaccagaaccucaaccuccaggagacccucaagcgcgucgccaacugcuccggccuccaccccgccuccaacuuccucuuccaguucuccauccucgacggcgccgucuccgaggagccccagcuccccauggcccucggcggccgcuucuccuucgacgccccccucaucuga

SEQ ID NO: 47026 - RNA, 1266 nt, Artificial Sequence
  derived and/or modified sequence opt2 from OMD__Homo_sapiens__NP_005005
augggcuuccucucccccaucuacgucaucuucuucuucuucggcgucaagguccacugccaguacgagaccuaccagugggacgaggacuacgaccaggagcccgacgacgacuaccagaccggcuuccccuuccgccagaacgucgacuacggcguccccuuccaccaguacacccucggcugcgucuccgagugcuucugccccaccaacuuccccuccuccauguacugcgacaaccgcaagcucaagaccauccccaacauccccaugcacauccagcagcucuaccuccaguucaacgagaucgaggccgucaccgccaacuccuucaucaacgccacccaccucaaggagaucaaccucucccacaacaagaucaagucccagaagaucgacuacggcgucuucgccaagcuccccaaccuccuccagcuccaccucgagcacaacaaccucgaggaguuccccuucccccuccccaagucccucgagcgccuccuccucggcuacaacgagaucuccaagcuccagaccaacgccauggacggccucgucaaccucaccaugcucgaccucugcuacaacuaccuccacgacucccuccucaaggacaagaucuucgccaagauggagaagcucaugcagcucaaccucugcuccaaccgccucgaguccaugccccccggccuccccuccucccucauguaccucucccucgagaacaacuccaucuccuccauccccgagaaguacuucgacaagcuccccaagcuccacacccuccgcaugucccacaacaagcuccaggacauccccuacaacaucuucaaccuccccaacaucgucgagcucuccgucggccacaacaagcucaagcaggccuucuacaucccccgcaaccucgagcaccucuaccuccagaacaacgagaucgagaagaugaaccucaccgucaugugccccuccaucgacccccuccacuaccaccaccucaccuacauccgcgucgaccagaacaagcucaaggagcccaucuccuccuacaucuucuucugcuucccccacauccacaccaucuacuacggcgagcagcgcuccaccaacggccagaccauccagcucaagacccaggucuuccgccgcuuccccgacgacgacgacgaguccgaggaccacgacgaccccgacaacgcccacgagucccccgagcaggagggcgccgagggccacuucgaccuccacuacuacgagaaccaggaguga

SEQ ID NO: 47027 - RNA, 1323 nt, Artificial Sequence
  derived and/or modified sequence opt2 from OMG__Homo_sapiens__NP_002535
auggaguaccagauccucaagaugucccucugccucuucauccuccucuuccucacccccggcauccucugcaucugcccccuccagugcaucugcaccgagcgccaccgccacgucgacugcuccggccgcaaccucuccacccuccccuccggccuccaggagaacaucauccaccucaaccucuccuacaaccacuucaccgaccuccacaaccagcucacccaguacaccaaccuccgcacccucgacaucuccaacaaccgccucgagucccuccccgcccaccucccccgcucccucuggaacauguccgccgccaacaacaacaucaagcuccucgacaaguccgacaccgccuaccaguggaaccucaaguaccucgacgucuccaagaacaugcucgagaaggucguccucaucaagaacacccuccgcucccucgagguccucaaccucuccuccaacaagcucuggaccguccccaccaacaugcccuccaagcuccacaucgucgaccucuccaacaacucccucacccagauccuccccggcacccucaucaaccucaccaaccucacccaccucuaccuccacaacaacaaguucaccuucauccccgaccaguccuucgaccagcucuuccagcuccaggagaucacccucuacaacaaccgcugguccugcgaccacaagcagaacaucaccuaccuccucaaguggaugauggagaccaaggcccacgucaucggcacccccugcuccacccagaucuccucccucaaggagcacaacauguaccccacccccuccggcuucaccuccucccucuucaccgucuccggcaugcagaccgucgacaccaucaacucccucuccgucgucacccagcccaaggucaccaagauccccaagcaguaccgcaccaaggagaccaccuucggcgccacccucuccaaggacaccaccuucaccuccaccgacaaggccuucguccccuaccccgaggacaccuccaccgagaccaucaacucccacgaggccgccgccgccacccucaccauccaccuccaggacggcauggucaccaacaccucccucaccuccuccaccaaguccucccccacccccaugacccucuccaucaccuccggcaugcccaacaacuucuccgagaugccccagcaguccaccacccucaaccucuggcgcgaggagaccaccaccaacgucaagaccccccuccccuccgucgccaacgccuggaaggucaacgccuccuuccuccuccuccucaacgucgucgucaugcucgccgucuga

SEQ ID NO: 47028 - RNA, 492 nt, Artificial Sequence
  derived and/or modified sequence opt2 from OMP__Homo_sapiens__NP_006180
auggccgaggaccgcccccagcagccccagcucgacaugccccucguccucgaccagggccucacccgccagaugcgccuccgcgucgagucccucaagcagcgcggcgagaagcgccaggacggcgagaagcuccuccagcccgccgaguccgucuaccgccucaacuucacccagcagcagcgccuccaguucgagcgcuggaacgucguccucgacaagcccggcaaggucaccaucaccggcaccucccagaacuggacccccgaccucaccaaccucaugacccgccagcuccucgaccccaccgccaucuucuggcgcaaggaggacuccgacgccaucgacuggaacgaggccgacgcccucgaguucggcgagcgccucuccgaccucgccaagauccgcaaggucauguacuuccucgucaccuucggcgagggcgucgagcccgccaaccucaaggccuccgucgucuucaaccagcucuga

SEQ ID NO: 47029 - RNA, 1398 nt, Artificial Sequence
  derived and/or modified sequence opt2 from ONECUT1__Homo_sapiens__NP_004489
augaacgcccagcucaccauggaggccaucggcgagcuccacggcgucucccacgagcccguccccgcccccgccgaccuccucggcggcuccccccacgcccgcuccuccgucgcccaccgcggcucccaccucccccccgcccacccccgcuccaugggcauggccucccuccucgacggcggcuccggcggcggcgacuaccaccaccaccaccgcgcccccgagcacucccucgccggcccccuccaccccaccaugaccauggccugcgagaccccccccggcauguccaugcccaccaccuacaccacccucaccccccuccagccccucccccccaucuccaccgucuccgacaaguucccccaccaccaccaccaccaccaccaccaccaccacccccaccaccaccagcgccucgccggcaacgucuccggcuccuucacccucaugcgcgacgagcgcggccucgccuccaugaacaaccucuacacccccuaccacaaggacgucgccggcaugggccagucccucuccccccucuccuccuccggccucggcuccauccacaacucccagcagggccucccccacuacgcccaccccggcgccgccaugcccaccgacaagaugcucacccccaacggcuucgaggcccaccaccccgccaugcucggccgccacggcgagcagcaccucacccccaccuccgccggcaugguccccaucaacggccuccccccccaccacccccacgcccaccucaacgcccagggccacggccagcuccucggcaccgcccgcgagcccaaccccuccgucaccggcgcccaggucuccaacggcuccaacuccggccagauggaggagaucaacaccaaggaggucgcccagcgcaucaccaccgagcucaagcgcuacuccaucccccaggccaucuucgcccagcgcguccucugccgcucccagggcacccucuccgaccuccuccgcaaccccaagcccugguccaagcucaaguccggccgcgagaccuuccgccgcauguggaaguggcuccaggagcccgaguuccagcgcauguccgcccuccgccucgccgccugcaagcgcaaggagcaggagcacggcaaggaccgcggcaacacccccaagaagccccgccucgucuucaccgacguccagcgccgcacccuccacgccaucuucaaggagaacaagcgccccuccaaggagcuccagaucaccaucucccagcagcucggccucgagcucuccaccgucuccaacuucuucaugaacgcccgccgccgcucccucgacaaguggcaggacgagggcuccuccaacuccggcaacuccuccuccuccuccuccaccugcaccaaggccuga

SEQ ID NO: 47030 - RNA, 1515 nt, Artificial Sequence
  derived and/or modified sequence opt2 from ONECUT2__Homo_sapiens__NP_004843
augaaggccgccuacaccgccuaccgcugccucaccaaggaccucgagggcugcgccaugaaccccgagcucaccauggagucccucggcacccuccacggccccgccggcggcggcuccggcggcggcggcggcggcggcggcggcggcggcggcggcggccccggccacgagcaggagcuccucgccucccccuccccccaccacgccggccgcggcgccgccggcucccuccgcggccccccccccccccccaccgcccaccaggagcucggcaccgccgccgccgccgccgccgccgccucccgcuccgccauggucaccuccauggccuccauccucgacggcggcgacuaccgccccgagcucuccaucccccuccaccacgccauguccauguccugcgacuccuccccccccggcaugggcauguccaacaccuacaccacccucaccccccuccagccccucccccccaucuccaccgucuccgacaaguuccaccacccccacccccaccaccacccccaccaccaccaccaccaccaccaccagcgccucuccggcaacgucuccggcuccuucacccucaugcgcgacgagcgcggccuccccgccaugaacaaccucuacucccccuacaaggagaugcccggcaugucccagucccucuccccccucgccgccaccccccucggcaacggccucggcggccuccacaacgcccagcagucccuccccaacuacggcccccccggccacgacaagaugcucucccccaacuucgacgcccaccacaccgccaugcucacccgcggcgagcagcaccucucccgcggccucggcaccccccccgccgccaugaugucccaccucaacggccuccaccaccccggccacacccagucccacggccccguccucgcccccucccgcgagcgcccccccuccuccuccuccggcucccaggucgccaccuccggccagcucgaggagaucaacaccaaggaggucgcccagcgcaucaccgccgagcucaagcgcuacuccaucccccaggccaucuucgcccagcgcguccucugccgcucccagggcacccucuccgaccuccuccgcaaccccaagcccugguccaagcucaaguccggccgcgagaccuuccgccgcauguggaaguggcuccaggagcccgaguuccagcgcauguccgcccuccgccucgccgccugcaagcgcaaggagcaggagcccaacaaggaccgcaacaacucccagaagaagucccgccucgucuucaccgaccuccagcgccgcacccucuucgccaucuucaaggagaacaagcgccccuccaaggagaugcagaucaccaucucccagcagcucggccucgagcucaccaccgucuccaacuucuucaugaacgcccgccgccgcucccucgagaaguggcaggacgaccucuccaccggcggcuccuccuccaccuccuccaccugcaccaaggccuga

SEQ ID NO: 47031 - RNA, 2883 nt, Artificial Sequence
  derived and/or modified sequence opt2 from OPA1__Homo_sapiens__NP_056375
auguggcgccuccgccgcgccgccgucgccugcgaggucugccagucccucgucaagcacuccuccggcaucaagggcucccucccccuccagaagcuccaccucgucucccgcuccaucuaccacucccaccaccccacccucaagcuccagcgcccccagcuccgcaccuccuuccagcaguucuccucccucaccaaccucccccuccgcaagcucaaguucucccccaucaaguacggcuaccagccccgccgcaacuucuggcccgcccgccucgccacccgccuccucaagcuccgcuaccucauccucggcuccgccgucggcggcggcuacaccgccaagaagaccuucgaccaguggaaggacaugauccccgaccucuccgaguacaaguggaucguccccgacaucgucugggagaucgacgaguacaucgacuucgagaagauccgcaaggcccuccccuccuccgaggaccucgucaagcucgcccccgacuucgacaagaucgucgagucccucucccuccucaaggacuucuucaccuccggcucccccgaggagaccgccuuccgcgccaccgaccgcggcuccgaguccgacaagcacuuccgcaaggucuccgacaaggagaagaucgaccagcuccaggaggagcuccuccacacccagcucaaguaccagcgcauccucgagcgccucgagaaggagaacaaggagcuccgcaagcucguccuccagaaggacgacaagggcauccaccaccgcaagcucaagaagucccucaucgacauguacuccgagguccucgacguccucuccgacuacgacgccuccuacaacacccaggaccaccucccccgcgucgucgucgucggcgaccaguccgccggcaagaccuccguccucgagaugaucgcccaggcccgcaucuucccccgcggcuccggcgagaugaugacccgcucccccgucaaggucacccucuccgagggcccccaccacgucgcccucuucaaggacuccucccgcgaguucgaccucaccaaggaggaggaccucgccgcccuccgccacgagaucgagcuccgcaugcgcaagaacgucaaggagggcugcaccgucucccccgagaccaucucccucaacgucaagggccccggccuccagcgcaugguccucgucgaccuccccggcgucaucaacaccgucaccuccggcauggcccccgacaccaaggagaccaucuucuccaucuccaaggccuacaugcagaaccccaacgccaucauccucugcauccaggacggcuccgucgacgccgagcgcuccaucgucaccgaccucgucucccagauggacccccacggccgccgcaccaucuucguccucaccaaggucgaccucgccgagaagaacgucgccucccccucccgcauccagcagaucaucgagggcaagcucuuccccaugaaggcccucggcuacuucgccgucgucaccggcaagggcaacuccuccgaguccaucgaggccauccgcgaguacgaggaggaguucuuccagaacuccaagcuccucaagaccuccaugcucaaggcccaccaggucaccacccgcaaccucucccucgccgucuccgacugcuucuggaagaugguccgcgaguccgucgagcagcaggccgacuccuucaaggccacccgcuucaaccucgagaccgaguggaagaacaacuacccccgccuccgcgagcucgaccgcaacgagcucuucgagaaggccaagaacgagauccucgacgaggucaucucccucucccaggucacccccaagcacugggaggagauccuccagcagucccucugggagcgcgucuccacccacgucaucgagaacaucuaccuccccgccgcccagaccaugaacuccggcaccuucaacaccaccgucgacaucaagcucaagcaguggaccgacaagcagcuccccaacaaggccgucgaggucgccugggagacccuccaggaggaguucucccgcuucaugaccgagcccaagggcaaggagcacgacgacaucuucgacaagcucaaggaggccgucaaggaggaguccaucaagcgccacaaguggaacgacuucgccgaggacucccuccgcgucauccagcacaacgcccucgaggaccgcuccaucuccgacaagcagcagugggacgccgccaucuacuucauggaggaggcccuccaggcccgccucaaggacaccgagaacgccaucgagaacauggucggccccgacuggaagaagcgcuggcucuacuggaagaaccgcacccaggagcagugcguccacaacgagaccaagaacgagcucgagaagaugcucaagugcaacgaggagcaccccgccuaccucgccuccgacgagaucaccaccguccgcaagaaccucgagucccgcggcgucgaggucgaccccucccucaucaaggacaccuggcaccaggucuaccgccgccacuuccucaagaccgcccucaaccacugcaaccucugccgccgcggcuucuacuacuaccagcgccacuucgucgacuccgagcucgagugcaacgacgucguccucuucuggcgcauccagcgcaugcucgccaucaccgccaacacccuccgccagcagcucaccaacaccgagguccgccgccucgagaagaacgucaaggagguccucgaggacuucgccgaggacggcgagaagaagaucaagcuccucaccggcaagcgcguccagcucgccgaggaccucaagaagguccgcgagauccaggagaagcucgacgccuucaucgaggcccuccaccaggagaaguga

SEQ ID NO: 47032 - RNA, 543 nt, Artificial Sequence
  derived and/or modified sequence opt2 from OPA3__Homo_sapiens__NP_001017989
auggucgucggcgccuuccccauggccaagcuccucuaccucggcauccgccaggucuccaagccccucgccaaccgcaucaaggaggccgcccgccgcuccgaguucuucaagaccuacaucugccucccccccgcccagcucuaccacuggcucgagaugcgcaccaagaugcgcaucaugggcuucaacgccgccgccaucaagccccucaacgagggcgccgccgccgagcucggcgccgagcuccucggcgagggcaucaucuucaucaccgccugcuccugccucaugcucgaguacuggcgccaccagcuccagcagcgccgcaaggagaaggagcgccgcgucgcccgcgaggcccuccgcggcgaggucggccaccucggccucgcccucgaggagcuccaggcccagguccaggccaccuccacccagcucgcccucgaggagcuccgcgcccagcuccaggagguccgcgcccaccucugccuccgcgaccccccccccgccccccccgucgcccccgccuccgagaaguga

SEQ ID NO: 47033 - RNA, 1017 nt, Artificial Sequence
  derived and/or modified sequence opt2 from OPCML__Homo_sapiens__NP_001012393
auguaccaccccgccuacugggucgucuucuccgccaccaccgcccuccucuucauccccggcguccccguccgcuccggcgacgccaccuuccccaaggccauggacaacgucaccguccgccagggcgaguccgccacccuccgcugcaccaucgacgaccgcgucacccgcgucgccuggcucaaccgcuccaccauccucuacgccggcaacgacaagugguccaucgacccccgcgucaucauccucgucaacacccccacccaguacuccaucaugauccagaacgucgacgucuacgacgagggccccuacaccugcuccguccagaccgacaaccaccccaagaccucccgcguccaccucaucguccagguccccccccagaucaugaacaucuccuccgacaucaccgucaacgagggcuccuccgucacccuccucugccucgccaucggccgccccgagcccaccgucaccuggcgccaccucuccgucaaggagggccagggcuucgucuccgaggacgaguaccucgagaucuccgacaucaagcgcgaccaguccggcgaguacgagugcuccgcccucaacgacgucgccgcccccgacguccgcaaggucaagaucaccgucaacuacccccccuacaucuccaaggccaagaacaccggcgucuccgucggccagaagggcauccucuccugcgaggccuccgccguccccauggccgaguuccagugguucaaggaggagacccgccucgccaccggccucgacggcaugcgcaucgagaacaagggccgcauguccacccucaccuucuucaacgucuccgagaaggacuacggcaacuacaccugcgucgccaccaacaagcucggcaacaccaacgccuccaucacccucuacggccccggcgccgucaucgacggcgucaacuccgccucccgcgcccucgccugccucuggcucuccggcacccuccucgcccacuucuucaucaaguucuga

SEQ ID NO: 47034 - RNA, 2085 nt, Artificial Sequence
  derived and/or modified sequence opt2 from OPHN1__Homo_sapiens__XP_005262327
augggccaccccccccucgaguucuccgacugcuaccucgacucccccgacuuccgcgagcgccucaagugcuacgagcaggagcucgagcgcaccaacaaguucaucaaggacgucaucaaggacggcaacgcccucaucuccgccaugcgcaacuacuccuccgccguccagaaguucucccagacccuccaguccuuccaguucgacuucaucggcgacacccucaccgacgacgagaucaacaucgccgaguccuucaaggaguucgccgagcuccucaacgaggucgagaacgagcgcaugaugaugguccacaacgccuccgaccuccucaucaagccccucgagaacuuccgcaaggagcagaucggcuucaccaaggagcgcaagaagaaguucgagaaggacggcgagcgcuucuacucccuccucgaccgccaccuccaccucuccuccaagaagaaggagucccagcuccaggaggccgaccuccaggucgacaaggagcgccacaacuucuucgaguccucccucgacuacgucuaccagauccaggagguccaggaguccaagaaguucaacaucgucgagcccguccucgccuuccuccacucccucuucaucuccaacucccucaccgucgagcucacccaggacuuccuccccuacaagcagcagcuccagcucucccuccagaacacccgcaaccacuucuccuccacccgcgaggagauggaggagcucaagaagcgcaugaaggaggccccccagaccugcaagcuccccggccagcccaccaucgagggcuaccucuacacccaggagaagugggcccucggcaucuccugggucaaguacuacugccaguacgagaaggagaccaagacccucaccaugacccccauggagcagaagcccggcgccaagcagggcccccucgaccucacccucaaguacugcguccgccgcaagaccgaguccaucgacaagcgcuucugcuucgacaucgagaccaacgagcgccccggcaccaucacccuccaggcccucuccgaggccaaccgccgccucuggauggaggccauggacggcaaggagcccaucuaccacucccccaucaccaagcagcaggagauggagcucaacgaggucggcuucaaguucguccgcaagugcaucaacaucaucgagaccaagggcaucaagaccgagggccucuaccgcaccgucggcuccaacauccagguccagaagcuccucaacgccuucuucgaccccaagugccccggcgacgucgacuuccacaacuccgacugggacaucaagaccaucaccuccucccucaaguucuaccuccgcaaccucuccgagcccgucaugaccuaccgccuccacaaggagcucgucuccgccgccaaguccgacaaccucgacuaccgccucggcgccauccacucccucgucuacaagcuccccgagaagaaccgcgagaugcucgagcuccucauccgccaccucgucaacgucugcgagcacuccaaggagaaccucaugacccccuccaacaugggcgucaucuucggccccacccucaugcgcgcccaggaggacaccgucgccgccaugaugaacaucaaguuccagaacaucgucgucgagauccucaucgagcacuucggcaagaucuaccucggcccccccgaggaguccgccgccccccccgucccccccccccgcgucaccgcccgccgccacaagcccaucaccaucuccaagcgccuccuccgcgagcgcaccgucuucuacaccuccucccucgacgaguccgagggcgacgccgacuccuucuccaagguccgcccccccggcgagaagcccaccaucauccgcccccccguccgcccccccgacccccccugccgcgccgccaccccccagaagcccgagcccaagcccgacaucgucgccggcaacgccggcgagaucaccuccuccgucgucgccucccgcacccgcuucuucgagaccgccucccgcaagaccggcuccucccagggccgccuccccggcgacgaguccuga

SEQ ID NO: 47035 - RNA, 1095 nt, Artificial Sequence
  derived and/or modified sequence opt2 from OPN1LW__Homo_sapiens__NP_064445
auggcccagcaguggucccuccagcgccucgccggccgccacccccaggacuccuacgaggacuccacccaguccuccaucuucaccuacaccaacuccaacuccacccgcggccccuucgagggccccaacuaccacaucgccccccgcugggucuaccaccucaccuccgucuggaugaucuucgucgucaccgccuccgucuucaccaacggccucguccucgccgccaccaugaaguucaagaagcuccgccacccccucaacuggauccucgucaaccucgccgucgccgaccucgccgagaccgucaucgccuccaccaucuccaucgucaaccaggucuccggcuacuucguccucggccaccccaugugcguccucgagggcuacaccgucucccucugcggcaucaccggccucuggucccucgccaucaucuccugggagcgcuggauggucgucugcaagcccuucggcaacguccgcuucgacgccaagcucgccaucgucggcaucgccuucuccuggaucugggccgccgucuggaccgccccccccaucuucggcuggucccgcuacuggccccacggccucaagaccuccugcggccccgacgucuucuccggcuccuccuaccccggcguccaguccuacaugaucguccucauggucaccugcugcaucaucccccucgccaucaucaugcucugcuaccuccaggucuggcucgccauccgcgccgucgccaagcagcagaaggaguccgaguccacccagaaggccgagaaggaggucacccgcauggucgucgucaugaucuucgccuacugcgucugcuggggccccuacaccuucuucgccugcuucgccgccgccaaccccggcuacgccuuccacccccucauggccgcccuccccgccuacuucgccaaguccgccaccaucuacaaccccgucaucuacgucuucaugaaccgccaguuccgcaacugcauccuccagcucuucggcaagaaggucgacgacggcuccgagcucuccuccgccuccaagaccgaggucuccuccgucuccuccgucucccccgccuga

SEQ ID NO: 47036 - RNA, 1095 nt, Artificial Sequence
  derived and/or modified sequence opt2 from OPN1MW2__Homo_sapiens__NP_001041646
auggcccagcaguggucccuccagcgccucgccggccgccacccccaggacuccuacgaggacuccacccaguccuccaucuucaccuacaccaacuccaacuccacccgcggccccuucgagggccccaacuaccacaucgccccccgcugggucuaccaccucaccuccgucuggaugaucuucgucgucaucgccuccgucuucaccaacggccucguccucgccgccaccaugaaguucaagaagcuccgccacccccucaacuggauccucgucaaccucgccgucgccgaccucgccgagaccgucaucgccuccaccaucuccgucgucaaccaggucuacggcuacuucguccucggccaccccaugugcguccucgagggcuacaccgucucccucugcggcaucaccggccucuggucccucgccaucaucuccugggagcgcuggauggucgucugcaagcccuucggcaacguccgcuucgacgccaagcucgccaucgucggcaucgccuucuccuggaucugggccgccgucuggaccgccccccccaucuucggcuggucccgcuacuggccccacggccucaagaccuccugcggccccgacgucuucuccggcuccuccuaccccggcguccaguccuacaugaucguccucauggucaccugcugcaucaccccccucuccaucaucguccucugcuaccuccaggucuggcucgccauccgcgccgucgccaagcagcagaaggaguccgaguccacccagaaggccgagaaggaggucacccgcauggucgucgucaugguccucgccuucugcuucugcuggggccccuacgccuucuucgccugcuucgccgccgccaaccccggcuaccccuuccacccccucauggccgcccuccccgccuucuucgccaaguccgccaccaucuacaaccccgucaucuacgucuucaugaaccgccaguuccgcaacugcauccuccagcucuucggcaagaaggucgacgacggcuccgagcucuccuccgccuccaagaccgaggucuccuccgucuccuccgucucccccgccuga

SEQ ID NO: 47037 - RNA, 1047 nt, Artificial Sequence
  derived and/or modified sequence opt2 from OPN1SW__Homo_sapiens__NP_001699
augcgcaagauguccgaggaggaguucuaccucuucaagaacaucuccuccgucggccccugggacggcccccaguaccacaucgcccccgucugggccuucuaccuccaggccgccuucaugggcaccgucuuccucaucggcuucccccucaacgccaugguccucgucgccacccuccgcuacaagaagcuccgccagccccucaacuacauccucgucaacgucuccuucggcggcuuccuccucugcaucuucuccgucuuccccgucuucgucgccuccugcaacggcuacuucgucuucggccgccacgucugcgcccucgagggcuuccucggcaccgucgccggccucgucaccggcuggucccucgccuuccucgccuucgagcgcuacaucgucaucugcaagcccuucggcaacuuccgcuucuccuccaagcacgcccucaccgucguccucgccaccuggaccaucggcaucggcgucuccaucccccccuucuucggcuggucccgcuucauccccgagggccuccagugcuccugcggccccgacugguacaccgucggcaccaaguaccgcuccgaguccuacaccugguuccucuucaucuucugcuucaucgucccccucucccucaucugcuucuccuacacccagcuccuccgcgcccucaaggccgucgccgcccagcagcaggaguccgccaccacccagaaggccgagcgcgaggucucccgcauggucgucgucauggucggcuccuucugcgucugcuacguccccuacgccgccuucgccauguacauggucaacaaccgcaaccacggccucgaccuccgccucgucaccauccccuccuucuucuccaaguccgccugcaucuacaaccccaucaucuacugcuucaugaacaagcaguuccaggccugcaucaugaagauggucugcggcaaggccaugaccgacgaguccgacaccugcuccucccagaagaccgaggucuccaccgucuccuccacccaggucggccccaacuga

SEQ ID NO: 47038 - RNA, 1209 nt, Artificial Sequence
  derived and/or modified sequence opt2 from OPN3__Homo_sapiens__NP_055137
auguacuccggcaaccgcuccggcggccacggcuacugggacggcggcggcgccgccggcgccgagggccccgcccccgccggcacccucucccccgccccccucuucucccccggcaccuacgagcgccucgcccuccuccucggcuccaucggccuccucggcgucggcaacaaccuccucguccucguccucuacuacaaguuccagcgccuccgcacccccacccaccuccuccucgucaacaucucccucuccgaccuccucgucucccucuucggcgucaccuucaccuucgucuccugccuccgcaacggcugggucugggacaccgucggcugcgucugggacggcuucuccggcucccucuucggcaucgucuccaucgccacccucaccguccucgccuacgagcgcuacauccgcgucguccacgcccgcgucaucaacuucuccugggccuggcgcgccaucaccuacaucuggcucuacucccucgccugggccggcgccccccuccucggcuggaaccgcuacauccucgacguccacggccucggcugcaccgucgacuggaaguccaaggacgccaacgacuccuccuucguccucuuccucuuccucggcugccucgucgucccccucggcgucaucgcccacugcuacggccacauccucuacuccauccgcaugcuccgcugcgucgaggaccuccagaccauccaggucaucaagauccucaaguacgagaagaagcucgccaagaugugcuuccucaugaucuucaccuuccucgucugcuggaugcccuacaucgucaucugcuuccucgucgucaacggccacggccaccucgucacccccaccaucuccaucgucuccuaccucuucgccaaguccaacaccgucuacaaccccgucaucuacgucuucaugauccgcaaguuccgccgcucccuccuccagcuccucugccuccgccuccuccgcugccagcgccccgccaaggaccuccccgccgccggcuccgagaugcagauccgccccaucgucaugucccagaaggacggcgaccgccccaagaagaaggucaccuucaacuccuccuccaucaucuucaucaucaccuccgacgagucccucuccgucgacgacuccgacaagaccaacggcuccaaggucgacgucauccagguccgcccccucuga

SEQ ID NO: 47039 - RNA, 1470 nt, Artificial Sequence
  derived and/or modified sequence opt2 from OPN4__Homo_sapiens__NP_001025186
augaacccccccuccggcccccgcgucccccccucccccacccaggagcccuccugcauggccacccccgccccccccuccuggugggacuccucccaguccuccaucuccucccucggccgccuccccuccaucucccccaccgcccccggcaccugggccgccgccugggucccccuccccaccgucgacguccccgaccacgcccacuacacccucggcaccgucauccuccucgucggccucaccggcaugcucggcaaccucaccgucaucuacaccuucugccgcgccguccuccgcggcgucaccgucaugaugcagucccgcucccuccgcacccccgccaacauguucaucaucaaccucgccgucuccgacuuccucauguccuucacccaggcccccgucuucuucaccuccucccucuacaagcaguggcucuucggcgagaccggcugcgaguucuacgccuucugcggcgcccucuucggcaucuccuccaugaucacccucaccgccaucgcccucgaccgcuaccucgucaucacccgcccccucgccaccuucggcgucgccuccaagcgccgcgccgccuucguccuccucggcgucuggcucuacgcccucgccuggucccucccccccuucuucggcugguccgccuacguccccgagggccuccucaccuccugcuccugggacuacauguccuucacccccgccguccgcgccuacaccaugcuccucugcugcuucgucuucuuccucccccuccucaucaucaucuacugcuacaucuucaucuuccgcgccauccgcgagaccggccgcgcccuccagaccuucggcgccugcaagggcaacggcgagucccucuggcagcgccagcgccuccaguccgagugcaagauggccaagaucaugcuccucgucauccuccucuucguccucuccugggcccccuacuccgccgucgcccucgucgccuucgccggcuacgcccacguccucacccccuacauguccuccguccccgccgucaucgccaaggccuccgccauccacaaccccaucaucuacgccaucacccaccccaaguaccgcgucgccaucgcccagcaccuccccugccucggcguccuccucggcgucucccgccgccacucccgccccuaccccuccuaccgcuccacccaccgcuccacccucaccucccacaccuccaaccucuccuggaucuccauccgccgccgccaggagucccucggcuccgaguccgaggucggcuggacccacauggaggccgccgccgucuggggcgccgcccagcaggccaacggccgcucccucuacggccagggccucgaggaccucgaggccaaggcccccccccgcccccagggccacgaggccgagacccccggcaagaccaagggccucauccccucccaggacccccgcauguga

SEQ ID NO: 47040 - RNA, 1065 nt, Artificial Sequence
  derived and/or modified sequence opt2 from OPN5__Homo_sapiens__NP_859528
auggcccucaaccacaccgcccucccccaggacgagcgccucccccacuaccuccgcgacggcgaccccuucgccuccaagcucuccugggaggccgaccucgucgccggcuucuaccucaccaucaucggcauccucuccaccuucggcaacggcuacguccucuacauguccucccgccgcaagaagaagcuccgccccgccgagaucaugaccaucaaccucgccgucugcgaccucggcaucuccgucgucggcaagcccuucaccaucaucuccugcuucugccaccgcugggucuucggcuggaucggcugccgcugguacggcugggccggcuucuucuucggcugcggcucccucaucaccaugaccgccgucucccucgaccgcuaccucaagaucugcuaccucuccuacggcgucuggcucaagcgcaagcacgccuacaucugccucgccgccaucugggccuacgccuccuucuggaccaccaugccccucgucggccucggcgacuacguccccgagcccuucggcaccuccugcacccucgacugguggcucgcccaggccuccgucggcggccaggucuucauccucaacauccucuucuucugccuccuccuccccaccgccgucaucgucuucuccuacgucaagaucaucgccaaggucaaguccuccuccaaggaggucgcccacuucgacucccgcauccacuccucccacguccucgagaugaagcucaccaaggucgccaugcucaucugcgccggcuuccucaucgccuggauccccuacgccgucgucuccgucugguccgccuucggccgccccgacuccauccccauccagcucuccgucguccccacccuccucgccaaguccgccgccauguacaaccccaucaucuaccaggucaucgacuacaaguucgccugcugccagaccggcggccucaaggccaccaagaagaagucccucgagggcuuccgccuccacaccgucaccaccguccgcaaguccuccgccguccucgagauccacgaggagugggaguga

SEQ ID NO: 47041 - RNA, 1143 nt, Artificial Sequence
  derived and/or modified sequence opt2 from OPRK1__Homo_sapiens__NP_000903
auggacucccccauccagaucuuccgcggcgagcccggccccaccugcgcccccuccgccugccucccccccaacuccuccgccugguuccccggcugggccgagcccgacuccaacggcuccgccggcuccgaggacgcccagcucgagcccgcccacaucucccccgccauccccgucaucaucaccgccgucuacuccgucgucuucgucgucggccucgucggcaacucccucgucauguucgucaucauccgcuacaccaagaugaagaccgccaccaacaucuacaucuucaaccucgcccucgccgacgcccucgucaccaccaccaugcccuuccaguccaccgucuaccucaugaacuccuggcccuucggcgacguccucugcaagaucgucaucuccaucgacuacuacaacauguucaccuccaucuucacccucaccaugauguccgucgaccgcuacaucgccgucugccaccccgucaaggcccucgacuuccgcaccccccucaaggccaagaucaucaacaucugcaucuggcuccucuccuccuccgucggcaucuccgccaucguccucggcggcaccaagguccgcgaggacgucgacgucaucgagugcucccuccaguuccccgacgacgacuacuccuggugggaccucuucaugaagaucugcgucuucaucuucgccuucgucauccccguccucaucaucaucgucugcuacacccucaugauccuccgccucaaguccguccgccuccucuccggcucccgcgagaaggaccgcaaccuccgccgcaucacccgccucguccucgucgucgucgccgucuucgucgucugcuggacccccauccacaucuucauccucgucgaggcccucggcuccaccucccacuccaccgccgcccucuccuccuacuacuucugcaucgcccucggcuacaccaacuccucccucaaccccauccucuacgccuuccucgacgagaacuucaagcgcugcuuccgcgacuucugcuucccccucaagaugcgcauggagcgccaguccaccucccgcguccgcaacaccguccaggaccccgccuaccuccgcgacaucgacggcaugaacaagcccgucuga

SEQ ID NO: 47042 - RNA, 1113 nt, Artificial Sequence
  derived and/or modified sequence opt2 from OPRL1__Homo_sapiens__NP_001186948
auggagccccucuuccccgcccccuucugggaggucaucuacggcucccaccuccagggcaaccucucccuccucucccccaaccacucccuccuccccccccaccuccuccucaacgccucccacggcgccuuccucccccucggccucaaggucaccaucgucggccucuaccucgccgucugcgucggcggccuccucggcaacugccucgucauguacgucauccuccgccacaccaagaugaagaccgccaccaacaucuacaucuucaaccucgcccucgccgacacccucguccuccucacccuccccuuccagggcaccgacauccuccucggcuucuggcccuucggcaacgcccucugcaagaccgucaucgccaucgacuacuacaacauguucaccuccaccuucacccucaccgccauguccgucgaccgcuacgucgccaucugccaccccauccgcgcccucgacguccgcaccuccuccaaggcccaggccgucaacgucgccaucugggcccucgccuccgucgucggcguccccgucgccaucaugggcuccgcccaggucgaggacgaggagaucgagugccucgucgagauccccaccccccaggacuacuggggccccgucuucgccaucugcaucuuccucuucuccuucaucguccccguccucgucaucuccgucugcuacucccucaugauccgccgccuccgcggcguccgccuccucuccggcucccgcgagaaggaccgcaaccuccgccgcaucacccgccucguccucgucgucgucgccgucuucgucggcugcuggacccccguccaggucuucguccucgcccagggccucggcguccagcccuccuccgagaccgccgucgccauccuccgcuucugcaccgcccucggcuacgucaacuccugccucaaccccauccucuacgccuuccucgacgagaacuucaaggccugcuuccgcaaguucugcugcgccuccgcccuccgccgcgacguccaggucuccgaccgcguccgcuccaucgccaaggacgucgcccucgccugcaagaccuccgagaccgucccccgccccgccuga

SEQ ID NO: 47043 - RNA, 1203 nt, Artificial Sequence
  derived and/or modified sequence opt2 from OPRM1__Homo_sapiens__NP_000905
auggacuccuccgccgcccccaccaacgccuccaacugcaccgacgcccucgccuacuccuccugcucccccgcccccucccccggcuccugggucaaccucucccaccucgacggcaaccucuccgaccccugcggccccaaccgcaccgaccucggcggccgcgacucccucugcccccccaccggcucccccuccaugaucaccgccaucaccaucauggcccucuacuccaucgucugcgucgucggccucuucggcaacuuccucgucauguacgucaucguccgcuacaccaagaugaagaccgccaccaacaucuacaucuucaaccucgcccucgccgacgcccucgccaccuccacccuccccuuccaguccgucaacuaccucaugggcaccuggcccuucggcaccauccucugcaagaucgucaucuccaucgacuacuacaacauguucaccuccaucuucacccucugcaccauguccgucgaccgcuacaucgccgucugccaccccgucaaggcccucgacuuccgcaccccccgcaacgccaagaucaucaacgucugcaacuggauccucuccuccgccaucggccuccccgucauguucauggccaccaccaaguaccgccagggcuccaucgacugcacccucaccuucucccaccccaccugguacugggagaaccuccucaagaucugcgucuucaucuucgccuucaucaugcccguccucaucaucaccgucugcuacggccucaugauccuccgccucaaguccguccgcaugcucuccggcuccaaggagaaggaccgcaaccuccgccgcaucacccgcaugguccucgucgucgucgccgucuucaucgucugcuggacccccauccacaucuacgucaucaucaaggcccucgucaccauccccgagaccaccuuccagaccgucuccuggcacuucugcaucgcccucggcuacaccaacuccugccucaaccccguccucuacgccuuccucgacgagaacuucaagcgcugcuuccgcgaguucugcauccccaccuccuccaacaucgagcagcagaacuccacccgcauccgccagaacacccgcgaccaccccuccaccgccaacaccgucgaccgcaccaaccaccagcucgagaaccucgaggccgagaccgccccccuccccuga

SEQ ID NO: 47044 - RNA, 999 nt, Artificial Sequence
  derived and/or modified sequence opt2 from OPTC__Homo_sapiens__XP_011507708
augcgccuccucgccuuccucucccuccucgcccucguccuccaggagaccggcaccgccucccucccccgcaaggagcgcaagcgccgcgaggagcagaugccccgcgagggcgacuccuucgagguccucccccuccgcaacgacguccucaaccccgacaacuacggcgaggucaucgaccucuccaacuacgaggagcucaccgacuacggcgaccagcuccccgaggucaaggucaccucccucgcccccgccaccuccaucucccccgccaaguccaccaccgcccccggcacccccuccuccaaccccaccaugacccgccccaccaccgccggccuccuccucuccucccagcccaaccacggccuccccaccugccucgucugcgucugccucggcuccuccgucuacugcgacgacaucgaccucgaggacauccccccccucccccgccgcaccgccuaccucuacgcccgcuucaaccgcaucucccgcauccgcgccgaggacuucaagggccucaccaagcucaagcgcaucgaccucuccaacaaccucaucuccuccaucgacaacgacgccuuccgccuccuccacgcccuccaggaccucauccuccccgagaaccagcucgaggcccuccccguccuccccuccggcaucgaguuccucgacguccgccucaaccgccuccaguccuccggcauccagcccgccgccuuccgcgccauggagaagcuccaguuccucuaccucuccgacaaccuccucgacuccauccccggcccccucccccucucccuccgcuccguccaccuccagaacaaccucaucgagaccaugcagcgcgacgucuucugcgaccccgaggagcacaagcacacccgccgccagcucgaggacauccgccucgacggcaaccccaucaaccucucccucuuccccuccgccuacuucugccucccccgccuccccaucggccgcuucaccuga

SEQ ID NO: 47045 - RNA, 1734 nt, Artificial Sequence
  derived and/or modified sequence opt2 from OPTN__Homo_sapiens__NP_001008214
augucccaccagccccucuccugccucaccgagaaggaggacucccccuccgaguccaccggcaacggccccccccaccucgcccaccccaaccucgacaccuucacccccgaggagcuccuccagcagaugaaggagcuccucaccgagaaccaccagcucaaggaggccaugaagcucaacaaccaggccaugaagggccgcuucgaggagcucuccgccuggaccgagaagcagaaggaggagcgccaguucuucgagauccaguccaaggaggccaaggagcgccucauggcccucucccacgagaacgagaagcucaaggaggagcucggcaagcucaagggcaaguccgagcgcuccuccgaggaccccaccgacgacucccgccucccccgcgccgaggccgagcaggagaaggaccagcuccgcacccaggucguccgccuccaggccgagaaggccgaccuccucggcaucgucuccgagcuccagcucaagcucaacuccuccggcuccuccgaggacuccuucgucgagauccgcauggccgagggcgaggccgagggcuccgucaaggagaucaagcacucccccggccccacccgcaccgucuccaccggcaccgcccucuccaaguaccgcucccgcuccgccgacggcgccaagaacuacuucgagcacgaggagcucaccgucucccagcuccuccucugccuccgcgagggcaaccagaaggucgagcgccucgaggucgcccucaaggaggccaaggagcgcgucuccgacuucgagaagaagaccuccaaccgcuccgagaucgagacccagaccgagggcuccaccgagaaggagaacgacgaggagaagggccccgagaccgucggcuccgaggucgaggcccucaaccuccaggucaccucccucuucaaggagcuccaggaggcccacaccaagcucuccgaggccgagcucaugaagaagcgccuccaggagaagugccaggcccucgagcgcaagaacuccgccauccccuccgagcucaacgagaagcaggagcucgucuacaccaacaagaagcucgagcuccaggucgaguccaugcucuccgagaucaagauggagcaggccaagaccgaggacgagaaguccaagcucaccguccuccagaugacccacaacaagcuccuccaggagcacaacaacgcccucaagaccaucgaggagcucacccgcaaggaguccgagaaggucgaccgcgccguccucaaggagcucuccgagaagcucgagcucgccgagaaggcccucgccuccaagcagcuccagauggacgagaugaagcagaccaucgccaagcaggaggaggaccucgagaccaugaccauccuccgcgcccagauggaggucuacugcuccgacuuccacgccgagcgcgccgcccgcgagaagauccacgaggagaaggagcagcucgcccuccagcucgccguccuccucaaggagaacgacgccuucgaggacggcggccgccagucccucauggagaugcagucccgccacggcgcccgcaccuccgacuccgaccagcaggccuaccucguccagcgcggcgccgaggaccgcgacuggcgccagcagcgcaacauccccauccacuccugccccaagugcggcgagguccuccccgacaucgacacccuccagauccacgucauggacugcaucaucuga

SEQ ID NO: 47046 - RNA, 912 nt, Artificial Sequence
  derived and/or modified sequence opt2 from OR10A2__Homo_sapiens__NP_001004460
auguccuucuccucccuccccaccgagauccagucccuccucuuccucaccuuccucaccaucuaccucgucacccucaugggcaacugccucaucauccucgucacccucgccgaccccaugcuccacucccccauguacuucuuccuccgcaaccucuccuuccucgagaucggcuucaaccucgucaucguccccaagaugcucggcacccuccucgcccaggacaccaccaucuccuuccucggcugcgccacccagauguacuucuucuucuucuucggcgucgccgagugcuuccuccucgccaccauggccuacgaccgcuacgucgccaucugcuccccccuccacuaccccgucaucaugaaccagcgcacccgcgccaagcucgccgccgccuccugguuccccggcuuccccgucgccaccguccagaccaccuggcucuucuccuuccccuucugcggcaccaacaaggucaaccacuucuucugcgacuccccccccguccuccgccucgucugcgccgacaccgcccucuucgagaucuacgccaucgucggcaccauccucgucgucaugauccccugccuccucauccucugcuccuacacccacaucgccgccgccauccucaagauccccuccgccaagggcaagaacaaggccuucuccaccugcuccucccaccuccucgucgucucccucuucuacaucucccucucccucaccuacuuccgccccaaguccaacaacucccccgagggcaagaagcuccucucccucuccuacaccgucaugacccccaugcucaaccccaucaucuacucccuccgcaacaacgaggucaagaacgcccucucccgcaccgucuccaaggcccucgcccuccgcaacugcauccccuga

SEQ ID NO: 47047 - RNA, 948 nt, Artificial Sequence
  derived and/or modified sequence opt2 from OR10A4__Homo_sapiens__NP_997069
augaugugggagaacuggaccaucgucuccgaguucguccucgucuccuucuccgcccucuccaccgagcuccaggcccuccucuuccuccucuuccucaccaucuaccucgucacccucaugggcaacguccucaucauccucgucaccaucgccgacuccgcccuccagucccccauguacuucuuccuccgcaaccucuccuuccucgagaucggcuucaaccucgucaucguccccaagaugcucggcacccucaucauccaggacaccaccaucuccuuccucggcugcgccacccagauguacuucuucuucuucuucggcgccgccgagugcugccuccucgccaccauggccuacgaccgcuacgucgccaucugcgacccccuccacuaccccgucaucaugggccacaucuccugcgcccagcucgccgccgccuccugguucuccggcuucuccgucgccaccguccagaccaccuggaucuucuccuuccccuucugcggccccaaccgcgucaaccacuucuucugcgacuccccccccgucaucgcccucgucugcgccgacaccuccgucuucgagcucgaggcccucaccgccaccguccucuucauccucuuccccuuccuccucauccucggcuccuacguccgcauccucuccaccaucuuccgcaugcccuccgccgagggcaagcaccaggccuucuccaccugcuccgcccaccuccucgucgucucccucuucuacuccaccgccauccucaccuacuuccgcccccaguccuccgccuccuccgaguccaagaagcuccucucccucuccuccaccgucgucacccccaugcucaaccccaucaucuacuccucccgcaacaaggaggucaaggccgcccucaagcgccucauccaccgcacccucggcucccagaagcucuga

SEQ ID NO: 47048 - RNA, 939 nt, Artificial Sequence
  derived and/or modified sequence opt2 from OR10C1__Homo_sapiens__NP_039229
auguccgccaacaccuccauggucaccgaguuccuccuccucggcuucucccaccucgccgaccuccagggccuccucuucuccgucuuccucaccaucuaccuccucaccgucgccggcaacuuccucaucgucguccucgucuccaccgacgccgcccuccagucccccauguacuucuuccuccgcacccucuccgcccucgagaucggcuacaccuccgucaccgucccccuccuccuccaccaccuccucaccggccgccgccacaucucccgcuccggcugcgcccuccagauguucuucuuccucuucuucggcgccaccgagugcugccuccucgccgccauggccuacgaccgcuacgccgccaucugcgagccccuccgcuacccccuccuccucucccaccgcgucugccuccagcucgccggcuccgccugggccugcggcguccucgucggccucggccacacccccuucaucuucucccuccccuucugcggccccaacaccaucccccaguucuucugcgagauccagcccguccuccagcucgucugcggcgacaccucccucaacgagcuccagaucauccucgccaccgcccuccucauccucugccccuucggccucauccucggcuccuacggccgcauccucgucaccaucuuccgcauccccuccgucgccggccgccgcaaggccuucuccaccugcuccucccaccucaucauggucucccucuucuacggcaccgcccucuucaucuacauccgccccaaggccuccuacgaccccgccaccgacccccucgucucccucuucuacgccgucgucacccccauccucaaccccaucaucuacucccuccgcaacaccgaggucaaggccgcccucaagcgcaccauccagaagaccguccccauggagaucuga

SEQ ID NO: 47049 - RNA, 963 nt, Artificial Sequence
  derived and/or modified sequence opt2 from OR10J1__Homo_sapiens__NP_036483
augcuccucugcuuccgcuucggcaaccaguccaugaagcgcgagaacuucacccucaucaccgacuucgucuuccagggcuucuccuccuuccacgagcagcagaucacccucuucggcgucuuccucgcccucuacauccucacccucgccggcaacaucaucaucgucaccaucauccgcauggaccuccaccuccacacccccauguacuucuuccucuccaugcucuccaccuccgagaccgucuacacccucgucauccucccccgcaugcucuccucccucgucggcaugucccagcccaucucccucgccggcugcgccacccagauguucuucuucgucaccuucggcaucaccaacugcuuccuccucaccgccaugggcuacgaccgcuacgucgccaucugcaacccccuccgcuacauggucaucaugaacaagcgccuccgcauccagcucguccucggcgccugcuccaucggccucaucgucgccaucacccaggucaccuccgucuuccgccuccccuucugcgcccgcaaggucccccacuucuucugcgacauccgccccgucaugaagcucuccugcaucgacaccaccgucaacgagauccucacccucaucaucuccguccucguccucgucguccccaugggccucgucuucaucuccuacguccucaucaucuccaccauccucaagaucgccuccgucgagggccgcaagaaggccuucgccaccugcgccucccaccucaccgucgucaucguccacuacuccugcgccuccaucgccuaccucaagcccaaguccgagaacacccgcgagcacgaccagcucaucuccgucaccuacaccgucaucaccccccuccucaaccccgucgucuacacccuccgcaacaaggaggucaaggacgcccucugccgcgccgucggcggcaaguucuccuga

SEQ ID NO: 47050 - RNA, 990 nt, Artificial Sequence
  derived and/or modified sequence opt2 from OR10J3__Homo_sapiens__NP_001004467
augcccaagcucaacuccaccuucgucaccgaguuccucuucgagggcuucuccuccuuccgccgccagcacaagcucgucuucuucgucgucuuccucacccucuaccuccucacccucuccggcaacgucaucaucaugaccaucauccgccucgaccaccaccuccacacccccauguacuucuuccucugcaugcucuccaucuccgagaccugcuacaccgucgccaucaucccccacaugcucuccggccuccucaacccccaccagcccaucgccacccaguccugcgccacccagcucuucuucuaccucaccuucggcaucaacaacugcuuccuccucaccgucaugggcuacgaccgcuacgucgccaucugcaacccccuccgcuacuccgucaucaugggcaagcgcgccugcauccagcucgccuccggcucccucggcaucggccucggcauggccaucguccaggucaccuccgucuucggccuccccuucugcgacgccuucgucaucucccacuucuucugcgacguccgccaccuccucaagcucgccugcaccgacaccaccgucaacgagaucaucaacuucgucgucuccgucugcguccucguccuccccaugggccucgucuucaucuccuacguccucaucaucuccaccauccucaagaucgccuccgccgagggccagaagaaggccuucgccaccugcgccucccaccucaccgucgucaucauccacuacggcugcgccuccaucaucuaccucaagcccaagucccaguccucccucggccaggaccgccucaucuccgucaccuacacccaccacucccccaccgagcccugcugcguccagcccgaggagcagggcggccagcgcugcuccgcccagucccgcggcgccaagaacuccgucucccucaugaagcgcggcugcgagggcuucuccuucgccuucaucaacauguacuga

SEQ ID NO: 47051 - RNA, 930 nt, Artificial Sequence
  derived and/or modified sequence opt2 from OR10J5__Homo_sapiens__NP_001004469
augaagcgcaagaacuucaccgaggucuccgaguucaucuuccucggcuucuccuccuucggcaagcaccagaucacccucuucgucgucuuccucaccgucuacauccucacccucgucgccaacaucaucaucgucaccaucaucugcaucgaccaccaccuccacacccccauguacuucuuccucuccaugcucgccuccuccgagaccgucuacacccucgucaucgucccccgcaugcuccucucccucaucuuccacaaccagcccaucucccucgccggcugcgccacccagauguucuucuucgucauccucgccaccaacaacugcuuccuccucaccgccaugggcuacgaccgcuacgucgccaucugccgcccccuccgcuacaccgucaucauguccaagggccucugcgcccagcucgucugcggcuccuucggcaucggccucaccauggccguccuccacgucaccgccauguucaaccuccccuucugcggcaccgucgucgaccacuucuucugcgacaucuaccccgucaugaagcucuccugcaucgacaccaccaucaacgagaucaucaacuacggcgucuccuccuucgucaucuucguccccaucggccucaucuucaucuccuacguccucgucaucuccuccauccuccagaucgccuccgccgagggccgcaagaagaccuucgccaccugcgucucccaccucaccgucgucaucguccacugcggcugcgccuccaucgccuaccucaagcccaaguccgaguccuccaucgagaaggaccucguccucuccgucaccuacaccaucaucaccccccuccucaaccccgucgucuacucccuccgcaacaaggaggucaaggacgcccucugccgcgucgucggccgcaacaucuccuga

SEQ ID NO: 47052 - RNA, 942 nt, Artificial Sequence
  derived and/or modified sequence opt2 from OR10K1__Homo_sapiens__NP_001004473
auggagcaggucaacaagaccgucguccgcgaguucgucguccucggcuucuccucccucgcccgccuccagcagcuccucuucgucaucuuccuccuccucuaccucuucacccucggcaccaacgccaucaucaucuccaccaucguccucgaccgcgcccuccacacccccauguacuucuuccucgccauccucuccugcuccgagaucugcuacaccuucgucaucguccccaagaugcucgucgaccuccucucccagaagaagaccaucuccuuccucggcugcgccauccagauguucuccuuccucuucuucggcuccucccacuccuuccuccucgccgccaugggcuacgaccgcuacauggccaucugcaacccccuccgcuacuccguccucaugggccacggcgucugcaugggccucauggccgccgccugcgccugcggcuucaccgucucccucgucaccaccucccucgucuuccaccuccccuuccacuccuccaaccagcuccaccacuucuucugcgacaucucccccguccucaagcucgccucccagcacuccggcuucucccagcucgucaucuucaugcucggcgucuucgcccucgucaucccccuccuccucauccucgucuccuacauccgcaucaucuccgccauccucaagauccccuccuccgucggccgcuacaagaccuucuccaccugcgccucccaccucaucgucgucaccguccacuacuccugcgccuccuucaucuaccuccgccccaagaccaacuacaccuccucccaggacacccucaucuccgucuccuacaccauccucaccccccucuucaaccccaugaucuacucccuccgcaacaaggaguucaaguccgcccuccgccgcaccaucggccagaccuucuacccccucuccuga

SEQ ID NO: 47053 - RNA, 939 nt, Artificial Sequence
  derived and/or modified sequence opt2 from OR10K2__Homo_sapiens__NP_001004476
auggagcgcgucaacgagaccgucguccgcgaggucaucuuccucggcuucuccucccucgcccgccuccagcagcuccucuucgucaucuuccuccuccucuaccucuucacccucggcaccaacgccaucaucaucuccaccaucguccucgaccgcgcccuccacauccccauguacuucuuccucgccauccucuccugcuccgagaucugcuacaccuucaucaucguccccaagaugcucgucgaccuccucucccagaagaagaccaucuccuuccucggcugcgccauccagauguucuccuuccucuuccucggcugcucccacuccuuccuccucgccgucaugggcuacgaccgcuacaucgccaucugcaacccccuccgcuacuccguccucaugggccacggcgucugcaugggccucgucgccgccgccugcgccugcggcuucaccgucgcccagaucaucaccucccucgucuuccaccuccccuucuacuccuccaaccagcuccaccacuucuucugcgacaucgcccccguccucaagcucgccucccaccacaaccacuucucccagaucgucaucuucaugcucugcacccucguccucgccaucccccuccuccucauccucgucuccuacguccacauccucuccgccauccuccaguuccccuccacccucggccgcugcaaggccuucuccaccugcgucucccaccucaucaucgucaccguccacuacggcugcgccuccuucaucuaccuccgcccccaguccaacuacuccuccucccaggacgcccucaucuccgucuccuacaccaucaucaccccccucuucaaccccaugaucuacucccuccgcaacaaggaguucaaguccgcccucugcaagaucguccgccgcaccaucucccuccucuga

SEQ ID NO: 47054 - RNA, 1008 nt, Artificial Sequence
  derived and/or modified sequence opt2 from OR10R2__Homo_sapiens__NP_001004472
augccccagauccucaucuucaccuaccucaacauguucuacuucuuccccccccuccagauccucgccgagaaccucaccauggucaccgaguuccuccuccucggcuucuccucccucggcgagauccagcucgcccucuucgucgucuuccucuuccucuaccucgucauccucuccggcaacgucaccaucaucuccgucauccaccucgacaagucccuccacacccccauguacuucuuccucggcauccucuccaccuccgagaccuucuacaccuucgucauccuccccaagaugcucaucaaccuccucuccgucgcccgcaccaucuccuucaacugcugcgcccuccagauguucuucuuccucggcuucgccaucaccaacugccuccuccucggcgucaugggcuacgaccgcuacgccgccaucugccacccccuccacuaccccacccucauguccuggcaggucugcggcaagcucgccgccgccugcgccaucggcggcuuccucgccucccucaccgucgucaaccucgucuucucccuccccuucugcuccgccaacaaggucaaccacuacuucugcgacaucuccgccgucauccuccucgccugcaccaacaccgacgucaacgaguucgucaucuucaucugcggcguccucguccucgucguccccuuccucuucaucugcgucuccuaccucugcauccuccgcaccauccucaagauccccuccgccgagggccgccgcaaggccuucuccaccugcgccucccaccucuccgucgucaucguccacuacggcugcgccuccuucaucuaccuccgccccaccgccaacuacgucuccaacaaggaccgccucgucaccgucaccuacaccaucgucaccccccuccucaaccccauggucuacucccuccgcaacaaggacguccagcucgccauccgcaagguccucggcaagaagggcucccucaagcucuacaacuga

SEQ ID NO: 47055 - RNA, 945 nt, Artificial Sequence
  derived and/or modified sequence opt2 from OR10T2__Homo_sapiens__NP_001004475
augcgcggcuucaacaagaccaccgucgucacccaguucauccucgucggcuucuccucccucggcgagcuccagcuccuccucuucgucaucuuccuccuccucuaccucaccauccucgucgccaacgucaccaucauggccgucauccgcuucuccuggacccuccacacccccauguacggcuuccucuucauccucuccuucuccgaguccugcuacaccuucgucaucaucccccagcuccucguccaccuccucuccgacaccaagaccaucuccuucauggccugcgccacccagcucuucuucuuccucggcuucgccugcaccaacugccuccucaucgccgucaugggcuacgaccgcuacgucgccaucugccacccccuccgcuacacccucaucaucaacaagcgccucggccucgagcucaucucccucuccggcgccaccggcuucuucaucgcccucgucgccaccaaccucaucugcgacaugcgcuucugcggccccaaccgcgucaaccacuacuucugcgacauggcccccgucaucaagcucgccugcaccgacacccacgucaaggagcucgcccucuucucccucuccauccucgucaucaugguccccuuccuccucauccucaucuccuacggcuucaucgucaacaccauccucaagauccccuccgccgagggcaagaaggccuucgucaccugcgccucccaccucaccgucgucuucguccacuacggcugcgccuccaucaucuaccuccgccccaaguccaaguccgccuccgacaaggaccagcucgucgccgucaccuacaccgucgucaccccccuccucaacccccucgucuacucccuccgcaacaaggaggucaagaccgcccucaagcgcguccucggcaugcccgucgccaccaagauguccuga

SEQ ID NO: 47056 - RNA, 981 nt, Artificial Sequence
  derived and/or modified sequence opt2 from OR10X1__Homo_sapiens__NP_001004477
augguccucaacgucuacugcugcuucuuccagaucuccgacauccagaccaugaagaucaaccagaccauccucaaggaguucauccucgucggcuucuccgucuacccccacguccagaccuuccucuucgucgucuucuucugccucuaccuccucacccucgccggcaaccucaucaucaugggccucaccugggucgaccgcucccuccacacccccauguaccucuuccucuccgcccucuccuucuccgagaccugcuacacccucaccaucguccccaagaugcucgaggaccuccucgccaaggaccgcuccaucuccgucaccggcugcucccuccagaugugcuucuuccucggccucggcggcaccaacugcaucauccucacccucaugggcuacgaccgcuuccucgccaucugcaacccccuccgcuacccccuccucaugaccaacaucgucugcggccagcucgucgccuccgccugcaccgccggcuucuucaucucccucaccgagaccgcccucaucuuccgcgacuccuucugccgccccaaccucgucaagcacuucuucugccacaugcucgccgucauccgccucuccugcaucgacuccaaccacaccgaguucaucaucacccucaucuccgucuccggccuccucggcacccuccuccucaucauccucaccgacgucuucaucaucuccaccguccuccgcauccccuccgccgagggcaagcagaaggccuucaccaccugcgccucccaccucaccgucgucaucauccacuucggcuucgccuccaucgucuaccucaagcccgaggccuccggcgacgacacccucaucgccguccccuacaccgucaucacccccuuccucucccccaucaucuucucccuccgcaacaaggacaugaagaacgccuuccgccgcaugaugggcaacaccgucgcccucaagaaguga

SEQ ID NO: 47057 - RNA, 942 nt, Artificial Sequence
  derived and/or modified sequence opt2 from OR10Z1__Homo_sapiens__NP_001004478
augggccagaccaacgucaccuccuggcgcgacuucgucuuccucggcuucuccuccuccggcgagcuccagcuccuccucuucgcccucuuccucucccucuaccucgucacccucaccuccaacgucuucaucaucaucgccauccgccucgacucccaccuccacacccccauguaccucuuccucuccuuccucuccuucuccgagaccugcuacacccucggcaucaucccccgcaugcucuccggccucgccggcggcgaccaggccaucuccuacgucggcugcgccgcccagauguucuucuccgccuccugggccugcaccaacugcuuccuccucgccgccaugggcuucgaccgcuacgucgccaucugcgccccccuccacuacgccucccacaugaaccccacccucugcgcccagcucgucaucaccuccuuccucaccggcuaccucuucggccucggcaugacccucgucaucuuccaccucuccuucugcuccucccacgagauccagcacuucuucugcgacaccccccccguccucucccucgccugcggcgacaccggccccuccgagcuccgcaucuucauccucucccuccucguccuccucgucuccuucuucuucaucaccaucuccuacgccuacauccucgccgccauccuccgcauccccuccgccgagggccagaagaaggccuucuccaccugcgccucccaccucaccgucgucaucauccacuacggcugcgccuccuucgucuaccuccgccccaaggccuccuacucccucgagcgcgaccagcucaucgccaugaccuacaccgucgucaccccccuccucaaccccaucgucuacucccuccgcaaccgcgccauccagaccgcccuccgcaacgccuuccgcggccgccuccucggcaagggcuga

SEQ ID NO: 47058 - RNA, 948 nt, Artificial Sequence
  derived and/or modified sequence opt2 from OR11A1__Homo_sapiens__NP_039225
auggagaucgucuccaccggcaacgagaccaucaccgaguucguccuccucggcuucuacgacauccccgagcuccacuuccucuucuucaucgucuucaccgccgucuacgucuucaucaucaucggcaacaugcucaucaucgucgccgucgucuccucccagcgccuccacaagcccauguacaucuuccucgccaaccucuccuuccucgacauccucuacaccuccgccgucaugcccaagaugcucgagggcuuccuccaggaggccaccaucuccgucgccggcugccuccuccaguucuucaucuucggcucccucgccaccgccgagugccuccuccucgccgucauggccuacgaccgcuaccucgccaucugcuacccccuccacuacccccuccucaugggcccccgccgcuacaugggccucgucgucaccaccuggcucuccggcuucgucgucgacggccucgucgucgcccucgucgcccagcuccgcuucugcggccccaaccacaucgaccaguucuacugcgacuucaugcucuucgucggccucgccugcuccgacccccgcgucgcccaggucaccacccucauccucuccgucuucugccucaccauccccuucggccucauccucaccuccuacgcccgcaucgucgucgccguccuccgcguccccgccggcgccucccgccgccgcgccuucuccaccugcuccucccaccucgccgucgucaccaccuucuacggcacccucaugaucuucuacgucgcccccuccgccguccacucccagcuccucuccaaggucuucucccuccucuacaccgucgucaccccccucuucaaccccgucaucuacaccaugcgcaacaaggagguccaccaggcccuccgcaagauccucugcaucaagcagaccgagacccucgacuga

SEQ ID NO: 47059 - RNA, 924 nt, Artificial Sequence
  derived and/or modified sequence opt2 from OR12D2__Homo_sapiens__NP_039224
augcucaacaccaccuccgucaccgaguuccuccuccucggcgucaccgacauccaggagcuccagcccuuccucuucgucgucuuccucaccaucuacuucaucuccgucaccggcaacggcgccguccucaugaucgucaucuccgacccccgccuccacucccucauguacuucuuccucggcaaccucuccuaccucgacaucugcuacuccaccgucacccuccccaagaugcuccagaacuuccucuccacccacaaggccaucuccuuccucggcugcaucucccagcuccacuucuuccacucccucggcuccaccgaguccaugcucuucgccgucauggccuucgaccucuccgucgccaucugcaagccccuccgcuacaccgucaucaugaacccccagcucugcacccagauggccaucaccaucugggucaucggcuucuuccacgcccuccuccacuccgucaugaccucccgccucaacuucugcggcuccaaccgcauccaccacuuccucugcgacaucaagccccuccucaagcucgccugcggcaacaccgagcucaaccaguggcuccucuccaccgucaccggcaccaucgccaugggccccuucuuccucacccuccucuccuacuucuacaucaucaccuaccucuucuucaagacccgcuccugcuccaugcucugcaaggcccucuccaccugcgccucccacuucauggucgucauccucuucuacgcccccguccucuucaccuacauccaccccgcccucgaguccuucauggaccaggaccgcaucgucgccaucauguacaccgucgucacccccguccucaacccccucaucuacacccuccgcaacaaggaggucaagggcgcccucggccgcgucauccgccgccucuga

SEQ ID NO: 47060 - RNA, 951 nt, Artificial Sequence
  derived and/or modified sequence opt2 from OR12D3__Homo_sapiens__NP_112221
auggagaacgucaccaccaugaacgaguuccuccuccucggccucaccggcguccaggagcuccagcccuucuucuucggcaucuuccucaucaucuaccucaucaaccucaucggcaacggcuccauccucgucauggucguccucgagccccagcuccacucccccauguacuucuuccucggcaaccucuccugccucgacaucuccuacuccuccgucacccuccccaagcuccucgucaaccucgucugcucccgccgcgccaucuccuuccucggcugcaucacccagcuccacuucuuccacuuccucggcuccaccgaggccauccuccucgccaucauggccuucgaccgcuucgucgccaucugcaacccccuccgcuacaccgucaucaugaacccccaggucugcauccuccucgccgccgccgccuggcucaucuccuucuucuacgcccucaugcacuccgucaugaccgcccaccucuccuucugcggcucccagaagcucaaccacuucuucuacgacgucaagccccuccucgagcucgccugcuccgacacccuccucaaccaguggcuccucuccaucgucaccggcuccaucuccaugggcgccuucuuccucacccuccucuccugcuucuacgucaucggcuuccuccucuucaagaaccgcuccugccgcauccuccacaaggcccucuccaccugcgccucccacuucauggucgucugccucuucuacggccccgucggcuucaccuacauccgccccgccuccgccaccuccaugauccaggaccgcaucauggccaucauguacuccgccgucacccccguccucaacccccucaucuacacccuccgcaacaaggaggucaugauggcccucaagaagaucuucggccgcaagcucuucaaggacuggcagcagcaccacuga

SEQ ID NO: 47061 - RNA, 1044 nt, Artificial Sequence
  derived and/or modified sequence opt2 from OR13C3__Homo_sapiens__NP_001001961
augaucguccagcucaucugcaccgucugcuuccucgccgucaacaccuuccacguccgcuccuccuucgacuuccucaaggccgacgacaugggcgagaucaaccagacccucgucuccgaguuccuccuccucggccucuccggcuaccccaagaucgagaucgucuacuucgcccucauccucgucauguaccucgucauccucaucggcaacggcguccucaucaucgccuccaucuucgacucccacuuccacacccccauguacuucuuccucggcaaccucuccuuccucgacaucugcuacaccuccuccuccguccccuccacccucgucucccucaucuccaagaagcgcaacaucuccuucuccggcugcgccguccagauguucuucggcuucgccaugggcuccaccgagugccuccuccucggcaugauggccuucgaccgcuacgucgccaucugcaacccccuccgcuaccccaucauccucuccaaggucgccuacguccucauggccuccgucuccuggcucuccggcggcaucaacuccgccguccagacccuccucgccaugcgccuccccuucugcggcaacaacaucaucaaccacuucgccugcgagauccucgccguccucaagcucgccugcgccgacaucucccucaacaucaucaccauggucaucuccaacauggccuuccucguccucccccucauggucaucuucuucuccuacauguucauccucuacaccauccuccagaugaacuccgccaccggccgccgcaaggccuucuccaccugcuccgcccaccucaccgucgucaucaucuucuacggcaccaucuucuucauguacgccaagcccaagucccaggaccucaucggcgaggagaagcuccaggcccucgacaagcucaucucccucuucuacggcgucgucacccccaugcucaaccccauccucuacucccuccgcaacaaggacgucaaggccgccgucaaguaccuccucaacaagaagcccauccacuga

SEQ ID NO: 47062 - RNA, 957 nt, Artificial Sequence
  derived and/or modified sequence opt2 from OR13C4__Homo_sapiens__NP_001001919
auggacaagaucaaccagaccuucguccgcgaguucauccuccucggccucuccggcuaccccaagcucgagaucaucuucuucgcccucauccucgucauguacgucgucauccucaucggcaacggcguccucaucaucgccuccauccucgacucccgccuccacaugcccauguacuucuuccucggcaaccucuccuuccucgacaucugcuacaccaccuccuccauccccuccacccucgucucccucaucuccaagaagcgcaacaucuccuucuccggcugcgccguccagauguucuucggcuucgccaugggcuccaccgagugcuuccuccucggcaugauggccuucgaccgcuacgucgccaucugcaacccccuccgcuaccccaucaucaugaacaaggucgucuacguccuccucaccuccgucuccuggcucuccggcggcaucaacuccaccguccagaccucccucgccaugcgcuggcccuucugcggcaacaacaucaucaaccacuuccucugcgagauccucgccguccucaagcucgccugcuccgacaucuccgucaacaucgucacccucgccgucuccaacaucgccuuccucguccucccccuccucgucaucuucuucuccuacauguucauccucuacaccauccuccgcaccaacuccgccaccggccgccacaaggccuucuccaccugcuccgcccaccucaccgucgucaucaucuucuacggcaccaucuucuucauguacgccaagcccaagucccaggaccuccucggcaaggacaaccuccaggccaccgagggccucgucuccauguucuacggcgucgucacccccaugcucaaccccaucaucuacucccuccgcaacaaggacgucaaggccgccaucaaguaccuccucucccgcaaggccaucaaccaguga

SEQ ID NO: 47063 - RNA, 960 nt, Artificial Sequence
  derived and/or modified sequence opt2 from OR13F1__Homo_sapiens__NP_001004485
auguuccccgccaacuggaccuccgucaaggucuucuucuuccucggcuucuuccacuaccccaagguccaggucaucaucuucgccgucugccuccucauguaccucaucacccuccucggcaacaucuuccucaucuccaucaccauccucgacucccaccuccacacccccauguaccucuuccucuccaaccucuccuuccucgacaucugguacuccuccuccgcccucucccccaugcucgccaacuucgucuccggccgcaacaccaucuccuucuccggcugcgccacccagauguaccucucccucgccaugggcuccaccgagugcguccuccuccccaugauggccuacgaccgcuacgucgccaucugcaacccccuccgcuaccccgucaucaugaaccgccgcaccugcguccagaucgccgccggcuccuggaugaccggcugccucaccgccauggucgagaugauguccguccucccccucucccucugcggcaacuccaucaucaaccacuucaccugcgagauccucgccauccucaagcucgucugcgucgacaccucccucguccagcucaucaugcucgucaucuccguccuccuccuccccaugcccaugcuccucaucugcaucuccuacgccuucauccucgccuccauccuccgcaucuccuccgucgagggccgcuccaaggccuucuccaccugcaccgcccaccucauggucgucguccucuucuacggcaccgcccucuccaugcaccucaagcccuccgccgucgacucccaggagaucgacaaguucauggcccucgucuacgccggccagacccccaugcucaaccccaucaucuacucccuccgcaacaaggaggucaaggucgcccucaagaagcuccucauccgcaaccacuucaacaccgccuucaucuccauccucaaguga

SEQ ID NO: 47064 - RNA, 924 nt, Artificial Sequence
  derived and/or modified sequence opt2 from OR13G1__Homo_sapiens__NP_001005487
augaaccacuccgucgucaccgaguucaucauccucggccucaccaagaagcccgagcuccagggcaucaucuuccucuucuuccucaucgucuaccucgucgccuuccucggcaacaugcucaucaucaucgccaagaucuacaacaacacccuccacacccccauguacgucuuccuccucacccucgccgucgucgacaucaucugcaccaccuccaucauccccaagaugcucggcaccaugcucaccuccgagaacaccaucuccuacgccggcugcaugucccagcucuuccucuucaccuggucccucggcgccgagaugguccucuucaccaccauggccuacgaccgcuacgucgccaucugcuucccccuccacuacuccaccaucaugaaccaccacaugugcgucgcccuccucuccauggucauggccaucgccgucaccaacuccuggguccacaccgcccucaucaugcgccucaccuucugcggccccaacaccaucgaccacuucuucugcgagauccccccccuccucgcccucuccugcucccccguccgcaucaacgaggucauggucuacgucgccgacaucacccucgccaucggcgacuucauccucaccugcaucuccuacggcuucaucaucgucgccauccuccgcauccgcaccgucgagggcaagcgcaaggccuucuccaccugcuccucccaccucaccgucgucacccucuacuacucccccgucaucuacaccuacauccgccccgccuccuccuacaccuucgagcgcgacaaggucgucgccgcccucuacacccucgucacccccacccucaaccccauggucuacuccuuccagaaccgcgagaugcaggccggcauccgcaaggucuucgccuuccucaagcacuga

SEQ ID NO: 47065 - RNA, 939 nt, Artificial Sequence
  derived and/or modified sequence opt2 from OR13J1__Homo_sapiens__NP_001004487
auggagccccucaaccgcaccgaggucuccgaguucuuccucaagggcuucuccggcuaccccgcccucgagcaccuccucuucccccucugcuccgccauguaccucgucacccuccucggcaacaccgccaucauggccgucuccguccucgacauccaccuccacacccccgucuacuucuuccucggcaaccucuccacccucgacaucugcuacacccccaccuucgucccccucaugcucguccaccuccucuccucccgcaagaccaucuccuucgccgucugcgccauccagaugugccucucccucuccaccggcuccaccgagugccuccuccucgccaucaccgccuacgaccgcuaccucgccaucugccagccccuccgcuaccacguccucaugucccaccgccucugcguccuccucaugggcgccgccuggguccucugccuccucaaguccgucaccgagauggucaucuccaugcgccuccccuucugcggccaccacgucgucucccacuucaccugcaagauccucgccguccucaagcucgccugcggcaacaccuccgucuccgaggacuuccuccucgccggcuccauccuccuccuccccgucccccucgccuucaucugccucuccuaccuccucauccucgccaccauccuccgcguccccuccgccgcccgcugcugcaaggccuucuccaccugccucgcccaccucgccgucguccuccucuucuacggcaccaucaucuucauguaccucaagcccaaguccaaggaggcccacaucuccgacgaggucuucaccguccucuacgccauggucaccaccaugcucaaccccaccaucuacucccuccgcaacaaggaggucaaggaggccgcccgcaaggucuggggccgcucccgcgccucccgcuga

SEQ ID NO: 47066 - RNA, 966 nt, Artificial Sequence
  derived and/or modified sequence opt2 from OR14J1__Homo_sapiens__NP_112208
auggucaaccucaccuccauguccggcuuccuccucaugggcuucuccgacgagcgcaagcuccagauccuccacgcccucgucuuccucgucaccuaccuccucgcccucaccggcaaccuccucaucaucaccaucaucaccgucgaccgccgccuccacucccccauguacuacuuccucaagcaccucucccuccucgaccucugcuucaucuccgucaccgucccccaguccaucgccaacucccucaugggcaacggcuacaucucccucguccagugcauccuccaggucuucuucuucaucgcccucgccuccuccgaggucgccauccucaccgucauguccuacgaccgcuacgccgccaucugccagccccuccacuacgagaccaucauggacccccgcgccugccgccacgccgucaucgccgucuggaucgccggcggccucuccggccucaugcacgccgccaucaacuucuccaucccccucugcggcaagcgcgucauccaccaguucuucugcgacgucccccagaugcucaagcucgccugcuccuacgaguucaucaacgagaucgcccucgccgccuucaccaccuccgccgccuucaucugccucaucuccaucguccucuccuacauccgcaucuucuccaccguccuccgcauccccuccgccgagggccgcaccaaggucuucuccaccugccucccccaccucuucgucgccaccuucuuccucuccgccgccggcuucgaguuccuccgccuccccuccgacuccuccuccaccgucgaccucgucuucuccgucuucuacaccgucaucccccccacccucaaccccgucaucuacucccuccgcaacgacuccaugaaggccgcccuccgcaagaugcucuccaaggaggagcucccccagcgcaagaugugccucaaggccauguucaagcucuga

SEQ ID NO: 47067 - RNA, 930 nt, Artificial Sequence
  derived and/or modified sequence opt2 from OR1A1__Homo_sapiens__NP_055380
augcgcgagaacaaccaguccuccacccucgaguucauccuccucggcgucaccggccagcaggagcaggaggacuucuucuacauccucuuccucuucaucuaccccaucacccucaucggcaaccuccucaucguccucgccaucugcuccgacguccgccuccacaaccccauguacuuccuccucgccaaccucucccucgucgacaucuucuucuccuccgucaccauccccaagaugcucgccaaccaccuccucggcuccaaguccaucuccuucggcggcugccucacccagauguacuucaugaucgcccucggcaacaccgacuccuacauccucgccgccauggccuacgaccgcgccgucgccaucucccgcccccuccacuacaccaccaucauguccccccgcuccugcaucuggcucaucgccggcuccugggucaucggcaacgccaacgcccucccccacacccuccucaccgccucccucuccuucugcggcaaccaggaggucgccaacuucuacugcgacaucaccccccuccucaagcucuccugcuccgacauccacuuccacgucaagaugauguaccucggcgucggcaucuucuccgucccccuccucugcaucaucgucuccuacauccgcgucuucuccaccgucuuccagguccccuccaccaagggcguccucaaggccuucuccaccugcggcucccaccucaccgucgucucccucuacuacggcaccgucaugggcaccuacuuccgcccccucaccaacuacucccucaaggacgccgucaucaccgucauguacaccgccgucacccccaugcucaaccccuucaucuacucccuccgcaaccgcgacaugaaggccgcccuccgcaagcucuucaacaagcgcaucuccuccuga

SEQ ID NO: 47068 - RNA, 945 nt, Artificial Sequence
  derived and/or modified sequence opt2 from OR1C1__Homo_sapiens__NP_036485
auggagaagcgcaaccucaccgucguccgcgaguucguccuccucggccuccccuccuccgccgagcagcagcaccuccucuccguccucuuccucugcauguaccucgccaccacccucggcaacaugcucaucaucgccaccaucggcuucgacucccaccuccacucccccauguacuucuuccucuccaaccucgccuucgucgacaucugcuucaccuccaccaccgucccccagauggucgucaacauccucaccggcaccaagaccaucuccuucgccggcugccucacccagcucuucuucuucgucuccuucgucaacauggacucccuccuccucugcgucauggccuacgaccgcuacgucgccaucugccacccccuccacuacaccgcccgcaugaaccucugccucugcguccagcucgucgccggccucuggcucgucaccuaccuccacgcccuccuccacaccguccucaucgcccagcucuccuucugcgccuccaacaucauccaccacuucuucugcgaccucaacccccuccuccagcucuccugcuccgacgucuccuucaacgucaugaucaucuucgccgucggcggccuccucgcccucaccccccucgucugcauccucgucuccuacggccucaucuucuccaccguccucaagaucaccuccacccagggcaagcagcgcgccgucuccaccugcuccugccaccucuccgucgucguccucuucuacggcaccgccaucgccgucuacuucucccccuccuccccccacaugcccgaguccgacacccucuccaccaucauguacuccauggucgcccccaugcucaaccccuucaucuacacccuccgcaaccgcgacaugaagcgcggccuccagaagaugcuccucaagugcaccgucuuccagcagcaguga

SEQ ID NO: 47069 - RNA, 939 nt, Artificial Sequence
  derived and/or modified sequence opt2 from OR1D2__Homo_sapiens__NP_002539
auggacggcggcaaccaguccgagggcuccgaguuccuccuccucggcauguccgagucccccgagcagcagcgcauccucuucuggauguuccucuccauguaccucgucaccgucgucggcaacguccucaucauccucgccaucuccuccgacucccgccuccacacccccgucuacuucuuccucgccaaccucuccuucaccgaccucuucuucgucaccaacaccauccccaagaugcucgucaaccuccagucccacaacaaggccaucuccuacgccggcugccucacccagcucuacuuccucgucucccucgucgcccucgacaaccucauccucgccgucauggccuacgaccgcuacgucgccaucugcugcccccuccacuacaccaccgccaugucccccaagcucugcauccuccuccucucccucugcuggguccucuccguccucuacggccucauccacacccuccucaugacccgcgucaccuucugcggcucccgcaagauccacuacaucuucugcgagauguacguccuccuccgcauggccugcuccaacauccagaucaaccacaccguccucaucgccaccggcugcuucaucuuccucauccccuucggcuucgucaucaucuccuacguccucaucauccgcgccauccuccgcauccccuccgucuccaagaaguacaaggccuucuccaccugcgccucccaccucggcgccgucucccucuucuacggcacccucugcauggucuaccucaagccccuccacaccuacuccgucaaggacuccgucgccaccgucauguacgccgucgucacccccaugaugaaccccuucaucuacucccuccgcaacaaggacaugcacggcgcccucggccgccuccucgacaagcacuucaagcgccucaccuga

SEQ ID NO: 47070 - RNA, 945 nt, Artificial Sequence
  derived and/or modified sequence opt2 from OR1E1__Homo_sapiens__NP_003544
augaugggccagaaccagaccuccaucuccgacuuccuccuccucggccuccccauccagcccgagcagcagaaccucugcuacgcccucuuccucgccauguaccucaccacccuccucggcaaccuccucaucaucguccucauccgccucgacucccaccuccacacccccauguaccucuuccucuccaaccucuccuucuccgaccucugcuucuccuccgucaccauccccaagcuccuccagaacaugcagaaccaggaccccuccauccccuacgccgacugccucacccagauguacuucuuccuccucuucggcgaccucgaguccuuccuccucgucgccauggccuacgaccgcuacgucgccaucugcuucccccuccacuacaccgccaucaugucccccaugcucugccucgcccucgucgcccucuccuggguccucaccaccuuccacgccaugcuccacacccuccucauggcccgccucugcuucugcgccgacaacgucaucccccacuucuucugcgacauguccgcccuccucaagcucgccuucuccgacacccgcgucaacgagugggucaucuucaucaugggcggccucauccucgucauccccuuccuccucauccucggcuccuacgcccgcaucgucuccuccauccucaagguccccuccuccaagggcaucugcaaggccuucuccaccugcggcucccaccucuccgucgucucccucuucuacggcaccgucaucggccucuaccucugcuccuccgccaacuccuccacccucaaggacaccgucauggccaugauguacaccgucgucacccccaugcucaaccccuucaucuacucccuccgcaaccgcgacaugaagggcgcccucucccgcgucauccaccagaagaagaccuucuucucccucuga

SEQ ID NO: 47071 - RNA, 972 nt, Artificial Sequence
  derived and/or modified sequence opt2 from OR1E2__Homo_sapiens__NP_003545
augaugggccagaaccagaccuccaucuccgacuuccuccuccucggccuccccauccagcccgagcagcagaaccucugcuacgcccucuuccucgccauguaccucaccacccuccucggcaaccuccucaucaucguccucauccgccucgacucccaccuccacacccccgucuaccucuuccucuccaaccucuccuucuccgaccucugcuucuccuccgucaccaugcccaagcuccuccagaacaugcagaaccaggaccccuccauccccuacgccgacugccucacccagauguacuucuuccucuacuucuccgaccucgaguccuuccuccucgucgccauggccuacgaccgcuacgucgccaucugcuuccccaugcacuacaccgccaucugcuuccuccuccacuacaccgccaucaugucccccaugcucugccucuccgucgucgcccucuccuggguccucaccaccuuccacgccaugcuccacacccuccucauggcccgccucugcuucugcgccgacaacgucaucccccacuucuucugcgacauguccgcccuccucaagcucgccugcuccgacacccgcgucaacgagugggucaucuucaucaugggcggccucauccucgucauccccuuccuccucauccucggcuccuacgcccgcaucgucuccuccauccucaagguccccuccuccaagggcaucugcaaggccuucuccaccugcggcucccaccucuccgucgucucccucuucuacggcaccgucaucggccucuaccucugccccuccgccaacuccuccacccucaaggacaccgucauggccaugauguacaccgucgucacccccaugcucacccccuucaucuacucccuccgcaaccgcgacaugaagggcgcccucgagcgcgucaucugcaagcgcaagaaccccuuccuccucuga

SEQ ID NO: 47072 - RNA, 942 nt, Artificial Sequence
  derived and/or modified sequence opt2 from OR1J2__Homo_sapiens__NP_473448
augucccccgagaaccaguccuccgucuccgaguuccuccuccucggccuccccauccgccccgagcagcaggccgucuucuucacccucuuccucggcauguaccucaccaccguccucggcaaccuccucaucaugcuccucauccagcucgacucccaccuccacacccccauguacuucuuccucucccaccucgcccucaccgacaucuccuucuccuccgucaccguccccaagaugcucauggacaugcgcaccaaguacaaguccauccucuacgaggagugcaucucccagauguacuucuucaucuucuucaccgaccucgacuccuuccucaucaccuccauggccuacgaccgcuacgucgccaucugccacccccuccacuacaccgucaucaugcgcgaggagcucugcgucuuccucgucgccgucuccuggauccucuccugcgccuccucccucucccacacccuccuccucacccgccucuccuucugcgccgccaacaccaucccccacgucuucugcgaccucgccgcccuccucaagcucuccugcuccgacaucuuccucaacgagcucgucauguucaccgucggcgucgucgucaucacccuccccuucaugugcauccucgucuccuacggcuacaucggcgccaccauccuccgcguccccuccaccaagggcauccacaaggcccucuccaccugcggcucccaccucuccgucgucucccucuacuacggcuccaucuucggccaguaccucuuccccaccgucuccuccuccaucgacaaggacgucaucgucgcccucauguacaccgucgucacccccaugcucaaccccuucaucuacucccuccgcaaccgcgacaugaaggaggcccucggcaagcucuucucccgcgccaccuucuucuccugguga

SEQ ID NO: 47073 - RNA, 951 nt, Artificial Sequence
  derived and/or modified sequence opt2 from OR1K1__Homo_sapiens__NP_543135
auggaggccgccaacgaguccuccgagggcaucuccuucguccuccucggccucaccaccucccccggccagcagcgcccccucuucguccucuuccuccuccucuacgucgccucccuccucggcaacggccucaucgucgccgccauccaggccucccccgcccuccacgcccccauguacuuccuccucgcccaccucuccuucgccgaccucugcuucgccuccgucaccguccccaagaugcucgccaaccuccucgcccacgaccacuccaucucccucgccggcugccucacccagauguacuucuucuucgcccucggcgucaccgacuccugccuccucgccgccauggccuacgacugcuacgucgccauccgccacccccuccccuacgccacccgcaugucccgcgccaugugcgccgcccucgucggcauggccuggcucgucucccacguccacucccuccucuacauccuccucauggcccgccucuccuucugcgccucccaccaggucccccacuucuucugcgaccaccagccccuccuccgccucuccugcuccgacacccaccacauccagcuccucaucuucaccgagggcgccgccgucgucgucacccccuuccuccucauccucgccuccuacggcgccaucgccgccgccguccuccagcuccccuccgccuccggccgccuccgcgccgucuccaccugcggcucccaccucgccgucgucucccucuucuacggcaccgucaucgccgucuacuuccaggccaccucccgccgcgaggccgaguggggccgcgucgccaccgucauguacaccgucgucacccccaugcucaaccccaucaucuacucccucuggaaccgcgacguccagggcgcccuccgcgcccuccucaucggccgccgcaucuccgccuccgacuccuga

SEQ ID NO: 47074 - RNA, 930 nt, Artificial Sequence
  derived and/or modified sequence opt2 from OR1L8__Homo_sapiens__NP_001004454
auggagcgcaucaaccacaccuccuccgucuccgaguucauccuccucggccucuccucccgccccgaggaccagaagacccucuucguccucuuccucaucgucuaccucgucaccaucaccggcaaccuccucaucauccucgccauccgcuucaacccccaccuccagacccccauguacuucuuccucuccuuccucucccucaccgacaucugcuucaccaccuccgucguccccaagaugcucaugaacuuccucuccgagaagaagaccaucuccuacgccggcugccucacccagauguacuuccucuacgcccucggcaacuccgacuccugccuccucgccgucauggccuucgaccgcuacgucgccgucugcgaccccuuccacuacgucaccaccaugucccaccaccacugcguccuccucgucgccuucuccugcuccuucccccaccuccacucccuccuccacacccuccuccucaaccgccucaccuucugcgacuccaacgucauccaccacuuccucugcgaccucucccccguccucaagcucuccugcuccuccaucuucgucaacgagaucguccagaugaccgaggcccccaucguccucgucacccgcuuccucugcaucgccuucuccuacauccgcauccucaccaccguccucaagauccccuccaccuccggcaagcgcaaggccuucuccaccugcggcuucuaccucaccgucgucacccucuucuacggcuccaucuucugcgucuaccuccagccccccuccaccuacgccgucaaggaccacgucgccaccaucgucuacaccguccucuccuccaugcucaaccccuucaucuacucccuccgcaacaaggaccucaagcagggccuccgcaagcucauguccaagcgcuccuga

SEQ ID NO: 47075 - RNA, 942 nt, Artificial Sequence
  derived and/or modified sequence opt2 from OR1M1__Homo_sapiens__NP_001004456
auggagccccgcaaccagaccuccgccucccaguucauccuccucggccucuccgagaagcccgagcaggagacccuccucuucucccucuucuucugcauguaccucgucauggucgucggcaaccuccucaucauccucgccaucuccaucgacucccaccuccacacccccauguacuucuuccucgccaaccucucccucgucgacuucugccucgccaccaacaccauccccaagaugcucgucucccuccagaccggcuccaaggccaucuccuaccccugcugccucauccagauguacuucuuccacuucuucggcaucgucgacuccgucaucaucgccaugauggccuacgaccgcuucgucgccaucugccacccccuccacuacgccaagaucaugucccuccgccucugccgccuccucgucggcgcccucugggccuucuccugcuucaucucccucacccacauccuccucauggcccgccucgucuucugcggcucccacgaggucccccacuacuucugcgaccucacccccauccuccgccucuccugcaccgacaccuccgucaaccgcaucuucauccucaucgucgccggcauggucaucgccacccccuucgucugcauccucgccuccuacgcccgcauccucgucgccaucaugaagguccccuccgccggcggccgcaagaaggccuucuccaccugcuccucccaccucuccgucgucgcccucuucuacggcaccaccaucggcgucuaccucugccccuccuccguccucaccaccgucaaggagaaggccuccgccgucauguacaccgccgucacccccaugcucaaccccuucaucuacucccuccgcaaccgcgaccucaagggcgcccuccgcaagcucgucaaccgcaagaucaccuccuccuccuga

SEQ ID NO: 47076 - RNA, 936 nt, Artificial Sequence
  derived and/or modified sequence opt2 from OR1N1__Homo_sapiens__NP_036495
auggagaaccaguccuccaucuccgaguucuuccuccgcggcaucuccgccccccccgagcagcagcagucccucuucggcaucuuccucugcauguaccucgucacccucaccggcaaccuccucaucauccucgccaucggcuccgaccuccaccuccacacccccauguacuucuuccucgccaaccucuccuucgucgacaugggccucaccuccuccaccgucaccaagaugcucgucaacauccagacccgccaccacaccaucuccuacaccggcugccucacccagauguacuucuuccucauguucggcgaccucgacuccuucuuccucgccgccauggccuacgaccgcuacgucgccaucugccacccccucugcuacuccaccgucaugcgcccccaggucugcgcccucaugcucgcccucugcuggguccucaccaacaucgucgcccucacccacaccuuccucauggcccgccucuccuucugcgucaccggcgagaucgcccacuucuucugcgacaucacccccguccucaagcucuccugcuccgacacccacaucaacgagaugauggucuucguccucggcggcaccguccucaucguccccuuccucugcaucgucaccuccuacauccacaucguccccgccauccuccgcguccgcacccgcggcggcgucggcaaggccuucuccaccugcuccucccaccucugcgucgucugcgucuucuacggcacccucuucuccgccuaccucugcccccccuccaucgccuccgaggagaaggacaucgccgccgccgccauguacaccaucgucacccccaugcucaaccccuucaucuacucccuccgcaacaaggacaugaagggcgcccucaagcgccucuucucccaccgcuccaucgucuccuccuga

SEQ ID NO: 47077 - RNA, 993 nt, Artificial Sequence
  derived and/or modified sequence opt2 from OR1N2__Homo_sapiens__NP_001004457
auggagggcuucuaccuccgccgcucccacgagcuccagggcaugggcaagcccggccgcgucaaccagaccaccgucuccgacuuccuccuccucggccucuccgaguggcccgaggagcagccccuccucuucggcaucuuccucggcauguaccucgucaccauggucggcaaccuccucaucauccucgccaucuccuccgacccccaccuccacacccccauguacuucuuccucgccaaccucucccucaccgacgccugcuucaccuccgccuccauccccaagaugcucgccaacauccacacccagucccagaucaucuccuacuccggcugccucgcccagcucuacuuccuccucauguucggcggccucgacaacugccuccucgccgucauggccuacgaccgcuacgucgccaucugccagccccuccacuacuccaccuccauguccccccagcucugcgcccucaugcucggcgucugcuggguccucaccaacugccccgcccucaugcacacccuccuccucacccgcgucgccuucugcgcccagaaggccaucccccacuucuacugcgaccccuccgcccuccucaagcucgccugcuccgacacccacgucaacgagcucaugaucaucaccaugggccuccucuuccucaccgucccccuccuccucaucgucuucuccuacguccgcaucuucugggccgucuucgucaucuccucccccggcggccgcuggaaggccuucuccaccugcggcucccaccucaccgucguccuccucuucuacggcucccucaugggcgucuaccuccucccccccuccaccuacuccaccgagcgcgagucccgcgccgccguccucuacauggucaucauccccacccucaaccccuucaucuacucccuccgcaaccgcgacaugaaggaggcccucggcaagcucuucgucuccggcaagaccuucuuccucuga

SEQ ID NO: 47078 - RNA, 933 nt, Artificial Sequence
  derived and/or modified sequence opt2 from OR2A25__Homo_sapiens__NP_001004488
augggcggcaaccagaccuccaucaccgaguuccuccuccucggcuuccccaucggcccccgcauccagaugcuccucuucggccucuucucccucuucuacaucuucauccuccucggcaacggcaccauccucggccucaucucccucgacucccgccuccacacccccauguacuucuuccucucccaccucgccgucgucgacaucgccugcgccugcuccaccgucccccagaugcucgucaaccuccuccaccccgccaagcccaucuccuucgccggcugcaugacccagauguuccucuuccucuccuucgcccacaccgagugccuccuccucgucgucauguccuacgaccgcuacgucgccaucugccacccccuccgcuacuccaccaucaugaccuggaaggucugcaucacccucgcccucaccuccuggauccucggcguccuccucgcccucguccaccucguccuccuccucccccucuccuucugcggcccccagaagcucaaccacuucuucugcgagaucauggccguccucaagcucgccugcgccgacacccacaucaacgaggucaugguccucgccggcgccgucuccguccucgucggcgccuucuucuccaccgucaucuccuacguccacauccucugcgccauccucaagauccaguccggcgagggcugccagaaggccuucuccaucugcuccucccaccucugcgucgucggccucuucuacggcaccgccaucaucauguacgucgagccccaguacgagucccccaaggagcagaagaaguaccuccuccucuuccacucccucuucaaccccaugcucaacccccucaucuacucccuccgcaacaaggagguccagggcacccucaagcgcaugcucgagaagaagcgcaccuccuga

SEQ ID NO: 47079 - RNA, 951 nt, Artificial Sequence
  derived and/or modified sequence opt2 from OR2AG1__Homo_sapiens__NP_001004489
auggagcucuggaacuucacccucggcuccggcuucauccucgucggcauccucaacgacuccggcucccccgagcuccucugcgccaccaucaccauccucuaccuccucgcccucaucuccaacggccuccuccuccucgccaucaccauggaggcccgccuccacaugcccauguaccuccuccucggccagcucucccucauggaccuccucuucaccuccgucgucacccccaaggcccucgccgacuuccuccgccgcgagaacaccaucuccuucggcggcugcgcccuccagauguuccucgcccucaccaugggcggcgccgaggaccuccuccucgccuucauggccuacgaccgcuacgucgccaucugccacccccucaccuacaugacccucauguccucccgcgccugcuggcucauggucgccaccuccuggauccucgccucccucuccgcccucaucuacaccgucuacaccaugcacuaccccuucugccgcgcccaggagauccgccaccuccucugcgagaucccccaccuccucaaggucgccugcgccgacaccucccgcuacgagcucauggucuacgucaugggcgucaccuuccucauccccucccucgccgccauccucgccuccuacacccagauccuccucaccguccuccacaugcccuccaacgagggccgcaagaaggcccucgucaccugcuccucccaccucaccgucgucggcauguucuacggcgccgccaccuucauguacguccuccccuccuccuuccacuccacccgccaggacaacaucaucuccgucuucuacaccaucgucacccccgcccucaacccccucaucuacucccuccgcaacaaggaggucaugcgcgcccuccgccgcguccucggcaaguacaugcuccccgcccacuccacccucuga

SEQ ID NO: 47080 - RNA, 1008 nt, Artificial Sequence
  derived and/or modified sequence opt2 from OR2AK2__Homo_sapiens__NP_001004491
augaacaucuccgacgucaucuccuucgacauccucgucuccgccaugaagaccggcaaccaguccuucggcaccgacuuccuccucgucggccucuuccaguacggcuggaucaacucccuccucuucgucgucaucgccacccucuucaccgucgcccucaccggcaacaucaugcucauccaccucauccgccucaacacccgccuccacacccccauguacuuccuccucucccagcucuccaucgucgaccucauguacaucuccaccaccguccccaagauggccgucuccuuccucucccaguccaagaccauccgcuuccucggcugcgagauccagaccuacgucuuccucgcccucggcggcaccgaggcccuccuccucggcuucauguccuacgaccgcuacgucgccaucugccacccccuccacuaccccaugcucauguccaagaagaucugcugccucauggucgccugcgccugggccuccggcuccaucaacgccuucauccacacccucuacgucuuccagcuccccuucugccgcucccgccucaucaaccacuucuucugcgagguccccgcccuccucucccucgucugccaggacaccucccaguacgaguacaccguccuccucuccggccucaucauccuccuccuccccuuccucgccauccucgccuccuacgcccgcguccucaucgucgucuuccagauguccuccggcaagggccaggccaaggccgucuccaccugcuccucccaccucaucgucgccucccucuucuacgccaccacccucuucaccuacacccgcccccacucccuccgcucccccucccgcgacaaggccgucgccgucuucuacaccaucgucaccccccuccucaaccccuucaucuacucccuccgcaacaaggaggucaccggcgccguccgccgccuccucggcuacuggaucugcugccgcaaguacgacuuccgcucccucuacuga

SEQ ID NO: 47081 - RNA, 963 nt, Artificial Sequence
  derived and/or modified sequence opt2 from OR2AT4__Homo_sapiens__NP_001005285
auggacgccaccgccugcaacgaguccgucgacggcucccccgucuucuaccuccucggcauccccucccuccccgagaccuucuuccuccccgucuucuucaucuuccuccucuucuaccuccucauccucaugggcaacgcccucauccucgucgccgucgucgccgagcccucccuccacaagcccauguacuucuuccucaucaaccucuccacccucgacauccucuucaccaccaccaccguccccaagaugcucucccucuuccuccucggcgaccgcuuccucuccuucuccuccugccuccuccagauguaccucuuccaguccuucaccugcuccgaggccuucauccucgucgucauggccuacgaccgcuacgucgccaucugccacccccuccacuaccccguccucaugaacccccagaccaacgccacccucgccgccuccgccuggcucaccgcccuccuccuccccauccccgccgucguccgcaccucccagauggccuacaacuccaucgccuacaucuaccacugcuucugcgaccaccucgccgucguccaggccuccugcuccgacaccaccccccagacccucaugggcuucugcaucgccauggucgucuccuuccucccccuccuccucguccuccucuccuacguccacauccucgccuccguccuccgcaucuccucccucgagggccgcgccaaggccuucuccaccugcuccucccaccuccucgucgucggcaccuacuacuccuccaucgccaucgccuacgucgccuaccgcgccgaccucccccucgacuuccacaucaugggcaacgucgucuacgccauccucacccccauccucaacccccucaucuacacccuccgcaaccgcgacgucaaggccgccaucaccaagaucaugucccaggaccccggcugcgaccgcuccaucuga

SEQ ID NO: 47082 - RNA, 1074 nt, Artificial Sequence
  derived and/or modified sequence opt2 from OR2B2__Homo_sapiens__NP_149046
augaacugggucaacaaguccgucccccaggaguucauccuccucgucuucuccgaccagcccuggcucgagaucccccccuucgucauguuccucuucuccuacauccucaccaucuucggcaaccucaccaucauccucgucucccacgucgacuucaagcuccacacccccauguacuucuuccucuccaaccucucccuccucgaccucugcuacaccaccuccaccgucccccagaugcucgucaacaucugcaacacccgcaaggucaucuccuacggcggcugcgucgcccagcucuucaucuuccucgcccucggcuccaccgagugccuccuccucgccgucaugugcuucgaccgcuucgucgccaucugccgcccccuccacuacuccaucaucaugcaccagcgccucugcuuccagcucgccgccgccuccuggaucuccggcuucuccaacuccguccuccaguccaccuggacccucaagaugccccucugcggccacaaggaggucgaccacuucuucugcgagguccccgcccuccucaagcucuccugcgucgacaccaccgccaacgaggccgagcucuucuucaucuccguccucuuccuccucauccccgucacccucauccucaucuccuacgccuucaucguccaggccguccuccgcauccaguccgccgagggccagcgcaaggccuucggcaccugcggcucccaccucaucgucgucucccucuucuacggcaccgccaucuccauguaccuccagccccccucccccuccuccaaggaccgcggcaagauggucucccucuucugcggcaucaucgcccccaugcucaacccccucaucuacacccuccgcaacaaggaggucaaggaggccuucaagcgccucgucgccaagucccuccucaaccaggagauccgcaacaugcagaugaucuccuucgccaaggacaccguccucaccuaccucaccaacuucuccgccuccugccccaucuucgucaucaccaucgagaacuacugcaaccucccccagcgcaaguuccccuga

SEQ ID NO: 47083 - RNA, 942 nt, Artificial Sequence
  derived and/or modified sequence opt2 from OR2B3__Homo_sapiens__NP_001005226
augaacugggagaacgaguccucccccaaggaguucauccuccucggcuucuccgaccgcgccuggcuccagaugccccucuucgucguccuccucaucuccuacaccaucaccaucuucggcaacgucuccaucaugauggucugcauccucgaccccaagcuccacacccccauguacuucuuccucaccaaccucuccauccucgaccucugcuacaccaccaccaccgucccccacaugcucgucaacaucggcugcaacaagaagaccaucuccuacgccggcugcgucgcccaccucaucaucuuccucgcccucggcgccaccgagugccuccuccucgccgucauguccuucgaccgcuacgucgccgucugccgcccccuccacuacgucgucaucaugaacuacugguucugccuccgcauggccgccuucuccuggcucaucggcuucggcaacuccguccuccaguccucccucacccucaacaugccccgcugcggccaccaggaggucgaccacuucuucugcgagguccccgcccuccucaagcucuccugcgccgacaccaagcccaucgaggccgagcucuucuucuucuccguccucauccuccucauccccgucacccucauccucaucuccuacggcuucaucgcccaggccguccucaagauccgcuccgccgagggccgccagaaggccuucggcaccugcggcucccacaugaucgucgucucccucuucuacggcaccgccaucuacauguaccuccagccccccuccuccaccuccaaggacuggggcaagauggucucccucuucuacggcaucaucaccuccaugcucaacucccucaucuacucccuccgcaacaaggacaugaaggaggccuucaagcgccucaugccccgcaucuucuucugcaagaaguga

SEQ ID NO: 47084 - RNA, 942 nt, Artificial Sequence
  derived and/or modified sequence opt2 from OR2B6__Homo_sapiens__NP_036499
augaacugggucaacgacuccaucauccaggaguucauccuccucggcuucuccgaccgccccuggcucgaguucccccuccucgucgucuuccucaucuccuacaccgucaccaucuucggcaaccucaccaucauccucgucucccgccucgacaccaagcuccacacccccauguacuucuuccucaccaaccucucccuccucgaccucugcuacaccaccugcaccgucccccagaugcucgucaaccucugcuccauccgcaaggucaucuccuaccgcggcugcgucgcccagcucuucaucuuccucgcccucggcgccaccgaguaccuccuccucgccgucauguccuucgaccgcuucgucgccaucugccgcccccuccacuacuccgucaucaugcaccagcgccucugccuccagcucgccgccgccuccugggucaccggcuucuccaacuccgucuggcucuccacccucacccuccagcucccccucugcgaccccuacgucaucgaccacuuccucugcgagguccccgcccuccucaagcucuccugcgucgagaccaccgccaacgaggccgagcucuuccucgucuccgagcucuuccaccucaucccccucacccucauccucaucuccuacgccuucaucguccgcgccguccuccgcauccaguccgccgagggccgccagaaggccuucggcaccugcggcucccaccucaucgucgucucccucuucuacuccaccgccgucuccgucuaccuccagccccccucccccuccuccaaggaccagggcaagauggucucccucuucuacggcaucaucgcccccaugcucaacccccucaucuacacccuccgcaacaaggaggucaaggagggcuucaagcgccucgucgcccgcgucuuccucaucaagaaguga

SEQ ID NO: 47085 - RNA, 939 nt, Artificial Sequence
  derived and/or modified sequence opt2 from OR2C1__Homo_sapiens__NP_036500
auggacggcgucaacgacuccucccuccagggcuucguccucaugggcaucuccgaccacccccagcucgagaugaucuucuucaucgccauccucuucuccuaccuccucacccuccucggcaacuccaccaucauccuccucucccgccucgaggcccgccuccacacccccauguacuucuuccucuccaaccucuccucccucgaccucgccuucgccaccuccuccgucccccagaugcucaucaaccucuggggccccggcaagaccaucuccuacggcggcugcaucacccagcucuacgucuuccucuggcucggcgccaccgagugcauccuccucgucgucauggccuucgaccgcuacgucgccgucugccgcccccuccgcuacaccgccaucaugaacccccagcucugcuggcuccucgccgucaucgccugccucggcggccucggcaacuccgucauccaguccaccuucacccuccagcucccccucugcggccaccgccgcgucgagggcuuccucugcgagguccccgccaugaucaagcucgccugcggcgacaccucccucaaccaggccguccucaacggcgucugcaccuucuucaccgccgucccccucuccaucaucgucaucuccuacugccucaucgcccaggccguccucaagauccgcuccgccgagggccgccgcaaggccuucaacaccugccucucccaccuccucgucgucuuccucuucuacggcuccgccuccuacggcuaccuccuccccgccaagaacuccaagcaggaccagggcaaguucaucucccucuucuacucccucgucacccccauggucaacccccucaucuacacccuccgcaacauggaggucaagggcgcccuccgccgccuccucggcaagggccgcgaggucggcuga

SEQ ID NO: 47086 - RNA, 954 nt, Artificial Sequence
  derived and/or modified sequence opt2 from OR2F2__Homo_sapiens__NP_001004685
auggagaucgacaaccagaccuggguccgcgaguucauccuccucggccucuccuccgacuggugcacccagaucucccucuucucccucuuccucgucaccuaccucaugaccguccucggcaacugccucaucguccuccucauccgccucgacucccgccuccacacccccauguacuucuuccucaccaaccucucccucgucgacgucuccuacgccaccuccgucgucccccagcuccucgcccacuuccucgccgagcacaaggccauccccuuccaguccugcgccgcccagcucuucuucucccucgcccucggcggcaucgaguucguccuccucgccgucauggccuacgaccgccacgucgccgucuccgaccgccuccgcuacuccgccaucaugcacggcggccucugcgcccgccucgccaucaccuccugggucuccggcuccaucaacucccucguccagaccgccaucaccuuccagcuccccaugugcaccaacaaguucaucgaccacaucuccugcgagcuccucgccgucguccgccucgccugcgucgacaccuccuccaacgaggccgccaucauggucuccuccaucguccuccucaugacccccuucugccucguccuccucuccuacauccgcaucaucuccaccauccucaagauccagucccgcgagggccgcaagaaggccuuccacaccugcgccucccaccucaccgucgucgcccucugcuacggcaccaccaucuucaccuacauccagccccacuccggccccuccguccuccaggagaagcucaucuccgucuucuacgccaucgucaugccccuccucaaccccgucaucuacucccuccgcaacaaggaggucaagggcgccuggcacaagcuccucgagaaguucuccggccucaccuccaagcucggcaccuga

SEQ ID NO: 47087 - RNA, 954 nt, Artificial Sequence
  derived and/or modified sequence opt2 from OR2G2__Homo_sapiens__NP_001001915
augggcaugguccgccacaccaacgaguccaaccucgccggcuucauccuccucggcuucuccgacuacccccagcuccagaagguccucuucguccucauccucauccucuaccuccucaccauccucggcaacaccaccaucauccucgucucccgccucgagcccaagcuccacaugcccauguacuucuuccucucccaccucuccuuccucuaccgcugcuucaccuccuccgucaucccccagcuccucgucaaccucugggagcccaugaagaccaucgccuacggcggcugccucguccaccucuacaacucccacgcccucggcuccaccgagugcguccuccccgccgucauguccugcgaccgcuacgucgccgucugccgcccccuccacuacaccguccucaugcacauccaccucugcauggcccucgccuccauggccuggcucuccggcaucgccaccacccucguccaguccacccucacccuccagcuccccuucugcggccaccgccaggucgaccacuucaucugcgagguccccguccucaucaagcucgccugcgucggcaccaccuucaacgaggccgagcucuucgucgccuccauccucuuccucaucguccccgucuccuucauccucgucuccuccggcuacaucgcccacgccguccuccgcaucaaguccgccacccgccgccagaaggccuucggcaccugcuucucccaccucaccgucgucaccaucuucuacggcaccaucaucuucauguaccuccagcccgccaagucccgcucccgcgaccagggcaaguucgucucccucuucuacaccgucgucacccgcaugcucaacccccucaucuacacccuccgcaucaaggaggucaagggcgcccucaagaagguccucgccaaggcccucggcgucaacauccucuga

SEQ ID NO: 47088 - RNA, 930 nt, Artificial Sequence
  derived and/or modified sequence opt2 from OR2G3__Homo_sapiens__NP_001001914
augggccucggcaacgaguccucccucauggacuucauccuccucggcuucuccgaccacccccgccucgaggccguccucuucgucuucguccucuucuucuaccuccucacccucgucggcaacuucaccaucaucaucaucuccuaccucgaccccccccuccacacccccauguacuucuuccucuccaaccucucccuccucgacaucugcuucaccaccucccucgccccccagacccucgucaaccuccagcgccccaagaagaccaucaccuacggcggcugcgucgcccagcucuacaucucccucgcccucggcuccaccgagugcauccuccucgccgacauggcccucgaccgcuacaucgccgucugcaagccccuccacuacgucgucaucaugaacccccgccucugccagcagcucgccuccaucuccuggcucuccggccucgccuccucccucauccacgccaccuucacccuccagcucccccucugcggcaaccaccgccucgaccacuucaucugcgagguccccgcccuccucaagcucgccugcgucgacaccaccgucaacgagcucguccucuucgucgucuccguccucuucgucgucaucccccccgcccucaucuccaucuccuacggcuucaucacccaggccguccuccgcaucaaguccgucgaggcccgccacaaggccuucuccaccugcuccucccaccucaccgucgucaucaucuucuacggcaccaucaucuacgucuaccuccagcccuccgacuccuacgcccaggaccagggcaaguucaucucccucuucuacaccauggucacccccacccucaaccccaucaucuacacccuccgcaacaaggacaugaaggaggcccuccgcaagcuccucuccggcaagcucuga

SEQ ID NO: 47089 - RNA, 939 nt, Artificial Sequence
  derived and/or modified sequence opt2 from OR2H2__Homo_sapiens__NP_009091
auggucaaccaguccuccacccccggcuuccuccuccucggcuucuccgagcaccccggccucgagcgcacccucuucgucgucguccucaccuccuaccuccucacccucgucggcaacacccucaucauccuccucuccgcccucgaccccaagcuccacucccccauguacuucuuccucuccaaccucuccuuccucgaccucugcuucaccaccuccugcgucccccagaugcucgucaaccucuggggccccaagaagaccaucuccuuccucgacugcuccguccagaucuucaucuuccucucccucggcaccaccgagugcauccuccucaccgucauggccuucgaccgcuacgucgccgucugccagccccuccacuacgccaccaucauccacccccgccucugcuggcagcucgccuccgucgccugggucaucggccucgucgaguccgucguccagacccccuccacccuccaccuccccuucugccccgaccgccaggucgacgacuucgucugcgagguccccgcccucauccgccucuccugcgaggacaccuccuacaacgagauccaggucgccgucgccuccgucuucauccucgucgucccccucucccucauccucgucuccuacggcgccaucaccugggccguccuccgcaucaacuccgccaagggccgccgcaaggccuucggcaccugcuccucccaccucaccgucgucacccucuucuacuccuccgucaucgccgucuaccuccagcccaagaaccccuacgcccaggagcgcggcaaguucuucggccucuucuacgccgucggcacccccucccucaacccccucaucuacacccuccgcaacaaggaggucacccgcgccuuccgccgccuccucggcaaggagaugggccucacccaguccuga

SEQ ID NO: 47090 - RNA, 939 nt, Artificial Sequence
  derived and/or modified sequence opt2 from OR2J2__Homo_sapiens__NP_112167
augaugaucaagaagaacgccuccuccgaggacuucuucauccuccucggcuucuccaacuggccccagcucgaggucguccucuucgucgucauccucaucuucuaccucaugacccucaccggcaaccucuucaucaucauccucuccuacgucgacucccaccuccacacccccauguacuucuuccucuccaaccucuccuuccucgaccucugcuacaccaccuccuccaucccccagcuccucgucaaccuccgcggccccgagaagaccaucuccuacgccggcugcaugguccagcucuacuucguccucgcccucggcaucaccgagugcguccuccucgucgucauguccuacgaccgcuacgucgccgucugccgcccccuccacuacaccguccucaugcacccccgcuucugccaccuccucgucgccgccuccugggucaucggcuucaccaucuccgcccuccacuccuccuucaccuucugggucccccucugcggccaccgccucgucgaccacuucuucugcgagguccccgcccuccuccgccucuccugcgucgacacccacgccaacgagcucacccucauggucauguccuccaucuucguccucaucccccucauccucauccucaccaccuacggcgccaucgcccgcgccguccucuccaugcaguccaccaccggccuccagaaggucuuccgcaccugcggcgcccaccucauggucgucucccucuucuucauccccgucaugugcauguaccuccagccccccuccgagaacucccccgaccagggcaaguucaucgcccucuucuacaccgucgucacccccucccucaacccccucaucuacacccuccgcaacaagcacgucaagggcgccgccaagcgccuccucggcugggaguggggcaaguga

SEQ ID NO: 47091 - RNA, 936 nt, Artificial Sequence
  derived and/or modified sequence opt2 from OR2J3__Homo_sapiens__NP_001005216
augaacgacgacggcaaggucaacgccuccuccgagggcuacuucauccucgucggcuucuccaacuggccccaccucgaggucgucaucuucgucgucguccucaucuucuaccucaugacccucaucggcaaccucuucaucaucauccucuccuaccucgacucccaccuccacacccccauguacuucuuccucuccaaccucuccuuccucgaccucugcuacaccaccuccuccaucccccagcuccucgucaaccucuggggccccgagaagaccaucuccuacgccggcugcaugauccagcucuacuucguccucgcccucggcaccaccgagugcguccuccucgucgucauguccuacgaccgcuacgccgccgucugccgcccccuccacuacaccguccucaugcacccccgcuucugccaccuccucgccgucgccuccugggucuccggcuucaccaacuccgcccuccacuccuccuucaccuucugggucccccucugcggccaccgccaggucgaccacuucuucugcgagguccccgcccuccuccgccucuccugcgucgacacccacgucaacgagcucacccucaugaucaccuccuccaucuucguccucaucccccucauccucauccucaccuccuacggcgccaucguccgcgccauccuccgcaugcaguccaccaccggccuccagaaggucuucggcaccugcggcgcccaccucauggccgucucccucuucuucauccccgccaugugcauguaccuccagccccccuccggcaacucccaggaccagggcaaguucaucgcccucuucuacaccgucgucacccccucccucaacccccucaucuacacccuccgcaacaaggucguccgcggcgccgucaagcgccucaugggcugggaguga

SEQ ID NO: 47092 - RNA, 939 nt, Artificial Sequence
  derived and/or modified sequence opt2 from OR2L2__Homo_sapiens__NP_001004686
auggagaacuacaaccagaccuccaccgacuucauccuccucggccucuucccccagucccgcaucggccucuucgucuucacccucaucuuccucaucuuccucauggcccucaucggcaaccucuccaugauccuccucaucuuccucgacauccaccuccacacccccauguacuuccuccucucccagcucucccucaucgaccucaacuacaucuccaccaucguccccaagauggucuacgacuuccucuacggcaacaaguccaucuccuucaccggcugcggcauccaguccuucuucuuccucacccucgccgucgccgagggccuccuccucaccuccauggccuacgaccgcuacgucgccaucugcuucccccuccacuaccccauccgcaucuccaagcgcgucugcgucaugaugaucaccggcuccuggaugaucuccuccaucaacuccugcgcccacaccgucuacgcccucugcauccccuacugcaagucccgcgccaucaaccacuucuucugcgacguccccgccaugcucacccucgccugcaccgacaccugggucuacgaguccaccgucuuccucuccuccaccaucuuccucguccuccccuucaccggcaucgccugcuccuacggccgcguccuccucgccgucuaccgcaugcacuccgccgagggccgcaagaaggccuacuccaccugcuccacccaccucaccgucgucuccuucuacuacgcccccuucgccuacaccuacguccgcccccgcucccuccgcucccccaccgaggacaagauccucgccgucuucuacaccauccucacccccaugcucaaccccaucaucuacucccuccgcaacaaggaggucaugggcgcccucacccaggucauccagaagaucuucuccgucaagauguga

SEQ ID NO: 47093 - RNA, 939 nt, Artificial Sequence
  derived and/or modified sequence opt2 from OR2M3__Homo_sapiens__NP_001004689
auggcccgcgagaacuccaccuucaacuccgacuucauccuccucggcaucuucaaccacucccccacccacaccuuccucuucuuccucguccucgccaucuucuccgucgccuucaugggcaacuccgucaugguccuccucaucuaccucgacacccagcuccacacccccauguaccuccuccucucccagcucucccucauggaccucaugcucaucugcaccaccguccccaagauggccuucaacuaccucuccggcuccaaguccaucuccauggccggcugcgccacccagaucuucuucuacaccucccuccucggcuccgagugcuuccuccucgccgucauggccuacgaccgcuacaccgccaucugccacccccuccgcuacaccaaccucaugucccccaagaucugcggccucaugaccgccuucuccuggauccucggcuccaccgacggcaucaucgacgucgucgccaccuucuccuucuccuacugcggcucccgcgagaucgcccacuucuucugcgacuuccccucccuccucauccucuccugcuccgacaccuccaucuucgagaagauccucuucaucugcugcaucgucaugaucgucuuccccgucgccaucaucaucgccuccuacgcccgcgucauccucgccgucauccacaugggcuccggcgagggccgccgcaaggccuucaccaccugcuccucccaccuccucgucgucggcauguacuacggcgccgcccucuucauguacauccgccccaccuccgaccgcucccccacccaggacaagauggucuccgucuucuacaccauccucacccccaugcucaacccccucaucuacucccuccgcaacaaggaggucacccgcgccuucaugaagauccucggcaagggcaaguccggcgaguga

SEQ ID NO: 47094 - RNA, 936 nt, Artificial Sequence
  derived and/or modified sequence opt2 from OR2M4__Homo_sapiens__NP_059974
auggucugggagaaccagaccuucaacuccaucuucauccuccucggcaucuucaaccacucccccacccacaccuuccucuucucccucguccucggcaucuucucccucgcccucauggagaacaucuccaugguccuccucaucuacaucgagaagcagcuccacacccccauguacuuccuccucucccagcucucccucauggaccucaugcucaucugcaccacccuccccaagaugaucuucuccuaccucuccggcaagaaguccaucucccucgccggcugcggcacccagaucuucuucuacgucucccuccucggcgccgagugcuuccuccucgccgucauggccuacgaccgcuacgucgccaucugccacccccuccaguacaccauccucaugaaccccaagcucugcgucuucaugaccgucgccuccuggacccucggcucccucgacggcaucaucguccucgccgccguccucuccuucuccuacugcuccucccucgagauccaccacuucuucugcgacgucgccgcccuccucccccucuccugcaccgagaccuccgccuucgagcgccuccucgucaucugcugcgucgucaugcucaucuuccccgucuccgucaucauccucuccuacucccacguccuccgcgccgucauccacaugggcuccggcgagucccgccgcaaggccuucaccaccugcuccucccaccucuccgucgucggccucuacuacggcgccgccauguucauguacaugcgccccgccuccaagcacacccccgaccaggacaagauggucuccgccuucuacaccauccucacccccaugcucaacccccucaucuacucccuccgcaacaaggaggucuuccgcgcccuccagaagguccucaagaagcgcaagcucaucuga

SEQ ID NO: 47095 - RNA, 939 nt, Artificial Sequence
  derived and/or modified sequence opt2 from OR2M7__Homo_sapiens__NP_001004691
auggccugggagaaccagaccuucaacuccgacuuccuccuccucggcaucuucaaccacucccccacccacaccuuccucuucuuccucguccucgccaucuucuccgucgccuucaugggcaacuccaucaugguccuccucaucuaccucgacacccagcuccacacccccauguacuuccuccucucccagcucucccucauggaccucaugcucaucugcaccaccguccccaagauggccuucaacuaccucuccggcuccaaguccaucuccauggccggcugcgccacccagaucuucuucuacaucucccuccucggcuccgagugcuuccuccucgccgucauguccuacgaccgcuacaccgccaucugccacccccuccgcuacaccaaccucaugcgccccaagaucugcggccucaugaccgccuucuccuggauccucggcuccaccgacggcaucaucgacgccgucgccaccuucuccuucuccuacugcggcucccgcgagaucgcccacuucugcugcgacuuccccucccuccucauccucuccugcaacgacaccuccaucuucgaggaggucaucuucaucugcugcaucgucaugcucgucuuccccgucgccaucaucaucaccuccuacgcccgcgucauccucgccgucauccacaugggcuccggcgagggccgccgcaaggccuucaccaccugcuccucccaccucauggucgucggcauguacuacggcgccggccucuucaugugcauccagcccaccucccaccacucccccaugcaggacaagauggucuccgucuucuacaccaucgucacccccaugcucaacccccucaucuacucccuccgcaacaaggaggucacccgcgcccucaugaagauccucggcaagggcaaguccggcgacuga

SEQ ID NO: 47096 - RNA, 960 nt, Artificial Sequence
  derived and/or modified sequence opt2 from OR2S2__Homo_sapiens__NP_063950
auggagaaggccaacgagaccucccccgucaugggcuucguccuccuccgccucuccgcccaccccgagcucgagaagaccuucuucguccucauccuccucauguaccucgucauccuccucggcaacggcguccucauccucgucaccauccucgacucccgccuccacacccccauguacuucuuccucggcaaccucuccuuccucgacaucugcuucaccaccuccuccgucccccucguccucgacuccuuccucaccccccaggagaccaucuccuucuccgccugcgccguccagauggcccucuccuucgccauggccggcaccgagugccuccuccucuccaugauggccuucgaccgcuacgucgccaucugcaacccccuccgcuacuccgucaucauguccaaggccgccuacaugcccauggccgccuccuccugggccaucggcggcgccgccuccgucguccacaccucccucgccauccagcuccccuucugcggcgacaacgucaucaaccacuucaccugcgagauccucgccguccucaagcucgccugcgccgacaucuccaucaacgucaucuccauggaggucaccaacgucaucuuccucggcguccccguccucuucaucuccuucuccuacgucuucaucaucaccaccauccuccgcauccccuccgccgagggccgcaagaaggucuucuccaccugcuccgcccaccucaccgucgucaucgucuucuacggcacccucuucuucauguacggcaagcccaaguccaaggacuccaugggcgccgacaaggaggaccucuccgacaagcucaucccccucuucuacggcgucgucacccccaugcucaaccccaucaucuacucccuccgcaacaaggacgucaaggccgccguccgccgccuccuccgccccaagggcuucacccaguga

SEQ ID NO: 47097 - RNA, 939 nt, Artificial Sequence
  derived and/or modified sequence opt2 from OR2T10__Homo_sapiens__NP_001004693
augcgccucgccaaccagacccucggcggcgacuucuuccuccucggcaucuucucccagaucucccaccccggccgccucugccuccucaucuucuccaucuuccucauggccgucuccuggaacaucacccucauccuccucauccacaucgacuccucccuccacacccccauguacuucuucaucaaccagcucucccucaucgaccucaccuacaucuccgucaccguccccaagaugcucgucaaccagcucgccaaggacaagaccaucuccguccucggcugcggcacccagauguacuucuaccuccagcucggcggcgccgagugcugccuccucgccgccauggccuacgaccgcuacgucgccaucugccacccccuccgcuacuccguccucaugucccaccgcgucugccuccuccucgccuccggcugcugguucgucggcuccgucgacggcuucaugcucacccccaucgccauguccuuccccuucugccgcucccacgagauccagcacuucuucugcgagguccccgccguccucaagcucuccugcuccgacaccucccucuacaagaucuucauguaccucugcugcgucaucaugcuccucauccccgucaccgucaucuccgucuccuacuacuacaucauccucaccauccacaagaugaacuccgucgagggccgcaagaaggccuucaccaccugcuccucccacaucaccgucgucucccucuucuacggcgccgccaucuacaacuacaugcuccccuccuccuaccagacccccgagaaggacaugauguccuccuucuucuacaccauccucacccccguccucaaccccaucaucuacuccuuccgcaacaaggacgucacccgcgcccucaagaagaugcucuccguccagaagccccccuacuga

SEQ ID NO: 47098 - RNA, 963 nt, Artificial Sequence
  derived and/or modified sequence opt2 from OR2T12__Homo_sapiens__NP_001004692
auggagaugcgcaacaccacccccgacuucauccuccucggccucuucaaccacacccgcgcccaccagguccucuucaugaugcuccucgccaccguccucaccucccucuucuccaacgcccucaugauccuccucauccacugggaccaccgccuccaccgccccauguacuuccuccucucccagcucucccucauggacaugaugcucgucuccaccaccguccccaagauggccgccgacuaccucaccggcaacaaggccaucucccgcgccggcugcggcguccagaucuucuuccuccccacccucggcggcggcgagugcuuccuccucgccgccauggccuacgaccgcuacgccgccgucugccacccccuccgcuaccccacccucauguccuggcagcucugccuccgcaugaccauguccuccuggcuccucggcgccgccgacggccuccuccaggccgucgccacccucuccuuccccuacugcggcgcccacgagaucgaccacuucuucugcgaggcccccguccucguccgccucgccugcgccgacaccuccgucuucgagaacgccauguacaucugcugcguccucaugcuccucguccccuucucccucauccucuccuccuacggccucauccucgccgccguccuccucaugcgcuccaccgaggcccgcaagaaggccuucgccaccugcuccucccacgucgccgucgucggccucuucuacggcgccggcaucuucaccuacaugcgccccaagucccaccgcuccaccaaccacgacaaggucgucuccgccuucuacaccauguucaccccccuccucaacccccucaucuacuccguccgcaacuccgaggucaaggaggcccucaagcgcuggcucggcaccugcgucaaccucaagcaccagcagaacgaggcccaccgcucccgcuga

SEQ ID NO: 47099 - RNA, 1110 nt, Artificial Sequence
  derived and/or modified sequence opt2 from OR2T1__Homo_sapiens__NP_112166
auguggcaggaguacuacuuccucaacgucuucuucccccuccucaaggucugcugccucaccaucaacucccacgucgucauccuccuccccugggagugcuaccaccucaucuggaagauccuccccuacaucggcaccaccgucggcuccauggaggaguacaacaccuccuccaccgacuucaccuucaugggccucuucaaccgcaaggagaccuccggccucaucuucgccaucaucuccaucaucuucuucaccgcccucauggccaacggcgucaugaucuuccucauccagaccgaccuccgccuccacacccccauguacuuccuccucucccaccucucccucaucgacaugauguacaucuccaccaucguccccaagaugcucgucaacuaccuccucgaccagcgcaccaucuccuucgucggcugcaccgcccagcacuuccucuaccucacccucgucggcgccgaguucuuccuccucggccucauggccuacgaccgcuacgucgccaucugcaacccccuccgcuaccccguccucaugucccgccgcgucugcuggaugaucaucgccggcuccugguucggcggcucccucgacggcuuccuccucacccccaucaccauguccuuccccuucugcaacucccgcgagaucaaccacuucuucugcgaggcccccgccguccucaagcucgccugcgccgacaccgcccucuacgagaccgucauguacgucugcugcguccucaugcuccucauccccuucuccgucguccucgccuccuacgcccgcauccucaccaccguccagugcauguccuccgucgagggccgcaagaaggccuucgccaccugcuccucccacaugaccgucgucucccucuucuacggcgccgccauguacaccuacaugcucccccacuccuaccacaagcccgcccaggacaagguccucuccgucuucuacaccauccucacccccaugcucaacccccucaucuacucccuccgcaacaaggacgucaccggcgcccucaagcgcgcccucggccgcuucaagggcccccagcgcgucuccggcggcgucuucuga

SEQ ID NO: 47100 - RNA, 975 nt, Artificial Sequence
  derived and/or modified sequence opt2 from OR2T2__Homo_sapiens__NP_001004136
augggcauggagggccuccuccagaacuccaccaacuucguccucaccggccucaucacccaccccgccuuccccggccuccucuucgccaucgucuucuccaucuucgucgucgccaucaccgccaaccucgucaugauccuccucauccacauggacucccgccuccacacccccauguacuuccuccucucccagcucuccaucauggacaccaucuacaucugcaucaccguccccaagaugcuccaggaccuccucuccaaggacaagaccaucuccuuccucggcugcgccguccagaucuuccucuaccucacccucaucggcggcgaguucuuccuccucggccucauggccuacgaccgcuacgucgccgucugcaacccccuccgcuacccccuccucaugaaccgccgcgucugccucuucauggucgucggcuccugggucggcggcucccucgacggcuucaugcucacccccgucaccauguccuuccccuucugccgcucccgcgagaucaaccacuucuucugcgagauccccgccguccucaagcucuccugcaccgacaccucccucuacgagacccucauguacgccugcugcguccucaugcuccucaucccccucuccgucaucuccgucuccuacacccacauccuccucaccguccaccgcaugaacuccgccgagggccgccgcaaggccuucgccaccugcuccucccacaucauggucgucuccgucuucuacggcgccgccuucuacaccaacguccucccccacuccuaccacacccccgagaaggacaaggucgucuccgccuucuacaccauccucacccccaugcucaacccccucaucuacucccuccgcaacaaggacgucgccgccgcccuccgcaagguccucggccgcugcggcuccucccaguccauccgcgucgccaccgucauccgcaagggcuga

SEQ ID NO: 47101 - RNA, 963 nt, Artificial Sequence
  derived and/or modified sequence opt2 from OR2T33__Homo_sapiens__NP_001004695
auggagaugcgcaacaccacccccgacuucauccuccucggccucuucaaccacacccgcgcccaccagguccucuucaugaugguccucuccaucguccucaccucccucuucggcaacucccucaugauccuccucauccacugggaccaccgccuccacacccccauguacuuccuccucucccagcucucccucauggacaugaugcucgucuccaccaccguccccaagauggccgccgacuaccucaccggcuccaaggccaucucccgcgccggcugcggcguccagaucuucuuccuccccacccucggcggcggcgagugcuuccuccucgccgccauggccuacgaccgcuacgccgccgucugccacccccuccgcuaccccacccucauguccuggcagcucugccuccgcaugaccauguccugcuggcuccucggcgccgccgacggccuccuccaggccgucgucacccucuccuuccccuacugcggcgcccacgagaucgaccacuucuucugcgagacccccguccucguccgccucgccugcgccgacaccuccgucuucgagaacgccauguacaucugcugcguccucaugcuccucguccccuucucccucauccucuccuccuacggccucauccucgccgccguccuccacaugcgcuccaccgaggcccgcaagaaggccuucgccaccugcuccucccacgucgccgucgucggccucuucuacggcgccgccaucuucaccuacaugcgccccaagucccaccgcuccaccaaccacgacaaggucgucuccgccuucuacaccauguucaccccccuccucaacccccucaucuacuccgucaagaacuccgaggucaagggcgcccucaagcgcuggcucggcaccugcgucaacaucaagcaccagcagaacgaggcccaccgcucccgcuga

SEQ ID NO: 47102 - RNA, 1047 nt, Artificial Sequence
  derived and/or modified sequence opt2 from OR2T4__Homo_sapiens__NP_001004696
auggacaacaucaccuggauggccucccacaccggcugguccgacuucauccucaugggccucuuccgccaguccaagcaccccauggccaacaucaccuggauggccaaccacaccggcugguccgacuucauccuccucggccucuuccgccaguccaagcaccccgcccuccucugcgucgucaucuucgucgucuuccucauggcccucuccggcaacgccguccucauccuccucauccacugcgacgcccaccuccacacccccauguacuucuucaucucccagcucucccucauggacauggccuacaucuccgucaccguccccaagaugcuccucgaccaggucaugggcgucaacaagaucuccgcccccgagugcggcaugcagauguucuucuacgucacccucgccggcuccgaguucuuccuccucgccaccauggccuacgaccgcuacgucgccaucugccacccccuccgcuaccccguccucaugaaccaccgcgucugccucuuccucuccuccggcugcugguuccucggcuccgucgacggcuucaccuucacccccaucaccaugaccuuccccuuccgcggcucccgcgagauccaccacuucuucugcgagguccccgccguccucaaccucuccugcuccgacaccucccucuacgagaucuucauguaccucugcugcguccucaugcuccucauccccgucgucaucaucuccuccuccuaccuccucauccuccucaccauccacggcaugaacuccgccgagggccgcaagaaggccuucgccaccugcuccucccaccucaccgucgucauccucuucuacggcgccgccaucuacaccuacaugcuccccuccuccuaccacacccccgagaaggacaugauggucuccgucuucuacaccauccucacccccgucgucaacccccucaucuacucccuccgcaacaaggacgucaugggcgcccucaagaagaugcucaccgucgagcccgccuuccagaaggccauggaguga

SEQ ID NO: 47103 - RNA, 948 nt, Artificial Sequence
  derived and/or modified sequence opt2 from OR2T5__Homo_sapiens__NP_001004697
auggccaacaucacccgcauggccaaccacaccggcaagcucgacuucauccucaugggccucuuccgccgcuccaagcaccccgcccuccucuccgucgucaucuucgucgucuuccucaaggcccucuccggcaacgccguccucauccuccucauccacugcgacgcccaccuccacucccccauguacuucuucaucucccagcucucccucauggacauggccuacaucuccgucaccguccccaagaugcuccucgaccaggucaugggcgucaacaaggucuccgcccccgagugcggcaugcagauguuccucuaccucacccucgccggcuccgaguucuuccuccucgccaccauggccuacgaccgcuacgucgccaucugccacccccuccgcuaccccguccucaugaaccaccgcgucugccucuuccucgccuccggcugcugguuccucggcuccgucgacggcuucaugcucacccccaucaccauguccuuccccuucugccgcuccugggagauccaccacuucuucugcgagguccccgccgucaccauccucuccugcuccgacaccucccucuacgagacccucauguaccucugcugcguccucaugcuccucauccccgucaccaucaucuccuccuccuaccuccucauccuccucaccguccaccgcaugaacuccgccgagggccgcaagaaggccuucgccaccugcuccucccaccucaccgucgucauccucuucuacggcgccgccgucuacaccuacaugcuccccuccuccuaccacacccccgagaaggacaugauggucuccgucuucuacaccauccucacccccguccucaacccccucaucuacucccuccgcaacaaggacgucaugggcgcccucaagaagaugcucaccguccgcuucguccucuga

SEQ ID NO: 47104 - RNA, 963 nt, Artificial Sequence
  derived and/or modified sequence opt2 from OR2W1__Homo_sapiens__NP_112165
auggaccaguccaacuacuccucccuccacggcuucauccuccucggcuucuccaaccaccccaagauggagaugauccucuccggcgucgucgccaucuucuaccucaucacccucgucggcaacaccgccaucauccucgccucccuccucgacucccagcuccacacccccauguacuucuuccuccgcaaccucuccuuccucgaccucugcuucaccaccuccaucaucccccagaugcucgucaaccucuggggccccgacaagaccaucuccuacgucggcugcaucauccagcucuacgucuacauguggcucggcuccgucgagugccuccuccucgccgucauguccuacgaccgcuucaccgccaucugcaagccccuccacuacuucgucgucaugaacccccaccucugccucaagaugaucaucaugaucugguccaucucccucgccaacuccgucguccucugcacccucacccucaaccuccccaccugcggcaacaacauccucgaccacuuccucugcgagcuccccgcccucgucaagaucgccugcgucgacaccaccaccgucgagauguccgucuucgcccucggcaucaucaucguccucaccccccucauccucauccucaucuccuacggcuacaucgccaaggccguccuccgcaccaaguccaaggccucccagcgcaaggccaugaacaccugcggcucccaccucaccgucgucuccauguucuacggcaccaucaucuacauguaccuccagcccggcaaccgcgccuccaaggaccagggcaaguuccucacccucuucuacaccgucaucacccccucccucaacccccucaucuacacccuccgcaacaaggacaugaaggacgcccucaagaagcucaugcgcuuccaccacaaguccaccaagaucaagcgcaacugcaaguccuga

SEQ ID NO: 47105 - RNA, 936 nt, Artificial Sequence
  derived and/or modified sequence opt2 from OR2Y1__Homo_sapiens__NP_001001657
augggcuccuucaacaccuccuucgaggacggcuucauccucgucggcuucuccgacuggccccagcucgagcccauccucuucgucuucaucuucaucuucuacucccucacccucuucggcaacaccaucaucaucgcccucuccuggcucgaccuccgccuccacacccccauguacuucuuccucucccaccucucccuccucgaccucugcuucaccaccuccaccgucccccagcuccucaucaaccucugcggcgucgaccgcaccaucacccgcggcggcugcgucgcccagcucuucaucuaccucgcccucggcuccaccgagugcguccuccucgucgucauggccuucgaccgcuacgccgccgucugccgcccccuccacuacauggccaucaugcacccccaccucugccagacccucgccaucgccuccuggggcgccggcuucgucaacucccucauccagaccggccucgccauggccaugccccucugcggccaccgccucaaccacuucuucugcgagaugcccgucuuccucaagcucgccugcgccgacaccgagggcaccgaggccaagauguucgucgcccgcgucaucgucgucgccguccccgccgcccucauccucggcuccuacguccacaucgcccacgccguccuccgcgucaaguccaccgccggccgccgcaaggccuucggcaccugcggcucccaccuccucgucgucuuccucuucuacggcuccgccaucuacaccuaccuccaguccauccacaacuacuccgagcgcgagggcaaguucgucgcccucuucuacaccaucaucacccccauccucaacccccucaucuacacccuccgcaacaaggacgucaagggcgcccucuggaagguccucuggcgcggccgcgacuccggcuga

SEQ ID NO: 47106 - RNA, 945 nt, Artificial Sequence
  derived and/or modified sequence opt2 from OR2Z1__Homo_sapiens__NP_001004699
augggcgacgucaaccaguccgucgccuccgacuucauccucgucggccucuucucccacuccggcucccgccagcuccucuucucccucgucgccgucauguucgucaucggccuccucggcaacaccguccuccucuuccucauccgcgucgacucccgccuccacacccccauguacuuccuccucucccagcucucccucuucgacaucggcugccccauggucaccauccccaagauggccuccgacuuccuccgcggcgagggcgccaccuccuacggcggcggcgccgcccagaucuucuuccucacccucaugggcgucgccgagggcguccuccucguccucauguccuacgaccgcuacgucgccgucugccagccccuccaguaccccguccucaugcgccgccaggucugccuccucaugaugggcuccuccugggucgucggcguccucaacgccuccauccagaccuccaucacccuccacuuccccuacugcgccucccgcaucgucgaccacuucuucugcgagguccccgcccuccucaagcucuccugcgccgacaccugcgccuacgagauggcccucuccaccuccggcguccucauccucaugcucccccucucccucaucgccaccuccuacggccacguccuccaggccguccucuccaugcgcuccgaggaggcccgccacaaggccgucaccaccugcuccucccacaucaccgucgucggccucuucuacggcgccgccgucuucauguacaugguccccugcgccuaccacuccccccagcaggacaacgucgucucccucuucuacucccucgucacccccacccucaacccccucaucuacucccuccgcaaccccgaggucuggauggcccucgucaagguccucucccgcgccggccuccgccagaugugcuga

SEQ ID NO: 47107 - RNA, 948 nt, Artificial Sequence
  derived and/or modified sequence opt2 from OR3A1__Homo_sapiens__NP_002541
augcagcccgaguccggcgccaacggcaccgucaucgccgaguucauccuccucggccuccucgaggcccccggccuccagcccgucgucuucguccucuuccucuucgccuaccucgucaccguccgcggcaaccucuccauccucgccgccguccucgucgagcccaagcuccacacccccauguacuucuuccucggcaaccucuccguccucgacgucggcugcaucuccgucaccguccccuccaugcucucccgccuccucucccgcaagcgcgccguccccugcggcgccugccucacccagcucuucuucuuccaccucuucgucggcgucgacugcuuccuccucaccgccauggccuacgaccgcuuccucgccaucugccgcccccucaccuacuccacccgcaugucccagaccguccagcgcaugcucgucgccgccuccugggccugcgccuucaccaacgcccucacccacaccgucgccauguccacccucaacuucugcggccccaacgucaucaaccacuucuacugcgaccucccccagcucuuccagcucuccugcuccuccacccagcucaacgagcuccuccucuucgccgucggcuucaucauggccggcacccccauggcccucaucgucaucuccuacauccacgucgccgccgccguccuccgcauccgcuccgucgagggccgcaagaaggccuucuccaccugcggcucccaccucaccgucgucgccaucuucuacggcuccggcaucuucaacuacaugcgccucggcuccaccaagcucuccgacaaggacaaggccgucggcaucuucaacaccgucaucaaccccaugcucaaccccaucaucuacuccuuccgcaaccccgacguccaguccgccaucuggcgcaugcucaccggccgccgcucccucgccuga

SEQ ID NO: 47108 - RNA, 1035 nt, Artificial Sequence
  derived and/or modified sequence opt2 from OR4A15__Homo_sapiens__NP_001005275
auggagcuccucaccaacaaccucaaguucaucaccgaccccuucgucugccgccuccgccaccucucccccacccccuccgaggagcacaugaagaacaagaacaacgucaccgaguucauccuccucggccucacccagaaccccgagggccagaagguccucuucgucaccuuccuccucaucuacauggucaccaucaugggcaaccuccucaucaucgucaccaucauggccucccagucccucggcucccccauguacuucuuccucgccucccucuccuucaucgacaccgucuacuccaccgccuucgcccccaagaugaucgucgaccuccucuccgagaagaagaccaucuccuuccagggcugcauggcccagcucuucauggaccaccucuucgccggcgccgaggucauccuccucgucgucauggccuacgaccgcuacauggccaucugcaagccccuccacgagcucaucaccaugaaccgccgcgucugcguccucaugcuccucgccgccuggaucggcggcuuccuccacucccucguccaguuccucuucaucuaccagcuccccuucugcggccccaacgucaucgacaacuuccucugcgaccucuacccccuccucaagcucgccugcaccaacaccuacgucaccggccucuccaugaucgccaacggcggcgccaucugcgccgucaccuucuucaccauccuccucuccuacggcgucauccuccacucccucaagacccagucccucgagggcaagcgcaaggccuucuacaccugcgccucccacgucaccgucgucauccucuucuucguccccugcaucuuccucuacgcccgccccaacuccaccuuccccaucgacaaguccaugaccgucguccucaccuucaucacccccaugcucaacccccucaucuacacccucaagaacgccgagaugaaguccgccaugcgcaagcucugguccaagaaggucucccucgccggcaaguggcucuaccacuccuga

SEQ ID NO: 47109 - RNA, 930 nt, Artificial Sequence
  derived and/or modified sequence opt2 from OR4C12__Homo_sapiens__NP_001005270
auggagaagaagaagaacgucaccgaguucauccucaucggccucacccagaaccccaucauggagaaggucaccuucgucgucuuccucguccucuacaugaucacccucuccggcaaccuccucaucgucgucaccaucaccaccucccaggcccucuccucccccauguacuucuuccucacccaccucucccucaucgacaccgucuacuccuccuccuccgcccccaagcucaucgucgacuccuuccaggagaagaagaucaucuccuucaacggcugcauggcccaggccuacgccgagcacaucuucggcgccaccgagaucauccuccucaccgucauggccugcgacugcuacgucgccaucugcaagccccucaacuacaccaccaucaugucccacucccucugcauccuccucgucgccgucgccugggucggcggcuuccuccacgccaccauccagauccucuucaccgucuggcuccccuucugcggccccaacgucaucggccacuucaugugcgaccucuacccccuccucaagcucgucugcaucgacacccacacccucggccucuucgucgccgucaacuccggcuucaucugccuccucaacuuccucauccucgucgucuccuacgucaucauccuccgcucccucaagaacaacucccucgagggccgcugcaaggcccucuccaccugcaucucccacaucaucgucgucguccucuucuucguccccugcaucuucgucuaccuccgcuccgucaccacccuccccaucgacaaggccgucgccgucuucuacaccauggucguccccaugcucaaccccgucgucuacacccuccgcaacgccgaggucaaguccgccauccgcaagcucuggcgcaagaaggucaccuccgacaacgacuga

SEQ ID NO: 47110 - RNA, 930 nt, Artificial Sequence
  derived and/or modified sequence opt2 from OR4C13__Homo_sapiens__NP_001001955
auggccaaccgcaacaacgucaccgaguucauccuccucggccucaccgagaaccccaagaugcagaagaucaucuucgucgucuucuccgucaucuacaucaacgccaugaucggcaacguccucaucgucgucaccaucaccgccucccccucccuccgcucccccauguacuucuuccucgccuaccucuccuucaucgacgccugcuacuccuccgucaacacccccaagcucaucaccgacucccucuacgagaacaagaccauccucuucaacggcugcaugacccaggucuucggcgagcacuucuuccgcggcgucgaggucauccuccucaccgucauggccuacgaccacuacgucgccaucugcaagccccuccacuacaccaccgucaugaagcagcacgucugcucccuccucgucggcgucuccugggucggcggcuuccuccacgccaccauccagauccucuucaucugccagcuccccuucugcggccccaacgucaucgaccacuucaugugcgaccucuacacccucaucaaccucgccugcaccaacacccacacccucggccucuucaucgccgccaacuccggcuucaucugccuccucaacugccuccuccuccucgucuccugcgucgucauccucuacucccucaagacccacucccucgaggcccgccacgaggcccucuccaccugcgucucccacaucaccgucgucauccucuccuucauccccugcaucuucgucuacaugcgcccccccgccacccuccccaucgacaaggccgucgccgucuucuacaccaugaucaccuccaugcucaacccccucaucuacacccuccgcaacgcccagaugaagaacgccauccgcaagcucugcucccgcaaggccaucuccuccgucaaguga

SEQ ID NO: 47111 - RNA, 930 nt, Artificial Sequence
  derived and/or modified sequence opt2 from OR4C6__Homo_sapiens__NP_001004704
auggagaaccagaacaacgucaccgaguucauccuccucggccucaccgagaaccucgagcucuggaagaucuucuccgccgucuuccucgucauguacgucgccaccguccucgagaaccuccucaucgucgucaccaucaucaccucccagucccuccgcucccccauguacuucuuccucaccuuccucucccuccucgacgucauguucuccuccgucgucgcccccaaggucaucgucgacacccucuccaaguccaccaccaucucccucaagggcugccucacccagcucuucgucgagcacuucuucggcggcgucggcaucauccuccucaccgucauggccuacgaccgcuacgucgccaucugcaagccccuccacuacaccaucaucauguccccccgcgucugcugccucauggucggcggcgccugggucggcggcuucaugcacgccaugauccagcuccucuucauguaccagauccccuucugcggccccaacaucaucgaccacuucaucugcgaccucuuccagcuccucacccucgccugcaccgacacccacauccucggccuccucgucacccucaacuccggcaugaugugcgucgccaucuuccucauccucaucgccuccuacaccgucauccucugcucccucaaguccuacuccuccaagggccgccacaaggcccucuccaccugcuccucccaccucaccgucgucguccucuucuucguccccugcaucuuccucuacaugcgccccgucgucacccaccccaucgacaaggccauggccgucuccgacuccaucaucacccccaugcucaacccccucaucuacacccuccgcaacgccgaggucaaguccgccaugaagaagcucuggaugaagugggaggcccucgccggcaaguga

SEQ ID NO: 47112 - RNA, 936 nt, Artificial Sequence
  derived and/or modified sequence opt2 from OR4D10__Homo_sapiens__NP_001004705
auggagauggagaacugcacccgcgucaaggaguucaucuuccucggccucacccagaaccgcgaggucucccucguccucuuccucuuccuccuccucgucuacgucaccacccuccucggcaaccuccucaucauggucaccgucaccugcgagucccgccuccacacccccauguacuuccuccuccacaaccucuccaucgccgacaucugcuucuccuccaucaccguccccaagguccucgucgaccuccucuccgagcgcaagaccaucuccuucaaccacugcuucacccagauguuccucuuccaccucaucggcggcgucgacgucuucucccucuccgucauggcccucgaccgcuacgucgccaucuccaagccccuccacuacgccaccaucaugucccgcgaccacugcaucggccucaccgucgccgccuggcucggcggcuucguccacuccaucguccagaucucccuccuccucccccuccccuucugcggccccaacguccucgacaccuucuacugcgacguccaccgcguccucaagcucgcccacaccgacaucuucauccucgagcuccucaugaucuccaacaacggccuccucaccacccucugguucuuccuccuccucgucuccuacaucgucauccucucccuccccaagucccaggccggcgagggccgccgcaaggccaucuccaccugcaccucccacaucaccgucgucacccuccacuucguccccugcaucuacgucuacgcccgccccuucaccgcccuccccauggacaaggccaucuccgucaccuucaccgucaucuccccccuccucaacccccucaucuacacccuccgcaaccacgagaugaaguccgccaugcgccgccucaagcgccgccucguccccuccgaccgcaaguga

SEQ ID NO: 47113 - RNA, 915 nt, Artificial Sequence
  derived and/or modified sequence opt2 from OR4K13__Homo_sapiens__NP_001004714
auggagcgcgccaaccacuccgucgucuccgaguucauccuccucggccucuccaagucccagaaccuccagauccucuucuuccucggcuucuccgucgucuucgucggcaucguccucggcaaccuccucauccucgucaccgucaccuucgacucccuccuccacacccccauguacuuccuccucuccaaccucuccugcaucgacaugauccucgccuccuucgccacccccaagaugaucgucgacuuccuccgcgagcgcaagaccaucuccugguggggcugcuacucccagauguucuucaugcaccuccucggcggcuccgagaugaugcuccucgucgccauggccaucgaccgcuacgucgccaucugcaagccccuccacuacaugaccaucauguccccccgcguccucaccggccuccuccucuccuccuacgccgucggcuucguccacuccuccucccagauggccuucaugcucacccuccccuucugcggccccaacgucaucgacuccuucuucugcgaccucccccucgucaucaagcucgccugcaaggacaccuacauccuccagcuccucgucaucgccgacuccggccuccucucccucgucugcuuccuccuccuccucgucuccuacggcgucaucaucuucuccguccgcuaccgcgccgccucccgcuccuccaaggccuucuccacccucuccgcccacaucaccgucgucacccucuucuucgcccccugcgucuucaucuacgucuggcccuucucccgcuacuccgucgacaagauccucuccgucuucuacaccaucuucaccccccuccucaaccccaucaucuacacccuccgcaaccaggaggucaaggccgccaucaagaagcgccucugcaucuga

SEQ ID NO: 47114 - RNA, 939 nt, Artificial Sequence
  derived and/or modified sequence opt2 from OR4P4__Homo_sapiens__NP_001004124
auggagaaguccaacaacuccacccucuucauccuccucggcuucucccagaacaagaacaucgagguccucugcuucguccucuuccucuucugcuacaucgccaucuggaugggcaaccuccucaucaugaucuccaucaccugcacccagcucauccaccagcccauguacuucuuccucaacuaccucucccucuccgaccucugcuacaccuccaccgucacccccaagcucauggucgaccuccucgccgagcgcaagaccaucuccuacaacaacugcaugauccagcucuucaccacccacuucuucggcggcaucgagaucuucauccucaccggcauggccuacgaccgcuacgucgccaucugcaagccccuccacuacaccaucaucaugucccgccagaagugcaacaccaucaucaucgucugcugcaccggcggcuucauccacuccgccucccaguuccuccucaccaucuucguccccuucugcggccccaacgagaucgaccacuacuucugcgacgucuacccccuccucaagcucgccugcuccaacauccacaugaucggccuccucgucaucgccaacuccggccucaucgcccucgucaccuucgucguccuccuccucuccuacgucuucauccucuacaccauccgcgccuacuccgccgagcgccgcuccaaggcccucgccaccugcuccucccacgucaucgucgucguccucuucuucgcccccgcccucuucaucuacauccgccccgucaccaccuucuccgaggacaaggucuucgcccucuucuacaccaucaucgcccccauguucaacccccucaucuacacccuccgcaacaccgagaugaagaacgccaugcgcaaggucuggugcugccagauccuccucaagcgcaaccagcucuucuga

SEQ ID NO: 47115 - RNA, 936 nt, Artificial Sequence
  derived and/or modified sequence opt2 from OR4S2__Homo_sapiens__NP_001004059
auggagaagaucaacaacgucaccgaguucaucuucuggggccucucccagucccccgagaucgagaaggucugcuucgucgucuucuccuucuucuacaucaucauccuccucggcaaccuccucaucaugcucaccgucugccucuccaaccucuucaagucccccauguacuucuuccucuccuuccucuccuucgucgacaucugcuacuccuccgucaccgcccccaagaugaucgucgaccuccucgccaaggacaagaccaucuccuacgucggcugcaugcuccagcucuucggcguccacuucuucggcugcaccgagaucuucauccucaccgucauggccuacgaccgcuacgucgccaucugcaagccccuccacuacaugaccaucaugaaccgcgagaccugcaacaagaugcuccucggcaccugggucggcggcuuccuccacuccaucauccaggucgcccucgucguccagcuccccuucugcggccccaacgagaucgaccacuacuucugcgacguccaccccguccucaagcucgccugcaccgagaccuacaucgucggcgucgucgucaccgccaacuccggcaccaucgcccucggcuccuucgucauccuccucaucuccuacuccaucauccucgucucccuccgcaagcaguccgccgagggccgccgcaaggcccucuccaccugcggcucccacaucgccauggucgucaucuucuucggccccugcaccuucauguacaugcgccccgacaccaccuucuccgaggacaagauggucgccgucuucuacaccaucaucacccccaugcucaacccccucaucuacacccuccgcaacgccgaggucaagaacgccaugaagaagcucuggggccgcaacgucuuccucgaggccaagggcaaguga

SEQ ID NO: 47116 - RNA, 942 nt, Artificial Sequence
  derived and/or modified sequence opt2 from OR51A2__Homo_sapiens__NP_001004748
auguccaucaucaacaccuccuacgucgagaucaccaccuucuuccucgucggcaugcccggccucgaguacgcccacaucuggaucuccauccccaucugcuccauguaccucaucgccauccucggcaacggcaccauccucuucaucaucaagaccgagcccucccuccacggccccauguacuacuuccucuccaugcucgccauguccgaccucggccucucccucuccucccuccccaccguccucuccaucuuccucuucaacgcccccgagaccuccuccuccgccugcuucgcccaggaguucuucauccacggcuucuccguccucgaguccuccguccuccucaucauguccuucgaccgcuuccucgccauccacaacccccuccgcuacaccuccauccucaccaccguccgcgucgcccagaucggcaucgucuucuccuucaaguccaugcuccucguccuccccuuccccuucacccuccgcucccuccgcuacugcaagaagaaccagcucucccacuccuacugccuccaccaggacgucaugaagcucgccugcuccgacaaccgcaucgacgucaucuacggcuucuucggcgcccucugccucauggucgacuucauccucaucgccgucuccuacacccucauccucaagaccguccccggcaucgccuccaagaaggaggagcucaaggcccucaacaccugcgucucccacaucugcgccgucaucaucuucuaccuccccaucaucaaccucgccgucguccaccgcuucgccggccacgucuccccccucaucaacguccucauggccaacguccuccuccucguccccccccucaugaagcccaucgucuacugcgucaagaccaagcagauccgcguccgcgucgucgccaagcucugccaguggaagaucuga

SEQ ID NO: 47117 - RNA, 939 nt, Artificial Sequence
  derived and/or modified sequence opt2 from OR51A7__Homo_sapiens__NP_001004749
auguccguccucaacaacuccgaggucaagcucuuccuccucaucggcauccccggccucgagcacgcccacaucugguucuccauccccaucugccucauguaccuccucgccaucaugggcaacugcaccauccucuucaucaucaagaccgagcccucccuccacgagcccauguacuacuuccucgccaugcucgccgucuccgacaugggccucucccucuccucccuccccaccaugcuccgcgucuuccucuucaacgccaugggcaucucccccaacgccugcuucgcccaggaguucuucauccacggcuucaccgucauggaguccuccguccuccucaucaugucccucgaccgcuuccucgccauccacaacccccuccgcuacuccuccauccucaccuccaaccgcgucgccaagaugggccucauccucgccauccgcuccauccuccucgucauccccuuccccuucacccuccgccgccucaaguacugccagaagaaccuccucucccacuccuacugccuccaccaggacaccaugaagcucgccugcuccgacaacaagaccaacgucaucuacggcuucuucaucgcccucugcaccaugcucgaccucgcccucaucguccucuccuacguccucauccucaagaccauccucuccaucgccucccucgccgagcgccucaaggcccucaacaccugcgucucccacaucugcgccguccucaccuucuacguccccaucaucacccucgccgccaugcaccacuucgccaagcacaaguccccccucgucgucauccucaucgccgacauguuccuccucguccccccccucaugaaccccaucgucuacugcgucaagacccgccagaucugggagaagauccucggcaagcuccucaacgucugcggccgcuga

SEQ ID NO: 47118 - RNA, 957 nt, Artificial Sequence
  derived and/or modified sequence opt2 from OR51E1__Homo_sapiens__NP_689643
augauggucgaccccaacggcaacgaguccuccgccaccuacuucauccucaucggccuccccggccucgaggaggcccaguucuggcucgccuucccccucugcucccucuaccucaucgccguccucggcaaccucaccaucaucuacaucguccgcaccgagcacucccuccacgagcccauguacaucuuccucugcaugcucuccggcaucgacauccucaucuccaccuccuccaugcccaagaugcucgccaucuucugguucaacuccaccaccauccaguucgacgccugccuccuccagauguucgccauccacucccucuccggcauggaguccaccguccuccucgccauggccuucgaccgcuacgucgccaucugccacccccuccgccacgccaccguccucacccucccccgcgucaccaagaucggcgucgccgccgucguccgcggcgccgcccucauggccccccuccccgucuucaucaagcagcuccccuucugccgcuccaacauccucucccacuccuacugccuccaccaggacgucaugaagcucgccugcgacgacauccgcgucaacgucgucuacggccucaucgucaucaucuccgccaucggccucgacucccuccucaucuccuucuccuaccuccucauccucaagaccguccucggccucacccgcgaggcccaggccaaggccuucggcaccugcgucucccacgucugcgccgucuucaucuucuacguccccuucaucggccucuccaugguccaccgcuucuccaagcgccgcgacuccccccuccccgucauccucgccaacaucuaccuccucgucccccccguccucaaccccaucgucuacggcgucaagaccaaggagauccgccagcgcauccuccgccucuuccacgucgccacccacgccuccgagcccuga

SEQ ID NO: 47119 - RNA, 963 nt, Artificial Sequence
  derived and/or modified sequence opt2 from OR51E2__Homo_sapiens__NP_110401
auguccuccugcaacuucacccacgccaccuucguccucaucggcauccccggccucgagaaggcccacuucugggucggcuucccccuccucuccauguacgucgucgccauguucggcaacugcaucgucgucuucaucguccgcaccgagcgcucccuccacgcccccauguaccucuuccucugcaugcucgccgccaucgaccucgcccucuccaccuccaccaugcccaagauccucgcccucuucugguucgacucccgcgagaucuccuucgaggccugccucacccagauguucuucauccacgcccucuccgccaucgaguccaccauccuccucgccauggccuucgaccgcuacgucgccaucugccacccccuccgccacgccgccguccucaacaacaccgucaccgcccagaucggcaucgucgccgucguccgcggcucccucuucuucuucccccucccccuccucaucaagcgccucgccuucugccacuccaacguccucucccacuccuacugcguccaccaggacgucaugaagcucgccuacgccgacacccuccccaacgucgucuacggccucaccgccauccuccucgucaugggcgucgacgucauguucaucucccucuccuacuuccucaucauccgcaccguccuccagcuccccuccaaguccgagcgcgccaaggccuucggcaccugcgucucccacaucggcgucguccucgccuucuacgucccccucaucggccucuccgucguccaccgcuucggcaacucccuccaccccaucguccgcgucgucaugggcgacaucuaccuccuccucccccccgucaucaaccccaucaucuacggcgccaagaccaagcagauccgcacccgcguccucgccauguucaagaucuccugcgacaaggaccuccaggccgucggcggcaaguga

SEQ ID NO: 47120 - RNA, 1029 nt, Artificial Sequence
  derived and/or modified sequence opt2 from OR51F2__Homo_sapiens__NP_001004753
augaccgagaccucccucuccucccagugcuuccccauguccguccucaacaacaccaucgccgagccccucaucuuccuccucaugggcauccccggccucaaggccacccaguacuggaucuccauccccuucugccuccucuacgucgucgccgucuccggcaacuccaugauccucuucgucguccucugcgagcgcucccuccacaagcccauguacuacuuccucuccaugcucuccgccaccgaccucucccucucccucugcacccucuccaccacccucggcgucuucugguucgaggcccgcgagaucaaccucaacgccugcaucgcccagauguucuuccuccacggcuucaccuucauggaguccggcguccuccucgccauggccuucgaccgcuucgucgccaucugcuacccccuccgcuacaccaccauccucaccaacgcccgcaucgccaagaucggcauguccaugcucauccgcaacgucgccgucaugcuccccgucaugcucuucgucaagcgccucuccuucugcuccuccaugguccucucccacuccuacugcuaccacgucgaccucauccagcucuccugcaccgacaaccgcaucaacuccauccucggccucuucgcccuccucuccaccaccggcuucgacugccccugcauccuccucuccuacauccucaucauccgcuccguccucuccaucgccuccuccgaggagcgccgcaaggccuucaacaccugcaccucccacaucuccgccgucuccaucuucuaccucccccucaucucccucucccucguccaccgcuacggccacuccgccccccccuucguccacaucaucauggccaacgucuuccuccucaucccccccguccucaaccccaucaucuacuccgucaagaucaagcagauccagaaggccaucaucaagguccucauccagaagcacuccaaguccaaccaccagcucuuccucauccgcgacaaggccaucuacgaguga

SEQ ID NO: 47121 - RNA, 966 nt, Artificial Sequence
  derived and/or modified sequence opt2 from OR51V1__Homo_sapiens__NP_001004760
auguuccucuccucccgcaugaucaccuccgucucccccuccaccuccaccaacuccuccuuccuccucaccggcuucuccggcauggagcagcaguaccccuggcucuccauccccuucuccuccaucuacgccaugguccuccucggcaacugcaugguccuccacgucaucuggaccgagcccucccuccaccagcccauguucuacuuccucuccaugcucgcccucaccgaccucugcaugggccucuccaccgucuacaccguccucggcauccucuggggcaucauccgcgagaucucccucgacuccugcaucgcccaguccuacuucauccacggccucuccuucauggaguccuccguccuccucaccauggccuucgaccgcuacaucgccaucugcaacccccuccgcuacuccuccauccucaccaacucccgcaucaucaagaucggccucaccaucaucggccgcuccuucuucuucaucaccccccccaucaucugccucaaguucuucaacuacugccacuuccacauccucucccacuccuucugccuccaccaggaccuccuccgccucgccugcuccgacauccgcuucaacuccuacuacgcccucaugcucgucaucugcauccuccuccucgacgccauccucauccucuucuccuacauccucauccucaaguccguccucgccgucgccucccaggaggagcgccacaagcucuuccagaccugcaucucccacaucugcgccguccucgucuucuacauccccaucaucucccucaccaugguccaccgcuucggcaagcaccucucccccgucgcccacguccucaucggcaacaucuacauccucuuccccccccucaugaaccccaucaucuacuccgucaagacccagcagauccacacccgcaugcuccgccucuucucccucaagcgcuacuga

SEQ ID NO: 47122 - RNA, 972 nt, Artificial Sequence
  derived and/or modified sequence opt2 from OR52B2__Homo_sapiens__NP_001004052
augucccacaccaacgucaccaucuuccaccccgccgucuucguccuccccggcauccccggccucgaggccuaccacaucuggcucuccaucccccucugccucaucuacaucaccgccguccucggcaacuccauccucaucgucgucaucgucauggagcgcaaccuccacguccccauguacuucuuccucuccaugcucgccgucauggacauccuccucuccaccaccaccguccccaaggcccucgccaucuucuggcuccaggcccacaacaucgccuucgacgccugcgucacccagggcuucuucguccacaugauguucgucggcgaguccgccauccuccucgccauggccuucgaccgcuucgucgccaucugcgccccccuccgcuacaccaccguccucaccuggcccgucgucggccgcaucgcccucgccgucaucacccgcuccuucugcaucaucuuccccgucaucuuccuccucaagcgccuccccuucugccucaccaacaucgucccccacuccuacugcgagcacaucggcgucgcccgccucgccugcgccgacaucaccgucaacaucugguacggcuucuccguccccaucgucauggucauccucgacgucauccucaucgccgucuccuacucccucauccuccgcgccgucuuccgccuccccucccaggacgcccgccacaaggcccucuccaccugcggcucccaccucugcgucauccucauguucuacguccccuccuucuucacccuccucacccaccacuucggccgcaacaucccccagcacguccacauccuccucgccaaccucuacgucgccgucccccccaugcucaaccccaucgucuacggcgucaagaccaagcagauccgcgagggcgucgcccaccgcuucuucgacaucaagaccuggugcugcaccuccccccucggcuccuga

SEQ ID NO: 47123 - RNA, 945 nt, Artificial Sequence
  derived and/or modified sequence opt2 from OR52B4__Homo_sapiens__NP_001005161
augcccaccgucaaccacuccggcaccucccacaccgucuuccaccuccucggcauccccggccuccaggaccagcacauguggaucuccauccccuucuucaucuccuacgucaccgcccuccucggcaacucccuccucaucuucaucauccucaccaagcgcucccuccacgagcccauguaccucuuccucugcaugcucgccggcgccgacaucguccucuccaccugcaccaucccccaggcccucgccaucuucugguuccgcgccggcgacaucucccucgaccgcugcaucacccagcucuucuucauccacuccaccuucaucuccgaguccggcauccuccucgucauggccuucgaccacuacaucgccaucugcuacccccuccgcuacaccaccauccucaccaacgcccucaucaagaagaucugcgucaccgucucccuccgcuccuacggcaccaucuuccccaucaucuuccuccucaagcgccucaccuucugccagaacaacaucaucccccacaccuucugcgagcacaucggccucgccaaguacgccugcaacgacauccgcaucaacaucugguacggcuucuccauccucauguccaccgucguccucgacgucguccucaucuucaucuccuacaugcucauccuccacgccgucuuccacaugcccucccccgacgccugccacaaggcccucaacaccuucggcucccacgucugcaucaucauccucuucuacggcuccggcaucuucaccauccucacccagcgcuucggccgccacaucccccccugcauccacaucccccucgccaacgucugcauccucgccccccccaugcucaaccccaucaucuacggcaucaagaccaagcagauccaggagcaggucguccaguuccucuucaucaagcagaaguga

SEQ ID NO: 47124 - RNA, 957 nt, Artificial Sequence
  derived and/or modified sequence opt2 from OR52D1__Homo_sapiens__NP_001005163
auguccgacuccaaccucuccgacaaccaccuccccgacaccuucuuccucaccggcauccccggccucgaggccgcccacuucuggaucgccauccccuucugcgccauguaccucgucgcccucgucggcaacgccgcccucauccucgucaucgccauggacaacgcccuccacgcccccauguaccucuuccucugccuccucucccucaccgaccucgcccucuccuccaccaccguccccaagaugcucgccauccucuggcuccacgccggcgagaucuccuucggcggcugccucgcccagauguucugcguccacuccaucuacgcccucgaguccuccauccuccucgccauggccuucgaccgcuacgucgccaucugcaacccccuccgcuacaccaccauccucaaccacgccgucaucggccgcaucggcuucgucggccucuuccgcuccgucgccaucgucucccccuucaucuuccuccuccgccgccuccccuacugcggccaccgcgucaugacccacaccuacugcgagcacaugggcaucgcccgccucgccugcgccaacaucaccgucaacaucgucuacggccucaccgucgcccuccucgccaugggccucgacuccauccucaucgccaucuccuacggcuucauccuccacgccgucuuccaccuccccucccacgacgcccagcacaaggcccucuccaccugcggcucccacaucggcaucauccucgucuucuacauccccgccuucuucuccuuccucacccaccgcuucggccaccacgagguccccaagcacguccacaucuuccucgccaaccucuacguccucgucccccccguccucaaccccauccucuacggcgcccgcaccaaggagauccgcucccgccuccucaagcuccuccaccucggcaagaccuccaucuga

SEQ ID NO: 47125 - RNA, 942 nt, Artificial Sequence
  derived and/or modified sequence opt2 from OR52E6__Homo_sapiens__NP_001005167
augcccaucgccaacgacacccaguuccacaccuccuccuuccuccuccucggcauccccggccucgaggacguccacaucuggaucggcuuccccuucuucuccgucuaccucaucgcccuccucggcaacgccgccaucuucuucgucauccagaccgagcagucccuccacgagcccauguacuacugccucgccaugcucgacuccaucgaccucucccucuccaccgccaccauccccaagaugcucggcaucuucugguucaacaucaaggagaucuccuucggcggcuaccucucccagauguucuucauccacuucuucaccgucauggaguccaucguccucgucgccauggccuucgaccgcuacaucgccaucugcaagccccucugguacaccaugauccucaccuccaagaucaucucccucaucgccggcaucgccguccuccgcucccucuacauggucaucccccucgucuuccuccuccuccgccuccccuucugcggccaccgcaucaucccccacaccuacugcgagcacaugggcaucgcccgccucgccugcgccuccaucaaggucaacaucauguucggccucggcuccaucucccuccuccuccucgacguccuccucaucauccucucccacauccgcauccucuacgccgucuucugccuccccuccugggaggcccgccucaaggcccucaacaccugcggcucccacaucggcgucauccucgccuucuccacccccgccuucuucuccuucuucacccacugcuucggccacgacaucccccaguacauccacaucuuccucgccaaccucuacgucgucgucccccccacccucaaccccgucaucuacggcguccgcaccaagcacauccgcgagaccguccuccgcaucuucuucaagaccgaccacuga

SEQ ID NO: 47126 - RNA, 975 nt, Artificial Sequence
  derived and/or modified sequence opt2 from OR52I1__Homo_sapiens__NP_001005169
augcucggccccgccuacaaccacaccauggagacccccgccuccuuccuccucgucggcauccccggccuccaguccucccaccucuggcucgccaucucccucuccgccauguacaucaccgcccuccucggcaacacccucaucgucaccgccaucuggauggacuccacccgccacgagcccauguacugcuuccucugcguccucgccgccgucgacaucgucauggccuccuccgucguccccaagauggucuccaucuucugcuccggcgacuccuccaucuccuucuccgccugcuucacccagauguucuucguccaccucgccaccgccgucgagaccggccuccuccucaccauggccuucgaccgcuacgucgccaucugcaagccccuccacuacaagcgcauccucaccccccaggucaugcucggcauguccauggccgucaccauccgcgccgucaccuucaugaccccccucuccuggaugaugaaccaccuccccuucugcggcuccaacgucgucguccacuccuacugcaagcacaucgcccucgcccgccucgccugcgccgaccccguccccuccucccucuacucccucaucggcuccucccucauggucggcuccgacgucgccuucaucgccgccuccuacauccucauccuccgcgccgucuucgaccucuccuccaagaccgcccagcucaaggcccucuccaccugcggcucccacgucggcgucauggcccucuacuaccuccccggcauggccuccaucuacgccgccuggcucggccaggacaucgucccccuccacacccagguccuccucgccgaccucuacgucaucauccccgccacccucaaccccaucaucuacggcaugcgcaccaagcagcuccucgagggcaucugguccuaccucaugcacuuccucuucgaccacuccaaccucggcuccuga

SEQ ID NO: 47127 - RNA, 1053 nt, Artificial Sequence
  derived and/or modified sequence opt2 from OR52I2__Homo_sapiens__NP_001005170
augugccagcagauccuccgcgacugcauccuccucauccaccaccucugcaucaaccgcaagaaggucucccucgucaugcucggccccgccuacaaccacaccauggagacccccgccuccuuccuccucgucggcauccccggccuccaguccucccaccucuggcucgccaucucccucuccgccauguacaucaucgcccuccucggcaacaccaucaucgucaccgccaucuggauggacuccacccgccacgagcccauguacugcuuccucugcguccucgccgccgucgacaucgucauggccuccuccgucguccccaagauggucuccaucuucugcuccggcgacuccuccaucuccuucuccgccugcuucacccagauguucuucguccaccucgccaccgccgucgagaccggccuccuccucaccauggccuucgaccgcuacgucgccaucugcaagccccuccacuacaagcgcauccucaccccccaggucaugcucggcauguccauggccaucaccauccgcgccaucaucgccaucaccccccucuccuggauggucucccaccuccccuucugcggcuccaacgucgucguccacuccuacugcgagcacaucgcccucgcccgccucgccugcgccgaccccguccccuccucccucuacucccucaucggcuccucccucauggucggcuccgacgucgccuucaucgccgccuccuacauccucauccucaaggccgucuucggccucuccuccaagaccgcccagcucaaggcccucuccaccugcggcucccacgucggcgucauggcccucuacuaccuccccggcauggccuccaucuacgccgccuggcucggccaggacgucgucccccuccacacccagguccuccucgccgaccucuacgucaucauccccgccacccucaaccccaucaucuacggcaugcgcaccaagcagcuccgcgagcgcaucugguccuaccucaugcacguccucuucgaccacuccaaccucggcuccuga

SEQ ID NO: 47128 - RNA, 945 nt, Artificial Sequence
  derived and/or modified sequence opt2 from OR52K1__Homo_sapiens__NP_001005171
augcuccccuccaacaucaccuccacccaccccgccgucuuccuccucgucggcauccccggccucgagcaccuccacgccuggaucuccauccccuucugcuucgccuacacccucgcccuccucggcaacugcacccuccucuucaucauccaggccgacgccgcccuccacgagcccauguaccucuuccucgccaugcucgccaccaucgaccucguccucuccuccaccacccuccccaagaugcucgccaucuucugguuccgcgaccaggagaucaacuucuucgccugccucguccagauguucuuccuccacuccuucuccaucauggaguccgccguccuccucgccauggccuucgaccgcuacgucgccaucugcaagccccuccacuacaccaccguccucaccggcucccucaucaccaagaucggcauggccgccgucgcccgcgccgucacccucaugaccccccuccccuuccuccuccgccgcuuccacuacugccgcggccccgucaucgcccacugcuacugcgagcacauggccgucguccgccucgccugcggcgacaccuccuucaacaacaucuacggcaucgccgucgccauguucaucgucguccucgaccuccucuucgucauccucuccuacgucuucauccuccaggccguccuccagcucgccucccaggaggcccgcuacaaggccuucggcaccugcgucucccacaucggcgccauccucuccaccuacacccccgucgucaucuccuccgucaugcaccgcgucgcccgccacgccgccccccgcguccacauccuccucgccaucuucuaccuccucuucccccccauggucaaccccaucaucuacggcgucaagaccaagcagauccgcgaguacguccucucccucuuccagcgcaagaacauguga

SEQ ID NO: 47129 - RNA, 945 nt, Artificial Sequence
  derived and/or modified sequence opt2 from OR52K2__Homo_sapiens__NP_001005172
auguccgccuccaacaucacccucacccaccccaccgccuuccuccucgucggcauccccggccucgagcaccuccacaucuggaucuccauccccuucugccucgccuacacccucgcccuccucggcaacugcacccuccuccucaucauccaggccgacgccgcccuccacgagcccauguaccucuuccucgccaugcucgccgccaucgaccucguccucuccuccuccgcccuccccaagaugcucgccaucuucugguuccgcgaccgcgagaucaacuucuucgccugccucgcccagauguucuuccuccacuccuucuccaucauggaguccgccguccuccucgccauggccuucgaccgcuacgucgccaucugcaagccccuccacuacaccaagguccucaccggcucccucaucaccaagaucggcauggccgccgucgcccgcgccgucacccucaugaccccccuccccuuccuccuccgcugcuuccacuacugccgcggccccgucaucgcccacugcuacugcgagcacauggccgucguccgccucgccugcggcgacaccuccuucaacaacaucuacggcaucgccgucgccauguucaucgucguccucgaccuccuccucgucauccucuccuacaucuucauccuccaggccguccuccuccucgccucccaggaggcccgcuacaaggccuucggcaccugcgucucccacaucggcgccauccucgccuucuacaccaccgucgucaucuccuccgucaugcaccgcgucgcccgccacgccgccccccacguccacauccuccucgccaacuucuaccuccucuucccccccauggucaaccccaucaucuacggcgucaagaccaagcagauccgcgaguccauccucggcgucuucccccgcaaggacauguga

SEQ ID NO: 47130 - RNA, 954 nt, Artificial Sequence
  derived and/or modified sequence opt2 from OR52M1__Homo_sapiens__NP_001004137
augcucaccuuccacaacgucugcuccguccccuccuccuucuggcucaccggcauccccggccucgagucccuccacgucuggcucuccauccccuucggcuccauguaccucgucgccgucgucggcaacgucaccauccucgccgucgucaagaucgagcgcucccuccaccagcccauguacuucuuccucugcaugcucgccgccaucgaccucguccucuccaccuccaccauccccaagcuccucggcaucuucugguucggcgccugcgacaucggccucgacgccugccucggccagauguuccucauccacugcuucgccaccgucgaguccggcaucuuccucgccauggccuucgaccgcuacgucgccaucugcaacccccuccgccacuccaugguccucaccuacaccgucgucggccgccucggccucgucucccuccuccgcggcguccucuacaucggcccccucccccucaugauccgccuccgccucccccucuacaagacccacgucaucucccacuccuacugcgagcacauggccgucgucgcccucaccugcggcgacucccgcgucaacaacgucuacggccucuccaucggcuuccucguccucauccucgacuccgucgccaucgccgccuccuacgucaugaucuuccgcgccgucaugggccucgccacccccgaggcccgccucaagacccucggcaccugcgccucccaccucugcgccauccucaucuucuacguccccaucgccgucuccucccucauccaccgcuucggccagugcguccccccccccguccacacccuccucgccaacuucuaccuccucaucccccccauccucaaccccaucgucuacgccguccgcaccaagcagauccgcgagucccuccuccagaucccccgcaucgagaugaagauccgcuga

SEQ ID NO: 47131 - RNA, 942 nt, Artificial Sequence
  derived and/or modified sequence opt2 from OR5D18__Homo_sapiens__NP_001001952
augcuccucaccgaccgcaacaccuccggcaccaccuucacccuccucggcuucuccgacuaccccgagcuccaggucccccucuuccucgucuuccucgccaucuacaacgucaccguccucggcaacaucggccucaucgucaucaucaagaucaaccccaagcuccacacccccauguacuucuuccucucccagcucuccuucgucgacuucugcuacuccuccaucaucgcccccaagaugcucgucaaccucgucgucaaggaccgcaccaucuccuuccucggcugcgucguccaguucuucuucuucugcaccuucgucgucaccgaguccuuccuccucgccgucauggccuacgaccgcuucgucgccaucugcaacccccuccucuacaccgucaacaugucccagaagcucugcguccuccucgucgucggcuccuacgccuggggcgucuccugcucccucgagcucaccugcuccgcccucaagcucugcuuccacggcuucaacaccaucaaccacuucuucugcgaguucuccucccuccucucccucuccugcuccgacaccuacaucaaccaguggcuccucuucuuccucgccaccuucaacgagaucuccacccuccucaucguccucaccuccuacgccuucaucgucgucaccauccucaagaugcgcuccgucuccggccgccgcaaggccuucuccaccugcgccucccaccucaccgccaucaccaucuuccacggcaccauccucuuccucuacugcguccccaacuccaagaacucccgccacaccgucaaggucgccuccgucuucuacaccgucgucauccccaugcucaacccccucaucuacucccuccgcaacaaggacgucaaggacaccgucaccgagauccucgacaccaaggucuucuccuacuga

SEQ ID NO: 47132 - RNA, 945 nt, Artificial Sequence
  derived and/or modified sequence opt2 from OR5H2__Homo_sapiens__NP_001005482
auguccaacgaggacauggagcaggacaacaccacccuccucaccgaguucguccucaccggccucaccuaccagcccgaguggaagaugccccucuuccucgucuuccucgucaucuaccucaucaccaucgucuggaaccucggccucaucgcccucaucuggaacgacccccagcuccacauccccauguacuucuuccucggcucccucgccuucgucgacgccuggaucuccuccaccgucacccccaagaugcucgucaacuuccucgccaagaaccgcaugaucucccucuccgagugcaugauccaguucuucuccuucgccuucggcggcaccaccgagugcuuccuccucgccaccauggccuacgaccgcuacgucgccaucugcaagccccuccucuaccccgucaucaugaacaacucccucugcauccgccuccucgccuucuccuuccucggcggcuuccuccacgcccucauccacgagguccucaucuuccgccucaccuucugcaacuccaacaucauccaccacuucuacugcgacaucaucccccucuucaugaucuccugcaccgaccccuccaucaacuuccucauggucuucauccucuccggcuccauccaggucuucaccaucgucaccguccucaacuccuacaccuucgcccucuucaccauccucaagaagaaguccguccgcggcguccgcaaggccuucuccaccugcggcgcccaccuccucuccgucucccucuacuacggcccccucaucuucauguaccuccgccccgccuccccccaggccgacgaccaggacaugaucgacuccgucuucuacaccaucaucaucccccuccucaaccccaucaucuacucccuccgcaacaagcaggucaucgacuccuucaccaagauggucaagcgcaacgucuga

SEQ ID NO: 47133 - RNA, 978 nt, Artificial Sequence
  derived and/or modified sequence opt2 from OR5H6__Homo_sapiens__NP_001005479
auguuccucuaccucugcuucaucuuccagcgcaccugcuccgaggagauggaggaggagaacgccacccuccucaccgaguucguccucaccggcuuccuccaccagcccgacugcaagaucccccucuuccucgccuuccucgucaucuaccucaucaccaucaugggcaaccucggccucaucguccucaucuggaaggacccccaccuccacauccccauguaccucuuccucggcucccucgccuucgucgacgccucccucuccuccaccgucacccccaagaugcucaucaacuuccucgccaaguccaagaugaucucccucuccgagugcaugguccaguucuucucccucgucaccaccgucaccaccgagugcuuccuccucgccaccauggccuacgaccgcuacgucgccaucugcaaggcccuccucuaccccgucaucaugaccaacgagcucugcauccagcuccucguccucuccuucaucggcggccuccuccacgcccucauccacgaggccuucuccuuccgccucaccuucugcaacuccaacaucauccagcacuucuacugcgacaucaucccccuccucaagaucuccugcaccgacuccuccaucaacuuccucauggucuucaucuucgccggcuccguccaggucuucaccaucggcaccauccucaucuccuacaccaucauccucuucaccauccucgagaagaaguccaucaagggcauccgcaaggccgucuccaccugcggcgcccaccuccucuccgucucccucuacuacggcccccucaccuucaaguaccucggcuccgccuccccccaggccgacgaccaggacaugauggagucccucuucuacaccgucaucgucccccuccucaaccccaugaucuacucccuccgcaacaagcaggucaucgccuccuucaccaagauguucaaguccaacgucuga

SEQ ID NO: 47134 - RNA, 927 nt, Artificial Sequence
  derived and/or modified sequence opt2 from OR5K1__Homo_sapiens__NP_001004736
auggccgaggagaaccacaccaugaagaacgaguucauccucaccggcuucaccgaccaccccgagcucaagacccuccucuucgucgucuucuucgccaucuaccucaucaccgucgucggcaacaucucccucgucgcccucaucuucacccaccgccgccuccacacccccauguacaucuuccucggcaaccucgcccucgucgacuccugcugcgccugcgccaucacccccaagaugcucgagaacuucuucuccgagaacaagcgcaucucccucuacgagugcgccguccaguucuacuuccucugcaccgucgagaccgccgacugcuuccuccucgccgccauggccuacgaccgcuacgucgccaucugcaacccccuccaguaccacaucaugauguccaagaagcucugcauccagaugaccaccggcgccuucaucgccggcaaccuccacuccaugauccacgucggccucgucuuccgccucgucuucugcggcuccaaccacaucaaccacuucuacugcgacauccucccccucuaccgccucuccugcgucgaccccuacaucaacgagcucguccucuucaucuucuccggcuccguccaggucuucaccaucggcuccguccucaucuccuaccucuacauccuccucaccaucuucaagaugaaguccaaggagggccgcgccaaggccuucuccaccugcgccucccacuuccucuccgucucccucuucuacggcucccucuucuucauguacguccgccccaaccuccucgaggagggcgacaaggacauccccgccgccauccucuucaccaucgucgucccccuccucaaccccuucaucuacucccuccgcaaccgcgaggucaucuccguccuccgcaagauccucaugaagaaguga

SEQ ID NO: 47135 - RNA, 951 nt, Artificial Sequence
  derived and/or modified sequence opt2 from OR5K2__Homo_sapiens__NP_001004737
auggucgaggagaaccacaccaugaagaacgaguucauccucaccggcuucaccgaccaccccgagcucaagacccuccucuucgucgucuucuucgccaucuaccucaucaccgucgucggcaacaucucccucgucgcccucaucuucacccacugccgccuccacacccccauguacaucuuccucggcaaccucgcccucgucgacuccugcugcgccugcgccaucacccccaagaugcucgagaacuucuucuccgagggcaagcgcaucucccucuacgagugcgccguccaguucuacuuccucugcaccgucgagaccgccgacugcuuccuccucgccgccgucgccuacgaccgcuacgucgccaucugcaacccccuccaguaccacaucaugauguccaagaagcucugcauccagaugaccaccggcgccuucaucgccggcaaccuccacuccaugauccacgucggccucgucuuccgccucgucuucugcggccucaaccacaucaaccacuucuacugcgacacccucccccucuaccgccucuccugcgucgaccccuucaucaacgagcucguccucuucaucuucuccggcuccguccaggucuucaccaucggcuccguccucaucuccuaccucuacauccuccucaccaucuuccgcaugaaguccaaggagggccgcgccaaggccuucuccaccugcgccucccacuucuccuccgucucccucuucuacggcuccaucuucuuccucuacauccgccccaaccuccucgaggagggcggcaacgacauccccgccgccauccucuucaccaucgucgucccccuccucaaccccuucaucuacucccuccgcaacaaggaggucaucuccguccuccgcaagauccuccucaagaucaagucccagggcuccgucaacaaguga

SEQ ID NO: 47136 - RNA, 966 nt, Artificial Sequence
  derived and/or modified sequence opt2 from OR5V1__Homo_sapiens__NP_110503
auggagcgcaagaaccagaccgccaucaccgaguucaucauccucggcuucuccaaccucaacgagcuccaguuccuccucuucaccaucuucuuccucaccuacuucugcacccucggcggcaacauccucaucauccucaccaccgucaccgacccccaccuccacacccccauguacuacuuccucggcaaccucgccuucaucgacaucugcuacaccaccuccaacgucccccagaugaugguccaccuccucuccaagaagaaguccaucuccuacgucggcugcgucguccagcucuucgccuucgucuucuucgucggcuccgagugccuccuccucgccgccauggccuacgaccgcuacaucgccaucugcaacccccuccgcuacuccgucauccucuccaagguccucugcaaccagcucgccgccuccugcugggccgccggcuuccucaacuccgucguccacaccguccucaccuucugccuccccuucugcggcaacaaccagaucaacuacuucuucugcgacauccccccccuccucauccucuccugcggcaacaccuccgucaacgagcucgcccuccucuccaccggcgucuucaucggcuggacccccuuccucugcaucguccucuccuacaucugcaucaucuccaccauccuccgcauccaguccuccgagggccgccgcaaggccuucuccaccugcgccucccaccucgccaucgucuuccucuucuacggcuccgccaucuucaccuacguccgccccaucuccaccuacucccucaagaaggaccgccucgucuccguccucuacuccgucgucacccccaugcucaaccccaucaucuacacccuccgcaacaaggacaucaaggaggccgucaagaccaucggcuccaaguggcagccccccaucuccucccucgacuccaagcucaccuacuga

SEQ ID NO: 47137 - RNA, 936 nt, Artificial Sequence
  derived and/or modified sequence opt2 from OR6B1__Homo_sapiens__NP_001005281
auggagcucgagaaccagacccgcgucaccaaguucauccucgucggcuuccccggcucccucuccaugcgcgccgccauguuccucaucuuccucgucgccuacauccucaccgucgccgagaacgucaucaucauccuccucguccuccagaaccgcccccuccacaagcccauguacuucuuccucgccaaccucuccuuccucgagaccugguacaucuccgucaccguccccaagcuccucuucuccuucugguccgucaacaacuccaucuccuucacccucugcaugauccagcucuacuucuucaucgcccucaugugcaccgagugcguccuccucgccgccauggccuacgaccgcuacgucgccaucugccgcccccuccacuaccccaccaucaugucccacggccucugcuuccgccucgcccucggcuccugggccaucggcuucggcaucucccucgccaagaucuacuucaucuccugccucuccuucugcggccccaacgucaucaaccacuucuucugcgacaucucccccguccucaaccucuccugcaccgacauguccaucaccgagcucgucgacuucauccucgcccucgucaucuuccucuucccccucuucaucaccguccucuccuacggcugcauccucgccaccauccucugcaugcccaccggcaagcagaaggccuucuccaccugcgccucccaccucgucgucgucaccaucuucuacuccgccaucaucuucauguacgcccgcccccgcgucauccacgccuucaacaugaacaagaucaucuccaucuucuacgccaucgucacccccucccucaaccccuucaucuacugccuccgcaaccgcgaggucaaggaggcccucaagaagcucgccuacugccaggccucccgcuccgacuga

SEQ ID NO: 47138 - RNA, 939 nt, Artificial Sequence
  derived and/or modified sequence opt2 from OR6B2__Homo_sapiens__NP_001005853
auguccggcgagaacgucaccaaggucuccaccuucauccucgucggccuccccaccgcccccggccuccaguaccuccucuuccuccucuuccuccucaccuaccucuucguccucgucgagaaccucgccaucauccucaucgucugguccuccaccucccuccaccgccccauguacuacuuccucuccuccauguccuuccucgagaucugguacgucuccgacaucacccccaagaugcucgagggcuuccuccuccagcagaagcgcaucuccuucgucggcugcaugacccagcucuacuucuucuccucccucgucugcaccgagugcguccuccucgccuccauggccuacgaccgcuacgucgccaucugccacccccuccgcuaccacguccucgucacccccggccucugccuccagcucgucggcuucuccuucgucuccggcuucaccaucuccaugaucaaggucugcuucaucuccuccgucaccuucugcggcuccaacguccucaaccacuucuucugcgacaucucccccauccucaagcucgccugcaccgacuucuccaccgccgagcucgucgacuucauccucgccuucaucauccucgucuucccccuccucgccaccauccucuccuacuggcacaucacccucgccguccuccgcauccccuccgccaccggcugcuggcgcgccuucuccaccugcgccucccaccucaccgucgucaccgucuucuacaccgcccuccucuucauguacguccgcccccaggccaucgacucccaguccuccaacaagcucaucuccgccgucuacaccgucgucacccccaucaucaacccccucaucuacugccuccgcaacaaggaguucaaggacgcccucaagaaggcccucggccucggccagaccucccacuga

SEQ ID NO: 47139 - RNA, 939 nt, Artificial Sequence
  derived and/or modified sequence opt2 from OR6C1__Homo_sapiens__NP_001005182
augcgcaaccacaccgagaucaccgaguucauccuccucggccucaccgacgaccccaacuuccaggucgucaucuucgucuuccuccucaucaccuacaugcucuccaucaccggcaaccucacccucaucaccaucacccuccucgacucccaccuccagacccccauguacuucuuccuccgcaacuucuccauccucgagaucuccuucaccaccgucuccauccccaaguuccucggcaacaucaucuccggcgacaagaccaucuccuucaacaacugcaucguccagcucuucuucuucauccuccucggcgucaccgaguucuaccuccucgccgccauguccuacgaccgcuacgucgccaucugcaagccccuccacugccucuccaucaugaaccgccgcgucugcacccuccucgucuucaccuccuggcucgucuccuuccucaucaucuuccccgcccucaugcuccuccucaagcuccacuacugccgcuccaacaucaucgaccacuucaccugcgacuacuucccccuccuccagcucgccugcuccgacaccaaguuccucgaggucaugggcuucuccugcgccgccuucacccucauguucacccucgcccucaucuuccucuccuacaucuacaucauccgcaccauccuccgcauccccuccaccucccagcgcaccaaggccuucuccaccugcuccucccacauggucgucgucuccaucuccuacggcuccugcaucuucauguacaucaagcccuccgccaaggaccgcgucucccucuccaagggcgucgccauccucaacaccuccgucgcccccaugaugaaccccuucaucuacucccuccgcaaccagcaggucaagcaggccuucaucaacauggcccgcaagaccgucuucuucaccuccaccuga

SEQ ID NO: 47140 - RNA, 927 nt, Artificial Sequence
  derived and/or modified sequence opt2 from OR6F1__Homo_sapiens__NP_001005286
auggacaccggcaacaagacccucccccaggacuuccuccuccucggcuuccccggcucccagacccuccagcucucccucuucaugcucuuccucgucauguacauccucaccgucuccggcaacgucgccauccucaugcucgucuccaccucccaccagcuccacacccccauguacuucuuccucuccaaccucuccuuccucgagaucugguacaccaccgccgccguccccaaggcccucgccauccuccucggccgcucccagaccaucuccuucaccuccugccuccuccagauguacuucgucuucucccucggcugcaccgaguacuuccuccucgccgccauggccuacgaccgcugccucgccaucugcuacccccuccacuacggcgccaucauguccucccuccucuccgcccagcucgcccucggcuccugggucugcggcuucgucgccaucgccguccccaccgcccucaucuccggccucuccuucugcggcccccgcgccaucaaccacuucuucugcgacaucgcccccuggaucgcccucgccugcaccaacacccaggccgucgagcucgucgccuucgucaucgccgucgucgucauccucuccuccugccucaucaccuucgucuccuacgucuacaucaucuccaccauccuccgcauccccuccgccuccggccgcuccaaggccuucuccaccugcuccucccaccucaccgucguccucaucugguacggcuccaccgucuuccuccacguccgcaccuccaucaaggacgcccucgaccucaucaaggccguccacguccucaacaccgucgucacccccguccucaaccccuucaucuacacccuccgcaacaaggagguccgcgagacccuccucaagaaguggaagggcaaguga

SEQ ID NO: 47141 - RNA, 975 nt, Artificial Sequence
  derived and/or modified sequence opt2 from OR6K2__Homo_sapiens__NP_001005279
auggagucccccaaccgcaccaccauccaggaguucaucuucuccgccuuccccuacuccugggucaaguccgucgucugcuucgucccccuccucuucaucuacgccuucaucgucgucggcaaccucgucaucaucaccgucguccagcucaacacccaccuccacacccccauguacaccuucaucuccgcccucuccuuccucgagaucugguacaccaccgccaccauccccaagaugcucuccucccuccucuccgagcgcuccaucuccuucaacggcugccuccuccagauguacuucuuccacuccaccggcaucugcgaggucugccuccucaccgucauggccuucgaccacuaccucgccaucugcuccccccuccacuaccccuccaucaugacccccaagcucugcacccagcucacccucuccugcugcgucugcggcuucaucaccccccuccccgagaucgccuggaucuccacccuccccuucugcggcuccaaccaccucgagcacaucuucugcgacuuccuccccguccuccgccucgccugcaccgacacccgcgccaucgucaugauccaggucgucgacgucauccacgccgucgagaucaucaccgccgucaugcucaucuucauguccuacgacggcaucgucgccgucauccuccgcauccacuccgccggcggccgccgcaccgccuucuccaccugcgucucccacuucaucgucuucucccucuucuucggcuccgucacccucauguaccuccgcuucuccgccaccuacucccucuucugggacaucgccaucgcccucgccuucgccguccucucccccuucuucaaccccaucaucuacucccuccgcaacaaggagaucaaggaggccaucaagaagcacaucggccaggccaagaucuucuucuccguccgccccggcaccuccuccaagaucuucuga

SEQ ID NO: 47142 - RNA, 948 nt, Artificial Sequence
  derived and/or modified sequence opt2 from OR6K3__Homo_sapiens__NP_001005327
auggaguccggcaaccaguccaccgucaccgaguucaucuucaccggcuucccccagcuccaggacggcucccuccucuacuucuucccccuccucuucaucuacaccuucaucaucaucgacaaccuccucaucuucuccgccguccgccucgacacccaccuccacaaccccauguacaacuucaucuccaucuucuccuuccucgagaucugguacaccaccgccaccauccccaagaugcucuccaaccucaucuccgagaagaaggccaucuccaugaccggcugcauccuccagauguacuucuuccacucccucgagaacuccgagggcauccuccucaccaccauggccaucgaccgcuacgucgccaucugcaacccccuccgcuaccagaugaucaugaccccccgccucugcgcccagcucuccgccggcuccugccucuucggcuuccucauccuccuccccgagaucgucaugaucuccacccuccccuucugcggccccaaccagauccaccagaucuucugcgaccucguccccguccucucccucgccugcaccgacaccuccaugauccucaucgaggacgucauccacgccgucaccaucaucaucaccuuccucaucaucgcccucuccuacguccgcaucgucaccgucauccuccgcauccccuccuccgagggccgccagaaggccuucuccaccugcgccggccaccucauggucuuccccaucuucuucggcuccgucucccucauguaccuccgcuucuccgacaccuacccccccguccucgacaccgccaucgcccucauguucaccguccucgcccccuucuucaaccccaucaucuacucccuccgcaacaaggacaugaacaacgccaucaagaagcucuucugccuccagaagguccucaacaagcccggcggcuga

SEQ ID NO: 47143 - RNA, 1032 nt, Artificial Sequence
  derived and/or modified sequence opt2 from OR6K6__Homo_sapiens__NP_001005184
augaagcaguacuccgucggcaaccagcacuccaacuaccgcucccuccucuuccccuuccucugcucccagaugacccagcucaccgccuccggcaaccagaccauggucaccgaguuccucuucuccauguucccccacgcccaccgcggcggccuccucuucuucaucccccuccuccucaucuacggcuucauccucaccggcaaccucaucauguucaucgucauccaggucggcauggcccuccacaccccccucuacuucuucaucuccguccucuccuuccucgagaucugcuacaccaccaccaccauccccaagaugcucuccugccucaucuccgagcagaaguccaucuccgucgccggcugccuccuccagauguacuucuuccacucccucggcaucaccgaguccugcguccucaccgccauggccaucgaccgcuacaucgccaucugcaacccccuccgcuaccccaccaucaugauccccaagcucugcauccagcucaccgucggcuccugcuucugcggcuuccuccucguccuccccgagaucgccuggaucuccacccuccccuucugcggcuccaaccagauccaccagaucuucugcgacuucacccccguccucucccucgccugcaccgacaccuuccucgucgucaucgucgacgccauccacgccgccgagaucgucgccuccuuccucgucaucgcccucuccuacauccgcaucaucaucgucauccucggcaugcacuccgccgagggccaccacaaggccuucuccaccugcgccgcccaccucgccgucuuccuccucuucuucggcuccgucgccgucauguaccuccgcuucuccgccaccuacuccgucuucugggacaccgccaucgccgucaccuucgucauccucgcccccuucuucaaccccaucaucuacucccucaagaacaaggacaugaaggaggccaucggccgccucuuccacuaccagaagcgcgccggcugggccggcaaguga

SEQ ID NO: 47144 - RNA, 939 nt, Artificial Sequence
  derived and/or modified sequence opt2 from OR6N1__Homo_sapiens__NP_001005185
auggacaccggcaacuggucccaggucgccgaguucaucauccucggcuucccccaccuccagggcguccagaucuaccucuuccuccuccuccuccucaucuaccucaugaccguccucggcaaccuccucaucuuccucgucgucugccucgacucccgccuccacacccccauguaccacuucgucuccauccucuccuucuccgagcucggcuacaccgccgccaccauccccaagaugcucgccaaccuccucuccgagaagaagaccaucuccuucuccggcugccuccuccagaucuacuucuuccacucccucggcgccaccgagugcuaccuccucaccgccauggccuacgaccgcuaccucgccaucugccgcccccuccacuaccccacccucaugacccccacccucugcgccgagaucgccaucggcugcuggcucggcggccucgccggccccgucgucgagaucucccucaucucccgccuccccuucugcggccccaaccgcauccagcacgucuucugcgacuucccccccguccucucccucgccugcaccgacaccuccaucaacguccucgucgacuucgucaucaacuccugcaagauccucgccaccuuccuccucauccucugcuccuacguccagaucaucugcaccguccuccgcauccccuccgccgccggcaagcgcaaggccaucuccaccugcgccucccacuucaccgucguccucaucuucuacggcuccauccucuccauguacguccagcucaagaaguccuacucccucgacuacgaccaggcccucgccgucgucuacuccguccucacccccuuccucaaccccuucaucuacucccuccgcaacaaggagaucaaggaggccguccgccgccagcucaagcgcaucggcauccucgccuga

SEQ ID NO: 47145 - RNA, 954 nt, Artificial Sequence
  derived and/or modified sequence opt2 from OR6N2__Homo_sapiens__NP_001005278
auggaccaguacaaccacuccucccucgccgaguucgucuuccucggcuucgccuccgucggcuacguccgcggcuggcucuucguccuccuccuccucgccuaccucuucaccaucugcggcaacaugcucaucuucuccgucauccgccucgacgccgcccuccacacccccauguaccacuucgucuccguccucuccuuccucgagcucugguacaccgccaccaccauccccaagaugcucuccaacauccucuccgagaagaagaccaucuccuucgccggcugccuccuccagaccuacuucuuccacucccucggcgccuccgagugcuaccuccucaccgccauggccuacgaccgcuaccucgccaucugccgcccccuccacuaccccaucaucaugaccaccacccucugcgccaagauggccgccgccugcuggaccugcggcuuccucugccccaucuccgaggucauccucgccucccagcuccccuucugcgccuacaacgagauccagcacaucuucugcgacuuccccccccuccucucccucgccugcaaggacaccuccgccaacauccucgucgacuucgccaucaacgccuucaucauccucaucaccuucuucuucaucaugaucuccuacgcccgcaucaucggcgccguccucaagaucaagaccgccuccggccgcaagaaggccuucuccaccugcgccucccaccucgccgucguccucaucuucuucggcuccaucaucuucauguacguccgccucaagaaguccuacucccucacccucgaccgcacccucgccaucgucuacuccguccucacccccauggucaaccccaucaucuacucccuccgcaacaaggagaucaucaaggccaucaagcgcaccaucuuccagaagggcgacaaggccucccucgcccaccucuga

SEQ ID NO: 47146 - RNA, 939 nt, Artificial Sequence
  derived and/or modified sequence opt2 from OR6X1__Homo_sapiens__NP_001005188
augcgcaacggcaccgucaucaccgaguucauccuccucggcuuccccgucauccagggccuccagaccccccucuucaucgccaucuuccucaccuacauccucacccucgccggcaacggccucaucaucgccaccgucugggccgagccccgccuccagauccccauguacuucuuccucugcaaccucuccuuccucgagaucugguacaccaccaccgucauccccaagcuccucggcaccuucgucgucgcccgcaccgucaucugcauguccugcugccuccuccaggccuucuuccacuucuucgucggcaccaccgaguuccucauccucaccaucauguccuucgaccgcuaccucaccaucugcaacccccuccaccaccccaccaucaugaccuccaagcucugccuccagcucgcccucuccuccugggucgucggcuucaccaucgucuucugccagaccaugcuccucauccagcuccccuucugcggcaacaacgucaucucccacuucuacugcgacgucggccccucccucaaggccgccugcaucgacaccuccauccucgagcuccucggcgucaucgccaccauccucgucauccccggcucccuccucuucaacaugaucuccuacaucuacauccucuccgccauccuccgcauccccuccgccaccggccaccagaagaccuucuccaccugcgccucccaccucaccgucgucucccuccucuacggcgccguccucuucauguaccuccgccccaccgcccacuccuccuucaagaucaacaaggucgucuccguccucaacaccauccucaccccccuccucaaccccuucaucuacaccauccgcaacaaggaggucaagggcgcccuccgcaaggccaugaccugccccaagaccggccacgccaaguga

SEQ ID NO: 47147 - RNA, 978 nt, Artificial Sequence
  derived and/or modified sequence opt2 from OR6Y1__Homo_sapiens__NP_001005189
augaccaccaucauccucgaggucgacaaccacaccgucaccacccgcuucauccuccucggcuuccccacccgccccgccuuccagcuccucuucuucuccaucuuccucgccaccuaccuccucacccuccucgagaaccuccucaucauccucgccauccacuccgacggccagcuccacaagcccauguacuucuuccucucccaccucuccuuccucgagaugugguacgucaccgucaucucccccaagaugcucgucgacuuccucucccacgacaaguccaucuccuucaacggcugcaugacccagcucuacuucuucgucaccuucgucugcaccgaguacauccuccucgccaucauggccuucgaccgcuacgucgccaucugcaacccccuccgcuaccccgucaucaugaccaaccagcucugcggcacccucgccggcggcugcugguucugcggccucaugaccgccaugaucaagauggucuucaucgcccagcuccacuacugcggcaugccccagaucaaccacuacuucugcgacaucuccccccuccucaacgucuccugcgaggacgccucccaggccgagauggucgacuucuuccucgcccucauggucaucgccaucccccucugcgucgucgucgccuccuacgccgccauccucgccaccauccuccgcauccccuccgcccagggccgccagaaggccuucuccaccugcgccucccaccucaccgucgucauccucuucuacuccaugacccucuucaccuacgcccgccccaagcucauguacgccuacaacuccaacaaggucgucuccguccucuacaccgucaucgucccccuccucaaccccaucaucuacugccuccgcaaccacgaggucaaggccgcccuccgcaagaccauccacugccgcggcuccggcccccagggcaacggcgccuucuccuccuga

SEQ ID NO: 47148 - RNA, 963 nt, Artificial Sequence
  derived and/or modified sequence opt2 from OR7C1__Homo_sapiens__NP_945182
auggagaccggcaaccagacccacgcccaggaguuccuccuccucggcuucuccgccaccuccgagauccaguucauccucuucggccucuuccucuccauguaccucgucaccuucaccggcaaccuccucaucauccucgccaucugcuccgacucccaccuccacacccccauguacuucuuccucuccaaccucuccuucgccgaccucugcuucaccuccaccaccguccccaagaugcuccucaacauccucacccagaacaaguucaucaccuacgccggcugccucucccagaucuucuucuucaccuccuucggcugccucgacaaccuccuccucaccgucauggccuacgaccgcuucgucgccgucugccacccccuccacuacaccgucaucaugaacccccagcucugcggccuccucguccucggcuccuggugcaucuccgucaugggcucccuccucgagacccucaccguccuccgccucuccuucugcaccgagauggagaucccccacuucuucugcgaccuccucgagguccucaagcucgccugcuccgacaccuucaucaacaacgucgucaucuacuucgccaccggcguccucggcgucaucuccuucaccggcaucuucuucuccuacuacaagaucgucuucuccauccuccgcaucuccuccgccggccgcaagcacaaggccuucuccaccugcggcucccaccucuccgucgucacccucuucuacggcaccggcuucggcgucuaccucuccuccgccgccacccccuccucccgcaccucccucgucgccuccgucauguacaccauggucacccccaugcucaaccccuucaucuacucccuccgcaacaccgacaugaagcgcgcccucggccgccuccucucccgcgccaccuucuucaacggcgacaucaccgccggccucuccuga

SEQ ID NO: 47149 - RNA, 939 nt, Artificial Sequence
  derived and/or modified sequence opt2 from OR7D2__Homo_sapiens__NP_787079
auggaggccggcaaccagaccggcuuccucgaguucauccuccucggccucuccgaggaccccgagcuccagcccuucaucuucggccucuuccucuccauguaccucgucaccguccucggcaaccuccucaucauccucgccaucuccuccgacucccaccuccacacccccauguacuucuuccucuccaaccucuccugggucgacaucugcuucuccaccugcaucguccccaagaugcucgucaacauccagaccgagaacaaggccaucuccuacauggacugccucacccaggucuacuucuccauguucuuccccauccucgacacccuccuccucaccgucauggccuacgaccgcuucgucgccgucugccacccccuccacuacaugaucaucaugaacccccaccucugcggccuccucgucuucgucaccuggcucaucggcgucaugaccucccuccuccacaucucccucaugaugcaccucaucuucugcaaggacuucgagaucccccacuucuucugcgagcucaccuacauccuccagcucgccugcuccgacaccuuccucaacuccacccucaucuacuucaugaccggcguccucggcgucuucccccuccucggcaucaucuucuccuacucccgcaucgccuccuccauccgcaagauguccuccuccggcggcaagcagaaggcccucuccaccugcggcucccaccucuccgucgucucccucuucuacggcaccggcaucggcguccacuucaccuccgccgucacccacuccucccagaagaucuccgucgccuccgucauguacaccgucgucacccccaugcucaaccccuucaucuacucccuccgcaacaaggacgucaagggcgcccucggcucccuccucucccgcgccgccuccugccucuga

SEQ ID NO: 47150 - RNA, 1020 nt, Artificial Sequence
  derived and/or modified sequence opt2 from OR7E24__Homo_sapiens__NP_001073404
auguccuacuuccccauccucuucuucuucuuccucaagcgcugccccuccuacaccgagccccagaaccucaccggcgucuccgaguuccuccuccucggccucuccgaggaccccgagcuccagcccguccucgccggccucuuccucuccauguaccucgucaccguccucggcaaccuccucaucauccucgccgucuccuccgacucccaccuccacacccccauguacuucuuccucuccaaccucucccucgccgacaucggcuucaccuccaccaccguccccaagaugaucgucgacaugcagacccacucccgcgucaucuccuacgagggcugccucacccagauguccuucuucguccucuucgccugcauggacgacaugcuccucuccgucauggccuacgaccgcuucgucgccaucugccacccccuccacuaccgcaucaucaugaacccccgccucugcggcuuccucauccuccucuccuucuucaucucccuccucgacucccagcuccacaaccucaucaugcuccagcucaccugcuucaaggacgucgacaucuccaacuucuucugcgaccccucccagcuccuccaccuccgcugcuccgacaccuucaucaacgagauggucaucuacuucaugggcgccaucuucggcugccuccccaucuccggcauccucuucuccuacuacaagaucgucucccccauccuccgcguccccaccuccgacggcaaguacaaggccuucuccaccugcggcucccaccucgccgucgucugccucuucuacggcaccggccucgucggcuaccucuccuccgccguccuccccuccccccgcaaguccauggucgccuccgucauguacaccgucgucacccccaugcucaaccccuucaucuacucccuccgcaacaaggacauccaguccgcccucugccgccuccacggccgcaucaucaagucccaccaccuccaccccuucugcuacaugggcuga

SEQ ID NO: 47151 - RNA, 1080 nt, Artificial Sequence
  derived and/or modified sequence opt2 from OR8S1__Homo_sapiens__NP_001005203
auggcccucggcaaccacuccaccaucaccgaguuccuccuccucggccucuccgccgaccccaacauccgcgcccuccucuucguccucuuccucggcaucuaccuccucaccaucauggagaaccucaugcuccuccucaugauccgcgccgacuccugccuccacaagcccauguacuucuuccucucccaccucuccuucgucgaccucugcuucuccuccgucaucguccccaagaugcucgagaaccuccucucccagcgcaagaccaucuccgucgagggcugccucgcccaggucuucuucgucuucgucaccgccggcaccgaggccugccuccucuccggcauggccuacgaccgccacgccgccaucugccgcccccuccucuacggccagaucaugggcaagcagcucuacaugcaccucgucuggggcuccuggggccucggcuuccucgacgcccucaucaacguccuccucgccgucaacauggucuucugcgaggccaagaucauccaccacuacuccuacgagaugcccucccuccucccccucuccugcuccgacaucucccgcucccucaucgcccuccucugcuccacccuccuccacggccucggcaacuuccuccucgucuuccucuccuacacccgcaucaucuccaccauccucuccaucuccuccaccuccggccgcuccaaggccuucuccaccugcuccgcccaccucaccgccgucacccucuacuacggcuccggccuccuccgccaccucaugcccaacuccggcucccccaucgagcucaucuucuccguccaguacaccgucgucacccccaugcucaacucccucaucuacucccucaagaacaaggaggucaagggcgagcgcucccuccgcgacuccucccaccucccccagcuccacaagggccaggcccgcuggaagcgccccgccuucaccgagggccgccgcgagcccggccaccccgagcucuccauccccgucaccccccagccccagggcgccugcgccugcuccgcccuccgcgccgcccccaccgcccuccccuga

SEQ ID NO: 47152 - RNA, 1008 nt, Artificial Sequence
  derived and/or modified sequence opt2 from OR9K2__Homo_sapiens__NP_001005243
augcucggcuccaagccccgcguccaccucuacauccuccccugcgccucccagcaggucuccaccaugggcgaccgcggcaccuccaaccacuccgagaugaccgacuucauccucgccggcuuccgcguccgccccgagcuccacauccuccucuuccuccucuuccucuucgucuacgccaugauccuccucggcaacgucggcaugaugaccaucaucaugaccgacccccgccucaacacccccauguacuucuuccucggcaaccucuccuucaucgaccucuucuacuccuccgucaucgagcccaaggccaugaucaacuucugguccgagaacaaguccaucuccuucgccggcugcgucgcccagcucuuccucuucgcccuccucaucgucaccgagggcuuccuccucgccgccauggccuacgaccgcuucaucgccaucugcaacccccuccucuacuccguccagauguccacccgccucugcacccagcucgucgccggcuccuacuucugcggcugcaucuccuccgucauccagaccuccaugaccuucacccucuccuucugcgccucccgcgccgucgaccacuucuacugcgacucccgcccccuccagcgccucuccugcuccgaccucuucauccaccgcaugaucuccuucucccucuccugcaucaucauccuccccaccaucaucgucaucaucgucuccuacauguacaucgucuccaccguccucaagauccacuccaccgagggccacaagaaggccuucuccaccugcuccucccaccucggcgucgucuccguccucuacggcgccgucuucuucauguaccucacccccgaccgcuuccccgagcucuccaaggucgccucccucugcuacucccucgucacccccaugcucaacccccucaucuacucccuccgcaacaaggacguccaggaggcccucaagaaguuccucgagaagaagaacaucauccucuga

SEQ ID NO: 47153 - RNA, 945 nt, Artificial Sequence
  derived and/or modified sequence opt2 from OR9Q2__Homo_sapiens__NP_001005283
auggccgagcgcaacuacaccgucgucaccgaguucuuccucaccgccuucaccgagcaccuccaguggcgcgucccccucuuccucaucuuccucuccuucuaccucgccaccaugcucggcaacaccggcaugauccuccucauccgcggcgaccgccgccuccacacccccauguacuucuuccucucccaccucucccucgucgacaucugcuacuccuccgccaucaucccccagaugcucgccguccucugggagcacggcaccaccaucucccaggcccgcugcgccgcccaguucuuccucuucaccuucuucgccuccaucgacugcuaccuccucgccaucauggccuacgaccgcuacaccgccgucugccagccccuccucuacgucaccaucaucaccgagaaggcccgcuggggccucgucaccggcgccuacgucgccggcuucuucuccgccuucguccgcaccgucaccgccuucacccucuccuucugcggcaacaacgagaucaacuucaucuucugcgaccuccccccccuccucaagcucuccugcggcgacuccuacacccaggaggucgucaucaucgucuucgcccucuucgucaugcccgccugcauccucgucauccucgucuccuaccucuucaucaucgucgccauccuccagauccacuccgccggcggccgcgccaagaccuucuccaccugcgccucccaccucaccgccgucgcccucuucuucggcacccucaucuucauguaccuccgcgacaacaccggccaguccuccgagggcgaccgcgucgucuccguccucuacaccgucgucacccccaugcucaacccccucaucuacucccuccgcaacaaggaggucaaggaggccacccgcaaggcccucuccaaguccaagcccgcccgccgccccuga

SEQ ID NO: 47154 - RNA, 906 nt, Artificial Sequence
  derived and/or modified sequence opt2 from ORAI1__Homo_sapiens__NP_116179
augcaccccgagcccgcccccccccccucccgcuccucccccgagcucccccccuccggcggcuccaccaccuccggcucccgccgcucccgccgccgcuccggcgacggcgagccccccggcgcccccccccccccccccuccgccgucaccuaccccgacuggaucggccaguccuacuccgaggucaugucccucaacgagcacuccaugcaggcccucuccuggcgcaagcucuaccucucccgcgccaagcucaaggccuccucccgcaccuccgcccuccucuccggcuucgccauggucgccauggucgagguccagcucgacgccgaccacgacuacccccccggccuccucaucgccuucuccgccugcaccaccguccucgucgccguccaccucuucgcccucaugaucuccaccugcauccuccccaacaucgaggccgucuccaacguccacaaccucaacuccgucaaggaguccccccacgagcgcaugcaccgccacaucgagcucgccugggccuucuccaccgucaucggcacccuccucuuccucgccgaggucguccuccucugcugggucaaguuccucccccucaagaagcagcccggccagccccgccccaccuccaagccccccgccuccggcgccgccgccaacgucuccaccuccggcaucacccccggccaggccgccgccaucgccuccaccaccaucaugguccccuucggccucaucuucaucgucuucgccguccacuucuaccgcucccucgucucccacaagaccgaccgccaguuccaggagcucaacgagcucgccgaguucgcccgccuccaggaccagcucgaccaccgcggcgaccacccccucacccccggcucccacuacgccuga

SEQ ID NO: 47155 - RNA, 888 nt, Artificial Sequence
  derived and/or modified sequence opt2 from ORAI3__Homo_sapiens__NP_689501
augaagggcggcgagggcgacgccggcgagcaggccccccucaaccccgagggcgagucccccgccggcuccgccaccuaccgcgaguucguccaccgcggcuaccucgaccucaugggcgccucccagcacucccuccgcgcccucuccuggcgccgccucuaccucucccgcgccaagcucaaggccuccucccgcaccuccgcccuccucuccggcuucgccauggucgccauggucgagguccagcucgaguccgaccacgaguacccccccggccuccucgucgccuucuccgccugcaccaccguccucgucgccguccaccucuucgcccucauggucuccaccugccuccucccccacaucgaggccgucuccaacauccacaaccucaacuccguccaccaguccccccaccagcgccuccaccgcuacgucgagcucgccuggggcuucuccaccgcccucggcaccuuccucuuccucgccgaggucguccucgucggcugggucaaguucguccccaucggcgccccccucgacacccccacccccaugguccccaccucccgcguccccggcacccucgcccccgucgccaccucccucucccccgccuccaaccucccccgcuccuccgccuccgccgcccccucccaggccgagcccgccugccccccccgccaggccugcggcggcggcggcgcccacggccccggcuggcaggccgccauggccuccaccgccaucaugguccccgucggccucgucuucgucgccuucgcccuccacuucuaccgcucccucgucgcccacaagaccgaccgcuacaagcaggagcucgaggagcucaaccgccuccagggcgagcuccaggccgucuga

SEQ ID NO: 47156 - RNA, 414 nt, Artificial Sequence
  derived and/or modified sequence opt2 from ORAOV1__Homo_sapiens__NP_703152
auggccggcucccaggacaucuucgacgccaucgucauggccgacgagcgcuuccacggcgagggcuaccgcgagggcuacgaggagggcuccucccucggcgucauggagggccgccagcacggcacccuccacggcgccaagaucggcuccgagaucggcugcuaccagggcuucgccuucgccuggaagugccuccuccacuccugcaccaccgagaaggacucccgcaagaugaagguccucgagucccucaucggcaugauccagaaguuccccuacgacgaccccaccuacgacaagcuccacgaggaccucgacaagauccgcggcaaguucaagcaguucugcucccuccucaacguccagcccgacuucaagaucuccgccgagggcuccggccucuccuucuga

SEQ ID NO: 47157 - RNA, 1734 nt, Artificial Sequence
  derived and/or modified sequence opt2 from ORC2__Homo_sapiens__NP_006181
auguccaagcccgagcucaaggaggacaagaugcucgagguccacuucgucggcgacgacgacguccucaaccacauccucgaccgcgagggcggcgccaagcucaagaaggagcgcgcccagcuccucgucaaccccaagaagaucaucaagaagcccgaguacgaccucgaggaggacgaccaggagguccucaaggaccagaacuacgucgagaucaugggccgcgacguccaggagucccucaagaacggcuccgccaccggcggcggcaacaaggucuacuccuuccagaaccgcaagcacuccgagaagauggccaagcucgccuccgagcucgccaagaccccccagaaguccgucuccuucucccucaagaacgaccccgagaucaccaucaacgucccccaguccuccaagggccacuccgccuccgacaagguccagcccaagaacaacgacaaguccgaguuccucuccaccgccccccgcucccuccgcaagcgccucaucgucccccgcucccacuccgacuccgaguccgaguacuccgccuccaacuccgaggacgacgagggcgucgcccaggagcacgaggaggacaccaacgccgucaucuucucccagaagauccaggcccagaaccgcgucgucuccgcccccgucggcaaggagacccccuccaagcgcaugaagcgcgacaagaccuccgaccucgucgaggaguacuucgaggcccacuccuccuccaagguccucaccuccgaccgcacccuccagaagcucaagcgcgccaagcucgaccagcagacccuccgcaaccuccucuccaaggucucccccuccuucuccgccgagcucaagcagcucaaccagcaguacgagaagcucuuccacaaguggaugcuccagcuccaccucggcuucaacaucguccucuacggccucggcuccaagcgcgaccuccucgagcgcuuccgcaccaccaugcuccaggacuccauccacgucgucaucaacggcuucuuccccggcaucuccgucaaguccguccucaacuccaucaccgaggagguccucgaccacaugggcaccuuccgcuccauccucgaccagcucgacuggaucgucaacaaguucaaggaggacuccucccucgagcucuuccuccucauccacaaccucgacucccagaugcuccgcggcgagaagucccagcagaucaucggccagcucuccucccuccacaacaucuaccucaucgccuccaucgaccaccucaacgccccccucaugugggaccacgccaagcagucccucuucaacuggcucugguacgagaccaccaccuacucccccuacaccgaggagaccuccuacgagaacucccuccucgucaagcaguccggcucccucccccucuccucccucacccacguccuccgcucccucacccccaacgcccgcggcaucuuccgccuccucaucaaguaccagcucgacaaccaggacaaccccuccuacaucggccucuccuuccaggacuucuaccagcagugccgcgaggccuuccucgucaacuccgaccucacccuccgcgcccagcucaccgaguuccgcgaccacaagcucauccgcaccaagaagggcaccgacggcgucgaguaccuccucauccccgucgacaacggcacccucaccgacuuccucgagaaggaggaggaggaggccuga

SEQ ID NO: 47158 - RNA, 1707 nt, Artificial Sequence
  derived and/or modified sequence opt2 from ORC3__Homo_sapiens__NP_001184188
augaagcacuuccuccagaagcucaucucccagcucauggacugcugcgucgacaucaaguccaaggaggaggaguccguccacgucacccagcgcaagacccacuacuccauggacucccucuccuccugguacaugaccgucacccagaagaccgaccccaagaugcucuccaagaagcgcaccaccuccucccaguggcaguccccccccgucgucgucauccucaaggacauggaguccuucgccaccaagguccuccaggacuucaucaucaucuccucccagcaccuccacgaguucccccucauccucaucuucggcaucgccaccucccccaucaucauccaccgccuccucccccacgccgucuccucccuccucugcaucgagcucuuccagucccucuccugcaaggagcaccucaccaccguccucgacaagcuccuccucaccacccaguuccccuucaagaucaacgagaagguccuccagguccucaccaacaucuuccucuaccacgacuucuccguccagaacuucaucaagggccuccagcucucccuccucgagcacuucuacucccagccccucuccguccucugcugcaaccuccccgaggccaagcgccgcaucaacuuccucuccaacaaccagugcgagaacauccgccgccuccccuccuuccgccgcuacgucgagaagcaggccuccgagaagcaggucgcccuccucaccaacgagcgcuaccucaaggaggagacccagcuccuccucgagaaccuccacgucuaccacaugaacuacuuccucguccuccgcugccuccacaaguucaccuccucccuccccaaguacccccucggccgccagauccgcgagcucuacugcaccugccucgagaagaacaucugggacuccgaggaguacgccuccguccuccagcuccuccgcaugcucgccaaggacgagcucaugaccauccucgagaagugcuucaaggucuucaaguccuacugcgagaaccaccucggcuccaccgccaagcgcaucgaggaguuccucgcccaguuccagucccucgacgagaccaaggaggaggaggacgccuccggcucccagcccaagggccuccagaagaccgaccucuaccaccuccagaagucccuccucgagaugaaggagcuccgccgcuccaagaagcagaccaaguucgagguccuccgcgagaacgucgucaacuucaucgacugccucguccgcgaguaccuccucccccccgagacccagccccuccacgaggucgucuacuucuccgccgcccacgcccuccgcgagcaccucaacgccgccccccgcaucgcccuccacaccgcccucaacaaccccuacuacuaccucaagaacgaggcccucaaguccgaggagggcugcauccccaacaucgcccccgacaucugcaucgccuacaagcuccaccucgagugcucccgccucaucaaccucgucgacugguccgaggccuucgccaccgucgucaccgccgccgagaagauggacgccaacuccgccaccuccgaggagaugaacgagaucauccacgcccgcuucauccgcgccgucuccgagcucgagcuccucggcuucaucaagcccaccaagcagaagaccgaccacgucgcccgccucaccuggggcggcugcuga

SEQ ID NO: 47159 - RNA, 1059 nt, Artificial Sequence
  derived and/or modified sequence opt2 from ORC4__Homo_sapiens__NP_001177810
auggagaucgaggaggucuccgagaacguccuccagguccaccucaacggccuccuccagaucaacgacaagaucgcccucaaggagaucacccgccagcucaaccucgagaacgucgucggcgacaaggucuucggcuccuucgccgagaaccucuccuuccuccucgaggcccucaagaagggcgaccgcaccuccuccugccccgucaucuucauccucgacgaguucgaccucuucgcccaccacaagaaccagacccuccucuacaaccucuucgacaucucccaguccgcccagacccccaucgccgucaucggccucaccugccgccucgacauccucgagcuccucgagaagcgcgucaagucccgcuucucccaccgccagauccaccucaugaacuccuucggcuucccccaguacgucaagaucuucaaggagcagcucucccuccccgccgaguuccccgacaaggucuucgccgagaaguggaacgagaacguccaguaccucuccgaggaccgcuccguccaggagguccuccagaagcacuucaacaucuccaagaaccuccgcucccuccacaugcuccucaugcucgcccucaaccgcgucaccgccucccaccccuucaugaccgccgucgaccucauggaggccucccagcucugcuccauggacuccaaggccaacaucguccacggccucuccguccucgagaucugccucaucaucgccaugaagcaccucaacgacaucuacgaggaggagcccuucaacuuccagauggucuacaacgaguuccagaaguucguccagcgcaaggcccacuccgucuacaacuucgagaagcccgucgucaugaaggccuucgagcaccuccagcagcucgagcucaucaagcccauggagcgcaccuccggcaacucccagcgcgaguaccagcucaugaagcuccuccucgacaacacccagaucaugaacgcccuccagaaguaccccaacugccccaccgacguccgccagugggccaccuccucccucuccuggcucuga

SEQ ID NO: 47160 - RNA, 1308 nt, Artificial Sequence
  derived and/or modified sequence opt2 from ORC5__Homo_sapiens__NP_002544
augccccaccucgagaacgucguccucugccgcgagucccaggucuccauccuccagucccucuucggcgagcgccaccacuucuccuuccccuccaucuucaucuacggccacaccgccuccggcaagaccuacgucacccagacccuccucaagacccucgagcucccccacgucuucgucaacugcgucgagugcuucacccuccgccuccuccucgagcagauccucaacaagcucaaccaccucuccuccuccgaggacggcugcuccaccgagaucaccugcgagaccuucaacgacuucguccgccucuucaagcaggucaccaccgccgagaaccucaaggaccagaccgucuacaucguccucgacaaggccgaguaccuccgcgacauggaggccaaccuccuccccggcuuccuccgccuccaggagcucgccgaccgcaacgucaccguccucuuccucuccgagaucgucugggagaaguuccgccccaacaccggcugcuucgagcccuucguccucuacuuccccgacuacuccaucggcaaccuccagaagauccucucccacgaccacccccccgaguacuccgccgacuucuacgccgccuacaucaacauccuccucggcgucuucuacaccgucugccgcgaccucaaggagcuccgccaccucgccguccucaacuuccccaaguacugcgagcccgucgucaagggcgaggccuccgagcgcgacacccgcaagcucuggcgcaacaucgagccccaccucaagaaggccaugcagaccgucuaccuccgcgagaucuccuccucccagugggagaagcuccagaaggacgacaccgaccccggccagcucaagggccucuccgcccacacccacgucgagcuccccuacuacuccaaguucauccucaucgccgccuaccucgccuccuacaaccccgcccgcaccgacaagcgcuucuuccucaagcaccacggcaagaucaagaagaccaacuuccucaagaagcacgagaagaccuccaaccaccuccucggccccaagcccuucccccucgaccgccuccucgccauccucuacuccaucgucgacucccgcgucgcccccaccgccaacaucuucucccagaucaccucccucgucacccuccagcuccucacccucgucggccacgacgaccagcucgacggccccaaguacaagugcaccgucucccucgacuucauccgcgccaucgcccgcaccgucaacuucgacaucaucaaguaccucuacgacuuccucuga

SEQ ID NO: 47161 - RNA, 759 nt, Artificial Sequence
  derived and/or modified sequence opt2 from ORC6__Homo_sapiens__NP_055136
augggcuccgagcucaucggccgccucgccccccgccucggccucgccgagcccgacaugcuccgcaaggccgaggaguaccuccgccucucccgcgucaagugcgucggccucuccgcccgcaccaccgagaccuccuccgccgucaugugccucgaccucgccgccuccuggaugaagugcccccucgaccgcgccuaccucaucaagcucuccggccucaacaaggagaccuaccaguccugccucaaguccuucgagugccuccucggccucaacuccaacaucggcauccgcgaccucgccguccaguucuccugcaucgaggccgucaacauggccuccaagauccucaaguccuacgaguccucccucccccagacccagcaggucgaccucgaccucucccgcccccucuucaccuccgccgcccuccucuccgccugcaagauccucaagcucaaggucgacaagaacaagauggucgccaccuccggcgucaagaaggccaucuucgaccgccucugcaagcagcucgagaagaucggccagcaggucgaccgcgagcccggcgacgucgccacccccccccgcaagcgcaagaagaucgucgucgaggcccccgccaaggagauggagaaggucgaggagaugccccacaagccccagaaggacgaggaccucacccaggacuacgaggaguggaagcgcaagauccucgagaacgccgccuccgcccagaaggccaccgccgaguga

SEQ ID NO: 47162 - RNA, 606 nt, Artificial Sequence
  derived and/or modified sequence opt2 from ORM1__Homo_sapiens__NP_000598
auggcccucuccuggguccucaccguccucucccuccucccccuccucgaggcccagaucccccucugcgccaaccucguccccguccccaucaccaacgccacccucgaccgcaucaccggcaagugguucuacaucgccuccgccuuccgcaacgaggaguacaacaaguccguccaggagauccaggccaccuucuucuacuucacccccaacaagaccgaggacaccaucuuccuccgcgaguaccagacccgccaggaccagugcaucuacaacaccaccuaccucaacguccagcgcgagaacggcaccaucucccgcuacgucggcggccaggagcacuucgcccaccuccucauccuccgcgacaccaagaccuacaugcucgccuucgacgucaacgacgagaagaacuggggccucuccgucuacgccgacaagcccgagaccaccaaggagcagcucggcgaguucuacgaggcccucgacugccuccgcauccccaaguccgacgucgucuacaccgacuggaagaaggacaagugcgagccccucgagaagcagcacgagaaggagcgcaagcaggaggagggcgaguccuga

SEQ ID NO: 47163 - RNA, 606 nt, Artificial Sequence
  derived and/or modified sequence opt2 from ORM2__Homo_sapiens__NP_000599
auggcccucuccuggguccucaccguccucucccuccucccccuccucgaggcccagaucccccucugcgccaaccucguccccguccccaucaccaacgccacccucgaccgcaucaccggcaagugguucuacaucgccuccgccuuccgcaacgaggaguacaacaaguccguccaggagauccaggccaccuucuucuacuucacccccaacaagaccgaggacaccaucuuccuccgcgaguaccagacccgccagaaccagugcuucuacaacuccuccuaccucaacguccagcgcgagaacggcaccgucucccgcuacgagggcggccgcgagcacgucgcccaccuccucuuccuccgcgacaccaagacccucauguucggcuccuaccucgacgacgagaagaacuggggccucuccuucuacgccgacaagcccgagaccaccaaggagcagcucggcgaguucuacgaggcccucgacugccucugcaucccccgcuccgacgucauguacaccgacuggaagaaggacaagugcgagccccucgagaagcagcacgagaaggagcgcaagcaggaggagggcgaguccuga

SEQ ID NO: 47164 - RNA, 462 nt, Artificial Sequence
  derived and/or modified sequence opt2 from ORMDL3__Homo_sapiens__NP_001307731
augaacgucggcaccgcccacuccgaggucaaccccaacacccgcgucaugaacucccgcggcaucuggcucuccuacguccucgccaucggccuccuccacaucguccuccucuccauccccuucgucuccguccccgucgucuggacccucaccaaccucauccacaacaugggcauguacaucuuccuccacaccgucaagggcacccccuucgagacccccgaccagggcaaggcccgccuccucacccacugggagcagauggacuacggcguccaguucaccgccucccgcaaguuccucaccaucacccccaucguccucuacuuccucaccuccuucuacaccaaguacgaccagauccacuucguccucaacaccgucucccucauguccguccucauccccaagcucccccagcuccacggcguccgcaucuucggcaucaacaaguacuga

SEQ ID NO: 47165 - RNA, 1839 nt, Artificial Sequence
  derived and/or modified sequence opt2 from OS9__Homo_sapiens__NP_001017956
auggccgccgagacccuccucuccucccuccucggccuccuccuccucggccuccuccuccccgccucccucaccggcggcgucggcucccucaaccucgaggagcucuccgagaugcgcuacggcaucgagauccucccccuccccgucaugggcggccagucccaguccuccgacgucgucaucgucuccuccaaguacaagcagcgcuacgagugccgccuccccgccggcgccauccacuuccagcgcgagcgcgaggaggagacccccgccuaccagggccccggcauccccgagcuccucucccccaugcgcgacgcccccugccuccucaagaccaaggacugguggaccuacgaguucugcuacggccgccacauccagcaguaccacauggaggacuccgagaucaagggcgagguccucuaccucggcuacuaccaguccgccuucgacugggacgacgagaccgccaaggccuccaagcagcaccgccucaagcgcuaccacucccagaccuacggcaacggcuccaagugcgaccucaacggccgcccccgcgaggccgagguccgcuuccucugcgacgagggcgccggcaucuccggcgacuacaucgaccgcgucgacgagccccucuccugcuccuacguccucaccauccgcaccccccgccucugcccccacccccuccuccgccccccccccuccgccgccccccaggccauccucugccaccccucccuccagcccgaggaguacauggccuacguccagcgccaggccgacuccaagcaguacggcgacaagaucaucgaggagcuccaggaccucggcccccaggucugguccgagaccaaguccggcgucgccccccagaagauggccggcgccucccccaccaaggacgacuccaaggacuccgacuucuggaagaugcucaacgagcccgaggaccaggcccccggcggcgaggagguccccgccgaggagcaggaccccucccccgaggccgccgacuccgccuccggcgcccccaacgacuuccagaacaacguccaggucaaggucauccgcucccccgccgaccucauccgcuucaucgaggagcucaagggcggcaccaagaagggcaagcccaacaucggccaggagcagcccgucgacgacgccgccgaggucccccagcgcgagcccgagaaggagcgcggcgaccccgagcgccagcgcgagauggaggaggaggaggacgaggacgaggacgaggacgaggacgaggacgagcgccagcuccucggcgaguucgagaaggagcucgagggcauccuccuccccuccgaccgcgaccgccuccgcuccgaggucaaggccggcauggagcgcgagcucgagaacaucauccaggagaccgagaaggagcucgaccccgacggccucaagaaggaguccgagcgcgaccgcgccaugcucgcccucaccuccacccucaacaagcucaucaagcgccucgaggagaagcagucccccgagcucgucaagaagcacaagaagaagcgcgucguccccaagaagcccccccccuccccccagcccaccggcaagaucgagaucaagaucguccgccccugggccgagggcaccgaggagggcgcccgcuggcucaccgacgaggacacccgcaaccucaaggagaucuucuucaacauccucguccccggcgccgaggaggcccagaaggagcgccagcgccagaaggagcucgaguccaacuaccgccgcgucuggggcucccccggcggcgagggcaccggcgaccucgacgaguucgacuucuga

SEQ ID NO: 47166 - RNA, 2253 nt, Artificial Sequence
  derived and/or modified sequence opt2 from OSBP2__Homo_sapiens__NP_001269667
augcaccgccagcgcacccgcaccauguccucccucgccgccaagcgccucggcaugaaccgccgccccgccggcuccggcggcggcggcggcgaggccgccaccuggggccaccgcuucuggcgcccccaggagcgccccaccgaccgcaaccagggcgagauggcccacaccugccgcggcaccaucaaccucuccaccgcccacaucgacaccgaggacuccugcggcauccuccucaccuccggcgcccgcuccuaccaccucaaggccuccuccgaggucgaccgccagcaguggaucaccgcccucgagcucgccaaggccaaggccguccgcgucaugaacacccacuccgacgacuccggcgacgacgacgaggccaccacccccgccgacaaguccgagcuccaccacacccucaagaaccucucccucaagcucgacgaccucuccaccugcaacgaccucaucgccaagcacggcgccgcccuccagcgcucccucaccgagcucgacggccucaagauccccuccgaguccggcgagaagcucaaggucgucaacgagcgcgccacccucuuccgcaucaccuccaacgccaugaucaacgccugccgcgacuuccucgagcucgccgagauccacucccgcaaguggcagcgcgcccuccaguacgagcaggagcagcgcguccaccucgaggagaccaucgagcagcucgccaagcagcacaacucccucgagcgcgccuuccacuccgcccccggccgccccgccaaccccuccaaguccuucaucgagggcucccuccucacccccaagggcgaggacuccgaggaggacgaggacaccgaguacuucgacgccauggaggacuccaccuccuucaucaccgucaucaccgaggccaaggaggaccgcaaggccgagggcuccaccggcaccuccuccgucgacugguccuccgccgacaacguccucgacggcgccucccucguccccaagggcuccuccaaggucaagcgccgcguccgcauccccaacaagcccaacuacucccucaaccucugguccaucaugaagaacugcaucggccgcgagcucucccgcauccccaugcccgucaacuucaacgagccccucuccaugcuccagcgccucaccgaggaccucgaguaccaccaccuccucgacaaggccguccacugcaccuccuccgucgagcagaugugccucgucgccgccuucuccgucuccuccuacuccaccaccguccaccgcaucgccaagcccuucaaccccaugcucggcgagaccuucgagcucgaccgccucgacgacaugggccuccgcucccucugcgagcaggucucccaccacccccccuccgccgcccacuacgucuucuccaagcacggcuggucccucuggcaggagaucaccaucuccuccaaguuccgcggcaaguacaucuccaucaugccccucggcgccauccaccucgaguuccaggccuccggcaaccacuacgucuggcgcaaguccaccuccaccguccacaacaucaucgucggcaagcucuggaucgaccaguccggcgacaucgagaucgucaaccacaagaccaacgaccgcugccagcucaaguuccuccccuacuccuacuucuccaaggaggccgcccgcaaggucaccggcgucgucuccgacucccagggcaaggcccacuacguccucuccggcuccugggacgagcagauggagugcuccaaggucaugcacuccucccccuccucccccuccuccgacggcaagcagaagaccgucuaccagacccucuccgccaagcuccucuggaagaaguacccccuccccgagaacgccgagaacauguacuacuucuccgagcucgcccucacccucaacgagcacgaggagggcgucgcccccaccgacucccgccuccgccccgaccagcgccucauggagaagggccgcugggacgaggccaacaccgagaagcagcgccucgaggagaagcagcgccucucccgccgccgccgccucgaggccugcggccccggcuccuccugcuccuccgaggaggagaaggaggccgacgccuacaccccccucugguucgagaagcgccucgacccccucaccggcgagauggccugcgucuacaagggcggcuacugggaggccaaggagaagcaggacuggcacaugugccccaacaucuucuga

SEQ ID NO: 47167 - RNA, 2424 nt, Artificial Sequence
  derived and/or modified sequence opt2 from OSBP__Homo_sapiens__NP_002547
auggccgccaccgagcuccgcggcgucgucggccccggccccgccgccaucgccgcccucggcggcggcggcgccggcccccccgucgucggcggcggcggcggccgcggcgacgccggccccggcuccggcgccgccuccggcaccgucgucgccgccgccgccggcggccccggccccggcgccggcggcgucgccgccgccggccccgcccccgccccccccaccggcggcuccggcggcuccggcgccggcggcuccggcuccgcccgcgagggcuggcucuucaaguggaccaacuacaucaagggcuaccagcgccgcugguucguccucuccaacggccuccucuccuacuaccgcuccaaggccgagaugcgccacaccugccgcggcaccaucaaccucgccaccgccaacaucaccgucgaggacuccugcaacuucaucaucuccaacggcggcgcccagaccuaccaccucaaggccuccuccgaggucgagcgccagcgcugggucaccgcccucgagcucgccaaggccaaggccgucaagaugcucgccgaguccgacgaguccggcgacgaggaguccgucucccagaccgacaagaccgagcuccagaacacccuccgcacccucuccuccaaggucgaggaccucuccaccugcaacgaccucaucgccaagcacggcaccgcccuccagcgcucccucuccgagcucgagucccucaagcuccccgccgaguccaacgagaagaucaagcaggucaacgagcgcgccacccucuuccgcaucaccuccaacgccaugaucaacgccugccgcgacuuccucaugcucgcccagacccacuccaagaaguggcagaagucccuccaguacgagcgcgaccagcgcauccgccucgaggagacccucgagcagcucgccaagcagcacaaccaccucgagcgcgccuuccgcggcgccaccguccuccccgccaacacccccggcaacgucggcuccggcaaggaccagugcugcuccggcaagggcgacauguccgacgaggacgacgagaacgaguucuucgacgcccccgagaucaucaccaugcccgagaaccucggccacaagcgcaccggcuccaacaucuccggcgccuccuccgacaucucccucgacgagcaguacaagcaccagcucgaggagaccaagaaggagaagcgcacccgcauccccuacaagcccaacuacucccucaaccucugguccaucaugaagaacugcaucggcaaggagcucuccaagauccccaugcccgucaacuucaacgagccccucuccaugcuccagcgccucaccgaggaccucgaguaccacgagcuccucgaccgcgccgccaagugcgagaacucccucgagcagcucugcuacgucgccgccuucaccgucuccuccuacuccaccaccgucuuccgcaccuccaagcccuucaacccccuccucggcgagaccuucgagcucgaccgccucgaggagaacggcuaccgcucccucugcgagcaggucucccaccacccccccgccgccgcccaccacgccgaguccaagaacggcuggacccuccgccaggagaucaagaucaccuccaaguuccgcggcaaguaccucuccaucaugccccucggcaccauccacugcaucuuccacgccaccggccaccacuacaccuggaagaaggucaccaccaccguccacaacaucaucgucggcaagcucuggaucgaccaguccggcgagaucgacaucgucaaccacaagaccggcgacaagugcaaccucaaguucguccccuacuccuacuucucccgcgacgucgcccgcaaggucaccggcgaggucaccgaccccuccggcaagguccacuucgcccuccucggcaccugggacgagaagauggagugcuucaagguccagcccgucaucggcgagaacggcggcgacgcccgccagcgcggccacgaggccgaggagucccgcgucaugcucuggaagcgcaacccccuccccaagaacgccgagaacauguacuacuucuccgagcucgcccucacccucaacgccugggaguccggcaccgcccccaccgacucccgccuccgccccgaccagcgccucauggagaacggccgcugggacgaggccaacgccgagaagcagcgccucgaggagaagcagcgccucucccgcaagaagcgcgaggccgaggccaugaaggccaccgaggacggcacccccuacgaccccuacaaggcccucugguucgagcgcaagaaggaccccgucaccaaggagcucacccacaucuaccgcggcgaguacugggagugcaaggagaagcaggacugguccuccugccccgacaucuucuga

SEQ ID NO: 47168 - RNA, 2103 nt, Artificial Sequence
  derived and/or modified sequence opt2 from OSBPL10__Homo_sapiens__NP_001167531
auggagcgcgccguccagggcaccgacggcggcggcggcuccaacuccuccucccgcuccuccucccgcgccaccuccgccggcuccucccccuccugcucccucgccggccgcggcgucuccucccgcuccgccgccgccggccucggcggcggcggcucccgcuccucccccggcuccgucgccgccucccccuccggcggcggcggccgccgccgcgagcccgcccucgagggcguccucuccaaguacaccaaccuccuccagggcuggcagaaccgcuacuucguccucgacuucgaggccggcauccuccaguacuucgucaacgagcaguccaagcaccagaagccccgcggcguccucucccucuccggcgccaucgucucccucuccgacgaggccccccacaugcucgucgucuacuccgccaacggcgagauguucaagcuccgcgccgccgacgccaaggagaagcaguucugggucacccagcuccgcgccugcgccaaguaccacauggagaugaacuccaagaugaugaaccaggucgagggccagcagaagaaccucguccacgccaucgagucccuccccggcuccggcccccucaccgcccucgaccaggaccuccuccuccucaaggccaccuccgccgccacccucuccugccucggcgagugccucaaccuccuccagcaguccguccaccaggccggccagcccucccagaagcccggcgccuccgagaacauccucggcuggcacggcuccaagucccacuccaccgagcagcucaagaacggcacccucggcucccuccccuccgccuccgccaacaucaccugggccauccuccccaacuccgccgaggacgagcagaccucccagcccgagcccgagcccaacuccggcuccgagcucguccucuccgaggacgagaaguccgacaacgaggacaaggaggagaccgagcucggcgucauggaggaccagcgcuccaucauccuccaccucaucucccagcucaagcucggcauggaccucaccaaggucguccuccccaccuucauccucgagaagcgcucccuccucgagauguacgccgacuucauggcccaccccgaccuccuccucgccaucaccgccggcgccacccccgaggagcgcgucaucugcuucgucgaguacuaccucaccgccuuccacgagggccgcaagggcgcccucgccaagaagcccuacaaccccaucaucggcgagaccuuccacugcuccugggagguccccaaggaccgcgucaagcccaagcgcaccgccucccgcucccccgccuccugccacgagcaccccauggccgacgaccccuccaaguccuacaagcuccgcuucgucgccgagcaggucucccaccacccccccaucuccugcuucuacugcgagugcgaggagaagcgccucugcgucaacacccacgucuggaccaaguccaaguucaugggcauguccgucggcgucuccaugaucggcgagggcguccuccgccuccucgagcacggcgaggaguacgucuucacccuccccuccgccuacgcccgcuccauccucaccauccccugggucgagcucggcggcaaggucuccaucaacugcgccaagaccggcuacuccgccaccgucaucuuccacaccaagcccuucuacggcggcaagguccaccgcgucaccgccgaggucaagcacaaccccaccaacaccaucgucugcaaggcccacggcgaguggaacggcacccucgaguucaccuacaacaacggcgagaccaaggucaucgacaccaccacccuccccgucuaccccaagaagauccgcccccucgagaagcagggccccauggagucccgcaaccucuggcgcgaggucacccgcuaccuccgccucggcgacaucgacgccgccaccgagcagaagcgccaccucgaggagaagcagcgcgucgaggagcgcaagcgcgagaaccuccgcacccccuggaagcccaaguacuucauccaggagggcgacggcugggucuacuucaacccccucuggaaggcccacuga

SEQ ID NO: 47169 - RNA, 2244 nt, Artificial Sequence
  derived and/or modified sequence opt2 from OSBPL11__Homo_sapiens__NP_073613
augcagggcggcgagcccgucuccaccaugaaggucuccgaguccgagggcaagcucgagggccaggccaccgccgucacccccaacaagaacuccuccugcggcggcggcaucuccuccuccuccuccucccgcggcggcuccgccaagggcuggcaguacuccgaccacauggagaacgucuacggcuaccucaugaaguacaccaaccucgucaccggcuggcaguaccgcuucuucguccucaacaacgaggccggccuccucgaguacuucgucaacgagcagucccgcaaccagaagccccgcggcacccuccagcucgccggcgccgucaucucccccuccgacgaggacucccacaccuucaccgucaacgccgccuccggcgagcaguacaagcuccgcgccaccgacgccaaggagcgccagcacugggucucccgccuccagaucugcacccagcaccacaccgaggccaucggcaagaacaaccccccccucaagucccgcuccuucucccucgccuccuccuccaacucccccaucucccagcgccgccccucccagaacgccaucuccuucuucaacgucggccacuccaagcuccagucccucuccaagcgcaccaaccucccccccgaccaccucgucgagguccgcgagaugaugucccacgccgagggccagcagcgcgaccucauccgccgcaucgagugccuccccaccuccggccaccucuccucccucgaccaggaccuccucaugcucaaggccaccuccauggccaccaugaacugccucaacgacugcuuccacauccuccagcuccagcacgccucccaccagaagggcucccuccccuccggcaccaccaucgaguggcucgagcccaagaucucccucuccaaccacuacaagaacggcgccgaccagcccuucgccaccgaccaguccaagcccgucgccguccccgaggagcagcccgucgccgaguccggccuccucgcccgcgagcccgaggagaucaacgccgacgacgagaucgaggacaccugcgaccacaaggaggacgaccucggcgccgucgaggagcagcgcuccgucauccuccaccuccucucccagcucaagcucggcauggaccucacccgcgucguccuccccaccuucauccucgagaagcgcucccuccucgagauguacgccgacuucaugucccaccccgaccucuucaucgccaucaccaacggcgccaccgccgaggaccgcaugauccgcuucgucgaguacuaccucaccuccuuccacgagggccgcaagggcgccaucgccaagaagcccuacaaccccaucaucggcgagaccuuccacugcuccuggaagaugcccaaguccgaggucgccuccuccgucuucuccuccuccuccacccagggcgucaccaaccacgccccccucuccggcgagucccucacccaggucggcuccgacugcuacaccguccgcuucgucgccgagcaggucucccaccacccccccgucuccggcuucuacgccgagugcaccgagcgcaagaugugcgucaacgcccacgucuggaccaaguccaaguuccucggcauguccaucggcgucaccauggucggcgagggcauccucucccuccucgagcacggcgaggaguacaccuucucccuccccugcgccuacgcccgcuccauccucaccguccccugggucgagcucggcggcaaggucuccgucaacugcgccaagaccggcuacuccgccuccaucaccuuccacaccaagcccuucuacggcggcaagcuccaccgcgucaccgccgaggucaagcacaacaucaccaacaccgucgucugccgcguccagggcgaguggaacuccguccucgaguucaccuacuccaacggcgagaccaaguacgucgaccucaccaagcucgccgucaccaagaagcgcguccgcccccucgagaagcaggaccccuucgagucccgccgccucuggaagaacgucaccgacucccuccgcgaguccgagaucgacaaggccaccgagcacaagcacacccucgaggagcgccagcgcaccgaggagcgccaccgcaccgagaccggcacccccuggaagaccaaguacuucaucaaggagggcgacggcugggucuaccacaagccccucuggaagaucauccccaccacccagcccgccgaguga

SEQ ID NO: 47170 - RNA, 1314 nt, Artificial Sequence
  derived and/or modified sequence opt2 from OSBPL1A__Homo_sapiens__NP_060500
auguccgaggagaaggacugcggcggcggcgacgcccucuccaacggcaucaagaagcaccgcaccucccuccccucccccauguucucccgcaacgacuucuccaucugguccauccuccgcaagugcaucggcauggagcucuccaagaucaccaugcccgucaucuucaacgagccccucuccuuccuccagcgccucaccgaguacauggagcacaccuaccucauccacaaggccuccucccucuccgaccccgucgagcgcaugcagugcgucgccgccuucgccgucuccgccgucgccucccagugggagcgcaccggcaagcccuucaacccccuccucggcgagaccuacgagcucguccgcgacgaccucggcuuccgccucaucuccgagcaggucucccaccacccccccaucuccgccuuccacgccgagggccucaacaacgacuucaucuuccacggcuccaucuaccccaagcucaaguucuggggcaaguccgucgaggccgagcccaagggcaccaucacccucgagcuccucgagcacaacgaggccuacaccuggaccaaccccaccugcugcguccacaacaucaucgucggcaagcucuggaucgagcaguacggcaacgucgagaucaucaaccacaagaccggcgacaagugcguccucaacuucaagcccugcggccucuucggcaaggagcuccacaaggucgagggcuacauccaggacaaguccaagaagaagcucugcgcccucuacggcaaguggaccgagugccucuacuccgucgaccccgccaccuucgacgccuacaagaagaacgacaagaagaacaccgaggagaagaagaacuccaagcagauguccaccuccgaggagcucgacgagaugcccguccccgacuccgaguccgucuucaucauccccggcuccguccuccucuggcgcaucgccccccgcccccccaacuccgcccagauguacaacuucaccuccuucgccaugguccucaacgaggucgacaaggacauggaguccgucauccccaagaccgacugccgccuccgccccgacauccgcgccauggagaacggcgagaucgaccaggccuccgaggagaagaagcgccucgaggagaagcagcgcgccgcccgcaagaaccgcuccaaguccgaggaggacuggaagacccgcugguuccaccagggccccaaccccuacaacggcgcccaggacuggaucuacuccggcuccuacugggaccgcaacuacuucaaccuccccgacaucuacuga

SEQ ID NO: 47171 - RNA, 1113 nt, Artificial Sequence
  derived and/or modified sequence opt2 from OSBPL2__Homo_sapiens__NP_001265578
augcccaucgccuucaacgagccccucuccuuccuccagcgcaucaccgaguacauggagcacgucuaccucauccaccgcgccuccugccagccccagccccucgagcgcaugcaguccgucgccgccuucgccgucuccgccgucgccucccagugggagcgcaccggcaagcccuucaacccccuccucggcgagaccuacgagcucauccgcgaggaccucggcuuccgcuucaucuccgagcaggucucccaccacccccccaucuccgccuuccacuccgagggccucaaccacgacuuccucuuccacggcuccaucuaccccaagcucaaguucuggggcaaguccgucgaggccgagccccgcggcaccaucacccucgagcuccucaagcacaacgaggccuacaccuggaccaaccccaccugcugcguccacaacgucaucaucggcaagcucuggaucgagcaguacggcaccgucgagauccucaaccaccgcaccggccacaagugcguccuccacuucaagcccugcggccucuucggcaaggagcuccacaaggucgagggccacauccaggacaagaacaagaagaagcucuucaugaucuacggcaaguggaccgagugccucuggggcaucgaccccgucuccuacgaguccuucaagaagcaggagcgccgcggcgaccaccuccgcaaggccaagcucgacgaggacuccggcaaggccgacuccgacgucgccgacgacguccccgucgcccaggagaccguccaggucauccccggcuccaagcuccucuggcgcaucaacacccgcccccccaacuccgcccagaucuggcccgcccgccgccgcuccggcuggcgccgcucccgcgagaagcacggcggcuccggcccccgccgccgccaguccggccgccgcggcggcuccacccaggccaucacccccacccucggcccccccaccggcugcaugcagggcaucacccucuccggcaucucccccaccgcccagaucuccaccgagggccucgagggccccggcgcccgcgaccgccgccucacccgccucgacuuccucgaguggccccucuga

SEQ ID NO: 47172 - RNA, 2664 nt, Artificial Sequence
  derived and/or modified sequence opt2 from OSBPL3__Homo_sapiens__NP_056365
augauguccgacgagaagaaccucggcgucucccagaagcucgucucccccucccgcuccaccuccuccugcuccuccaagcagggcucccgccaggacuccugggaggucgucgagggccuccgcggcgagaugaacuacacccaggagccccccguccagaagggcuuccuccucaagaagcgcaaguggccccucaagggcuggcacaagcgcuucuucuaccucgacaagggcauccucaaguacgccaagucccagaccgacaucgagcgcgagaagcuccacggcugcaucgacgucggccucuccgucauguccgucaagaaguccuccaagugcaucgaccucgacaccgaggagcacaucuaccaccucaaggucaaguccgaggaggucuucgacgagugggucuccaagcuccgccaccaccgcauguaccgccagaacgagaucgccauguucccccacgaggucaaccacuucuucuccggcuccaccaucaccgacuccuccuccggcgucuucgacuccaucuccucccgcaagcgcuccuccaucuccaagcagaaccucuuccagaccggcuccaacgucuccuucuccugcggcggcgagacccgcgucccccucuggcuccaguccuccgaggacauggagaagugcuccaaggaccucgcccacugccacgccuaccucgucgagaugucccagcuccuccaguccauggacguccuccaccgcaccuacuccgcccccgccaucaacgccauccagggcggcuccuucgagucccccaagaaggagaagcgcucccaccgccgcuggcgcucccgcgccaucggcaaggacgccaagggcacccuccagguccccaagcccuucuccggccccguccgccuccacuccuccaaccccaaccucuccacccucgacuucggcgaggagaagaacuacuccgacggcuccgagaccuccuccgaguucuccaagaugcaggaggaccucugccacaucgcccacaaggucuacuucacccuccgcuccgccuucaacaucauguccgccgagcgcgagaagcucaagcagcucauggagcaggacgccuccuccucccccuccgcccaggucaucggccucaagaacgcccucuccuccgcccucgcccagaacaccgaccucaaggagcgccuccgccgcauccacgccgagucccuccuccucgacucccccgccgucgccaaguccggcgacaaccucgccgaggagaacucccgcgacgagaaccgcgcccucguccaccagcucuccaacgagucccgccucuccaucaccgacucccucuccgaguucuucgacgcccaggagguccuccucucccccuccuccuccgagaacgagaucuccgacgacgacuccuacgucuccgacaucuccgacaaccucucccucgacaaccucuccaacgaccucgacaacgagcgccagacccucggccccguccucgacuccggccgcgaggccaagucccgccgccgcaccugccuccccgcccccugccccuccuccuccaacaucucccucuggaacauccuccgcaacaacaucggcaaggaccucuccaaggucgccaugcccgucgagcucaacgagccccucaacacccuccagcgccucugcgaggagcucgaguacuccgagcuccucgacaaggccgcccagauccccuccccccucgagcgcauggucuacgucgccgccuucgccaucuccgccuacgccuccuccuacuaccgcgccggcuccaagcccuucaaccccguccucggcgagaccuacgagugcauccgcgaggacaagggcuuccaguucuucuccgagcaggucucccaccacccccccaucuccgccugccacgccgagucccgcaacuucgucuucuggcaggacguccgcuggaagaacaaguucuggggcaaguccauggagaucguccccaucggcaccacccacgucacccuccccgucuucggcgaccacuucgaguggaacaaggucaccuccugcauccacaacauccucuccggccagcgcuggaucgagcacuacggcgagaucgucaucaagaaccuccacgacgacuccugcuacugcaaggucaacuucaucaaggccaaguacugguccaccaacgcccacgagaucgagggcaccgucuucgaccgcuccggcaaggccguccaccgccucuucggcaaguggcacgaguccaucuacugcggcggcggcuccuccuccgccugcgucuggcgcgccaaccccaugcccaagggcuacgagcaguacuacuccuucacccaguucgcccucgagcucaacgagauggaccccuccuccaagucccuccucccccccaccgacacccgcuuccgccccgaccagcgcuuccucgaggagggcaaccucgaggaggccgagauccagaagcagcgcaucgagcagcuccagcgcgagcgccgccgcguccucgaggagaaccacgucgagcaccagccccgcuucuuccgcaaguccgacgacgacuccugggucuccaacggcaccuaccucgagcuccgcaaggaccucggcuucuccaagcucgaccaccccguccucugguga

SEQ ID NO: 47173 - RNA, 2640 nt, Artificial Sequence
  derived and/or modified sequence opt2 from OSBPL5__Homo_sapiens__NP_065947
augaaggaggaggccuuccuccgccgccgcuucucccucugcccccccuccuccaccccccagaaggucgacccccgcaagcucacccgcaaccuccuccucuccggcgacaacgagcucuacccccucucccccggcaaggacauggagcccaacggccccucccucccccgcgacgagggcccccccacccccuccuccgccaccaaggucccccccgccgaguaccgccucugcaacggcuccgacaaggagugcgucucccccaccgcccgcgucaccaagaaggagacccucaaggcccagaaggagaacuaccgccaggagaagaagcgcgccacccgccagcuccucuccgcccucaccgaccccuccgucgucaucauggccgacucccucaagauccgcggcacccucaaguccuggaccaagcucuggugcguccucaagcccggcguccuccucaucuacaagacccccaaggucggccagugggucggcaccguccuccuccacugcugcgagcucaucgagcgccccuccaagaaggacggcuucugcuucaagcucuuccacccccucgaccaguccgucugggccgucaagggccccaagggcgaguccgucggcuccaucacccagccccuccccuccuccuaccucaucuuccgcgccgccuccgaguccgacggccgcugcuggcucgacgcccucgagcucgcccuccgcugcuccucccuccuccgccucggcaccugcaagcccggccgcgacggcgagcccggcaccucccccgacgccucccccuccucccucugcggccuccccgccuccgccaccguccaccccgaccaggaccucuucccccucaacggcuccucccucgagaacgacgccuucuccgacaaguccgagcgcgagaaccccgaggaguccgacaccgagacccaggaccacucccgcaagaccgaguccggcuccgaccaguccgagacccccggcgcccccguccgccgcggcaccaccuacgucgagcagguccaggaggagcucggcgagcucggcgaggccucccaggucgagaccgucuccgaggagaacaagucccucauguggacccuccucaagcagcuccgccccggcauggaccucucccgcgucguccuccccaccuucguccucgagccccgcuccuuccucaacaagcucuccgacuacuacuaccacgccgaccuccucucccgcgccgccgucgaggaggacgccuacucccgcaugaagcucguccuccgcugguaccucuccggcuucuacaagaagcccaagggcaucaagaagcccuacaaccccauccucggcgagaccuuccgcugcugcugguuccacccccagaccgacucccgcaccuucuacaucgccgagcaggucucccaccacccccccgucuccgccuuccacgucuccaaccgcaaggacggcuucugcaucuccggcuccaucaccgccaagucccgcuucuacggcaacucccucuccgcccuccucgacggcaaggccacccucaccuuccucaaccgcgccgaggacuacacccucaccaugcccuacgcccacugcaagggcauccucuacggcaccaugacccucgagcucggcggcaaggucaccaucgagugcgccaagaacaacuuccaggcccagcucgaguucaagcucaagcccuucuucggcggcuccaccuccaucaaccagaucuccggcaagaucaccuccggcgaggagguccucgccucccucuccggccacugggaccgcgacgucuucaucaaggaggagggcuccggcuccuccgcccucuucuggacccccuccggcgagguccgccgccagcgccuccgccagcacaccgucccccucgaggagcagaccgagcucgaguccgagcgccucuggcagcacgucacccgcgccaucuccaagggcgaccagcaccgcgccacccaggagaaguucgcccucgaggaggcccagcgccagcgcgcccgcgagcgccaggagucccucaugcccuggaagccccagcucuuccaccucgaccccaucacccaggaguggcacuaccgcuacgaggaccacucccccugggacccccucaaggacaucgcccaguucgagcaggacggcauccuccgcacccuccagcaggaggccgucgcccgccagaccaccuuccucggcucccccggcccccgccacgagcgcuccggccccgaccagcgccuccgcaaggccuccgaccagcccuccggccacucccaggccaccgaguccuccggcuccacccccgaguccugccccgagcucuccgacgaggagcaggacggcgacuucguccccggcggcgagucccccugcccccgcugccgcaaggaggcccgccgccuccaggcccuccacgaggccauccucuccauccgcgaggcccagcaggagcuccaccgccaccucuccgccaugcucuccuccaccgcccgcgccgcccaggcccccacccccggccuccuccaguccccccgcuccugguuccuccucugcgucuuccucgccugccagcucuucaucaaccacauccucaaguga

SEQ ID NO: 47174 - RNA, 2880 nt, Artificial Sequence
  derived and/or modified sequence opt2 from OSBPL6__Homo_sapiens__NP_001188409
auguccuccgacgagaagggcaucucccccgcccacaagaccuccacccccacccaccgcuccgccuccuccuccaccuccucccagcgcgacucccgccaguccauccacauccucgagcgcaccgccuccuccuccaccgagcccuccgucucccgccagcuccucgagcccgagcccgucccccucuccaaggaggccgacuccugggagaucaucgagggccucaagaucggccagaccaacguccagaagcccgacaagcacgagggcuucaugcucaagaagcgcaaguggccccucaagggcuggcacaagcgcuucuucguccucgacaacggcaugcucaaguacuccaaggccccccucgacauccagaagggcaagguccacggcuccaucgacgucggccucuccgucauguccaucaagaagaaggcccgccgcaucgaccucgacaccgaggagcacaucuaccaccucaaggucaagucccaggacugguucgacgccugggucuccaagcuccgccaccaccgccucuaccgccagaacgagaucguccgcuccccccgcgacgccuccuuccacaucuuccccuccaccuccaccgccgaguccucccccgccgccaacgucuccgucauggacggcaagaugcagcccaacuccuuccccuggcaguccccccuccccugcuccaacucccuccccgccaccugcaccaccggccaguccaaggucgccgccuggcuccaggacuccgaggagauggaccgcugcgccgaggaccucgcccacugccaguccaaccucgucgagcucuccaagcuccuccagaaccucgagauccuccagcgcacccaguccgcccccaacuucaccgacaugcaggccaacugcgucgacaucuccaagaaggacaagcgcgucacccgccgcuggcgcaccaaguccgucuccaaggacaccaagauccagcuccaggagggcccccccgccaagggccaguucuccaccacccgccgccgccagcgccucgccgccgccgucgccaccaccguccccuucuccgccaccaugucccccguccgccuccacuccuccaaccccaaccucugcgccgacaucgaguuccagaccccccccucccaccucaccgacccccucgaguccuccaccgacuacaccaagcuccaggaggaguucugccucaucgcccagaagguccacucccuccucaaguccgccuucaacuccaucgccaucgagaaggagaagcucaagcagauggucuccgagcaggaccacuccaagggccacuccacccagauggcccgccuccgccagucccucucccaggcccucaaccagaacgccgagcuccgcucccgccucaaccgcauccacuccgaguccaucaucugcgaccaggucgucuccgucaacaucauccccucccccgacgaggccggcgagcagauccacgucucccucccccucucccagcaggucgccaacgagucccgccucuccauguccgaguccgucuccgaguucuucgacgcccaggagguccuccucuccgccuccuccuccgagaacgaggccuccgacgacgaguccuacaucuccgacgucuccgacaacaucuccgaggacaacaccuccgucgccgacaacaucucccgccagauccucaacggcgagcucaccggcggcgccuuccgcaacggccgccgcgccugccuccccgcccccugccccgacaccuccaacaucaaccucuggaacauccuccgcaacaacaucggcaaggaccucuccaaggucuccaugcccgucgagcucaacgagccccucaacacccuccagcaccucugcgaggagauggaguacuccgagcuccucgacaaggccuccgagaccgacgaccccuacgagcgcaugguccucgucgccgccuucgccgucuccggcuacugcuccaccuacuuccgcgccggcuccaagcccuucaaccccguccucggcgagaccuacgagugcauccgcgaggacaagggcuuccgcuucuucuccgagcaggucucccaccacccccccaucuccgccugccacugcgaguccaagaacuucgucuucuggcaggacauccgcuggaagaacaaguucuggggcaaguccauggagauccuccccgucggcacccucaacgucaugcuccccaaguacggcgacuacuacgucuggaacaaggucaccaccugcauccacaacauccucuccggccgccgcuggaucgagcacuacggcgaggucaccauccgcaacaccaaguccuccgucugcaucugcaagcucaccuucgucaaggucaacuacuggaacuccaacaugaacgagguccagggcgucgucaucgaccaggagggcaaggccgucuaccgccucuucggcaaguggcacgagggccucuacugcggcgucgcccccuccgccaagugcaucuggcgccccggcuccaugcccaccaacuacgagcucuacuacggcuucacccgcuucgccaucgagcucaacgagcucgaccccguccucaaggaccuccucccccccaccgacgcccgcuuccgccccgaccagcgcuuccucgaggagggcaaccucgaggccgccgccuccgagaagcagcgcgucgaggagcuccagcgcucccgccgccgcuacauggaggagaacaaccucgagcacauccccaaguucuucaagaaggucaucgacgccaaccagcgcgaggccugggucuccaacgacaccuacugggagcuccgcaaggaccccggcuucuccaaggucgacucccccguccucugguga

SEQ ID NO: 47175 - RNA, 2544 nt, Artificial Sequence
  derived and/or modified sequence opt2 from OSBPL8__Homo_sapiens__NP_001003712
augucccagcgccagggcaaggaggccuaccccacccccaccaaggaccuccaccagcccucccucucccccgccuccccccacucccagggcuucgagcgcggcaaggaggacaucucccagaacaaggacgaguccucccucuccauguccaaguccaaguccgaguccaagcucuacaacggcuccgagaaggacuccuccaccuccuccaagcucaccaagaaggagucccucaagguccagaagaagaacuaccgcgaggagaagaagcgcgccaccaaggagcuccucuccaccaucaccgaccccuccgucaucgucauggccgacuggcucaagauccgcggcacccucaaguccuggaccaagcucuggugcguccucaagcccggcguccuccucaucuacaagacccagaagaacggccagugggucggcaccguccuccucaacgccugcgagaucaucgagcgccccuccaagaaggacggcuucugcuucaagcucuuccacccccucgagcaguccaucugggccgucaagggccccaagggcgaggccgucggcuccaucacccagccccuccccuccuccuaccucaucauccgcgccaccuccgaguccgacggccgcugcuggauggacgcccucgagcucgcccucaagugcuccucccuccucaagcgcaccaugauccgcgagggcaaggagcacgaccucuccgucuccuccgacuccacccacgucaccuucuacggccuccuccgcgccaacaaccuccacuccggcgacaacuuccagcucaacgacuccgagaucgagcgccagcacuucaaggaccaggacauguacuccgacaaguccgacaaggagaacgaccaggagcacgacgaguccgacaacgaggucaugggcaaguccgaggaguccgacaccgacaccuccgagcgccaggacgacuccuacaucgagcccgagcccgucgagccccucaaggagaccaccuacaccgagcagucccacgaggagcucggcgaggccggcgaggccucccagaccgagaccgucuccgaggagaacaagucccucaucuggacccuccucaagcagguccgccccggcauggaccucuccaaggucguccuccccaccuucauccucgagccccgcuccuuccucgacaagcucuccgacuacuacuaccacgccgacuuccucuccgaggccgcccucgaggagaaccccuacuuccgccucaagaaggucgucaagugguaccucuccggcuucuacaagaagcccaagggccucaagaagcccuacaaccccauccucggcgagaccuuccgcugccucuggauccacccccgcaccaacuccaagaccuucuacaucgccgagcaggucucccaccacccccccaucuccgccuucuacgucuccaaccgcaaggacggcuucugccucuccggcuccauccucgccaaguccaaguucuacggcaacucccucuccgccauccucgagggcgaggcccgccucaccuuccucaaccgcggcgaggacuacgucaugaccaugcccuacgcccacugcaagggcauccucuacggcaccaugacccucgagcucggcggcaccgucaacaucaccugccagaagaccggcuacuccgccauccucgaguucaagcucaagcccuuccucggcuccuccgacugcgucaaccagaucuccggcaagcucaagcucggcaaggagguccucgccacccucgagggccacugggacuccgaggucuucaucaccgacaagaagaccgacaacuccgaggucuucuggaaccccacccccgacaucaagcaguggcgccucauccgccacaccgucaaguucgaggagcagggcgacuucgaguccgagaagcucuggcagcgcgucacccgcgccaucaacgccaaggaccagaccgaggccacccaggagaaguacguccucgaggaggcccagcgccaggccgcccgcgaccgcaagaccaagaacgaggagugguccugcaagcucuucgagcucgacccccucaccggcgaguggcacuacaaguucgccgacacccgccccugggacccccucaacgacaugauccaguucgagaaggacggcgucauccagaccaaggucaagcaccgcacccccauggucuccguccccaagaugaagcacaagcccacccgccagcagaagaaggucgccaagggcuacuccucccccgagcccgacauccaggacuccuccggcuccgaggcccaguccgucaagcccuccacccgccgcaagaagggcaucgagcucggcgacauccaguccuccaucgaguccaucaagcagacccaggaggagaucaagcgcaacaucauggcccuccgcaaccaccucgucuccuccacccccgccaccgacuacuuccuccagcagaaggacuacuucaucaucuuccuccucauccuccuccaggucaucaucaacuucauguucaaguga

SEQ ID NO: 47176 - RNA, 2280 nt, Artificial Sequence
  derived and/or modified sequence opt2 from OSBPL9__Homo_sapiens__XP_011538901
auggccuccaucauggagggcccccucuccaaguggaccaacgucaugaagggcuggcaguaccgcugguucguccucgacuacaacgccggccuccucuccuacuacaccuccaaggacaagaugaugcgcggcucccgccgcggcugcguccgccuccgcggcgccgucaucggcaucgacgacgaggacgacuccaccuucaccaucaccgucgaccagaagaccuuccacuuccaggcccgcgacgccgacgagcgcgagaaguggauccacgcccucgaggagaccauccuccgccacacccuccagcuccagaucuccaccacccucgccuucuuccaguccuccggcaucucccccguccucgaguucuccaagaucaucggccucgacuccggcuucguccccuccguccaggacuucgacaagaagcucaccgaggccgacgccuaccuccagauccucaucgagcagcucaagcucuucgacgacaagcuccagaacugcaaggaggacgagcagcgcaagaagaucgagacccucaaggagaccaccaacuccauggucgaguccaucaagcacugcaucguccuccuccagaucgccaaggaccaguccaacgccgagaagcacgccgacggcaugaucuccaccaucaaccccgucgacgccaucuaccagcccuccccccucgagcccgucaucuccaccaugcccucccagaccguccucccccccgagcccguccagcucugcaaguccgagcagcgccccuccucccuccccgucggccccguccucgccacccucggccaccaccagacccccacccccaacuccaccggcuccggccacuccccccccuccuccucccucaccucccccucccacgucaaccucucccccaacaccguccccgaguucuccuacuccuccuccgaggacgaguucuacgacgccgacgaguuccaccaguccggcuccucccccaagcgccucaucgacuccuccggcuccgccuccguccucacccacuccuccuccggcaacucccucaagcgccccgacaccaccgagucccucaacuccucccucuccaacggcaccuccgacgccgaccucuucgacucccacgacgaccgcgacgacgacgccgaggccggcuccgucgaggagcacaaguccgucaucaugcaccuccucucccagguccgccucggcauggaccucaccaaggucguccuccccaccuucauccucgagcgccgcucccuccucgagauguacgccgacuucuucgcccaccccgaccucuucgucuccaucuccgaccagaaggaccccaaggaccgcaugguccaggucgucaagugguaccucuccgccuuccacgccggccgcaagggcuccgucgccaagaagcccuacaaccccauccucggcgagaucuuccagugccacuggacccuccccaacgacaccgaggagaacaccgagcucgucuccgagggccccguccccugggucuccaagaacuccgucaccuucgucgccgagcaggucucccaccacccccccaucuccgccuucuacgccgagugcuucaacaagaagauccaguucaacgcccacaucuggaccaaguccaaguuccucggcauguccaucggcguccacaacaucggccagggcugcgucuccugccucgacuacgacgagcacuacauccucaccuuccccaacggcuacggccgcuccauccucaccguccccugggucgagcucggcggcgagugcaacaucaacugcuccaagaccggcuacuccgccaacaucaucuuccacaccaagcccuucuacggcggcaagaagcaccgcaucaccgccgagaucuucucccccaacgacaagaaguccuucugcuccaucgagggcgaguggaacggcgucauguacgccaaguacgccaccggcgagaacaccgucuucgucgacaccaagaagcuccccaucaucaagaagaagguccgcaagcucgaggaccagaacgaguacgagucccgcucccucuggaaggacgucaccuucaaccucaagauccgcgacaucgacgccgccaccgaggccaagcaccgccucgaggagcgccagcgcgccgaggcccgcgagcgcaaggagaaggagauccagugggagacccgccucuuccacgaggacggcgagugcugggucuacgacgagccccuccucaagcgccucggcgccgccaagcacuga

SEQ ID NO: 47177 - RNA, 849 nt, Artificial Sequence
  derived and/or modified sequence opt2 from OSCAR__Homo_sapiens__NP_001269278
auggcccucguccucauccuccagcuccucacccucuggccccucugccacaccgacaucacccccuccgucccccccgccuccuaccaccccaagcccuggcucggcgcccagcccgccaccgucgucacccccggcgucaacgucacccuccgcugccgcgccccccagcccgccuggcgcuucggccucuucaagcccggcgagaucgccccccuccucuuccgcgacgucuccuccgagcucgccgaguucuuccucgaggaggucacccccgcccagggcggcuccuaccgcugcugcuaccgccgccccgacuggggccccggcgucuggucccagcccuccgacguccucgagcuccucgucaccgaggagcucccccgccccucccucgucgcccuccccggccccgucgucggccccggcgccaacgucucccuccgcugcgccggccgccuccgcaacauguccuucguccucuaccgcgagggcgucgccgccccccuccaguaccgccacuccgcccagcccugggccgacuucacccuccucggcgcccgcgcccccggcaccuacuccugcuacuaccacacccccuccgcccccuacguccucucccagcgcuccgagguccucgucaucuccugggagggcgagggccccgaggcccgccccgccuccuccgcccccggcaugcaggcccccggccccccccccuccgaccccggcgcccaggcccccucccucuccuccuuccgcccccgcggccucguccuccagccccuccucccccagacccaggacuccugggaccccgcccccccccccuccgaccccggcgucuga

SEQ ID NO: 47178 - RNA, 879 nt, Artificial Sequence
  derived and/or modified sequence opt2 from OSER1__Homo_sapiens__XP_011527155
augaaguccgaggccaaggacggcgaggaggagucccuccagaccgccuucaagaagcuccgcgucgacgccuccggcuccgucgccucccucuccgucggcgagggcaccggcguccgcgcccccguccgcaccgccaccgacgacaccaagcccaagaccaccugcgccuccaaggacuccuggcacggcuccacccgcaaguccucccgcggcgccguccgcacccagcgccgccgccgcuccaagucccccguccuccacccccccaaguucauccacugcuccaccaucgccuccuccuccuccucccagcucaagcacaagucccagaccgacucccccgacggcuccuccggccucggcaucuccucccccaaggaguucuccgccggcgaguccuccaccucccucgacgccaaccacaccggcgccgucgucgagccccuccgcaccuccgucccccgccuccccuccgaguccaagaaggaggacuccuccgacgccacccaggucccccaggccucccucaaggccuccgaccucuccgacuuccaguccgucuccaagcucaaccagggcaagcccugcaccugcaucggcaaggagugccagugcaagcgcuggcacgacauggaggucuacuccuucuccggccuccaguccguccccccccucgcccccgagcgccgcuccacccucgaggacuacucccagucccuccacgcccgcacccucuccggcuccccccgcuccugcuccgagcaggcccgcgucuucgucgacgacgucaccaucgaggaccucuccggcuacauggaguacuaccucuacauccccaagaagaugucccacauggccgagaugauguacaccuga

SEQ ID NO: 47179 - RNA, 1008 nt, Artificial Sequence
  derived and/or modified sequence opt2 from OSGEP__Homo_sapiens__NP_060277
augcccgccguccucggcuucgagggcuccgccaacaagaucggcgucggcgucguccgcgacggcaagguccucgccaacccccgccgcaccuacgucaccccccccggcaccggcuuccuccccggcgacaccgcccgccaccaccgcgccgucauccucgaccuccuccaggaggcccucaccgaguccggccucaccucccaggacaucgacugcaucgccuacaccaagggccccggcaugggcgccccccucgucuccgucgccgucgucgcccgcaccgucgcccagcucuggaacaagccccucgucggcgucaaccacugcaucggccacaucgagaugggccgccucaucaccggcgccaccucccccaccguccucuacgucuccggcggcaacacccaggucaucgccuacuccgagcaccgcuaccgcaucuucggcgagaccaucgacaucgccgucggcaacugccucgaccgcuucgcccgcguccucaagaucuccaacgaccccucccccggcuacaacaucgagcagauggccaagcgcggcaagaagcucgucgagcuccccuacaccgucaagggcauggacgucuccuucuccggcauccucuccuucaucgaggacgucgcccaccgcaugcucgccaccggcgagugcacccccgaggaccucugcuucucccuccaggagaccgucuucgccaugcucgucgagaucaccgagcgcgccauggcccacugcggcucccaggaggcccucaucgucggcggcgucggcugcaacguccgccuccaggagaugauggccaccaugugccaggagcgcggcgcccgccucuucgccaccgacgagcgcuucugcaucgacaacggcgccaugaucgcccaggccggcugggagauguuccgcgccggccaccgcaccccccucuccgacuccggcgucacccagcgcuaccgcaccgacgaggucgaggucaccuggcgcgacuga

SEQ ID NO: 47180 - RNA, 1434 nt, Artificial Sequence
  derived and/or modified sequence opt2 from OSGIN1__Homo_sapiens__NP_892026
auguccuccucccgcaaggaccaccucggcgccuccuccuccgagccccuccccgucaucaucgucggcaacggccccuccggcaucugccucuccuaccuccucuccggcuacacccccuacaccaagcccgacgccauccacccccacccccuccuccagcgcaagcucaccgaggcccccggcgucuccauccucgaccaggaccucgacuaccucuccgagggccucgagggccgcucccagucccccgucgcccuccucuucgacgcccuccuccgccccgacaccgacuucggcggcaacaugaaguccguccucaccuggaagcaccgcaaggagcacgccaucccccacgucguccucggccgcaaccuccccggcggcgccuggcacuccaucgagggcuccauggucauccucucccagggccaguggaugggccuccccgaccucgaggucaaggacuggaugcagaagaagcgccgcggccuccgcaacucccgcgccaccgccggcgacaucgcccacuacuaccgcgacuacgucgucaagaagggccucggccacaacuucgucuccggcgccgucgucaccgccgucgaguggggcacccccgaccccuccuccugcggcgcccaggacuccuccccccucuuccaggucuccggcuuccucacccgcaaccaggcccagcagcccuucucccucugggcccgcaacgucguccucgccaccggcaccuucgacucccccgcccgccucggcauccccggcgaggcccuccccuucauccaccacgagcucuccgcccucgaggccgccacccgcgucggcgccgucacccccgccuccgaccccguccucaucaucggcgccggccucuccgccgccgacgccguccucuacgcccgccacuacaacauccccgucauccacgccuuccgccgcgccgucgacgaccccggccucgucuucaaccagcuccccaagaugcucuaccccgaguaccacaagguccaccagaugaugcgcgagcaguccauccucucccccucccccuacgagggcuaccgcucccucccccgccaccagcuccucugcuucaaggaggacugccaggccgucuuccaggaccucgagggcgucgagaaggucuucggcgucucccucguccucguccucaucggcucccaccccgaccucuccuuccuccccggcgccggcgccgacuucgccgucgaccccgaccagccccucuccgccaagcgcaaccccaucgacgucgaccccuucaccuaccaguccacccgccaggagggccucuacgccaugggcccccucgccggcgacaacuucguccgcuucguccagggcggcgcccucgccgucgccuccucccuccuccgcaaggagacccgcaagccccccuga

SEQ ID NO: 47181 - RNA, 759 nt, Artificial Sequence
  derived and/or modified sequence opt2 from OSM__Homo_sapiens__NP_065391
augggcguccuccucacccagcgcacccuccucucccucguccucgcccuccucuuccccuccauggccuccauggccgccaucggcuccugcuccaaggaguaccgcguccuccucggccagcuccagaagcagaccgaccucaugcaggacaccucccgccuccucgaccccuacauccgcauccagggccucgacguccccaagcuccgcgagcacugccgcgagcgccccggcgccuuccccuccgaggagacccuccgcggccucggccgccgcggcuuccuccagacccucaacgccacccucggcugcguccuccaccgccucgccgaccucgagcagcgccuccccaaggcccaggaccucgagcgcuccggccucaacaucgaggaccucgagaagcuccagauggcccgccccaacauccucggccuccgcaacaacaucuacugcauggcccagcuccucgacaacuccgacaccgccgagcccaccaaggccggccgcggcgccucccagccccccacccccacccccgccuccgacgccuuccagcgcaagcucgagggcugccgcuuccuccacggcuaccaccgcuucaugcacuccgucggccgcgucuucuccaaguggggcgagucccccaaccgcucccgccgccacuccccccaccaggcccuccgcaagggcguccgccgcacccgccccucccgcaagggcaagcgccucaugacccgcggccagcucccccgcuga

SEQ ID NO: 47182 - RNA, 1029 nt, Artificial Sequence
  derived and/or modified sequence opt2 from OSMR__Homo_sapiens__NP_001161827
auggcccucuucgccgucuuccagaccaccuucuuccucacccuccucucccuccgcaccuaccaguccgagguccucgccgagcgccucccccucacccccgucucccucaaggucuccaccaacuccacccgccagucccuccaccuccaguggaccguccacaaccuccccuaccaccaggagcucaagauggucuuccagauccagaucucccgcaucgagaccuccaacgucaucugggucggcaacuacuccaccaccgucaaguggaaccagguccuccacugguccugggaguccgagcucccccucgagugcgccacccacuucguccgcaucaagucccucgucgacgacgccaaguuccccgagcccaacuucugguccaacugguccuccugggaggaggucuccguccaggacuccaccggccaggacauccucuucgucuuccccaaggacaagcucgucgaggagggcaccaacgucaccaucugcuacgucucccgcaacauccagaacaacgucuccugcuaccucgagggcaagcagauccacggcgagcagcucgacccccacgucaccgccuucaaccucaacuccguccccuucauccgcaacaagggcaccaacaucuacugcgaggccucccagggcaacgucuccgagggcaugaagggcaucguccucuucgucuccaagguccucgaggagcccaaggacuucuccugcgagaccgaggacuucaagacccuccacugcaccugggaccccggcaccgacaccgcccucggcugguccaagcagcccucccaguccuacacccucuucgaguccuucuccggcgagaagaagcucugcacccacaagaacuggugcaacuggcagaucacccaggacucccaggagaccuacaacuucacccucaucgccgagaacuaccuccgcaagcgcuccgucaacauccucuucaaccucacccaccgcggcgagacccgcgucgucaccgcccaccgcggccacuga

SEQ ID NO: 47183 - RNA, 801 nt, Artificial Sequence
  derived and/or modified sequence opt2 from OSR1__Homo_sapiens__XP_006712005
augggcuccaagacccuccccgcccccguccccauccaccccucccuccagcucaccaacuacuccuuccuccaggccgucaacggccuccccaccguccccuccgaccaccuccccaaccucuacggcuucuccgcccuccacgccguccaccuccaccaguggacccucggcuaccccgccaugcaccucccccgcuccuccuucuccaagguccccggcaccgucuccucccucgucgacgcccgcuuccagcuccccgccuuccccugguucccccacgucauccagcccaagcccgagaucaccgccggcggcuccguccccgcccucaagaccaagccccgcuucgacuucgccaaccucgcccucgccgccacccaggaggaccccgccaagcucggccgcggcgagggccccggcucccccgccggcggccucggcgcccuccucgacgucaccaagcucucccccgagaagaagcccacccgcggccgccuccccuccaagaccaagaaggaguucgucugcaaguucugcggccgccacuucaccaaguccuacaaccuccucauccacgagcgcacccacaccgacgagcgccccuacaccugcgacaucugccacaaggccuuccgccgccaggaccaccuccgcgaccaccgcuacauccacuccaaggagaagcccuucaagugccaggagugcggcaagggcuucugccagucccgcacccucgccguccacaagacccuccacucccaggucaaggagcucaagaccuccaagaucaagugcuga

SEQ ID NO: 47184 - RNA, 939 nt, Artificial Sequence
  derived and/or modified sequence opt2 from OSR2__Homo_sapiens__NP_001135934
augggcuccaaggcccuccccgcccccaucccccuccaccccucccuccagcucaccaacuacuccuuccuccaggccgucaacaccuuccccgccaccgucgaccaccuccagggccucuacggccucuccgccguccagaccaugcacaugaaccacuggacccucggcuaccccaacguccacgagaucacccgcuccaccaucaccgagauggccgccgcccagggccucgucgacgcccgcuuccccuuccccgcccuccccuucaccacccaccucuuccaccccaagcagggcgccaucgcccacguccuccccgcccuccacaaggaccgcccccgcuucgacuucgccaaccucgccgucgccgccacccaggaggacccccccaagaugggcgaccucuccaagcucucccccggccucggcucccccaucuccggccucuccaagcucacccccgaccgcaagcccucccgcggccgccuccccuccaagaccaagaaggaguucaucugcaaguucugcggccgccacuucaccaaguccuacaaccuccucauccacgagcgcacccacaccgacgagcgccccuacaccugcgacaucugccacaaggccuuccgccgccaggaccaccuccgcgaccaccgcuacauccacuccaaggagaagcccuucaagugccaggagugcggcaagggcuucugccagucccgcacccucgccguccacaagacccuccacaugcaggaguccccccacaagugccccaccugcggccgcaccuucaaccagcgcuccaaccucaagacccaccuccucacccacaccgacaucaagcccuacuccugcgagcagugcggcaaggucuuccgccgcaacugcgaccuccgccgccacucccucacccacaccccccgccaggacuucuga

SEQ ID NO: 47185 - RNA, 645 nt, Artificial Sequence
  derived and/or modified sequence opt2 from OSTF1__Homo_sapiens__NP_036515
auguccaagcccccccccaagcccgucaagcccggccaggucaaggucuuccgcgcccucuacaccuucgagccccgcacccccgacgagcucuacuucgaggagggcgacaucaucuacaucaccgacauguccgacaccaacugguggaagggcaccuccaagggccgcaccggccucauccccuccaacuacgucgccgagcaggccgaguccaucgacaacccccuccacgaggccgccaagcgcggcaaccucuccuggcuccgcgagugccucgacaaccgcgucggcgucaacggccucgacaaggccggcuccaccgcccucuacugggccugccacggcggccacaaggacaucgucgagaugcucuucacccagcccaacaucgagcucaaccagcagaacaagcucggcgacaccgcccuccacgccgccgccuggaagggcuacgccgacaucguccagcuccuccucgccaagggcgcccgcaccgaccuccgcaacaucgagaagaagcucgccuucgacauggccaccaacgccgccugcgccucccuccucaagaagaagcagggcaccgacgccguccgcacccucuccaacgccgaggacuaccucgacgacgaggacuccgacuga

SEQ ID NO: 47186 - RNA, 1005 nt, Artificial Sequence
  derived and/or modified sequence opt2 from OSTM1__Homo_sapiens__NP_054747
auggagcccggccccaccgccgcccagcgccgcugcucccucccccccuggcucccccucggccuccuccucugguccggccucgcccucggcgcccuccccuucggcuccuccccccaccgcgucuuccacgaccuccucuccgagcagcagcuccucgaggucgaggaccucucccucucccuccuccagggcggcggccucggcccccucucccucccccccgaccuccccgaccucgaccccgagugccgcgagcuccuccucgacuucgccaacuccuccgccgagcucaccggcugccucguccgcuccgcccgccccguccgccucugccagaccugcuacccccucuuccagcaggucgucuccaagauggacaacaucucccgcgccgccggcaacaccuccgagucccaguccugcgcccgcucccuccucauggccgaccgcaugcagaucgucgucauccucuccgaguucuucaacaccaccuggcaggaggccaacugcgccaacugccucaccaacaacuccgaggagcucuccaacuccaccgucuacuuccucaaccucuucaaccacacccucaccugcuucgagcacaaccuccagggcaacgcccacucccuccuccagaccaagaacuacuccgaggucugcaagaacugccgcgaggccuacaagacccucuccucccucuacuccgagaugcagaagaugaacgagcucgagaacaaggccgagcccggcacccaccucugcaucgacgucgaggacgccaugaacaucacccgcaagcucuggucccgcaccuucaacugcuccguccccugcuccgacaccguccccgucaucgccgucuccgucuucauccucuuccuccccgucgucuucuaccucuccuccuuccuccacuccgagcagaagaagcgcaagcucauccuccccaagcgccucaaguccuccaccuccuucgccaacauccaggagaacuccaacuga

SEQ ID NO: 47187 - RNA, 1065 nt, Artificial Sequence
  derived and/or modified sequence opt2 from OTC__Homo_sapiens__NP_000522
augcucuucaaccuccgcauccuccucaacaacgccgccuuccgcaacggccacaacuucaugguccgcaacuuccgcugcggccagccccuccagaacaagguccagcucaagggccgcgaccuccucacccucaagaacuucaccggcgaggagaucaaguacaugcucuggcucuccgccgaccucaaguuccgcaucaagcagaagggcgaguaccucccccuccuccagggcaagucccucggcaugaucuucgagaagcgcuccacccgcacccgccucuccaccgagaccggcuucgcccuccucggcggccaccccugcuuccucaccacccaggacauccaccucggcgucaacgagucccucaccgacaccgcccgcguccucuccuccauggccgacgccguccucgcccgcgucuacaagcaguccgaccucgacacccucgccaaggaggccuccauccccaucaucaacggccucuccgaccucuaccaccccauccagauccucgccgacuaccucacccuccaggagcacuacuccucccucaagggccucacccucuccuggaucggcgacggcaacaacauccuccacuccaucaugauguccgccgccaaguucggcaugcaccuccaggccgccacccccaagggcuacgagcccgacgccuccgucaccaagcucgccgagcaguacgccaaggagaacggcaccaagcuccuccucaccaacgacccccucgaggccgcccacggcggcaacguccucaucaccgacaccuggaucuccaugggccaggaggaggagaagaagaagcgccuccaggccuuccagggcuaccaggucaccaugaagaccgccaaggucgccgccuccgacuggaccuuccuccacugccucccccgcaagcccgaggaggucgacgacgaggucuucuacuccccccgcucccucgucuuccccgaggccgagaaccgcaaguggaccaucauggccgucauggucucccuccucaccgacuacuccccccagcuccagaagcccaaguucuga

SEQ ID NO: 47188 - RNA, 3183 nt, Artificial Sequence
  derived and/or modified sequence opt2 from OTOA__Homo_sapiens__NP_001155155
augggcaacuccaucaccuaccgcgaccaggccgccgucgagaaccaccucgagcagcgccuccaccagccccagaagcuccucgaggaccuccgcaagaccgacgcccagcaguuccgcaccgccaugaagugccuccucgaggacaagaaggacggccucgaccucaaggacaucaucaucgaccucggcgagauccgcgagcgcgcccuccagucccccggcgucaaccgcucccucuuccucaucacccucgagcgcugcuuccagaugcucaacucccucgagugcgucgagauccucggcaagguccuccgcggcuccuccggcuccuuccuccagcccgacaucaccgagcgccucccccgcgaccuccgcgaggacgccuucaagaaccucuccgccgucuucaaggaccucuacgacaagaccuccgcccacucccagcgcgcccucuacuccuggaugaccggcauccuccagaccuccuccaacgccaccgacgacuccgccuccugggucuccgccgagcaccucuggguccucggccgcuacaugguccaccucuccuucgaggagaucaccaagaucucccccaucgagaucggccucuucaucuccuacgacaacgccaccaagcagcucgacauggucuacgacaucacccccgagcucgcccaggccuuccucgagcgcaucuccuccuccaacuucaacaugcgcaacaccuccaccauccaccgccucggccuccucgucugcuucuacaacgaccucgagcuccucgacgccaccgucgcccagguccuccucuaccagaugaucaagugcucccaccuccgcggcuuccaggccggcguccagaagcucaaggccgagcuccucgacaucgccauggagaaccagacccucaacgagacccucggcucccucuccgacgccgucgucggccucaccuacucccagcucgagucccucucccccgaggccguccacggcgccaucuccacccucaaccaggucuccggcugggccaagucccaggucaucauccucuccgccaaguaccucgcccacgagaagguccucuccuucuacaacgucucccagaugggcgcccuccucgccggcgucuccacccaggccuucugcuccaugaagcgcaaggacaucucccagguccuccgcuccgccgucucccaguacgucuccgaccucucccccgcccagcagcagggcauccucuccaagaugguccaggccgaggacaccgcccccggcaucgucgagauccagggcgccuucuucaaggaggucucccucuucgaccuccgccgccagcccggcuucaacuccaccguccucaaggacaaggagcucggccgcucccaggcccucuuccucuacgagcuccuccucaagaccacccgccgccccgaggagcuccucuccgccggccagcucgucaagggcgucaccugcucccacaucgacgccauguccaccgacuucuuccucgcccacuuccaggacuuccagaacaacuucgcccuccucucccccuaccaggucaacugccucgccuggaaguacugggaggucucccgccucuccaugccccccuuccuccucgccgcccuccccgcccgcuaccucgccuccguccccgccucccagugcguccccuuccucaucucccucggcaaguccuggcucgacucccucguccucgacucccacaagaagaccuccguccuccgcaagguccagcagugccucgacgacuccaucgccgacgaguacaccgucgacaucaugggcaaccuccucugccaccuccccgccgccaucaucgaccgcggcaucuccccccgcgccugggccaccgcccuccacggccuccgcgacugccccgaccucaaccccgagcagaaggccgccguccgccucaagcuccucggccaguacggccucccccagcacuggaccgccgagaccaccaaggaccucggccccuuccucguccucuucuccggcgacgagcucuccuccaucgccaccaaguuccccgagauccuccuccaggccgccuccaagauggcccgcacccuccccaccaaggaguuccucugggccgucuuccaguccguccgcaacuccuccgacaagauccccuccuacgaccccaugcccggcugccacggcgucgucgcccccuccuccgacgacaucuucaagcucgccgaggccaacgccugcugggcccucgaggaccuccgcugcauggaggaggacaccuucauccgcaccgucgagcuccucggcgccguccagggcuucucccgcccccagcucaugacccucaaggagaaggccauccaggucugggacaugcccuccuacuggcgcgagcaccacaucgucucccucggccgcaucgcccucgcccucaacgaguccgagcucgagcagcucgaccucuccuccaucgacaccgucgccucccucuccuggcagaccgaguggacccccggccaggccgaguccauccuccagggcuaccucgacgacuccggcuacuccauccaggaccucaaguccuuccaccucgucggccucggcgccacccucugcgccaucaacaucaccgagaucccccucaucaagaucuccgaguuccgcgucgucgucgcccgcaucggcacccuccucugcuccacccacguccucgccgaguucaagcgcaaggccgaggucgucuucggcgaccccaccgaguggaccuccuccguccuccaggagcucggcaccaucgccgccggccucaccaaggccgagcuccgcaugcucgacaaggaccucaugcccuacuuccagcccuccgccaucaagugccuccccgacgagaucuucaaggagcucuccgccgagcagaucgccucccucggccccgagaacgccgccgccgucacccacgcccagcgccgccgccucuccccccuccagcuccagucccuccagcaggcccucgacggcgccaagacccacuccuggcaggacgcccccgccuccgccggccccacccgcaccuccuccucccgcucccccgccggcgcccuccaguccuggggccucuggcucggcugcccccuccucguccucauggccaagcuccucugguga

SEQ ID NO: 47189 - RNA, 3693 nt, Artificial Sequence
  derived and/or modified sequence opt2 from OTOF__Homo_sapiens__NP_004793
augaucaagaccgagaaguccuaccccgagcgccgccuccgcggcguccucgaggagcucuccugcggcugcugccgcuuccucucccucgccgacaaggaccagggccacuccucccgcacccgccucgaccgcgagcgccucaaguccugcaugcgcgagcucgagaacaugggccagcaggcccgcaugcuccgcgcccaggucaagcgccacaccguccgcgacaagcuccgccucugccagaacuuccuccagaagcuccgcuuccucgccgacgagccccagcacuccauccccgacaucuucaucuggaugauguccaacaacaagcgcgucgccuacgcccgcguccccuccaaggaccuccucuucuccaucgucgaggaggagaccggcaaggacugcgccaaggucaagacccucuuccucaagcuccccggcaagcgcggcuucggcuccgccggcuggaccguccaggccaaggucgagcucuaccucuggcucggccucuccaagcagcgcaaggaguuccucugcggccuccccugcggcuuccaggaggucaaggccgcccagggccucggccuccacgccuucccccccgucucccucgucuacaccaagaagcaggccuuccagcuccgcgcccacauguaccaggcccgcucccucuucgccgccgacuccuccggccucuccgaccccuucgcccgcgucuucuucaucaaccagucccagugcaccgagguccucaacgagacccucugccccaccugggaccagaugcucgucuucgacaaccucgagcucuacggcgaggcccacgagcuccgcgacgacccccccaucaucgucaucgagaucuacgaccaggacuccaugggcaaggccgacuucaugggccgcaccuucgccaagccccucgucaagauggccgacgaggccuacugccccccccgcuuccccccccagcucgaguacuaccagaucuaccgcggcaacgccaccgccggcgaccuccucgccgccuucgagcuccuccagaucggccccgccggcaaggccgaccucccccccaucaacggccccgucgacgucgaccgcggccccaucaugcccguccccaugggcauccgccccguccucuccaaguaccgcgucgagguccucuucuggggccuccgcgaccucaagcgcgucaaccucgcccaggucgaccgcccccgcgucgacaucgagugcgccggcaagggcguccaguccucccucauccacaacuacaagaagaaccccaacuucaacacccucgucaagugguucgaggucgaccuccccgagaacgagcuccuccaccccccccucaacauccgcgucgucgacugccgcgccuucggccgcuacacccucgucggcucccacgccgucuccucccuccgccgcuucaucuaccgcccccccgaccgcuccgcccccuccuggaacaccaccggcgaggucgucgucaccauggagcccgagguccccaucaagaagcucgagaccauggucaagcucgacgccaccuccgaggccgucgucaaggucgacgucgccgaggaggagaaggagaagaagaagaagaagaagggcaccgccgaggagcccgaggaggaggagcccgacgaguccaugcucgacuggugguccaaguacuucgccuccaucgacaccaugaaggagcagcuccgccagcaggagcccuccggcaucgaccucgaggagaaggaggaggucgacaacaccgagggccucaagggcuccaugaagggcaaggagaaggcccgcgccgccaaggaggagaagaagaagaagacccaguccuccggcuccggccagggcuccgaggcccccgagaagaagaagcccaagaucgacgagcucaaggucuaccccaaggagcucgaguccgaguucgacaacuucgaggacuggcuccacaccuucaaccuccuccgcggcaagaccggcgacgacgaggacggcuccaccgaggaggagcgcaucgucggccgcuucaagggcucccucugcgucuacaaggucccccuccccgaggacgucucccgcgaggccggcuacgacuccaccuacggcauguuccagggcauccccuccaacgaccccaucaacguccucguccgcgucuacgucguccgcgccaccgaccuccaccccgccgacaucaacggcaaggccgaccccuacaucgccauccgccucggcaagaccgacauccgcgacaaggagaacuacaucuccaagcagcucaaccccgucuucggcaaguccuucgacaucgaggccuccuuccccauggaguccaugcucaccgucgccgucuacgacugggaccucgucggcaccgacgaccucaucggcgagaccaagaucgaccucgagaaccgcuucuacuccaagcaccgcgccaccugcggcaucgcccagaccuacuccacccacggcuacaacaucuggcgcgaccccaugaagcccucccagauccucacccgccucugcaaggacggcaaggucgacggcccccacuucggcccccccggccgcgucaaggucgccaaccgcgucuucaccggccccuccgagaucgaggacgagaacggccagcgcaagcccaccgacgagcacgucgcccuccucgcccuccgccacugggaggacaucccccgcgccggcugccgccucguccccgagcacgucgagacccgcccccuccucaaccccgacaagcccggcaucgagcagggccgccucgagcucugggucgacauguuccccauggacaugcccgcccccggcaccccccucgacaucuccccccgcaagcccaagaaguacgagcuccgcgucaucaucuggaacaccgacgaggucguccucgaggacgacgacuucuucaccggcgagaaguccuccgacaucuucguccgcggcuggcucaagggccagcaggaggacaagcaggacaccgacguccacuaccacucccucaccggcgagggcaacuucaacuggcgcuaccucuuccccuucgacuaccucgccgccgaggagaagaucgucaucuccaagaaggaguccauguucuccugggacgagaccgaguacaagauccccgcccgccucacccuccagaucugggacgccgaccacuucuccgccgacgacuuccucggcgccaucgagcucgaccucaaccgcuucccccgcggcgccaagaccgccaagcagugcaccauggagauggccaccggcgaggucgacgucccccucgucuccaucuucaagcagaagcgcgucaagggcugguggccccuccucgcccgcaacgagaacgacgaguucgagcucaccggcaaggucgaggccgagcuccaccuccucaccgccgaggaggccgagaagaaccccgucggccucgcccgcaacgagcccgacccccucgagaagcccaaccgccccgacaccuccuucaucugguuccucaacccccucaaguccgcccgcuacuuccucuggcacaccuaccgcuggcuccuccucaagcuccuccuccuccuccuccuccuccuccuccucgcccucuuccucuacuccguccccggcuaccucgucaagaagauccucggcgccuga

SEQ ID NO: 47190 - RNA, 8778 nt, Artificial Sequence
  derived and/or modified sequence opt2 from OTOG__Homo_sapiens__NP_001264198
augggcguccucgccuccgcccucugcuggcuccucugcgucuggcuccccuggggcgagcaggccgccgagucccuccgcguccagcgccucggcgagcgcgucgucgacuccggccgcuccggcgcccgcggcaugcgcaacgucaagggcaugcgcaacggccccgcccagacccgcgucuccuccuccuccucccaccaggaggccacccucgccaugggcgacaaggccaccgucgucggcggccagcaggccgaggcccccgacuccgucgccauguccuccugggagcgccgccuccaccgcgccaagugcgcccccuccuaccucuucuccugcuucaacggcggcgagugcguccaccccgccuucugcgacugccgccgcuucaacgccaccggcccccgcugccagauggucuacaacgccggccccgagcgcgacuccaucugccgcgccuggggccagcaccacgucgagaccuucgacggccucuacuacuaccucuccggcaagggcuccuacacccucgucggccgccacgagcccgagggccaguccuucuccauccagguccacaacgacccccagugcggcuccucccccuacaccugcucccgcgccgucucccucuucuucgucggcgagcaggagauccaccucgccaaggaggucacccacggcggcaugcgcguccagcucccccacgucaugggcuccgcccgccuccagcagcucgccggcuacgucaucguccgccaccaguccgccuucacccucgccugggacggcgccuccgccgucuacaucaagaugucccccgagcuccucggcuggacccacggccucugcggcaacaacaacgccgaccccaaggacgaccucgucaccuccuccggcaagcucaccgacgacgucgucgaguucguccacuccuggcaggagcaggcccccaaccagccccccggccccaccaccuccucccucccccgcccccccugccuccagcagaaccccggcaccaugcagggcgucuacgagcagugcgaggcccuccuccgcccccccuucgacgccugccacgccuacgucuccccccuccccuucaccgccuccugcaccuccgaccucugccaguccaugggcgacgucgccaccuggugccgcgcccucgccgaguacgcccgcgccugcgcccaggccggccgcccccuccagggcuggcgcacccagcuccgccagugcaccguccacugcaaggagaaggccuucaccuacaacgagugcaucgccugcugccccgccuccugccacccccgcgccuccugcgucgacuccgagaucgccugcgucgacggcugcuacugccccaacggccucaucuucgaggacggcggcugcgucgcccccgccgagugccccugcgaguuccacggcacccucuacccccccggcuccgucgucaaggaggacugcaacaccugcaccugcaccuccggcaagugggagugcuccaccgccgucugccccgccgagugcuccgucaccggcgacauccacuucaccaccuucgacggccgccgcuacaccuuccccgccaccugccaguacauccucgccaagucccgcuccuccggcaccuucaccgucacccuccagaacgcccccugcggccucaaccaggacggcgccugcguccaguccgucuccgucauccuccaccaggacccccgccgccaggucacccucacccaggccggcgacguccuccucuucgaccaguacaagaucaucccccccuacaccgacgacgccuucgagauccgccgccucuccuccgucuuccuccgcguccgcaccaacgucggcguccgcguccucuacgaccgcgagggccuccgccucuaccuccaggucgaccagcgcugggucgaggacaccgucggccucugcggcaccuucaacggcaacacccaggacgacuuccucucccccgucggcguccccgaguccaccccccagcucuucggcaacuccuggaagacccucuccgccugcuccccccucgucuccggcuccccccucgaccccugcgacguccaccuccaggccgccuccuacuccguccaggccugcuccguccucaccggcgagauguucgcccccugcuccgccuuccucucccccguccccuacuucgagcagugccgccgcgacgccugccgcugcggccagcccugccucugcgccacccucgcccacuacgcccaccucugccgccgccacggccuccccgucgacuuccgcgcccgccuccccgccugcgcccucuccugcgaggccuccaaggaguacucccccugcgucgcccccugcggccgcaccugccaggaccucgccucccccgaggccugcggcgucgacggcggcgacgaccucucccgcgacgagugcgucgagggcugcgccugcccccccgacaccuaccucgacacccaggccgaccucugcgucccccgcaaccagugcuccugccacuuccagggcgucgacuacccccccggcgacuccgacauccccucccucggccacugccacugcaaggacggcgucauguccugcgacucccgcgcccccgccgccgccugccccgccggccaggucuucgucaacugcuccgaccuccacaccgaccucgagcucucccgcgagcgcaccugcgagcagcagcuccucaaccucuccgucuccgcccgcggccccugccucuccggcugcgccugcccccagggccuccuccgccacggcgacgccugcuuccuccccgaggagugccccugcaccuggaagggcaaggaguacuuccccggcgaccaggucaugucccccugccacaccugcgucugccagcgcggcuccuuccagugcacccuccaccccugcgccuccaccugcaccgccuacggcgaccgccacuaccgcaccuucgacggccuccccuucgacuucgucggcgccugcaagguccaccucgucaaguccaccuccgacgucuccuucuccgucaucgucgagaacgucaacugcuacuccuccggcaugaucugccgcaaguucaucuccaucaacgucggcaacucccucaucgucuucgacgacgacuccggcaaccccucccccgaguccuuccucgacgacaagcaggagguccacaccuggcgcgucggcuucuucacccucguccacuucccccaggagcacaucacccuccucugggaccagcgcaccaccguccacguccaggccggcccccaguggcagggccagcucgccggccucugcggcaacuucgaccucaagaccaucaacgagaugcgcacccccgagaaccucgagcucaccaacccccaggaguucggcuccuccugggccgccgucgagugccccgacacccucgacccccgcgacaugugcguccucaacccccuccgcgagcccuucgccaagaaggagugcuccauccuccucuccgaggucuucgagaucugccaccccgucgucgacgucaccugguucuacuccaacugccucaccgacaccugcggcugcucccagggcggcgacugcgagugcuucugcgccuccgucuccgccuacgcccaccagugcugccagcacggcgucgccgucgacuggcgcaccccccgccucugccccuacgacugcgacuucuucaacaagguccucggcaagggccccuaccagcucuccucccucgccgccggcggcgcccucgucggcaugaaggccgucggcgacgacaucguccucguccgcaccgaggacgucgcccccgccgacaucgucuccuuccuccucaccgccgcccucuacaaggccaaggcccacgaccccgacgucgucucccucgaggccgccgaccgccccaacuucuuccuccacgucaccgccaacggcucccucgagcucgccaaguggcagggccgcgacaccuuccagcagcacgccuccuuccuccuccaccgcggcacccgccaggccggccucgucgcccucgagucccucgccaagcccuccuccuuccucuacgucuccggcgccguccucgcccuccgccucuacgagcacaccgaggucuuccgccgcggcacccucuuccgccuccucgacgccaagcccuccggcgccgccuaccccaucugcgaguggcgcuacgacgccugcgccucccccugcuuccagaccugccgcgacccccgcgccgccuccugccgcgacgucccccgcgucgagggcugcguccccgucugccccaccccccagguccucgacgaggucacccagcgcugcgucuaccucgaggacugcgucgagcccgccgucuggguccccaccgaggcccucggcaacgagacccucccccccucccagggccuccccacccccuccgacgaggagccccagcucucccaggaguccccccgcacccccacccaccgccccgcccucacccccgccgccccccucaccaccgcccucaacccccccgucaccgccaccgaggagcccgucgucucccccggccccacccagaccacccuccagcagccccucgagcucaccgccucccagcuccccgccggccccaccgagucccccgccuccaagggcgucaccgccucccuccucgccaucccccacacccccgaguccuccucccuccccgucgcccuccagacccccacccccggcauggucuccggcgccauggagaccacccgcgucaccgucaucuucgccggcucccccaacaucaccgucuccucccgcuccccccccgccccccgcuucccccucaugaccaaggccgucaccguccgcggccacggcucccuccccguccgcaccacccccccccagcccucccucaccgccucccccuccucccgccccgucgccucccccggcgccaucucccgcucccccaccuccuccggcucccacaaggccguccucacccccgccgucaccaaggucaucucccgcaccggcgucccccagcccacccaggcccaguccgccuccucccccuccaccccccucaccgucgccggcaccgccgccgagcagguccccgucuccccccucgccacccgcucccucgagaucguccucuccaccgagaagggcgaggccggccacucccagcccaugggcucccccgccuccccccagccccacccccuccccuccgcccccccccgccccgcccagcacaccaccauggccacccgcucccccgcccucccccccgagacccccgccgccgccucccucuccaccgccaccgacggccucgccgccacccccuucaugucccucgaguccacccgccccucccagcuccucuccggccucccccccgacaccucccucccccucgccaaggucggcaccuccgcccccgucgccacccccggccccaaggccuccgucaucaccaccccccuccagccccaggccaccacccuccccgcccagacccucucccccguccuccccuucacccccgccgccaugacccaggcccacccccccacccacaucgccccccccgccgccggcaccgcccccggccuccuccucggcgccacccuccccaccuccggcguccuccccgucgccgagggcaccgccuccauggucuccgucgucccccgcaaguccaccaccggcaaggucgccauccucuccaagcaggucucccuccccaccuccauguacggcuccgccgagggcggccccaccgagcucacccccgccaccucccacccccucaccccccucgucgccgagcccgagggcgcccaggccggcaccgcccuccccguccccaccuccuacgcccucucccgcgucuccgcccgcaccgccccccaggacuccaugcucguccuccucccccagcucgccgaggcccacggcaccuccgccggcccccaccucgccgccgagcccgucgacgaggccaccaccgagcccuccggccgcuccgcccccgcccucuccaucgucgagggccucgccgaggcccucgccaccaccaccgaggccaacaccuccaccaccugcguccccaucgccgagcaggacugcguccgccacaucugccucgagggccagcucauccgcgucaaccagucccagcacugcccccagggcgccgcccccccccgcugcggcauccucggccucgccguccgcgucggcggcgaccgcugcugcccccucugggagugcgccugccgcugcuccaucuuccccgaccucuccuucgucaccuucgacggcucccacgucgcccucuucaaggaggccaucuacauccucucccagucccccgacgagaugcucaccguccacguccucgacugcaaguccgccaaccucggccaccucaacuggccccccuucugccucgucaugcucaacaugacccaccucgcccaccaggucaccaucgaccgcuucaaccgcaaggucaccgucgaccuccagcccgucuggccccccgucucccgcuacggcuuccgcaucgaggacaccggccacauguacaugauccucacccccuccgacauccagauccaguggcuccacuccuccggccucaugaucgucgaggccuccaagaccuccaaggcccagggccacggccucugcggcaucugcgacggcgacgccgccaacgaccucacccucaaggacggcuccgucgucggcggcgccgaggaccccgcccccuuccucgacuccuggcagguccccuccucccucaccuccgucggccagacccgcuuccgccccgacuccugcgccaccaccgacugcucccccugccuccgcauggucuccaaccgcaccuucuccgccugccaccgcuucgucccccccgaguccuucugcgagcucuggauccgcgacaccaaguacguccagcagcccugcgucgcccucaccgucuacgucgccaugugccacaaguuccacgucugcaucgaguggcgccgcuccgacuacugccccuuccucugcuccuccgacuccaccuaccaggccugcgucaccgccugcgagccccccaagaccugccaggacggcauccucggcccccucgaccccgagcacugccagguccucggcgagggcugcgucugcuccgagggcaccauccuccaccgccgccacuccgcccucugcauccccgaggccaagugcgccugcaccgacuccaugggcgucccccgcgcccucggcgagaccuggaacuccucccucuccggcugcugccagcaccagugccaggcccccgacaccaucguccccgucgaccucggcugccccuccccccgccccgaguccugccuccgcuucggcgaggucgcccuccuccuccccaccaaggaccccugcugccucggcaccgucugcgucugcaaccagacccucugcgagggccucgcccccaccugccgccccggccaccgccuccucacccacuuccaggaggacuccugcugccccuccuacuccugcgagugcgaccccgaccucugcgaggccgagcucguccccuccugccgccaggaccagauccucaucaccggccgccucggcgacuccugcugcaccuccuacuucugcgccugcggcgacugccccgacuccauccccgagugccaggagggcgaggcccucaccguccaccgcaacaccaccgagcucugcugcccccucuaccagugcgucugcgagaacuuccgcugcccccagguccagugcggccucggcaccgcccucgucgaggucuggucccccgaccgcugcugccccuacaaguccugcgagugcgacugcgacaccauccccgucccccgcugccaccucugggagaagucccagcucgacgaggaguucaugcacuccgucgagaacgucugcggcugcgccaaguacgagugcgucaaggcccccgucugccucucccgcgagcucggcgucaugcagcccggccagaccgucgucgagcucuccgccgacggcgucugccacaccucccgcugcaccaccguccucgacccccucaccaacuucuaccagaucaacaccaccuccguccucugcgacauccacugcgaggccaaccaggaguacgagcacccccgcgaccucgccgccugcugcggcuccugccgcaacgucuccugccucuucaccuuccccaacggcaccaccucccucuuccuccccggcgccuccuggaucgccgacugcgcccgccaccacugcuccuccaccccccucggcgccguccucguccgcucccccaucuccugccccccccucaacgagaccgagugcgccaaggucggcggcuccgucguccccucccucgagggcugcugccgcaccugcaaggaggacggccgcuccugcaagaaggucaccauccgcaugaccauccgcaagaacgagugccgcuccuccacccccgucaaccucgucuccugcgacggccgcugccccuccgccuccaucuacaacuacaacaucaacaccuacgcccgcuucugcaagugcugccgcgaggucggccuccagcgccgcuccguccagcucuucugcgccaccaacgccaccuggguccccuacaccguccaggagcccaccgacugcgccugccagugguccuga

SEQ ID NO: 47191 - RNA, 7035 nt, Artificial Sequence
  derived and/or modified sequence opt2 from OTOGL__Homo_sapiens__NP_775862
augauccccugguccaucuuccuccuccacguccuccucuucucccuccaggaguacaucugcgccuccuccauccucaugggcaccuccaagaacggcuucaacgagaaccgccagaagcgcgcccuccucgccgcccaguucgaggccaccuccccccgcuacuucuuccacgacgccaucaacuggggcgaguccaagaucaagggcuccugccccuacgagugccucaacggcgccuucugcuccaagaccggcaccugcgacugccagaucuuccaggcccucggcacccgcugccagaucauccccaacaugggcaacggccgcgacggcaucugcaagaccuggggccaguaccacuucgagaccuucgacggcaucuacuacuacuuccccggcaacugcuccuacaucuucgccaaggacugcggcgaccucgagccccgcuacaccgucuggguccacaacucccccaagugccucggcuccgucuacuccugcuaccgcuccaucucccucuucuucuccaaccaggaggagauccgcaucuacggccacgagaucaagaagaacggcaucucccucacccucccccagaccaucggccagaucuucaucgagaagcucgccgacuacauccucgucaagaccaccuucggcuucucccucgccugggacggcaucuccggcaucuaccucaagcucuccgaggaccacaagggcaaguccugcggccucugcggcaacuacaacgacauccaguccgacgacuucaucauccuccaggaggacuacaccgaggacaucgccauguucgccaacuccugguccguccagacccccgacgacaccaagugcguccucacccccuccgacuuccccaaccccugcuccuccggcaugcccgccuucgaggccaucuucuucaagugccagauccuccuccaguuccccuuccucuccugccacgaguacaucgaccccuaccucuacaucgccuccugcgucaacgaccucugcaagaccgacgacgacgagaccuacugccgcgccgccaccgaguacgcccgcgccugcucccacgccggcuaccccauccaggacuggcgcgacgacuuccccgccugcaccgacaagugcgacgacuccuucguccaccgcgacugcaucuccugcugcccccccaccugcaccuucgagaagcagugccucggcuccaaccuccacugccucgacggcugcuacugccccgacggccucgucauggacaacggcaccugcaucucccucgagaacugccccugcggcuuccacggccucgccuacuccgucggcuccaagaucgagcaggagugcaccgagugcgucugcgucggcggcgucuggaacugcaccgagcaggacugccccguccagugcuccgucgucggcgacucccacuucaccaccuucgacggccgccacuacuccuucaucggcaugugccaguacauccucgucaagggcaccggcaaggacaaguucaccaucacccuccagaaggcccccugcgagcagaaccucggccucgucugccuccaguccaucacccucauccucgaggacgacuucaacaagcaggucacccucggccgcggcggccagauccucaccucccccaaccagggcuucaaccucaacggcaucgucgagauccagacccucuccucccucuucauccuccucaagaccaccuucggccucaagauccucuucgccaucgacggcgagcgcaucuacauccagcucaccuccgccuggaagcgccgcacccucggccucugcggcaccuucaacggcaacauccgcgacgacuuccucucccccuccggcaugaucgagggcaccccccagcuccacgccaacgccuggcgcgucuccuccaccugcuucgcccccguccacguccccgucgucgaccccugcaacaucaaccagcagaacaucggcuacgccgcccacugcgacgucauccaccaggagcucuucgcccccugccacaucuacaucucccccggccucuacuaccagcucugccgccacgacgccugcaagugcggcuccuccugccucugcaacgcccucgcccacuacgccuaccucugcggccagcacggcguccccaucgacuuccgcacccagaucuccuucugcgccgucgucugccagaagggcaugcucuaccaccacugcuccuccuucugccuccacuccugcaucucccucuccucccccgagcagugcuccgacgacugcgccgagggcugcaacugccccgagggcaaguucuacgaggacacccucaacuucugcguccccaucuuccacugccgcugccacuaccgcggcuccgucuaccagcccggcgagcucauccccacccccuccggccucugccagugcuccaacggcaccgucaagugcgacgagcucgccacccccuccgccguccacaucugccccgagggcaaggaguacuucgacugccgcuuccccgaccccgagcuccccgccggcggcgucaacugcgagaccaccugcgccaaccucgccaugaacuucaccugcacccccuccucccccugcaucuccggcugcgucugcgcccccggcauggccgagcaccgcggcaagugcuacguccccgaguccugccccugcaucuggaaggacugggaguaccucuccggcgaggucaucgccacccccugcuacaccugcgucugccgccgcggcauguucaacugcaccuacuaccccugccccgccgucugcaccaucuacggcgaccgccacuacuacuccuucgacggccucgaguacgacuacaucuccgacugccaggucuuccucaucaaguccgccgacgacuccgacaucuccgucaucgcccagaacaagaagugcuucgacaacgacaucgucugcuccaaguccguccucaucuccgucggcgacaccgagaucuaccucaacgacacccccuacaagcagaagcaguccggcuucuuccucgagaacaaguccaccuaccagcucuggaaggccggcuacuacaucgucgucuacuuccccgagaaggacaucaccauccucugggaccgcaagaccaccauccacaucaaggucggcccccaguggaagaacaagcucuccggccucugcggcaacuucgacaagugcaccuccaacgacaugaccaccuccaacaaccucgagguccgcaacgcccgcgucuucggcgacuccugggcccucggccagugcgagucccccgacgagaccaucaagcccugcgaggcccaccagaacaaguuccccuacgccaagaaggagugcuccauccucuacuccgacaucuucgccuccugccgcaacgucaucgacgucaccuccuucgccaagaacugccacgaggacaccugcaacugcaaccucggcggcgacugcgagugccucugcaccuccaucgccgccuacgccuacaagugcugccaggagggcaucuccauccacuggcgcuccuccaccgucugcucccucgacugcgaguacuacaacgagggccucggcgagggccccuacaugcucgccuccuacggccaguccggccucguccucggcgccaacaugaccucccgcuccgucuucugccucccccgcuccuccguccacaccucccucuucuucuacuucaugaucacccccggccucuucaaggagaaggucuccucccucgcccucgucucccucgaguccgccgagcgccccaacuacuuccucuacguccacgacaacgacacccucucccucgagcucugggaggccaacuccgccuuccaccgccgcgccaccuucuuccaccaccagggccucuggauccccggcuacuccgccuucgagcucuacuccaagaagggcuucuucaucaucuucaccgacuccuccgucaaggccuccaaguacgacgacuccgaggaguucaagcacuccuccuccuucuccaucgaggagauccaggccgccguccccuaccgcaagaugugcgaguggcgcuacgagcccugcgccacccccugcuucaagaccugcuccgaccccgaggcccucgccugcaaguuccucccccccgucgagggcugccuccccuacugccccaagaacaugauccucgacgaggucacccucaagugcgucuacccccgcgacugcauccccgucauccccaccgagcccacccucaugccccccgccaagcccaccguccccauguucaccgucugggagaugaucacccccuccgacaucaccgucuucgacaugcucacccccaccaccggccucgagugcgagccccagaaguucgaccccgucuacgacugcucccaguacaucugccucaacauggaguggcagcucuacaacuggucccucaacugccccaaggacgucgagaugcccgacugcggcuuccgcggccgccccguccaggucaacuccgacaucugcugccccgagugggagugccccugccgcugcuccaugcucuccgagcucuccaucaucaccuucgacggcaacaacgccgcccucuacuccauggccuccuacauccucguccgcauccccggcgagaucaucgucgcccacaucgagaagugcuccaugaaccagaacggcaacucccucaagaagcucgcccccuccggccgcaucuccggccucugcuucaagaagcucaacgucaccacccccauccacaagaucaucgucaaccgccucgcccgcaaggucgaggucgacuccaucgucgucccccuccccuucuccucccaggagcucuccaucgaggacuccggcuccauguacgucaucaccacccccgccggccucaucaucaaguggucccaccucaccggcaucaucgacauccacuucggcuuccgcuucaaccucuccuccuacaccgagggccucugcggcaucugcaacgaggaccccgacgacgaccuccgcaugcagaacggcaccaucaucaccaacauggaggacaucggccucuucaucgaguccugggagaucgagaaguccuucgaggucaccaugcgccgccccguccgcaacugcaccgagcacgacugcucccagugcaucgaccuccucaaccgccgcaucuucauccccugccacgacaaggucucccccgaggacuucugcgagaagauguggaucaacuacaccuacuucuggaacuacgagugcgacgcccucuccgccuacgucgcccucugcaacaaguucgacaucugcauccaguggcgcacccccgacuacugcucccucuccugccccgagggcaaggaguaccagcccugcguccgccccugcgaggcccgcaccugccucaaccagugguucuacggccacaccuccugccucaaccuccgcgaggacugcgucugcaaggucggcaccauccuccaccgcccccacuccgcccagugcauccccgagaaggagugcgccugcaccgacuccgaggaccagccccgcaccgccggcgagaucuggaacggcggcaucgacgagugcacccucuacaagugccucgagaacggcuccaucauccccaucgagcccgacugcgacgaggagcccacccccgucugcgagcgcgaggccgaggucgucaugggcaucaucgacaaguggaccugcugcuccaaggaggucugcggcugcgacaccacccucugcgagaccuccauccccaccugcaccaacucccagaagcucaucgucggccacuccccccucuccugcugcccccaguacaagugcgagugcgacccccucaagugccccuccaucuccacccccgagugccgcgaggaccaguucaugauccagguccgccaggaggagcccugcugcuucucccccuucugcgucugcgaguccugcaccaagcccgucccccucugccacgacggcgaguuccucaccgucgaccucaacuccacccacuucugcugcccccaguacuacugcgucugcgagcccaaccucugccccaugccccuccucaacugcgccgaggacaugaaccucgucaaggagaacgucuccggccagugcugccccaccuggcacugcgagugcaacugcgagaaccucaucaugcccaccugcgaggucggcgaguucaccgccaucgaccacaacuuccaguccgacugcggcugcauccaguaccucugcgagaaggacgacgucugcgucuuccaggaggucuccguccucaaccccggccaguccaugaucaaguaccucgaggaggacuucugcuacgccaucgagugccucgaggagaaggacaaccacaccggcuuccacacccucaacuucacccucgucaacugcuccaagaagugcgacguccaccaggucuacacccccucccccuccgacuacggcugcugcggcaccugcaagaacgucuccugcaaguuccacauggagaacggcaccuccgucgucuacgccgucggcuccaccuggcacuacaacugcaccaccuacgagugcgucaagaccgacgagggcgccaucauccucaacuacaccauggucugcccccccuucaacgagaccgagugcaagaugaacgagggcaucgucaagcucuacaacgagggcugcugcaagaucugcaagcgcgaggagcgcaucugccagaaggucaucaucaaguccgucauccgcaagcaggacugcaugucccagucccccaucaacgucgccuccugcgacggcaagugccccuccgccaccaucuacaacaucaacaucgagucccaccuccgcuucugcaagugcugccgcgagaacggcguccgcaaccucuccgucccccucuacugcuccggcaacggcaccgagaucauguacacccuccaggagcccaucgacugcaccugccaguggaacuga

SEQ ID NO: 47192 - RNA, 1434 nt, Artificial Sequence
  derived and/or modified sequence opt2 from OTOL1__Homo_sapiens__NP_001073909
auguggauguucuccuggcucugcgccauccucaucauccucgccaucgccggcaugaacaccaucgccaagaccaccccccacaccaaguucaccaagaaguccgaggagcgcgagaugcccaagggccucaagcccuccuccggccccccccccgaggaggaggagacccucuucaccgagauggccgagauggccgagcccaucaccaagcccuccgcccucgacuccgucuucggcaccgccacccucucccccuucgagaacuucacccucgaccccgccgacuucuuccucaacugcugcgacugcugcucccccguccccggccagaagggcgagcccggcgagaccggccagcccggccccaagggcgaggccggcaaccucggcauccccggcccccccggcgucgucggcccccagggcccccgcggcuacaagggcgagaagggccucaagggcgagcgcggcgaccagggcguccccggcuaccccggcaagcccggcgcccagggcgagcccggccccaagggcgacaagggcaacaucggccucggcggcgucaagggccagaagggcuccaagggcgacaccugcggcaacugcaccaagggcgagaagggcgaccagggcgccaugggcucccccggccuccacggcggccccggcgccaagggcgagaagggcgagaugggcgagaagggcgagaugggcgacaagggcugcugcggcgacuccggcgagcgcggcggcaagggccagaagggcgagggcggcaugaagggcgagaagggcuccaagggcgacuccggcauggagggcaaguccggccgcaacggccuccccggcgccaagggcgaccccggcaucaagggcgagaagggcgagcucggcccccccggccuccucggccccaccggccccaagggcgacaucggcaacaagggcguccgcggccccaccggcaagaagggcucccgcggcuucaagggcuccaagggcgagcucgcccgcgucccccgcuccgccuucuccgccggccucuccaagcccuuccccccccccaacauccccaucaaguucgagaagauccucuacaacgaccagggcaacuacucccccgucaccggcaaguucaacugcuccauccccggcaccuacgucuucuccuaccacaucaccguccgcggccgccccgcccgcaucucccucgucgcccagaacaagaagcaguucaagucccgcgagacccucuacggccaggagaucgaccaggccucccuccucgucauccucaagcucuccgccggcgaccaggucuggcucgaggucuccaaggacuggaacggcgucuacgucuccgccgaggacgacuccaucuucaccggcuuccuccucuaccccgaggagaccuccggcaucucccccuga

SEQ ID NO: 47193 - RNA, 1839 nt, Artificial Sequence
  derived and/or modified sequence opt2 from OTOP1__Homo_sapiens__NP_819056
augcucgagggccucggcucccccgccuccccccgcgccgccgccuccgccuccgucgccggcuccuccggccccgccgccugcuccccccccuccuccuccgccccccgcucccccgagucccccgccccccgccgcggcggcguccgcgccuccgucccccagaagcucgccgagaugcucuccucccaguacggccucaucgucuucgucgccggccuccuccuccuccucgccugggccguccacgccgccggcgucuccaaguccgaccuccucugcuuccucaccgcccucaugcuccuccagcuccucuggaugcucugguacgucggccgcuccuccgcccaccgccgccucuuccgccucaaggacacccacgccggcgccggcuggcuccgcggcuccaucacccucuucgccgucaucaccgucauccucggcugccucaagaucggcuacuucaucggcuucuccgagugccucuccgccaccgagggcgucuuccccgucacccacuccguccacacccuccuccaggucuacuuccucuggggccacgccaaggacaucauccaguccuucaagacccucgagcgcuucggcgucauccacuccgucuucaccaaccuccuccucugggccaacggcguccucaacgaguccaagcaccagcucaacgagcacaaggagcgccucaucacccucggcuucggcaacaucaccaccguccucgacgaccacaccccccagugcaacugcaccccccccacccucugcaccgccaucucccacggcaucuacuaccucuaccccuucaacaucgaguaccagauccucgccuccaccaugcucuacguccucuggaagaacaucggccgcaaggucgacucccaccagcaccagaagaugcaguucaaguccgacggcgucauggucggcgccguccucggccucaccguccucgccgccaccaucgccgucgucgucgucuaccucauccacaucggccgcuccaagaccaaguccgaguccgcccucaucauguucuaccucuacgccaucacccuccucaugcucaugggcgccgccggccucgccggcauccgcaucuaccgcaucgacgagaagucccucgacgaguccaagaaccccgcccgcaagcucgacuccgaccuccucgucggcaccgccuccggcuccuggcucaucuccuggggcuccauccucgccauccucugcgccgagggccacccccgcuacaccugguacaaccuccccuacuccauccucgccaucgucgagaaguacauccagaaccucuucaucuucgaguccauccaccgcgagcccgagaagcucuccgaggacauccagacccuccgcgucgucaccgucugcaacggcaacaccaugccccucgccuccuccugccccaaguccggcggcgucgcccgcgacgucgccccccagggcaaggacaugccccccgccgccaacggcaacgucugcaugcgcgagucccacgacaaggaggaggagaagcaggaggaguccuccuggggcggcucccccucccccguccgccucccccgcuuccuccagggcaacgccaagcgcaagguccuccgcaacaucgccgccuuccucuuccucugcaacaucucccucuggaucccccccgccuucggcugccgccccgaguacgacaacggccucgaggagaucgucuucggcuucgagcccuggaucaucgucgucaaccucgccaugcccuucuccaucuucuaccgcaugcacgccgccgccucccucuucgaggucuacugcaagaucuga

SEQ ID NO: 47194 - RNA, 387 nt, Artificial Sequence
  derived and/or modified sequence opt2 from OTOR__Homo_sapiens__NP_064542
auggcccgcauccuccuccucuuccuccccggccucgucgccgucugcgccguccacggcaucuucauggaccgccucgccuccaagaagcucugcgccgacgacgagugcgucuacaccaucucccucgccuccgcccaggaggacuacaacgcccccgacugccgcuucaucaacgucaagaagggccagcagaucuacgucuacuccaagcucgucaaggagaacggcgccggcgaguucugggccggcuccgucuacggcgacggccaggacgagaugggcgucgucggcuacuucccccgcaaccucgucaaggagcagcgcgucuaccaggaggccaccaaggagguccccaccaccgacaucgacuucuucugcgaguga

SEQ ID NO: 47195 - RNA, 978 nt, Artificial Sequence
  derived and/or modified sequence opt2 from OTP__Homo_sapiens__NP_115485
augcucucccacgccgaccuccucgacgcccgccucggcaugaaggacgccgccgagcuccucggccaccgcgaggccgucaagugccgccucggcgucggcggcuccgaccccggcggccaccccggcgaccucgcccccaacuccgaccccgucgagggcgccacccuccuccccggcgaggacaucaccaccgucggcuccacccccgccucccucgccgucuccgccaaggaccccgacaagcagcccggcccccagggcggccccaaccccucccaggccggccagcagcagggccagcagaagcagaagcgccaccgcacccgcuucacccccgcccagcucaacgagcucgagcgcuccuucgccaagacccacuaccccgacaucuucaugcgcgaggagcucgcccuccgcaucggccucaccgagucccgcguccaggucugguuccagaaccgccgcgccaaguggaagaagcgcaagaagaccaccaacgucuuccgcgcccccggcacccuccuccccacccccggccucccccaguuccccuccgccgccgccgccgccgccgccgccaugggcgacucccucugcuccuuccacgccaacgacacccgcugggccgccgccgccaugcccggcgucucccagcucccccucccccccgcccucggccgccagcaggccauggcccagucccucucccagugcucccucgccgccggccccccccccaacuccaugggccucuccaacucccucgccggcuccaacggcgccggccuccagucccaccucuaccagcccgccuuccccggcaugguccccgccucccuccccggccccuccaacgucuccggcuccccccagcucugcuccucccccgacuccuccgacgucuggcgcggcaccuccaucgccucccuccgccgcaaggcccucgagcacaccgucuccauguccuucaccuga

SEQ ID NO: 47196 - RNA, 816 nt, Artificial Sequence
  derived and/or modified sequence opt2 from OTUB1__Homo_sapiens__NP_060140
auggccgccgaggagccccagcagcagaagcaggagccccucggcuccgacuccgagggcgucaacugccucgccuacgacgaggccaucauggcccagcaggaccgcauccagcaggagaucgccguccagaacccccucgucuccgagcgccucgagcucuccguccucuacaaggaguacgccgaggacgacaacaucuaccagcagaagaucaaggaccuccacaagaaguacuccuacauccgcaagacccgccccgacggcaacugcuucuaccgcgccuucggcuucucccaccucgaggcccuccucgacgacuccaaggagcuccagcgcuucaaggccgucuccgccaaguccaaggaggaccucgucucccagggcuucaccgaguucaccaucgaggacuuccacaacaccuucauggaccucaucgagcaggucgagaagcagaccuccgucgccgaccuccucgccuccuucaacgaccaguccaccuccgacuaccucgucgucuaccuccgccuccucaccuccggcuaccuccagcgcgaguccaaguucuucgagcacuucaucgagggcggccgcaccgucaaggaguucugccagcaggaggucgagcccaugugcaaggaguccgaccacauccacaucaucgcccucgcccaggcccucuccgucuccauccaggucgaguacauggaccgcggcgagggcggcaccaccaacccccacaucuuccccgagggcuccgagcccaaggucuaccuccucuaccgccccggccacuacgacauccucuacaaguga

SEQ ID NO: 47197 - RNA, 1446 nt, Artificial Sequence
  derived and/or modified sequence opt2 from OTUD1__Homo_sapiens__NP_001138845
augcagcucuacuccuccgucugcacccacuaccccgccggcgcccccggccccaccgccgccgcccccgccccccccgccgccgccacccccuucaaggucucccuccagccccccggcgccgccggcgccgcccccgagcccgagaccggcgagugccagcccgccgccgccgccgagcaccgcgaggccgccgccguccccgccgccaagaugcccgccuucuccuccugcuucgaggucgucuccggcgccgccgcccccgccuccgccgccgccggcccccccggcgccuccugcaagcccccccuccccccccacuacaccuccaccgcccagaucaccguccgcgcccucggcgccgaccgccuccuccuccacggccccgaccccguccccggcgccgccggcuccgccgccgccccccgcggccgcugccuccuccucgcccccgcccccgccgcccccguccccccccgccgcggcuccuccgccuggcuccucgaggagcuccuccgccccgacugccccgagcccgccggccucgacgccacccgcgagggccccgaccgcaacuuccgccucuccgagcaccgccaggcccucgccgccgccaagcaccgcggccccgccgccacccccggcucccccgaccccggccccggccccuggggcgaggagcaccucgccgagcgcggcccccgcggcugggagcgcggcggcgaccgcugcgacgcccccggcggcgacgccgcccgccgccccgaccccgaggccgaggccccccccgccggcuccaucgaggccgcccccuccuccgccgccgagcccgucaucgucucccgcuccgacccccgcgacgagaagcucgcccucuaccucgccgaggucgagaagcaggacaaguaccuccgccagcgcaacaaguaccgcuuccacaucauccccgacggcaacugccucuaccgcgccgucuccaagaccgucuacggcgaccagucccuccaccgcgagcuccgcgagcagaccguccacuacaucgccgaccaccucgaccacuucuccccccucaucgagggcgacgucggcgaguucaucaucgccgccgcccaggacggcgccugggccggcuaccccgagcuccucgccaugggccagaugcucaacgucaacauccaccucaccaccggcggccgccucgagucccccaccgucuccaccaugauccacuaccucggccccgaggacucccuccgccccuccaucuggcucuccuggcucuccaacggccacuacgacgccgucuucgaccacuccuaccccaaccccgaguacgacaacuggugcaagcagacccagguccagcgcaagcgcgacgaggagcucgccaaguccauggccaucucccucuccaagauguacaucgagcagaacgccugcuccuga

SEQ ID NO: 47198 - RNA, 3150 nt, Artificial Sequence
  derived and/or modified sequence opt2 from OTUD4__Homo_sapiens__NP_001096123
auggccugcauccacuaccuccgcgagaaccgcgagaaguucgaggccuucaucgagggcuccuucgaggaguaccucaagcgccucgagaacccccaggagugggucggccaggucgagaucuccgcccucucccucauguaccgcaaggacuucaucaucuaccgcgagcccaacgucucccccucccaggucaccgagaacaacuuccccgagaagguccuccucugcuucuccaacggcaaccacuacgacaucgucuaccccaucaaguacaaggaguccuccgccaugugccagucccuccucuacgagcuccucuacgagaaggucuucaagaccgacgucuccaagaucgucauggagcucgacacccucgaggucgccgacgaggacaacuccgagaucuccgacuccgaggacgacuccugcaaguccaagaccgccgccgccgccgccgacgucaacggcuucaagccccucuccggcaacgagcagcucaagaacaacggcaacuccaccucccucccccucucccgcaagguccucaagucccucaaccccgccgucuaccgcaacgucgaguacgagaucuggcucaaguccaagcaggcccagcagaagcgcgacuacuccaucgccgccggccuccaguacgaggucggcgacaagugccagguccgccucgaccacaacggcaaguuccucaacgccgacguccagggcauccacuccgagaacggccccguccucgucgaggagcucggcaagaagcacaccuccaagaaccucaaggcccccccccccgaguccuggaacaccgucuccggcaagaagaugaagaagcccuccaccuccggccagaacuuccacuccgacgucgacuaccgcggccccaagaaccccuccaagcccaucaaggcccccuccgcccuccccccccgccuccagcaccccuccggcguccgccagcacgccuucuccucccacuccuccggcucccagucccagaaguucuccuccgagcacaagaaccucucccgcacccccucccagaucauccgcaagcccgaccgcgagcgcgucgaggacuucgaccacaccucccgcgaguccaacuacuucggccucucccccgaggagcgccgcgagaagcaggccaucgaggagucccgccuccucuacgagauccagaaccgcgacgagcaggccuuccccgcccucuccuccuccuccgucaaccaguccgccucccaguccuccaaccccugcguccagcgcaaguccucccacgucggcgaccgcaagggcucccgccgccgcauggacaccgaggagcgcaaggacaaggacuccauccacggccacucccagcucgacaagcgccccgagcccuccacccucgagaacaucaccgacgacaaguacgccaccgucuccucccccuccaaguccaagaagcucgagugccccucccccgccgagcagaagcccgccgagcacgucucccucuccaaccccgccccccuccucgucucccccgagguccaccucacccccgccguccccucccuccccgccaccguccccgccuggcccuccgagcccaccaccuucggccccaccggcguccccgcccccauccccguccucuccgucacccagacccucaccaccggccccgacuccgccgucucccaggcccaccucacccccucccccguccccgucuccauccaggccgucaaccagccccucaugccccucccccagacccucucccucuaccaggacccccucuaccccggcuuccccugcaacgagaagggcgaccgcgccaucgucccccccuacucccucugccagaccggcgaggaccuccccaaggacaagaacauccuccgcuucuucuucaaccucggcgucaaggccuacuccugccccaugugggccccccacuccuaccucuacccccuccaccaggccuaccucgccgccugccgcauguaccccaagguccccguccccgucuacccccacaaccccugguuccaggaggcccccgccgcccagaacgaguccgacugcaccugcaccgacgcccacuuccccaugcagaccgaggccuccgucaacggccagaugccccagcccgagaucggcccccccaccuucuccuccccccucgucaucccccccucccaggucuccgagucccacggccagcucuccuaccaggccgaccucgaguccgagacccccggccagcuccuccacgccgacuacgaggagucccucuccggcaagaacauguucccccagcccuccuucggccccaaccccuuccucggccccguccccaucgccccccccuucuucccccacgucugguacggcuaccccuuccagggcuucaucgagaaccccgucaugcgccagaacaucguccuccccuccgacgagaagggcgagcucgaccucucccucgagaaccucgaccucuccaaggacugcggcuccgucuccaccgucgacgaguuccccgaggcccgcggcgagcacguccacucccuccccgaggccuccgucuccuccaagcccgacgagggccgcaccgagcaguccucccagacccgcaaggccgacaccgcccucgccuccaucccccccgucgccgagggcaaggcccacccccccacccagauccucaaccgcgagcgcgagaccguccccgucgagcucgagcccaagcgcaccauccagucccucaaggagaagaccgagaaggucaaggaccccaagaccgccgccgacgucgucucccccggcgccaacuccgucgacucccgcguccagcgccccaaggaggaguccuccgaggacgagaacgaggucuccaacauccuccgcuccggccgcuccaagcaguucuacaaccagaccuacggcucccgcaaguacaaguccgacuggggcuacuccggccgcggcggcuaccagcacguccgcuccgaggaguccuggaagggccagcccucccgcucccgcgacgagggcuaccaguaccaccgcaacguccgcggccgccccuuccgcggcgaccgccgccgcuccggcaugggcgacggccaccgcggccagcacaccuga

SEQ ID NO: 47199 - RNA, 2781 nt, Artificial Sequence
  derived and/or modified sequence opt2 from OTUD7A__Homo_sapiens__NP_570971
auggucuccuccguccuccccaaccccaccuccgccgagugcugggccgcccuccuccacgaccccaugacccucgacauggacgccguccucuccgacuucguccgcuccaccggcgccgagcccggccucgcccgcgaccuccucgagggcaagaacugggaccucaccgccgcccucuccgacuacgagcagcuccgccagguccacaccgccaaccucccccacgucuucaacgagggccgcggccccaagcagcccgagcgcgagccccagcccggccacaaggucgagcgccccugccuccagcgccaggacgacaucgcccaggagaagcgccucucccgcggcaucucccacgccuccuccgccaucgucucccucgcccgcucccacgucgccuccgagugcaacaacgagcaguucccccucgagaugcccaucuacaccuuccagcuccccgaccucuccgucuacuccgaggacuuccgcuccuucaucgagcgcgaccucaucgagcaggccaccauggucgcccucgagcaggccggccgccucaacuggugguccaccgucugcaccuccugcaagcgccuccucccccucgccaccaccggcgacggcaacugccuccuccacgccgccucccucggcauguggggcuuccacgaccgcgaccucguccuccgcaaggcccucuacaccaugaugcgcaccggcgccgagcgcgaggcccucaagcgccgcuggcgcuggcagcagacccagcagaacaaggaggaggagugggagcgcgaguggaccgagcuccucaagcucgccuccuccgagccccgcacccacuucuccaagaacggcggcaccggcggcggcgucgacaacuccgaggaccccgucuacgagucccucgaggaguuccacgucuucguccucgcccacauccuccgccgccccaucgucgucgucgccgacaccaugcuccgcgacuccggcggcgaggccuucgcccccauccccuucggcggcaucuaccucccccucgaggucccccccaaccgcugccacugcuccccccucguccucgccuacgaccaggcccacuucuccgcccucgucuccauggagcagcgcgaccagcagcgcgagcaggccgucaucccccucaccgacuccgagcacaagcuccucccccuccacuucgccgucgaccccggcaaggacugggaguggggcaaggacgacaacgacaacgcccgccucgcccaccucauccucucccucgaggccaagcucaaccuccuccacuccuacaugaacgucaccuggauccgcauccccuccgagacccgcgccccccucgcccagcccgagucccccaccgccuccgccggcgaggacguccagucccucgccgacucccucgacuccgaccgcgacuccgucugcuccaacuccaacuccaacaacggcaagaacggcaaggacaaggagaaggagaagcagcgcaaggagaaggacaagacccgcgccgacuccgucgccaacaagcucggcuccuucuccaagacccucggcaucaagcucaagaagaacaugggcggccucggcggccucguccacggcaagaugggccgcgccaacuccgccaacggcaagaacggcgacuccgccgagcgcggcaaggagaagaaggccaagucccgcaagggcuccaaggaggaguccggcgccuccgccuccaccucccccuccgagaagaccacccccucccccaccgacaaggccgccggcgccucccccgccgagaagggcggcggcccccgcggcgacgccuggaaguacuccaccgacgucaagcucucccucaacauccuccgcgccgccaugcagggcgagcgcaaguucaucuucgccggccuccuccucaccucccaccgccaccaguuccacgaggagaugaucggcuacuaccucaccuccgcccaggagcgcuucuccgccgagcaggagcagcgccgccgcgacgccgccaccgccgccgccgccgccgccgccgccgccgccgccaccgccaagcgccccccccgccgccccgagaccgagggcguccccguccccgagcgcgccucccccggcccccccacccagcucguccucaagcucaaggagcgccccucccccggccccgccgccggccgcgccgcccgcgccgccgccggcggcaccgccucccccggcggcggcgcccgccgcgccuccgccuccggccccguccccggccgcuccccccccgcccccgcccgccaguccgucauccacguccaggccuccggcgcccgcgacgaggccugcgcccccgccgucggcgcccuccgccccugcgccaccuacccccagcagaaccgcucccucuccucccaguccuacucccccgcccgcgccgccgcccuccgcaccgucaacaccgucgagucccucgcccgcgccguccccggcgcccuccccggcgccgccggcaccgccggcgccgccgagcacaagucccagaccuacaccaacggcuucggcgcccuccgcgacggccucgaguucgccgacgccgacgcccccaccgcccgcuccaacggcgagugcggccgcggcggccccggccccguccagcgccgcugccagcgcgagaacugcgccuucuacggccgcgccgagaccgagcacuacugcuccuacugcuaccgcgaggagcuccgccgccgccgcgaggcccgcggcgcccgccccuga

SEQ ID NO: 47200 - RNA, 2559 nt, Artificial Sequence
  derived and/or modified sequence opt2 from OTUD7B__Homo_sapiens__XP_011508087
augacccucgacauggacgccguccucuccgacuucguccgcuccaccggcgccgagcccggccucgcccgcgaccuccucgagggcaagaacugggacgucaacgccgcccucuccgacuucgagcagcuccgccagguccacgccggcaaccucccccccuccuucuccgagggcuccggcggcucccgcacccccgagaagggcuucuccgaccgcgagcccacccgccccccccgccccauccuccagcgccaggacgacaucguccaggagaagcgccucucccgcggcaucucccacgccuccuccuccaucgucucccucgcccgcucccacgucuccuccaacggcggcggcggcggcuccaacgagcacccccucgagaugcccaucugcgccuuccagcuccccgaccucaccgucuacaacgaggacuuccgcuccuucaucgagcgcgaccucaucgagcaguccaugcucgucgcccucgagcaggccggccgccucaacuggugggucuccgucgaccccaccucccagcgccuccucccccucgccaccaccggcgacggcaacugccuccuccacgccgccucccucggcauguggggcuuccacgaccgcgaccucaugcuccgcaaggcccucuacgcccucauggagaagggcgucgagaaggaggcccucaagcgccgcuggcgcuggcagcagacccagcagaacaaggaguccggccucgucuacaccgaggacgaguggcagaaggaguggaacgagcucaucaagcucgccuccuccgagccccgcaugcaccucggcaccaacggcgccaacugcggcggcgucgaguccuccgaggagcccgucuacgagucccucgaggaguuccacgucuucguccucgcccacguccuccgccgccccaucgucgucgucgccgacaccaugcuccgcgacuccggcggcgaggccuucgcccccauccccuucggcggcaucuaccucccccucgagguccccgccucccagugccaccgcuccccccucguccucgccuacgaccaggcccacuucuccgcccucgucuccauggagcagaaggagaacaccaaggagcaggccgucaucccccucaccgacuccgaguacaagcuccucccccuccacuucgccgucgaccccggcaagggcugggaguggggcaaggacgacuccgacaacguccgccucgccuccgucauccucucccucgaggucaagcuccaccuccuccacuccuacaugaacgucaaguggaucccccucuccuccgacgcccaggucaagaccucccccaccuccacccucgccccccucgcccagcccgagucccccaccgccuccgccggcgacgagccccgcuccacccccgaguccggcgacuccgacaaggaguccgucggcuccuccuccaccuccaacgagggcggccgccgcaaggagaaguccaagcgcgaccgcgagaaggacaagaagcgcgccgacuccgucgccaacaagcucggcuccuucggcaagacccucggcuccaagcucaagaagaacaugggcggccucaugcacuccaagggcuccaagcccggcggcgucggcaccggccucggcggcuccuccggcaccgagacccucgagaagaagaagaagaacucccucaaguccuggaagggcggcaaggaggaggccgccggcgacggccccgucuccgagaagccccccgccgaguccgucggcaacggcggcuccaaguacucccaggaggucaugcagucccucuccauccuccgcaccgccaugcagggcgagggcaaguucaucuucgucggcacccucaagaugggccaccgccaccaguaccaggaggagaugauccagcgcuaccucuccgacgccgaggagcgcuuccucgccgagcagaagcagaaggaggccgagcgcaagaucaugaacggcggcaucggcggcggccccccccccgccaagaagcccgagcccgacgcccgcgaggagcagcccaccggcccccccgccgagucccgcgccauggccuucuccaccggcuaccccggcgacuucaccaucccccgccccuccggcggcggcguccacugccaggagccccgccgccagcucgccggcggccccugcgucggcggccucccccccuacgccaccuucccccgccagugcccccccggccgccccuacccccaccaggacuccauccccucccucgagcccggcucccacuccaaggacggccuccaccgcggcgcccuccuccccccccccuaccgcgucgccgacuccuacuccaacggcuaccgcgagccccccgagcccgacggcugggccggcggccuccgcggccucccccccacccagaccaagugcaagcagcccaacugcuccuucuacggccaccccgagaccaacaacuucugcuccugcugcuaccgcgaggagcuccgccgccgcgagcgcgagcccgacggcgagcuccucguccaccgcuucuga

SEQ ID NO: 47201 - RNA, 1059 nt, Artificial Sequence
  derived and/or modified sequence opt2 from OTULIN__Homo_sapiens__NP_612357
augucccgcggcaccaugccccagcccgaggccuggcccggcgccuccugcgccgagacccccgcccgcgaggccgccgccaccgcccgcgacggcggcaaggccgccgccuccggccagccccgccccgagaugcagugccccgccgagcacgaggaggacauguaccgcgccgccgacgagaucgagaaggagaaggagcuccucauccacgagcgcggcgccuccgagccccgccucuccgucgcccccgagauggacaucauggacuacugcaagaaggaguggcgcggcaacacccagaaggccaccugcaugaagaugggcuacgaggaggucucccagaaguucaccuccauccgccgcguccgcggcgacaacuacugcgcccuccgcgccacccucuuccaggccaugucccaggccgucggccucccccccuggcuccaggaccccgagcucaugcuccuccccgagaagcucaucuccaaguacaacuggaucaagcaguggaagcucggccucaaguucgacggcaagaacgaggaccucgucgacaagaucaaggagucccucacccuccuccgcaagaagugggccggccucgccgagaugcgcaccgccgaggcccgccagaucgccugcgacgagcucuucaccaacgaggccgaggaguacucccucuacgaggccgucaaguuccucaugcucaaccgcgccaucgagcucuacaacgacaaggagaagggcaaggagguccccuucuucuccguccuccucuucgcccgcgacaccuccaacgaccccggccagcuccuccgcaaccaccucaaccaggucggccacaccggcggccucgagcaggucgagauguuccuccucgccuacgccguccgccacaccauccaggucuaccgccucuccaaguacaacaccgaggaguucaucaccgucuaccccaccgacccccccaaggacuggcccgucgucacccucaucgccgaggacgaccgccacuacaacauccccguccgcgucugcgaggagaccucccucuga

SEQ ID NO: 47202 - RNA, 1065 nt, Artificial Sequence
  derived and/or modified sequence opt2 from OTX1__Homo_sapiens__NP_055377
augauguccuaccucaagcagccccccuacggcaugaacggccucggccucgccggccccgccauggaccuccuccaccccuccgucggcuaccccgccaccccccgcaagcagcgccgcgagcgcaccaccuucacccgcucccagcucgacguccucgaggcccucuucgccaagacccgcuaccccgacaucuucaugcgcgaggaggucgcccucaagaucaaccuccccgagucccgcguccaggucugguucaagaaccgccgcgccaagugccgccagcagcagcaguccggcuccggcaccaagucccgccccgccaagaagaaguccucccccguccgcgaguccuccggcuccgaguccuccggccaguucaccccccccgccgucuccuccuccgccuccuccuccuccuccgccuccuccuccuccgccaaccccgccgccgccgccgccgccggccucggcggcaaccccgucgccgccgccuccucccucuccacccccgccgccuccuccaucuggucccccgccuccaucucccccggcuccgcccccgccuccgucuccguccccgagccccucgccgcccccuccaacaccuccugcaugcagcgcuccgucgccgccggcgccgccaccgccgccgccuccuaccccauguccuacggccagggcggcuccuacggccagggcuaccccacccccuccuccuccuacuucggcggcgucgacugcuccuccuaccucgcccccaugcacucccaccaccacccccaccagcucucccccauggcccccuccuccauggccggccaccaccaccaccacccccacgcccaccacccccucucccaguccuccggccaccaccaccaccaccaccaccaccaccaccagggcuacggcggcuccggccucgccuucaacuccgccgacugccucgacuacaaggagcccggcgccgccgccgccuccuccgccuggaagcucaacuucaacucccccgacugccucgacuacaaggaccaggccuccuggcgcuuccagguccucuga

SEQ ID NO: 47203 - RNA, 870 nt, Artificial Sequence
  derived and/or modified sequence opt2 from OTX2__Homo_sapiens__NP_001257453
augauguccuaccucaagcagccccccuacgccgucaacggccucucccucaccaccuccggcauggaccuccuccaccccuccgucggcuaccccgccaccccccgcaagcagcgccgcgagcgcaccaccuucacccgcgcccagcucgacguccucgaggcccucuucgccaagacccgcuaccccgacaucuucaugcgcgaggaggucgcccucaagaucaaccuccccgagucccgcguccaggucugguucaagaaccgccgcgccaagugccgccagcagcagcagcagcagcagaacggcggccagaacaagguccgccccgccaagaagaagaccucccccgcccgcgaggucuccuccgaguccggcaccuccggccaguucaccccccccuccuccaccuccguccccaccaucgccuccuccuccgcccccgucuccaucuggucccccgccuccaucuccccccucuccgacccccucuccaccuccuccuccugcaugcagcgcuccuaccccaugaccuacacccaggccuccggcuacucccagggcuacgccggcuccaccuccuacuucggcggcauggacugcggcuccuaccucacccccaugcaccaccagcuccccggccccggcgccacccucucccccaugggcaccaacgccgucaccucccaccucaaccagucccccgccucccucuccacccagggcuacggcgccuccucccucggcuucaacuccaccaccgacugccucgacuacaaggaccagaccgccuccuggaagcucaacuucaacgccgacugccucgacuacaaggaccagaccuccuccuggaaguuccagguccucuga

SEQ ID NO: 47204 - RNA, 684 nt, Artificial Sequence
  derived and/or modified sequence opt2 from OVCA2__Homo_sapiens__NP_543012
auggccgcccagcgcccccuccgcguccucugccucgccggcuuccgccaguccgagcgcggcuuccgcgagaagaccggcgcccuccgcaaggcccuccgcggccgcgccgagcucgucugccucuccggcccccaccccguccccgacccccccggccccgagggcgcccgcuccgacuucggcuccugcccccccgaggagcagccccgcggcuggugguucuccgagcaggaggccgacgucuucuccgcccucgaggagcccgccgucugccgcggccucgaggagucccucggcauggucgcccaggcccucaaccgccucggccccuucgacggccuccucggcuucucccagggcgccgcccucgccgcccucgucugcgcccucggccaggccggcgacccccgcuucccccucccccgcuucauccuccucgucuccggcuucugcccccgcggcaucggcuucaaggaguccauccuccagcgcccccucucccuccccucccuccacgucuucggcgacaccgacaaggucauccccucccaggaguccguccagcucgccucccaguuccccggcgccaucacccucacccacuccggcggccacuucauccccgccgccgccccccagcgccaggccuaccucaaguuccucgaccaguucgccgaguga

SEQ ID NO: 47205 - RNA, 804 nt, Artificial Sequence
  derived and/or modified sequence opt2 from OVOL1__Homo_sapiens__NP_004552
augccccgcgccuuccucgucaagaagcccugcgucuccaccugcaagcgcaacugguccgagcuccccgacgaggagcgcggcgagaucuacguccccgucucccucggcuucugccccccccagcccuaccgcgagcccgagcccuccgucgccgagccccccuccugcccccucgcccucaacaugucccuccgcgacuccuccuacuccauggcccccggccccugcgucgucgcccagcuccccuccgaggacaugggccaccucaccgacccccagucccgcgaccacggcuuccuccgcaccaagaugaaggucacccucggcgacucccccuccggcgaccucuucaccugccgcgucugccagaaggccuucaccuaccagcgcaugcucaaccgccacaugaagugccacaacgacgucaagcgccaccucugcaccuacugcggcaagggcuucaacgacaccuucgaccucaagcgccacguccgcacccacaccggcguccgccccuacaagugcucccucugcgacaaggccuucacccagcgcugcucccucgagucccaccucaagaagauccacggcguccagcagaaguacgccuacaaggagcgccgcgccaagcucuacgucugcgaggagugcggcugcaccuccgagucccaggagggccacguccuccaccucaaggagcaccaccccgacuccccccuccuccgcaagaccuccaagaaggucgccgucgcccuccagaacaccgucaccucccuccuccagggcuccccccaccucuga

SEQ ID NO: 47206 - RNA, 828 nt, Artificial Sequence
  derived and/or modified sequence opt2 from OVOL2__Homo_sapiens__NP_067043
augcccaaggucuuccucgucaagcgccgcucccucggcgucuccguccgcuccugggacgagcuccccgacgagaagcgcgccgacaccuacauccccgucggccucggccgccuccuccacgacccccccgaggacugccgcuccgacggcggcuccuccuccggcuccggcuccuccuccgccggcgagcccggcggcgccgaguccuccuccuccccccacgcccccgaguccgagacccccgagcccggcgacgccgagggccccgacggccaccucgccaccaagcagcgccccgucgcccgcuccaagaucaaguucaccaccggcaccugcuccgacuccgucguccacuccugcgaccucugcggcaagggcuuccgccuccagcgcaugcucaaccgccaccucaagugccacaaccaggucaagcgccaccucugcaccuucugcggcaagggcuucaacgacaccuucgaccucaagcgccacguccgcacccacaccggcauccgccccuacaagugcaacgucugcaacaaggccuucacccagcgcugcucccucgagucccaccucaagaagauccacggcguccagcagcaguacgccuacaagcagcgccgcgacaagcucuacgucugcgaggacugcggcuacaccggccccacccaggaggaccucuaccuccacgucaacuccgcccaccccggcuccuccuuccucaagaagaccuccaagaagcucgccgcccuccuccagggcaagcucaccuccgcccaccaggagaacaccucccucuccgaggaggaggagcgcaaguga

SEQ ID NO: 47207 - RNA, 1488 nt, Artificial Sequence
  derived and/or modified sequence opt2 from OXA1L__Homo_sapiens__NP_005006
auggucaccuggcucuaccgcuuccuccccaccuccaacauggccgccaagcuccgcucccuccucccccccgaccuccgccuccaguucuggcuccacgcccgccuccagaagugcuuccucucccgcggcugcggcuccuacugcgccggcgccaaggccuccccccuccccggcaagauggccaugggccucaugugcggccgccgcgagcuccuccgccuccuccaguccggccgccgcguccacuccgucgccggccccucccaguggcucggcaagccccucaccacccgccuccucuuccccgccgcccccugcugcugccgcccccacuaccucuuccucgccgccuccggcccccgcucccucuccaccuccgccaucuccuucgccgagguccagguccaggccccccccgucgucgccgccacccccucccccaccgccguccccgaggucgccuccggcgagaccgccgacgucguccagaccgccgccgagcaguccuucgccgagcucggccucggcuccuacacccccgucggccucauccagaaccuccucgaguucaugcacgucgaccucggccuccccugguggggcgccaucgccgccugcaccgucuucgcccgcugccucaucuucccccucaucgucaccggccagcgcgaggccgcccgcauccacaaccaccuccccgagauccagaaguucuccucccgcauccgcgaggccaagcucgccggcgaccacaucgaguacuacaaggccuccuccgagauggcccucuaccagaagaagcacggcaucaagcucuacaagccccucauccuccccgucacccaggcccccaucuucaucuccuucuucaucgcccuccgcgagauggccaaccuccccguccccucccuccagaccggcggccucuggugguuccaggaccucaccgucuccgaccccaucuacauccucccccucgccgucaccgccaccaugugggccguccucgagcucggcgccgagaccggcguccaguccuccgaccuccaguggaugcgcaacgucauccgcaugaugccccucaucacccuccccaucaccaugcacuuccccaccgccgucuucauguacuggcucuccuccaaccucuucucccucguccaggucuccugccuccgcauccccgccguccgcaccguccucaagaucccccagcgcgucguccacgaccucgacaagcuccccccccgcgagggcuuccucgaguccuucaagaagggcuggaagaacgccgagaugacccgccagcuccgcgagcgcgagcagcgcaugcgcaaccagcucgagcucgccgcccgcggcccccuccgccagaccuucacccacaacccccuccuccagcccggcaaggacaacccccccaacauccccuccuccuccuccaagcccaaguccaaguaccccuggcacgacacccucggcuga

SEQ ID NO: 47208 - RNA, 1563 nt, Artificial Sequence
  derived and/or modified sequence opt2 from OXCT1__Homo_sapiens__NP_000427
auggccgcccucaagcuccucuccuccggccuccgccucugcgccuccgcccgcggcuccggcgccaccugguacaagggcugcgucugcuccuucuccaccuccgcccaccgccacaccaaguucuacaccgaccccgucgaggccgucaaggacauccccgacggcgccaccguccucgucggcggcuucggccucugcggcauccccgagaaccucaucgacgcccuccucaagaccggcgucaagggccucaccgccgucuccaacaacgccggcgucgacaacuucggccucggccuccuccuccgcuccaagcagaucaagcgcauggucuccuccuacgucggcgagaacgccgaguucgagcgccaguaccucuccggcgagcucgaggucgagcucaccccccagggcacccucgccgagcgcauccgcgccggcggcgccggcguccccgccuucuacacccccaccggcuacggcacccucguccaggagggcggcucccccaucaaguacaacaaggacggcuccgucgccaucgccuccaagccccgcgagguccgcgaguucaacggccagcacuucauccucgaggaggccaucaccggcgacuucgcccucgucaaggccuggaaggccgaccgcgccggcaacgucaucuuccgcaaguccgcccgcaacuucaaccuccccaugugcaaggccgccgagaccaccgucgucgaggucgaggagaucgucgacaucggcgccuucgcccccgaggacauccacaucccccagaucuacguccaccgccucaucaagggcgagaaguacgagaagcgcaucgagcgccucuccauccgcaaggagggcgacggcgaggccaaguccgccaagcccggcgacgacguccgcgagcgcaucaucaagcgcgccgcccucgaguucgaggacggcauguacgccaaccucggcaucggcaucccccuccucgccuccaacuucaucucccccaacaucaccguccaccuccaguccgagaacggcguccucggccucggccccuacccccgccagcacgaggccgacgccgaccucaucaacgccggcaaggagaccgucaccauccuccccggcgccuccuucuucuccuccgacgaguccuucgccaugauccgcggcggccacgucgaccucaccaugcucggcgccaugcaggucuccaaguacggcgaccucgccaacuggaugauccccggcaagauggucaagggcaugggcggcgccauggaccucgucuccuccgccaagaccaaggucgucgucaccauggagcacuccgccaagggcaacgcccacaagaucauggagaagugcacccucccccucaccggcaagcagugcgucaaccgcaucaucaccgagaaggccgucuucgacgucgacaagaagaagggccucacccucaucgagcucugggagggccucaccgucgacgacguccagaaguccaccggcugcgacuucgccgucucccccaagcucaugcccaugcagcagaucgccaacuga

SEQ ID NO: 47209 - RNA, 1272 nt, Artificial Sequence
  derived and/or modified sequence opt2 from OXER1__Homo_sapiens__NP_683765
augcucugccaccgcggcggccagcucaucguccccaucaucccccucugccccgagcacuccugccgcggccgccgccuccagaaccuccucuccggccccuggcccaagcagcccauggagcuccacaaccucuccucccccucccccucccucuccuccuccguccucccccccuccuucucccccucccccuccuccgcccccuccgccuucaccaccgucggcggcuccuccggcggccccugccaccccaccuccuccucccucgucuccgccuuccucgcccccauccucgcccucgaguucguccucggccucgucggcaacucccucgcccucuucaucuucugcauccacacccgccccuggaccuccaacaccgucuuccucgucucccucgucgccgccgacuuccuccucaucuccaaccucccccuccgcgucgacuacuaccuccuccacgagaccuggcgcuucggcgccgccgccugcaaggucaaccucuucaugcucuccaccaaccgcaccgccuccgucgucuuccucaccgccaucgcccucaaccgcuaccucaaggucguccagccccaccacguccucucccgcgccuccgucggcgccgccgcccgcgucgccggcggccucugggucggcauccuccuccucaacggccaccuccuccucuccaccuucuccggccccuccugccucuccuaccgcgucggcaccaagcccuccgccucccuccgcuggcaccaggcccucuaccuccucgaguucuuccucccccucgcccucauccucuucgccaucgucuccaucggccucaccauccgcaaccgcggccucggcggccaggccggcccccagcgcgccaugcgcguccucgccauggucgucgccgucuacaccaucugcuuccuccccuccaucaucuucggcauggccuccauggucgccuucuggcucuccgccugccgcucccucgaccucugcacccagcucuuccacggcucccucgccuucaccuaccucaacuccguccucgaccccguccucuacugcuucuccucccccaacuuccuccaccagucccgcgcccuccucggccucacccgcggccgccagggccccgucuccgacgaguccuccuaccagcccucccgccaguggcgcuaccgcgaggccucccgcaaggccgaggccaucggcaagcucaagguccagggcgaggucucccucgagaaggagggcuccucccagggcuga

SEQ ID NO: 47210 - RNA, 1014 nt, Artificial Sequence
  derived and/or modified sequence opt2 from OXGR1__Homo_sapiens__XP_005254103
augaacgagccccucgacuaccucgccaacgccuccgacuuccccgacuacgccgccgccuucggcaacugcaccgacgagaacaucccccucaagaugcacuaccuccccgucaucuacggcaucaucuuccucgucggcuuccccggcaacgccgucgucaucuccaccuacaucuucaagaugcgccccuggaaguccuccaccaucaucaugcucaaccucgccugcaccgaccuccucuaccucaccucccuccccuuccucauccacuacuacgccuccggcgagaacuggaucuucggcgacuucaugugcaaguucauccgcuucuccuuccacuucaaccucuacuccuccauccucuuccucaccugcuucuccaucuuccgcuacugcgucaucauccaccccauguccugcuucuccauccacaagacccgcugcgccgucgucgccugcgccgucgucuggaucaucucccucgucgccgucauccccaugaccuuccucaucaccuccaccaaccgcaccaaccgcuccgccugccucgaccucaccuccuccgacgagcucaacaccaucaagugguacaaccucauccucaccgccaccaccuucugccucccccucgucaucgucacccucugcuacaccaccaucauccacacccucacccacggccuccagaccgacuccugccucaagcagaaggcccgccgccucaccauccuccuccuccucgccuucuacgucugcuuccuccccuuccacauccuccgcgucauccgcaucgagucccgccuccucuccaucuccugcuccaucgagaaccagauccacgaggccuacaucgucucccgcccccucgccgcccucaacaccuucggcaaccuccuccucuacgucgucgucuccgacaacuuccagcaggccgucugcuccaccguccgcugcaaggucuccggcaaccucgagcaggccaagaagaucuccuacuccaacaaccccuga

SEQ ID NO: 47211 - RNA, 2625 nt, Artificial Sequence
  derived and/or modified sequence opt2 from OXR1__Homo_sapiens__NP_001185461
augaccaaggacaagaacucccccggccucaagaagaagucccaguccgucgacaucaacgcccccggcuucaacccccucgccggcgccggcaagcagaccccccaggccuccaagccccccgcccccaagacccccaucaucgaggaggagcagaacaacgccgccaacacccagaagcaccccucccgccgcuccgagcucaagcgcuucuacaccaucgacaccggccagaagaagacccucgacaagaaggacggccgccgcauguccuuccagaagcccaagggcaccaucgaguacaccgucgagucccgcgacucccucaacuccaucgcccucaaguucgacaccacccccaacgagcucguccagcucaacaagcucuucucccgcgccgucgucaccggccagguccucuacguccccgaccccgaguacgucuccuccgucgaguccucccccucccucucccccgucuccccccucucccccaccuccuccgaggccgaguucgacaagaccaccaaccccgacguccaccccaccgaggccacccccuccuccaccuucaccggcauccgccccgcccgcgucgucuccuccaccuccgaggaggaggaggccuucaccgagaaguuccucaagaucaacugcaaguacaucaccuccggcaagggcaccgucuccggcguccuccucgucacccccaacaacaucauguucgacccccacaagaacgacccccucguccaggagaacggcugcgaggaguacggcaucaugugccccauggaggaggucauguccgccgccauguacaaggagauccucgacuccaagaucaaggagucccuccccaucgacaucgaccagcucuccggccgcgacuucugccacuccaagaagaugaccggcuccaacaccgaggagaucgacucccgcauccgcgacgccggcaacgacuccgccuccaccgccccccgcuccaccgaggagucccucuccgaggacgucuucaccgaguccgagcucucccccauccgcgaggagcucgucuccuccgacgagcuccgccaggacaaguccuccggcgccuccuccgaguccguccagaccgucaaccaggccgaggucgagucccucaccgucaaguccgaguccaccggcacccccggccaccuccgcuccgacaccgagcacuccaccaacgaggucggcacccucugccacaagaccgaccucaacaaccucgagauggccaucaaggaggaccagaucgccgacaacuuccagggcaucuccggccccaaggaggacuccaccuccaucaagggcaacuccgaccaggacuccuuccuccacgagaacucccuccaccaggaggagucccagaaggagaacaugcccugcggcgagaccgccgaguucaagcagaagcaguccgucaacaagggcaagcagggcaaggagcagaaccaggacucccagaccgaggccgaggagcuccgcaagcucuggaagacccacaccaugcagcagaccaagcagcagcgcgagaacauccagcaggucucccagaaggaggccaagcacaagaucaccuccgccgacggccacaucgaguccuccgcccuccucaaggagaagcagcgccaccgccuccacaaguuccucugccuccgcgucggcaagcccaugcgcaagaccuucgucucccaggccuccgccaccaugcagcaguacgcccagcgcgacaagaagcacgaguacugguucgccgucccccaggagcgcaccgaccaccucuacgccuucuucauccaguggucccccgagaucuacgccgaggacaccggcgaguacacccgcgagcccggcuucaucgucgucaagaagaucgaggaguccgagaccaucgaggacuccuccaaccaggccgccgcccgcgagugggaggucgucuccgucgccgaguaccaccgccgcaucgacgcccucaacaccgaggagcuccgcacccucugccgccgccuccagaucaccacccgcgaggacaucaacuccaagcaggucgccaccgucaaggccgaccucgaguccgaguccuuccgccccaaccucuccgaccccuccgagcuccuccuccccgaccagaucgagaagcucaccaagcaccuccccccccgcaccaucggcuaccccuggacccucgucuacggcaccggcaagcacggcaccucccucaagacccucuaccgcaccaugaccggccucgacacccccguccucauggucaucaaggacuccgacggccaggucuucggcgcccucgccuccgagccccucaaggucuccgacggcuucuacggcaccggcgagaccuucgucuucaccuucugccccgaguucgaggucuucaaguggaccggcgacaacauguucuucaucaagggcgacauggacucccucgccuucggcggcggcggcggcgaguucgcccucuggcucgacggcgaccucuaccacggccgcucccacuccugcaagaccuucggcaaccgcacccucuccaagaaggaggacuucuucauccaggacaucgagaucugggccuucgaguga

SEQ ID NO: 47212 - RNA, 1584 nt, Artificial Sequence
  derived and/or modified sequence opt2 from OXSR1__Homo_sapiens__NP_005100
auguccgaggacuccuccgcccuccccugguccaucaaccgcgacgacuacgagcuccaggaggucaucggcuccggcgccaccgccgucguccaggccgccuacugcgcccccaagaaggagaaggucgccaucaagcgcaucaaccucgagaagugccagaccuccauggacgagcuccucaaggagauccaggccaugucccagugccaccaccccaacaucgucuccuacuacaccuccuucgucgucaaggacgagcucuggcucgucaugaagcuccucuccggcggcuccguccucgacaucaucaagcacaucgucgccaagggcgagcacaaguccggcguccucgacgaguccaccaucgccaccauccuccgcgagguccucgagggccucgaguaccuccacaagaacggccagauccaccgcgacgucaaggccggcaacauccuccucggcgaggacggcuccguccagaucgccgacuucggcgucuccgccuuccucgccaccggcggcgacaucacccgcaacaagguccgcaagaccuucgucggcacccccugcuggauggcccccgaggucauggagcagguccgcggcuacgacuucaaggccgacaucugguccuucggcaucaccgccaucgagcucgccaccggcgccgcccccuaccacaaguacccccccaugaagguccucaugcucacccuccagaacgacccccccucccucgagaccggcguccaggacaaggagaugcucaagaaguacggcaaguccuuccgcaagaugaucucccucugccuccagaaggaccccgagaagcgccccaccgccgccgagcuccuccgccacaaguucuuccagaaggccaagaacaaggaguuccuccaggagaagacccuccagcgcgcccccaccaucuccgagcgcgccaagaagguccgccgcguccccggcuccuccggccgccuccacaagaccgaggacggcggcugggagugguccgacgacgaguucgacgaggaguccgaggagggcaaggccgccaucucccagcuccgcuccccccgcgucaaggaguccaucuccaacuccgagcucuuccccaccaccgaccccgucggcacccuccuccagguccccgagcagaucuccgcccaccucccccagcccgccggccagaucgccacccagcccacccaggucucccucccccccaccgccgagcccgccaagaccgcccaggcccucuccuccggcuccggcucccaggagaccaagauccccaucucccucguccuccgccuccgcaacuccaagaaggagcucaacgacauccgcuucgaguucacccccggccgcgacaccgccgagggcgucucccaggagcucaucuccgccggccucgucgacggccgcgaccucgucaucgucgccgccaaccuccagaagaucgucgaggagccccaguccaaccgcuccgucaccuucaagcucgccuccggcgucgagggcuccgacauccccgacgacggcaagcucaucggcuucgcccagcucuccaucuccuga

SEQ ID NO: 47213 - RNA, 378 nt, Artificial Sequence
  derived and/or modified sequence opt2 from OXT__Homo_sapiens__XP_011527540
auggccggccccucccucgccugcugccuccucggccuccucgcccucaccuccgccugcuacauccagaacugcccccucggcggcaagcgcgccgcccccgaccucgacguccgcaagugccuccccugcggccccggcggcaagggccgcugcuucggccccaacaucugcugcgccgaggagcucggcugcuucgucggcaccgccgaggcccuccgcugccaggaggagaacuaccuccccucccccugccaguccggccagaaggccugcggcuccggcggccgcugcgccguccucggccucugcugcucccccgacggcugccacgccgaccccgccugcgacgccgaggccaccuucucccagcgcuga

SEQ ID NO: 47214 - RNA, 1170 nt, Artificial Sequence
  derived and/or modified sequence opt2 from OXTR__Homo_sapiens__NP_000907
auggagggcgcccucgccgccaacugguccgccgaggccgccaacgccuccgccgccccccccggcgccgagggcaaccgcaccgccggccccccccgccgcaacgaggcccucgcccgcgucgaggucgccguccucugccucauccuccuccucgcccucuccggcaacgccugcguccuccucgcccuccgcaccacccgccagaagcacucccgccucuucuucuucaugaagcaccucuccaucgccgaccucgucgucgccgucuuccagguccucccccagcuccucugggacaucaccuuccgcuucuacggccccgaccuccucugccgccucgucaaguaccuccaggucgucggcauguucgccuccaccuaccuccuccuccucaugucccucgaccgcugccucgccaucugccagccccuccgcucccuccgccgccgcaccgaccgccucgccguccucgccaccuggcucggcugccucgucgccuccgccccccagguccacaucuucucccuccgcgaggucgccgacggcgucuucgacugcugggccgucuucauccagcccuggggccccaaggccuacaucaccuggaucacccucgccgucuacaucguccccgucaucguccucgccgccugcuacggccucaucuccuucaagaucuggcagaaccuccgccucaagaccgccgccgccgccgccgccgaggcccccgagggcgccgccgccggcgacggcggccgcgucgcccucgcccgcgucuccuccgucaagcucaucuccaaggccaagauccgcaccgucaagaugaccuucaucaucguccucgccuucaucgucugcuggacccccuucuucuucguccagaugugguccgucugggacgccaacgcccccaaggaggccuccgccuucaucaucgucaugcuccucgccucccucaacuccugcugcaaccccuggaucuacaugcucuucaccggccaccucuuccacgagcucguccagcgcuuccucugcugcuccgccuccuaccucaagggccgccgccucggcgagaccuccgccuccaagaaguccaacuccuccuccuucguccucucccaccgcuccuccucccagcgcuccugcucccagcccuccaccgccuga

SEQ ID NO: 47215 - RNA, 1200 nt, Artificial Sequence
  derived and/or modified sequence opt2 from P2RX1__Homo_sapiens__NP_002549
auggcccgccgcuuccaggaggagcucgccgccuuccucuucgaguacgacaccccccgcaugguccucguccgcaacaagaaggucggcgucaucuuccgccucauccagcucgucguccucgucuacgucaucggcugggucuuccucuacgagaagggcuaccagaccuccuccggccucaucuccuccgucuccgucaagcucaagggccucgccgucacccagcuccccggccucggcccccaggucugggacgucgccgacuacgucuuccccgcccagggcgacaacuccuucgucgucaugaccaacuucaucgucacccccaagcagacccagggcuacugcgccgagcaccccgagggcggcaucugcaaggaggacuccggcugcacccccggcaaggccaagcgcaaggcccagggcauccgcaccggcaagugcgucgccuucaacgacaccgucaagaccugcgagaucuucggcuggugccccgucgaggucgacgacgacaucccccgccccgcccuccuccgcgaggccgagaacuucacccucuucaucaagaacuccaucuccuucccccgcuucaaggucaaccgccgcaaccucgucgaggaggucaacgccgcccacaugaagaccugccucuuccacaagacccuccacccccucugccccgucuuccagcucggcuacgucguccaggaguccggccagaacuucuccacccucgccgagaagggcggcgucgucggcaucaccaucgacuggcacugcgaccucgacuggcacguccgccacugccgccccaucuacgaguuccacggccucuacgaggagaagaaccucucccccggcuucaacuuccgcuucgcccgccacuucgucgagaacggcaccaacuaccgccaccucuucaaggucuucggcauccgcuucgacauccucgucgacggcaaggccggcaaguucgacaucauccccaccaugaccaccaucggcuccggcaucggcaucuucggcgucgccaccguccucugcgaccuccuccuccuccacauccuccccaagcgccacuacuacaagcagaagaaguucaaguacgccgaggacaugggccccggcgccgccgagcgcgaccucgccgccaccuccuccacccucggccuccaggagaacaugcgcaccuccuga

SEQ ID NO: 47216 - RNA, 1113 nt, Artificial Sequence
  derived and/or modified sequence opt2 from P2RX2__Homo_sapiens__NP_001269093
auggccgccgcccagcccaaguaccccgccggcgccaccgcccgccgccucgcccgcggcugcugguccgcccucugggacuacgagacccccaaggucaucgucguccgcaaccgccgccucggcguccucuaccgcgccguccagcuccucauccuccucuacuucgucugguacgucuucaucguccagaaguccuaccaggaguccgagaccggccccgaguccuccaucaucaccaaggucaagggcaucaccaccuccgagcacaaggucugggacgucgaggaguacgucaagccccccgaguccauccgcguccacaacgccaccugccucuccgacgccgacugcgucgccggcgagcucgacaugcucggcaacggcgcccuccaggaccuccgcggcguccgccucguccccggcggccgcuggggccucugccagcccaucuccggcuacgacggccccaaguuccaccacccccaccaggagcagcacccccucccccagaucccccuccuccagggccagcaccgccgcccccaccgccgcguccccgaggcccuccacgucccccgcggccuccgcccccuccucccccaccuccaggccggccucuaccgcggcgagggcuggggcgagcuccaccgcgcccgcacccagggccgcggcggcgucaucggcgucaucaucaacugggacugcgaccucgaccuccccgccuccgagugcaaccccaaguacuccuuccgccgccucgaccccaagcacguccccgccuccuccggcuacaacuuccgcuucgccaaguacuacaagaucaacggcaccaccacccgcacccucaucaaggccuacggcauccgcaucgacgucaucguccacggccaggccggcaaguucucccucauccccaccaucaucaaccucgccaccgcccucaccuccgucggcgucggcuccuuccucugcgacuggauccuccucaccuucaugaacaagaacaaggucuacucccacaagaaguucgacaagauggucgacacccccgccuccgagcccgcccaggccuccacccccaccgaccccaagggccucgcccagcucuga

SEQ ID NO: 47217 - RNA, 1194 nt, Artificial Sequence
  derived and/or modified sequence opt2 from P2RX3__Homo_sapiens__XP_011543372
augaacugcaucuccgacuucuucaccuacgagaccaccaaguccgucgucgucaaguccuggaccaucggcaucaucaaccgcgucguccagcuccucaucaucuccuacuucgucggcugggucuuccuccacgagaaggccuaccagguccgcgacaccgccaucgaguccuccgucgucaccaaggucaagggcuccggccucuacgccaaccgcgucauggacgucuccgacuacgucacccccccccagggcaccuccgucuucgucaucaucaccaagaugaucgucaccgagaaccagaugcagggcuucugccccgaguccgaggagaaguaccgcugcgucuccgacucccagugcggccccgagcgccuccccggcggcggcauccucaccggccgcugcgucaacuacuccuccguccuccgcaccugcgagauccagggcuggugccccaccgaggucgacaccgucgagacccccaucaugauggaggccgagaacuucaccaucuucaucaagaacuccauccgcuucccccucuucaacuucgagaagggcaaccuccuccccaaccucaccgcccgcgacaugaagaccugccgcuuccaccccgacaaggaccccuucugccccauccuccgcgucggcgacgucgucaaguucgccggccaggacuucgccaagcucgcccgcaccggcggcguccucggcaucaagaucggcugggucugcgaccucgacaaggccugggaccagugcauccccaaguacuccuucacccgccucgacuccgucuccgagaaguccuccgucucccccggcuacaacuuccgcuucgccaaguacuacaagauggagaacggcuccgaguaccgcacccuccucaaggccuucggcauccgcuucgacguccucgucuacggcaacgccggcaaguucaacaucauccccaccaucaucuccuccgucgccgccuucaccuccgucggcgucggcaccguccucugcgacaucauccuccucaacuuccucaagggcgccgaccaguacaaggccaagaaguucgaggaggucaacgagaccacccucaagaucgccgcccucaccaaccccgucuaccccuccgaccagaccaccgccgagaagcaguccaccgacuccggcgccuucuccaucggccacuga

SEQ ID NO: 47218 - RNA, 1215 nt, Artificial Sequence
  derived and/or modified sequence opt2 from P2RX4__Homo_sapiens__NP_001243725
auggccggcugcugcgccgcccucgccgccuuccucuucgaguacgacaccccccgcaucguccucauccgcucccgcaaggucggccucaugaaccgcgccguccagcuccucauccucgccuacgucaucggcugcuaccacccccaccucgccgaggucgagauggaguccccccgccgcugggucuucgucugggagaagggcuaccaggagaccgacuccgucgucuccuccgucaccaccaaggucaagggcgucgccgucaccaacaccuccaagcucggcuuccgcaucugggacgucgccgacuacgucauccccgcccaggaggagaacucccucuucgucaugaccaacgucauccucaccaugaaccagacccagggccucugccccgagauccccgacgccaccaccgucugcaaguccgacgccuccugcaccgccggcuccgccggcacccacuccaacggcgucuccaccggccgcugcgucgccuucaacggcuccgucaagaccugcgaggucgccgccuggugccccgucgaggacgacacccacgucccccagcccgccuuccucaaggccgccgagaacuucacccuccucgucaagaacaacaucugguaccccaaguucaacuucuccaagcgcaacauccuccccaacaucaccaccaccuaccucaaguccugcaucuacgacgccaagaccgaccccuucugccccaucuuccgccucggcaagaucgucgagaacgccggccacuccuuccaggacauggccgucgagggcggcaucaugggcauccaggucaacugggacugcaaccucgaccgcgccgccucccucugccucccccgcuacuccuuccgccgccucgacacccgcgacgucgagcacaacgucucccccggcuacaacuuccgcuucgccaaguacuaccgcgaccucgccggcaacgagcagcgcacccucaucaaggccuacggcauccgcuucgacaucaucgucuucggcaaggccggcaaguucgacaucauccccaccaugaucaacaucggcuccggccucgcccuccucggcauggccaccguccucugcgacaucaucguccucuacugcaugaagaagcgccucuacuaccgcgagaagaaguacaaguacgucgaggacuacgagcagggccucgccuccgagcucgaccaguga

SEQ ID NO: 47219 - RNA, 1266 nt, Artificial Sequence
  derived and/or modified sequence opt2 from P2RX5__Homo_sapiens__NP_001191448
augggccaggccggcugcaagggccucugccucucccucuucgacuacaagaccgagaaguacgucaucgccaagaacaagaaggucggccuccucuaccgccuccuccaggccuccauccucgccuaccucgucgucugggucuuccucaucaagaagggcuaccaggacgucgacaccucccuccaguccgccgucaucaccaaggucaagggcgucgccuucaccaacaccuccgaccucggccagcgcaucugggacgucgccgacuacgucauccccgcccagggcgagaacgucuucuucgucgucaccaaccucaucgucacccccaaccagcgccagaacgucugcgccgagaacgagggcauccccgacggcgccugcuccaaggacuccgacugccacgccggcgaggccgucaccgccggcaacggcgucaagaccggccgcugccuccgccgcgagaaccucgcccgcggcaccugcgagaucuucgccuggugcccccucgagaccuccucccgccccgaggagcccuuccucaaggaggccgaggacuucaccaucuucaucaagaaccacauccgcuuccccaaguucaacuucuccaacaacgucauggacgucaaggaccgcuccuuccucaaguccugccacuucggccccaagaaccacuacugccccaucuuccgccucggcuccgucauccgcugggccggcuccgacuuccaggacaucgcccucgagggcggcgucaucggcaucaacaucgaguggaacugcgaccucgacaaggccgccuccgagugccacccccacuacuccuucucccgccucgacaacaagcucuccaaguccgucuccuccggcuacaacuuccgcuucgcccgcuacuaccgcgacgccgccggcgucgaguuccgcacccucaugaaggccuacggcauccgcuucgacgucauggucaacggcaagggcgccuucuucugcgaccucguccucaucuaccucaucaagaagcgcgaguucuaccgcgacaagaaguacgaggagguccgcggccucgaggacuccucccaggaggccgaggacgaggccuccggccucggccucuccgagcagcucaccuccggccccggccuccucggcaugcccgagcagcaggagcuccaggagccccccgaggccaagcgcggcuccuccucccagaagggcaacggcuccgucugcccccagcuccucgagccccaccgcuccaccuga

SEQ ID NO: 47220 - RNA, 1248 nt, Artificial Sequence
  derived and/or modified sequence opt2 from P2RX6__Homo_sapiens__NP_001153026
augugcccccagcucgccggcgccggcuccaugggcucccccggcgccaccaccggcuggggccuccucgacuacaagaccgagaagugggcccuccucgccaagaagggcuaccaggagcgcgaccucgagccccaguucuccaucaucaccaagcucaagggcgucuccgucacccagaucaaggagcucggcaaccgccucugggacgucgccgacuucgucaagcccccccagggcgagaacgucuucuuccucgucaccaacuuccucgucacccccgcccagguccagggccgcugccccgagcaccccuccgucccccucgccaacugcugggucgacgaggacugccccgagggcgagggcggcacccacucccacggcgucaagaccggccagugcgucgucuucaacggcacccaccgcaccugcgagaucugguccuggugccccgucgaguccggcgucguccccucccgcccccuccucgcccaggcccagaacuucacccucuucaucaagaacaccgucaccuucuccaaguucaacuucuccaaguccaacgcccucgagaccugggaccccaccuacuucaagcacugccgcuacgagccccaguucucccccuacugccccgucuuccgcaucggcgaccucgucgccaaggccggcggcaccuucgaggaccucgcccuccucggcggcuccgucggcauccgcguccacugggacugcgaccucgacaccggcgacuccggcugcuggccccacuacuccuuccagcuccaggagaaguccuacaacuuccgcaccgccacccacuggugggagcagcccggcgucgaggcccgcacccuccucaagcucuacggcauccgcuucgacauccucgucaccggccaggccggcaaguucggccucauccccaccgccgucacccucggcaccggcgccgccuggcucggcgucgucaccuucuucugcgaccuccuccuccucuacgucgaccgcgaggcccacuucuacuggcgcaccaaguacgaggaggccaaggcccccaaggccaccgccaacuccgucuggcgcgagcucgcccucgccucccaggcccgccucgccgagugccuccgccgcuccuccgcccccgcccccaccgccaccgccgccggcucccagacccagacccccggcuggcccugccccuccuccgacacccaccuccccacccacuccggcucccucuga

SEQ ID NO: 47221 - RNA, 1788 nt, Artificial Sequence
  derived and/or modified sequence opt2 from P2RX7__Homo_sapiens__NP_002553
augcccgccugcugcuccugcuccgacgucuuccaguacgagaccaacaaggucacccgcauccaguccaugaacuacggcaccaucaagugguucuuccacgucaucaucuucuccuacgucugcuucgcccucgucuccgacaagcucuaccagcgcaaggagcccgucaucuccuccguccacaccaaggucaagggcaucgccgaggucaaggaggagaucgucgagaacggcgucaagaagcucguccacuccgucuucgacaccgccgacuacaccuucccccuccagggcaacuccuucuucgucaugaccaacuuccucaagaccgagggccaggagcagcgccucugccccgaguaccccacccgccgcacccucugcuccuccgaccgcggcugcaagaagggcuggauggacccccaguccaagggcauccagaccggccgcugcgucgucuacgagggcaaccagaagaccugcgaggucuccgccuggugccccaucgaggccgucgaggaggccccccgccccgcccuccucaacuccgccgagaacuucaccguccucaucaagaacaacaucgacuuccccggccacaacuacaccacccgcaacauccuccccggccucaacaucaccugcaccuuccacaagacccagaacccccagugccccaucuuccgccucggcgacaucuuccgcgagaccggcgacaacuucuccgacgucgccauccagggcggcaucaugggcaucgagaucuacugggacugcaaccucgaccgcugguuccaccacugccgccccaaguacuccuuccgccgccucgacgacaagaccaccaacgucucccucuaccccggcuacaacuuccgcuacgccaaguacuacaaggagaacaacgucgagaagcgcacccucaucaaggucuucggcauccgcuucgacauccucgucuucggcaccggcggcaaguucgacaucauccagcucgucgucuacaucggcuccacccucuccuacuucggccucgccgccgucuucaucgacuuccucaucgacaccuacuccuccaacugcugccgcucccacaucuaccccuggugcaagugcugccagcccugcgucgucaacgaguacuacuaccgcaagaagugcgaguccaucgucgagcccaagcccacccucaaguacgucuccuucgucgacgagucccacauccgcauggucaaccagcagcuccucggccgcucccuccaggacgucaagggccaggaggucccccgccccgccauggacuucaccgaccucucccgccucccccucgcccuccacgacaccccccccauccccggccagcccgaggagauccagcuccuccgcaaggaggccaccccccgcucccgcgacucccccgucuggugccagugcggcuccugccuccccucccagcuccccgagucccaccgcugccucgaggagcucugcugccgcaagaagcccggcgccugcaucaccaccuccgagcucuuccgcaagcucguccucucccgccacguccuccaguuccuccuccucuaccaggagccccuccucgcccucgacgucgacuccaccaacucccgccuccgccacugcgccuaccgcugcuacgccaccuggcgcuucggcucccaggacauggccgacuucgccauccuccccuccugcugccgcuggcgcauccgcaaggaguuccccaaguccgagggccaguacuccggcuucaagucccccuacuga

SEQ ID NO: 47222 - RNA, 1125 nt, Artificial Sequence
  derived and/or modified sequence opt2 from P2RY11__Homo_sapiens__NP_002557
auggccgccaacgucuccggcgccaaguccugccccgccaacuuccucgccgccgccgacgacaagcucuccggcuuccagggcgacuuccucuggcccauccucgucgucgaguuccucgucgccgucgccuccaacggccucgcccucuaccgcuucuccauccgcaagcagcgccccuggcaccccgccgucgucuucuccguccagcucgccgucuccgaccuccucugcgcccucacccuccccccccucgccgccuaccucuacccccccaagcacuggcgcuacggcgaggccgccugccgccucgagcgcuuccucuucaccugcaaccuccucggcuccgucaucuucaucaccugcaucucccucaaccgcuaccucggcaucguccaccccuucuucgcccgcucccaccuccgccccaagcacgccugggccgucuccgccgccggcuggguccucgccgcccuccucgccaugcccacccucuccuucucccaccucaagcgcccccagcagggcgccggcaacugcuccgucgcccgccccgaggccugcaucaagugccucggcaccgccgaccacggccucgccgccuaccgcgccuacucccucguccucgccggccucggcugcggccucccccuccuccucacccucgccgccuacggcgcccucggccgcgccguccuccgcucccccggcaugaccgucgccgagaagcuccgcgucgccgcccucgucgccuccggcgucgcccucuacgccuccuccuacguccccuaccacaucaugcgcguccucaacgucgacgcccgccgccgcugguccacccgcugccccuccuucgccgacaucgcccaggccaccgccgcccucgagcucggccccuacgucggcuaccaggucaugcgcggccucaugccccucgccuucugcguccacccccuccucuacauggccgccguccccucccucggcugcugcugccgccacugccccggcuaccgcgacuccuggaaccccgaggacgccaaguccaccggccaggcccucccccucaacgccaccgccgcccccaagcccuccgagccccagucccgcgagcucucccaguga

SEQ ID NO: 47223 - RNA, 1029 nt, Artificial Sequence
  derived and/or modified sequence opt2 from P2RY12__Homo_sapiens__NP_795345
augcaggccgucgacaaccucaccuccgcccccggcaacaccucccucugcacccgcgacuacaagaucacccagguccucuucccccuccucuacaccguccucuucuucgucggccucaucaccaacggccucgccaugcgcaucuucuuccagauccgcuccaaguccaacuucaucaucuuccucaagaacaccgucaucuccgaccuccucaugauccucaccuuccccuucaagauccucuccgacgccaagcucggcaccggcccccuccgcaccuucgucugccaggucaccuccgucaucuucuacuucaccauguacaucuccaucuccuuccucggccucaucaccaucgaccgcuaccagaagaccacccgccccuucaagaccuccaaccccaagaaccuccucggcgccaagauccucuccgucgucaucugggccuucauguuccuccucucccuccccaacaugauccucaccaaccgccagccccgcgacaagaacgucaagaagugcuccuuccucaaguccgaguucggccucgucuggcacgagaucgucaacuacaucugccaggucaucuucuggaucaacuuccucaucgucaucgucugcuacacccucaucaccaaggagcucuaccgcuccuacguccgcacccgcggcgucggcaaggucccccgcaagaaggucaacgucaaggucuucaucaucaucgccgucuucuucaucugcuucguccccuuccacuucgcccgcauccccuacacccucucccagacccgcgacgucuucgacugcaccgccgagaacacccucuucuacgucaaggaguccacccucuggcucaccucccucaacgccugccucgaccccuucaucuacuucuuccucugcaaguccuuccgcaacucccucaucuccaugcucaagugccccaacuccgccaccucccucucccaggacaaccgcaagaaggagcaggacggcggcgaccccaacgaggagacccccauguga

SEQ ID NO: 47224 - RNA, 1065 nt, Artificial Sequence
  derived and/or modified sequence opt2 from P2RY13__Homo_sapiens__NP_795713
augaccgccgccauccgccgccagcgcgagcucuccauccuccccaaggucacccucgaggccaugaacaccaccgucaugcagggcuucaaccgcuccgagcgcugcccccgcgacacccgcaucguccagcucgucuuccccgcccucuacaccgucgucuuccucaccggcauccuccucaacacccucgcccucugggucuucguccacauccccuccuccuccaccuucaucaucuaccucaagaacacccucgucgccgaccucaucaugacccucaugcuccccuucaagauccucuccgacucccaccucgcccccuggcagcuccgcgccuucgucugccgcuucuccuccgucaucuucuacgagaccauguacgucggcaucguccuccucggccucaucgccuucgaccgcuuccucaagaucauccgcccccuccgcaacaucuuccucaagaagcccgucuucgccaagaccgucuccaucuucaucugguucuuccucuucuucaucucccuccccaacaccauccucuccaacaaggaggccacccccuccuccgucaagaagugcgccucccucaagggcccccucggccucaaguggcaccagauggucaacaacaucugccaguucaucuucuggaccgucuucauccucaugcucgucuucuacgucgucaucgccaagaaggucuacgacuccuaccgcaaguccaaguccaaggaccgcaagaacaacaagaagcucgagggcaaggucuucgucgucgucgccgucuucuucgucugcuucgcccccuuccacuucgcccgcguccccuacacccacucccagaccaacaacaagaccgacugccgccuccagaaccagcucuucaucgccaaggagaccacccucuuccucgccgccaccaacaucugcauggacccccucaucuacaucuuccucugcaagaaguucaccgagaagcuccccugcaugcagggccgcaagaccaccgccuccucccaggagaaccacuccucccagaccgacaacaucacccucggcuga

SEQ ID NO: 47225 - RNA, 1017 nt, Artificial Sequence
  derived and/or modified sequence opt2 from P2RY14__Homo_sapiens__NP_055694
augaucaacuccaccuccacccagccccccgacgaguccugcucccagaaccuccucaucacccagcagaucauccccguccucuacugcauggucuucaucgccggcauccuccucaacggcgucuccggcuggaucuucuucuacguccccuccuccaaguccuucaucaucuaccucaagaacaucgucaucgccgacuucgucaugucccucaccuuccccuucaagauccucggcgacuccggccucggccccuggcagcucaacgucuucgucugccgcgucuccgccguccucuucuacgucaacauguacgucuccaucgucuucuucggccucaucuccuucgaccgcuacuacaagaucgucaagccccucuggaccuccuucauccaguccgucuccuacuccaagcuccucuccgucaucgucuggaugcucaugcuccuccucgccguccccaacaucauccucaccaaccaguccguccgcgaggucacccagaucaagugcaucgagcucaaguccgagcucggccgcaaguggcacaaggccuccaacuacaucuucgucgccaucuucuggaucgucuuccuccuccucaucgucuucuacaccgccaucaccaagaagaucuucaagucccaccucaaguccucccgcaacuccaccuccgucaagaagaaguccucccgcaacaucuucuccaucgucuucgucuucuucgucugcuucguccccuaccacaucgcccgcauccccuacaccaagucccagaccgaggcccacuacuccugccaguccaaggagauccuccgcuacaugaaggaguucacccuccuccucuccgccgccaacgucugccucgaccccaucaucuacuucuuccucugccagcccuuccgcgagauccucugcaagaagcuccacaucccccucaaggcccagaacgaccucgacaucucccgcaucaagcgcggcaacaccacccucgaguccaccgacacccucuga

SEQ ID NO: 47226 - RNA, 1122 nt, Artificial Sequence
  derived and/or modified sequence opt2 from P2RY1__Homo_sapiens__NP_002554
augaccgagguccucuggcccgccguccccaacggcaccgacgccgccuuccucgccggccccggcuccuccuggggcaacuccaccgucgccuccaccgccgccgucuccuccuccuucaagugcgcccucaccaagaccggcuuccaguucuacuaccuccccgccgucuacauccucgucuucaucaucggcuuccucggcaacuccgucgccaucuggauguucgucuuccacaugaagcccugguccggcaucuccgucuacauguucaaccucgcccucgccgacuuccucuacguccucacccuccccgcccucaucuucuacuacuucaacaagaccgacuggaucuucggcgacgccaugugcaagcuccagcgcuucaucuuccacgucaaccucuacggcuccauccucuuccucaccugcaucuccgcccaccgcuacuccggcgucgucuacccccucaagucccucggccgccucaagaagaagaacgccaucugcaucuccguccucgucuggcucaucgucgucgucgccaucucccccauccucuucuacuccggcaccggcguccgcaagaacaagaccaucaccugcuacgacaccaccuccgacgaguaccuccgcuccuacuucaucuacuccaugugcaccaccgucgccauguucugcgucccccucguccucauccucggcugcuacggccucaucguccgcgcccucaucuacaaggaccucgacaacuccccccuccgccgcaaguccaucuaccucgucaucaucguccucaccgucuucgccgucuccuacauccccuuccacgucaugaagaccaugaaccuccgcgcccgccucgacuuccagacccccgccaugugcgccuucaacgaccgcgucuacgccaccuaccaggucacccgcggccucgccucccucaacuccugcgucgaccccauccucuacuuccucgccggcgacaccuuccgccgccgccucucccgcgccacccgcaaggccucccgccgcuccgaggccaaccuccaguccaaguccgaggacaugacccucaacauccuccccgaguucaagcagaacggcgacaccucccucuga

SEQ ID NO: 47227 - RNA, 1134 nt, Artificial Sequence
  derived and/or modified sequence opt2 from P2RY2__Homo_sapiens__NP_788085
auggccgccgaccucggccccuggaacgacaccaucaacggcaccugggacggcgacgagcucggcuaccgcugccgcuucaacgaggacuucaaguacguccuccuccccgucuccuacggcgucgucugcguccucggccucugccucaacgccgucgcccucuacaucuuccucugccgccucaagaccuggaacgccuccaccaccuacauguuccaccucgccgucuccgacgcccucuacgccgccucccucccccuccucgucuacuacuacgcccgcggcgaccacuggcccuucuccaccguccucugcaagcucguccgcuuccucuucuacaccaaccucuacugcuccauccucuuccucaccugcaucuccguccaccgcugccucggcguccuccgcccccuccgcucccuccgcuggggccgcgcccgcuacgcccgccgcgucgccggcgccgucuggguccucguccucgccugccaggcccccguccucuacuucgucaccaccuccgcccgcggcggccgcgucaccugccacgacaccuccgcccccgagcucuucucccgcuucgucgccuacuccuccgucaugcucggccuccucuucgccguccccuucgccgucauccucgucugcuacguccucauggcccgccgccuccucaagcccgccuacggcaccuccggcggccucccccgcgccaagcgcaaguccguccgcaccaucgccgucguccucgccgucuucgcccucugcuuccuccccuuccacgucacccgcacccucuacuacuccuuccgcucccucgaccucuccugccacacccucaacgccaucaacauggccuacaaggucacccgcccccucgccuccgccaacuccugccucgaccccguccucuacuuccucgccggccagcgccucguccgcuucgcccgcgacgccaagccccccaccggccccucccccgccacccccgcccgccgccgccucggccuccgccgcuccgaccgcaccgacaugcagcgcaucgaggacguccucggcuccuccgaggacucccgccgcaccgaguccacccccgccggcuccgagaacaccaaggacauccgccucuga

SEQ ID NO: 47228 - RNA, 1098 nt, Artificial Sequence
  derived and/or modified sequence opt2 from P2RY4__Homo_sapiens__NP_002556
auggccuccaccgaguccucccuccuccgcucccucggccucucccccggccccggcuccuccgaggucgagcucgacugcugguucgacgaggacuucaaguucauccuccuccccgucuccuacgccgucgucuucguccucggccucggccucaacgcccccacccucuggcucuucaucuuccgccuccgccccugggacgccaccgccaccuacauguuccaccucgcccucuccgacacccucuacguccucucccuccccacccucaucuacuacuacgccgcccacaaccacuggcccuucggcaccgagaucugcaaguucguccgcuuccucuucuacuggaaccucuacugcuccguccucuuccucaccugcaucuccguccaccgcuaccucggcaucugccacccccuccgcgcccuccgcuggggccgcccccgccucgccggccuccucugccucgccgucuggcucgucgucgccggcugccucguccccaaccucuucuucgucaccaccuccaacaagggcaccaccguccucugccacgacaccacccgccccgaggaguucgaccacuacguccacuucuccuccgccgucaugggccuccucuucggcguccccugccucgucacccucgucugcuacggccucauggcccgccgccucuaccagccccuccccggcuccgcccaguccuccucccgccuccgcucccuccgcaccaucgccgucguccucaccgucuucgccgucugcuucguccccuuccacaucacccgcaccaucuacuaccucgcccgccuccucgaggccgacugccgcguccucaacaucgucaacgucgucuacaaggucacccgcccccucgccuccgccaacuccugccucgaccccguccucuaccuccucaccggcgacaaguaccgccgccagcuccgccagcucugcggcggcggcaagccccagccccgcaccgccgccuccucccucgcccucgucucccuccccgaggacuccuccugccgcugggccgccaccccccaggacuccuccugcuccaccccccgcgccgaccgccucuga

SEQ ID NO: 47229 - RNA, 987 nt, Artificial Sequence
  derived and/or modified sequence opt2 from P2RY6__Homo_sapiens__NP_001264134
auggagugggacaacggcaccggccaggcccucggccucccccccaccaccugcgucuaccgcgagaacuucaagcagcuccuccucccccccgucuacuccgccguccucgccgccggccucccccucaacaucugcgucaucacccagaucugcaccucccgccgcgcccucacccgcaccgccgucuacacccucaaccucgcccucgccgaccuccucuacgccugcucccucccccuccucaucuacaacuacgcccagggcgaccacuggcccuucggcgacuucgccugccgccucguccgcuuccucuucuacgccaaccuccacggcuccauccucuuccucaccugcaucuccuuccagcgcuaccucggcaucugccacccccucgcccccuggcacaagcgcggcggccgccgcgccgccuggcucgucugcgucgccgucuggcucgccgucaccacccagugccuccccaccgccaucuucgccgccaccggcauccagcgcaaccgcaccgucugcuacgaccucuccccccccgcccucgccacccacuacaugcccuacggcauggcccucaccgucaucggcuuccuccuccccuucgccgcccuccucgccugcuacugccuccucgccugccgccucugccgccaggacggccccgccgagcccgucgcccaggagcgccgcggcaaggccgcccgcauggccgucgucgucgccgccgccuucgccaucuccuuccuccccuuccacaucaccaagaccgccuaccucgccguccgcuccacccccggcguccccugcaccguccucgaggccuucgccgccgccuacaagggcacccgccccuucgccuccgccaacuccguccucgaccccauccucuucuacuucacccagaagaaguuccgccgccgcccccacgagcuccuccagaagcucaccgccaaguggcagcgccagggccgcuga

SEQ ID NO: 47230 - RNA, 1080 nt, Artificial Sequence
  derived and/or modified sequence opt2 from P2RY8__Homo_sapiens__XP_005274835
augcagguccccaacuccaccggccccgacaacgccacccuccagaugcuccgcaaccccgccaucgccgucgcccuccccgucgucuacucccucgucgccgccgucuccauccccggcaaccucuucucccucuggguccucugccgccgcaugggcccccgcucccccuccgucaucuucaugaucaaccucuccgucaccgaccucaugcucgccuccguccuccccuuccagaucuacuaccacugcaaccgccaccacugggucuucggcguccuccucugcaacgucgucaccgucgccuucuacgccaacauguacuccuccauccucaccaugaccugcaucuccgucgagcgcuuccucggcguccucuacccccucuccuccaagcgcuggcgccgccgccgcuacgccgucgccgccugcgccggcaccuggcuccuccuccucaccgcccucuccccccucgcccgcaccgaccucaccuaccccguccacgcccucggcaucaucaccugcuucgacguccucaaguggaccaugcuccccuccgucgccaugugggccgucuuccucuucaccaucuucauccuccucuuccucauccccuucgucaucaccgucgccugcuacaccgccaccauccucaagcuccuccgcaccgaggaggcccacggccgcgagcagcgccgccgcgccgucggccucgccgccgucguccuccucgccuucgucaccugcuucgcccccaacaacuucguccuccucgcccacaucgucucccgccucuucuacggcaaguccuacuaccacgucuacaagcucacccucugccucuccugccucaacaacugccucgaccccuucgucuacuacuucgccucccgcgaguuccagcuccgccuccgcgaguaccucggcugccgccgcgucccccgcgacacccucgacacccgccgcgagucccucuucuccgcccgcaccaccuccguccgcuccgaggccggcgcccaccccgagggcauggagggcgccacccgccccggccuccagcgccaggaguccgucuucuga

SEQ ID NO: 47231 - RNA, 1584 nt, Artificial Sequence
  derived and/or modified sequence opt2 from P3H2__Homo_sapiens__NP_001127890
auggagaugcagcagaacaucgagaacuaccgcgccaccgccggcgucgaggcccuccagcucgucgaccgcgaggccaagccccacauggaguccuacaacgccggcgucaagcacuacgaggccgacgacuucgagauggccauccgccacuucgagcaggcccuccgcgaguacuucgucgaggacaccgagugccgcacccucugcgagggcccccagcgcuucgaggaguacgaguaccucggcuacaaggccggccucuacgaggccaucgccgaccacuacaugcagguccucgucugccagcacgagugcguccgcgagcucgccacccgccccggccgccucucccccaucgagaacuuccucccccuccacuacgacuaccuccaguucgccuacuaccgcgucggcgaguacgucaaggcccucgagugcgccaaggccuaccuccucugccaccccgacgacgaggacguccucgacaacgucgacuacuacgagucccuccucgacgacuccaucgaccccgccuccaucgaggcccgcgaggaccucaccauguucgucaagcgccacaagcucgaguccgagcucaucaaguccgccgccgagggccucggcuucuccuacaccgagcccaacuacuggauccgcuacggcggccgccaggacgagaaccgcguccccuccggcgucaacgucgagggcgccgagguccacggcuucuccaugggcaagaagcucucccccaagaucgaccgcgaccuccgcgagggcggcccccuccucuacgagaacaucaccuucgucuacaacuccgagcagcucaacggcacccagcgcguccuccucgacaacguccucuccgaggagcagugccgcgagcuccacuccgucgccuccggcaucaugcucgucggcgacggcuaccgcggcaagaccuccccccacacccccaacgagaaguucgagggcgccaccguccucaaggcccucaaguccggcuacgagggccgcgucccccucaaguccgcccgccucuucuacgacaucuccgagaaggcccgccgcaucgucgaguccuacuucaugcucaacuccacccucuacuucuccuacacccacauggucugccgcaccgcccucuccggccagcaggaccgccgcaacgaccucucccaccccauccacgccgacaacugccuccucgaccccgaggccaacgagugcuggaaggagccccccgccuacaccuuccgcgacuacuccgcccuccucuacaugaacgacgacuucgagggcggcgaguucaucuucaccgagauggacgccaagaccgucaccgccuccaucaagcccaagugcggccgcaugaucuccuucuccuccggcggcgagaacccccacggcgucaaggccgucaccaagggcaagcgcugcgccgucgcccucugguucacccucgacccccucuaccgcgagcucgagcgcauccaggccgacgaggucaucgccauccucgaccaggagcagcagggcaagcacgagcucaacaucaaccccaaggacgagcucuga

SEQ ID NO: 47232 - RNA, 2211 nt, Artificial Sequence
  derived and/or modified sequence opt2 from P3H3__Homo_sapiens__NP_055077
augcuccgccuccuccgcccccuccuccuccuccuccuccuccccccccccggcucccccgagccccccggccucacccagcucucccccggcgcccccccccaggcccccgaccuccucuacgccgacggccuccgcgccuacgccgccggcgccugggcccccgccgucgcccuccuccgcgaggcccuccgcucccaggccgcccucggccgcguccgccucgacugcggcgccuccugcgccgccgaccccggcgccgcccuccccgccguccuccucggcgcccccgagcccgacuccggccccggccccacccagggcuccugggagcgccagcuccuccgcgccgcccuccgccgcgccgacugccucacccagugcgccgcccgccgccucggccccggcggcgccgcccgccuccgcgucggcuccgcccuccgcgacgccuuccgccgccgcgagcccuacaacuaccuccagcgcgccuacuaccagcucaagaagcucgaccucgccgccgccgccgcccacaccuucuucgucgccaaccccaugcaccuccagaugcgcgaggacauggccaaguaccgccgcauguccggcguccgcccccaguccuuccgcgaccucgagacccccccccacugggccgccuacgacaccggccucgagcuccucggccgccaggaggccggccucgcccucccccgccucgaggaggcccuccagggcucccucgcccagauggaguccugccgcgccgacugcgagggccccgaggagcagcagggcgccgaggaggaggaggacggcgccgccucccagggcggccucuacgaggccaucgccggccacuggauccagguccuccagugccgccagcgcugcgucggcgagaccgccacccgccccggccgcuccuuccccguccccgacuuccuccccaaccagcuccgccgccuccacgaggcccacgcccaggucggcaaccucucccaggccaucgagaacguccucuccguccuccucuucuaccccgaggacgaggccgccaagcgcgcccucaaccaguaccaggcccagcucggcgagccccgccccggccucggcccccgcgaggacauccagcgcuucauccuccgcucccucggcgagaagcgccagcucuacuacgccauggagcaccucggcaccuccuucaaggaccccgaccccuggacccccgccgcccucauccccgaggcccuccgcgagaagcuccgcgaggaccaggagaagcgccccugggaccacgagcccgucaagcccaagccccucaccuacuggaaggacguccuccuccucgagggcgucacccucacccaggacucccgccagcucaacggcuccgagcgcgccguccucgacggccuccucacccccgccgagugcggcguccuccuccagcucgccaaggacgccgccggcgccggcgcccgcuccggcuaccgcggccgccgcuccccccacaccccccacgagcgcuucgagggccucaccguccucaaggccgcccagcucgcccgcgccggcaccgucggcucccagggcgccaagcuccuccucgaggucuccgagcgcguccgcacccucacccaggccuacuucucccccgagcgcccccuccaccucuccuucacccaccucgucugccgcuccgccaucgagggcgagcaggagcagcgcauggaccucucccaccccguccacgccgacaacugcguccucgaccccgacaccggcgagugcuggcgcgagccccccgccuacaccuaccgcgacuacuccggccuccucuaccucaacgacgacuuccagggcggcgaccucuucuucaccgagcccaacgcccucaccgucaccgcccgcguccgcccccgcugcggccgccucgucgccuucuccuccggcgucgagaacccccacggcgucugggccgucacccgcggccgccgcugcgcccucgcccucuggcacaccugggcccccgagcaccgcgagcaggaguggaucgaggccaaggagcuccuccaggagucccaggaggaggaggaggaggaggaggaggagaugcccuccaaggaccccucccccgagccccccucccgccgccaccagcgcguccaggacaagaccggccgcgccccccgcguccgcgaggagcucuga

SEQ ID NO: 47233 - RNA, 1314 nt, Artificial Sequence
  derived and/or modified sequence opt2 from P3H4__Homo_sapiens__NP_006446
auggcccgcgucgccuggggccuccucuggcuccuccucggcuccgccggcgcccaguacgagaaguacuccuuccgcggcuucccccccgaggaccucaugccccucgccgccgccuacggccacgcccucgagcaguacgagggcgaguccuggcgcgaguccgcccgcuaccucgaggccgcccuccgccuccaccgccuccuccgcgacuccgaggccuucugccacgccaacugcuccggccccgcccccgccgccaagcccgaccccgacggcggccgcgccgacgagugggccugcgagcuccgccucuucggccgcguccucgagcgcgccgccugccuccgccgcugcaagcgcacccuccccgccuuccagguccccuaccccccccgccagcuccuccgcgacuuccagucccgccuccccuaccaguaccuccacuacgcccucuucaaggccaaccgccucgagaaggccgucgccgccgccuacaccuuccuccagcgcaaccccaagcacgagcucaccgccaaguaccucaacuacuaccagggcaugcucgacgucgccgacgagucccucaccgaccucgaggcccagcccuacgaggccgucuuccuccgcgccgucaagcucuacaacuccggcgacuuccgcuccuccaccgaggacauggagcgcgcccucuccgaguaccucgccgucuucgcccgcugccucgccggcugcgagggcgcccacgagcaggucgacuucaaggacuucuaccccgccaucgccgaccucuucgccgagucccuccagugcaaggucgacugcgaggccaaccucacccccaacgucggcggcuacuucgucgacaaguucgucgccaccauguaccacuaccuccaguucgccuacuacaagcucaacgacguccgccaggccgcccgcuccgccgccuccuacaugcucuucgaccccaaggacuccgucaugcagcagaaccucgucuacuaccgcuuccaccgcgcccgcuggggccucgaggaggaggacuuccagccccgcgaggaggccaugcucuaccacaaccagaccgccgagcuccgcgagcuccucgaguucacccacauguaccuccaguccgacgacgagauggagcucgaggagaccgagcccccccucgagcccgaggacgcccucuccgacgccgaguucgagggcgagggcgacuacgaggagggcauguacgccgacugguggcaggagcccgacgccaagggcgacgaggccgaggccgagcccgagcccgagcucgccuga

SEQ ID NO: 47234 - RNA, 1605 nt, Artificial Sequence
  derived and/or modified sequence opt2 from P4HA1__Homo_sapiens__NP_000908
augaucugguacauccucaucaucggcauccuccucccccagucccucgcccaccccggcuucuucaccuccaucggccagaugaccgaccucauccacaccgagaaggaccucgucaccucccucaaggacuacaucaaggccgaggaggacaagcucgagcagaucaagaagugggccgagaagcucgaccgccucaccuccaccgccaccaaggaccccgagggcuucgucggccaccccgucaacgccuucaagcucaugaagcgccucaacaccgagugguccgagcucgagaaccucguccucaaggacauguccgacggcuucaucuccaaccucaccauccagcgccaguacuuccccaacgacgaggaccaggucggcgccgccaaggcccuccuccgccuccaggacaccuacaaccucgacaccgacaccaucuccaagggcaaccuccccggcgucaagcacaaguccuuccucaccgccgaggacugcuucgagcucggcaaggucgccuacaccgaggccgacuacuaccacaccgagcucuggauggagcaggcccuccgccagcucgacgagggcgagaucuccaccaucgacaaggucuccguccucgacuaccucuccuacgccgucuaccagcagggcgaccucgacaaggcccuccuccucaccaagaagcuccucgagcucgaccccgagcaccagcgcgccaacggcaaccucaaguacuucgaguacaucauggccaaggagaaggacgucaacaaguccgccuccgacgaccaguccgaccagaagaccacccccaagaagaagggcgucgccgucgacuaccuccccgagcgccagaaguacgagaugcucugccgcggcgagggcaucaagaugaccccccgccgccagaagaagcucuucugccgcuaccacgacggcaaccgcaaccccaaguucauccucgcccccgccaagcaggaggacgagugggacaagccccgcaucauccgcuuccacgacaucaucuccgacgccgagaucgagaucgucaaggaccucgccaagccccgccucucccgcgccaccguccacgaccccgagaccggcaagcucaccaccgcccaguaccgcgucuccaaguccgccuggcucuccggcuacgagaaccccgucgucucccgcaucaacaugcgcauccaggaccucaccggccucgacgucuccaccgccgaggagcuccaggucgccaacuacggcgucggcggccaguacgagccccacuucgacuucgcccgcaaggacgagcccgacgccuucaaggagcucggcaccggcaaccgcaucgccaccuggcucuucuacauguccgacgucuccgccggcggcgccaccgucuuccccgaggucggcgccuccgucuggcccaagaagggcaccgccgucuucugguacaaccucuucgccuccggcgagggcgacuacuccacccgccacgccgccugccccguccucgucggcaacaagugggucuccaacaaguggcuccacgagcgcggccaggaguuccgccgccccugcacccucuccgagcucgaguga

SEQ ID NO: 47235 - RNA, 1608 nt, Artificial Sequence
  derived and/or modified sequence opt2 from P4HA2__Homo_sapiens__XP_005272177
augaagcucugggucuccgcccuccucauggccugguucggcguccucuccugcguccaggccgaguucuucaccuccaucggccacaugaccgaccucaucuacgccgagaaggagcucguccagucccucaaggaguacauccucgucgaggaggccaagcucuccaagaucaaguccugggccaacaagauggaggcccucaccuccaaguccgccgccgacgccgagggcuaccucgcccaccccgucaacgccuacaagcucgucaagcgccucaacaccgacuggcccgcccucgaggaccucguccuccaggacuccgccgccggcuucaucgccaaccucuccguccagcgccaguucuuccccaccgacgaggacgagaucggcgccgccaaggcccucaugcgccuccaggacaccuaccgccucgaccccggcaccaucucccgcggcgagcuccccggcaccaaguaccaggccaugcucuccgucgacgacugcuucggcaugggccgcuccgccuacaacgagggcgacuacuaccacaccguccucuggauggagcagguccucaagcagcucgacgccggcgaggaggccaccaccaccaagucccagguccucgacuaccucuccuacgccgucuuccagcucggcgaccuccaccgcgcccucgagcucacccgccgccuccucucccucgaccccucccacgagcgcgccggcggcaaccuccgcuacuucgagcagcuccucgaggaggagcgcgagaagacccucaccaaccagaccgaggccgagcucgccacccccgagggcaucuacgagcgccccgucgacuaccuccccgagcgcgacgucuacgagucccucugccgcggcgagggcgucaagcucaccccccgccgccagaagcgccucuucugccgcuaccaccacggcaaccgcgccccccagcuccucaucgcccccuucaaggaggaggacgagugggacuccccccacaucguccgcuacuacgacgucauguccgacgaggagaucgagcgcaucaaggagaucgccaagcccaagcucgcccgcgccaccguccgcgaccccaagaccggcguccucaccgucgccuccuaccgcgucuccaaguccuccuggcucgaggaggacgacgaccccgucgucgcccgcgucaaccgccgcaugcagcacaucaccggccucaccgucaagaccgccgagcuccuccaggucgccaacuacggcgucggcggccaguacgagccccacuucgacuucucccgcaacgacgagcgcgacaccuucaagcaccucggcaccggcaaccgcgucgccaccuuccucaacuacauguccgacgucgaggccggcggcgccaccgucuuccccgaccucggcgccgccaucuggcccaagaagggcaccgccgucuucugguacaaccuccuccgcuccggcgagggcgacuaccgcacccgccacgccgccugccccguccucgucggcugcaagugggucuccaacaagugguuccacgagcgcggccaggaguuccuccgccccugcggcuccaccgaggucgacuga

SEQ ID NO: 47236 - RNA, 1527 nt, Artificial Sequence
  derived and/or modified sequence opt2 from P4HB__Homo_sapiens__NP_000909
augcuccgccgcgcccuccucugccucgccgucgccgcccucguccgcgccgacgcccccgaggaggaggaccacguccucguccuccgcaaguccaacuucgccgaggcccucgccgcccacaaguaccuccucgucgaguucuacgcccccuggugcggccacugcaaggcccucgcccccgaguacgccaaggccgccggcaagcucaaggccgagggcuccgagauccgccucgccaaggucgacgccaccgaggaguccgaccucgcccagcaguacggcguccgcggcuaccccaccaucaaguucuuccgcaacggcgacaccgccucccccaaggaguacaccgccggccgcgaggccgacgacaucgucaacuggcucaagaagcgcaccggccccgccgccaccacccuccccgacggcgccgccgccgagucccucgucgaguccuccgaggucgccgucaucggcuucuucaaggacgucgaguccgacuccgccaagcaguuccuccaggccgccgaggccaucgacgacauccccuucggcaucaccuccaacuccgacgucuucuccaaguaccagcucgacaaggacggcgucguccucuucaagaaguucgacgagggccgcaacaacuucgagggcgaggucaccaaggagaaccuccucgacuucaucaagcacaaccagcucccccucgucaucgaguucaccgagcagaccgcccccaagaucuucggcggcgagaucaagacccacauccuccucuuccuccccaaguccgucuccgacuacgacggcaagcucuccaacuucaagaccgccgccgaguccuucaagggcaagauccucuucaucuucaucgacuccgaccacaccgacaaccagcgcauccucgaguucuucggccucaagaaggaggagugccccgccguccgccucaucacccucgaggaggagaugaccaaguacaagcccgaguccgaggagcucaccgccgagcgcaucaccgaguucugccaccgcuuccucgagggcaagaucaagccccaccucaugucccaggagcuccccgaggacugggacaagcagcccgucaagguccucgucggcaagaacuucgaggacgucgccuucgacgagaagaagaacgucuucgucgaguucuacgcccccuggugcggccacugcaagcagcucgcccccaucugggacaagcucggcgagaccuacaaggaccacgagaacaucgucaucgccaagauggacuccaccgccaacgaggucgaggccgucaagguccacuccuuccccacccucaaguucuuccccgccuccgccgaccgcaccgucaucgacuacaacggcgagcgcacccucgacggcuucaagaaguuccucgaguccggcggccaggacggcgccggcgacgacgacgaccucgaggaccucgaggaggccgaggagcccgacauggaggaggacgacgaccagaaggccgucaaggacgagcucuga

SEQ ID NO: 47237 - RNA, 1692 nt, Artificial Sequence
  derived and/or modified sequence opt2 from P4HTM__Homo_sapiens__NP_808807
auggccgccgccgccgucaccggccagcgccccgagaccgccgccgccgaggaggccucccgcccccagugggccccccccgaccacugccaggcccaggccgccgccggccucggcgacggcgaggacgcccccguccgcccccucugcaagccccgcggcaucugcucccgcgccuacuuccucguccucauggucuucguccaccucuaccucggcaacguccucgcccuccuccucuucguccacuacuccaacggcgacgaguccuccgaccccggcccccagcaccgcgcccagggccccggccccgagcccacccucggcccccucacccgccucgagggcaucaaggucggccacgagcgcaagguccagcucgucaccgaccgcgaccacuucauccgcacccucucccucaagccccuccucuucgagauccccggcuuccucaccgacgaggagugccgccucaucauccaccucgcccagaugaagggccuccagcgcucccagauccuccccaccgaggaguacgaggaggccauguccaccaugcaggucucccagcucgaccucuuccgccuccucgaccagaaccgcgacggccaccuccagcuccgcgagguccucgcccagacccgccucggcaacggcugguggaugacccccgaguccauccaggagauguacgccgccaucaaggccgaccccgacggcgacggcguccucucccuccaggaguucuccaacauggaccuccgcgacuuccacaaguacaugcgcucccacaaggccgaguccuccgagcucguccgcaacucccaccacaccuggcucuaccagggcgagggcgcccaccacaucaugcgcgccauccgccagcgcguccuccgccucacccgccucucccccgagaucgucgagcucuccgagccccuccaggucguccgcuacggcgagggcggccacuaccacgcccacgucgacuccggccccgucuaccccgagaccaucugcucccacaccaagcucgucgccaacgaguccguccccuucgagaccuccugccgccaggucucccccaacuggggccuccccuccauccuccgccccggcacccccaugacccaggcccagcccugcaccgucggcgucccccucggcaugggccccggcgaccacugggucauccccgucucccccugggagcacccccagcucggcaccugcuccguccccccccuccccuacuccuacaugaccguccucuucuaccucaacaacgucaccggcggcggcgagaccgucuuccccgucgccgacaaccgcaccuacgacgagaugucccucauccaggacgacgucgaccuccgcgacacccgccgccacugcgacaagggcaaccuccgcgucaagccccagcagggcaccgccgucuucugguacaacuaccuccccgacggccagggcugggucggcgacgucgacgacuacucccuccacggcggcugccucgucacccgcggcaccaaguggaucgccaacaacuggaucaacgucgaccccucccgcgcccgccaggcccucuuccagcaggagauggcccgccucgcccgcgagggcggcaccgacucccagcccgagugggcccucgaccgcgccuaccgcgacgcccgcgucgagcucuga

SEQ ID NO: 47238 - RNA, 1185 nt, Artificial Sequence
  derived and/or modified sequence opt2 from PA2G4__Homo_sapiens__NP_006182
auguccggcgaggacgagcagcaggagcagaccaucgccgaggaccucgucgucaccaaguacaagaugggcggcgacaucgccaaccgcguccuccgcucccucgucgaggccuccuccuccggcgucuccguccucucccucugcgagaagggcgacgccaugaucauggaggagaccggcaagaucuucaagaaggagaaggagaugaagaagggcaucgccuuccccaccuccaucuccgucaacaacugcgucugccacuucuccccccucaaguccgaccaggacuacauccucaaggagggcgaccucgucaagaucgaccucggcguccacgucgacggcuucaucgccaacgucgcccacaccuucgucgucgacgucgcccagggcacccaggucaccggccgcaaggccgacgucaucaaggccgcccaccucugcgccgaggccgcccuccgccucgucaagcccggcaaccagaacacccaggucaccgaggccuggaacaaggucgcccacuccuucaacugcacccccaucgagggcaugcucucccaccagcucaagcagcacgucaucgacggcgagaagaccaucauccagaaccccaccgaccagcagaagaaggaccacgagaaggccgaguucgagguccacgaggucuacgccgucgacguccucgucuccuccggcgagggcaaggccaaggacgccggccagcgcaccaccaucuacaagcgcgaccccuccaagcaguacggccucaagaugaagaccucccgcgccuucuucuccgaggucgagcgccgcuucgacgccaugcccuucacccuccgcgccuucgaggacgagaagaaggcccgcaugggcgucgucgagugcgccaagcacgagcuccuccagcccuucaacguccucuacgagaaggagggcgaguucgucgcccaguucaaguucaccguccuccucaugcccaacggccccaugcgcaucaccuccggccccuucgagcccgaccucuacaaguccgagauggagguccaggacgccgagcucaaggcccuccuccaguccuccgccucccgcaagacccagaagaagaagaagaagaaggccuccaagaccgccgagaacgccaccuccggcgagacccucgaggagaacgaggccggcgacuga

SEQ ID NO: 47239 - RNA, 1911 nt, Artificial Sequence
  derived and/or modified sequence opt2 from PABPC1__Homo_sapiens__XP_005250918
augaaccccuccgcccccuccuaccccauggccucccucuacgucggcgaccuccaccccgacgucaccgaggccaugcucuacgagaaguucucccccgccggccccauccucuccauccgcgucugccgcgacaugaucacccgccgcucccucggcuacgccuacgucaacuuccagcagcccgccgacgccgagcgcgcccucgacaccaugaacuucgacgucaucaagggcaagcccguccgcaucauguggucccagcgcgaccccucccuccgcaaguccggcgucggcaacaucuucaucaagaaccucgacaaguccaucgacaacaaggcccucuacgacaccuucuccgccuucggcaacauccucuccugcaaggucgucugcgacgagaacggcuccaagggcuacggcuucguccacuucgagacccaggaggccgccgagcgcgccaucgagaagaugaacggcaugcuccucaacgaccgcaaggucuucgucggccgcuucaagucccgcaaggagcgcgaggccgagcucggcgcccgcgccaaggaguucaccaacgucuacaucaagaacuucggcgaggacauggacgacgagcgccucaaggaccucuucggcaaguucggccccgcccucuccgucaaggucaugaccgacgaguccggcaaguccaagggcuucggcuucgucuccuucgagcgccacgaggacgcccagaaggccgucgacgagaugaacggcaaggagcucaacggcaagcagaucuacgucggccgcgcccagaagaaggucgagcgccagaccgagcucaagcgcaaguucgagcagaugaagcaggaccgcaucacccgcuaccagggcgucaaccucuacgucaagaaccucgacgacggcaucgacgacgagcgccuccgcaaggaguucucccccuucggcaccaucaccuccgccaaggucaugauggagggcggccgcuccaagggcuucggcuucgucugcuucuccucccccgaggaggccaccaaggccgucaccgagaugaacggccgcaucgucgccaccaagccccucuacgucgcccucgcccagcgcaaggaggagcgccaggcccaccucaccaaccaguacaugcagcgcauggccuccguccgcgccguccccaaccccgucaucaaccccuaccagcccgccccccccuccggcuacuucauggccgccaucccccagacccagaaccgcgccgccuacuacccccccucccagaucgcccagcuccgccccuccccccgcuggaccgcccagggcgcccgcccccaccccuuccagaacaugcccggcgccauccgccccgccgccccccgcccccccuucuccaccaugcgccccgccuccucccaggucccccgcgucauguccacccagcgcgucgccaacaccuccacccagaccaugggcccccgccccgccgccgccgccgccgccgccacccccgccguccgcaccgucccccaguacaaguacgccgccggcguccgcaacccccagcagcaccucaacgcccagccccaggucaccaugcagcagcccgccguccacguccagggccaggagccccucaccgccuccaugcucgccuccgcccccccccaggagcagaagcagaugcucggcgagcgccucuucccccucauccaggccaugcaccccacccucgccggcaagaucaccggcaugcuccucgagaucgacaacuccgagcuccuccacaugcucgagucccccgagucccuccgcuccaaggucgacgaggccgucgccguccuccaggcccaccaggccaaggaggccgcccagaaggccgucaacuccgccaccggcguccccaccgucuga

SEQ ID NO: 47240 - RNA, 1896 nt, Artificial Sequence
  derived and/or modified sequence opt2 from PABPC3__Homo_sapiens__NP_112241
augaaccccuccacccccuccuaccccaccgccucccucuacgucggcgaccuccaccccgacgucaccgaggccaugcucuacgagaaguucucccccgccggccccauccucuccauccgcaucugccgcgaccucaucaccuccggcuccuccaacuacgccuacgucaacuuccagcacaccaaggacgccgagcacgcccucgacaccaugaacuucgacgucaucaagggcaagcccguccgcaucauguggucccagcgcgaccccucccuccgcaaguccggcgucggcaacaucuucgucaagaaccucgacaaguccaucaacaacaaggcccucuacgacaccgucuccgccuucggcaacauccucuccugcaacgucgucugcgacgagaacggcuccaagggcuacggcuucguccacuucgagacccacgaggccgccgagcgcgccaucaagaagaugaacggcaugcuccucaacggccgcaaggucuucgucggccaguucaagucccgcaaggagcgcgaggccgagcucggcgcccgcgccaaggaguuccccaacgucuacaucaagaacuucggcgaggacauggacgacgagcgccucaaggaccucuucggcaaguucggccccgcccucuccgucaaggucaugaccgacgaguccggcaaguccaagggcuucggcuucgucuccuucgagcgccacgaggacgcccagaaggccgucgacgagaugaacggcaaggagcucaacggcaagcagaucuacgucggccgcgcccagaagaaggucgagcgccagaccgagcucaagcgcaccuucgagcagaugaagcaggaccgcaucacccgcuaccaggucgucaaccucuacgucaagaaccucgacgacggcaucgacgacgagcgccuccgcaaggccuucucccccuucggcaccaucaccuccgccaaggucaugauggagggcggccgcuccaagggcuucggcuucgucugcuucuccucccccgaggaggccaccaaggccgucaccgagaugaacggccgcaucgucgccaccaagccccucuacgucgcccucgcccagcgcaaggaggagcgccaggccuaccucaccaacgaguacaugcagcgcauggccuccguccgcgccguccccaaccagcgcgccccccccuccggcuacuucaugaccgccgucccccagacccagaaccacgccgccuacuacccccccucccagaucgcccgccuccgccccuccccccgcuggaccgcccagggcgcccgcccccaccccuuccagaacaagcccuccgccauccgccccggcgccccccgcguccccuucuccaccaugcgccccgccuccucccaggucccccgcgucauguccacccagcgcgucgccaacaccuccacccagaccgucggcccccgccccgccgccgccgccgccgccgccgccacccccgccguccgcaccgucccccgcuacaaguacgccgccggcguccgcaacccccagcagcaccgcaacgcccagccccaggucaccaugcagcagcucgccguccacguccagggccaggagacccucaccgccucccgccucgccuccgcccccccccagaagcagaagcagaugcucggcgagcgccucuucccccucauccaggccaugcaccccacccucgccggcaagaucaccggcaugcuccucgagaucgacaacuccgagcuccucuacaugcucgagucccccgagucccuccgcuccaaggucgacgaggccgucgccguccuccaggcccaccaggccaaggaggccacccagaaggccgucaacuccgccaccggcguccccaccgucuga

SEQ ID NO: 47241 - RNA, 1287 nt, Artificial Sequence
  derived and/or modified sequence opt2 from PABPC4L__Homo_sapiens__NP_001108206
augcgcguccuccccgagcucggcgaguccugccucaacuccaucgccuggccccucugcggcgaccccgaggccuccacccucgagcccggccaguccugcgaccucgucuccccccaccgcgacugcuccaagaacucccgcggccagacccacuccggcaaggacaaggagaugaacgucgccgccaaguaccgcauggccucccucuacgucggcgaccuccacgccgacgucaccgaggaccuccucuuccgcaaguucuccaccgucggccccguccucuccauccgcaucugccgcgaccaggucacccgccgcucccucggcuacgccuacgucaacuuccuccagcucgccgacgcccagaaggcccucgacaccaugaacuucgacaucaucaagggcaaguccauccgccucauguggucccagcgcgacgccuaccuccgccgcuccggcaucggcaacgucuucaucaagaaccucgacaaguccaucgacaacaagacccucuacgagcacuucuccgccuucggcaagauccucuccuccaaggucauguccgacgaccagggcuccaagggcuacgccuucguccacuuccagaaccaguccgccgccgaccgcgccaucgaggagaugaacggcaagcuccucaagggcugcaaggucuucgucggccgcuucaagaaccgcaaggaccgcgaggccgagcuccgcuccaaggccuccgaguucaccaacgucuacaucaagaacuucggcggcgacauggacgacgagcgccucaaggacgucuucuccaaguacggcaagacccucuccgucaaggucaugaccgacuccuccggcaaguccaagggcuucggcuucgucuccuucgacucccacgaggccgccaagaaggccgucgaggagaugaacggccgcgacaucaacggccagcucaucuucgucggccgcgcccagaagaaggucgagcgccaggccgagcucaagcagauguucgagcagcucaagcgcgagcgcauccgcggcugccagggcgucaagcucuacaucaagaaccucgacgacaccaucgacgacgagaagcuccgcaacgaguucuccuccuucggcuccaucucccgcgucaaggucaugcaggaggagggccaguccaagggcuucggccucaucugcuucuccucccccgaggacgccaccaaggccaugaccgagaugaacggccgcauccucggcuccaagccccucuccaucgcccucgcccagcgccacuga

SEQ ID NO: 47242 - RNA, 921 nt, Artificial Sequence
  derived and/or modified sequence opt2 from PABPN1__Homo_sapiens__NP_004634
auggccgccgccgccgccgccgccgccgccgccggcgccgccggcggccgcggcuccggccccggccgccgccgccaccucguccccggcgccggcggcgaggccggcgagggcgcccccggcggcgccggcgacuacggcaacggccucgaguccgaggagcucgagcccgaggagcuccuccucgagcccgagcccgagcccgagcccgaggaggagcccccccgcccccgcgccccccccggcgcccccggccccggccccggcuccggcgcccccggcucccaggaggaggaggaggagcccggccucgucgagggcgaccccggcgacggcgccaucgaggaccccgagcucgaggccaucaaggcccgcguccgcgagauggaggaggaggccgagaagcucaaggagcuccagaacgaggucgagaagcagaugaacaugucccccccccccggcaacgccggccccgucaucauguccaucgaggagaagauggaggccgacgcccgcuccaucuacgucggcaacgucgacuacggcgccaccgccgaggagcucgaggcccacuuccacggcugcggcuccgucaaccgcgucaccauccucugcgacaaguucuccggccaccccaagggcuucgccuacaucgaguucuccgacaaggaguccguccgcaccucccucgcccucgacgagucccucuuccgcggccgccagaucaaggucauccccaagcgcaccaaccgccccggcaucuccaccaccgaccgcggcuucccccgcgcccgcuaccgcgcccgcaccaccaacuacaacuccucccgcucccgcuucuacuccggcuucaacucccgcccccgcggccgcgucuaccgcggccgcgcccgcgccaccuccugguacucccccuacuga

SEQ ID NO: 47243 - RNA, 774 nt, Artificial Sequence
  derived and/or modified sequence opt2 from PACRG__Homo_sapiens__NP_001073848
auggucgccgagaaggagacccucucccucaacaagugccccgacaagaugcccaagcgcaccaagcuccucgcccagcagccccuccccguccaccagccccacucccucgucuccgagggcuucaccgucaaggccaugaugaagaacuccgucguccgcggcccccccgccgccggcgccuucaaggagcgccccaccaagcccaccgccuuccgcaaguucuacgagcgcggcgacuuccccaucgcccucgagcacgacuccaagggcaacaagaucgccuggaaggucgagaucgagaagcucgacuaccaccacuaccucccccucuucuucgacggccucugcgagaugaccuuccccuacgaguucuucgcccgccagggcauccacgacaugcucgagcacggcggcaacaagauccuccccguccucccccagcucaucauccccaucaagaacgcccucaaccuccgcaaccgccaggucaucugcgucacccucaagguccuccagcaccucgucgucuccgccgagauggucggcaaggcccucguccccuacuaccgccagauccuccccguccucaacaucuucaagaacaugaacgucaacuccggcgacggcaucgacuacucccagcagaagcgcgagaacaucggcgaccucauccaggagacccucgaggccuucgagcgcuacggcggcgagaacgccuucaucaacaucaaguacgucguccccaccuacgaguccugccuccucaacuga

SEQ ID NO: 47244 - RNA, 2892 nt, Artificial Sequence
  derived and/or modified sequence opt2 from PACS1__Homo_sapiens__NP_060496
auggccgagcgcggcggcgccggcggcggccccggcggcgccggcggcggcuccggccagcgcggcuccggcgucgcccaguccccccagcagccccccccccagcagcagcagcagcagcccccccagcagcccaccccccccaagcucgcccaggccaccuccuccuccuccuccaccuccgccgccgccgccuccuccuccuccuccuccaccuccaccuccauggccgucgccgucgccuccggcuccgccccccccggcggccccggccccggccgcacccccgcccccguccagaugaaccucuacgccaccugggaggucgaccgcuccuccuccuccugcgucccccgccucuucucccucacccucaagaagcucgucaugcucaaggagauggacaaggaccucaacuccgucgucaucgccgucaagcuccagggcuccaagcgcauccuccgcuccaacgagaucguccuccccgccuccggccucgucgagaccgagcuccagcucaccuucucccuccaguacccccacuuccucaagcgcgacgccaacaagcuccagaucaugcuccagcgccgcaagcgcuacaagaaccgcaccauccucggcuacaagacccucgccgucggccucaucaacauggccgaggucaugcagcaccccaacgagggcgcccucguccucggccuccacuccaacgucaaggacgucuccguccccgucgccgagaucaagaucuacucccucuccucccagcccaucgaccacgagggcaucaaguccaagcucuccgaccgcucccccgacaucgacaacuacuccgaggaggaggaggaguccuucuccuccgagcaggagggcuccgacgacccccuccacggccaggaccucuucuacgaggacgaggaccuccgcaaggucaagaagacccgccgcaagcucaccuccaccuccgccaucacccgccagcccaacaucaagcagaaguucgucgcccuccucaagcgcuucaaggucuccgacgaggucggcuucggccucgagcacgucucccgcgagcagauccgcgaggucgaggaggaccucgacgagcucuacgacucccucgagauguacaaccccuccgacuccggccccgagauggaggagaccgaguccauccucuccacccccaagcccaagcucaagcccuucuucgagggcaugucccaguccuccucccagaccgagaucggcucccucaacuccaagggcucccucggcaaggacaccaccucccccauggagcucgccgcccucgagaagaucaaguccaccuggaucaagaaccaggacgacucccucaccgagaccgacacccucgagaucaccgaccaggacauguucggcgacgccuccaccucccucgucguccccgagaaggucaagacccccaugaaguccuccaagaccgaccuccagggcuccgccucccccuccaaggucgagggcguccacaccccccgccagaagcgcuccaccccccucaaggagcgccagcucuccaagccccucuccgagcgcaccaacuccuccgacuccgagcgcucccccgaccucggccacuccacccagaucccccgcaaggucgucuacgaccagcucaaccagauccucgucuccgacgccgcccuccccgagaacgucauccucgucaacaccaccgacuggcagggccaguacgucgccgagcuccuccaggaccagcgcaagcccgucgucugcaccugcuccaccgucgagguccaggccguccucuccgcccuccucacccgcauccagcgcuacugcaacugcaacuccuccaugccccgccccgucaaggucgccgccgucggcggccaguccuaccucuccuccauccuccgcuucuucgucaagucccucgccaacaagaccuccgacuggcucggcuacaugcgcuuccucaucaucccccucggcucccaccccgucgccaaguaccucggcuccgucgacuccaaguacuccuccuccuuccucgacuccggcuggcgcgaccucuucucccgcuccgagccccccgucuccgagcagcucgacgucgccggccgcgucaugcaguacgucaacggcgccgccaccacccaccagcuccccgucgccgaggccaugcucaccugccgccacaaguuccccgacgaggacuccuaccagaaguucauccccuucaucggcgucgucaaggucggccucgucgaggacucccccuccaccgccggcgacggcgacgacucccccgucgucucccucaccguccccuccaccuccccccccuccuccuccggccucucccgcgacgccaccgccaccccccccuccucccccuccauguccuccgcccucgccaucgucggcucccccaacucccccuacggcgacgucaucggccuccaggucgacuacuggcucggccaccccggcgagcgccgccgcgagggcgacaagcgcgacgccuccuccaagaacacccucaaguccgucuuccgcuccguccaggucucccgccucccccacuccggcgaggcccagcucuccggcaccauggccaugaccgucgucaccaaggagaagaacaagaagguccccaccaucuuccucuccaagaagccccgcgagaaggaggucgacuccaagucccaggucaucgagggcaucucccgccucaucugcuccgccaagcagcagcagaccaugcuccgcgucuccaucgacggcgucgagugguccgacaucaaguucuuccagcucgccgcccaguggcccacccacgucaagcacuuccccgucggccucuucuccggcuccaaggccaccuga

SEQ ID NO: 47245 - RNA, 2715 nt, Artificial Sequence
  derived and/or modified sequence opt2 from PACS2__Homo_sapiens__NP_001094383
auggccgagcgcggccgccucggccuccccggcgcccccggcgcccucaacacccccguccccaugaaccucuucgccaccugggaggucgacggcuccucccccuccugcgucccccgccucugcucccucacccucaagaagcucgucgucuucaaggagcucgagaaggagcucaucuccgucgucaucgccgucaagaugcagggcuccaagcgcauccuccgcucccacgagaucguccucccccccuccggccaggucgagaccgaccucgcccucaccuucucccuccaguacccccacuuccucaagcgcgagggcaacaagcuccagaucaugcuccagcgccgcaagcgcuacaagaaccgcaccauccucggcuacaagacccucgccgccggcuccaucuccauggccgaggucaugcagcaccccuccgagggcggccagguccucucccucugcuccuccaucaaggaggcccccgucaaggccgccgagaucuggaucgccucccucuccucccagcccaucgaccacgaggacuccaccaugcaggccggccccaaggccaaguccaccgacaacuacuccgaggaggaguacgaguccuucuccuccgagcaggaggccuccgacgacgccguccagggccaggaccucgacgaggacgacuucgacgucggcaagcccaagaagcagcgccgcuccaucguccgcaccaccuccaugacccgccagcagaacuucaagcagaaggucgucgcccuccuccgccgcuucaaggucuccgacgagguccucgacuccgagcaggaccccgccgagcacauccccgaggccgaggaggaccucgaccuccucuacgacacccucgacauggagcaccccuccgacuccggccccgacauggaggacgacgacuccguccucuccacccccaagcccaagcuccgccccuacuucgagggccucucccacuccuccucccagaccgagaucggcuccauccacuccgcccgcucccacaaggagccccccucccccgccgacguccccgagaagacccgcucccucggcggccgccagcccuccgacuccgucuccgacaccgucgcccucggcguccccggcccccgcgagcaccccggccagcccgaggacucccccgaggccgaggccuccacccucgacgucuucaccgagcgccucccccccuccggccgcaucaccaagaccgagucccucgucauccccuccacccgcuccgagggcaagcaggccggccgccgcggccgcuccaccucccucaaggagcgccaggccgcccgcccccagaacgagcgcgccaacucccucgacaacgagcgcugccccgacgcccgcucccagcuccagguccagcuccagaucccccgcaagaccgucuacgaccagcucaaccacauccucaucuccgacgaccagcuccccgagaacaucauccucgucaacaccuccgacuggcagggccaguuccucuccgacguccuccagcgccacacccuccccgucgucugcaccugcucccccgccgacguccaggccgccuucuccaccaucgucucccgcauccagcgcuacugcaacugcaacucccagccccccacccccgucaagaucgccgucgccggcgcccagcacuaccucuccgccauccuccgccucuucgucgagcagcucucccacaagacccccgacuggcucggcuacaugcgcuuccucgucaucccccucggcucccaccccgucgcccgcuaccucggcuccgucgacuaccgcuacaacaacuucuuccaggaccucgccuggcgcgaccucuucaacaagcucgaggcccaguccgccguccaggacacccccgacaucgucucccgcaucacccaguacaucgccggcgccaacugcgcccaccagcuccccaucgccgaggccaugcucaccuacaagcagaagcgcaagaagcacuuccacuucgacuucacccucucccccgacgaggaguccucccagaaguucauccccuucgucggcgucgucaaggucggcaucgucgagcccuccuccgccaccuccggcgacuccgacgacgccgcccccuccggcuccggcacccucuccuccaccccccccuccgccucccccgccgccaaggaggccucccccaccccccccuccucccccuccgucuccggcggccucuccucccccucccagggcgucggcgccgagcucaugggccuccaggucgacuacuggaccgccgcccagcccgccgaccgcaagcgcgacgccgagaagaaggaccuccccgucaccaagaacacccucaagugcaccuuccgcucccuccaggucucccgccuccccuccuccggcgaggccgccgccacccccaccauguccaugaccgucgucaccaaggagaagaacaagaaggucauguuccuccccaagaaggccaaggacaaggacgucgaguccaagucccagugcaucgagggcaucucccgccucaucugcaccgcccgccagcagcagaacaugcuccgcguccucaucgacggcgucgagugcuccgacgucaaguucuuccagcucgccgcccagugguccucccacgucaagcacuuccccaucugcaucuucggccacuccaaggccaccuucuga

SEQ ID NO: 47246 - RNA, 1335 nt, Artificial Sequence
  derived and/or modified sequence opt2 from PACSIN1__Homo_sapiens__XP_011512843
auguccuccuccuacgacgaggccucccucgcccccgaggagaccaccgacuccuucugggaggucggcaacuacaagcgcaccgucaagcgcaucgacgacggccaccgccucugcaacgaccucaugaacugcguccaggagcgcgccaagaucgagaaggccuacggccagcagcucaccgacugggccaagcgcuggcgccagcucaucgagaagggcccccaguacggcucccucgagcgcgccuggggcgccaucaugaccgaggccgacaaggucuccgagcuccaccaggaggucaagaacaaccuccucaacgaggaccucgagaaggucaagaacuggcagaaggacgccuaccacaagcagaucaugggcggcuucaaggagaccaaggaggccgaggacggcuuccgcaaggcccagaagcccugggccaagaagaugaaggagcucgaggccgccaagaaggccuaccaccucgccugcaaggaggagaagcucgccaugacccgcgagaugaacuccaagaccgagcaguccgucacccccgagcagcagaagaagcuccaggacaaggucgacaagugcaagcaggacguccagaagacccaggagaaguacgagaagguccucgaggacgucggcaagaccaccccccaguacauggagaacauggagcaggucuucgagcagugccagcaguucgaggagaagcgccucgucuuccucaaggagguccuccucgacaucaagcgccaccucaaccucgccgagaacuccuccuacauccacgucuaccgcgagcucgagcaggccauccgcggcgccgacgcccaggaggaccuccgcugguuccgcuccaccuccggccccggcaugcccaugaacuggccccaguucgaggaguggaaccccgaccucccccacaccaccaccaagaaggagaagcagcccaagaaggccgagggcgucgcccucaccaacgccaccggcgccgucgaguccaccucccaggccggcgaccgcggcuccgucuccuccuacgaccgcggccagcccuacgccaccgagugguccgacgacgaguccggcaaccccuucggcggcuccgagaccaacggcggcgccaaccccuucgaggacgacuccaagggcguccgcguccgcgcccucuacgacuacgacggccaggagcaggacgagcucuccuucaaggccggcgacgagcucaccaagcucggcgaggaggacgagcagggcuggugccgcggccgccucgacuccggccagcucggccucuaccccgccaacuacgucgaggccaucuga

SEQ ID NO: 47247 - RNA, 1461 nt, Artificial Sequence
  derived and/or modified sequence opt2 from PACSIN2__Homo_sapiens__NP_001171899
auguccgucaccuacgacgacuccgucggcgucgaggucuccuccgacuccuucugggaggucggcaacuacaagcgcaccgucaagcgcaucgacgacggccaccgccucugcuccgaccucaugaacugccuccacgagcgcgcccgcaucgagaaggccuacgcccagcagcucaccgagugggcccgccgcuggcgccagcucgucgagaagggcccccaguacggcaccgucgagaaggccuggauggccuucauguccgaggccgagcgcgucuccgagcuccaccucgaggucaaggccucccucaugaacgacgacuucgagaagaucaagaacuggcagaaggaggccuuccacaagcagaugaugggcggcuucaaggagaccaaggaggccgaggacggcuuccgcaaggcccagaagcccugggccaagaagcucaaggaggucgaggccgccaagaaggcccaccacgccgccugcaaggaggagaagcucgccaucucccgcgaggccaacuccaaggccgaccccucccucaaccccgagcagcucaagaagcuccaggacaagaucgagaagugcaagcaggacguccucaagaccaaggagaaguacgagaagucccucaaggagcucgaccagggcaccccccaguacauggagaacauggagcaggucuucgagcagugccagcaguucgaggagaagcgccuccgcuucuuccgcgagguccuccucgagguccagaagcaccucgaccucuccaacgucgccggcuacaaggccaucuaccacgaccucgagcaguccauccgcgccgccgacgccgucgaggaccuccgcugguuccgcgccaaccacggccccggcauggccaugaacuggccccaguucgaggagugguccgccgaccucaaccgcacccucucccgccgcgagaagaagaaggccaccgacggcgucacccucaccggcaucaaccagaccggcgaccagucccuccccuccaagcccuccuccacccucaacguccccuccaaccccgcccaguccgcccagucccaguccuccuacaaccccuucgaggacgaggacgacaccggcuccaccgucuccgagaaggacgacaccaaggccaagaacgucuccuccuacgagaagacccaguccuaccccaccgacugguccgacgacgaguccaacaaccccuucuccuccaccgacgccaacggcgacuccaaccccuucgacgacgacgccaccuccggcaccgagguccgcguccgcgcccucuacgacuacgagggccaggagcacgacgagcucuccuucaaggccggcgacgagcucaccaagauggaggacgaggacgagcagggcuggugcaagggccgccucgacaacggccaggucggccucuaccccgccaacuacgucgaggccauccaguga

SEQ ID NO: 47248 - RNA, 1806 nt, Artificial Sequence
  derived and/or modified sequence opt2 from PADI4__Homo_sapiens__XP_011539452
auggcccagggcacccucauccgcgucacccccgagcagcccacccacgccgucugcguccucggcacccucacccagcucgacaucugcuccuccgcccccgaggacugcaccuccuucuccaucaacgccucccccggcgucgucgucgacaucgcccacggcccccccgccaagaagaaguccaccggcuccuccaccuggccccucgaccccggcgucgaggucacccucaccaugaaggucgccuccggcuccaccggcgaccagaagguccagaucuccuacuacggccccaagaccccccccgucaaggcccuccucuaccucaccggcgucgaccuccaggacaugucccucaugacccucuccaccaagacccccaaggacuucuucaccaaccacacccucguccuccacgucgcccgcuccgagauggacaagguccgcgucuuccaggccacccgcggcaagcucuccuccaagugcuccgucguccucggccccaaguggcccucccacuaccucaugguccccggcggcaagcacaacauggacuucuacgucgaggcccucgccuuccccgacaccgacuuccccggccucaucacccucaccaucucccuccucgacaccuccaaccucgagcuccccgaggccgucgucuuccaggacuccgucgucuuccgcgucgcccccuggaucaugacccccaacacccagcccccccaggaggucuacgccugcuccaucuucgagaacgaggacuuccucaaguccgucaccacccucgccaugaaggccaagugcaagcucaccaucugccccgaggaggagaacauggacgaccaguggaugcaggacgagauggagaucggcuacauccaggccccccacaagacccuccccgucgucuucgacuccccccgcaaccgcggccucaaggaguuccccaucaagcgcgucaugggccccgacuucggcuacgucacccgcggcccccagaccggcggcaucuccggccucgacuccuucggcaaccucgaggucuccccccccgucaccguccgcggcaaggaguacccccucggccgcauccucuucggcgacuccugcuaccccuccaacgacucccgccagaugcaccaggcccuccaggacuuccucuccgcccagcagguccaggcccccgucaagcucuacuccgacuggcucuccgucggccacgucgacgaguuccucuccuucguccccgcccccgaccgcaagggcuuccgccuccuccucgccuccccccgcuccugcuacaagcucuuccaggagcagcagaacgagggccacggcgaggcccuccucuucgagggcaucaagaagaagaagcagcagaagaucaagaacauccucuccaacaagacccuccgcgagcacaacuccuucgucgagcgcugcaucgacuggaaccgcgagcuccucaagcgcgagcucggccucgccgaguccgacaucaucgacaucccccagcucuucaagcucaaggaguucuccaaggccgaggccuucuuccccaacauggucaacaugcucguccucggcaagcaccucggcauccccaagcccuucggccccgucaucaacggccgcugcugccucgaggagaaggucugcucccuccucgagccccucggccuccagugcaccuucaucaacgacuucuucaccuaccacauccgccacggcgagguccacugcggcaccaacguccgccgcaagcccuucuccuucaagugguggaacaugguccccuga

SEQ ID NO: 47249 - RNA, 543 nt, Artificial Sequence
  derived and/or modified sequence opt2 from PAEP__Homo_sapiens__NP_001018059
augcucugccuccuccucacccucggcgucgcccucgucugcggcguccccgccauggacaucccccagaccaagcaggaccucgagcuccccaagcucgccggcaccuggcacuccauggccauggccaccaacaacaucucccucauggccacccucaaggccccccuccgcguccacaucaccucccuccuccccacccccgaggacaaccucgagaucguccuccaccgcugggagaacaacuccugcgucgagaagaagguccucggcgagaagaccgagaaccccaagaaguucaagaucaacuacaccgucgccaacgaggccacccuccucgacaccgacuacgacaacuuccucuuccucugccuccaggacaccaccacccccauccaguccaugaugugccaguaccucgcccgcguccucgucgaggacgacgagaucaugcagggcuucauccgcgccuuccgcccccucccccgccaccucugguaccuccucgaccucaagcagauggaggagcccugccgcuucuga

SEQ ID NO: 47250 - RNA, 1458 nt, Artificial Sequence
  derived and/or modified sequence opt2 from PAF1__Homo_sapiens__NP_001243755
auggcccccaccauccagacccaggcccagcgcgaggacggccaccgcuccggcgucgucugccgcgucaaguacugcaacucccuccccgacauccccuucgaccccaaguucaucaccuaccccuucgaccagaaccgcuucguccaguacaaggccaccucccucgagaagcagcacaagcacgaccuccucaccgagcccgaccucggcgucaccaucgaccucaucaaccccgacaccuaccgcaucgaccccaacguccuccucgaccccgccgacgagaagcuccucgaggaggagauccaggcccccaccuccuccaagcgcucccagcagcacgccaaggucguccccuggaugcgcaagaccgaguacaucuccaccgaguucaaccgcuacggcaucuccaacgagaagcccgaggucaagaucggcgucuccgucaagcagcaguucaccgaggaggagaucuacaaggaccgcgacucccagaucaccgccaucgagaagaccuucgaggacgcccagaaguccaucucccagcacuacuccaagccccgcgucacccccgucgaggucaugcccgucuuccccgacuucaagauguggaucaaccccugcgcccaggucaucuucgacuccgaccccgcccccaaggacaccuccggcgccgccgcccucgagaugaugucccaggccaugauccgcggcaugauggacgaggagggcaaccaguucgucgccuacuuccuccccgucgaggagacccucaagaagcgcaagcgcgaccaggaggaggagauggacuacgcccccgacgacgucuacgacuacaagaucgcccgcgaguacaacuggaacgucaagaacaaggccuccaagggcuacgaggagaacuacuucuucaucuuccgcgagggcgacggcgucuacuacaacgagcucgagacccgcguccgccucuccaagcgccgcgccaaggccggcguccaguccggcaccaacgcccuccucgucgucaagcaccgcgacaugaacgagaaggagcucgaggcccaggaggcccgcaaggcccagcucgagaaccacgagcccgaggaggaggaggaggaggagauggagaccgaggagaaggaggccggcggcuccgucaugcucauccuccgcaccaugcccacccucaugaugcgcaccgaggaccgccccaaggucgccgucaccaugauccagaccgccgccgccaugggcgucgccuccggcgccggcgccaccgccgccgcccccguccccucccccgucgccgccuccacccgcccccgccgcauggccgucaagcuccagcuccucauccccgucaagcucaucgucaccgucaccgagucccagggcauccagggcugguuccgccaccacuacugcgagcagcaguccaccuuccucgucgucugccucuga

SEQ ID NO: 47251 - RNA, 1233 nt, Artificial Sequence
  derived and/or modified sequence opt2 from PAFAH1B1__Homo_sapiens__NP_000421
augguccucucccagcgccagcgcgacgagcucaaccgcgccaucgccgacuaccuccgcuccaacggcuacgaggaggccuacuccgucuucaagaaggaggccgagcucgacgucaacgaggagcucgacaagaaguacgccggccuccucgagaagaaguggaccuccgucauccgccuccagaagaaggucauggagcucgaguccaagcucaacgaggccaaggaggaguucaccuccggcggcccccucggccagaagcgcgaccccaaggaguggaucccccgcccccccgagaaguacgcccucuccggccaccgcucccccgucacccgcgucaucuuccaccccgucuucuccgucauggucuccgccuccgaggacgccaccaucaaggucugggacuacgagaccggcgacuucgagcgcacccucaagggccacaccgacuccguccaggacaucuccuucgaccacuccggcaagcuccucgccuccugcuccgccgacaugaccaucaagcucugggacuuccagggcuucgagugcauccgcaccaugcacggccacgaccacaacgucuccuccgucgccaucaugcccaacggcgaccacaucgucuccgccucccgcgacaagaccaucaagaugugggagguccagaccggcuacugcgucaagaccuucaccggccaccgcgaguggguccgcaugguccgccccaaccaggacggcacccucaucgccuccugcuccaacgaccagaccguccgcgucugggucgucgccaccaaggagugcaaggccgagcuccgcgagcacgagcacgucgucgagugcaucuccugggcccccgaguccuccuacuccuccaucuccgaggccaccggcuccgagaccaagaaguccggcaagcccggccccuuccuccucuccggcucccgcgacaagaccaucaagaugugggacgucuccaccggcaugugccucaugacccucgucggccacgacaacuggguccgcggcguccucuuccacuccggcggcaaguucauccucuccugcgccgacgacaagacccuccgcgucugggacuacaagaacaagcgcugcaugaagacccucaacgcccacgagcacuucgucaccucccucgacuuccacaagaccgcccccuacgucgucaccggcuccgucgaccagaccgucaaggucugggagugccgcuga

SEQ ID NO: 47252 - RNA, 609 nt, Artificial Sequence
  derived and/or modified sequence opt2 from PAFAH1B2__Homo_sapiens__NP_001171675
augucccagggcgacuccaaccccgccgccaucccccacgccgccgaggacauccagggcgacgaccgcuggaugucccagcacaaccgcuucguccucgacugcaaggacaaggagcccgacguccucuucgucggcgacuccaugguccagcucaugcagcaguacgagaucuggcgcgagcucuucuccccccuccacgcccucaacuucggcaucggcggcgacaccacccgccacguccucuggcgccucaagaacggcgagcucgagaacaucaagcccaaggucaucgucgucugggucggcaccaacaaccacgagaacaccgccgaggaggucgccggcggcaucgaggccaucguccagcucaucaacacccgccagccccaggccaagaucaucguccucggcaaggccgccgccuccaaguacuccaucuccgagaucguccgccucgagcagggcuccgucaacugguccaucggcaccuaccccgacgacacccccgccaccacccgccccgccauccuccagcucuucaccggcaagaugucccgcaucaccaugaaggagaagucccgcuggaccgaggagauccuccacuga

SEQ ID NO: 47253 - RNA, 1251 nt, Artificial Sequence
  derived and/or modified sequence opt2 from PAFAH2__Homo_sapiens__XP_011539830
augaccgucgcccccuccgucuccgccuccaaguucuccuccggcaaguccuucgacucccccggcgacgagaugggcgucaaccaguccgucggcuucccccccgucaccggcccccaccucgucggcugcggcgacgucauggagggccagaaccuccagggcuccuucuuccgccucuucuaccccugccagaaggccgaggagaccauggagcagccccucuggaucccccgcuacgaguacugcaccggccucgccgaguaccuccaguucaacaagcgcugcggcggccuccucuucaaccucgccgucggcuccugccgccuccccgucuccuggaacggccccuucaagaccaaggacuccggcuacccccucaucaucuucucccacggccucggcgccuuccgcacccucuacuccgccuucugcauggagcucgccucccgcggcuucgucgucgccguccccgagcaccgcgaccgcuccgccgccaccaccuacuucugcaagcaggcccccgaggagaaccagcccaccaacgagucccuccaggaggaguggauccccuuccgccgcgucgaggagggcgagaaggaguuccacguccgcaacccccagguccaccagcgcgucuccgagugccuccgcguccucaagauccuccaggaggucaccgccggccagaccgucuucaacauccuccccggcggccucgaccucaugacccucaagggcaacaucgacaugucccgcgucgccgucaugggccacuccuucggcggcgccaccgccauccucgcccucgccaaggagacccaguuccgcugcgccgucgcccucgacgccuggauguucccccucgagcgcgacuucuaccccaaggcccgcggccccgucuucuucaucaacaccgagaaguuccagaccauggaguccgucaaccucaugaagaagaucugcgcccagcacgagcagucccgcaucaucaccguccucggcuccguccaccgcucccagaccgacuucgccuucgucaccggcaaccucaucggcaaguucuucuccaccgagacccgcggcucccucgaccccuacgagggccaggaggucaugguccgcgccaugcucgccuuccuccagaagcaccucgaccucaaggaggacuacaaccaguggaacaaccucaucgagggcaucggccccucccucacccccggcgccccccaccaccucuccucccucuga

SEQ ID NO: 47254 - RNA, 1299 nt, Artificial Sequence
  derived and/or modified sequence opt2 from PAG1__Homo_sapiens__XP_011515867
augggccccgccggcucccuccucggcuccggccagaugcagaucacccucuggggcucccucgccgccgucgccaucuucuucgucaucaccuuccucaucuuccucugcuccuccugcgaccgcgagaagaagccccgccagcacuccggcgaccacgagaaccucaugaacguccccuccgacaaggagauguucucccgcuccgucaccucccucgccaccgacgcccccgccuccuccgagcagaacggcgcccucaccaacggcgacauccucuccgaggacuccacccucaccugcaugcagcacuacgaggagguccagaccuccgccuccgaccuccucgacucccaggacuccaccggcaagcccaagugccaccagucccgcgagcucccccgcaucccccccgaguccgccgucgacaccaugcucaccgcccgcuccgucgacggcgaccagggccucggcauggagggccccuacgagguccucaaggacuccuccucccaggagaacauggucgaggacugccucuacgagaccgucaaggagaucaaggaggucgccgccgccgcccaccucgagaagggccacuccggcaaggccaaguccaccuccgccuccaaggagcuccccggcccccagaccgagggcaaggccgaguucgccgaguacgccuccgucgaccgcaacaagaagugccgccaguccgucaacgucgaguccauccucggcaacuccugcgaccccgaggaggaggcccccccccccguccccgucaagcuccucgacgagaacgagaaccuccaggagaaggagggcggcgaggccgaggaguccgccaccgacaccaccuccgagaccaacaagcgcuucuccucccucuccuacaagucccgcgaggaggaccccacccucaccgaggaggagaucuccgccauguacuccuccgucaacaagcccggccagcucgucaacaaguccggccagucccucaccguccccgaguccaccuacaccuccauccagggcgacccccagcgcucccccuccuccugcaacgaccucuacgccaccgucaaggacuucgagaagacccccaacuccacccucccccccgccggccgccccuccgaggagcccgagcccgacuacgaggccauccagacccucaaccgcgaggaggagaaggccacccucggcaccaacggccaccacggccucguccccaaggagaacgacuacgaguccaucuccgaccuccagcagggccgcgacaucacccgccucuga

SEQ ID NO: 47255 - RNA, 441 nt, Artificial Sequence
  derived and/or modified sequence opt2 from PAGE1__Homo_sapiens__NP_003776
augggcuuccuccgccgccucaucuaccgccgccgccccaugaucuacgucgaguccuccgaggaguccuccgacgagcagcccgacgaggucgagucccccacccagucccaggacuccacccccgccgaggagcgcgaggacgagggcgccuccgccgcccagggccaggagcccgaggccgacucccaggagcucguccagcccaagaccggcugcgagcucggcgacggccccgacaccaagcgcgucugccuccgcaacgaggagcagaugaagcuccccgccgagggccccgagcccgaggccgacucccaggagcagguccaccccaagaccggcugcgagcgcggcgacggccccgacguccaggagcucggccuccccaaccccgaggaggucaagacccccgaggaggacgagggccagucccagcccuga

SEQ ID NO: 47256 - RNA, 309 nt, Artificial Sequence
  derived and/or modified sequence opt2 from PAGE4__Homo_sapiens__NP_008934
auguccgcccgcguccgcucccgcucccgcggccgcggcgacggccaggaggcccccgacgucgucgccuucgucgcccccggcgagucccagcaggaggagccccccaccgacaaccaggacaucgagcccggccaggagcgcgagggcaccccccccaucgaggagcgcaaggucgagggcgacugccaggagauggaccucgagaagacccgcuccgagcgcggcgacggcuccgacgucaaggagaagaccccccccaaccccaagcacgccaagaccaaggaggccggcgacggccagcccuga

SEQ ID NO: 47257 - RNA, 333 nt, Artificial Sequence
  derived and/or modified sequence opt2 from PAGE5__Homo_sapiens__NP_001013453
auguccgagcacgucacccgcucccaguccuccgagcgcggcaacgaccaggaguccucccagcccgucggccccgucaucguccagcagcccaccgaggagaagcgccaggaggaggagccccccaccgacaaccagggcaucgcccccuccggcgagaucaagaacgagggcgcccccgccguccagggcaccgacgucgaggccuuccagcaggagcucgcccuccucaagaucgaggacgcccccggcgacggccccgacguccgcgagggcacccuccccaccuucgaccccaccaagguccucgaggccggcgagggccagcucuga

SEQ ID NO: 47258 - RNA, 765 nt, Artificial Sequence
  derived and/or modified sequence opt2 from PAGR1__Homo_sapiens__NP_078792
augucccucgcccgcggccacggcgacaccgccgccuccaccgccgccccccucuccgaggagggcgaggucaccuccggccuccaggcccucgccgucgaggacaccggcggccccuccgccuccgccggcaaggccgaggacgagggcgagggcggccgcgaggagaccgagcgcgagggcuccggcggcgaggaggcccagggcgagguccccuccgccggcggcgaggagcccgccgaggaggacuccgaggacuggugcguccccugcuccgacgaggaggucgagcuccccgccgacggccagcccuggaugcccccccccuccgagauccagcgccucuacgagcuccucgccgcccacggcacccucgagcuccaggccgagauccucccccgccgcccccccacccccgaggcccaguccgaggaggagcgcuccgacgaggagcccgaggccaaggaggaggaggaggagaagccccacaugcccaccgaguucgacuucgacgacgagcccgucacccccaaggacucccucaucgaccgccgccgcacccccggcuccuccgcccgcucccagaagcgcgaggcccgccucgacaagguccucuccgacaugaagcgccacaagaagcucgaggagcagauccuccgcaccggccgcgaccucuucucccucgacuccgaggaccccucccccgccucccccccccuccgcuccuccggcuccucccucuucccccgccagcgcaaguacuga

SEQ ID NO: 47259 - RNA, 1359 nt, Artificial Sequence
  derived and/or modified sequence opt2 from PAH__Homo_sapiens__NP_000268
auguccaccgccguccucgagaaccccggccucggccgcaagcucuccgacuucggccaggagaccuccuacaucgaggacaacugcaaccagaacggcgccaucucccucaucuucucccucaaggaggaggucggcgcccucgccaagguccuccgccucuucgaggagaacgacgucaaccucacccacaucgagucccgccccucccgccucaagaaggacgaguacgaguucuucacccaccucgacaagcgcucccuccccgcccucaccaacaucaucaagauccuccgccacgacaucggcgccaccguccacgagcucucccgcgacaagaagaaggacaccguccccugguucccccgcaccauccaggagcucgaccgcuucgccaaccagauccucuccuacggcgccgagcucgacgccgaccaccccggcuucaaggaccccgucuaccgcgcccgccgcaagcaguucgccgacaucgccuacaacuaccgccacggccagcccaucccccgcgucgaguacauggaggaggagaagaagaccuggggcaccgucuucaagacccucaagucccucuacaagacccacgccugcuacgaguacaaccacaucuucccccuccucgagaaguacugcggcuuccacgaggacaacaucccccagcucgaggacgucucccaguuccuccagaccugcaccggcuuccgccuccgccccgucgccggccuccucuccucccgcgacuuccucggcggccucgccuuccgcgucuuccacugcacccaguacauccgccacggcuccaagcccauguacacccccgagcccgacaucugccacgagcuccucggccacgucccccucuucuccgaccgcuccuucgcccaguucucccaggagaucggccucgccucccucggcgcccccgacgaguacaucgagaagcucgccaccaucuacugguucaccgucgaguucggccucugcaagcagggcgacuccaucaaggccuacggcgccggccuccucuccuccuucggcgagcuccaguacugccucuccgagaagcccaagcuccucccccucgagcucgagaagaccgccauccagaacuacaccgucaccgaguuccagccccucuacuacgucgccgaguccuucaacgacgccaaggagaagguccgcaacuucgccgccaccaucccccgccccuucuccguccgcuacgaccccuacacccagcgcaucgagguccucgacaacacccagcagcucaagauccucgccgacuccaucaacuccgagaucggcauccucugcuccgcccuccagaagaucaaguga

SEQ ID NO: 47260 - RNA, 1278 nt, Artificial Sequence
  derived and/or modified sequence opt2 from PAICS__Homo_sapiens__NP_001072992
auggccaccgccgagguccucaacaucggcaagaagcucuacgagggcaagaccaaggaggucuacgagcuccucgacucccccggcaagguccuccuccaguccaaggaccagaucaccgccggcaacgccgcccgcaagaaccaccucgagggcaaggccgccaucuccaacaagaucaccuccugcaucuuccagcuccuccaggaggccggcaucaagaccgccuucacccgcaagugcggcgagaccgccuucaucgccccccagugcgagaugauccccaucgagugggucugccgccgcaucgccaccggcuccuuccucaagcgcaaccccggcgucaaggagggcuacaaguucuacccccccaaggucgagcucuucuucaaggacgacgccaacaacgacccccagugguccgaggagcagcucaucgccgccaaguucugcuucgccggccuccucaucggccagaccgaggucgacaucaugucccacgccacccaggccaucuucgagauccucgagaaguccuggcucccccagaacugcacccucgucgacaugaagaucgaguucggcgucgacgucaccaccaaggagaucguccucgccgacgucaucgacaacgacuccuggcgccucuggcccuccggcgaccgcucccagcagaaggacaagcaguccuaccgcgaccucaaggaggucacccccgagggccuccagauggucaagaagaacuucgagugggucgccgagcgcgucgagcuccuccucaaguccgagucccagugccgcgucgucguccucaugggcuccaccuccgaccucggccacugcgagaagaucaagaaggccugcggcaacuucggcauccccugcgagcuccgcgucaccuccgcccacaagggccccgacgagacccuccgcaucaaggccgaguacgagggcgacggcauccccaccgucuucgucgccgucgccggccgcuccaacggccucggccccgucauguccggcaacaccgccuaccccgucaucuccugccccccccucacccccgacuggggcguccaggacgucugguccucccuccgccuccccuccggccucggcugcuccaccguccucucccccgagggcuccgcccaguucgccgcccagaucuucggccucuccaaccaccucgucugguccaagcuccgcgccuccauccucaacaccuggaucucccucaagcaggccgacaagaagauccgcgagugcaaccucuga

SEQ ID NO: 47261 - RNA, 1440 nt, Artificial Sequence
  derived and/or modified sequence opt2 from PAIP1__Homo_sapiens__NP_006442
auguccgacggcuucgaccgcgcccccggcgccggccgcggccgcucccgcggccucggccgcggcggcggcggccccgagggcggcggcuuccccaacggcgccggccccgccgagcgcgcccgccaccagcccccccagcccaaggcccccggcuuccuccagccccccccccuccgccagccccgcaccacccccccccccggcgcccagugcgagguccccgccuccccccagcgccccucccgccccggcgcccuccccgagcagacccgcccccuccgcgccccccccuccucccaggacaagaucccccagcagaacuccgaguccgccauggccaagccccaggucgucgucgcccccguccucauguccaagcucuccgucaacgcccccgaguucuaccccuccggcuacuccuccuccuacaccgaguccuacgaggacggcugcgaggacuaccccacccucuccgaguacguccaggacuuccucaaccaccucaccgagcagcccggcuccuucgagaccgagaucgagcaguucgccgagacccucaacggcugcgucaccaccgacgacgcccuccaggagcucgucgagcucaucuaccagcaggccaccuccauccccaacuucuccuacaugggcgcccgccucugcaacuaccucucccaccaccucaccaucuccccccaguccggcaacuuccgccagcuccuccuccagcgcugccgcaccgaguacgaggucaaggaccaggccgccaagggcgacgaggucacccgcaagcgcuuccacgccuucguccucuuccucggcgagcucuaccucaaccucgagaucaagggcaccaacggccaggucacccgcgccgacauccuccaggucggccuccgcgagcuccucaacgcccucuucuccaaccccauggacgacaaccucaucugcgccgucaagcuccucaagcucaccggcuccguccucgaggacgccuggaaggagaagggcaagauggacauggaggagaucauccagcgcaucgagaacgucguccucgacgccaacugcucccgcgacgucaagcagaugcuccucaagcucgucgagcuccgcuccuccaacuggggccgcguccacgccaccuccaccuaccgcgaggccacccccgagaacgaccccaacuacuucaugaacgagcccaccuucuacaccuccgacggcguccccuucaccgccgccgaccccgacuaccaggagaaguaccaggagcuccucgagcgcgaggacuucuuccccgacuacgaggagaacggcaccgaccucuccggcgccggcgaccccuaccucgacgacaucgacgacgagauggaccccgagaucgaggaggccuacgagaaguucugccucgaguccgagcgcaagcgcaagcaguga

SEQ ID NO: 47262 - RNA, 384 nt, Artificial Sequence
  derived and/or modified sequence opt2 from PAIP2__Homo_sapiens__XP_011541730
augaaggaccccucccgcuccuccaccucccccuccaucaucaacgaggacgucaucaucaacggccacucccacgaggacgacaaccccuucgccgaguacauguggauggagaacgaggaggaguucaaccgccagaucgaggaggagcucugggaggaggaguucaucgagcgcugcuuccaggagaugcucgaggaggaggaggagcacgagugguucauccccgcccgcgaccucccccagaccauggaccagauccaggaccaguucaacgaccucgucaucuccgacggcuccucccucgaggaccucgucgucaaguccaaccucaaccccaacgccaaggaguucguccccggcgucaaguacggcaacaucuga

SEQ ID NO: 47263 - RNA, 1638 nt, Artificial Sequence
  derived and/or modified sequence opt2 from PAK1__Homo_sapiens__NP_002567
auguccaacaacggccucgacauccaggacaagccccccgccccccccaugcgcaacaccuccaccaugaucggcgccggcuccaaggacgccggcacccucaaccacggcuccaagccccucccccccaaccccgaggagaagaagaagaaggaccgcuucuaccgcuccauccuccccggcgacaagaccaacaagaagaaggagaaggagcgccccgagaucucccuccccuccgacuucgagcacaccauccacgucggcuucgacgccgucaccggcgaguucaccggcaugcccgagcagugggcccgccuccuccagaccuccaacaucaccaaguccgagcagaagaagaacccccaggccguccucgacguccucgaguucuacaacuccaagaagaccuccaacucccagaaguacauguccuucaccgacaaguccgccgaggacuacaacuccuccaacgcccucaacgucaaggccgucuccgagacccccgccgucccccccgucuccgaggacgaggacgacgacgacgacgacgccacccccccccccgucaucgccccccgccccgagcacaccaaguccgucuacacccgcuccgucaucgagccccuccccgucacccccacccgcgacgucgccaccucccccaucucccccaccgagaacaacaccaccccccccgacgcccucacccgcaacaccgagaagcagaagaagaagcccaagauguccgacgaggagauccucgagaagcuccgcuccaucgucuccgucggcgaccccaagaagaaguacacccgcuucgagaagaucggccagggcgccuccggcaccgucuacaccgccauggacgucgccaccggccaggaggucgccaucaagcagaugaaccuccagcagcagcccaagaaggagcucaucaucaacgagauccucgucaugcgcgagaacaagaaccccaacaucgucaacuaccucgacuccuaccucgucggcgacgagcucugggucgucauggaguaccucgccggcggcucccucaccgacgucgucaccgagaccugcauggacgagggccagaucgccgccgucugccgcgagugccuccaggcccucgaguuccuccacuccaaccaggucauccaccgcgacaucaaguccgacaacauccuccucggcauggacggcuccgucaagcucaccgacuucggcuucugcgcccagaucacccccgagcaguccaagcgcuccaccauggucggcacccccuacuggauggcccccgaggucgucacccgcaaggccuacggccccaaggucgacaucuggucccucggcaucauggccaucgagaugaucgagggcgagccccccuaccucaacgagaacccccuccgcgcccucuaccucaucgccaccaacggcacccccgagcuccagaaccccgagaagcucuccgccaucuuccgcgacuuccucaaccgcugccucgagauggacgucgagaagcgcggcuccgccaaggagcuccuccagcaccaguuccucaagaucgccaagccccucuccucccucaccccccucaucgccgccgccaaggaggccaccaagaacaaccacuga

SEQ ID NO: 47264 - RNA, 1179 nt, Artificial Sequence
  derived and/or modified sequence opt2 from PAK1IP1__Homo_sapiens__NP_060376
auggagcucgucgccggcugcuacgagcagguccucuucggcuucgccguccaccccgagcccgaggccugcggcgaccacgagcaguggacccucgucgccgacuucacccaccacgcccacaccgccucccucuccgccgucgccgucaacucccgcuucgucgucaccggcuccaaggacgagaccauccacaucuacgacaugaagaagaagaucgagcacggcgcccucguccaccacuccggcaccaucaccugccucaaguucuacggcaaccgccaccucaucuccggcgccgaggacggccucaucugcaucugggacgccaagaagugggagugccucaaguccaucaaggcccacaagggccaggucaccuuccucuccauccaccccuccggcaagcucgcccucuccgucggcaccgacaagacccuccgcaccuggaaccucgucgagggccgcuccgccuucaucaagaacaucaagcagaacgcccacaucgucgagugguccccccgcggcgagcaguacgucgucaucauccagaacaagaucgacaucuaccagcucgacaccgccuccaucuccggcaccaucaccaacgagaagcgcaucuccuccgucaaguuccucuccgaguccguccucgccgucgccggcgacgaggaggucauccgcuucuucgacugcgacucccucgucugccucugcgaguucaaggcccacgagaaccgcgucaaggacauguucuccuucgagauccccgagcaccacgucaucgucuccgccuccuccgacggcuucaucaagauguggaagcucaagcaggacaagaaggucccccccucccuccucugcgagaucaacaccaacgcccgccucaccugccucggcgucuggcucgacaaggucgccgacaugaaggagucccucccccccgccgccgagcccucccccgucuccaaggagcaguccaagaucggcaagaaggagcccggcgacaccguccacaaggaggagaagcgcuccaagcccaacaccaagaagcgcggccucaccggcgacuccaagaaggccaccaaggaguccggccucaucuccaccaagaagcgcaagauggucgagaugcucgagaagaagcgcaagaagaagaagaucaagaccaugcaguga

SEQ ID NO: 47265 - RNA, 1575 nt, Artificial Sequence
  derived and/or modified sequence opt2 from PAK2__Homo_sapiens__NP_002568
auguccgacaacggcgagcucgaggacaagccccccgccccccccguccgcauguccuccaccaucuucuccaccggcggcaaggacccccucuccgccaaccacucccucaagccccuccccuccguccccgaggagaagaagccccgccacaagaucaucuccaucuucuccggcaccgagaagggcuccaagaagaaggagaaggagcgccccgagaucuccccccccuccgacuucgagcacaccauccacgucggcuucgacgccgucaccggcgaguucaccggcaugcccgagcagugggcccgccuccuccagaccuccaacaucaccaagcucgagcagaagaagaacccccaggccguccucgacguccucaaguucuacgacuccaacaccgucaagcagaaguaccucuccuucaccccccccgagaaggacggcuuccccuccggcacccccgcccucaacgccaagggcaccgaggcccccgccgucgucaccgaggaggaggacgacgacgaggagaccgccccccccgucaucgccccccgccccgaccacaccaaguccaucuacacccgcuccgucaucgaccccguccccgcccccgucggcgacucccacgucgacggcgccgccaagucccucgacaagcagaagaagaagaccaagaugaccgacgaggagaucauggagaagcuccgcaccaucgucuccaucggcgaccccaagaagaaguacacccgcuacgagaagaucggccagggcgccuccggcaccgucuucaccgccaccgacgucgcccucggccaggaggucgccaucaagcagaucaaccuccagaagcagcccaagaaggagcucaucaucaacgagauccucgucaugaaggagcucaagaaccccaacaucgucaacuuccucgacuccuaccucgucggcgacgagcucuucgucgucauggaguaccucgccggcggcucccucaccgacgucgucaccgagaccugcauggacgaggcccagaucgccgccgucugccgcgagugccuccaggcccucgaguuccuccacgccaaccaggucauccaccgcgacaucaaguccgacaacguccuccucggcauggagggcuccgucaagcucaccgacuucggcuucugcgcccagaucacccccgagcaguccaagcgcuccaccauggucggcacccccuacuggauggcccccgaggucgucacccgcaaggccuacggccccaaggucgacaucuggucccucggcaucauggccaucgagauggucgagggcgagccccccuaccucaacgagaacccccuccgcgcccucuaccucaucgccaccaacggcacccccgagcuccagaaccccgagaagcucucccccaucuuccgcgacuuccucaaccgcugccucgagauggacgucgagaagcgcggcuccgccaaggagcuccuccagcaccccuuccucaagcucgccaagccccucuccucccucaccccccucaucauggccgccaaggaggccaugaaguccaaccgcuga

SEQ ID NO: 47266 - RNA, 1635 nt, Artificial Sequence
  derived and/or modified sequence opt2 from PAK3__Homo_sapiens__NP_001121639
auguccgacggccucgacaacgaggagaagccccccgcccccccccuccgcaugaacuccaacaaccgcgacuccuccgcccucaaccacuccuccaagccccuccccauggcccccgaggagaagaacaagaaggcccgccuccgcuccaucuuccccggcggcggcgacaagaccaacaagaagaaggagaaggagcgccccgagaucucccuccccuccgacuucgagcacaccauccacgucggcuucgacgccgucaccggcgaguucaccggcauccccgagcagugggcccgccuccuccagaccuccaacaucaccaagcucgagcagaagaagaacccccaggccguccucgacguccucaaguucuacgacuccaaggagaccgucaacaaccagaaguacauguccuucaccuccggcgacaaguccgcccacggcuacaucgccgcccaccccuccuccaccaagaccgccuccgagcccccccucgccccccccgucuccgaggaggaggacgaggaggaggaggaggaggaggacgagaacgagcccccccccgucaucgccccccgccccgagcacaccaaguccaucuacacccgcuccgucgucgaguccaucgccucccccgccguccccaacaaggaggucaccccccccuccgccgagaacgccaacuccuccacccucuaccgcaacaccgaccgccagcgcaagaaguccaagaugaccgacgaggagauccucgagaagcuccgcuccaucgucuccgucggcgaccccaagaagaaguacacccgcuucgagaagaucggccagggcgccuccggcaccgucuacaccgcccucgacaucgccaccggccaggaggucgccaucaagcagaugaaccuccagcagcagcccaagaaggagcucaucaucaacgagauccucgucaugcgcgagaacaagaaccccaacaucgucaacuaccucgacuccuaccucgucggcgacgagcucugggucgucauggaguaccucgccggcggcucccucaccgacgucgucaccgagaccugcauggacgagggccagaucgccgccgucugccgcgagugccuccaggcccucgacuuccuccacuccaaccaggucauccaccgcgacaucaaguccgacaacauccuccucggcauggacggcuccgucaagcucaccgacuucggcuucugcgcccagaucacccccgagcaguccaagcgcuccaccauggucggcacccccuacuggauggcccccgaggucgucacccgcaaggccuacggccccaaggucgacaucuggucccucggcaucauggccaucgagauggucgagggcgagccccccuaccucaacgagaacccccuccgcgcccucuaccucaucgccaccaacggcacccccgagcuccagaaccccgagcgccucuccgccgucuuccgcgacuuccucaaccgcugccucgagauggacgucgaccgccgcggcuccgccaaggagcuccuccagcaccccuuccucaagcucgccaagccccucuccucccucaccccccucaucaucgccgccaaggaggccaucaagaacuccucccgcuga

SEQ ID NO: 47267 - RNA, 1776 nt, Artificial Sequence
  derived and/or modified sequence opt2 from PAK4__Homo_sapiens__NP_001014832
auguucggcaagcgcaagaagcgcgucgagaucuccgcccccuccaacuucgagcaccgcguccacaccggcuucgaccagcacgagcagaaguucaccggccucccccgccaguggcagucccucaucgaggaguccgcccgccgccccaagccccucgucgaccccgccugcaucaccuccauccagcccggcgcccccaagaccaucguccgcggcuccaagggcgccaaggacggcgcccucacccuccuccucgacgaguucgagaacauguccgucacccgcuccaacucccuccgccgcgacuccccccccccccccgcccgcgcccgccaggagaacggcaugcccgaggagcccgccaccaccgcccgcggcggccccggcaaggccggcucccgcggccgcuucgccggccacuccgaggccggcggcggcuccggcgaccgccgccgcgccggccccgagaagcgccccaaguccucccgcgagggcuccggcggcccccaggaguccucccgcgacaagcgcccccucuccggccccgacgucggcaccccccagcccgccggccucgccuccggcgccaagcucgccgccggccgccccuucaacaccuacccccgcgccgacaccgaccaccccucccgcggcgcccagggcgagccccacgacgucgcccccaacggccccuccgccggcggccucgccaucccccaguccuccuccuccuccucccgcccccccacccgcgcccgcggcgcccccucccccggcguccucggcccccacgccuccgagccccagcucgccccccccgccugcacccccgccgcccccgccguccccggcccccccggcccccgcuccccccagcgcgagccccagcgcgucucccacgagcaguuccgcgccgcccuccagcucgucgucgaccccggcgacccccgcuccuaccucgacaacuucaucaagaucggcgagggcuccaccggcaucgucugcaucgccaccguccgcuccuccggcaagcucgucgccgucaagaagauggaccuccgcaagcagcagcgccgcgagcuccucuucaacgaggucgucaucaugcgcgacuaccagcacgagaacgucgucgagauguacaacuccuaccucgucggcgacgagcucugggucgucauggaguuccucgagggcggcgcccucaccgacaucgucacccacacccgcaugaacgaggagcagaucgccgccgucugccucgccguccuccaggcccucuccguccuccacgcccagggcgucauccaccgcgacaucaaguccgacuccauccuccucacccacgacggccgcgucaagcucuccgacuucggcuucugcgcccaggucuccaaggaggucccccgccgcaagucccucgucggcacccccuacuggauggcccccgagcucaucucccgccuccccuacggccccgaggucgacaucuggucccucggcaucauggucaucgagauggucgacggcgagccccccuacuucaacgagcccccccucaaggccaugaagaugauccgcgacaaccuccccccccgccucaagaaccuccacaaggucucccccucccucaagggcuuccucgaccgccuccucguccgcgaccccgcccagcgcgccaccgccgccgagcuccucaagcaccccuuccucgccaaggccggcccccccgccuccaucgucccccucaugcgccagaaccgcacccgcuga

SEQ ID NO: 47268 - RNA, 2046 nt, Artificial Sequence
  derived and/or modified sequence opt2 from PAK6__Homo_sapiens__NP_001263646
auguuccgcaagaagaagaagaagcgccccgagaucuccgccccccagaacuuccagcaccgcguccacaccuccuucgaccccaaggagggcaaguucgucggccuccccccccaguggcagaacauccucgacacccuccgccgccccaagcccgucgucgaccccucccgcaucacccgcguccagcuccagcccaugaagaccgucguccgcggcuccgccaugcccgucgacggcuacaucuccggccuccucaacgacauccagaagcucuccgucaucuccuccaacacccuccgcggccgcucccccaccucccgccgccgcgcccagucccucggccuccucggcgacgagcacugggccaccgaccccgacauguaccuccaguccccccaguccgagcgcaccgacccccacggccucuaccucuccugcaacggcggcacccccgccggccacaagcagaugcccuggcccgagccccaguccccccgcguccuccccaacggccucgccgccaaggcccagucccucggccccgccgaguuccagggcgccucccagcgcugccuccagcucggcgccugccuccaguccuccccccccggcgccuccccccccaccggcaccaaccgccacggcaugaaggccgccaagcacggcuccgaggaggcccgcccccaguccugccucgucggcuccgccaccggccgccccggcggcgagggcucccccucccccaagacccgcgaguccucccucaagcgccgccucuuccgcuccauguuccucuccaccgccgccaccgccccccccuccuccuccaagcccggcccccccccccaguccaagcccaacuccuccuuccgccccccccagaaggacaacccccccucccucgucgccaaggcccagucccuccccuccgaccagcccgucggcaccuucuccccccucaccaccuccgacaccuccuccccccagaagucccuccgcaccgcccccgccaccggccagcuccccggccgcuccucccccgccggcuccccccgcaccuggcacgcccagaucuccaccuccaaccucuaccucccccaggaccccaccgucgccaagggcgcccucgccggcgaggacaccggcgucgucacccacgagcaguucaaggccgcccuccgcauggucgucgaccagggcgacccccgccuccuccucgacuccuacgucaagaucggcgagggcuccaccggcaucgucugccucgcccgcgagaagcacuccggccgccaggucgccgucaagaugauggaccuccgcaagcagcagcgccgcgagcuccucuucaacgaggucgucaucaugcgcgacuaccagcacuucaacgucgucgagauguacaaguccuaccucgucggcgaggagcucuggguccucauggaguuccuccagggcggcgcccucaccgacaucgucucccagguccgccucaacgaggagcagaucgccaccgucugcgaggccguccuccaggcccucgccuaccuccacgcccagggcgucauccaccgcgacaucaaguccgacuccauccuccucacccucgacggccgcgucaagcucuccgacuucggcuucugcgcccagaucuccaaggacguccccaagcgcaagucccucgucggcacccccuacuggauggcccccgaggucaucucccgcucccucuacgccaccgaggucgacaucuggucccucggcaucauggucaucgagauggucgacggcgagccccccuacuucuccgacucccccguccaggccaugaagcgccuccgcgacucccccccccccaagcucaagaacucccacaaggucucccccguccuccgcgacuuccucgagcgcaugcucguccgcgacccccaggagcgcgccaccgcccaggagcuccucgaccaccccuuccuccuccagaccggccuccccgagugccucgucccccucauccagcucuaccgcaagcagaccuccaccugcuga

SEQ ID NO: 47269 - RNA, 2160 nt, Artificial Sequence
  derived and/or modified sequence opt2 from PAK7__Homo_sapiens__NP_065074
auguucggcaagaagaagaagaagaucgagaucuccggccccuccaacuucgagcaccgcguccacaccggcuucgacccccaggagcagaaguucaccggccucccccagcaguggcacucccuccucgccgacaccgccaaccgccccaagcccauggucgaccccuccugcaucacccccauccagcucgcccccaugaagaccaucguccgcggcaacaagcccugcaaggagaccuccaucaacggccuccucgaggacuucgacaacaucuccgucacccgcuccaacucccuccgcaaggaguccccccccacccccgaccagggcgccuccucccacggccccggccacgccgaggagaacggcuucaucaccuucucccaguacuccuccgaguccgacaccaccgccgacuacaccaccgagaaguaccgcgagaagucccucuacggcgacgaccucgaccccuacuaccgcggcucccacgccgccaagcagaacggccacgucaugaagaugaagcacggcgaggccuacuacuccgaggucaagccccucaaguccgacuucgcccgcuucuccgccgacuaccacucccaccucgacucccucuccaagcccuccgaguacuccgaccucaagugggaguaccagcgcgccuccuccuccuccccccucgacuacuccuuccaguucacccccucccgcaccgccggcaccuccggcugcuccaaggagucccucgccuacuccgaguccgaguggggccccucccucgacgacuacgaccgccgccccaaguccuccuaccucaaccagaccuccccccagcccaccaugcgccagcgcucccgcuccggcuccggccuccaggagcccaugaugcccuucggcgccuccgccuucaagacccacccccagggccacuccuacaacuccuacaccuacccccgccucuccgagcccaccaugugcauccccaaggucgacuacgaccgcgcccagaugguccucucccccccccucuccggcuccgacaccuacccccgcggccccgccaagcucccccagucccaguccaaguccggcuacuccuccuccucccaccaguaccccuccggcuaccacaaggccacccucuaccaccaccccucccuccaguccuccucccaguacaucuccaccgccuccuaccucuccucccucucccucuccuccuccaccuaccccccccccuccuggggcuccuccuccgaccagcagcccucccgcgucucccacgagcaguuccgcgccgcccuccagcucgucgucucccccggcgacccccgcgaguaccucgccaacuucaucaagaucggcgagggcuccaccggcaucgucugcaucgccaccgagaagcacaccggcaagcaggucgccgucaagaagauggaccuccgcaagcagcagcgccgcgagcuccucuucaacgaggucgucaucaugcgcgacuaccaccacgacaacgucgucgacauguacuccuccuaccucgucggcgacgagcucugggucgucauggaguuccucgagggcggcgcccucaccgacaucgucacccacacccgcaugaacgaggagcagaucgccaccgucugccucuccguccuccgcgcccucuccuaccuccacaaccagggcgucauccaccgcgacaucaaguccgacuccauccuccucaccuccgacggccgcaucaagcucuccgacuucggcuucugcgcccaggucuccaaggagguccccaagcgcaagucccucgucggcacccccuacuggauggcccccgaggucaucucccgccuccccuacggcaccgaggucgacaucuggucccucggcaucauggucaucgagaugaucgacggcgagccccccuacuucaacgagcccccccuccaggccaugcgccgcauccgcgacucccuccccccccgcgucaaggaccuccacaaggucuccuccguccuccgcggcuuccucgaccucaugcucguccgcgagcccucccagcgcgccaccgcccaggagcuccucggccaccccuuccucaagcucgccggcccccccuccugcaucgucccccucaugcgccaguaccgccaccacuga

SEQ ID NO: 47270 - RNA, 3561 nt, Artificial Sequence
  derived and/or modified sequence opt2 from PALB2__Homo_sapiens__NP_078951
auggacgagccccccggcaagccccucuccugcgaggagaaggagaagcucaaggagaagcucgccuuccucaagcgcgaguacuccaagacccucgcccgccuccagcgcgcccagcgcgccgagaagaucaagcacuccaucaagaagaccgucgaggagcaggacugccucucccagcaggaccucuccccccagcucaagcacuccgagcccaagaacaagaucugcgucuacgacaagcuccacaucaagacccaccucgacgaggagaccggcgagaagaccuccaucacccucgacgucggccccgaguccuucaaccccggcgacggccccggcggccuccccauccagcgcaccgacgacacccaggagcacuucccccaccgcgucuccgaccccuccggcgagcagaagcagaagcuccccucccgccgcaagaagcagcagaagcgcaccuucaucucccaggagcgcgacugcgucuucggcaccgacucccuccgccucuccggcaagcgccucaaggagcaggaggagaucuccuccaagaaccccgcccgcucccccgucaccgagauccgcacccaccuccucucccucaaguccgagcuccccgacucccccgagcccgucaccgagaucaacgaggacuccguccucaucccccccaccgcccagcccgagaagggcgucgacaccuuccuccgccgccccaacuucacccgcgccaccaccgucccccuccagacccucuccgacuccggcuccucccagcaccucgagcacaucccccccaagggcuccuccgagcucaccacccacgaccucaagaacauccgcuucaccucccccgucucccucgaggcccagggcaagaagaugaccgucuccaccgacaaccuccucgucaacaaggccaucuccaaguccggccagcuccccaccuccuccaaccucgaggccaacaucuccugcucccucaacgagcucaccuacaacaaccuccccgccaacgagaaccagaaccucaaggagcagaaccagaccgagaagucccucaagucccccuccgacacccucgacggccgcaacgagaaccuccaggaguccgagauccucucccagcccaagucccucucccucgaggccaccuccccccucuccgccgagaagcacuccugcaccguccccgagggccuccucuuccccgccgaguacuacguccgcaccacccgcuccauguccaacugccagcgcaaggucgccgucgaggccgucauccagucccaccucgacgucaagaagaagggcuucaagaacaagaacaaggacgccuccaagaaccucaaccucuccaacgaggagaccgaccaguccgagauccgcauguccggcaccugcaccggccagcccuccucccgcaccucccagaagcuccucucccucaccaaggucuccucccccgccggccccaccgaggacaacgaccucucccgcaaggccgucgcccaggcccccggccgccgcuacaccggcaagcgcaaguccgccugcacccccgccuccgaccacugcgagccccuccuccccaccuccucccucuccaucgucaaccgcuccaaggaggaggucaccucccacaaguaccagcacgagaagcucuucauccaggucaagggcaagaagucccgccaccagaaggaggacucccucuccugguccaacuccgccuaccucucccucgacgacgacgccuucaccgcccccuuccaccgcgacggcaugcucucccucaagcagcuccucuccuuccucuccaucaccgacuuccagcuccccgacgaggacuucggcccccucaagcucgagaaggucaaguccugcuccgagaagcccgucgagcccuucgaguccaagauguucggcgagcgccaccucaaggagggcuccugcaucuuccccgaggagcucucccccaagcgcauggacaccgagauggaggaccucgaggaggaccucaucguccuccccggcaagucccaccccaagcgccccaacucccagucccagcacaccaagaccggccucuccuccuccauccuccucuacaccccccucaacaccgucgcccccgacgacaacgaccgccccaccaccgacaugugcucccccgccuuccccauccucggcaccacccccgccuucggcccccagggcuccuacgagaaggccuccaccgaggucgccggccgcaccugcugcaccccccagcucgcccaccucaaggacuccgucugccucgccuccgacaccaagcaguucgacuccuccggcucccccgccaagccccacaccacccuccaggucuccggccgccagggccagcccaccugcgacugcgacuccgucccccccggcacccccccccccaucgaguccuucaccuucaaggagaaccagcucugccgcaacaccugccaggagcuccacaagcacuccgucgagcagaccgagaccgccgagcuccccgccuccgacuccaucaaccccggcaaccuccagcucgucuccgagcucaagaaccccuccggcuccugcuccgucgacgucuccgccauguucugggagcgcgccggcugcaaggagcccugcaucaucaccgccugcgaggacgucgucucccucuggaaggcccucgacgccuggcagugggagaagcucuacaccuggcacuucgccgagguccccguccuccagaucguccccguccccgacgucuacaaccucgucugcgucgcccucggcaaccucgagauccgcgagauccgcgcccucuucugcuccuccgacgacgaguccgagaagcagguccuccucaaguccggcaacaucaaggccguccucggccucaccaagcgccgccucgucuccuccuccggcacccucuccgaccagcaggucgaggucaugaccuucgccgaggacggcggcggcaaggagaaccaguuccucaugccccccgaggagaccauccucaccuucgccgagguccagggcaugcaggaggcccuccucggcaccaccaucaugaacaacaucgucaucuggaaccucaagaccggccagcuccucaagaagaugcacaucgacgacuccuaccaggccuccgucugccacaaggccuacuccgagaugggccuccucuucaucguccucucccaccccugcgccaaggaguccgagucccuccgcucccccgucuuccagcucaucgucaucaaccccaagaccacccucuccgucggcgucaugcucuacugccucccccccggccaggccggccgcuuccucgagggcgacgucaaggaccacugcgccgccgccauccucaccuccggcaccaucgccaucugggaccuccuccucggccagugcaccgcccuccucccccccgucuccgaccagcacugguccuucgucaagugguccggcaccgacucccaccuccucgccggccagaaggacggcaacaucuucgucuaccacuacuccuga

SEQ ID NO: 47271 - RNA, 2571 nt, Artificial Sequence
  derived and/or modified sequence opt2 from PALD1__Homo_sapiens__NP_055246
augggcaccaccgccuccaccgcccagcagaccgucuccgccggcacccccuucgagggccuccagggcuccggcaccauggacucccgccacuccgucuccauccacuccuuccaguccaccucccuccacaacuccaaggccaaguccaucauccccaacaaggucgcccccgucgucaucaccuacaacugcaaggaggaguuccagauccacgacgagcuccucaaggcccacuacacccucggccgccucuccgacaacacccccgagcacuaccucguccagggccgcuacuuccucguccgcgacgucaccgagaagauggacguccucggcaccgucggcuccugcggcgcccccaacuuccgccagguccagggcggccucaccgucuucggcaugggccagcccucccucuccggcuuccgccgcguccuccagaagcuccagaaggacggccaccgcgagugcgucaucuucugcguccgcgaggagcccguccucuuccuccgcgccgacgaggacuucgucuccuacaccccccgcgacaagcagaaccuccacgagaaccuccagggccucggccccggcguccgcgucgagucccucgagcucgccauccgcaaggagauccacgacuucgcccagcucuccgagaacaccuaccacgucuaccacaacaccgaggaccucuggggcgagccccacgccgucgccauccacggcgaggacgaccuccacgucaccgaggaggucuacaagcgcccccucuuccuccagcccaccuaccgcuaccaccgccucccccuccccgagcagggcuccccccucgaggcccagcucgacgccuucgucuccguccuccgcgagacccccucccuccuccagcuccgcgacgcccacggccccccccccgcccucgucuucuccugccagaugggcgucggccgcaccaaccucggcaugguccucggcacccucauccuccuccaccgcuccggcaccaccucccagcccgaggccgcccccacccaggccaagccccuccccauggagcaguuccaggucauccaguccuuccuccgcauggucccccagggccgccgcauggucgaggaggucgaccgcgccaucaccgccugcgccgagcuccacgaccucaaggaggucguccucgagaaccagaagaagcucgagggcauccgccccgagucccccgcccagggcuccggcucccgccacuccgucuggcagcgcgcccucuggucccucgagcgcuacuucuaccucauccucuucaacuacuaccuccacgagcaguacccccucgccuucgcccucuccuucucccgcuggcucugcgcccaccccgagcucuaccgccuccccgucacccucuccuccgccggccccgucgccccccgcgaccucaucgcccgcggcucccuccgcgaggacgaccucgucucccccgacgcccucuccaccguccgcgagauggacgucgccaacuuccgccgcgucccccgcaugcccaucuacggcaccgcccagcccuccgccaaggcccucggcuccauccucgccuaccucaccgacgccaagcgccgccuccgcaaggucgucugggucucccuccgcgaggaggccguccucgagugcgacggccacaccuacucccuccgcuggcccggcccccccgucgcccccgaccagcucgagacccucgaggcccagcucaaggcccaccucuccgagcccccccccggcaaggagggcccccucaccuaccgcuuccagaccugccucaccaugcaggaggucuucucccagcaccgccgcgccugccccggccucaccuaccaccgcauccccaugcccgacuucugcgccccccgcgaggaggacuucgaccagcuccucgaggcccuccgcgccgcccucuccaaggaccccggcaccggcuucgucuucuccugccucuccggccagggccgcaccaccaccgccauggucgucgccguccucgccuucuggcacauccagggcuuccccgaggucggcgaggaggagcucgucuccguccccgacgccaaguucaccaagggcgaguuccaggucgucaugaaggucguccagcuccuccccgacggccaccgcgucaagaaggaggucgacgccgcccucgacaccgucuccgagaccaugacccccaugcacuaccaccuccgcgagaucaucaucugcaccuaccgccaggccaaggccgccaaggaggcccaggagaugcgccgccuccagcuccgcucccuccaguaccucgagcgcuacgucugccucauccucuucaacgccuaccuccaccucgagaaggccgacuccuggcagcgccccuucuccaccuggaugcaggaggucgccuccaaggccggcaucuacgagauccucaacgagcucggcuuccccgagcucgaguccggcgaggaccagcccuucucccgccuccgcuaccgcuggcaggagcaguccugcucccucgagcccuccgcccccgaggaccuccucuga

SEQ ID NO: 47272 - RNA, 3372 nt, Artificial Sequence
  derived and/or modified sequence opt2 from PALLD__Homo_sapiens__NP_001159580
auguccggcaccuccucccacgaguccuucuacgacucccucuccgacaugcaggaggaguccaagaacaccgacuucuuccccggccucuccgccuuccucucccaggaggagaucaacaagucccucgaccucgcccgccgcgccaucgccgacuccgagaccgaggacuucgacuccgagaaggagaucucccagaucuucuccaccucccccgccucccucugcgagcaccccucccacaaggagaccaagcucggcgagcacgccucccgccgcccccaggacaaccgcuccacccccguccagccccucgccgagaagcagaccaaguccaucuccucccccgucuccaagcgcaagcccgccauguccccccuccucacccgccccuccuacauccgcucccuccgcaaggccgagaagcgcggcgccaagacccccuccaccaacgucaagcccaagaccccccaccagcgcaagggcggcccccagucccagcucugcgacaaggccgccaaccucaucgaggagcucaccuccaucuucaaggccgccaagccccgcaaccgcucccccaacggcgaguccuccucccccgacuccggcuaccucucccccaagaaccagcccuccgcccuccucuccgccuccgccucccagucccccauggaggaccagggcgagauggagcgcgaggucaagucccccggcgcccgccacugcuaccaggacaaccaggaccucgccgucccccacaaccgcaagucccacccccagccccacuccgcccuccacuuccccgccgccccccgcuucauccagaagcuccgcucccaggaggucgccgagggcucccgcgucuaccucgagugccgcgucaccggcaaccccaccccccgcguccgcugguucugcgagggcaaggagcuccacaacacccccgacauccagauccacugcgagggcggcgaccuccacacccucaucaucgccgaggccuucgaggacgacaccggccgcuacaccugccucgccaccaaccccuccggcuccgacaccaccuccgccgaggucuucaucgagggcgccuccuccaccgacuccgacuccgagucccucgccuucaagucccgcgccggcgccaugccccaggcccagaagaagaccaccuccgucucccucaccaucggcuccuccucccccaagaccggcgucaccaccgccgucauccagccccucuccguccccguccagcagguccacucccccaccuccuaccucugccgccccgacggcaccaccaccgccuacuucccccccgucuucaccaaggagcuccagaacaccgccgucgccgagggccaggucgucguccucgagugccgcguccgcggcgcccccccccuccagguccagugguuccgccagggcuccgagauccaggacucccccgacuuccgcauccuccagaagaagccccgcuccaccgccgagcccgaggagaucugcacccucgucaucgccgagaccuuccccgaggacgccggcaucuucaccugcuccgcccgcaacgacuacggcuccgccaccuccaccgcccagcucgucgucaccuccgccaacaccgagaacugcuccuacgaguccaugggcgaguccaacaacgaccacuuccagcacuuccccccccccccccccauccucgagaccuccucccucgagcucgccuccaagaagcccuccgagauccagcaggucaacaaccccgagcucggccucucccgcgccgcccuccagaugcaguucaacgccgccgagcgcgagaccaacggcguccaccccucccgcggcgucaacggccucaucaacggcaaggccaacuccaacaagucccuccccacccccgccguccuccucucccccaccaaggagccccccccccuccucgccaagcccaagcucggcuuccccaagaaggccucccgcaccgcccgcaucgccuccgacgaggagauccagggcaccaaggacgccgucauccaggaccucgagcgcaagcuccgcuucaaggaggaccuccucaacaacggccagccccgccucaccuacgaggagcgcauggcccgccgccuccucggcgccgacuccgccaccgucuucaacauccaggagcccgaggaggagaccgccaaccaggacaucggcuccccccacgccuccgucggcuccccccucgacggccagaaggaguacaaggucuccuccugcgagcagcgccucaucuccgagaucgaguaccgccucgagcgcucccccgucgacgaguccggcgacgagguccaguacggcgacguccccgucgagaacggcauggcccccuucuucgagaugaagcucaagcacuacaagaucuucgagggcaugcccgucaccuucaccugccgcgucgccggcaaccccaagcccaagaucuacugguucaaggacggcaagcagaucucccccaaguccgaccacuacaccauccagcgcgaccucgacggcaccugcucccuccacaccaccgccuccacccucgacgacgacggcaacuacaccaucauggccgccaacccccagggccgcaucuccugcaccggccgccucaugguccaggccgucaaccagcgcggccgcuccccccgcucccccuccggccacccccacguccgccgcccccgcucccgcucccgcgacuccggcgacgagaacgagcccauccaggagcgcuucuuccgcccccacuuccuccaggcccccggcgaccucaccguccaggagggcaagcucugccgcauggacugcaaggucuccggccuccccacccccgaccucuccuggcagcucgacggcaagcccguccgccccgacuccgcccacaagaugcucguccgcgagaacggcguccacucccucaucaucgagcccgucaccucccgcgacgccggcaucuacaccugcaucgccaccaaccgcgccggccagaacuccuucucccucgagcucgucgucgccgccaaggaggcccacaagccccccgucuucaucgagaagcuccagaacaccggcgucgccgacggcuaccccguccgccucgagugccgcguccucggcgucccccccccccagaucuucuggaagaaggagaacgagucccucacccacuccaccgaccgcgucuccaugcaccaggacaaccacggcuacaucugccuccucauccagggcgccaccaaggaggacgccggcugguacaccgucuccgccaagaacgaggccggcaucgucuccugcaccgcccgccucgacgucuacaucucccgccacuga

SEQ ID NO: 47273 - RNA, 3312 nt, Artificial Sequence
  derived and/or modified sequence opt2 from PALM2-AKAP2__Homo_sapiens__NP_009134
auggccgaggccgagcuccacaaggagcgccuccaggccaucgccgagaagcgcaagcgccagaccgagaucgagggcaagcgccagcagcucgacgagcagauccuccuccuccagcacuccaaguccaagguccuccgcgagaaguggcuccuccagggcauccccgccggcaccgccgaggaggaggaggcccgccgccgccaguccgaggaggacgaguuccgcgucaagcagcucgaggacaacauccagcgccucgagcaggagauccagacccucgaguccgaggagucccagaucuccgccaaggagcagaucauccucgagaagcucaaggagaccgagaaguccuucaaggacuuccagaagggcuucuccuccaccgacggcgacgccgucaacuacaucuccucccagcuccccgaccuccccauccucugcucccgcaccgccgagcccucccccggccaggacggcaccucccgcgccgccggcgucggcugggagaacguccuccucaaggagggcgaguccgccuccaacgccaccgagaccuccggccccgacaugaccaucaagaagcccccccagcucuccgaggacgacaucuggcucaaguccgagggcgacaacuacuccgccacccuccucgagcccgccgccuccucccucucccccgaccacaagaacauggagaucgaggucuccgucgccgagugcaaguccguccccggcaucaccuccaccccccaccccauggaccaccccuccgccuucuacucccccccccacaacggccuccucaccgaccaccacgagucccucgacaacgacgucgcccgcgagauccgcuaccucgacgagguccucgaggccaacugcugcgacuccgccgucgacggcaccuacaacggcaccuccucccccgagcccggcgccgucguccucgucggcggccucuccccccccguccacgaggccacccagcccgagcccaccgagcgcaccgccucccgccaggcccccccccacaucgagcucuccaacuccucccccgaccccauggccgaggccgagcgcaccaacggccacucccccucccagccccgcgacgcccucggcgacucccuccagguccccgucucccccuccuccaccaccuccucccgcugcuccucccgcgacggcgaguucacccucaccacccucaagaaggaggccaaguucgagcuccgcgccuuccacgaggacaagaagcccuccaagcucuucgaggacgacgagcacgagaaggagcaguacugcauccgcaagguccgccccuccgaggagaugcucgagcucgagaaggagcgccgcgagcucauccgcucccaggccgucaagaagaaccccggcaucgccgccaagugguggaaccccccccaggagaagaccaucgaggagcagcucgacgaggagcaccucgagucccacaagaaguacaaggagcgcaaggagcgccgcgcccagcaggagcagcuccuccuccagaagcagcuccagcagcagcagcagcagccccccucccagcucugcaccgcccccgccuccucccacgagcgcgccuccaugaucgacaaggccaaggaggacaucgucaccgagcagaucgacuucuccgccgcccgcaagcaguuccagcucauggagaacucccgccaggccgucgccaagggccaguccaccccccgccucuucuccaucaagcccuucuaccgcccccucggcuccgucaacuccgacaagccccucaccaacccccgcccccccuccgucggcggcccccccgaggacuccggcgccuccgccgccaagggccagaagucccccggcgcccucgagacccccuccgccgccggcucccagggcaacaccgccucccagggcaaggagggccccuacuccgagcccuccaagcgcggcccccucuccaagcucugggccgaggacggcgaguucaccuccgcccgcgccguccucaccgucgucaaggacgacgaccacggcauccucgaccaguucucccgcuccgucaacgucucccucacccaggaggagcucgacuccggccucgacgagcucuccguccgcucccaggacaccaccguccucgagacccucuccaacgacuucuccauggacaacaucuccgacuccggcgccuccaacgagaccaccaacgcccuccaggagaacucccucgccgacuucucccucccccagaccccccagaccgacaaccccuccgagggccgcggcgagggcgucuccaaguccuucuccgaccacggcuucuacucccccuccuccacccucggcgacuccccccucgucgacgacccccucgaguaccaggccggccuccucguccagaacgccauccagcaggccaucgccgagcaggucgacaaggccgucuccaagaccucccgcgacggcgccgagcagcagggccccgaggccaccgucgaggaggccgaggccgccgccuucggcuccgagaagccccaguccauguucgagcccccccaggucuccucccccguccaggagaagcgcgacguccuccccaagauccuccccgccgaggaccgcgcccuccgcgagcgcggccccccccagccccuccccgccguccagcccuccggccccaucaacauggaggagacccgccccgagggcuccuacuucuccaaguacuccgaggccgccgagcuccgcuccaccgccucccuccucgccacccaggaguccgacgucauggucggccccuucaagcuccgcucccgcaagcagcgcacccucuccaugaucgaggaggagauccgcgccgcccaggagcgcgaggaggagcucaagcgccagcgccagguccuccaguccacccaguccccccgcaccaagaacgcccccucccuccccucccgcaccugcuacaagaccgcccccggcaagaucgagaaggucaagcccccccccucccccaccaccgagggccccucccuccagcccgaccucgcccccgaggaggccgccggcacccagcgccccaagaaccucaugcagacccucauggaggacuacgagacccacaaguccaagcgccgcgagcgcauggacgacuccuccuacaccuccaagcuccucuccugcaaggucaccuccgagguccucgaggccacccgcgucaaccgccgcaaguccgcccucgcccuccgcugggaggccggcaucuacgccaaccaggaggaggaggacaacgaguga

SEQ ID NO: 47274 - RNA, 378 nt, Artificial Sequence
  derived and/or modified sequence opt2 from PAM16__Homo_sapiens__NP_057153
auggccaaguaccucgcccagaucaucgucaugggcguccaggucgucggccgcgccuucgcccgcgcccuccgccaggaguucgccgccucccgcgccgccgccgacgcccgcggccgcgccggccaccgcuccgccgccgccuccaaccucuccggccucucccuccaggaggcccagcagauccucaacgucuccaagcucucccccgaggagguccagaagaacuacgagcaccucuucaaggucaacgacaaguccgucggcggcuccuucuaccuccaguccaaggucguccgcgccaaggagcgccucgacgaggagcucaagauccaggcccaggaggaccgcgagaagggccagaugccccacaccuga

SEQ ID NO: 47275 - RNA, 2664 nt, Artificial Sequence
  derived and/or modified sequence opt2 from PAM__Homo_sapiens__NP_620177
auggccggccgcguccccucccuccucguccuccucgucuuccccuccuccugccucgccuuccgcuccccccucuccgucuucaagcgcuucaaggagaccacccgccccuucuccaacgagugccucggcaccacccgccccgucguccccaucgacuccuccgacuucgcccucgacauccgcaugcccggcgucacccccaagcaguccgacaccuacuucugcauguccaugcgcauccccgucgacgaggaggccuucgucaucgacuucaagccccgcgccuccauggacaccguccaccacaugcuccucuucggcugcaacaugcccuccuccaccggcuccuacugguucugcgacgagggcaccugcaccgacaaggccaacauccucuacgccugggcccgcaacgccccccccacccgccuccccaagggcgucggcuuccgcgucggcggcgagaccggcuccaaguacuucguccuccagguccacuacggcgacaucuccgccuuccgcgacaacaacaaggacugcuccggcgucucccuccaccucacccgccucccccagccccucaucgccggcauguaccucaugauguccgucgacaccgucauccccgccggcgagaaggucgucaacuccgacaucuccugccacuacaagaacuaccccaugcacgucuucgccuaccgcguccacacccaccaccucggcaaggucgucuccggcuaccgcguccgcaacggccaguggacccucaucggccgccaguccccccagcucccccaggccuucuaccccgucggccaccccgucgacgucuccuucggcgaccuccucgccgcccgcugcgucuucaccggcgagggccgcaccgaggccacccacaucggcggcaccuccuccgacgagaugugcaaccucuacaucauguacuacauggaggccaagcacgccgucuccuucaugaccugcacccagaacgucgcccccgacauguuccgcaccaucccccccgaggccaacauccccauccccgucaaguccgacauggucaugaugcacgagcaccacaaggagaccgaguacaaggacaagaucccccuccuccagcagcccaagcgcgaggaggaggagguccucgaccagggcgacuucuacucccuccucuccaagcuccucggcgagcgcgaggacgucguccacguccacaaguacaaccccaccgagaaggccgaguccgaguccgaccucgucgccgagaucgccaacgucguccagaagaaggaccucggccgcuccgacgcccgcgagggcgccgagcacgagcgcggcaacgccauccucguccgcgaccgcauccacaaguuccaccgccucgucuccacccuccgcccccccgagucccgcgucuucucccuccagcagcccccccccggcgagggcaccugggagcccgagcacaccggcgacuuccacauggaggaggcccucgacuggcccggcgucuaccuccuccccggccaggucuccggcgucgcccucgaccccaagaacaaccucgucaucuuccaccgcggcgaccacgucugggacggcaacuccuucgacuccaaguucgucuaccagcagaucggccucggccccaucgaggaggacaccauccucgucaucgaccccaacaacgccgccguccuccaguccuccggcaagaaccucuucuaccucccccacggccucuccaucgacaaggacggcaacuacugggucaccgacgucgcccuccaccaggucuucaagcucgaccccaacaacaaggagggccccguccucauccucggccgcuccaugcagcccggcuccgaccagaaccacuucugccagcccaccgacgucgccgucgaccccggcaccggcgccaucuacgucuccgacggcuacugcaacucccgcaucguccaguucucccccuccggcaaguucaucacccaguggggcgaggaguccuccggcuccuccccccuccccggccaguucaccgucccccacucccucgcccucgucccccuccucggccagcucugcgucgccgaccgcgagaacggccgcauccagugcuucaagaccgacaccaaggaguucguccgcgagaucaagcacuccuccuucggccgcaacgucuucgccaucuccuacauccccggccuccucuucgccgucaacggcaagccccacuucggcgaccaggagcccguccagggcuucgucaugaacuucuccaacggcgagaucaucgacaucuucaagcccguccgcaagcacuucgacaugccccacgacaucgucgccuccgaggacggcaccgucuacaucggcgacgcccacaccaacaccgucuggaaguucacccucaccgagaagcucgagcaccgcuccgucaagaaggccggcaucgagguccaggagaucaagggcaagggcuccggcggccucaaccucggcaacuucuucgccucccgcaagggcuacucccgcaagggcuucgaccgccucuccaccgagggcuccgaccaggagaaggaggacgacggcuccgaguccgaggaggaguacuccgccccccuccccgcccucgcccccuccuccuccuga

SEQ ID NO: 47276 - RNA, 2163 nt, Artificial Sequence
  derived and/or modified sequence opt2 from PAMR1__Homo_sapiens__NP_001001991
auggagcucggcugcuggacccagcucggccucaccuuccuccagcuccuccucaucuccucccucccccgcgaguacaccgucaucaacgaggccugccccggcgccgaguggaacaucaugugccgcgagugcugcgaguacgaccagaucgagugcgucugccccggcaagcgcgaggucgucggcuacaccauccccugcugccgcaacgaggagaacgagugcgacuccugccucauccaccccggcugcaccaucuucgagaacugcaaguccugccgcaacggcuccuggggcggcacccucgacgacuucuacgucaagggcuucuacugcgccgagugccgcgccggcugguacggcggcgacugcaugcgcugcggccagguccuccgcgcccccaagggccagauccuccucgaguccuacccccucaacgcccacugcgaguggaccauccacgccaagcccggcuucgucauccagcuccgcuucgucaugcucucccucgaguucgacuacaugugccaguacgacuacgucgagguccgcgacggcgacaaccgcgacggccagaucaucaagcgcgucugcggcaacgagcgccccgcccccauccaguccaucggcuccucccuccacguccucuuccacuccgacggcuccaagaacuucgacggcuuccacgccaucuacgaggagaucaccgccugcuccuccucccccugcuuccacgacggcaccugcguccucgacaaggccggcuccuacaagugcgccugccucgccggcuacaccggccagcgcugcgagaaccuccucgaggagcgcaacugcuccgaccccggcggccccgucaacggcuaccagaagaucaccggcggccccggccucaucaacggccgccacgccaagaucggcaccgucgucuccuucuucugcaacaacuccuacguccucuccggcaacgagaagcgcaccugccagcagaacggcgagugguccggcaagcagcccaucugcaucaaggccugccgcgagcccaagaucuccgaccucguccgccgccgcguccuccccaugcagguccagucccgcgagaccccccuccaccagcucuacuccgccgccuucuccaagcagaagcuccaguccgcccccaccaagaagcccgcccuccccuucggcgaccuccccaugggcuaccagcaccuccacacccagcuccaguacgagugcaucucccccuucuaccgccgccucggcuccucccgccgcaccugccuccgcaccggcaagugguccggccgcgcccccuccugcauccccaucugcggcaagaucgagaacaucaccgcccccaagacccagggccuccgcuggcccuggcaggccgccaucuaccgccgcaccuccggcguccacgacggcucccuccacaagggcgccugguuccucgucugcuccggcgcccucgucaacgagcgcaccgucgucgucgccgcccacugcgucaccgaccucggcaaggucaccaugaucaagaccgccgaccucaaggucguccucggcaaguucuaccgcgacgacgaccgcgacgagaagaccauccagucccuccagaucuccgccaucauccuccaccccaacuacgaccccauccuccucgacgccgacaucgccauccucaagcuccucgacaaggcccgcaucuccacccgcguccagcccaucugccucgccgccucccgcgaccucuccaccuccuuccaggagucccacaucaccgucgccggcuggaacguccucgccgacguccgcucccccggcuucaagaacgacacccuccgcuccggcgucgucuccgucgucgacucccuccucugcgaggagcagcacgaggaccacggcauccccgucuccgucaccgacaacauguucugcgccuccugggagcccaccgcccccuccgacaucugcaccgccgagaccggcggcaucgccgccgucuccuuccccggccgcgccucccccgagccccgcuggcaccucaugggccucgucuccugguccuacgacaagaccugcucccaccgccucuccaccgccuucaccaagguccuccccuucaaggacuggaucgagcgcaacaugaaguga

SEQ ID NO: 47277 - RNA, 3609 nt, Artificial Sequence
  derived and/or modified sequence opt2 from PAN2__Homo_sapiens__NP_001120932
augaacuucgagggccucgaccccggccucgccgaguacgcccccgccaugcacuccgcccucgaccccguccucgacgcccaccucaaccccucccuccuccagaacgucgagcucgaccccgagggcgucgcccucgaggcccuccccguccaggaguccguccacaucauggagggcgucuacuccgagcuccacuccgucgucgccgaggucggcguccccgucuccgucucccacuucgaccuccacgaggagaugcucugggucggcucccacggcggccacgccaccuccuucuucggccccgcccucgagcgcuacuccuccuuccaggucaacggcuccgacgacauccgccagauccagucccucgagaacggcauccucuuccucaccaagaacaaccucaaguacauggcccgcggcggccucaucaucuucgacuaccuccucgacgagaacgaggacaugcacucccuccuccucaccgacuccuccacccuccucgucggcggccuccagaaccacauccucgagaucgaccucaacaccguccaggagacccagaaguacgccgucgagacccccggcgucaccaucaugcgccagaccaaccgcuucuucuucugcggccacaccuccggcaaggucucccuccgcgaccuccgcaccuucaaggucgagcacgaguucgacgccuucuccggcucccucuccgacuucgacguccacggcaaccuccucgccgccugcggcuucuccucccgccucaccggccucgccugcgaccgcuuccucaaggucuacgaccuccgcaugaugcgcgccaucaccccccuccagguccacgucgaccccgccuuccuccgcuucauccccaccuacaccucccgccucgccaucaucucccaguccggccagugccaguucugcgagcccaccggccucgccaaccccgccgacaucuuccacgucaaccccgucggcccccuccucaugaccuucgacgucuccgccuccaagcaggcccucgccuucggcgacuccgagggcugcguccaccucuggaccgacucccccgagcccuccuucaaccccuacucccgcgagaccgaguucgcccuccccugccucgucgacucccuccccccccucgacuggucccaggaccuccucccccucucccucauccccgucccccucaccaccgacacccuccucuccgacuggcccgccgccaacuccgcccccgccccccgccgcgccccccccgucgacgccgagauccuccgcaccaugaagaaggucggcuucaucggcuacgcccccaacccccgcacccgccuccgcaaccagauccccuaccgccucaaggaguccgacuccgaguucgacuccuucucccaggucaccgagucccccgucggccgcgaggaggagccccaccuccacauggucuccaagaaguaccgcaaggucaccaucaaguacuccaagcucggccucgaggacuucgacuucaagcacuacaacaagacccucuucgccggccucgagccccacauccccaacgccuacugcaacugcaugauccagguccucuacuuccucgagcccguccgcugccucauccagaaccaccucugccagaaggaguucugccucgccugcgagcucggcuuccucuuccacaugcucgaccucucccgcggcgaccccugccagggcaacaacuuccuccgcgccuuccgcaccauccccgaggccuccgcccucggccucauccucgccgacuccgacgaggccuccggcaagggcaaccucgcccgccucauccagcgcuggaaccgcuucauccucacccagcuccaccaggacaugcaggagcucgagaucccccaggccuaccgcggcgccggcggcuccuccuucugcuccuccggcgacuccgucaucggccagcucuucuccugcgagauggagaacugcucccucugccgcugcggcuccgagaccguccgcgccuccuccacccuccucuucacccucuccuaccccgacggcuccaaguccgacaagaccggcaagaacuacgacuucgcccagguccucaagcgcuccaucugccucgaccagaacacccaggccuggugcgacaccugcgagaaguaccagcccaccauccagacccgcaacauccgccaccuccccgacauccucgucaucaacugcgaggucaacuccuccaaggaggccgacuucuggcgcaugcaggccgaggucgccuucaagauggccgucaagaagcacggcggcgagaucuccaagaacaaggaguucgcccucgccgacuggaaggagcucggcucccccgagggcguccucgucugccccuccaucgaggagcucaagaacgucuggcuccccuucuccauccgcaugaagaugaccaagaacaagggccucgacgucugcaacuggaccgacggcgacgagaugcaguggggccccgcccgcgccgaggaggagcacggcgucuacgucuacgaccucauggccaccgucguccacauccucgacucccgcaccggcggcucccucgucgcccacaucaaggucggcgagaccuaccaccagcgcaaggagggcgucacccaccagcagugguaccucuucaacgacuuccucaucgagcccaucgacaagcacgaggccguccaguucgacaugaacuggaagguccccgccauccucuacuacgucaagcgcaaccucaacucccgcuacaaccucaacaucaagaaccccaucgaggccuccguccuccucgccgaggccucccucgcccgcaagcagcgcaagacccacaccaccuucaucccccucaugcucaacgagaugccccagaucggcgaccucgucggccucgacgccgaguucgucacccucaacgaggaggaggccgagcuccgcuccgacggcaccaaguccaccaucaagcccucccagauguccgucgcccgcaucaccugcguccgcggccagggccccaacgagggcauccccuucaucgacgacuacaucuccacccaggagcaggucgucgacuaccucacccaguacuccggcaucaagcccggcgaccucgacgccaagaucuccuccaagcaccucaccacccucaaguccaccuaccucaagcuccgcuuccucaucgacaucggcgucaaguucgucggccacggccuccagaaggacuuccgcgucaucaaccucaugguccccaaggaccagguccucgacaccgucuaccucuuccacaugccccgcaagcgcaugaucucccuccgcuuccucgccugguacuuccucgaccucaagauccagggcgagacccacgacuccaucgaggacgcccgcaccgcccuccagcucuaccgcaaguaccucgagcucuccaagaacggcaccgagcccgaguccuuccacaagguccucaagggccucuacgagaagggccgcaagauggacuggaagguccccgagcccgagggccagaccucccccaagaacgccgccgucuucuccuccguccucgcccucuga

SEQ ID NO: 47278 - RNA, 2664 nt, Artificial Sequence
  derived and/or modified sequence opt2 from PAN3__Homo_sapiens__NP_787050
augaacuccggcggcggccuccccccccccuccgccgccgccucccccuccuccuccucccucgccgccgccgucgccgucgucgccccccccggcgucggcggcguccccggcggcgccgccgucggcgucaagcucaaguacugccgcuacuacgccaaggacaagaccugcuucuacggcgaggagugccaguuccuccacgaggaccccgccgccggcgccgcccccggccucggccuccacuccaacuccgucccccucgcccucgccggcgcccccgucgccggcuucccccccggcgccgucgccggcggcggcgccggccccccccccggccccaagaagcccgaccucggcgaccccggcaccggcgccgccgccggcggcggcggcuccuccggcggccucgacggcccccgccucgccauccccggcauggacggcggcgcccucaccgacaccucccucaccgacuccuacuucuccaccuccuucaucggcgucaacggcuucggcucccccgucgagaccaaguacccccucaugcagcgcaugaccaacuccuccuccucccccucccuccucaacgacuccgccaagcccuacuccgcccacgacccccucaccucccccgccuccucccucuucaacgacuucggcgcccucaacaucucccagcgccgcaagccccgcaaguaccgccucggcaugcucgaggagcgccucguccccaugggcuccaaggcccgcaaggccaagaaccccaucggcugccucgccgaccgcugcaaguccggcguccccaucaacauggucugguggaaccgcgucaccgagaacaaccuccagacccccaaccccaccgccuccgaguucauccccaagggcggcuccaccucccgccucuccaacgucucccaguccaacauguccgccuucucccaggucuucucccaccccuccaugggcucccccgccaccgccggccucgcccccggcaugucccucuccgccggcuccuccccccuccacucccccaagaucaccccccacaccucccccgccccccgccgccgcucccacacccccaaccccgccuccuacaugguccccuccuccgccuccaccuccgucaacaaccccgucucccagacccccuccuccggccaggucauccagaaggagaccgucggcggcaccaccuacuucuacaccgacaccacccccgccccccucaccggcauggucuuccccaacuaccacaucuacccccccaccgccccccacgucgccuacaugcagcccaaggccaacgcccccuccuucuucauggccgacgagcuccgccaggagcucaucaaccgccaccucaucaccauggcccagaucgaccaggccgacaugcccgccguccccaccgaggucgacuccuaccacucccucuucccccucgagccccuccccccccccaaccgcauccagaaguccuccaacuucggcuacaucaccuccugcuacaaggccgucaacuccaaggacgaccuccccuacugccuccgccgcauccacggcuuccgccucgucaacaccaagugcaugguccucgucgacauguggaagaagauccagcacuccaacaucgucacccuccgcgaggucuucaccaccaaggccuucgccgagcccucccucgucuucgccuacgacuuccacgccggcggcgagaccaugaugucccgccacuucaacgaccccaacgccgacgccuacuucaccaagcgcaaguggggccagcacgagggcccccucccccgccagcacgccggccuccuccccgagucccucaucugggccuacaucguccagcucuccuccgcccuccgcaccauccacaccgccggccucgccugccgcgucauggaccccaccaagauccucaucaccggcaagacccgccuccgcgucaacugcgucggcgucuucgacguccucaccuucgacaacucccagaacaacaacccccucgcccucauggcccaguaccagcaggccgaccucaucucccucggcaaggucguccucgcccucgccugcaacucccucgccggcauccagcgcgagaaccuccagaaggccauggagcucgucaccaucaacuacuccuccgaccucaagaaccucauccucuaccuccucaccgaccagaaccgcaugcgcuccgucaacgacaucaugcccaugaucggcgcccgcuucuacacccagcucgacgccgcccagaugcgcaacgacgucaucgaggaggaccucgccaaggagguccagaacggccgccucuuccgccuccucgccaagcucggcaccaucaacgagcgccccgaguuccagaaggaccccaccugguccgagaccggcgaccgcuaccuccucaagcucuuccgcgaccaccucuuccaccaggucaccgaggccggcgcccccuggaucgaccucucccacaucaucuccugccucaacaagcucgacgccggcguccccgagaagaucucccucaucucccgcgacgagaaguccguccucgucgucaccuacuccgaccucaagcgcugcuucgagaacaccuuccaggagcucaucgccgccgccaacggccagcucuga

SEQ ID NO: 47279 - RNA, 945 nt, Artificial Sequence
  derived and/or modified sequence opt2 from PANK1__Homo_sapiens__NP_612189
augaagcucaucaacggcaagaagcagaccuuccccugguucggcauggacaucggcggcacccucgucaagcucgucuacuucgagcccaaggacaucaccgccgaggaggagcaggaggaggucgagaaccucaaguccauccgcaaguaccucaccuccaacaccgccuacggcaagaccggcauccgcgacguccaccucgagcucaagaaccucaccaugugcggccgcaagggcaaccuccacuucauccgcuuccccuccugcgccaugcaccgcuucauccagaugggcuccgagaagaacuucuccucccuccacaccacccucugcgccaccggcggcggcgccuucaaguucgaggaggacuuccgcaugaucgccgaccuccagcuccacaagcucgacgagcucgacugccucauccagggccuccucuacgucgacuccgucggcuucaacggcaagcccgagugcuacuacuucgagaaccccaccaaccccgagcucugccagaagaagcccuacugccucgacaaccccuaccccaugcuccucgucaacaugggcuccggcgucuccauccucgccgucuacuccaaggacaacuacaagcgcgucaccggcaccuccuucggcaacaugauguccaaggagaagcgcgacuccaucuccaaggaggaccucgcccgcgccacccucgucaccaucaccaacaacaucggcuccaucgcccgcaugugcgcccucaacgagaacaucgaccgcgucgucuucgucggcaacuuccuccgcaucaacauggucuccaugaagcuccucgccuacgccauggacuucugguccaagggccagcucaaggcccucuuccucgagcacgagggcuacuucggcgccgucggcgcccuccucgagcucuucaagaugaccgacgacaaguga

SEQ ID NO: 47280 - RNA, 1713 nt, Artificial Sequence
  derived and/or modified sequence opt2 from PANK2__Homo_sapiens__NP_705902
augcgccgccucggccccuuccacccccgcguccacugggccgccccccccucccucuccuccggccuccaccgccuccucuuccuccgcggcacccgcauccccuccuccaccacccucucccccccccgccacgacucccucucccucgacggcggcaccgucaaccccccccgcguccgcgagcccaccggccgcgaggccuucggccccucccccgccuccuccgacuggcuccccgcccgcuggcgcaacggccgcggcggccgcccccgcgcccgccucugcuccggcuggaccgccgccgaggaggcccgccgcaaccccacccucggcggccuccucggccgccagcgccuccuccuccgcaugggcggcggccgccucggcgcccccauggagcgccacggccgcgccuccgccaccuccgucuccuccgccggcgagcaggccgccggcgaccccgagggccgccgccaggagccccuccgccgccgcgccuccuccgccuccguccccgccgucggcgccuccgccgagggcacccgccgcgaccgccucggcuccuacuccggccccaccuccgucucccgccagcgcgucgagucccuccgcaagaagcgcccccucuuccccugguucggccucgacaucggcggcacccucgucaagcucgucuacuucgagcccaaggacaucaccgccgaggaggaggaggaggaggucgagucccucaaguccauccgcaaguaccucaccuccaacgucgccuacggcuccaccggcauccgcgacguccaccucgagcucaaggaccucacccucugcggccgcaagggcaaccuccacuucauccgcuuccccacccacgacaugcccgccuucauccagaugggccgcgacaagaacuucuccucccuccacaccgucuucugcgccaccggcggcggcgccuacaaguucgagcaggacuuccucaccaucggcgaccuccagcucugcaagcucgacgagcucgacugccucaucaagggcauccucuacaucgacuccgucggcuucaacggccgcucccagugcuacuacuucgagaaccccgccgacuccgagaagugccagaagcuccccuucgaccucaagaaccccuacccccuccuccucgucaacaucggcuccggcgucuccauccucgccgucuacuccaaggacaacuacaagcgcgucaccggcaccucccucggcggcggcaccuucuucggccucugcugccuccucaccggcugcaccaccuucgaggaggcccucgagauggccucccgcggcgacuccaccaaggucgacaagcucguccgcgacaucuacggcggcgacuacgagcgcuucggccuccccggcugggccgucgccuccuccuucggcaacaugauguccaaggagaagcgcgaggccgucuccaaggaggaccucgcccgcgccacccucaucaccaucaccaacaacaucggcuccaucgcccgcaugugcgcccucaacgagaacaucaaccaggucgucuucgucggcaacuuccuccgcaucaacaccaucgccaugcgccuccucgccuacgcccucgacuacugguccaagggccagcucaaggcccucuucuccgagcacgagggcuacuucggcgccgucggcgcccuccucgagcuccucaagauccccuga

SEQ ID NO: 47281 - RNA, 1281 nt, Artificial Sequence
  derived and/or modified sequence opt2 from PANX1__Homo_sapiens__NP_056183
auggccaucgcccagcucgccaccgaguacgucuucuccgacuuccuccucaaggagcccaccgagcccaaguucaagggccuccgccucgagcucgccgucgacaagauggucaccugcaucgccgucggccucccccuccuccucaucucccucgccuucgcccaggagaucuccaucggcacccagaucuccugcuucucccccuccuccuucuccuggcgccaggccgccuucgucgacuccuacugcugggccgccguccagcagaagaacucccuccaguccgaguccggcaaccucccccucuggcuccacaaguucuuccccuacauccuccuccucuucgccauccuccucuaccuccccccccucuucuggcgcuucgccgccgccccccacaucugcuccgaccucaaguucaucauggaggagcucgacaaggucuacaaccgcgccaucaaggccgccaaguccgcccgcgaccucgacaugcgcgacggcgccugcuccguccccggcgucaccgagaaccucggccagucccucugggaggucuccgagucccacuucaaguaccccaucgucgagcaguaccucaagaccaagaagaacuccaacaaccucaucaucaaguacaucuccugccgccuccucacccucaucaucauccuccucgccugcaucuaccucggcuacuacuucucccucuccucccucuccgacgaguucgucugcuccaucaaguccggcauccuccgcaacgacuccaccguccccgaccaguuccagugcaagcucaucgccgucggcaucuuccagcuccucuccgucaucaaccucgucgucuacguccuccucgcccccgucgucgucuacacccucuucguccccuuccgccagaagaccgacguccucaaggucuacgagauccuccccaccuucgacguccuccacuucaaguccgagggcuacaacgaccucucccucuacaaccucuuccucgaggagaacaucuccgaggucaaguccuacaagugccucaagguccucgagaacaucaaguccuccggccagggcaucgaccccaugcuccuccucaccaaccucggcaugaucaagauggacgucgucgacggcaagacccccauguccgccgagaugcgcgaggagcagggcaaccagaccgccgagcuccagggcaugaacaucgacuccgagaccaaggccaacaacggcgagaagaacgcccgccagcgccuccucgacuccuccugcuga

SEQ ID NO: 47282 - RNA, 2034 nt, Artificial Sequence
  derived and/or modified sequence opt2 from PANX2__Homo_sapiens__NP_443071
augcaccaccuccucgagcaguccgccgacauggccaccgcccuccucgccggcgagaagcuccgcgagcucauccuccccggcgcccaggacgacaaggccggcgcccucgccgcccuccuccuccagcucaagcucgagcuccccuucgaccgcgucgucaccaucggcaccguccucguccccauccuccucgucacccucgucuucaccaagaacuucgccgaggagcccaucuacugcuacaccccccacaacuucacccgcgaccaggcccucuacgcccgcggcuacugcuggaccgagcuccgcgacgcccuccccggcgucgacgccucccucuggcccucccucuucgagcacaaguuccuccccuacgcccuccucgccuucgccgccaucauguacguccccgcccucggcugggaguuccucgccuccacccgccucaccuccgagcucaacuuccuccuccaggagaucgacaacugcuaccaccgcgccgccgagggccgcgcccccaagaucgagaagcagauccaguccaagggccccggcaucaccgagcgcgagaagcgcgagaucaucgagaacgccgagaaggagaagucccccgagcagaaccucuucgagaaguaccucgagcgccgcggccgcuccaacuuccucgccaagcucuaccucgcccgccacguccucauccuccuccucuccgccguccccaucuccuaccucugcaccuacuacgccacccagaagcagaacgaguucaccugcgcccucggcgccucccccgacggcgccgccggcgccggccccgccguccgcgucuccugcaagcuccccuccguccagcuccagcgcaucaucgccggcgucgacaucguccuccucugcgucaugaaccucaucauccucgucaaccucauccaccucuucaucuuccgcaaguccaacuucaucuucgacaagcuccacaaggucggcaucaagacccgccgccaguggcgccgcucccaguucugcgacaucaacauccucgccauguucugcaacgagaaccgcgaccacaucaagucccucaaccgccucgacuucaucaccaacgaguccgaccucauguacgacaacgucguccgccagcuccucgccgcccucgcccaguccaaccacgacgccacccccaccguccgcgacuccggcguccagaccgucgaccccuccgccaaccccgccgagcccgacggcgccgccgagccccccgucgucaagcgcccccgcaagaagaugaaguggauccccaccuccaacccccucccccagcccuucaaggagccccucgccaucaugcgcgucgagaacuccaaggccgagaagcccaagcccgcccgccgcaagaccgccaccgacacccucaucgccccccuccucgaccgcuccgcccaccacuacaagggcggcggcggcgaccccggccccggccccgcccccgcccccgcccccccccccgcccccgacaagaagcacgcccgccacuucucccucgacguccaccccuacauccucggcaccaagaaggccaaggccgaggccguccccgccgcccuccccgccucccgcucccaggagggcggcuuccucucccaggccgaggacugcggccucggccucgcccccgcccccaucaaggacgccccccuccccgagaaggagauccccuaccccaccgagcccgcccgcgccggccuccccuccggcggccccuuccacguccgcuccccccccgccgcccccgccgucgccccccucacccccgccucccucggcaaggccgagccccucaccauccucucccgcaacgccacccacccccuccuccacaucaacacccucuacgaggcccgcgaggaggaggacggcggcccccgccucccccaggacgucggcgaccucaucgccauccccgccccccagcagauccucaucgccaccuucgacgagccccgcaccgucgucuccaccgucgaguucuga

SEQ ID NO: 47283 - RNA, 1536 nt, Artificial Sequence
  derived and/or modified sequence opt2 from PAOX__Homo_sapiens__NP_690875
auggaguccaccggcuccgucggcgaggcccccggcggcccccgcguccucgucgucggcggcggcaucgccggccucggcgccgcccagcgccucugcggccacuccgccuucccccaccuccgcguccucgaggccaccgcccgcgccggcggccgcauccgcuccgagcgcugcuucggcggcgucgucgaggucggcgcccacuggauccacggccccucccgcggcaaccccgucuuccagcucgccgccgaguacggccuccucggcgagaaggagcucucccaggagaaccagcucgucgagaccggcggccacgucggccuccccuccgucuccuacgccuccuccggcgccuccgucucccuccagcucgucgccgagauggccacccucuucuacggccucaucgaccagacccgcgaguuccuccacgccgccgagacccccguccccuccgucggcgaguaccucaagaaggagaucggccagcacgucgccggcuggaccgaggacgaggagacccgcaagcucaagcucgccguccucaacuccuucuucaaccucgagugcugcgucuccggcacccacuccauggaccucgucgcccucgcccccuucggcgaguacaccguccuccccggccucgacugcaccuucuccaagggcuaccagggccucaccaacugcaugauggccgcccuccccgaggacaccgucgucuucgagaagcccgucaagaccauccacuggaacggcuccuuccaggaggccgccuuccccggcgagaccuuccccgucuccgucgagugcgaggacggcgaccgcuuccccgcccaccacgucaucgucaccgucccccucggcuuccuccgcgagcaccucgacaccuucuucgaccccccccuccccgccgagaaggccgaggccauccgcaagaucggcuucggcaccaacaacaagaucuuccucgaguucgaggagcccuucugggagcccgacugccagcucauccagcucgucugggaggacaccuccccccucgaggacgccgcccccgagcuccaggacgccugguuccgcaagcucaucggcuucgucguccuccccgccuucgccuccguccacguccucugcggcuucaucgccggccucgaguccgaguucauggagacccucuccgacgaggagguccuccucugccucacccagguccuccgccgcgucaccggcaacccccgccuccccgcccccaaguccguccuccgcucccgcuggcacuccgcccccuacacccgcggcuccuacuccuacgucgccgucggcuccaccggcggcgaccucgaccuccucgcccagccccuccccgccgacggcgccggcgcccagcuccagauccucuucgccggcgaggccacccaccgcaccuucuacuccaccacccacggcgcccuccucuccggcuggcgcgaggccgaccgccuccucucccucugggccccccagguccagcagccccgcccccgccucuga

SEQ ID NO: 47284 - RNA, 2379 nt, Artificial Sequence
  derived and/or modified sequence opt2 from PAPD7__Homo_sapiens__XP_005248291
auggacccccgcgucgccuggauccagcccgagcagaagggccccgccaacgcccucuggaugcagaucugggagaccucccagggcgucggccgcggcggcuccggcuucgccuccuacuucugccucaacucccccgcccucgacaccgccgccgccgccggcgccgccggccgcggcuccggcggccucggccccgcccuccccgccgccuccccccccccccccggccccaccgcccccgccgcccucccccccgcccuccucaccgcccucggccccgccgccgagggcgcccgccgccuccacaagucccccucccucuccuccuccuccuccuccuccuccuccaacgccgaguccggcaccgagucccccggcugcuccuccuccuccuccuccuccgccucccucggccgccccggcggcggccgcggcggcgccuucuucaacuucgccgacggcgcccccuccgcccccggcaccgccaacggccaccccggcccccgcggccccgcccccgccggcucccccucccagcaccaguuccaccccggccgccgcaagcgcgagaacaaggccuccaccuacggccucaacuaccuccucuccggcucccgcgccgccgcccucuccggcggcggcggccccggcgcccaggccccccgccccggcacccccuggaagucccgcgccuacucccccggcauccagggccuccacgaggagaucaucgacuucuacaacuucaugucccccugccccgaggaggccgccaugcgccgcgaggucgucaagcgcaucgagaccgucgucaaggaccucuggcccaccgccgacguccagaucuucggcuccuucuccaccggccucuaccuccccaccuccgacaucgaccucgucgucuucggcaagugggagcgccccccccuccagcuccucgagcaggcccuccgcaagcacaacgucgccgagcccugcuccaucaagguccucgacaaggccaccguccccaucaucaagcucaccgaccaggagaccgaggucaaggucgacaucuccuucaacauggagaccggcguccgcgccgccgaguucaucaagaacuacaugaagaaguacucccuccuccccuaccucauccucguccucaagcaguuccuccuccagcgcgaccucaacgaggucuucaccggcggcaucuccuccuacucccucauccucauggccaucuccuuccuccagcuccacccccgcaucgacgcccgccgcgccgacgagaaccucggcaugcuccucgucgaguucuucgagcucuacggccgcaacuucaacuaccucaagaccggcauccgcaucaaggagggcggcgccuacaucgccaaggaggagaucaugaaggccaugaccuccggcuaccgccccuccaugcucugcaucgaggacccccuccuccccggcaacgacgucggccgcuccuccuacggcgccaugcaggucaagcaggucuucgacuacgccuacaucguccucucccacgccgucuccccccucgcccgcuccuaccccaaccgcgacgccgaguccacccucggccgcaucaucaaggucacccaggaggucaucgacuaccgccgcuggaucaaggagaaguggggcuccaaggcccaccccucccccggcauggacucccgcaucaagaucaaggagcgcaucgccaccugcaacggcgagcagacccagaaccgcgagcccgagucccccuacggccagcgccucacccucucccucuccuccccccagcuccucuccuccggcuccuccgccuccuccgucuccucccucuccggcuccgacgucgacuccgacaccccccccugcaccacccccuccgucuaccaguucucccuccaggcccccgccccccucauggccggccuccccaccgcccuccccaugcccuccggcaagccccagcccaccaccucccgcacccucaucaugaccaccaacaaccagacccgcuucaccauccccccccccacccucggcgucgcccccguccccugccgccaggccggcgucgagggcaccgccucccucaaggccguccaccacauguccucccccgccauccccuccgccucccccaacccccucuccuccccccaccucuaccacaagcagcacaacggcaugaagcucuccaugaagggcucccacggccacacccagggcggcggcuacuccuccgucggcuccggcggcguccgcccccccgucggcaaccgcggccaccaccaguacaaccgcaccggcuggcgccgcaagaagcacacccacacccgcgacucccuccccgucucccucucccgcuga

SEQ ID NO: 47285 - RNA, 1317 nt, Artificial Sequence
  derived and/or modified sequence opt2 from PAPL__Homo_sapiens__NP_001004318
augcacccccuccccggcuacugguccugcuacugccuccuccuccucuucucccucggcguccagggcucccucggcgcccccuccgccgcccccgagcagguccaccucuccuaccccggcgagcccggcuccaugaccgucaccuggaccaccuggguccccacccgcuccgagguccaguucggccuccagcccuccggcccccucccccuccgcgcccagggcaccuucguccccuucgucgacggcggcauccuccgccgcaagcucuacauccaccgcgucacccuccgcaagcuccuccccggcguccaguacgucuaccgcugcggcuccgcccagggcuggucccgccgcuuccgcuuccgcgcccucaagaacggcgcccacugguccccccgccucgccgucuucggcgaccucggcgccgacaaccccaaggccgucccccgccuccgccgcgacacccagcagggcauguacgacgccguccuccacgucggcgacuucgccuacaaccucgaccaggacaacgcccgcgucggcgaccgcuucaugcgccucaucgagcccgucgccgccucccuccccuacaugaccugccccggcaaccacgaggagcgcuacaacuucuccaacuacaaggcccgcuucuccaugcccggcgacaacgagggccucugguacuccugggaccucggccccgcccacaucaucuccuucuccaccgaggucuacuucuuccuccacuacggccgccaccucguccagcgccaguuccgcuggcucgaguccgaccuccagaaggccaacaagaaccgcgccgcccgccccuggaucaucaccaugggccaccgccccauguacugcuccaacgccgaccucgacgacugcacccgccacgaguccaagguccgcaagggccuccagggcaagcucuacggccucgaggaccucuucuacaaguacggcgucgaccuccagcucugggcccacgagcacuccuacgagcgccucuggcccaucuacaacuaccaggucuucaacggcucccgcgagaugcccuacaccaacccccgcggccccguccacaucaucaccggcuccgccggcugcgaggagcgccucacccccuucgccgucuucccccgccccugguccgccguccgcgucaaggaguacggcuacacccgccuccacauccucaacggcacccacauccacauccagcaggucuccgacgaccaggacggcaagaucgucgacgacgucugggucguccgcccccucuucggccgccgcauguaccucuga

SEQ ID NO: 47286 - RNA, 858 nt, Artificial Sequence
  derived and/or modified sequence opt2 from PAPOLA__Homo_sapiens__NP_001238935
augcccuuccccgucaccacccagggcucccagcagacccagcccccccagaagcacuacggcaucaccucccccaucucccucgccgcccccaaggagaccgacugcguccucacccagaagcucaucgagacccucaagcccuucggcgucuucgaggaggaggaggagcuccagcgccgcauccucauccucggcaagcucaacaaccucgucaaggaguggauccgcgagaucuccgaguccaagaaccucccccaguccgucaucgagaacgucggcggcaagaucuucaccuucggcuccuaccgccucggcguccacaccaagggcgccgacaucgacgcccucugcgucgccccccgccacgucgaccgcuccgacuucuucaccuccuucuacgacaagcucaagcuccaggaggaggucaaggaccuccgcgccgucgaggaggccuucguccccgucaucaagcucugcuucgacggcaucgagaucgacauccucuucgcccgccucgcccuccagaccauccccgaggaccucgaccuccgcgacgacucccuccucaagaaccucgacauccgcugcauccgcucccucaacggcugccgcgucaccgacgagauccuccaccucguccccaacaucgacaacuuccgccucacccuccgcgccaucaagcucugggccaagcgccacaacaucuacuccaacauccucggcuuccucggcggcgucuccugggccaugcucgucgcccgcaccugccagcucuaccccaacgccaucgccuccacccucguccacaaguucuuccucgucuucuccaagugguacgucuuccgccucuacuga

SEQ ID NO: 47287 - RNA, 2211 nt, Artificial Sequence
  derived and/or modified sequence opt2 from PAPOLG__Homo_sapiens__NP_075045
augaaggagauguccgccaacaccguccucgacucccagcgccagcagaagcacuacggcaucaccucccccaucucccucgccucccccaaggagaucgaccacaucuacacccagaagcucaucgacgccaugaagcccuucggcgucuucgaggacgaggaggagcucaaccaccgccucgucguccucggcaagcucaacaaccucgucaaggaguggaucuccgacgucuccgaguccaagaaccucccccccuccgucgucgccaccgucggcggcaagaucuucaccuucggcuccuaccgccucggcguccacaccaagggcgccgacaucgacgcccucugcgucgccccccgccacgucgagcgcuccgacuucuuccaguccuucuucgagaagcucaagcaccaggacggcauccgcaaccuccgcgccgucgaggacgccuucguccccgucaucaaguucgaguucgacggcaucgagaucgaccucgucuucgcccgccucgccauccagaccaucuccgacaaccucgaccuccgcgacgacucccgccuccgcucccucgacauccgcugcauccgcucccucaacggcugccgcgucaccgacgagauccuccaccucguccccaacaaggagaccuuccgccucacccuccgcgccgucaagcucugggccaagcgccgcggcaucuacuccaacaugcucggcuuccucggcggcgucuccugggccaugcucgucgcccgcaccugccagcucuaccccaacgccgccgccuccacccucguccacaaguucuuccucgucuucuccaagugggaguggcccaaccccguccuccucaagcagcccgaggaguccaaccucaaccuccccgucugggacccccgcgucaaccccuccgaccgcuaccaccucaugcccaucaucacccccgccuacccccagcagaacuccaccuacaacgucuccaccuccacccgcaccgucauggucgaggaguucaagcagggccucgccgucaccgacgagauccuccagggcaaguccgacugguccaagcuccucgagccccccaacuucuuccagaaguaccgccacuacaucguccucaccgccuccgccuccaccgaggagaaccaccucgagugggucggccucgucgaguccaagauccgcguccucgucggcaaccucgagcgcaacgaguucaucacccucgcccacgucaacccccaguccuuccccggcaacaaggagcaccacaaggacaacaacuacgucuccaugugguuccucggcaucaucuuccgccgcgucgagaacgccgaguccgucaacaucgaccucaccuacgacauccaguccuucaccgacaccgucuaccgccaggccaacaacaucaacaugcucaaggagggcaugaagaucgaggccacccacgucaagaagaagcagcuccaccacuaccuccccgccgagauccuccagaagaagaagaagcagucccucuccgacgucaaccgcuccuccggcggccuccaguccaagcgccucucccucgacuccuccugccucgacuccucccgcgacaccgacaacggcacccccuucaacucccccgccuccaaguccgacucccccuccgucggcgagaccgagcgcaacuccgccgagcccgccgccgucaucgucgagaagccccucuccgucccccccgcccagggccucuccauccccgucaucggcgccaaggucgacuccaccgucaagaccgucuccccccccaccgucugcaccauccccaccgucgucggccgcaacgucaucccccgcaucaccaccccccacaaccccgcccagggccagccccaccucaacggcauguccaacaucaccaagaccgucacccccaagcgcucccacucccccuccaucgacggcacccccaagcgccucaaggacgucgagaaguucauccgccucgaguccaccuucaaggacccccgcaccgccgaggagcgcaagcgcaaguccgucgacgccaucggcggcgaguccaugcccauccccaccaucgacaccucccgcaagaagcgccuccccuccaaggagcuccccgacuccuccucccccguccccgccaacaacauccgcgucaucaagaacuccauccgccucacccucaaccgcuga

SEQ ID NO: 47288 - RNA, 2484 nt, Artificial Sequence
  derived and/or modified sequence opt2 from PAPPA2__Homo_sapiens__NP_068755
augaugugccucaagauccuccgcaucucccucgccauccucgccggcugggcccucugcuccgccaacuccgagcucggcuggacccgcaagaagucccucgucgagcgcgagcaccucaaccagguccuccucgagggcgagcgcugcuggcucggcgccaagguccgccgcccccgcgccuccccccagcaccaccucuucggcgucuaccccucccgcgccggcaacuaccuccgccccuaccccgucggcgagcaggagauccaccacaccggccgcuccaagcccgacaccgagggcaacgccgucucccucgucccccccgaccucaccgagaaccccgccggccuccgcggcgccgucgaggagcccgccgcccccugggucggcgacucccccaucggccaguccgagcuccucggcgacgacgacgccuaccucggcaaccagcgcuccaaggagucccucggcgaggccggcauccagaagggcuccgccauggccgccaccaccaccaccgccaucuucaccacccucaacgagcccaagcccgagacccagcgccgcggcugggccaagucccgccagcgccgccaggucuggaagcgccgcgccgaggacggccagggcgacuccggcaucuccucccacuuccagcccuggcccaagcacucccucaagcaccgcgucaagaaguccccccccgaggaguccaaccagaacggcggcgagggcuccuaccgcgaggccgagaccuucaacucccaggucggccuccccauccucuacuucuccggccgccgcgagcgccuccuccuccgccccgagguccucgccgagaucccccgcgaggccuucaccgucgaggccugggucaagcccgagggcggccagaacaaccccgccaucaucgccggcgucuucgacaacugcucccacaccgucuccgacaagggcugggcccucggcauccgcuccggcaaggacaagggcaagcgcgacgcccgcuucuucuucucccucugcaccgaccgcgucaagaaggccaccauccucaucucccacucccgcuaccagcccggcaccuggacccacgucgccgccaccuacgacggccgccacauggcccucuacgucgacggcacccaggucgccuccucccucgaccaguccggcccccucaacucccccuucauggccuccugccgcucccuccuccucggcggcgacuccuccgaggacggccacuacuuccgcggccaccucggcacccucgucuucugguccaccgcccucccccagucccacuuccagcacuccucccagcacuccuccggcgaggaggaggccaccgaccucguccucaccgccuccuucgagcccgucaacaccgaguggguccccuuccgcgacgagaaguacccccgccucgagguccuccagggcuucgagcccgagcccgagauccucuccccccuccagcccccccucugcggccagaccgucugcgacaacgucgagcucaucucccaguacaacggcuacuggccccuccgcggcgagaaggucauccgcuaccaggucgucaacaucugcgacgacgagggccucaaccccaucgucuccgaggagcagauccgccuccagcacgaggcccucaacgaggccuucucccgcuacaacaucuccuggcagcucuccguccaccagguccacaacuccacccuccgccaccgcgucguccucgucaacugcgagcccuccaagaucggcaacgaccacugcgaccccgagugcgagcacccccucaccggcuacgacggcggcgacugccgccuccagggccgcugcuacuccuggaaccgccgcgacggccucugccacgucgagugcaacaacaugcucaacgacuucgacgacggcgacugcugcgacccccaggucgccgacguccgcaagaccugcuucgaccccgacucccccaagcgcgccuacauguccgucaaggagcucaaggaggcccuccagcucaacuccacccacuuccucaacaucuacuucgccuccuccguccgcgaggaccucgccggcgccgccaccuggcccugggacaaggacgccgucacccaccucggcggcaucguccucucccccgccuacuacggcaugcccggccacaccgacaccaugauccacgaggucggccacguccucggccucuaccacgucuucaagggcgucuccgagcgcgaguccugcaacgaccccugcaaggagaccguccccuccauggagaccggcgaccucugcgccgacaccgcccccacccccaaguccgagcucugccgcgagcccgagcccaccuccgacaccugcggcuucacccgcuuccccggcgcccccuucaccaacuacauguccuacaccggcaucaccaccguccucuucugcuuccuccuccgcauccacggcggccucuga

SEQ ID NO: 47289 - RNA, 4884 nt, Artificial Sequence
  derived and/or modified sequence opt2 from PAPPA__Homo_sapiens__NP_002572
augcgccucugguccuggguccuccaccucggccuccucuccgccgcccucggcugcggccucgccgagcgcccccgccgcgcccgccgcgacccccgcgccggccgccccccccgccccgccgccggccccgccaccugcgccacccgcgccgcccgcggccgccgcgccucccccccccccccccccccccccggcggcgccugggaggccguccgcgucccccgccgccgccagcagcgcgaggcccgcggcgccaccgaggagcccuccccccccucccgcgcccucuacuucuccggccgcggcgagcagcuccgccuccgcgccgaccucgagcucccccgcgacgccuucacccuccaggucuggcuccgcgccgagggcggccagcgcucccccgccgucaucaccggccucuacgacaagugcuccuacaucucccgcgaccgcggcugggucgucggcauccacaccaucuccgaccaggacaacaaggacccccgcuacuucuucucccucaagaccgaccgcgcccgccaggucaccaccaucaacgcccaccgcuccuaccuccccggccagugggucuaccucgccgccaccuacgacggccaguucaugaagcucuacgucaacggcgcccaggucgccaccuccggcgagcaggucggcggcaucuucuccccccucacccagaagugcaagguccucaugcucggcggcuccgcccucaaccacaacuaccgcggcuacaucgagcacuucucccucuggaaggucgcccgcacccagcgcgagauccucuccgacauggagacccacggcgcccacaccgcccucccccagcuccuccuccaggagaacugggacaacgucaagcacgccuggucccccaugaaggacggcuccucccccaaggucgaguucuccaacgcccacggcuuccuccucgacaccucccucgagcccccccucugcggccagacccucugcgacaacaccgaggucaucgccuccuacaaccagcucuccuccuuccgccagcccaaggucguccgcuaccgcgucgucaaccucuacgaggacgaccacaagaaccccaccgucacccgcgagcaggucgacuuccagcaccaccagcucgccgaggccuucaagcaguacaacaucuccugggagcucgacguccucgaggucuccaacuccucccuccgccgccgccucauccucgccaacugcgacaucuccaagaucggcgacgagaacugcgaccccgagugcaaccacacccucaccggccacgacggcggcgacugccgccaccuccgccaccccgccuucgucaagaagcagcacaacggcgucugcgacauggacugcaacuacgagcgcuucaacuucgacggcggcgagugcugcgaccccgagaucaccaacgucacccagaccugcuucgaccccgacuccccccaccgcgccuaccucgacgucaacgagcucaagaacauccucaagcucgacggcuccacccaccucaacaucuucuucgccaaguccuccgaggaggagcucgccggcgucgccaccuggcccugggacaaggaggcccucaugcaccucggcggcaucguccucaaccccuccuucuacggcaugcccggccacacccacaccaugauccacgagaucggccacucccucggccucuaccacgucuuccgcggcaucuccgagauccaguccugcuccgaccccugcauggagaccgagcccuccuucgagaccggcgaccucugcaacgacaccaaccccgcccccaagcacaaguccugcggcgaccccggccccggcaacgacaccugcggcuuccacuccuucuucaacacccccuacaacaacuucauguccuacgccgacgacgacugcaccgacuccuucacccccaaccaggucgcccgcaugcacugcuaccucgaccucgucuaccagggcuggcagcccucccgcaagcccgcccccgucgcccucgccccccagguccucggccacaccaccgacuccgucacccucgagugguucccccccaucgacggccacuucuucgagcgcgagcucggcuccgccugccaccucugccucgagggccgcauccucguccaguacgccuccaacgccuccucccccaugcccugcucccccuccggccacugguccccccgcgaggccgagggccaccccgacgucgagcagcccugcaaguccuccguccgcaccuggucccccaacuccgccgucaacccccacaccgucccccccgccugccccgagccccagggcugcuaccucgagcucgaguuccucuacccccucguccccgagucccucaccaucugggucaccuucgucuccaccgacugggacuccuccggcgccgucaacgacaucaagcuccucgccgucuccggcaagaacaucucccucggcccccagaacgucuucugcgacgucccccucaccauccgccucugggacgucggcgaggaggucuacggcauccagaucuacacccucgacgagcaccucgagaucgacgccgccaugcucaccuccaccgccgacaccccccucugccuccagugcaagccccucaaguacaaggucguccgcgaccccccccuccagauggacgucgccuccauccuccaccucaaccgcaaguucgucgacauggaccucaaccucggcuccgucuaccaguacugggucaucaccaucuccggcaccgaggaguccgagcccucccccgccgucaccuacauccacggcuccggcuacugcggcgacggcaucauccagaaggaccagggcgagcagugcgacgacaugaacaagaucaacggcgacggcugcucccucuucugccgccaggaggucuccuucaacugcaucgacgagcccucccgcugcuacuuccacgacggcgacggcgucugcgaggaguucgagcagaagaccuccaucaaggacugcggcgucuacaccccccagggcuuccucgaccagugggccuccaacgccuccgucucccaccaggaccagcagugccccggcugggucaucaucggccagcccgccgccucccaggucugccgcaccaaggucaucgaccucuccgagggcaucucccagcacgccugguaccccugcaccaucuccuaccccuacucccagcucgcccagaccaccuucuggcuccgcgccuacuucucccagcccauggucgccgccgccgucaucguccaccucgucaccgacggcaccuacuacggcgaccagaagcaggagaccaucuccguccagcuccucgacaccaaggaccagucccacgaccucggccuccacguccucuccugccgcaacaacccccucaucauccccgucguccacgaccucucccagcccuucuaccacucccaggccguccgcgucuccuucuccuccccccucgucgccaucuccggcgucgcccuccgcuccuucgacaacuucgaccccgucacccucuccuccugccagcgcggcgagaccuacucccccgccgagcaguccugcguccacuucgccugcgagaagaccgacugccccgagcucgccgucgagaacgccucccucaacugcuccuccuccgaccgcuaccacggcgcccagugcaccgucuccugccgcaccggcuacguccuccagauccgccgcgacgacgagcucaucaagucccagaccggccccuccgucaccgucaccugcaccgagggcaaguggaacaagcaggucgccugcgagcccgucgacugcuccauccccgaccaccaccaggucuacgccgccuccuucuccugccccgagggcaccaccuucggcucccagugcuccuuccagugccgccaccccgcccagcucaagggcaacaacucccuccucaccugcauggaggacggccucugguccuuccccgaggcccucugcgagcucaugugccucgcccccccccccguccccaacgccgaccuccagaccgcccgcugccgcgagaacaagcacaaggucggcuccuucugcaaguacaagugcaagcccggcuaccacguccccggcuccucccgcaaguccaagaagcgcgccuucaagacccagugcacccaggacggcuccuggcaggagggcgccugcguccccgucaccugcgacccccccccccccaaguuccacggccucuaccagugcaccaacggcuuccaguucaacuccgagugccgcaucaagugcgaggacuccgacgccucccagggccucggcuccaacgucauccacugccgcaaggacggcaccuggaacggcuccuuccacgucugccaggagaugcagggccagugcuccguccccaacgagcucaacuccaaccucaagcuccagugccccgacggcuacgccaucggcuccgagugcgccaccuccugccucgaccacaacuccgaguccaucauccuccccaugaacgucaccguccgcgacaucccccacuggcucaaccccacccgcgucgagcgcgucgucugcaccgccggccucaagugguacccccaccccgcccucauccacugcgucaagggcugcgagcccuucaugggcgacaacuacugcgacgccaucaacaaccgcgccuucugcaacuacgacggcggcgacugcugcaccuccaccgucaagaccaagaaggucacccccuuccccauguccugcgaccuccagggcgacugcgccugccgcgacccccaggcccaggagcacucccgcaaggaccuccgcggcuacucccacggcuga

SEQ ID NO: 47290 - RNA, 1875 nt, Artificial Sequence
  derived and/or modified sequence opt2 from PAPSS1__Homo_sapiens__NP_005434
auggagauccccggcucccucugcaagaaggucaagcucuccaacaacgcccagaacuggggcaugcagcgcgccaccaacgucaccuaccaggcccaccacgucucccgcaacaagcgcggccaggucgucggcacccgcggcggcuuccgcggcugcaccgucuggcucaccggccucuccggcgccggcaagaccaccgucuccauggcccucgaggaguaccucgucugccacggcauccccugcuacacccucgacggcgacaacauccgccagggccucaacaagaaccucggcuucucccccgaggaccgcgaggagaacguccgccgcaucgccgaggucgccaagcucuucgccgacgccggccucgucugcaucaccuccuucaucucccccuacacccaggaccgcaacaacgcccgccagauccacgagggcgccucccuccccuucuucgaggucuucgucgacgccccccuccacgucugcgagcagcgcgacgucaagggccucuacaagaaggcccgcgccggcgagaucaagggcuucaccggcaucgacuccgaguacgagaagcccgaggcccccgagcucguccucaagaccgacuccugcgacgucaacgacugcguccagcaggucgucgagcuccuccaggagcgcgacaucguccccgucgacgccuccuacgaggucaaggagcucuacguccccgagaacaagcuccaccucgccaagaccgacgccgagacccuccccgcccucaagaucaacaaggucgacaugcaguggguccagguccucgccgagggcugggccaccccccucaacggcuucaugcgcgagcgcgaguaccuccagugccuccacuucgacugccuccucgacggcggcgucaucaaccucuccguccccaucguccucaccgccacccacgaggacaaggagcgccucgacggcugcaccgccuucgcccucauguacgagggccgccgcgucgccauccuccgcaaccccgaguucuucgagcaccgcaaggaggagcgcugcgcccgccaguggggcaccaccugcaagaaccaccccuacaucaagauggucauggagcagggcgacuggcucaucggcggcgaccuccagguccucgaccgcgucuacuggaacgacggccucgaccaguaccgccucacccccaccgagcucaagcagaaguucaaggacaugaacgccgacgccgucuucgccuuccagcuccgcaaccccguccacaacggccacgcccuccucaugcaggacacccacaagcagcuccucgagcgcggcuaccgccgccccguccuccuccuccacccccucggcggcuggaccaaggacgacgacgucccccucauguggcgcaugaagcagcacgccgccguccucgaggagggcguccucaaccccgagaccaccgucgucgccaucuuccccucccccaugauguacgccggccccaccgagguccaguggcacugccgcgcccgcauggucgccggcgccaacuucuacaucgucggccgcgaccccgccggcaugccccaccccgagaccggcaaggaccucuacgagcccucccacggcgccaagguccucaccauggcccccggccucaucacccucgagaucguccccuuccgcgucgccgccuacaacaagaagaagaagcgcauggacuacuacgacuccgagcaccacgaggacuucgaguucaucuccggcacccgcaugcgcaagcucgcccgcgagggccagaagccccccgagggcuucauggcccccaaggccuggaccguccucaccgaguacuacaagucccucgagaaggccuga

SEQ ID NO: 47291 - RNA, 1860 nt, Artificial Sequence
  derived and/or modified sequence opt2 from PAPSS2__Homo_sapiens__NP_001015880
auguccggcaucaagaagcagaagaccgagaaccagcagaaguccaccaacgucgucuaccaggcccaccacgucucccgcaacaagcgcggccaggucgucggcacccgcggcggcuuccgcggcugcaccgucuggcucaccggccucuccggcgccggcaagaccaccaucuccuucgcccucgaggaguaccucgucucccacgccauccccugcuacucccucgacggcgacaacguccgccacggccucaaccgcaaccucggcuucucccccggcgaccgcgaggagaacauccgccgcaucgccgaggucgccaagcucuucgccgacgccggccucgucugcaucaccuccuucaucucccccuucgccaaggaccgcgagaacgcccgcaagauccacgaguccgccggccuccccuucuucgagaucuucgucgacgccccccucaacaucugcgagucccgcgacgucaagggccucuacaagcgcgcccgcgccggcgagaucaagggcuucaccggcaucgacuccgacuacgagaagcccgagacccccgagcgcguccucaagaccaaccucuccaccgucuccgacugcguccaccaggucgucgagcuccuccaggagcagaacaucguccccuacaccaucaucaaggacauccacgagcucuucguccccgagaacaagcucgaccacguccgcgccgaggccgagacccuccccucccucuccaucaccaagcucgaccuccaguggguccagguccucuccgagggcugggccaccccccucaagggcuucaugcgcgagaaggaguaccuccaggucaugcacuucgacacccuccucgacggcauggcccuccccgacggcgucaucaacauguccauccccaucguccuccccgucuccgccgaggacaagacccgccucgagggcugcuccaaguucguccucgcccacggcggccgccgcgucgccauccuccgcgacgccgaguucuacgagcaccgcaaggaggagcgcugcucccgcgucuggggcaccaccugcaccaagcacccccacaucaagauggucauggaguccggcgacuggcucgucggcggcgaccuccagguccucgagaagauccgcuggaacgacggccucgaccaguaccgccucaccccccucgagcucaagcagaagugcaaggagaugaacgccgacgccgucuucgccuuccagcuccgcaaccccguccacaacggccacgcccuccucaugcaggacacccgccgccgccuccucgagcgcggcuacaagcaccccguccuccuccuccacccccucggcggcuggaccaaggacgacgacgucccccucgacuggcgcaugaagcagcacgccgccguccucgaggagggcguccucgaccccaaguccaccaucgucgccaucuuccccucccccaugcucuacgccggccccaccgagguccaguggcacugccgcucccgcaugaucgccggcgccaacuucuacaucgucggccgcgaccccgccggcaugccccaccccgagaccaagaaggaccucuacgagcccacccacggcggcaagguccucuccauggcccccggccucaccuccgucgagaucauccccuuccgcgucgccgccuacaacaaggccaagaaggccauggacuucuacgaccccgcccgccacaacgaguucgacuucaucuccggcacccgcaugcgcaagcucgcccgcgagggcgagaacccccccgacggcuucauggcccccaaggccuggaagguccucaccgacuacuaccgcucccucgagaagaacuga

SEQ ID NO: 47292 - RNA, 936 nt, Artificial Sequence
  derived and/or modified sequence opt2 from PAQR3__Homo_sapiens__NP_001035292
augcaccagaagcuccucaaguccgcccacuacaucgagcucggcuccuaccaguacuggcccguccucgucccccgcggcauccgccucuacaccuacgagcagauccccggcucccucaaggacaaccccuacaucaccgacggcuaccgcgccuaccuccccucccgccucugcaucaagucccucuucauccucuccaacgagaccgucaacaucuggucccaccuccucggcuucuuccucuucuucacccucggcaucuacgacaugaccuccguccuccccuccgccuccgccucccgcgaggacuucgucaucugcuccaucugccucuucugcuuccaggucugcaugcucugcuccgucggcuaccaccucuucuccugccaccgcuccgagaagaccugccgccgcuggauggcccucgacuacgccggcaucuccaucggcauccucggcugcuacgucuccggcgucuucuacgccuucuacugcaacaacuacuggcgccaggucuaccucaucaccguccucgccaugauccucgccgucuucuucgcccagauccaccccaacuaccucacccagcaguggcagcgccuccgcuccaucaucuucugcuccgucuccggcuacggcgucauccccacccuccacugggucuggcucaacggcggcaucggcgcccccaucguccaggacuucgccccccgcgucaucgucauguacaugaucgcccuccucgccuuccucuucuacaucuccaagguccccgagcgcuacuuccccggccagcucaacuaccucggcuccucccaccagaucuggcacauccucgccgucgucaugcucuacugguggcaccaguccaccgucuacgucaugcaguaccgccacuccaagcccugccccgacuacgucucccaccucuga

SEQ ID NO: 47293 - RNA, 993 nt, Artificial Sequence
  derived and/or modified sequence opt2 from PAQR5__Homo_sapiens__NP_060175
augcucucccucaagcucccccgccucuucuccaucgaccagaucccccaggucuuccacgagcagggcauccucuucggcuaccgccacccccaguccuccgccaccgccugcauccucucccucuuccagaugaccaacgagacccucaacaucuggacccaccuccuccccuucugguucuucgccuggcgcuucgucaccgcccucuacaugaccgacaucaagaacgacuccuacuccuggcccaugcucgucuacaugugcaccuccugcgucuacccccucgucuccuccugcgcccacaccuucuccuccauguccaagaacgcccgccacaucugcuacuuccucgacuacggcgccgucaaccucuucucccucggcuccgccaucgccuacuccgccuacaccuuccccgacgcccucaugugcaccaccuuccacgacuacuacgucgcccucgccguccucaacaccauccucuccaccggccucuccugcuacucccgcuuccucgagauccagaagccccgccucugcaaggucauccgcguccucgccuucgccuaccccuacaccugggacucccuccccaucuucuaccgccucuuccucuuccccggcgaguccgcccagaacgaggccaccuccuaccaccagaagcacaugaucaugacccuccucgccuccuuccucuacuccgcccaccuccccgagcgccucgcccccggccgcuucgacuacaucggccacucccaccagcucuuccacgucugcgucauccucgccacccacaugcagauggaggccauccuccucgacaagacccuccgcaaggaguggcuccucgccaccuccaagcccuucuccuucucccagaucgccggcgccauccuccucugcaucaucuucucccucuccaacaucaucuacuucuccgccgcccucuaccgcauccccaagcccgagcuccacaagaaggagaccuga

SEQ ID NO: 47294 - RNA, 1041 nt, Artificial Sequence
  derived and/or modified sequence opt2 from PAQR7__Homo_sapiens__XP_011539164
auggccauggcccagaagcucucccaccuccuccccucccuccgccaggucauccaggagccccagcucucccuccagcccgagcccgucuucaccgucgaccgcgccgagguccccccccucuucuggaagcccuacaucuacgccggcuaccgcccccuccaccagaccuggcgcuucuacuuccgcacccucuuccagcagcacaacgaggccgucaacgucuggacccaccuccucgccgcccucguccuccuccuccgccucgcccucuucgucgagaccgucgacuucuggggcgacccccacgcccucccccucuucaucaucguccucgccuccuucaccuaccucuccuucuccgcccucgcccaccuccuccaggccaaguccgaguucuggcacuacuccuucuucuuccucgacuacgucggcgucgccgucuaccaguucggcuccgcccucgcccacuucuacuacgccaucgagcccgccuggcacgcccagguccaggccgucuuccuccccauggccgccuuccucgccuggcucuccugcaucggcuccugcuacaacaaguacauccagaagcccggccuccucggccgcaccugccaggagguccccuccguccucgccuacgcccucgacaucucccccgucguccaccgcaucuucgucuccuccgaccccaccaccgacgaccccgcccuccucuaccacaagugccaggucgucuucuuccuccucgccgccgccuucuucuccaccuucaugcccgagcgcugguuccccggcuccugccacgucuucggccagggccaccagcucuuccacaucuuccucguccucugcacccucgcccagcucgaggccgucgcccucgacuacgaggcccgccgccccaucuacgagccccuccacacccacuggccccacaacuucuccggccucuuccuccucaccgucggcuccuccauccucaccgccuuccuccucucccagcucguccagcgcaagcucgaccagaagaccaaguga

SEQ ID NO: 47295 - RNA, 3618 nt, Artificial Sequence
  derived and/or modified sequence opt2 from PARD3B__Homo_sapiens__NP_001289698
augaaggucaccgucugcuucggccgcaccggcaucgucguccccugcaaggagggccagcuccgcgucggcgagcucacccagcaggcccuccagcgcuaccucaagacccgcgagaagggccccggcuacugggucaagauccaccaccucgaguacaccgacggcggcauccucgaccccgacgacguccucgccgacgucgucgaggacaaggacaagcucaucgccgucuucgaggagcaggagccccuccacaagaucgagucccccuccggcaaccccgccgaccgccagucccccgacgccuucgagaccgaggucgccgcccagcucgccgccuucaagcccaucggcggcgagaucgaggucacccccuccgcccucaagcucggcaccccccuccucguccgccgcuccuccgaccccguccccggcccccccgccgacacccagcccuccgccucccaccccggcggccagucccucaagcucgucguccccgacuccacccagaaccucgaggaccgcgagguccucaacggcguccagaccgagcuccucaccuccccccgcaccaaggacacccucuccgacaugacccgcaccgucgagaucuccggcgagggcggcccccucggcauccacgucguccccuucuucuccucccucuccggccgcauccucggccucuucauccgcggcaucgaggacaacucccgcuccaagcgcgagggccucuuccacgagaacgagugcaucgucaagaucaacaacgucgaccucgucgacaagaccuucgcccaggcccaggacgucuuccgccaggccaugaagucccccuccguccuccuccacguccuccccccccagaaccgcgagcaguacgagaaguccgucaucggcucccucaacaucuucggcaacaacgacggcguccucaagaccaagguccccccccccguccacggcaaguccggccucaagaccgccaaccucaccggcaccgacucccccgagaccgacgccuccgccucccuccagcagaacaaguccccccgcgucccccgccucggcggcaagcccuccucccccucccucuccccccucaugggcuucggcuccaacaagaacgccaagaagaucaagaucgaccucaagaagggccccgagggccucggcuucaccgucgucacccgcgacuccuccauccacggccccggccccaucuucgucaagaacauccuccccaagggcgccgccaucaaggacggccgccuccaguccggcgaccgcauccucgaggucaacggccgcgacgucaccggccgcacccaggaggagcucgucgccaugcuccgcuccaccaagcagggcgagaccgccucccucgucaucgcccgccaggagggccacuuccucccccgcgagcucaagggcgagcccgacugcugcgcccucucccucgagaccuccgagcagcucaccuucgagaucccccucaacgacuccggcuccgccggccucggcgucucccucaagggcaacaagucccgcgagaccggcaccgaccucggcaucuucaucaaguccaucauccacggcggcgccgccuucaaggacggccgccuccgcaugaacgaccagcucaucgccgucaacggcgagucccuccucggcaaguccaaccacgaggccauggagacccuccgccgcuccauguccauggagggcaacauccgcggcaugauccagcucgucauccuccgccgccccgagcgccccauggaggaccccgccgagugcggcgccuucuccaagcccugcuucgagaacugccagaacgccgucaccaccucccgccgcaacgacaacuccauccuccacccccucggcaccugcuccccccaggacaagcagaagggccuccuccuccccaacgacggcugggccgaguccgaggucccccccucccccaccccccacuccgcccucggccucggccucgaggacuacucccacuccuccggcgucgacuccgccgucuacuuccccgaccagcacaucaacuuccgcuccgucacccccgcccgccagcccgaguccaucaaccucaaggccuccaaguccauggaccucguccccgacgaguccaagguccacucccucgccggccagaaguccgagucccccuccaaggacuucggccccacccucggccucaagaaguccuccucccucgagucccuccagaccgccgucgccgagguccgcaagaacgaccuccccuuccaccgcccccgcccccacaugguccgcggccgcggcugcaacgaguccuuccgcgccgccaucgacaaguccuacgacggccccgaggagaucgaggccgacggccucuccgacaaguccucccacuccggccagggcgcccucaacugcgaguccgccccccagggcaacuccgagcucgaggacauggagaacaaggcccgcaaggucaagaagaccaaggagaaggagaagaagaaggagaagggcaagcucaaggucaaggagaagaagcgcaaggaggagaacgaggaccccgagcgcaagaucaagaagaagggcuucggcgccaugcuccgcuucggcaagaagaaggaggacaagggcggcaaggccgagcagaagggcacccucaagcacggcggccuccgcgaggaggagcucgagaagaugaaggaggagcgcgagcgcaucggcgccaagcaccaggagcuccgcgagaagcaggcccgcggccuccucgacuacgccaccggcgccaucggcuccgucuacgacauggacgacgacgagauggaccccaacuacgcccgcgucaaccacuuccgcgagcccugcaccuccgccaacgucuuccgcucccccucccccccccgcgccggccccuucggcuacccccgcgacggccacccccucucccccgagcgcgaccaccucgagggccucuacgccaaggucaacaagcccuaccacccccucguccccgccgacuccggccgccccaccggcggcuccaccgaccgcauccagaagcuccgcaaggaguacuaccaggcccgccgcgagggcuucccccucuacgaggacgacgagggccgcgcccgccccuccgaguacgaccuccucuggguccccggccgcggccccgacggcaacgcccacaaccuccgcuucgagggcauggagcgccaguacgccucccucccccgcggcggccccgccgaccccgucgacuaccuccccgccgccccccgcggccucuacaaggagcgcgagcuccccuacuaccccggcgcccaccccaugcacccccccaagggcuccuacccccgccccaccgagcuccgcgucgccgaccuccgcuacccccagcacuacccccccccccccgccccccagcacaagggccccuuccgccaggacgucccccccucccccccccagcaccagcgcaugcccgccuaccaggagaccggccgccccggcccccgcggcggcucccccgaccaguaccccuaccgcacccaggacucccgccagaagaaccccaugaccgccgccgucuga

SEQ ID NO: 47296 - RNA, 4062 nt, Artificial Sequence
  derived and/or modified sequence opt2 from PARD3__Homo_sapiens__NP_001171714
augaaggucaccgucugcuucggccgcacccgcgucgucguccccugcggcgacggccacaugaaggucuucucccucauccagcaggccgucacccgcuaccgcaaggccaucgccaaggaccccaacuacuggauccagguccaccgccucgagcacggcgacggcggcauccucgaccucgacgacauccucugcgacgucgccgacgacaaggaccgccucgucgccgucuucgacgagcaggacccccaccacggcggcgacggcaccuccgccuccuccaccggcacccagucccccgagaucuucggcuccgagcucggcaccaacaacgucuccgccuuccagcccuaccaggccaccuccgagaucgaggucacccccuccguccuccgcgccaacaugccccuccacguccgccgcuccuccgaccccgcccucaucggccucuccaccuccgucuccgacuccaacuucuccuccgaggagcccucccgcaagaaccccacccgcugguccaccaccgccggcuuccucaagcagaacaccgccggcucccccaagaccugcgaccgcaagaaggacgagaacuaccgcucccucccccgcgacaccuccaacugguccaaccaguuccagcgcgacaacgcccgcuccucccucuccgccucccaccccauggucggcaaguggcucgagaagcaggagcaggacgaggacggcaccgaggaggacaacucccgcgucgagcccgucggccacgccgacaccggccucgagcacauccccaacuucucccucgacgacauggucaagcucgucgagguccccaacgacggcggcccccucggcauccacgucguccccuucuccgcccgcggcggccgcacccucggccuccucgucaagcgccucgagaagggcggcaaggccgagcacgagaaccucuuccgcgagaacgacugcaucguccgcaucaacgacggcgaccuccgcaaccgccgcuucgagcaggcccagcacauguuccgccaggccaugcgcacccccaucaucugguuccacgucguccccgccgccaacaaggagcaguacgagcagcucucccaguccgagaagaacaacuacuacuccucccgcuucucccccgacucccaguacaucgacaaccgcuccgucaacuccgccggccuccacaccguccagcgcgccccccgccucaaccacccccccgagcagaucgacucccacucccgccucccccacuccgcccaccccuccggcaagccccccuccgcccccgccuccgccccccagaacgucuucuccaccaccgucuccuccggcuacaacaccaagaagaucggcaagcgccucaacauccagcucaagaagggcaccgagggccucggcuucuccaucaccucccgcgacgucaccaucggcggcuccgcccccaucuacgucaagaacauccucccccgcggcgccgccauccaggacggccgccucaaggccggcgaccgccucaucgaggucaacggcgucgaccucgucggcaagucccaggaggaggucgucucccuccuccgcuccaccaagauggagggcaccgucucccuccucgucuuccgccaggaggacgccuuccacccccgcgagcucaacgccgagcccucccagaugcagauccccaaggagaccaaggccgaggacgaggacaucguccucacccccgacggcacccgcgaguuccucaccuucgaggucccccucaacgacuccggcuccgccggccucggcgucuccgucaagggcaaccgcuccaaggagaaccacgccgaccucggcaucuucgucaaguccaucaucaacggcggcgccgccuccaaggacggccgccuccgcgucaacgaccagcucaucgccgucaacggcgagucccuccucggcaagaccaaccaggacgccauggagacccuccgccgcuccauguccaccgagggcaacaagcgcggcaugauccagcucaucgucgcccgccgcaucuccaagugcaacgagcucaagucccccggcuccccccccggccccgagcuccccaucgagaccgcccucgacgaccgcgagcgccgcaucucccacucccucuacuccggcaucgagggccucgacgagucccccucccgcaacgccgcccucucccgcaucaugggcaaguaccagcucucccccaccgucaacaugccccaggacgacaccgucaucaucgaggacgaccgccuccccguccuccccccccaccucuccgaccaguccuccuccuccucccacgacgacgucggcuucgucaccgccgacgccggcaccugggccaaggccgccaucuccgacuccgccgacugcucccucucccccgacgucgaccccguccucgccuuccagcgcgagggcuucggccgccaguccauguccgagaagcgcaccaagcaguucuccgacgccucccagcucgacuucgucaagacccgcaaguccaaguccauggaccucggcaucgccgacgagaccaagcucaacaccgucgacgaccagaaggccggcucccccucccgcgacgucggccccucccucggccucaagaaguccuccucccucgagucccuccagaccgccgucgccgaggucacccucaacggcgacauccccuuccaccgcccccgcccccgcaucauccgcggccgcggcugcaacgaguccuuccgcgccgccaucgacaaguccuacgacaagcccgccgucgacgacgacgacgagggcauggagacccucgaggaggacaccgaggaguccucccgcuccggccgcgaguccgucuccaccgccuccgaccagcccucccacucccucgagcgccagaugaacggcaaccaggagaagggcgacaagaccgaccgcaagaaggacaagaccggcaaggagaagaagaaggaccgcgacaaggagaaggacaagaugaaggccaagaagggcaugcucaagggccucggcgacauguuccgcuucggcaagcaccgcaaggacgacaagaucgagaagaccggcaagaucaagauccaggaguccuucaccuccgaggaggagcgcauccgcaugaagcaggagcaggagcgcauccaggccaagacccgcgaguuccgcgagcgccaggcccgcgagcgcgacuacgccgagauccaggacuuccaccgcaccuucggcugcgacgacgagcucauguacggcggcgucuccuccuacgagggcuccauggcccucaacgcccgcccccaguccccccgcgagggccacaugauggacgcccucuacgcccaggucaagaagccccgcaacuccaagcccucccccgucgacuccaaccgcuccacccccuccaaccacgaccgcauccagcgccuccgccaggaguuccagcaggccaagcaggacgaggacgucgaggaccgccgccgcaccuacuccuucgagcagcccuggcccaacgcccgccccgccacccaguccggccgccacuccgucuccgucgagguccagaugcagcgccagcgccaggaggagcgcgaguccucccagcaggcccagcgccaguacuccucccucccccgccagucccgcaagaacgccuccuccgucucccaggacuccugggagcagaacuacucccccggcgagggcuuccaguccgccaaggagaacccccgcuacuccuccuaccagggcucccgcaacggcuaccucggcggccacggcuucaacgcccgcgucaugcucgagacccaggagcuccuccgccaggagcagcgccgcaaggagcagcagaugaagaagcagccccccuccgagggccccuccaacuacgacuccuacaagaagguccaggaccccuccuacgccccccccaagggccccuuccgccaggacgucccccccucccccucccaggucgcccgccucaaccgccuccagacccccgagaagggccgccccuucuacuccuga

SEQ ID NO: 47297 - RNA, 1038 nt, Artificial Sequence
  derived and/or modified sequence opt2 from PARD6A__Homo_sapiens__NP_001032358
auggcccgcccccagcgcacccccgcccgcucccccgacuccaucgucgaggucaaguccaaguucgacgccgaguuccgccgcuucgcccucccccgcgccuccgucuccggcuuccaggaguucucccgccuccuccgcgccguccaccagauccccggccucgacguccuccucggcuacaccgacgcccacggcgaccuccucccccucaccaacgacgacucccuccaccgcgcccucgccuccggcccccccccccuccgccuccucguccagaagcgcgaggccgacuccuccggccucgccuucgccuccaacucccuccagcgccgcaagaagggccuccuccuccgccccgucgccccccuccgcacccgccccccccuccucaucucccucccccaggacuuccgccaggucuccuccgucaucgacgucgaccuccuccccgagacccaccgccgcguccgccuccacaagcacggcuccgaccgcccccucggcuucuacauccgcgacggcauguccguccgcgucgccccccagggccucgagcgcguccccggcaucuucaucucccgccucguccgcggcggccucgccgaguccaccggccuccucgccgucuccgacgagauccucgaggucaacggcaucgaggucgccggcaagacccucgaccaggucaccgacaugauggucgccaacucccacaaccucaucgucaccgucaagcccgccaaccagcgcaacaacgucguccgcggcgccuccggccgccucaccggcccccccuccgccggccccggccccgccgagcccgacuccgacgacgacuccuccgaccucgucaucgagaaccgccagccccccuccuccaacggccucucccagggcccccccugcugggaccuccaccccggcugccgccaccccggcacccgcuccucccuccccucccucgacgaccaggagcaggccuccuccggcuggggcucccgcauccgcggcgacggcuccggcuucucccucuga

SEQ ID NO: 47298 - RNA, 1119 nt, Artificial Sequence
  derived and/or modified sequence opt2 from PARD6B__Homo_sapiens__NP_115910
augaaccgcucccaccgccacggcgccggcuccggcugccucggcaccauggaggucaaguccaaguucggcgccgaguuccgccgcuucucccucgagcgcuccaagcccggcaaguucgaggaguucuacggccuccuccagcacguccacaagauccccaacgucgacguccucgucggcuacgccgacauccacggcgaccuccuccccaucaacaacgacgacaacuaccacaaggccgucuccaccgccaacccccuccuccgcaucuucauccagaagaaggaggaggccgacuacuccgccuucggcaccgacacccucaucaagaagaagaacguccucaccaacguccuccgccccgacaaccaccgcaagaagccccacaucgucaucuccaugccccaggacuuccgccccgucuccuccaucaucgacgucgacauccuccccgagacccaccgccgcguccgccucuacaaguacggcaccgagaagccccucggcuucuacauccgcgacggcuccuccguccgcgucaccccccacggccucgagaagguccccggcaucuucaucucccgccucguccccggcggccucgcccaguccaccggccuccucgccgucaacgacgagguccucgaggucaacggcaucgaggucuccggcaagucccucgaccaggucaccgacaugaugaucgccaacucccgcaaccucaucaucaccguccgccccgccaaccagcgcaacaacgucguccgcaacucccgcaccuccggcuccuccggccaguccaccgacaacucccuccucggcuacccccagcagaucgagcccuccuucgagcccgaggacgaggacuccgaggaggacgacaucaucaucgaggacaacggcgucccccagcagauccccaaggccguccccaacaccgagucccucgagucccucacccagaucgagcucuccuucgaguccggccagaacggcuucauccccuccaacgaggucucccucgccgccaucgccuccuccuccaacaccgaguucgagacccacgcccccgaccagaagcuccucgaggaggacggcaccaucaucacccucuga

SEQ ID NO: 47299 - RNA, 2685 nt, Artificial Sequence
  derived and/or modified sequence opt2 from PARG__Homo_sapiens__NP_001290415
auggacaccaagggcaucaagaccgccgaguccgagucccucgacuccaaggagaacaacaacacccgcaucgaguccaugauguccuccguccagaaggacaacuucuaccagcacaacgucgagaagcucgagaacgucucccagcucucccucgacaagucccccaccgagaaguccacccaguaccucaaccagcaccagaccgccgccaugugcaaguggcagaacgagggcaagcacaccgagcagcuccucgaguccgagccccagaccgucacccucguccccgagcaguucuccaacgccaacaucgaccgcuccccccagaacgacgaccacuccgacaccgacuccgaggagaaccgcgacaaccagcaguuccucaccaccgucaagcucgccaacgccaagcagaccaccgaggacgagcaggcccgcgaggccaagucccaccagaagugcuccaaguccugcgaccccggcgaggacugcgccuccugccagcaggacgagaucgacgucguccccgaguccccccucuccgacgucggcuccgaggacgucggcaccggccccaagaacgacaacaagcucacccgccaggaguccugccucggcaacuccccccccuucgagaaggaguccgagcccgagucccccauggacgucgacaacuccaagaacuccugccaggacuccgaggccgacgaggagaccucccccggcuucgacgagcaggaggacggcuccuccucccagaccgccaacaagcccucccgcuuccaggcccgcgacgccgacaucgaguuccgcaagcgcuacuccaccaagggcggcgagguccgccuccacuuccaguucgagggcggcgagucccgcaccggcaugaacgaccucaacgccaagcuccccggcaacaucuccucccucaacgucgagugccgcaacuccaagcagcacggcaagaaggacuccaagaucaccgaccacuucaugcgccuccccaaggccgaggaccgccgcaaggagcagugggagaccaagcaccagcgcaccgagcgcaagauccccaaguacguccccccccaccucucccccgacaagaaguggcucggcacccccaucgaggagaugcgccgcaugccccgcugcggcauccgccucccccuccuccgccccuccgccaaccacaccgucaccauccgcgucgaccuccuccgcgccggcgagguccccaagcccuuccccacccacuacaaggaccucugggacaacaagcacgucaagaugcccugcuccgagcagaaccucuaccccgucgaggacgagaacggcgagcgcaccgccggcucccgcugggagcucauccagaccgcccuccucaacaaguucacccgcccccagaaccucaaggacgccauccucaaguacaacgucgccuacuccaagaagugggacuucaccgcccucaucgacuucugggacaagguccucgaggaggccgaggcccagcaccucuaccaguccauccuccccgacauggucaagaucgcccucugccuccccaacaucugcacccagcccaucccccuccucaagcagaagaugaaccacuccaucaccaugucccaggagcagaucgccucccuccucgccaacgccuucuucugcaccuucccccgccgcaacgccaagaugaaguccgaguacuccuccuaccccgacaucaacuucaaccgccucuucgagggccgcuccucccgcaagcccgagaagcucaagacccucuucugcuacuuccgccgcgucaccgagaagaagcccaccggccucgucaccuucacccgccagucccucgaggacuuccccgagugggagcgcugcgagaagccccucacccgccuccacgucaccuacgagggcaccaucgaggagaacggccagggcaugcuccaggucgacuucgccaaccgcuucgucggcggcggcgucaccuccgccggccucguccaggaggagauccgcuuccucaucaaccccgagcucaucaucucccgccucuucaccgagguccucgaccacaacgagugccucaucaucaccggcaccgagcaguacuccgaguacaccggcuacgccgagaccuaccgcuggucccgcucccacgaggacggcuccgagcgcgacgacuggcagcgccgcugcaccgagaucgucgccaucgacgcccuccacuuccgccgcuaccucgaccaguucguccccgagaagaugcgccgcgagcucaacaaggccuacugcggcuuccuccgccccggcgucuccuccgagaaccucuccgccgucgccaccggcaacuggggcugcggcgccuucggcggcgacgcccgccucaaggcccucauccagauccucgccgccgccgccgccgagcgcgacgucgucuacuucaccuucggcgacuccgagcucaugcgcgacaucuacuccaugcacaucuuccucaccgagcgcaagcucaccgucggcgacgucuacaagcuccuccuccgcuacuacaacgaggagugccgcaacugcuccacccccggccccgacaucaagcucuaccccuucaucuaccacgccgucgaguccugcgccgagaccgccgaccacuccggccagcgcaccggcaccuga

SEQ ID NO: 47300 - RNA, 1398 nt, Artificial Sequence
  derived and/or modified sequence opt2 from PARK2__Homo_sapiens__NP_004553
augaucgucuucguccgcuucaacuccucccacggcuuccccgucgaggucgacuccgacaccuccaucuuccagcucaaggaggucgucgccaagcgccagggcguccccgccgaccagcuccgcgucaucuucgccggcaaggagcuccgcaacgacuggaccguccagaacugcgaccucgaccagcaguccaucguccacaucguccagcgccccuggcgcaagggccaggagaugaacgccaccggcggcgacgacccccgcaacgccgccggcggcugcgagcgcgagccccagucccucacccgcgucgaccucuccuccuccguccuccccggcgacuccgucggccucgccgucauccuccacaccgacucccgcaaggacuccccccccgccggcucccccgccggccgcuccaucuacaacuccuucuacgucuacugcaagggccccugccagcgcguccagcccggcaagcuccgcguccagugcuccaccugccgccaggccacccucacccucacccagggccccuccugcugggacgacguccucauccccaaccgcauguccggcgagugccaguccccccacugccccggcaccuccgccgaguucuucuucaagugcggcgcccaccccaccuccgacaaggagaccuccgucgcccuccaccucaucgccaccaacucccgcaacaucaccugcaucaccugcaccgacguccgcucccccguccucgucuuccagugcaacucccgccacgucaucugccucgacugcuuccaccucuacugcgucacccgccucaacgaccgccaguucguccacgacccccagcucggcuacucccuccccugcgucgccggcugccccaacucccucaucaaggagcuccaccacuuccgcauccucggcgaggagcaguacaaccgcuaccagcaguacggcgccgaggagugcguccuccagaugggcggcguccucugcccccgccccggcugcggcgccggccuccuccccgagcccgaccagcgcaaggucaccugcgagggcggcaacggccucggcugcggcuucgccuucugccgcgagugcaaggaggccuaccacgagggcgagugcuccgccgucuucgaggccuccggcaccaccacccaggccuaccgcgucgacgagcgcgccgccgagcaggcccgcugggaggccgccuccaaggagaccaucaagaagaccaccaagcccugcccccgcugccacguccccgucgagaagaacggcggcugcaugcacaugaagugcccccagccccagugccgccucgaguggugcuggaacugcggcugcgaguggaaccgcgucugcaugggcgaccacugguucgacgucuga

SEQ ID NO: 47301 - RNA, 990 nt, Artificial Sequence
  derived and/or modified sequence opt2 from PARL__Homo_sapiens__NP_001032728
auggccuggcgcggcugggcccagcgcggcuggggcugcggccaggccuggggcgccuccgucggcggccgcuccugcgaggagcucaccgccguccucacccccccccagcuccucggccgccgcuucaacuucuucauccagcagaagugcggcuuccgcaaggccccccgcaaggucgagccccgccgcuccgaccccggcaccuccggcgaggccuacaagcgcuccgcccucaucccccccgucgaggagaccgucuucuaccccucccccuaccccauccgcucccucaucaagccccucuucuucaccgucggcuucaccggcugcgccuucggcuccgccgccaucuggcaguacgagucccucaagucccgcguccaguccuacuucgacggcaucaaggccgacuggcucgacuccauccgcccccagaaggagggcgacuuccgcaaggagaucaacaagugguggaacaaccucuccgacggccagcgcaccgucaccggcaucaucgccgccaacguccucgucuucugccucuggcgcguccccucccuccagcgcaccaugauccgcuacuucaccuccaaccccgccuccuccgucaucuccaacuucgucuccuacgucggcaaggucgccaccggccgcuacggccccucccucggcgccuccggcgccaucaugaccguccucgccgccgucugcaccaagauccccgagggccgccucgccaucaucuuccuccccauguucaccuucaccgccggcaacgcccucaaggccaucaucgccauggacaccgccggcaugauccucggcuggaaguucuucgaccacgccgcccaccucggcggcgcccucuucggcaucugguacgucaccuacggccacgagcucaucuggaagaaccgcgagccccucgucaagaucuggcacgagauccgcaccaacggccccaagaagggcggcggcuccaaguga

SEQ ID NO: 47302 - RNA, 933 nt, Artificial Sequence
  derived and/or modified sequence opt2 from PARM1__Homo_sapiens__NP_056208
auggucuacaagacccucuucgcccucugcauccucaccgccggcuggcgcguccagucccuccccaccuccgccccccucuccgucucccuccccaccaacaucgucccccccaccaccaucuggaccuccuccccccagaacaccgacgccgacaccgccucccccuccaacggcacccacaacaacuccguccuccccgucaccgccuccgcccccaccucccuccuccccaagaacaucuccaucgagucccgcgaggaggagaucaccucccccggcuccaacugggagggcaccaacaccgaccccucccccuccggcuucuccuccaccuccggcggcguccaccucaccaccacccucgaggagcacuccuccggcacccccgaggccggcgucgccgccacccucucccaguccgccgccgagccccccacccucaucuccccccaggcccccgccuccucccccuccucccucuccaccuccccccccgaggucuucuccgccuccgucaccaccaaccacuccuccaccgucaccuccacccagcccaccggcgcccccaccgcccccgagucccccaccgaggaguccuccuccgaccacacccccaccucccacgccaccgccgagcccgucccccaggagaagaccccccccaccaccgucuccggcaaggucaugugcgagcucaucgacauggagaccaccaccaccuucccccgcgucaucaugcaggaggucgagcacgcccucuccuccggcuccaucgccgccaucaccgucaccgucaucgccgucguccuccucgucuucggcgucgccgccuaccucaagauccgccacuccuccuacggccgccuccucgacgaccacgacuacggcuccuggggcaacuacaacaacccccucuacgacgacuccuga

SEQ ID NO: 47303 - RNA, 1737 nt, Artificial Sequence
  derived and/or modified sequence opt2 from PARN__Homo_sapiens__NP_001127949
auggacuuccuccucuuccaguucggccucugcaccuucaaguacgacuacaccgacuccaaguacaucaccaaguccuucaacuucuacgucuuccccaagcccuucaaccgcuccucccccgacgucaaguucgucugccaguccuccuccaucgacuuccucgccucccagggcuucgacuucaacaaggucuuccgcaacggcauccccuaccucaaccaggaggaggagcgccagcuccgcgagcaguacgacgagaagcgcucccaggccaacggcgccggcgcccucuccuacgucucccccaacaccuccaagugccccgucaccauccccgaggaccagaagaaguucaucgaccaggucgucgagaagaucgaggaccuccuccaguccgaggagaacaagaaccucgaccucgagcccugcaccggcuuccagcgcaagcucaucuaccagacccucuccuggaaguaccccaagggcauccacgucgagacccucgagaccgagaagaaggagcgcuacaucgucaucuccaaggucgacgaggaggagcgcaagcgccgcgagcagcagaagcacgccaaggagcaggaggagcucaacgacgccgucggcuucucccgcgucauccacgccaucgccaacuccggcaagcucgucaucggccacaacaugcuccucgacgucaugcacaccguccaccaguucuacugcccccuccccgccgaccucuccgaguucaaggagaugaccaccugcgucuucccccgccuccucgacaccaagcucauggccuccacccagcccuucaaggacaucaucaacaacaccucccucgccgagcucgagaagcgccucaaggagacccccuucaacccccccaaggucgaguccgccgagggcuuccccuccuacgacaccgccuccgagcagcuccacgaggccggcuacgacgccuacaucaccggccucugcuucaucuccauggccaacuaccucggcuccuuccucuccccccccaagauccacgucuccgcccgcuccaagcucaucgagcccuucuucaacaagcucuuccucaugcgcgucauggacauccccuaccucaaccucgagggccccgaccuccagcccaagcgcgaccacguccuccacgucaccuuccccaaggaguggaagaccuccgaccucuaccagcucuucuccgccuucggcaacauccagaucuccuggaucgacgacaccuccgccuucgucucccucucccagcccgagcaggucaagaucgccgucaacaccuccaaguacgccgaguccuaccgcauccagaccuacgccgaguacaugggccgcaagcaggaggagaagcagaucaagcgcaaguggaccgaggacuccuggaaggaggccgacuccaagcgccucaacccccagugcauccccuacacccuccagaaccacuacuaccgcaacaacuccuucaccgcccccuccaccgucggcaagcgcaaccucucccccucccaggaggaggccggccucgaggacggcgucuccggcgagaucuccgacaccgagcucgagcagaccgacuccugcgccgagccccucuccgagggccgcaagaaggccaagaagcucaagcgcaugaagaaggagcucucccccgccggcuccaucuccaagaacucccccgccacccucuucgagguccccgacaccugguga

SEQ ID NO: 47304 - RNA, 2106 nt, Artificial Sequence
  derived and/or modified sequence opt2 from PARP12__Homo_sapiens__NP_073587
auggcccaggccggcgucgucggcgaggucacccagguccucugcgccgccggcggcgcccucgagcuccccgagcuccgccgccgccuccgcaugggccucuccgccgacgcccucgagcgccuccuccgccagcgcggccgcuucgucgucgccguccgcgccggcggcgccgccgccgcccccgagcgcgucguccucgccgccuccccccuccgccucugccgcgcccaccagggcuccaagcccggcugcgucggccucugcgcccagcuccaccucugccgcuucauggucuacggcgccugcaaguuccuccgcgccggcaagaacugccgcaacucccacucccucaccaccgagcacaaccucuccguccuccgcacccacggcgucgaccaccucuccuacaacgagcucugccagcuccucuuccagaacgaccccuggcuccuccccgagaucugccagcacuacaacaagggcgacggcccccacggcuccugcgccuuccagaagcagugcaucaagcuccacaucugccaguacuuccuccagggcgagugcaaguucggcaccuccugcaagcgcucccacgacuucuccaacuccgagaaccucgagaagcucgagaagcucggcauguccuccgaccucgucucccgccuccccaccaucuaccgcaacgcccacgacaucaagaacaaguccuccgcccccucccgcguccccccccucuucgucccccagggcaccuccgagcgcaaggacuccuccggcuccgucucccccaacacccucucccaggaggagggcgaccagaucugccucuaccacauccgcaaguccugcuccuuccaggacaagugccaccgcguccacuuccaccuccccuaccgcuggcaguuccucgaccgcggcaagugggaggaccucgacaacauggagcucaucgaggaggccuacugcaaccccaagaucgagcgcauccucugcuccgaguccgccuccaccuuccacucccacugccucaacuucaacgccaugaccuacggcgccacccaggcccgccgccucuccaccgccuccuccgucaccaagcccccccacuucauccucaccaccgacuggaucugguacugguccgacgaguucggcuccuggcaggaguacggccgccagggcaccguccaccccgucaccaccgucuccuccuccgacgucgagaaggccuaccucgccuacugcacccccggcuccgacggccaggccgccacccucaaguuccaggccggcaagcacaacuacgagcucgacuucaaggccuucguccagaagaaccucgucuacggcaccaccaagaaggucugccgccgccccaaguacgucuccccccaggacgucaccaccaugcagaccugcaacaccaaguuccccggccccaaguccauccccgacuacugggacuccuccgcccuccccgaccccggcuuccagaagaucacccucuccuccuccuccgaggaguaccagaaggucuggaaccucuucaaccgcacccuccccuucuacuucguccagaagaucgagcgcguccagaaccucgcccucugggaggucuaccaguggcagaagggccagaugcagaagcagaacggcggcaaggccgucgacgagcgccagcucuuccacggcaccuccgccaucuucgucgacgccaucugccagcagaacuucgacuggcgcgucugcggcguccacggcaccuccuacggcaagggcuccuacuucgcccgcgacgccgccuacucccaccacuacuccaaguccgacacccagacccacaccauguuccucgcccgcguccucgucggcgaguucguccgcggcaacgccuccuucguccgcccccccgccaaggagggcugguccaacgccuucuacgacuccugcgucaacuccgucuccgaccccuccaucuucgucaucuucgagaagcaccaggucuaccccgaguacgucauccaguacaccaccuccuccaagcccuccgucacccccuccauccuccucgcccucggcucccucuucuccucccgccaguga

SEQ ID NO: 47305 - RNA, 5406 nt, Artificial Sequence
  derived and/or modified sequence opt2 from PARP14__Homo_sapiens__NP_060024
auggccguccccggcuccuucccccuccucgucgagggcuccuggggccccgacccccccaagaaccucaacaccaagcuccagauguacuuccagucccccaagcgcuccggcggcggcgagugcgagguccgccaggacccccgcucccccucccgcuuccucgucuucuucuaccccgaggacguccgccagaagguccucgagcgcaagaaccacgagcucgucuggcagggcaagggcaccuucaagcucaccguccagcuccccgccacccccgacgagaucgaccacgucuucgaggaggagcuccucaccaaggaguccaagaccaaggaggacgucaaggagcccgacgucuccgaggagcucgacaccaagcucccccucgacggcggccucgacaagauggaggacauccccgaggagugcgagaacaucuccucccucgucgccuucgagaaccucaaggccaacgucaccgacaucaugcucauccuccucgucgagaacaucuccggccucuccaacgacgacuuccaggucgagaucauccgcgacuucgacgucgccgucgucaccuuccagaagcacaucgacaccauccgcuucgucgacgacugcaccaagcaccacuccaucaagcagcuccagcucuccccccgccuccucgaggucaccaacaccauccgcgucgagaaccucccccccggcgccgacgacuacucccucaagcucuucuucgagaaccccuacaacggcggcggccgcgucgccaacgucgaguacuuccccgaggaguccuccgcccucaucgaguucuucgaccgcaagguccucgacaccaucauggccaccaagcucgacuucaacaagaugccccucuccgucuuccccuacuacgccucccucggcaccgcccucuacggcaaggagaagccccucaucaagcuccccgcccccuucgaggagucccucgaccucccccucuggaaguuccuccagaagaagaaccaccucaucgaggagaucaacgacgagaugcgccgcugccacugcgagcucaccuggucccagcucuccggcaaggucaccauccgccccgccgccacccucgucaacgagggccgcccccgcaucaagaccuggcaggccgacaccuccaccacccucuccuccauccgcuccaaguacaaggucaaccccaucaaggucgaccccaccaugugggacaccaucaagaacgacgucaaggacgaccgcauccucaucgaguucgacacccucaaggagauggucauccucgccggcaaguccgaggacguccaguccaucgagguccagguccgcgagcucaucgaguccaccacccagaagaucaagcgcgaggagcagucccucaaggagaagaugaucaucucccccggccgcuacuuccuccucugccacuccucccuccucgaccaccuccucaccgagugccccgagaucgagaucugcuacgaccgcgucacccagcaccucugccucaagggccccuccgccgacgucuacaaggccaagugcgagauccaggagaaggucuacaccauggcccagaagaacauccaggucucccccgagaucuuccaguuccuccagcaggucaacuggaaggaguucuccaagugccucuucaucgcccagaagauccucgcccucuacgagcucgagggcaccaccguccuccucaccuccugcuccuccgaggcccuccucgaggccgagaagcagaugcucuccgcccucaacuacaagcgcaucgaggucgagaacaaggagguccuccacggcaagaaguggaagggccucacccacaaccuccucaagaagcagaacuccucccccaacaccgucaucaucaacgagcucaccuccgagaccaccgccgaggucaucaucaccggcugcgucaaggaggucaacgagaccuacaagcuccucuucaacuucgucgagcagaacaugaagaucgagcgccucgucgaggucaagcccucccucgucaucgacuaccucaagaccgagaagaagcucuucuggcccaagaucaagaaggucaacguccaggucuccuucaaccccgagaacaagcagaagggcauccuccucaccggcuccaagaccgagguccucaaggccgucgacaucgucaagcaggucugggacuccgucugcgucaaguccguccacaccgacaagcccggcgccaagcaguucuuccaggacaaggcccgcuucuaccaguccgagaucaagcgccucuucggcugcuacaucgagcuccaggagaacgaggucaugaaggagggcggcucccccgccggccagaagugcuucucccgcaccguccucgcccccggcgucguccucaucguccagcagggcgaccucgcccgccuccccgucgacgucgucgucaacgccuccaacgaggaccucaagcacuacggcggccucgccgccgcccucuccaaggccgccggccccgagcuccaggccgacugcgaccagaucgucaagcgcgagggccgccuccuccccggcaacgccaccaucuccaaggccggcaagcuccccuaccaccacgucauccacgccgucggcccccgcugguccggcuacgaggccccccgcugcgucuaccuccuccgccgcgccguccagcucucccucugccucgccgagaaguacaaguaccgcuccaucgccauccccgccaucuccuccggcgucuucggcuucccccucggccgcugcgucgagaccaucgucuccgccaucaaggagaacuuccaguucaagaaggacggccacugccucaaggagaucuaccucgucgacgucuccgagaagaccgucgaggccuucgccgaggccgucaagaccgucuucaaggccacccuccccgacaccgccgccccccccggccucccccccgccgccgccggccccggcaagaccuccugggagaagggcucccucgucucccccggcggccuccagaugcuccucgucaaggagggcguccagaacgccaagaccgacgucgucgucaacuccgucccccucgaccucguccucucccgcggcccccucuccaagucccuccucgagaaggccggccccgagcuccaggaggagcucgacaccgucggccagggcgucgccgucuccaugggcaccguccucaagaccuccuccuggaaccucgacugccgcuacguccuccacgucgucgcccccgaguggcgcaacggcuccaccuccucccucaagaucauggaggacaucauccgcgagugcauggagaucaccgagucccucucccucaaguccaucgccuuccccgccaucggcaccggcaaccucggcuuccccaagaacaucuucgccgagcucaucaucuccgaggucuucaaguucuccuccaagaaccagcucaagacccuccaggagguccacuuccuccuccaccccuccgaccacgagaacauccaggccuucuccgacgaguucgcccgccgcgccaacggcaaccucgucuccgacaagauccccaaggccaaggacacccagggcuucuacggcaccgucuccucccccgacuccggcgucuacgagaugaagaucggcuccaucaucuuccaggucgccuccggcgacaucaccaaggaggaggccgacgucaucgucaacuccaccuccaacuccuucaaccucaaggccggcgucuccaaggccauccucgagugcgccggccagaacgucgagcgcgagugcucccagcaggcccagcagcgcaagaacgacuacaucaucaccggcggcggcuuccuccgcugcaagaacaucauccacgucaucggcggcaacgacgucaaguccuccgucuccuccguccuccaggagugcgagaagaagaacuacuccuccaucugccuccccgccaucggcaccggcaacgccaagcagcaccccgacaaggucgccgaggccaucaucgacgccaucgaggacuucguccagaagggcuccgcccaguccgucaagaaggucaaggucgucaucuuccucccccagguccucgacgucuucuacgccaacaugaagaagcgcgagggcacccagcucuccucccagcaguccgucauguccaagcucgccuccuuccucggcuucuccaagcaguccccccagaagaagaaccaccucguccucgagaagaagaccgaguccgccaccuuccgcgucugcggcgagaacgucaccugcgucgaguacgccaucuccuggcuccaggaccucaucgagaaggagcagugccccuacaccuccgaggacgagugcaucaaggacuucgacgagaaggaguaccaggagcucaacgagcuccagaagaagcucaacaucaacaucucccucgaccacaagcgcccccucaucaagguccucggcaucucccgcgacgucaugcaggcccgcgacgagaucgaggccaugaucaagcgcguccgccucgccaaggagcaggagucccgcgccgacugcaucuccgaguucaucgaguggcaguacaacgacaacaacaccucccacugcuucaacaagaugaccaaccucaagcucgaggacgcccgccgcgagaagaagaagaccgucgacgucaagaucaaccaccgccacuacaccgucaaccucaacaccuacaccgccaccgacaccaagggccacucccucuccguccagcgccucaccaaguccaaggucgacauccccgcccacugguccgacaugaagcagcagaacuucugcgucgucgagcuccuccccuccgaccccgaguacaacaccgucgccuccaaguucaaccagaccugcucccacuuccgcaucgagaagaucgagcgcauccagaaccccgaccucuggaacuccuaccaggccaagaagaagaccauggacgccaagaacggccagaccaugaacgagaagcagcucuuccacggcaccgacgccggcuccgucccccacgucaaccgcaacggcuucaaccgcuccuacgccggcaagaacgccgucgccuacggcaagggcaccuacuucgccgucaacgccaacuacuccgccaacgacaccuacucccgccccgacgccaacggccgcaagcacgucuacuacguccgcguccucaccggcaucuacacccacggcaaccacucccucaucgucccccccuccaagaacccccagaaccccaccgaccucuacgacaccgucaccgacaacguccaccaccccucccucuucgucgccuucuacgacuaccaggccuaccccgaguaccucaucaccuuccgcaaguga

SEQ ID NO: 47306 - RNA, 2037 nt, Artificial Sequence
  derived and/or modified sequence opt2 from PARP15__Homo_sapiens__NP_001106995
auggccgcccccggcccccuccccgccgccgcccucucccccggcgcccccaccccccgcgagcucaugcacggcgucgccggcgucaccucccgcgccggccgcgaccgcgaggccggcuccguccuccccgccggcaaccgcggcgcccgcaaggccucccgccgcuccuccucccgcuccaugucccgcgacaacaaguucuccaagaaggacugccucuccauccgcaacgucgucgccuccauccagaccaaggagggccucaaccucaagcucaucuccggcgacguccucuacaucugggccgacgucaucgucaacuccguccccaugaaccuccagcucggcggcggcccccucucccgcgccuuccuccagaaggccggccccaugcuccagaaggagcucgacgaccgccgccgcgagaccgaggagaaggucggcaacaucuucaugaccuccggcugcaaccucgacugcaaggccguccuccacgccgucgcccccuacuggaacaacggcgccgagaccuccuggcagaucauggccaacaucaucaagaagugccucaccaccgucgagguccucuccuucuccuccaucaccuuccccaugaucggcaccggcucccuccaguuccccaaggccgucuucgccaagcucauccucuccgaggucuucgaguacuccuccuccacccgccccaucaccuccccccuccaggagguccacuuccucgucuacaccaacgacgacgagggcugccaggccuuccucgacgaguucaccaacuggucccgcaucaaccccaacaaggcccgcauccccauggccggcgacacccagggcgucgucggcaccgucuccaagcccugcuucaccgccuacgagaugaagaucggcgccaucaccuuccaggucgccaccggcgacaucgccaccgagcaggucgacgucaucgucaacuccaccgcccgcaccuucaaccgcaaguccggcgucucccgcgccauccucgagggcgccggccaggccgucgaguccgagugcgccguccucgccgcccagccccaccgcgacuucaucaucacccccggcggcugccucaagugcaagaucaucauccacguccccggcggcaaggacguccgcaagaccgucaccuccguccucgaggagugcgagcagcgcaaguacaccuccgucucccuccccgccaucggcaccggcaacgccggcaagaaccccaucaccgucgccgacaacaucaucgacgccaucgucgacuucuccucccagcacuccacccccucccucaagaccgucaaggucgucaucuuccagcccgagcuccucaacaucuucuacgacuccaugaagaagcgcgaccucuccgccucccucaacuuccaguccaccuucuccaugaccaccugcaaccuccccgagcacuggaccgacaugaaccaccagcucuucugcaugguccagcucgagcccggccaguccgaguacaacaccaucaaggacaaguucacccgcaccugcuccuccuacgccaucgagaagaucgagcgcauccagaacgccuuccucuggcaguccuaccaggucaagaagcgccagauggacaucaagaacgaccacaagaacaacgagcgccuccucuuccacggcaccgacgccgacuccguccccuacgucaaccagcacggcuucaaccgcuccugcgccggcaagaacgccgucuccuacggcaagggcaccuacuucgccgucgacgccuccuacuccgccaaggacaccuacuccaagcccgacuccaacggccgcaagcacauguacgucguccgcguccucaccggcgucuucaccaagggccgcgccggccucgucacccccccccccaagaacccccacaaccccaccgaccucuucgacuccgucaccaacaacacccgcucccccaagcucuucgucgucuucuucgacaaccaggccuaccccgaguaccucaucaccuucaccgccuga

SEQ ID NO: 47307 - RNA, 3045 nt, Artificial Sequence
  derived and/or modified sequence opt2 from PARP1__Homo_sapiens__NP_001609
auggccgaguccuccgacaagcucuaccgcgucgaguacgccaaguccggccgcgccuccugcaagaagugcuccgaguccauccccaaggacucccuccgcauggccaucaugguccagucccccauguucgacggcaaggucccccacugguaccacuucuccugcuucuggaaggucggccacuccauccgccaccccgacgucgaggucgacggcuucuccgagcuccgcugggacgaccagcagaaggucaagaagaccgccgaggccggcggcgucaccggcaagggccaggacggcaucggcuccaaggccgagaagacccucggcgacuucgccgccgaguacgccaaguccaaccgcuccaccugcaagggcugcauggagaagaucgagaagggccagguccgccucuccaagaagauggucgaccccgagaagccccagcucggcaugaucgaccgcugguaccaccccggcugcuucgucaagaaccgcgaggagcucggcuuccgccccgaguacuccgccucccagcucaagggcuucucccuccucgccaccgaggacaaggaggcccucaagaagcagcuccccggcgucaaguccgagggcaagcgcaagggcgacgaggucgacggcgucgacgaggucgccaagaagaaguccaagaaggagaaggacaaggacuccaagcucgagaaggcccucaaggcccagaacgaccucaucuggaacaucaaggacgagcucaagaaggucugcuccaccaacgaccucaaggagcuccucaucuucaacaagcagcagguccccuccggcgaguccgccauccucgaccgcgucgccgacggcauggucuucggcgcccuccuccccugcgaggagugcuccggccagcucgucuucaaguccgacgccuacuacugcaccggcgacgucaccgccuggaccaagugcauggucaagacccagacccccaaccgcaaggagugggucacccccaaggaguuccgcgagaucuccuaccucaagaagcucaaggucaagaagcaggaccgcaucuucccccccgagaccuccgccuccgucgccgccacccccccccccuccaccgccuccgcccccgccgccgucaacuccuccgccuccgccgacaagccccucuccaacaugaagauccucacccucggcaagcucucccgcaacaaggacgaggucaaggccaugaucgagaagcucggcggcaagcucaccggcaccgccaacaaggccucccucugcaucuccaccaagaaggaggucgagaagaugaacaagaagauggaggaggucaaggaggccaacauccgcgucgucuccgaggacuuccuccaggacgucuccgccuccaccaagucccuccaggagcucuuccucgcccacauccucucccccuggggcgccgaggucaaggccgagcccgucgaggucgucgccccccgcggcaaguccggcgccgcccucuccaagaaguccaagggccaggucaaggaggagggcaucaacaaguccgagaagcgcaugaagcucacccucaagggcggcgccgccgucgaccccgacuccggccucgagcacuccgcccacguccucgagaagggcggcaaggucuucuccgccacccucggccucgucgacaucgucaagggcaccaacuccuacuacaagcuccagcuccucgaggacgacaaggagaaccgcuacuggaucuuccgcuccuggggccgcgucggcaccgucaucggcuccaacaagcucgagcagaugcccuccaaggaggacgccaucgagcacuucaugaagcucuacgaggagaagaccggcaacgccuggcacuccaagaacuucaccaaguaccccaagaaguucuacccccucgagaucgacuacggccaggacgaggaggccgucaagaagcucaccgucaaccccggcaccaaguccaagcuccccaagcccguccaggaccucaucaagaugaucuucgacgucgaguccaugaagaaggccauggucgaguacgagaucgaccuccagaagaugccccucggcaagcucuccaagcgccagauccaggccgccuacuccauccucuccgagguccagcaggccgucucccagggcuccuccgacucccagauccucgaccucuccaaccgcuucuacacccucaucccccacgacuucggcaugaagaagcccccccuccucaacaacgccgacuccguccaggccaaggucgagaugcucgacaaccuccucgacaucgaggucgccuacucccuccuccgcggcggcuccgacgacuccuccaaggaccccaucgacgucaacuacgagaagcucaagaccgacaucaaggucgucgaccgcgacuccgaggaggccgagaucauccgcaaguacgucaagaacacccacgccaccacccacaacgccuacgaccucgaggucaucgacaucuucaagaucgagcgcgagggcgagugccagcgcuacaagcccuucaagcagcuccacaaccgccgccuccucuggcacggcucccgcaccaccaacuucgccggcauccucucccagggccuccgcaucgccccccccgaggcccccgucaccggcuacauguucggcaagggcaucuacuucgccgacauggucuccaaguccgccaacuacugccacaccucccagggcgaccccaucggccucauccuccucggcgaggucgcccucggcaacauguacgagcucaagcacgccucccacaucuccaagcuccccaagggcaagcacuccgucaagggccucggcaagaccacccccgaccccuccgccaacaucucccucgacggcgucgacgucccccucggcaccggcaucuccuccggcgucaacgacaccucccuccucuacaacgaguacaucgucuacgacaucgcccaggucaaccucaaguaccuccucaagcucaaguucaacuucaagaccucccucugguga

SEQ ID NO: 47308 - RNA, 1713 nt, Artificial Sequence
  derived and/or modified sequence opt2 from PARP2__Homo_sapiens__NP_001036083
auggccgcccgccgccgccgcuccaccggcggcggccgcgcccgcgcccucaacgaguccaagcgcgucaacaacggcaacaccgcccccgaggacuccucccccgccaagaagacccgccgcugccagcgccaggaguccaagaagaugcccgucgccggcggcaaggccaacaaggaccgcaccgaggacaagcaggacgaguccgucaaggcccuccuccucaagggcaaggcccccgucgaccccgagugcaccgccaaggucggcaaggcccacgucuacugcgagggcaacgacgucuacgacgucaugcucaaccagaccaaccuccaguucaacaacaacaaguacuaccucauccagcuccucgaggacgacgcccagcgcaacuucuccgucuggaugcgcuggggccgcgucggcaagaugggccagcacucccucgucgccugcuccggcaaccucaacaaggccaaggagaucuuccagaagaaguuccucgacaagaccaagaacaacugggaggaccgcgagaaguucgagaagguccccggcaaguacgacaugcuccagauggacuacgccaccaacacccaggacgaggaggagaccaagaaggaggagucccucaaguccccccucaagcccgagucccagcucgaccuccgcguccaggagcucaucaagcucaucugcaacguccaggccauggaggagaugaugauggagaugaaguacaacaccaagaaggccccccucggcaagcucaccgucgcccagaucaaggccggcuaccagucccucaagaagaucgaggacugcauccgcgccggccagcacggccgcgcccucauggaggccugcaacgaguucuacacccgcaucccccacgacuucggccuccgcacccccccccucauccgcacccagaaggagcucuccgagaagauccagcuccucgaggcccucggcgacaucgagaucgccaucaagcucgucaagaccgagcuccagucccccgagcacccccucgaccagcacuaccgcaaccuccacugcgcccuccgcccccucgaccacgaguccuacgaguucaaggucaucucccaguaccuccaguccacccacgcccccacccacuccgacuacaccaugacccuccucgaccucuucgaggucgagaaggacggcgagaaggaggccuuccgcgaggaccuccacaaccgcaugcuccucuggcacggcucccgcauguccaacugggucggcauccucucccacggccuccgcaucgccccccccgaggcccccaucaccggcuacauguucggcaagggcaucuacuucgccgacauguccuccaaguccgccaacuacugcuucgccucccgccucaagaacaccggccuccuccuccucuccgaggucgcccucggccagugcaacgagcuccucgaggccaaccccaaggccgagggccuccuccagggcaagcacuccaccaagggccucggcaagauggcccccuccuccgcccacuucgucacccucaacggcuccaccgucccccucggccccgccuccgacaccggcauccucaaccccgacggcuacacccucaacuacaacgaguacaucgucuacaaccccaaccagguccgcaugcgcuaccuccucaagguccaguucaacuuccuccagcucugguga

SEQ ID NO: 47309 - RNA, 1623 nt, Artificial Sequence
  derived and/or modified sequence opt2 from PARP3__Homo_sapiens__NP_001003931
augucccuccucuuccucgccauggcccccaagcccaagcccuggguccagaccgagggccccgagaagaagaagggccgccaggccggccgcgaggaggaccccuuccgcuccaccgccgaggcccucaaggccauccccgccgagaagcgcaucauccgcgucgaccccaccugcccccucuccuccaaccccggcacccaggucuacgaggacuacaacugcacccucaaccagaccaacaucgagaacaacaacaacaaguucuacaucauccagcuccuccaggacuccaaccgcuucuucaccugcuggaaccgcuggggccgcgucggcgaggucggccaguccaagaucaaccacuucacccgccucgaggacgccaagaaggacuucgagaagaaguuccgcgagaagaccaagaacaacugggccgagcgcgaccacuucgucucccaccccggcaaguacacccucaucgagguccaggccgaggacgaggcccaggaggccgucgucaaggucgaccgcggccccguccgcaccgucaccaagcgcguccagcccugcucccucgaccccgccacccagaagcucaucaccaacaucuucuccaaggagauguucaagaacaccauggcccucauggaccucgacgucaagaagaugccccucggcaagcucuccaagcagcagaucgcccgcggcuucgaggcccucgaggcccucgaggaggcccucaagggccccaccgacggcggccagucccucgaggagcucuccucccacuucuacaccgucaucccccacaacuucggccacucccagcccccccccaucaacucccccgagcuccuccaggccaagaaggacaugcuccucguccucgccgacaucgagcucgcccaggcccuccaggccgucuccgagcaggagaagaccgucgaggaggucccccacccccucgaccgcgacuaccagcuccucaagugccagcuccagcuccucgacuccggcgcccccgaguacaaggucauccagaccuaccucgagcagaccggcuccaaccaccgcugccccacccuccagcacaucuggaaggucaaccaggagggcgaggaggaccgcuuccaggcccacuccaagcucggcaaccgcaagcuccucuggcacggcaccaacauggccgucgucgccgccauccucaccuccggccuccgcaucaugccccacuccggcggccgcgucggcaagggcaucuacuucgccuccgagaacuccaaguccgccggcuacgucaucggcaugaagugcggcgcccaccacgucggcuacauguuccucggcgaggucgcccucggccgcgagcaccacaucaacaccgacaaccccucccucaagucccccccccccggcuucgacuccgucaucgcccgcggccacaccgagcccgaccccacccaggacaccgagcucgagcucgacggccagcaggucgucgucccccagggccagcccguccccugccccgaguucuccuccuccaccuucucccaguccgaguaccucaucuaccaggagucccagugccgccuccgcuaccuccucgagguccaccucuga

SEQ ID NO: 47310 - RNA, 5175 nt, Artificial Sequence
  derived and/or modified sequence opt2 from PARP4__Homo_sapiens__NP_006428
auggucaugggcaucuucgccaacugcaucuucugccucaaggucaaguaccucccccagcagcagaagaagaagcuccagaccgacaucaaggagaacggcggcaaguucuccuucucccucaacccccagugcacccacaucauccucgacaacgccgacguccucucccaguaccagcucaacuccauccagaagaaccacguccacaucgccaaccccgacuucaucuggaaguccauccgcgagaagcgccuccucgacgucaagaacuacgaccccuacaagccccucgacaucacccccccccccgaccagaaggccuccuccuccgaggucaagaccgagggccucugccccgacuccgccaccgaggaggaggacaccgucgagcucaccgaguucggcaugcagaacgucgagaucccccaccucccccaggacuucgaggucgccaaguacaacacccucgagaaggucggcauggagggcggccaggaggccgucgucgucgagcuccagugcucccgcgacucccgcgacugccccuuccucaucuccucccacuuccuccucgacgacggcauggagacccgccgccaguucgccaucaagaagaccuccgaggacgccuccgaguacuucgagaacuacaucgaggagcucaagaagcagggcuuccuccuccgcgagcacuucacccccgaggccacccagcucgccuccgagcagcuccaggcccuccuccucgaggaggucaugaacuccuccacccucucccaggaggucuccgaccucgucgagaugaucugggccgaggcccucggccaccucgagcacaugcuccucaagcccgucaaccgcaucucccucaacgacgucuccaaggccgagggcauccuccuccucgucaaggccgcccucaagaacggcgagaccgccgagcagcuccagaagaugaugaccgaguucuaccgccucaucccccacaagggcaccaugcccaaggaggucaaccucggccuccucgccaagaaggccgaccucugccagcucauccgcgacauggucaacgucugcgagaccaaccucuccaagcccaacccccccucccucgccaaguaccgcgcccuccgcugcaagaucgagcacgucgagcagaacaccgaggaguuccuccgcguccgcaaggagguccuccagaaccaccacuccaagucccccgucgacguccuccagaucuuccgcgucggccgcgucaacgagaccaccgaguuccucuccaagcucggcaacguccgcccccuccuccacggcucccccguccagaacaucgucggcauccucugccgcggccuccuccuccccaaggucgucgaggaccgcggcguccagcgcaccgacgucggcaaccucggcuccggcaucuacuucuccgacucccucuccaccuccaucaaguacucccaccccggcgagaccgacggcacccgccuccuccucaucugcgacgucgcccucggcaagugcauggaccuccacgagaaggacuucucccucaccgaggccccccccggcuacgacuccguccacggcgucucccagaccgccuccgucaccaccgacuucgaggacgacgaguucgucgucuacaagaccaaccaggucaagaugaaguacaucaucaaguucuccaugcccggcgaccagaucaaggacuuccaccccuccgaccacaccgagcucgaggaguaccgccccgaguucuccaacuucuccaaggucgaggacuaccagcuccccgacgccaagaccuccuccuccaccaaggccggccuccaggacgccuccggcaaccucgucccccucgaggacguccacaucaagggccgcaucaucgacaccgucgcccaggucaucgucuuccagaccuacaccaacaagucccacguccccaucgaggccaaguacaucuucccccucgacgacaaggccgccgucugcggcuucgaggccuucaucaacggcaagcacaucgucggcgagaucaaggagaaggaggaggcccagcaggaguaccucgaggccgucacccagggccacggcgccuaccucaugucccaggacgcccccgacgucuucaccgucuccgucggcaaccucccccccaaggccaagguccucaucaagaucaccuacaucaccgagcucuccauccucggcaccgucggcgucuucuucaugcccgccaccgucgcccccuggcagcaggacaaggcccucaacgagaaccuccaggacaccgucgagaagaucugcaucaaggagaucggcaccaagcaguccuucucccucaccauguccaucgagaugcccuacgucaucgaguucaucuucuccgacacccacgagcucaagcagaagcgcaccgacugcaaggccgucaucuccaccauggagggcuccucccucgacuccuccggcuucucccuccacaucggccucuccgccgccuaccucccccgcaugugggucgagaagcaccccgagaaggaguccgaggccugcaugcucgucuuccagcccgaccucgacgucgaccuccccgaccucgccuccgaguccgaggucaucaucugccucgacugcuccuccuccauggagggcgucaccuuccuccaggccaagcagaucgcccuccacgcccucucccucgucggcgagaagcagaaggucaacaucauccaguucggcaccggcuacaaggagcucuucuccuaccccaagcacaucaccuccaacaccauggccgccgaguucaucauguccgccacccccaccaugggcaacaccgacuucuggaagacccuccgcuaccucucccuccucuaccccgcccgcggcucccgcaacauccuccucgucuccgacggccaccuccaggacgagucccucacccuccagcucgucaagcgcucccgcccccacacccgccucuucgccugcggcaucggcuccaccgccaaccgccacguccuccgcauccucucccagugcggcgccggcgucuucgaguacuucaacgccaaguccaagcacuccuggcgcaagcagaucgaggaccagaugacccgccucugcucccccuccugccacuccgucuccgucaaguggcagcagcucaaccccgacguccccgaggcccuccaggcccccgcccagguccccucccucuuccucaacgaccgccuccucgucuacggcuucaucccccacugcacccaggccacccucugcgcccucauccaggagaaggaguuccgcaccauggucuccaccaccgagcuccagaagaccaccggcaccaugauccacaagcucgccgcccgcgcccucauccgcgacuacgaggacggcauccuccacgagaacgagaccucccacgagaugaagaagcagacccucaagucccucaucaucaagcucuccaaggagaacucccucaucacccaguucaccuccuucgucgccgucgagaagcgcgacgagaacgagucccccuuccccgacauccccaaggucuccgagcucaucgccaaggaggacgucgacuuccuccccuacauguccuggcagggcgagccccaggaggccguccgcaaccagucccuccucgccuccuccgaguggcccgagcuccgccucuccaagcgcaagcaccgcaagauccccuucuccaagcgcaagauggagcucucccagcccgaggucuccgaggacuucgaggaggacggccucggcguccuccccgccuucaccuccaaccucgagcgcggcggcgucgagaagcuccucgaccucuccuggaccgaguccugcaagcccaccgccaccgagccccucuucaagaaggucucccccugggagaccuccaccuccuccuucuuccccauccucgcccccgccgucggcuccuaccucccccccaccgcccgcgcccacucccccgccucccucuccuucgccuccuaccgccaggucgccuccuucggcuccgccgcccccccccgccaguucgacgccucccaguucucccagggccccguccccggcaccugcgccgacuggaucccccaguccgccuccugccccaccggccccccccagaacccccccuccucccccuacugcggcaucgucuucuccggcuccucccucuccuccgcccaguccgccccccuccagcaccccggcggcuucaccacccgccccuccgccggcaccuuccccgagcucgacuccccccagcuccacuucucccuccccaccgaccccgaccccauccgcggcuucggcuccuaccaccccuccgccuccucccccuuccacuuccagcccuccgccgccucccucaccgccaaccuccgccuccccauggccuccgcccuccccgaggcccucugcucccagucccgcaccacccccgucgaccucugccuccucgaggaguccgucggcucccucgagggcucccgcugccccgucuucgccuuccaguccuccgacaccgaguccgacgagcucuccgagguccuccaggacuccugcuuccuccagaucaagugcgacaccaaggacgacuccauccucugcuuccucgaggucaaggaggaggacgagaucgucugcauccagcacuggcaggacgccguccccuggaccgagcuccucucccuccagaccgaggacggcuucuggaagcucacccccgagcucggccucauccucaaccucaacaccaacggccuccacuccuuccucaagcagaagggcauccagucccucggcgucaagggccgcgagugccuccucgaccucaucgccaccaugcucguccuccaguucauccgcacccgccucgagaaggagggcaucgucuucaagucccucaugaagauggacgacgccuccaucucccgcaacauccccugggccuucgaggccaucaagcaggccuccgaguggguccgccgcaccgagggccaguaccccuccaucugcccccgccucgagcucggcaacgacugggacuccgccaccaagcagcuccucggccuccagcccaucuccaccgucuccccccuccaccgcguccuccacuacucccagggcuga

SEQ ID NO: 47311 - RNA, 1893 nt, Artificial Sequence
  derived and/or modified sequence opt2 from PARP6__Homo_sapiens__NP_064599
auggacaucaagggccaguucuggaacgacgacgacuccgagggcgacaacgaguccgaggaguuccucuacggcguccagggcuccugcgccgccgaccucuaccgccacccccagcucgacgccgacaucgaggccgucaaggagaucuacuccgagaacuccgucuccauccgcgaguacggcaccaucgacgacgucgacaucgaccuccacaucaacaucuccuuccucgacgaggaggucuccaccgccuggaagguccuccgcaccgagcccaucguccuccgccuccgcuucucccucucccaguaccucgacggccccgagcccuccaucgaggucuuccagcccuccaacaaggagggcuucggccucggccuccagcucaagaagauccucggcauguucaccucccagcaguggaagcaccucuccaacgacuuccucaagacccagcaggagaagcgccacuccugguucaaggccuccggcaccaucaagaaguuccgcgccggccucuccaucuucucccccauccccaagucccccuccuuccccaucauccaggacuccaugcucaagggcaagcucggcguccccgagcuccgcgucggccgccucaugaaccgcuccaucuccugcaccaugaagaaccccaaggucgaggucuucggcuacccccccuccccccaggccggccuccucugcccccagcacgucggccuccccccccccgcccgcaccuccccccucgucuccggccacugcaagaacauccccacccucgaguacggcuuccucguccagaucaugaaguacgccgagcagcgcauccccacccucaacgaguacugcgucgucugcgacgagcagcacgucuuccagaacggcuccaugcucaagcccgccgucugcacccgcgagcucugcgucuucuccuucuacacccucggcgucauguccggcgccgccgaggaggucgccaccggcgccgaggucgucgaccuccucgucgccaugugccgcgccgcccucgaguccccccgcaaguccaucaucuucgagcccuaccccuccgucgucgaccccaccgaccccaagacccucgccuucaaccccaagaagaagaacuacgagcgccuccagaaggcccucgacuccgucauguccauccgcgagaugacccagggcuccuaccucgagaucaagaagcagauggacaagcucgacccccucgcccacccccuccuccaguggaucaucuccuccaaccgcucccacaucgucaagcucccccucucccgccucaaguucaugcacaccucccaccaguuccuccuccucuccuccccccccgccaaggaggcccgcuuccgcaccgccaagaagcucuacggcuccaccuucgccuuccacggcucccacaucgagaacuggcacuccauccuccgcaacggccucgucaacgccuccuacaccaagcuccagcuccacggcgccgccuacggcaagggcaucuaccucucccccaucuccuccaucuccuucggcuacuccggcaugggcaagggccagcaccgcaugcccuccaaggacgagcucguccagcgcuacaaccgcaugaacaccaucccccagacccgcuccauccagucccgcuuccuccagucccgcaaccucaacugcaucgcccucugcgaggucaucaccuccaaggaccuccagaagcacggcaacaucugggucugccccgucuccgaccacgucugcacccgcuucuucuucgucuacgaggacggccaggucggcgacgccaacaucaacacccaggaccccaagauccagaaggagaucaugcgcgucaucggcacccaggucuacaccaacuga

SEQ ID NO: 47312 - RNA, 2565 nt, Artificial Sequence
  derived and/or modified sequence opt2 from PARP9__Homo_sapiens__NP_001139574
auggacuucuccauggucgccggcgccgccgccuacaacgagaaguccggccgcaucaccucccucucccuccucuuccagaaggucuucgcccagaucuucccccaguggcgcaagggcaacaccgaggagugccuccccuacaagugcuccgagaccggcgcccucggcgagaacuacuccuggcagauccccaucaaccacaacgacuucaagauccucaagaacaacgagcgccagcucugcgagguccuccagaacaaguucggcugcaucuccacccucgucucccccguccaggagggcaacuccaagucccuccaggucuuccgcaagaugcucaccccccgcaucgagcucuccgucuggaaggacgaccucaccacccacgccgucgacgccgucgucaacgccgccaacgaggaccuccuccacggcggcggccucgcccucgcccucgucaaggccggcggcuucgagauccaggaggaguccaagcaguucgucgcccgcuacggcaaggucuccgccggcgagaucgccgucaccggcgccggccgccuccccugcaagcagaucauccacgccgucggcccccgcuggauggagugggacaagcagggcugcaccggcaagcuccagcgcgccaucgucuccauccucaacuacgucaucuacaagaacacccacaucaagaccgucgccauccccgcccucuccuccggcaucuuccaguucccccucaaccucugcaccaagaccaucgucgagaccauccgcgucucccuccagggcaagcccaugauguccaaccucaaggagauccaccucgucuccaacgaggaccccaccgucgccgccuucaaggccgccuccgaguucauccucggcaaguccgagcucggccaggagaccacccccuccuucaacgccauggucgucaacaaccucacccuccagaucguccagggccacaucgaguggcagaccgccgacgucaucgucaacuccgucaacccccacgacaucaccgucggccccgucgccaaguccauccuccagcaggccggcgucgagaugaaguccgaguuccucgccaccaaggccaagcaguuccagcgcucccagcucguccucgucaccaagggcuucaaccucuucugcaaguacaucuaccacguccucuggcacuccgaguuccccaagccccagauccucaagcacgccaugaaggagugccucgagaagugcaucgagcagaacaucaccuccaucuccuuccccgcccucggcaccggcaacauggagaucaagaaggagaccgccgccgagauccucuucgacgagguccucaccuucgccaaggaccacgucaagcaccagcucaccgucaaguucgucaucuuccccaccgaccucgagaucuacaaggccuucuccuccgagauggccaagcgcuccaagaugcucucccucaacaacuacuccgucccccaguccacccgcgaggagaagcgcgagaacggccucgaggcccgcucccccgccaucaaccucaugggcuucaacgucgaggagauguacgaggcccacgccuggauccagcgcauccucucccuccagaaccaccacaucaucgagaacaaccacauccucuaccucggccgcaaggagcacgacauccucucccagcuccagaagaccuccuccgucuccaucaccgagaucaucucccccggccgcaccgagcucgagaucgagggcgcccgcgccgaccucaucgaggucgucaugaacaucgaggacaugcucugcaagguccaggaggagauggcccgcaagaaggagcgcggccucuggcgcucccucggccaguggaccauccagcagcagaagacccaggacgagaugaaggagaacaucaucuuccucaagugccccgucccccccacccaggagcuccucgaccagaagaagcaguucgagaagugcggccuccagguccucaaggucgagaagaucgacaacgagguccucauggccgccuuccagcgcaagaagaagaugauggaggagaagcuccaccgccagcccgucucccaccgccucuuccagcagguccccuaccaguucugcaacgucgucugccgcgucggcuuccagcgcauguacuccacccccugcgaccccaaguacggcgccggcaucuacuucaccaagaaccucaagaaccucgccgagaaggccaagaagaucuccgccgccgacaagcucaucuacgucuucgaggccgagguccucaccggcuucuucugccagggccacccccucaacaucgucccccccccccucucccccggcgccaucgacggccacgacuccgucgucgacaacgucuccucccccgagaccuucgucaucuucuccggcaugcaggccaucccccaguaccucuggaccugcacccaggaguacguccagucccaggacuacuccuccggccccaugcgccccuucgcccagcaccccuggcgcggcuucgccuccggcucccccgucgacuga

SEQ ID NO: 47313 - RNA, 1752 nt, Artificial Sequence
  derived and/or modified sequence opt2 from PARPBP__Homo_sapiens__XP_011536808
auggagcucaucauggccgucuucaaccagaaguccgucuccgacaugaucaaggaguuccgcaagaacuggcgcgcccucugcaacuccgagcgcaccacccucugcggcgccgacuccaugcuccucgcccuccagcucuccauggccgagaacaacaagcagcacuccggcgaguucaccgucucccucuccgacguccuccucaccuggaaguaccuccuccacgagaagcucaaccuccccgucgagaacauggacgucaccgaccacuacgaggacguccgcaagaucuacgacgacuuccucaagaacuccaacaugcucgaccucaucgacgucuaccagaagugccgcgcccucaccuccaacugcgagaacuacaacaccgucucccccucccagcuccucgacuuccucuccggcaagcaguacgccgucggcgacgagaccgaccucuccauccccaccucccccaccuccaaguacaaccgcgacaacgagaagguccagcuccucgcccgcaagaucaucuucuccuaccucaaccuccucgucaacuccaagaacgaccucgccgucgccuacauccucaacauccccgaccgcggccucggccgcgaggccuucaccgaccucaagcacgccgcccgcgagaagcagauguccaucuuccucgucgccaccuccuucauccgcaccaucgagcucggcggcaagggcuacgcccccccccccuccgacccccuccgcacccacgucaagggccucuccaacuucaucaacuucaucgacaagcucgacgagauccucggcgagauccccaaccccuccaucgccggcggccagauccucuccgucaucaagaugcagcucaucaagggccagaacucccgcgaccccuucugcaaggccaucgaggaggucgcccaggaccucgaccuccgcaucaagaacaucaucaacucccaggagggcgucgucgcccucuccaccaccgacaucucccccgcccgccccaagucccacgccaucaaccacggcaccgccuacugcggccgcgacaccgucaaggcccuccucguccuccucgacgaggaggccgccaacgcccccaccaagaacaaggccgagcuccucuacgacgaggagaacaccauccaccaccacggcaccuccauccucacccucuuccgcucccccacccaggucaacaacuccaucaagccccuccgcgagcgcaucugcgucuccaugcaggagaagaagaucaagaugaagcagacccucauccgcucccaguucgccugcaccuacaaggacgacuacaugaucuccaaggacaacuggaacaacgucaaccucgccuccaagccccucugcguccucuacauggagaacgaccucuccgagggcgucaaccccuccgucggccgcuccaccaucggcaccuccuucggcaacguccaccucgaccgcuccaagaacgagaaggucucccgcaaguccaccucccagaccggcaacaaguccuccaagcgcaagcaggucgaccucgacggcgagaacauccucugcgacaaccgcaacgagcccccccagcacaagaacgccaagauccccaagaaguccaacgacucccagaaccgccucuacggcaagcucgccaaggucgccaaguccaacaagugcaccgccaaggacaagcucaucuccggccaggccaagcucacccaguucuuccgccucuga

SEQ ID NO: 47314 - RNA, 1605 nt, Artificial Sequence
  derived and/or modified sequence opt2 from PARS2__Homo_sapiens__XP_011539505
augcgcgccgcccuccccggccucucccucggccgccgcgagucccacaccguccucgagguccccgcccucgagcgccccugggaccaccuccuccccgagcccgccuuccccuucuacgucggcgagaacggcggccccggccgcuccgccugcgccucccgcugccagggcgucauggagggccuccucacccgcugccgcgcccuccccgcccucgccaccugcucccgccagcucuccggcuacguccccugccgcuuccaccacugcgccccccgccgcggccgccgccuccuccucucccgcgucuuccagccccagaaccuccgcgaggaccgcguccucucccuccaggacaaguccgacgaccucaccugcaagucccagcgccucaugcuccaggucggccucaucuaccccgccucccccggcugcuaccaccuccuccccuacaccguccgcgccauggagaagcucguccgcgucaucgaccaggagaugcaggccaucggcggccagaaggucaacaugcccucccucucccccgccgagcucuggcaggccaccaaccgcugggaccucaugggcaaggagcuccuccgccuccgcgaccgccacggcaaggaguacugccucggccccacccacgaggaggccaucaccgcccucaucgccucccagaagaagcucuccuacaagcagcuccccuuccuccucuaccaggucacccgcaaguuccgcgacgagccccgcccccgcuucggccuccuccgcggccgcgaguucuacaugaaggacauguacaccuucgacuccucccccgaggccgcccagcagaccuacucccucgucugcgacgccuacugcucccucuucaacaagcucggccuccccuucgucaagguccaggccgacgucggcaccaucggcggcaccgucucccacgaguuccagcuccccgucgacaucggcgaggaccgccucgccaucugcccccgcugcuccuucuccgccaacauggagacccucgaccucucccagaugaacugccccgccugccagggcccccucaccaagaccaagggcaucgaggucggccacaccuucuaccucggcaccaaguacuccuccaucuucaacgcccaguucaccaacgucugcggcaagcccacccucgccgagaugggcugcuacggccucggcgucacccgcauccucgccgccgccaucgagguccucuccaccgaggacugcguccgcuggcccucccuccucgcccccuaccaggccugccucaucccccccaagaagggcuccaaggagcaggccgccuccgagcucaucggccagcucuacgaccacaucaccgaggccgucccccagcuccacggcgagguccuccucgacgaccgcacccaccucaccaucggcaaccgccucaaggacgccaacaaguucggcuaccccuucgucaucaucgccggcaagcgcgcccucgaggaccccgcccacuucgaggucuggugccagaacaccggcgaggucgccuuccucaccaaggacggcgucauggaccuccucacccccguccagaccgucuga

SEQ ID NO: 47315 - RNA, 1239 nt, Artificial Sequence
  derived and/or modified sequence opt2 from PARVA__Homo_sapiens__NP_060692
augcucggcaucaucccccuccccuucggcaagccccagccccagucccgccgccgcccccuccgcccccccuccgccuccuccgccucccgccccgcccgcggcucccuccgccgcgccauggccaccuccccccagaagucccccuccguccccaagucccccacccccaaguccccccccucccgcaagaaggacgacuccuuccucggcaagcucggcggcacccucgcccgccgcaagaaggccaaggaggucuccgagcuccaggaggagggcaugaacgccaucaaccucccccucucccccauccccuucgagcucgaccccgaggacaccaugcucgaggagaacgagguccgcaccauggucgaccccaacucccgcuccgaccccaagcuccaggagcucaugaagguccucaucgacuggaucaacgacguccucgucggcgagcgcaucaucgucaaggaccucgccgaggaccucuacgacggccagguccuccagaagcucuucgagaagcucgaguccgagaagcucaacgucgccgaggucacccaguccgagaucgcccagaagcagaagcuccagaccguccucgagaagaucaacgagacccucaagcuccccccccgcuccaucaaguggaacgucgacuccguccacgccaagucccucgucgccauccuccaccuccucgucgcccucucccaguacuuccgcgcccccauccgccuccccgaccacgucuccauccaggucgucgucguccagaagcgcgagggcauccuccagucccgccagauccaggaggagaucaccggcaacaccgaggcccucuccggccgccacgagcgcgacgccuucgacacccucuucgaccacgcccccgacaagcucaacgucgucaagaagacccucaucaccuucgucaacaagcaccucaacaagcucaaccucgaggucaccgagcucgagacccaguucgccgacggcgucuaccucguccuccucaugggccuccucgagggcuacuucgucccccuccacuccuucuuccucacccccgacuccuucgagcagaagguccucaacgucuccuucgccuucgagcucaugcaggacggcggccucgagaagcccaagccccgccccgaggacaucgucaacugcgaccucaaguccacccuccgcguccucuacaaccucuucaccaaguaccgcaacgucgaguga

SEQ ID NO: 47316 - RNA, 1194 nt, Artificial Sequence
  derived and/or modified sequence opt2 from PARVB__Homo_sapiens__NP_001003828
augcaccacgucuucaaggaccaccagcgcggcgagaagcgcggcuuccucucccccgagaacaagaacugccgccgccucgagcuccgccgcggcugcuccugcuccuggggccucugcucccaggcccucauggccucccucgccggcucccuccuccccggcuccgaccgcuccggcgucgagaccuccgaguacgcccagggcggcgucuccgaccuccaggaggagggcaagaacgccaucaacucccccaugucccccgcccucgucgacguccaccccgaggacacccagcucgaggagaacgaggagcgcaccaugaucgaccccaccuccaaggaggaccccaaguucaaggagcucgucaagguccuccucgacuggaucaacgacguccucgucgaggagcgcaucaucgucaagcagcucgaggaggaccucuacgacggccagguccuccagaagcuccucgagaagcucgccggcugcaagcucaacgucgccgaggucacccaguccgagaucggccagaagcagaagcuccagaccguccucgaggccguccacgaccuccuccgcccccgcggcugggcccuccgcugguccgucgacuccauccacggcaagaaccucgucgccauccuccaccuccucgucucccucgccaugcacuuccgcgcccccauccgccuccccgagcacgucaccguccaggucgucgucguccgcaagcgcgagggccuccuccacuccucccacaucuccgaggagcucaccaccaccaccgagaugaugaugggccgcuucgagcgcgacgccuucgacacccucuucgaccacgcccccgacaagcucuccgucgucaagaagucccucaucaccuucgucaacaagcaccucaacaagcucaaccucgaggucaccgagcucgagacccaguucgccgacggcgucuaccucguccuccucaugggccuccucgaggacuacuucgucccccuccaccacuucuaccucacccccgaguccuucgaccagaagguccacaacgucuccuucgccuucgagcucaugcucgacggcggccucaagaagcccaaggcccgccccgaggacgucgucaaccucgaccucaaguccacccuccgcguccucuacaaccucuucaccaaguacaagaacgucgaguga

SEQ ID NO: 47317 - RNA, 996 nt, Artificial Sequence
  derived and/or modified sequence opt2 from PARVG__Homo_sapiens__NP_001131077
auggagcccgaguuccucuacgaccuccuccagcuccccaagggcgucgagccccccgccgaggaggagcucuccaagggcggcaagaagaaguaccucccccccaccucccgcaaggaccccaaguucgaggagcuccagaagguccucauggaguggaucaacgccacccuccuccccgagcacaucgucguccgcucccucgaggaggacauguucgacggccucauccuccaccaccucuuccagcgccucgccgcccucaagcucgaggccgaggacaucgcccucaccgccaccucccagaagcacaagcucaccgucguccucgaggccgucaaccgcucccuccagcucgaggaguggcaggccaagugguccgucgaguccaucuucaacaaggaccuccucuccacccuccaccuccucgucgcccucgccaagcgcuuccagcccgaccucucccuccccaccaacguccaggucgaggucaucaccaucgaguccaccaaguccggccucaaguccgagaagcucgucgagcagcucaccgaguacuccaccgacaaggacgagccccccaaggacgucuucgacgagcucuucaagcucgcccccgagaaggucaacgccgucaaggaggccaucgucaacuucgucaaccagaagcucgaccgccucggccucuccguccagaaccucgacacccaguucgccgacggcgucauccuccuccuccucaucggccagcucgagggcuucuuccuccaccucaaggaguucuaccucacccccaacucccccgccgagaugcuccacaacgucacccucgcccucgagcuccucaaggacgagggccuccucuccugccccgucucccccgaggacaucgucaacaaggacgccaaguccacccuccgcguccucuacggccucuucugcaagcacacccagaaggcccaccgcgaccgcaccccccacggcgcccccaacuga

SEQ ID NO: 47318 - RNA, 2322 nt, Artificial Sequence
  derived and/or modified sequence opt2 from PASD1__Homo_sapiens__NP_775764
augaagaugcgcggcgagaagcgccgcgacaaggucaaccccaaguccucccagcgcaagcucaacuggauccccuccuuccccaccuacgacuacuucaaccaggucacccuccagcuccucgacggcuucaugaucacccucuccaccgacggcgucaucaucugcgucgccgagaacaucuccucccuccucggccaccuccccgccgagaucgucggcaagaagcuccucucccuccuccccgacgaggagaaggacgaggucuaccagaagaucauccucaaguucccccuccucaacuccgagacccacaucgaguucugcugccaccucaagcgcggcaacgucgagcacggcgacuccuccgccuacgagaacgucaaguucaucgucaacguccgcgacaucugcaacgaguuccccgucgucuucuccggccucuucuccucccaccucugcgccgacuucgccgccugcgucccccaggaggaccgccucuaccucgucggcaacgucugcauccuccgcacccagcuccuccagcagcucuacaccuccaaggccgucuccgacgaggccguccucacccaggacuccgacgaggagcccuucgucggcgagcucuccuccucccagggccagcgcggccacaccuccaugaaggccgucuacgucgagcccgccgccgccgccgccgccgccgccaucuccgacgaccagaucgacaucgccgaggucgagcaguacggcccccaggagaacguccacauguucgucgacuccgacuccaccuacugcuccuccaccgucuuccucgacaccaugcccgagucccccgcccucucccuccaggacuuccgcggcgagcccgaggucaacccccucuaccgcgccgaccccgucgaccucgaguucuccgucgaccaggucgacuccgucgaccaggagggccccauggaccagcaggaccccgagaaccccgucgccccccucgaccaggccggccucauggaccccgucgaccccgaggacuccgucgaccucggcgccgccggcgccuccgcccagccccuccagcccuccucccccgucgccuacgacaucaucucccaggagcucgagcucaugaagaagcucaaggagcagcucgaggagcgcaccuggcuccuccacgacgccauccagaaccagcagaacgcccucgagcucaugauggaccaccuccagaagcagcccaacacccuccgccacgucgucauccccgaccuccaguccuccgaggccguccccaagaagcagcagaagcagcacgccggccaggucaagcgcccccucccccaccccaaggacgucaagugcuucugcggccucucccucuccaacucccucaagaacaccggcgagcuccaggagcccugcgucgccuucaaccagcagcagcucguccagcaggagcagcaccucaaggagcagcagcgccagcuccgcgagcagcuccagcagcuccgcgagcagcgcaagguccagaagcagaagaagaugcaggagaagaagaagcuccaggagcagaagaugcaggagaagaagaagcuccaggagcagcgccgccagaagaagaagaagcuccaggagcgcaagaaguggcagggccagaugcuccagaaggagcccgaggaggagcagcagaagcagcagcuccaggagcagccccucaagcacaacgucaucgucggcaacgagcgcguccagaucugccuccagaacccccgcgacgucuccgucccccucugcaaccaccccguccgcuuccuccaggcccagcccaucguccccguccagcgcgccgccgagcagcagcccuccggcuucuaccaggacgagaacugcggccagcaggaggacgagucccaguccuucuaccccgaggccuaccagggcccccccgucaaccagcucccccucaucgacaccuccaacuccgaggccaucuccuccuccuccaucccccaguuccccaucaccuccgacuccaccaucuccacccucgagaccccccaggacuacauccgccucuggcaggagcucuccgacucccucggccccgucguccaggucaacaccugguccugcgacgagcagggcacccuccacggccagcccaccuaccaccagguccaggucuccgaggucggcgucgagggcccccccgacccccaggccuuccagggccccgccgccuaccagcccgaccagaugcgcuccgccgagcagacccgccucaugcccgccgagcagcgcgacuccaacaagcccugcuga

SEQ ID NO: 47319 - RNA, 3993 nt, Artificial Sequence
  derived and/or modified sequence opt2 from PASK__Homo_sapiens__NP_001239048
auggaggacggcggccucaccgccuucgaggaggaccagcgcugccucucccagucccucccccuccccgucuccgccgagggccccgccgcccagaccaccgccgagcccucccgcuccuucuccuccgcccaccgccaccucucccgccgcaacggccucucccgccucugccagucccgcaccgcccucuccgaggaccgcugguccuccuacugccucuccucccucgccgcccagaacaucugcaccuccaagcuccacugccccgccgcccccgagcacaccgaccccuccgagccccgcggcuccgucuccugcugcucccuccuccgcggccucuccuccggcugguccuccccccuccuccccgcccccgucugcaaccccaacaaggccaucuucaccgucgacgccaagaccaccgagauccucgucgccaacgacaaggccugcggccuccucggcuacuccucccaggaccucaucggccagaagcucacccaguucuuccuccgcuccgacuccgacgucgucgaggcccucuccgaggagcacauggaggccgacggccacgccgccgucgucuucggcaccgucgucgacaucaucucccgcuccggcgagaagauccccgucuccgucuggaugaagcgcaugcgccaggagcgccgccucugcugcgucgucguccucgagcccgucgagcgcgucuccaccugggucgccuuccaguccgacggcaccgucaccuccugcgacucccucuucgcccaccuccacggcuacgucuccggcgaggacgucgccggccagcacaucaccgaccucauccccuccguccagcucccccccuccggccagcacauccccaagaaccucaagauccagcgcuccgucggccgcgcccgcgacggcaccaccuucccccucucccucaagcucaagucccagcccuccuccgaggaggccaccaccggcgaggccgcccccgucuccggcuaccgcgccuccgucugggucuucugcaccaucuccggccucaucacccuccuccccgacggcaccauccacggcaucaaccacuccuucgcccucacccucuucggcuacggcaagaccgagcuccucggcaagaacaucaccuuccucauccccggcuucuacuccuacauggaccucgccuacaacuccucccuccagcuccccgaccucgccuccugccucgacgucggcaacgaguccggcugcggcgagcgcacccucgaccccuggcagggccaggaccccgccgagggcggccaggacccccgcaucaacgucguccucgccggcggccacgucgucccccgcgacgagauccgcaagcucauggagucccaggacaucuucaccggcacccagaccgagcucaucgccggcggccagcuccucuccugccucuccccccagcccgcccccggcgucgacaacguccccgagggcucccuccccguccacggcgagcaggcccuccccaaggaccagcagaucaccgcccucggccgcgaggagcccgucgccaucgagucccccggccaggaccuccucggcgagucccgcuccgagcccgucgacgucaagcccuucgccuccugcgaggacuccgaggcccccguccccgccgaggacggcggcuccgacgccggcaugugcggccucugccagaaggcccagcucgagcgcaugggcgucuccggccccuccggcuccgaccucugggccggcgccgccgucgccaagccccaggccaagggccagcucgccggcggcucccuccucaugcacugccccugcuacggcuccgaguggggccucugguggcgcucccaggaccucgcccccucccccuccggcauggccggccucuccuucggcacccccacccucgacgagcccuggcucggcgucgagaacgaccgcgaggagcuccagaccugccucaucaaggagcagcucucccagcucucccucgccggcgcccucgacgucccccacgccgagcucguccccaccgagugccaggccgucaccgcccccgucuccuccugcgaccucggcggccgcgaccucugcggcggcugcaccggcuccuccuccgccugcuacgcccucgccaccgaccuccccggcggccucgaggccgucgaggcccaggaggucgacgucaacuccuucuccuggaaccucaaggagcucuucuucuccgaccagaccgaccagaccuccuccaacugcuccugcgccaccuccgagcuccgcgagacccccuccucccucgccgucggcuccgaccccgacgucggcucccuccaggagcagggcuccugcguccucgacgaccgcgagcuccuccuccucaccggcaccugcgucgaccucggccagggccgccgcuuccgcgaguccugcgucggccacgaccccaccgagccccucgaggucugccucgucuccuccgagcacuacgccgccuccgaccgcgagucccccggccacguccccuccacccucgacgccggccccgaggacaccugccccuccgccgaggagccccgccucaacguccaggucaccuccacccccgucaucgucaugcgcggcgccgccggccuccagcgcgagauccaggagggcgccuacuccggcuccugcuaccaccgcgacggccuccgccucuccauccaguucgagguccgccgcgucgagcuccagggccccaccccccucuucugcugcuggcucgucaaggaccuccuccacucccagcgcgacuccgccgcccgcacccgccucuuccucgccucccuccccggcuccacccacuccaccgccgccgagcucaccggccccucccucgucgagguccuccgcgcccgccccugguucgaggagccccccaaggccgucgagcucgagggccucgccgccugcgagggcgaguacucccagaaguacuccaccauguccccccucggcuccggcgccuucggcuucgucuggaccgccgucgacaaggagaagaacaaggaggucgucgucaaguucaucaagaaggagaagguccucgaggacugcuggaucgaggaccccaagcucggcaaggucacccucgagaucgccauccucucccgcgucgagcacgccaacaucaucaagguccucgacaucuucgagaaccagggcuucuuccagcucgucauggagaagcacggcuccggccucgaccucuucgccuucaucgaccgccacccccgccucgacgagccccucgccuccuacaucuuccgccagguccgcgccggccagucccgccucgucuccgccgucggcuaccuccgccucaaggacaucauccaccgcgacaucaaggacgagaacaucgucaucgccgaggacuucaccaucaagcucaucgacuucggcuccgccgccuaccucgagcgcggcaagcucuucuacaccuucugcggcaccaucgaguacugcgcccccgagguccucaugggcaaccccuaccgcggccccgagcucgagauguggucccucggcgucacccucuacacccucgucuucgaggagaaccccuucugcgagcucgaggagaccgucgaggccgccauccacccccccuaccucgucuccaaggagcucaugucccucgucuccggccuccuccagcccguccccgagcgccgcaccacccucgagaagcucgucaccgaccccugggucacccagcccgucaaccucgccgacuacaccugggaggaggucuuccgcgucaacaagcccgaguccggcguccucuccgccgccucccucgagaugggcaaccgcucccucuccgacgucgcccaggcccaggagcucugcggcggccccguccccggcgaggcccccaacggccagggcugccuccaccccggcgacccccgccuccucaccuccuga

SEQ ID NO: 47320 - RNA, 381 nt, Artificial Sequence
  derived and/or modified sequence opt2 from PATE1__Homo_sapiens__NP_612151
auggacaagucccuccuccucgagcuccccauccuccucugcugcuuccgcgcccucuccggcucccucuccaugcgcaacgacgccgucaacgagaucgucgccgucaagaacaacuuccccgucaucgagaucguccagugccgcaugugccaccuccaguuccccggcgagaagugcucccgcggccgcggcaucugcaccgccaccaccgaggaggccugcauggucggccgcauguucaagcgcgacggcaaccccuggcucaccuucaugggcugccucaagaacugcgccgacgucaagggcauccgcugguccgucuaccucgucaacuuccgcugcugccgcucccacgaccucugcaacgaggaccucuga

SEQ ID NO: 47321 - RNA, 2064 nt, Artificial Sequence
  derived and/or modified sequence opt2 from PATZ1__Homo_sapiens__NP_055138
auggagcgcgucaacgacgccuccugcggccccuccggcugcuacaccuaccaggucucccgccacuccaccgagaugcuccacaaccucaaccagcagcgcaagaacggcggccgcuucugcgacguccuccuccgcgucggcgacgaguccuuccccgcccaccgcgccguccucgccgccugcuccgaguacuucgaguccgucuucuccgcccagcucggcgacggcggcgccgccgacggcggccccgccgacgucggcggcgccaccgccgcccccggcggcggcgccggcggcucccgcgagcucgagaugcacaccaucuccuccaaggucuucggcgacauccucgacuucgccuacaccucccgcaucgucguccgccucgaguccuuccccgagcucaugaccgccgccaaguuccuccucaugcgcuccgucaucgagaucugccaggaggucaucaagcaguccaacguccagauccucgucccccccgcccgcgccgacaucaugcucuuccgcccccccggcaccuccgaccucggcuucccccucgacaugaccaacggcgccgcccucgccgccaacuccaacggcaucgccggcuccaugcagcccgaggaggaggccgcccgcgccgccggcgccgccaucgccggccaggccucccuccccguccuccccggcgucgaccgccuccccauggucgccggcccccucuccccccagcuccucaccucccccuuccccuccgucgccuccuccgcccccccccucaccggcaagcgcggccgcggccgcccccgcaaggccaaccuccucgacuccauguucggcucccccggcggccuccgcgaggccggcauccuccccugcggccucugcggcaaggucuucaccgacgccaaccgccuccgccagcacgaggcccagcacggcgucaccucccuccagcucggcuacaucgaccucccccccccccgccucggcgagaacggccuccccaucuccgaggaccccgacggcccccgcaagcgcucccgcacccgcaagcaggucgccugcgagaucugcggcaagaucuuccgcgacgucuaccaccucaaccgccacaagcucucccacuccggcgagaagcccuacuccugccccgucugcggccuccgcuucaagcgcaaggaccgcauguccuaccacguccgcucccacgacggcuccgucggcaagcccuacaucugccaguccugcggcaagggcuucucccgccccgaccaccucaacggccacaucaagcagguccacaccuccgagcgcccccacaagugccagaccugcaacgccuccuucgccacccgcgaccgccuccgcucccaccucgccugccacgaggacaagguccccugccaggucugcggcaaguaccuccgcgccgccuacauggccgaccaccucaagaagcacuccgagggccccuccaacuucugcuccaucugcaaccgcggcuucuccuccgccuccuaccucaagguccacgucaagacccaccacggcgucccccucccccaggucucccgccaccaggagcccauccucaacggcggcgccgccuuccacugcgcccgcaccuacggcaacaaggagggccagaagugcucccaccaggaccccaucgaguccuccgacuccuacggcgaccucuccgacgccuccgaccucaagacccccgagaagcaguccgccaacggcuccuucuccugcgacauggccguccccaagaacaagauggaguccgacggcgagaagaaguaccccugccccgagugcggcuccuucuuccgcuccaaguccuaccucaacaagcacauccagaagguccacguccgcgcccucggcggcccccucggcgaccucggccccgcccucggcucccccuucuccccccagcagaacaugucccuccucgaguccuucggcuuccagaucguccaguccgccuucgccuccucccucgucgaccccgaggucgaccagcagcccaugggccccgagggcaaguga

SEQ ID NO: 47322 - RNA, 1023 nt, Artificial Sequence
  derived and/or modified sequence opt2 from PAWR__Homo_sapiens__XP_006719498
auggccaccggcggcuaccgcaccuccuccggccucggcggcuccaccaccgacuuccucgaggaguggaaggccaagcgcgagaagaugcgcgccaagcagaacccccccggccccgccccccccggcggcggcuccuccgacgccgccggcaagccccccgccggcgcccucggcacccccgccgccgccgccgccaacgagcucaacaacaaccuccccggcggcgcccccgccgcccccgccguccccggccccggcggcgucaacugcgccgucggcuccgccaugcucacccgcgccgcccccggcccccgccgcuccgaggacgagccccccgccgccuccgccuccgccgccccccccccccagcgcgacgaggaggagcccgacggcguccccgagaagggcaaguccuccggccccuccgcccgcaagggcaagggccagaucgagaagcgcaagcuccgcgagaagcgccgcuccaccggcgucgucaacauccccgccgccgagugccucgacgaguacgaggacgacgaggccggccagaaggagcgcaagcgcgaggacgccaucacccagcagaacaccauccagaacgaggccgucaaccuccucgaccccggcuccuccuaccuccuccaggagcccccccgcaccgucuccggccgcuacaaguccaccaccuccgucuccgaggaggacgucuccucccgcuacucccgcaccgaccgcuccggcuucccccgcuacaaccgcgacgccaacgucuccggcacccucgucuccuccuccacccucgagaagaagaucgaggaccucgagaaggaggucguccgcgagcgccaggagaaccuccgccucguccgccucaugcaggacaaggaggagaugaucggcaagcucaaggaggagaucgaccuccucaaccgcgaccucgacgacaucgaggacgagaacgagcagcucaagcaggagaacaagacccuccucaaggucgucggccagcucacccgcuga

SEQ ID NO: 47323 - RNA, 1605 nt, Artificial Sequence
  derived and/or modified sequence opt2 from PAX1__Homo_sapiens__NP_006183
augaaguucacccucggccucggcucccgcgccuggcgcgucuccugggagggcgccgccgccgccgccgccggccccggcgccggcggcuccgcccuccgcugccgcgcccagcgcgucuccuccccccgccucggccgccgcggcucccgccucuccggcgcccucccccucugccucucccgcggcggcggcggcgcccaggcccuccccgacugcgccggccccucccccggccaccccggccaccccggcgcccgccagcucgccggcccccucgccauggagcagaccuacggcgaggucaaccagcucggcggcgucuucgucaacggccgcccccuccccaacgccauccgccuccgcaucgucgagcucgcccagcucggcauccgccccugcgacaucucccgccagcuccgcgucucccacggcugcgucuccaagauccucgcccgcuacaacgagaccggcuccauccuccccggcgccaucggcggcuccaagccccgcgucaccacccccaacgucgucaagcacauccgcgacuacaagcagggcgaccccggcaucuucgccugggagauccgcgaccgccuccucgccgacggcgucugcgacaaguacaacguccccuccgucuccuccaucucccgcauccuccgcaacaagaucggcucccucgcccagcccggccccuacgaggccuccaagcagccccccucccagcccacccuccccuacaaccacaucuaccaguaccccuaccccucccccgucucccccaccggcgccaagaugggcucccaccccggcguccccggcaccgccggccacgucuccaucccccgcuccuggcccuccgcccacuccgucuccaacauccucggcauccgcaccuucauggagcagaccggcgcccucgccggcuccgagggcaccgccuacucccccaagauggaggacugggccggcgucaaccgcaccgccuuccccgccacccccgccgucaacggccucgagaagcccgcccucgaggccgacaucaaguacacccaguccgccuccacccucuccgccgucggcggcuuccuccccgccugcgccuaccccgccuccaaccagcacggcgucuacuccgcccccggcggcggcuaccucgcccccggcccccccuggccccccgcccagggccccccccucgccccccccggcgccggcgucgccguccacggcggcgagcucgccgccgccaugaccuucaagcaccccucccgcgagggcucccuccccgcccccgccgcccgcccccgcacccccuccgucgccuacaccgacugccccucccgcccccgccccccccgcggcuccuccccccgcacccgcgcccgccgcgagcgccaggccgaccccggcgcccaggucugcgccgccgcccccgccaucggcaccggccgcaucggcggccucgccgaggaggaggccuccgccggcccccgcggcgcccgccccgccuccccccaggcccagcccugccucuggcccgaccccccccacuuccucuacugguccggcuuccucggcuucuccgagcucggcuucuga

SEQ ID NO: 47324 - RNA, 1185 nt, Artificial Sequence
  derived and/or modified sequence opt2 from PAX2__Homo_sapiens__NP_000269
auggacaugcacugcaaggccgaccccuucuccgccaugcaccccggccacggcggcgucaaccagcucggcggcgucuucgucaacggccgcccccuccccgacgucguccgccagcgcaucgucgagcucgcccaccagggcguccgccccugcgacaucucccgccagcuccgcgucucccacggcugcgucuccaagauccucggccgcuacuacgagaccggcuccaucaagcccggcgucaucggcggcuccaagcccaaggucgccacccccaaggucgucgacaagaucgccgaguacaagcgccagaaccccaccauguucgccugggagauccgcgaccgccuccucgccgagggcaucugcgacaacgacaccguccccuccgucuccuccaucaaccgcaucauccgcaccaagguccagcagcccuuccaccccacccccgacggcgccggcaccggcgucaccgcccccggccacaccaucguccccuccaccgccuccccccccgucuccuccgccuccaacgaccccgucggcuccuacuccaucaacggcauccucggcaucccccgcuccaacggcgagaagcgcaagcgcgacgaggacgucuccgagggcuccguccccaacggcgacucccaguccggcgucgacucccuccgcaagcaccuccgcgccgacaccuucacccagcagcagcucgaggcccucgaccgcgucuucgagcgccccuccuaccccgacgucuuccaggccuccgagcacaucaaguccgagcagggcaacgaguacucccuccccgcccucacccccggccucgacgaggucaaguccucccucuccgccuccaccaaccccgagcucggcuccaacgucuccggcacccagaccuaccccgucgucaccggccgcgacauggccuccaccacccuccccggcuaccccccccacgucccccccaccggccagggcuccuaccccaccuccacccucgccggcaugguccccggcuccgaguucuccggcaaccccuacucccacccccaguacaccgccuacaacgaggccuggcgcuucuccaaccccgcccuccucuccucccccuacuacuacuccgccgccccccgcggcuccgcccccgccgccgccgccgccgccuacgaccgccacuga

SEQ ID NO: 47325 - RNA, 648 nt, Artificial Sequence
  derived and/or modified sequence opt2 from PAX3__Homo_sapiens__NP_000429
augaccacccucgccggcgccgucccccgcaugaugcgccccggccccggccagaacuacccccgcuccggcuucccccucgaggucuccaccccccucggccagggccgcgucaaccagcucggcggcgucuucaucaacggccgcccccuccccaaccacauccgccacaagaucgucgagauggcccaccacggcauccgccccugcgucaucucccgccagcuccgcgucucccacggcugcgucuccaagauccucugccgcuaccaggagaccggcuccauccgccccggcgccaucggcggcuccaagcccaagcaggucaccacccccgacgucgagaagaagaucgaggaguacaagcgcgagaaccccggcauguucuccugggagauccgcgacaagcuccucaaggacgccgucugcgaccgcaacaccguccccuccgucuccuccaucucccgcauccuccgcuccaaguucggcaagggcgaggaggaggaggccgaccucgagcgcaaggaggccgaggaguccgagaagaaggccaagcacuccaucgacggcauccucuccgagcgcggcaagcgcuggcgccucggccgccgcaccugcugggucaccuggcgcgccuccgccuccuga

SEQ ID NO: 47326 - RNA, 1032 nt, Artificial Sequence
  derived and/or modified sequence opt2 from PAX4__Homo_sapiens__NP_006184
augaaccagcucggcggccucuucgucaacggccgcccccucccccucgacacccgccagcagaucguccgccucgccgucuccggcaugcgccccugcgacaucucccgcauccucaaggucuccaacggcugcgucuccaagauccucggccgcuacuaccgcaccggcguccucgagcccaagggcaucggcggcuccaagccccgccucgccaccccccccgucgucgcccgcaucgcccagcucaagggcgagugccccgcccucuucgccugggagauccagcgccagcucugcgccgagggccucugcacccaggacaagacccccuccgucuccuccaucaaccgcguccuccgcgcccuccaggaggaccagggccuccccugcacccgccuccgcucccccgccguccucgcccccgccguccucaccccccacuccggcuccgagaccccccgcggcacccaccccggcaccggccaccgcaaccgcaccaucuucucccccucccaggccgaggcccucgagaaggaguuccagcgcggccaguaccccgacuccgucgcccgcggcaagcucgccaccgccaccucccuccccgaggacaccguccgcgucugguucuccaaccgccgcgccaaguggcgccgccaggagaagcucaagugggagaugcagcuccccggcgccucccagggccucaccgucccccgcgucgcccccggcaucaucuccgcccagcagucccccggcuccguccccaccgccgcccuccccgcccucgagccccucggccccuccugcuaccagcucugcugggccaccgcccccgagcgcugccucuccgacaccccccccaaggccugccucaagcccugcuggggccaccuccccccccagcccaacucccucgacuccggccuccucugccuccccugccccuccucccacugccaccucgccucccucuccggcucccaggcccuccucuggcccggcugcccccuccucuacggccucgaguga

SEQ ID NO: 47327 - RNA, 1074 nt, Artificial Sequence
  derived and/or modified sequence opt2 from PAX5__Homo_sapiens__NP_001267476
auggaccucgagaagaacuaccccaccccccgcaccucccgcaccggccacggcggcgucaaccagcucggcggcgucuucgucaacggccgcccccuccccgacgucguccgccagcgcaucgucgagcucgcccaccagggcguccgccccugcgacaucucccgccagcuccgcgucucccacggcugcgucuccaagauccucggccgcuacuacgagaccggcuccaucaagcccggcgucaucggcggcuccaagcccaaggucgccacccccaaggucgucgagaagaucgccgaguacaagcgccagaaccccaccauguucgccugggagauccgcgaccgccuccucgccgagcgcgucugcgacaacgacaccguccccuccgucuccuccaucaaccgcaucauccgcaccaagguccagcagccccccaaccagcccguccccgccuccucccacuccaucgucuccaccggcuccgucacccaggucuccuccgucuccaccgacuccgccggcuccuccuacuccaucuccggcauccucggcaucaccucccccuccgccgacaccaacaagcgcaagcgcgacgagggcauccaggagucccccguccccaacggccacucccuccccggccgcgacuuccuccgcaagcagaugcgcggcgaccucuucacccagcagcagcucgagguccucgaccgcgucuucgagcgccagcacuacuccgacaucuucaccaccaccgagcccaucaagcccgagcagaccaccgaguacuccgccauggccucccucgccggcggccucgacgacaugaaggccaaccucgccucccccacccccgccgacaucggcuccuccguccccggcccccaguccuaccccaucgucaccggcuccgaguucuccggcucccccuacucccacccccaguacuccuccuacaacgacuccuggcgcuuccccaaccccggccuccucggcucccccuacuacuacuccgccgccgcccgcggcgccgccccccccgccgccgccaccgccuacgaccgccacuga

SEQ ID NO: 47328 - RNA, 1311 nt, Artificial Sequence
  derived and/or modified sequence opt2 from PAX6__Homo_sapiens__NP_001245391
augcagaacucccacuccggcgucaaccagcucggcggcgucuucgucaacggccgcccccuccccgacuccacccgccagaagaucgucgagcucgcccacuccggcgcccgccccugcgacaucucccgcauccuccagacccacgccgacgccaagguccagguccucgacaaccagaacgucuccaacggcugcgucuccaagauccucggccgcuacuacgagaccggcuccauccgcccccgcgccaucggcggcuccaagccccgcgucgccacccccgaggucgucuccaagaucgcccaguacaagcgcgagugccccuccaucuucgccugggagauccgcgaccgccuccucuccgagggcgucugcaccaacgacaacauccccuccgucuccuccaucaaccgcguccuccgcaaccucgccuccgagaagcagcagaugggcgccgacggcauguacgacaagcuccgcaugcucaacggccagaccggcuccuggggcacccgccccggcugguaccccggcaccuccguccccggccagcccacccaggacggcugccagcagcaggagggcggcggcgagaacaccaacuccaucuccuccaacggcgaggacuccgacgaggcccagaugcgccuccagcucaagcgcaagcuccagcgcaaccgcaccuccuucacccaggagcagaucgaggcccucgagaaggaguucgagcgcacccacuaccccgacgucuucgcccgcgagcgccucgccgccaagaucgaccuccccgaggcccgcauccaggucugguucuccaaccgccgcgccaaguggcgccgcgaggagaagcuccgcaaccagcgccgccaggccuccaacacccccucccacauccccaucuccuccuccuucuccaccuccgucuaccagcccaucccccagcccaccacccccgucuccuccuucaccuccggcuccaugcucggccgcaccgacaccgcccucaccaacaccuacuccgcccucccccccaugcccuccuucaccauggccaacaaccuccccaugcagccccccguccccucccagaccuccuccuacuccugcaugcuccccaccucccccuccgucaacggccgcuccuacgacaccuacacccccccccacaugcagacccacaugaacucccagcccaugggcaccuccggcaccaccuccaccggccucaucucccccggcgucuccguccccguccagguccccggcuccgagcccgacaugucccaguacuggccccgccuccaguga

SEQ ID NO: 47329 - RNA, 1353 nt, Artificial Sequence
  derived and/or modified sequence opt2 from PAX8__Homo_sapiens__NP_003457
augccccacaacuccauccgcuccggccacggcggccucaaccagcucggcggcgccuucgucaacggccgcccccuccccgaggucguccgccagcgcaucgucgaccucgcccaccagggcguccgccccugcgacaucucccgccagcuccgcgucucccacggcugcgucuccaagauccucggccgcuacuacgagaccggcuccauccgccccggcgucaucggcggcuccaagcccaaggucgccacccccaaggucgucgagaagaucggcgacuacaagcgccagaaccccaccauguucgccugggagauccgcgaccgccuccucgccgagggcgucugcgacaacgacaccguccccuccgucuccuccaucaaccgcaucauccgcaccaagguccagcagcccuucaaccuccccauggacuccugcgucgccaccaagucccucucccccggccacacccucauccccuccuccgccgucaccccccccgaguccccccaguccgacucccucggcuccaccuacuccaucaacggccuccucggcaucgcccagcccggcuccgacaagcgcaagauggacgacuccgaccaggacuccugccgccucuccaucgacucccaguccuccuccuccggcccccgcaagcaccuccgcaccgacgccuucucccagcaccaccucgagccccucgagugccccuucgagcgccagcacuaccccgaggccuacgccucccccucccacaccaagggcgagcagggccucuacccccucccccuccucaacuccacccucgacgacggcaaggccacccucacccccuccaacaccccccucggccgcaaccucuccacccaccagaccuaccccgucgucgccgacccccacucccccuucgccaucaagcaggagacccccgaggucuccuccuccuccuccacccccuccucccucuccuccuccgccuuccucgaccuccagcaggucggcuccggcgucccccccuucaacgccuucccccacgccgccuccgucuacggccaguucaccggccaggcccuccucuccggccgcgagauggucggccccacccuccccggcuaccccccccacauccccaccuccggccagggcuccuacgccuccuccgccaucgccggcauggucgccggcuccgaguacuccggcaacgccuacggccacacccccuacuccuccuacuccgaggccuggcgcuuccccaacuccucccuccucuccucccccuacuacuacuccuccaccucccgccccuccgccccccccaccaccgccaccgccuucgaccaccucuga

SEQ ID NO: 47330 - RNA, 1026 nt, Artificial Sequence
  derived and/or modified sequence opt2 from PAX9__Homo_sapiens__NP_006185
auggagcccgccuucggcgaggucaaccagcucggcggcgucuucgucaacggccgcccccuccccaacgccauccgccuccgcaucgucgagcucgcccagcucggcauccgccccugcgacaucucccgccagcuccgcgucucccacggcugcgucuccaagauccucgcccgcuacaacgagaccggcuccauccuccccggcgccaucggcggcuccaagccccgcgucaccacccccaccgucgucaagcacauccgcaccuacaagcagcgcgaccccggcaucuucgccugggagauccgcgaccgccuccucgccgacggcgucugcgacaaguacaacguccccuccgucuccuccaucucccgcauccuccgcaacaagaucggcaaccucgcccagcagggccacuacgacuccuacaagcagcaccagcccaccccccagcccgcccuccccuacaaccacaucuacuccuaccccucccccaucaccgccgccgccgccaagguccccaccccccccggcguccccgccauccccggcuccgucgccaugccccgcaccuggcccuccucccacuccgucaccgacauccucggcauccgcuccaucaccgaccaggucuccgacuccucccccuaccacucccccaaggucgaggagugguccucccucggccgcaacaacuuccccgccgccgccccccacgccgucaacggccucgagaagggcgcccucgagcaggaggccaaguacggccaggcccccaacggccuccccgccgucggcuccuucgucuccgccuccuccauggcccccuaccccacccccgcccaggucucccccuacaugaccuacuccgccgcccccuccggcuacgucgccggccacggcuggcagcacgccggcggcaccucccucuccccccacaacugcgacauccccgccucccucgccuucaagggcaugcaggccgcccgcgagggcucccacuccgucaccgccuccgcccucuga

SEQ ID NO: 47331 - RNA, 3210 nt, Artificial Sequence
  derived and/or modified sequence opt2 from PAXIP1__Homo_sapiens__NP_031375
auguccgaccaggcccccaagguccccgaggagauguuccgcgaggucaaguacuacgccgucggcgacaucgacccccaggucauccagcuccucaaggccggcaaggccaaggaggucuccuacaacgcccucgccucccacaucaucuccgaggacggcgacaaccccgaggucggcgaggcccgcgaggucuucgaccuccccgucgucaagcccuccugggucauccucuccguccagugcggcacccuccuccccgucaacggcuucucccccgaguccugccagaucuucuucggcaucaccgccugccucucccaggucuccuccgaggaccgcuccgcccucugggcccucgucaccuucuacggcggcgacugccagcucacccucaacaagaagugcacccaccucaucguccccgagcccaagggcgagaaguacgagugcgcccucaagcgcgccuccaucaagaucgucacccccgacuggguccucgacugcgucuccgagaagaccaagaaggacgaggccuucuaccacccccgccucaucaucuacgaggaggaggaggaggaggaggaggaggaggaggaggucgagaacgaggagcaggacucccagaacgagggcuccaccgacgagaaguccucccccgccuccucccaggagggcucccccuccggcgaccagcaguucucccccaaguccaacaccgagaaguccaagggcgagcucauguucgacgacuccuccgacuccucccccgagaagcaggagcgcaaccucaacuggacccccgccgaggucccccagcucgccgccgccaagcgccgccucccccagggcaaggagcccggccucaucaaccucugcgccaacgucccccccguccccggcaacauccucccccccgagguccgcggcaaccucauggccgccggccagaaccuccaguccuccgagcgcuccgagaugaucgccaccuggucccccgccguccgcacccuccgcaacaucaccaacaacgccgacauccagcagaugaaccgccccuccaacgucgcccacauccuccagacccucuccgcccccaccaagaaccucgagcagcaggucaaccacucccagcagggccacaccaacgccaacgccguccucuucucccaggucaaggucacccccgagacccacaugcuccagcagcagcagcaggcccagcagcagcagcagcagcaccccguccuccaccuccagccccagcagaucaugcagcuccagcagcagcagcagcagcagaucucccagcagcccuacccccagcagcccccccaccccuucucccagcagcagcagcagcagcagcaggcccacccccaccaguucucccagcagcagcuccaguucccccagcagcagcuccaccccccccagcagcuccaccgcccccagcagcagcuccagcccuuccagcagcagcacgcccuccagcagcaguuccaccagcuccagcagcaccagcuccagcagcagcagcucgcccagcuccagcagcagcacucccuccuccagcagcagcagcagcagcagauccagcagcagcagcuccagcgcaugcaccagcagcagcagcagcagcagaugcagucccagaccgccccccaccucucccagaccucccaggcccuccagcaccagguccccccccagcagcccccccagcagcagcagcagcagcagcccccccccuccccccagcagcaccagcucuucggccacgaccccgccgucgagauccccgaggagggcuuccuccucggcugcgucuucgccaucgccgacuaccccgagcagauguccgacaagcagcuccucgccaccuggaagcgcaucauccaggcccacggcggcaccgucgaccccaccuucaccucccgcugcacccaccuccucugcgagucccaggucuccuccgccuacgcccaggccauccgcgagcgcaagcgcugcgucaccgcccacuggcucaacaccguccucaagaagaagaagaugguccccccccaccgcgcccuccacuuccccgucgccuucccccccggcggcaagcccugcucccagcacaucaucuccgucaccggcuucgucgacuccgaccgcgacgaccucaagcucauggccuaccucgccggcgccaaguacaccggcuaccucugccgcuccaacaccguccucaucugcaaggagcccaccggccucaaguacgagaaggccaaggaguggcgcauccccugcgucaacgcccaguggcucggcgacauccuccucggcaacuucgaggcccuccgccagauccaguacucccgcuacaccgccuucucccuccaggaccccuucgcccccacccagcaccucguccucaaccuccucgacgccuggcgcgucccccucaaggucuccgccgagcuccucauguccauccgccucccccccaagcucaagcagaacgaggucgccaacguccagcccuccuccaagcgcgcccgcaucgaggacguccccccccccaccaagaagcucacccccgagcucacccccuucguccucuucaccggcuucgagcccguccagguccagcaguacaucaagaagcucuacauccucggcggcgaggucgccgaguccgcccagaagugcacccaccucaucgccuccaaggucacccgcaccgucaaguuccucaccgccaucuccgucgucaagcacaucgucacccccgaguggcucgaggagugcuuccgcugccagaaguucaucgacgagcagaacuacauccuccgcgacgccgaggccgagguccucuucuccuucucccucgaggagucccucaagcgcgcccacgucuccccccucuucaaggccaaguacuucuacaucacccccggcaucugccccucccucuccaccaugaaggccaucgucgagugcgccggcggcaagguccucuccaagcagcccuccuuccgcaagcucauggagcacaagcagaacuccucccucuccgagaucauccucaucuccugcgagaacgaccuccaccucugccgcgaguacuucgcccgcggcaucgacguccacaacgccgaguucguccucaccggcguccucacccagacccucgacuacgaguccuacaaguucaacuga

SEQ ID NO: 47332 - RNA, 969 nt, Artificial Sequence
  derived and/or modified sequence opt2 from PBK__Homo_sapiens__XP_006716431
auggagggcaucuccaacuucaagacccccuccaagcucuccgagaagaagaaguccguccucugcuccacccccaccaucaacauccccgccucccccuucaugcagaagcucggcuucggcaccggcgucaacgucuaccucaugaagcgcuccccccgcggccucucccacucccccugggccgucaagaagaucaaccccaucugcaacgaccacuaccgcuccgucuaccagaagcgccucauggacgaggccaagauccucaagucccuccaccaccccaacaucgucggcuaccgcgccuucaccgaggccaacgacggcucccucugccucgccauggaguacggcggcgagaagucccucaacgaccucaucgaggagcgcuacaaggccucccaggaccccuuccccgccgccaucauccucaaggucgcccucaacauggcccgcggccucaaguaccuccaccaggagaagaagcuccuccacggcgacaucaaguccuccaacgucgucaucaagggcgacuucgagaccaucaagaucugcgacgucggcgucucccucccccucgacgagaacaugaccgucaccgaccccgaggccugcuacaucggcaccgagcccuggaagcccaaggaggccgucgaggagaacggcgucaucaccgacaaggccgacaucuucgccuucggccucacccucugggagaugaugacccucuccaucccccacaucaaccucuccaacgacgacgacgacgaggacaagaccuucgacgaguccgacuucgacgacgaggccuacuacgccgcccucggcacccgcccccccaucaacauggaggagcucgacgaguccuaccagaaggucaucgagcucuucuccgucugcaccaacgaggaccccaaggaccgccccuccgccgcccacaucgucgaggcccucgagaccgacgucuga

SEQ ID NO: 47333 - RNA, 843 nt, Artificial Sequence
  derived and/or modified sequence opt2 from PBLD__Homo_sapiens__NP_001028255
augaagcuccccaucuucaucgccgacgccuucaccgcccgcgccuuccgcggcaaccccgccgccgucugccuccucgagaacgagcucgacgaggacaugcaccagaagaucgcccgcgagaugaaccucuccgagaccgccuucauccgcaagcuccaccccaccgacaacuucgcccaguccuccugcuucggccuccgcugguucacccccgccuccgaggucccccucugcggccacgccacccucgccuccgccgccguccucuuccacaagaucaagaacaugaacuccacccucaccuucgucacccucuccggcgagcuccgcgcccgccgcgccgaggacggcaucguccucgaccucccccucuaccccgcccacccccaggacuuccacgaggucgaggaccucaucaagaccgccaucggcaacacccucguccaggacaucugcuacucccccgacacccagaagcuccucguccgccucuccgacgucuacaaccgcuccuuccucgagaaccucaaggucaacaccgagaaccuccuccaggucgagaacaccggcaaggucaagggccucauccucacccucaagggcgagcccggcggccagacccaggccuucgacuucuacucccgcuacuucgcccccugggucggcgucgccgaggaccccgucaccggcuccgcccacgccguccucuccuccuacuggucccagcaccucggcaagaaggagaugcacggccgcaccgcccucuaccaguuccucuucuaccuccccaacuccaagcucgucuuccuccucaucugcaccaucccccucaagauguga

SEQ ID NO: 47334 - RNA, 408 nt, Artificial Sequence
  derived and/or modified sequence opt2 from PBOV1__Homo_sapiens__NP_067648
augcgcgccuuccuccgcaaccagaaguacgaggacaugcacaacaucauccacauccuccagauccgcaagcuccgccaccgccucuccaacuucccccgccuccccggcauccucgcccccgagaccguccuccuccccuucugcuacaaggucuuccgcaagaaggagaaggucaagcgcucccagaaggccaccgaguucaucgacuacuccaucgagcagucccaccacgccauccucaccccccuccagacccaccucaccaugaagggcuccuccaugaagugcuccucccucuccuccgaggccauccucuucacccucacccuccagcucacccagacccucggccucgagugcugccuccucuaccucuccaagaccauccacccccagaucaucuga

SEQ ID NO: 47335 - RNA, 4749 nt, Artificial Sequence
  derived and/or modified sequence opt2 from PBRM1__Homo_sapiens__NP_060783
augggcuccaagcgccgccgcgccaccucccccuccuccuccgucuccggcgacuucgacgacggccaccacuccgucuccacccccggccccucccgcaagcgccgccgccucuccaaccuccccaccgucgaccccaucgccgucugccacgagcucuacaacaccauccgcgacuacaaggacgagcagggccgccuccucugcgagcucuucauccgcgcccccaagcgccgcaaccagcccgacuacuacgaggucgucucccagcccaucgaccucaugaagauccagcagaagcucaagauggaggaguacgacgacgucaaccuccucaccgccgacuuccagcuccucuucaacaacgccaaguccuacuacaagcccgacucccccgaguacaaggccgccugcaagcucugggaccucuaccuccgcacccgcaacgaguucguccagaagggcgaggccgacgacgaggacgacgacgaggacggccaggacaaccagggcaccgucaccgagggcuccucccccgccuaccucaaggagauccucgagcagcuccucgaggccaucgucgucgccaccaaccccuccggccgccucaucuccgagcucuuccagaagcuccccuccaagguccaguaccccgacuacuacgccaucaucaaggagcccaucgaccucaagaccaucgcccagcgcauccagaacggcuccuacaaguccauccacgccauggccaaggacaucgaccuccucgccaagaacgccaagaccuacaacgagcccggcucccaggucuucaaggacgccaacuccaucaagaagaucuucuacaugaagaaggccgagaucgagcaccacgagauggccaaguccucccuccgcaugcgcacccccuccaaccucgccgccgcccgccucaccggccccucccacuccaagggcucccucggcgaggagcgcaaccccaccuccaaguacuaccgcaacaagcgcgccguccagggcggccgccucuccgccaucaccauggcccuccaguacggcuccgaguccgaggaggacgccgcccucgccgccgcccgcuacgaggagggcgaguccgaggccgaguccaucaccuccuucauggacgucuccaaccccuucuaccagcucuacgacaccguccgcuccugccgcaacaaccagggccagcucaucgccgagcccuucuaccaccuccccuccaagaagaaguaccccgacuacuaccagcagaucaagaugcccaucucccuccagcagauccgcaccaagcucaagaaccaggaguacgagacccucgaccaccucgagugcgaccucaaccucauguucgagaacgccaagcgcuacaacguccccaacuccgccaucuacaagcgcguccucaagcuccagcaggucaugcaggccaagaagaaggagcucgcccgccgcgacgacaucgaggacggcgacuccaugaucuccuccgccaccuccgacaccggcuccgccaagcgcaaguccaagaagaacauccgcaagcagcgcaugaagauccucuucaacgucguccucgaggcccgcgagcccggcuccggccgccgccucugcgaccucuucauggucaagcccuccaagaaggacuaccccgacuacuacaagaucauccucgagcccauggaccucaagaucaucgagcacaacauccgcaacgacaaguacgccggcgaggagggcaugaucgaggacaugaagcucauguuccgcaacgcccgccacuacaacgaggagggcucccaggucuacaacgacgcccacauccucgagaagcuccucaaggagaagcgcaaggagcucggcccccuccccgacgacgacgacauggccucccccaagcucaagcucucccgcaaguccggcaucucccccaagaaguccaaguacaugacccccaugcagcagaagcucaacgaggucuacgaggccgucaagaacuacaccgacaagcgcggccgccgccucuccgccaucuuccuccgccuccccucccgcuccgagcuccccgacuacuaccucaccaucaagaagcccauggacauggagaagauccgcucccacaugauggccaacaaguaccaggacaucgacuccauggucgaggacuucgucaugauguucaacaacgccugcaccuacaacgagcccgagucccucaucuacaaggacgcccucguccuccacaagguccuccucgagacccgccgcgaccucgagggcgacgaggacucccacguccccaacgucacccuccucauccaggagcucauccacaaccucuucgucuccgucaugucccaccaggacgacgagggccgcugcuacuccgacucccucgccgagauccccgccgucgaccccaacuuccccaacaagcccccccucaccuucgacaucauccgcaagaacgucgagaacaaccgcuaccgccgccucgaccucuuccaggagcacauguucgagguccucgagcgcgcccgccgcaugaaccgcaccgacuccgagaucuacgaggacgccgucgagcuccagcaguucuucaucaagauccgcgacgagcucugcaagaacggcgagauccuccucucccccgcccucuccuacaccaccaagcaccuccacaacgacgucgagaaggagcgcaaggagaagcuccccaaggagaucgaggaggacaagcucaagcgcgaggaggagaagcgcgaggccgagaaguccgaggacuccuccggcgccgccggccucuccggccuccaccgcaccuacucccaggacugcuccuucaagaacuccauguaccacgucggcgacuacgucuacgucgagcccgccgaggccaaccuccagccccacaucgucugcaucgagcgccucugggaggacuccgccgagaaggaggucuucaaguccgacuacuacaacaagguccccgucuccaagauccucggcaagugcgucgucauguucgucaaggaguacuucaagcucugccccgagaacuuccgcgacgaggacgucuucgucugcgagucccgcuacuccgccaagaccaaguccuucaagaagaucaagcucuggaccaugcccaucuccuccguccgcuucgucccccgcgacgucccccuccccgucguccgcgucgccuccgucuucgccaacgccgacaagggcgacgacgagaagaacaccgacaacuccgaggacucccgcgccgaggacaacuucaaccucgagaaggagaaggaggacguccccgucgagauguccaacggcgagcccggcugccacuacuucgagcagcuccacuacaacgacauguggcucaaggucggcgacugcgucuucaucaagucccacggccucguccgcccccgcgucggccgcaucgagaaggucuggguccgcgacggcgccgccuacuucuacggccccaucuucauccaccccgaggagaccgagcacgagcccaccaagauguucuacaagaaggaggucuuccucuccaaccucgaggagaccugccccaugaccugcauccucggcaagugcgccguccucuccuucaaggacuuccucuccugccgccccaccgagauccccgagaacgacauccuccucugcgagucccgcuacaacgaguccgacaagcagaugaagaaguucaagggccucaagcgcuucucccucuccgccaaggucgucgacgacgagaucuacuacuuccgcaagcccaucgucccccagaaggagcccuccccccuccucgagaagaagauccagcuccucgaggccaaguucgccgagcucgagggcggcgacgacgacaucgaggagaugggcgaggaggacuccgaguccacccccaaguccgccaagggcuccgccaagaaggagggcuccaagcgcaagaucaacauguccggcuacauccucuucuccuccgagaugcgcgccgucaucaaggcccagcaccccgacuacuccuucggcgagcucucccgccucgucggcaccgaguggcgcaaccucgagaccgccaagaaggccgaguacgagggcaugaugggcggcuacccccccggccuccccccccuccagggccccgucgacggccucgucuccaugggcuccaugcagccccuccaccccggcggcccccccccccaccaccucccccccggcguccccggccuccccggcauccccccccccggcgucaugaaccagggcgucgcccccauggucggcacccccgcccccggcggcucccccuacggccagcaggucggcguccucggcccccccggccagcaggcccccccccccuaccccggcccccaccccgccggcccccccgucauccagcagcccaccacccccauguucgucgcccccccccccaagacccagcgccuccuccacuccgaggccuaccucaaguacaucgagggccucuccgccgaguccaacuccaucuccaagugggaccagacccucgccgcccgccgccgcgacguccaccucuccaaggagcaggagucccgccuccccucccacuggcucaaguccaagggcgcccacaccaccauggccgacgcccucuggcgccuccgcgaccucaugcuccgcgacacccucaacauccgccaggccuacaaccucgagaacgucuga

SEQ ID NO: 47336 - RNA, 1044 nt, Artificial Sequence
  derived and/or modified sequence opt2 from PBX1__Homo_sapiens__NP_001191890
auggacgagcagccccgccucaugcacucccacgccggcgucggcauggccggccaccccggccucucccagcaccuccaggacggcgccggcggcaccgagggcgagggcggccgcaagcaggacaucggcgacauccuccagcagaucaugaccaucaccgaccagucccucgacgaggcccaggcccgcaagcacgcccucaacugccaccgcaugaagcccgcccucuucaacguccucugcgagaucaaggagaagaccguccucuccauccgcggcgcccaggaggaggagcccaccgacccccagcucaugcgccucgacaacaugcuccucgccgagggcgucgccggccccgagaagggcggcggcuccgccgccgccgccgccgccgccgccgccuccggcggcgccggcuccgacaacuccgucgagcacuccgacuaccgcgccaagcucucccagauccgccagaucuaccacaccgagcucgagaaguacgagcaggccugcaacgaguucaccacccacgucaugaaccuccuccgcgagcagucccgcacccgccccaucucccccaaggagaucgagcgcauggucuccaucauccaccgcaaguucuccuccauccagaugcagcucaagcaguccaccugcgaggccgucaugauccuccgcucccgcuuccucgacgcccgccgcaagcgccgcaacuucaacaagcaggccaccgagauccucaacgaguacuucuacucccaccucuccaaccccuaccccuccgaggaggccaaggaggagcucgccaagaagugcggcaucaccgucucccaggucuccaacugguucggcaacaagcgcauccgcuacaagaagaacaucggcaaguuccaggaggaggccaacaucuacgccgccaagaccgccgucaccgccaccaacgucuccgcccacggcucccaggccaacucccccuccacccccaacuccgccggcggcuaccccucccccugcuaccagcccgaccgccgcauccaguga

SEQ ID NO: 47337 - RNA, 1293 nt, Artificial Sequence
  derived and/or modified sequence opt2 from PBX2__Homo_sapiens__NP_002577
auggacgagcgccuccucggcccccccccccccggcggcggccgcggcggccucggccucgucuccggcgagcccggcggccccggcgagccccccggcggcggcgaccccggcggcggcuccggcggcguccccggcggccgcggcaagcaggacaucggcgacauccuccagcagaucaugaccaucaccgaccagucccucgacgaggcccaggccaagaagcacgcccucaacugccaccgcaugaagcccgcccucuucuccguccucugcgagaucaaggagaagaccggccucuccauccgcuccucccaggaggaggagcccgucgacccccagcucaugcgccucgacaacaugcuccucgccgagggcgucgccggccccgagaagggcggcggcuccgccgccgccgccgccgccgccgccgccuccggcggcggcgucucccccgacaacuccaucgagcacuccgacuaccgcuccaagcucgcccagauccgccacaucuaccacuccgagcucgagaaguacgagcaggccugcaacgaguucaccacccacgucaugaaccuccuccgcgagcagucccgcacccgccccgucgcccccaaggagauggagcgcauggucuccaucauccaccgcaaguucuccgccauccagaugcagcucaagcaguccaccugcgaggccgucaugauccuccgcucccgcuuccucgacgcccgccgcaagcgccgcaacuucuccaagcaggccaccgagguccucaacgaguacuucuacucccaccucuccaaccccuaccccuccgaggaggccaaggaggagcucgccaagaagugcggcaucaccgucucccaggucuccaacugguucggcaacaagcgcauccgcuacaagaagaacaucggcaaguuccaggaggaggccaacaucuacgccgucaagaccgccgucuccgucacccagggcggccacucccgcaccuccucccccaccccccccuccuccgccggcuccggcggcuccuucaaccucuccggcuccggcgacauguuccucggcaugcccggccucaacggcgacuccuacuccgccucccaggucgagucccuccgccacuccaugggccccggcggcuacggcgacaaccucggcggcggccagauguacuccccccgcgagaugcgcgccaacggcuccuggcaggaggccgucacccccuccuccgucaccucccccaccgagggccccggcuccguccacuccgacaccuccaacuga

SEQ ID NO: 47338 - RNA, 1080 nt, Artificial Sequence
  derived and/or modified sequence opt2 from PBX3__Homo_sapiens__NP_001128250
augaagcccgcccucuucuccguccucugcgagaucaaggagaagaccggccucuccauccgcggcgcccaggaggaggacccccccgacccccagcucaugcgccucgacaacaugcuccucgccgagggcgucuccggccccgagaagggcggcggcuccgccgccgccgccgccgccgccgccgccuccggcggcuccuccgacaacuccaucgagcacuccgacuaccgcgccaagcucacccagauccgccagaucuaccacaccgagcucgagaaguacgagcaggccugcaacgaguucaccacccacgucaugaaccuccuccgcgagcagucccgcacccgccccaucucccccaaggagaucgagcgcauggucggcaucauccaccgcaaguucuccuccauccagaugcagcucaagcaguccaccugcgaggccgucaugauccuccgcucccgcuuccucgacgcccgccgcaagcgccgcaacuucuccaagcaggccaccgagauccucaacgaguacuucuacucccaccucuccaaccccuaccccuccgaggaggccaaggaggagcucgccaagaagugcuccaucaccgucucccaggucuccaacugguucggcaacaagcgcauccgcuacaagaagaacaucggcaaguuccaggaggaggccaaccucuacgccgccaagaccgccgucaccgccgcccacgccgucgccgccgccguccagaacaaccagaccaacucccccaccacccccaacuccggcuccuccggcuccuucaaccuccccaacuccggcgacauguucaugaacaugcagucccucaacggcgacuccuaccagggcucccaggucggcgccaacguccagucccaggucgacacccuccgccacgucaucaaccagaccggcggcuacuccgacggccucggcggcaacucccucuacuccccccacaaccucaacgccaacggcggcuggcaggacgccaccacccccuccuccgucaccucccccaccgagggccccggcuccguccacuccgacaccuccaacuga

SEQ ID NO: 47339 - RNA, 1125 nt, Artificial Sequence
  derived and/or modified sequence opt2 from PBX4__Homo_sapiens__NP_079521
auggccgcccccccccgccccgcccccuccccccccgccccccgccgccucgacaccuccgacguccuccagcagaucauggccaucaccgaccagucccucgacgaggcccaggcccgcaagcacgcccucaacugccaccgcaugaagcccgcccucuucuccguccucugcgagaucaaggagaagaccgucgucuccauccgcggcauccaggacgaggacccccccgacgcccagcuccuccgccucgacaacaugcuccucgccgagggcgucugccgccccgagaagcgcggccgcggcggcgccgucgcccgcgccggcaccgccacccccggcggcugccccaacgacaacuccaucgagcacuccgacuaccgcgccaagcucucccagauccgccagaucuaccacuccgagcucgagaaguacgagcaggccugccgcgaguucaccacccacgucaccaaccuccuccaggagcagucccgcaugcgccccgucucccccaaggagaucgagcgcauggucggcgccauccacggcaaguucuccgccauccagaugcagcucaagcaguccaccugcgaggccgucaugacccuccgcucccgccuccucgacgcccgccgcaagcgccgcaacuucuccaagcaggccaccgagguccucaacgaguacuucuacucccaccucaacaaccccuaccccuccgaggaggccaaggaggagcucgcccgcaagggcggccucaccaucucccaggucuccaacugguucggcaacaagcgcauccgcuacaagaagaacaugggcaaguuccaggaggaggccaccaucuacaccggcaagaccgccgucgacaccaccgaggucggcguccccggcaaccacgccuccugccucuccacccccuccuccggcuccuccggccccuucccccuccccuccgccggcgacgccuuccucacccuccgcacccucgccucccuccagcccccccccggcggcggcugccuccagucccaggcccagggcuccuggcagggcgccaccccccagcccgccaccgccucccccgccggcgaccccggcuccaucaacuccuccaccuccaacuga

SEQ ID NO: 47340 - RNA, 315 nt, Artificial Sequence
  derived and/or modified sequence opt2 from PCBD1__Homo_sapiens__NP_000272
auggccggcaaggcccaccgccucuccgccgaggagcgcgaccagcuccuccccaaccuccgcgccgucggcuggaacgagcucgagggccgcgacgccaucuucaagcaguuccacuucaaggacuucaaccgcgccuucggcuucaugacccgcgucgcccuccaggccgagaagcucgaccaccaccccgagugguucaacgucuacaacaagguccacaucacccucuccacccacgagugcgccggccucuccgagcgcgacaucaaccucgccuccuucaucgagcaggucgccgucuccaugaccuga

SEQ ID NO: 47341 - RNA, 393 nt, Artificial Sequence
  derived and/or modified sequence opt2 from PCBD2__Homo_sapiens__NP_115527
auggccgccguccucggcgcccucggcgccacccgccgccuccucgccgcccuccgcggccagucccucggccucgccgccauguccuccggcacccaccgccucaccgccgaggagcgcaaccaggccauccucgaccucaaggccgccggcugguccgagcucuccgagcgcgacgccaucuacaaggaguucuccuuccacaacuucaaccaggccuucggcuucaugucccgcgucgcccuccaggccgagaagaugaaccaccaccccgagugguucaacgucuacaacaagguccagaucacccucaccucccacgacugcggcgagcucaccaagaaggacgucaagcucgccaaguucaucgagaaggccgccgccuccgucuga

SEQ ID NO: 47342 - RNA, 1071 nt, Artificial Sequence
  derived and/or modified sequence opt2 from PCBP1__Homo_sapiens__NP_006187
auggacgccggcgucaccgaguccggccucaacgucacccucaccauccgccuccucaugcacggcaaggaggucggcuccaucaucggcaagaagggcgaguccgucaagcgcauccgcgaggaguccggcgcccgcaucaacaucuccgagggcaacugccccgagcgcaucaucacccucaccggccccaccaacgccaucuucaaggccuucgccaugaucaucgacaagcucgaggaggacaucaacuccuccaugaccaacuccaccgccgccucccgcccccccgucacccuccgccucgucguccccgccacccagugcggcucccucaucggcaagggcggcugcaagaucaaggagauccgcgaguccaccggcgcccagguccaggucgccggcgacaugcuccccaacuccaccgagcgcgccaucaccaucgccggcgucccccaguccgucaccgagugcgucaagcagaucugccucgucaugcucgagacccucucccaguccccccagggccgcgucaugaccauccccuaccagcccaugcccgccuccucccccgucaucugcgccggcggccaggaccgcugcuccgacgccgccggcuacccccacgccacccacgaccucgagggccccccccucgacgccuacuccauccagggccagcacaccaucuccccccucgaccucgccaagcucaaccaggucgcccgccagcagucccacuucgccaugaugcacggcggcaccggcuucgccggcaucgacuccuccucccccgaggucaagggcuacugggccucccucgacgccuccacccagaccacccacgagcucaccauccccaacaaccucaucggcugcaucaucggccgccagggcgccaacaucaacgagauccgccagauguccggcgcccagaucaagaucgccaaccccgucgagggcuccuccggccgccaggucaccaucaccggcuccgccgccuccaucucccucgcccaguaccucaucaacgcccgccucuccuccgagaagggcaugggcugcuccuga

SEQ ID NO: 47343 - RNA, 996 nt, Artificial Sequence
  derived and/or modified sequence opt2 from PCBP2__Homo_sapiens__NP_001092090
auggacaccggcgucaucgagggcggccucaacgucacccucaccauccgccuccucaugcacggcaaggaggucggcuccaucaucggcaagaagggcgaguccgucaagaagaugcgcgaggaguccggcgcccgcaucaacaucuccgagggcaacugccccgagcgcaucaucacccucgccggccccaccaacgccaucuucaaggccuucgccaugaucaucgacaagcucgaggaggacaucuccuccuccaugaccaacuccaccgccgccucccgcccccccgucacccuccgccucgucguccccgccucccagugcggcucccucaucggcaagggcggcugcaagaucaaggagauccgcgaguccaccggcgcccagguccaggucgccggcgacaugcuccccaacuccaccgagcgcgccaucaccaucgccggcaucccccaguccaucaucgagugcgucaagcagaucugcgucgucaugcucgaguccccccccaagggcgucaccauccccuaccgccccaagcccuccuccucccccgucaucuucgccggcggccaggccuacaccauccagggccaguacgccaucccccagcccgaccucaccaagcuccaccagcucgccaugcagcagucccacuuccccaugacccacggcaacaccggcuucuccggcaucgaguccuccucccccgaggucaagggcuacugggccggccucgacgccuccgcccagaccaccucccacgagcucaccauccccaacgaccucaucggcugcaucaucggccgccagggcgccaagaucaacgagauccgccagauguccggcgcccagaucaagaucgccaaccccgucgagggcuccaccgaccgccaggucaccaucaccggcuccgccgccuccaucucccucgcccaguaccucaucaacguccgccucuccuccgagaccggcggcaugggcuccuccuga

SEQ ID NO: 47344 - RNA, 1038 nt, Artificial Sequence
  derived and/or modified sequence opt2 from PCBP3__Homo_sapiens__NP_001123613
augggcgagggcgacgccuucugggcccccuccguccucccccacuccacccucuccacccucucccaccacccccagccccaguucggccgccgcauggaguccaaggucuccgagggcggccucaacgucacccucaccauccgccuccucaugcacggcaaggaggucggcuccaucaucggcaagaagggcgagaccgucaagaagaugcgcgaggaguccggcgcccgcaucaacaucuccgagggcaacugccccgagcgcaucgucaccaucaccggccccaccgacgccaucuucaaggccuucgccaugaucgccuacaaguucgaggaggacaucaucaacuccauguccaacucccccgccaccuccaagccccccgucacccuccgccucgucguccccgccucccagugcggcucccucaucggcaagggcggcuccaagaucaaggagauccgcgaguccaccggcgcccagguccaggucgccggcgacaugcuccccaacuccaccgagcgcgccgucaccaucuccggcacccccgacgccaucauccagugcgucaagcagaucugcgucgucaugcucgaggccuacaccauccagggccaguacgccaucccccaccccgaccucaccaagcuccaccagcucgccaugcagcagacccccuuccccccccucggccagaccaaccccgccuuccccggcgagaagcucccccuccacuccuccgaggaggcccagaaccucaugggccaguccuccggccucgacgccuccccccccgccuccacccacgagcucaccauccccaacgaccucaucggcugcaucaucggccgccagggcaccaagaucaacgagauccgccagauguccggcgcccagaucaagaucgccaacgccaccgagggcuccuccgagcgccagaucaccaucaccggcacccccgccaacaucucccucgcccaguaccucaucaacgcccgccucaccuccgaggucaccggcaugggcacccucuga

SEQ ID NO: 47345 - RNA, 1281 nt, Artificial Sequence
  derived and/or modified sequence opt2 from PCBP4__Homo_sapiens__XP_005265387
auggaggccggccaggucgccgcccgcacccacucccaggucgccgucgcccccgccucccccgaccgcauguccggcuccgacggcggccucgaggaggagcccgagcucuccaucacccucacccuccgcaugcucaugcacggcaaggaggucggcuccaucaucggcaagaagggcgagaccgucaagcgcauccgcgagcaguccuccgcccgcaucaccaucuccgagggcuccugccccgagcgcaucaccaccaucaccggcuccaccgccgccgucuuccacgccgucuccaugaucgccuucaagcucgacgaggaccucugcgccgcccccgccaacggcggcaacgucucccgcccccccgucacccuccgccucgucauccccgccucccagugcggcucccucaucggcaaggccggcaccaagaucaaggagauccgcgagaccaccggcgcccagguccaggucgccggcgaccuccuccccaacuccaccgagcgcgccgucaccgucuccggcguccccgacgccaucauccucugcguccgccagaucugcgccgucauccucgaguccccccccaagggcgccaccauccccuaccaccccucccucucccucggcaccguccuccucuccgccaaccagggcuucuccguccagggccaguacggcgccgucacccccgccgaggucaccaagcuccagcagcucuccucccacgccguccccuucgccacccccuccgucguccccggccucgaccccggcacccagaccuccucccaggaguuccucguccccaacgaccucaucggcugcgucaucggccgccagggcuccaagaucuccgagauccgccagauguccggcgcccacaucaagaucggcaaccaggccgagggcgccggcgagcgccacgucaccaucaccggcucccccgucuccaucgcccucgcccaguaccucaucaccgccugccucgagaccgccaaguccaccuccggcggcacccccuccuccgcccccgccgaccuccccgcccccuucucccccccccucaccgcccuccccaccgccccccccggccuccucggcacccccuacgccaucucccucuccaacuucaucggccucaagcccaugcccuuccucgcccucccccccgccucccccggccccccccccggccucgccgccuacaccgccaagauggccgccgccaacggcuccaagaaggccgagcgccagaaguucucccccuacuga

SEQ ID NO: 47346 - RNA, 2187 nt, Artificial Sequence
  derived and/or modified sequence opt2 from PCCA__Homo_sapiens__NP_000273
auggccggcuucugggucggcaccgccccccucgucgccgccggccgccgcggccgcuggcccccccagcagcucaugcucuccgccgcccuccgcacccucaagcacguccucuacuacucccgccagugccucauggucucccgcaaccucggcuccgucggcuacgaccccaacgagaagaccuucgacaagauccucgucgccaaccgcggcgagaucgccugccgcgucauccgcaccugcaagaagaugggcaucaagaccgucgccauccacuccgacgucgacgccuccuccguccacgucaagauggccgacgaggccgucugcgucggccccgcccccaccuccaaguccuaccucaacauggacgccaucauggaggccaucaagaagacccgcgcccaggccguccaccccggcuacggcuuccucuccgagaacaaggaguucgcccgcugccucgccgccgaggacgucgucuucaucggccccgacacccacgccauccaggccaugggcgacaagaucgaguccaagcuccucgccaagaaggccgaggucaacaccauccccggcuucgacggcgucgucaaggacgccgaggaggccguccgcaucgcccgcgagaucggcuaccccgucaugaucaaggccuccgccggcggcggcggcaagggcaugcgcaucgccugggacgacgaggagacccgcgacggcuuccgccucuccucccaggaggccgccuccuccuucggcgacgaccgccuccucaucgagaaguucaucgacaacccccgccacaucgagauccagguccucggcgacaagcacggcaacgcccucuggcucaacgagcgcgagugcuccauccagcgccgcaaccagaaggucgucgaggaggcccccuccaucuuccucgacgccgagacccgccgcgccaugggcgagcaggccgucgcccucgcccgcgccgucaaguacuccuccgccggcaccgucgaguuccucgucgacuccaagaagaacuucuacuuccucgagaugaacacccgccuccaggucgagcaccccgucaccgagugcaucaccggccucgaccucguccaggagaugauccgcgucgccaagggcuacccccuccgccacaagcaggccgacauccgcaucaacggcugggccgucgagugccgcgucuacgccgaggaccccuacaaguccuucggccuccccuccaucggccgccucucccaguaccaggagccccuccaccuccccggcguccgcgucgacuccggcauccagcccggcuccgacaucuccaucuacuacgaccccaugaucuccaagcucaucaccuacggcuccgaccgcaccgaggcccucaagcgcauggccgacgcccucgacaacuacgucauccgcggcgucacccacaacaucgcccuccuccgcgaggucaucaucaacucccgcuucgucaagggcgacaucuccaccaaguuccucuccgacgucuaccccgacggcuucaagggccacaugcucaccaaguccgagaagaaccagcuccucgccaucgccuccucccucuucgucgccuuccagcuccgcgcccagcacuuccaggagaacucccgcaugcccgucaucaagcccgacaucgccaacugggagcucuccgucaagcuccacgacaagguccacaccgucgucgccuccaacaacggcuccgucuucuccgucgaggucgacggcuccaagcucaacgucaccuccaccuggaaccucgccuccccccuccucuccgucuccgucgacggcacccagcgcaccguccagugccucucccgcgaggccggcggcaacauguccauccaguuccucggcaccgucuacaaggucaacauccucacccgccucgccgccgagcucaacaaguucaugcucgagaaggucaccgaggacaccuccuccguccuccgcucccccaugcccggcgucgucgucgccgucuccgucaagcccggcgacgccgucgccgagggccaggagaucugcgucaucgaggccaugaagaugcagaacuccaugaccgccggcaagaccggcaccgucaaguccguccacugccaggccggcgacaccgucggcgagggcgaccuccucgucgagcucgaguga

SEQ ID NO: 47347 - RNA, 1620 nt, Artificial Sequence
  derived and/or modified sequence opt2 from PCCB__Homo_sapiens__NP_000523
auggccgccgcccuccgcgucgccgccgucggcgcccgccucuccguccucgccuccggccuccgcgccgccguccgcucccucugcucccaggccaccuccgucaacgagcgcaucgagaacaagcgccgcaccgcccuccucggcggcggccagcgccgcaucgacgcccagcacaagcgcggcaagcucaccgcccgcgagcgcaucucccuccuccucgaccccggcuccuucgucgaguccgacauguucgucgagcaccgcugcgccgacuucggcauggccgccgacaagaacaaguuccccggcgacuccgucgucaccggccgcggccgcaucaacggccgccucgucuacgucuucucccaggacuucaccgucuucggcggcucccucuccggcgcccacgcccagaagaucugcaagaucauggaccaggccaucaccgucggcgcccccgucaucggccucaacgacuccggcggcgcccgcauccaggagggcgucgagucccucgccggcuacgccgacaucuuccuccgcaacgucaccgccuccggcgucaucccccagaucucccucaucaugggccccugcgccggcggcgccgucuacucccccgcccucaccgacuucaccuucauggucaaggacaccuccuaccucuucaucaccggccccgacgucgucaaguccgucaccaacgaggacgucacccaggaggagcucggcggcgccaagacccacaccaccauguccggcgucgcccaccgcgccuucgagaacgacgucgacgcccucugcaaccuccgcgacuucuucaacuaccucccccucuccucccaggaccccgcccccguccgcgagugccacgaccccuccgaccgccucguccccgagcucgacaccaucgucccccucgaguccaccaaggccuacaacauggucgacaucauccacuccgucgucgacgagcgcgaguucuucgagaucaugcccaacuacgccaagaacaucaucgucggcuucgcccgcaugaacggccgcaccgucggcaucgucggcaaccagcccaaggucgccuccggcugccucgacaucaacuccuccgucaagggcgcccgcuucguccgcuucugcgacgccuucaacaucccccucaucaccuucgucgacguccccggcuuccuccccggcaccgcccaggaguacggcggcaucauccgccacggcgccaagcuccucuacgccuucgccgaggccaccguccccaaggucaccgucaucacccgcaaggccuacggcggcgccuacgacgucauguccuccaagcaccucugcggcgacaccaacuacgccuggcccaccgccgagaucgccgucaugggcgccaagggcgccgucgagaucaucuucaagggccacgagaacgucgaggccgcccaggccgaguacaucgagaaguucgccaaccccuuccccgccgccguccgcggcuucgucgacgacaucauccagcccuccuccacccgcgcccgcaucugcugcgaccucgacguccucgccuccaagaagguccagcgccccuggcgcaagcacgccaacaucccccucuga

SEQ ID NO: 47348 - RNA, 3123 nt, Artificial Sequence
  derived and/or modified sequence opt2 from PCDH10__Homo_sapiens__NP_116586
augaucguccuccuccucuucgcccuccucuggauggucgagggcgucuucucccagcuccacuacaccguccaggaggagcaggagcacggcaccuucgucggcaacaucgccgaggaccucggccucgacaucaccaagcucuccgcccgcggcuuccagaccguccccaacucccgcacccccuaccucgaccucaaccucgagaccggcguccucuacgucaacgagaagaucgaccgcgagcagaucugcaagcagucccccuccugcguccuccaccucgaggucuuccucgagaacccccucgagcucuuccaggucgagaucgagguccucgacaucaacgacaacccccccuccuuccccgagcccgaccucaccgucgagaucuccgaguccgccacccccggcacccgcuucccccucgaguccgccuucgaccccgacgucggcaccaacucccuccgcgacuacgagaucacccccaacuccuacuucucccucgacguccagacccagggcgacggcaaccgcuucgccgagcucguccucgagaagccccucgaccgcgagcagcaggccguccaccgcuacguccucaccgccgucgacggcggcggcggcggcggcgucggcgagggcggcggcggcggcggcggcgccggccuccccccccagcagcagcgcaccggcaccgcccuccucaccauccgcguccucgacuccaacgacaacguccccgccuucgaccagcccgucuacaccgucucccuccccgagaacuccccccccggcacccucgucauccagcucaacgccaccgaccccgacgagggccagaacggcgaggucgucuacuccuucuccucccacaucuccccccgcgcccgcgagcucuucggccucuccccccgcaccggccgccucgaggucuccggcgagcucgacuacgaggagucccccgucuaccaggucuacguccaggccaaggaccucggccccaacgccguccccgcccacugcaagguccucguccgcguccucgacgccaacgacaacgcccccgagaucuccuucuccaccgucaaggaggccgucuccgagggcgccgcccccggcaccgucgucgcccucuucuccgucaccgaccgcgacuccgaggagaacggccagguccagugcgagcuccucggcgacguccccuuccgccucaaguccuccuucaagaacuacuacaccaucgucaccgaggccccccucgaccgcgaggccggcgacuccuacacccucaccgucgucgcccgcgaccgcggcgagcccgcccucuccaccuccaaguccauccagguccaggucuccgacgucaacgacaacgccccccgcuucucccagcccgucuacgacgucuacgucaccgagaacaacguccccggcgccuacaucuacgccgucuccgccaccgaccgcgacgagggcgccaacgcccagcucgccuacuccauccucgagugccagauccagggcauguccgucuucaccuacgucuccaucaacuccgagaacggcuaccucuacgcccuccgcuccuucgacuacgagcagcucaaggacuucuccuuccaggucgaggcccgcgacgccggcuccccccaggcccucgccggcaacgccaccgucaacauccucaucgucgaccagaacgacaacgcccccgccaucgucgccccccuccccggccgcaacggcacccccgcccgcgagguccucccccgcuccgccgagcccggcuaccuccucacccgcgucgccgccgucgacgccgacgacggcgagaacgcccgccucaccuacuccaucguccgcggcaacgagaugaaccucuuccgcauggacuggcgcaccggcgagcuccgcaccgcccgccgcguccccgccaagcgcgacccccagcgccccuacgagcucgucaucgagguccgcgaccacggccagcccccccucuccuccaccgccacccucgucguccagcucgucgacggcgccgucgagccccagggcggcggcggcuccggcggcggcggcuccggcgagcaccagcgccccucccgcuccggcggcggcgagaccucccucgaccucacccucauccucaucaucgcccucggcuccgucuccuucaucuuccuccucgccaugaucguccucgccguccgcugccagaaggagaagaagcucaacaucuacaccugccucgccuccgacugcugccucugcugcugcugcugcggcggcggcggcuccaccugcugcggccgccaggcccgcgcccgcaagaagaagcucuccaaguccgacaucaugcucguccaguccuccaacguccccuccaaccccgcccagguccccaucgaggaguccggcggcuucggcucccaccaccacaaccagaacuacugcuaccaggucugccucacccccgaguccgccaagaccgaccucauguuccucaagcccugcucccccucccgcuccaccgacaccgagcacaaccccugcggcgccaucgucaccggcuacaccgaccagcagcccgacaucaucuccaacggcuccauccucuccaacgagaccaagcaccagcgcgccgagcucuccuaccucgucgaccgcccccgccgcgucaacuccuccgccuuccaggaggccgacaucgucuccuccaaggacuccggccacggcgacuccgagcagggcgacuccgaccacgacgccaccaaccgcgcccaguccgccggcauggaccucuucuccaacugcaccgaggagugcaaggcccucggccacuccgaccgcugcuggaugcccuccuucguccccuccgacggccgccaggccgccgacuaccgcuccaaccuccacguccccggcauggacuccguccccgacaccgaggucuucgagacccccgaggcccagcccggcgccgagcgcuccuucuccaccuucggcaaggagaaggcccuccacuccacccucgagcgcaaggagcucgacggccuccucaccaacacccgcgcccccuacaagccccccuaccucacccgcaagcgcaucugcuga

SEQ ID NO: 47349 - RNA, 4020 nt, Artificial Sequence
  derived and/or modified sequence opt2 from PCDH11X__Homo_sapiens__NP_001161832
auggaccuccucuccggcaccuacaucuucgccguccuccucgccugcgucgucuuccacuccggcgcccaggagaagaacuacaccauccgcgaggagaugcccgagaacguccucaucggcgaccuccucaaggaccucaaccucucccucauccccaacaagucccucaccaccgccaugcaguucaagcucgucuacaagaccggcgacgucccccucauccgcaucgaggaggacaccggcgagaucuucaccaccggcgcccgcaucgaccgcgagaagcucugcgccggcaucccccgcgacgagcacugcuucuacgaggucgaggucgccauccuccccgacgagaucuuccgccucgucaagauccgcuuccucaucgaggacaucaacgacaacgccccccucuuccccgccaccgucaucaacaucuccauccccgagaacuccgccaucaacuccaaguacacccuccccgccgccgucgaccccgacgucggcaucaacggcguccagaacuacgagcucaucaagucccagaacaucuucggccucgacgucaucgagacccccgagggcgacaagaugccccagcucaucguccagaaggagcucgaccgcgaggagaaggacaccuacgucaugaaggucaaggucgaggacggcggcuucccccagcgcuccuccaccgccauccuccaggucuccgucaccgacaccaacgacaaccaccccgucuucaaggagaccgagaucgaggucuccauccccgagaacgcccccgucggcaccuccgucacccagcuccacgccaccgacgccgacaucggcgagaacgccaagauccacuucuccuucuccaaccucgucuccaacaucgcccgccgccucuuccaccucaacgccaccaccggccucaucaccaucaaggagccccucgaccgcgaggagacccccaaccacaagcuccucguccucgccuccgacggcggccucaugcccgcccgcgccaugguccucgucaacgucaccgacgucaacgacaacguccccuccaucgacauccgcuacaucgucaaccccgucaacgacaccgucguccucuccgagaacaucccccucaacaccaagaucgcccucaucaccgucaccgacaaggacgccgaccacaacggccgcgucaccugcuucaccgaccacgagauccccuuccgccuccgccccgucuucuccaaccaguuccuccucgagaccgccgccuaccucgacuacgaguccaccaaggaguacgccaucaagcuccucgccgccgacgccggcaagcccccccucaaccaguccgccaugcucuucaucaaggucaaggacgagaacgacaacgcccccgucuucacccaguccuucgucaccgucuccauccccgagaacaacucccccggcauccagcucaccaaggucuccgccauggacgccgacuccggccccaacgccaagaucaacuaccuccucggccccgacgccccccccgaguucucccucgacugccgcaccggcaugcucaccgucgucaagaagcucgaccgcgagaaggaggacaaguaccucuucaccauccucgccaaggacaacggcguccccccccucaccuccaacgucaccgucuucgucuccaucaucgaccagaacgacaacucccccgucuucacccacaacgaguacaacuucuacguccccgagaaccucccccgccacggcaccgucggccucaucaccgucaccgaccccgacuacggcgacaacuccgccgucacccucuccauccucgacgagaacgacgacuucaccaucgacucccagaccggcgucauccgccccaacaucuccuucgaccgcgagaagcaggaguccuacaccuucuacgucaaggccgaggacggcggccgcgucucccgcuccuccuccgccaaggucaccaucaacgucgucgacgucaacgacaacaagcccgucuucaucgucccccccuccaacugcuccuacgagcucguccuccccuccaccaaccccggcaccgucgucuuccaggucaucgccgucgacaacgacaccggcaugaacgccgagguccgcuacuccaucgucggcggcaacacccgcgaccucuucgccaucgaccaggagaccggcaacaucacccucauggagaagugcgacgucaccgaccucggccuccaccgcguccucgucaaggccaacgaccucggccagcccgacucccucuucuccgucgucaucgucaaccucuucgucaacgaguccgucaccaacgccacccucaucaacgagcucguccgcaaguccaccgaggcccccgucacccccaacaccgagaucgccgacgucuccucccccaccuccgacuacgucaagauccucgucgccgccgucgccggcaccaucaccgucgucgucgucaucuucaucaccgccgucguccgcugccgccaggccccccaccucaaggccgcccagaagaacaagcagaacuccgagugggccacccccaaccccgagaaccgccagaugaucaugaugaagaagaagaagaagaagaagaagcacucccccaagaaccuccuccucaacuucgucaccaucgaggagaccaaggccgacgacgucgacuccgacggcaaccgcgucacccucgaccuccccaucgaccucgaggagcagaccaugggcaaguacaacugggucaccacccccaccaccuucaagcccgacucccccgaccucgcccgccacuacaaguccgccuccccccagcccgccuuccagauccagcccgagaccccccucaacuccaagcaccacaucauccaggagcucccccucgacaacaccuucgucgccugcgacuccaucuccaagugcuccuccuccuccuccgaccccuacuccgucuccgacugcggcuaccccgucaccaccuucgagguccccgucuccguccacacccgcccccccaugaaggaggucguccgcuccugcacccccaugaaggaguccaccaccauggagaucuggauccacccccagccccagcgcaaguccgagggcaaggucgccggcaagucccagcgccgcgucaccuuccaccuccccgagggcucccaggaguccuccuccgacggcggccucggcgaccacgacgccggcucccucaccuccaccucccacggccucccccucggcuacccccaggaggaguacuucgaccgcgccacccccuccaaccgcaccgagggcgacggcaacuccgaccccgaguccaccgccgagaucaccguccagcccaccgucgaggaggccuccgacaacugcacccaggagugccucaucuacggccacuccgacgccugcuggaugcccgccucccucgaccacuccuccuccucccaggcccaggccuccgcccucugccacucccccccccucucccaggccuccacccagcaccacuccccccgcgucacccagaccaucgcccucugccacuccccccccgucacccagaccaucgcccucugccacucccccccccccauccaggucuccgcccuccaccacucccccccccucguccaggccaccgcccuccaccacuccccccccuccgcccaggccuccgcccucugcuacucccccccccucgcccaggccgccgccaucucccacuccuccccccucccccaggucaucgcccuccaccgcucccaggcccaguccuccgucucccuccagcagggcuggguccagggcgccgacggccucugcuccgucgaccagggcguccagggcuccgccaccucccaguucuacaccauguccgagcgccuccaccccuccgacgacuccaucaaggucaucccccucaccaccuucaccccccgccagcaggcccgccccucccgcggcgacucccccaucauggaggagcacccccucuga

SEQ ID NO: 47350 - RNA, 3114 nt, Artificial Sequence
  derived and/or modified sequence opt2 from PCDH11Y__Homo_sapiens__NP_116753
augaccgucggcuucaacuccgacaucuccuccgucguccgcgucaacaccaccaacugccacaagugccuccucuccggcaccuacaucuucgccguccuccucgucugcgucgucuuccacuccggcgcccaggagaagaacuacaccauccgcgaggagauccccgagaacguccucaucggcaaccuccucaaggaccucaaccucucccucauccccaacaagucccucaccaccaccaugcaguucaagcucgucuacaagaccggcgacgucccccucauccgcaucgaggaggacaccggcgagaucuucaccaccggcgcccgcaucgaccgcgagaagcucugcgccggcaucccccgcgacgagcacugcuucuacgaggucgaggucgccauccuccccgacgagaucuuccgccucgucaagauccgcuuccucaucgaggacaucaacgacaacgccccccucuuccccgccaccgucaucaacaucuccauccccgagaacuccgccaucaacuccaaguacacccuccccgccgccgucgaccccgacgucggcaucaacggcguccagaacuacgagcucaucaagucccagaacaucuucggccucgacgucaucgagacccccgagggcgacaagaugccccagcucaucguccagaaggagcucgaccgcgaggagaaggacaccuacgucaugaaggucaaggucgaggacggcggcuucccccagcgcuccuccaccgccauccuccaggucuccgucaccgacaccaacgacaaccaccccgucuucaaggagaccgagaucgaggucuccauccccgagaacgcccccgucggcaccuccgucacccagcuccacgccaccgacgccgacaucggcgagaacgccaagauccacuucuccuucuccaaccucgucuccaacaucgcccgccgccucuuccaccucaacgccaccaccggccucaucaccaucaaggagccccucgaccgcgaggagacccccaaccacaagcuccucguccucgccuccgacggcggccucaugcccgcccgcgccaugguccucgucaacgucaccgacgucaacgacaacguccccuccaucgacauccgcuacaucgucaaccccgucaacgacaccgucguccucuccgagaacaucccccucaacaccaagaucgcccucaucaccgucaccgacaaggacgccgaccacaacggccgcgucaccugcuucaccgaccacgagauccccuuccgccuccgccccgucuucuccaaccaguuccuccucgagaacgccgccuaccucgacuacgaguccaccaaggaguacgccaucaagcuccucgccgccgacgccggcaagcccccccucaaccaguccgccaugcucuucaucaaggucaaggacgagaacgacaacgcccccgucuucacccaguccuucgucaccgucuccauccccgagaacaacucccccggcauccagcucaugaaggucuccgccaccgacgccgacuccggccccaacgccgagaucaacuaccuccucggccccgacgccccccccgaguucucccucgaccgccgcaccggcaugcucaccgucgucaagaagcucgaccgcgagaaggaggacaaguaccucuucaccauccucgccaaggacaacggcguccccccccucaccuccaacgucaccgucuucgucuccaucaucgaccagaacgacaacucccccgucuucacccacaacgaguacaaguucuacguccccgagaaccucccccgccacggcaccgucggccucaucaccgucaccgaccccgacuacggcgacaacuccgccgucacccucuccauccucgacgagaacgacgacuucaccaucgacucccagaccggcgucauccgccccaacaucuccuucgaccgcgagaagcaggaguccuacaccuucuacgucaaggccgaggacggcggccgcgucucccgcuccuccuccgccaaggucaccaucaacgucgucgacgucaacgacaacaagcccgucuucaucgucccccccuacaacuacuccuacgagcucguccuccccuccaccaaccccggcaccgucgucuuccaggucaucgccgucgacaacgacaccggcaugaacgccgagguccgcuacuccaucgucggcggcaacacccgcgaccucuucgccaucgaccaggagaccggcaacaucacccucauggagaagugcgacgucaccgaccucggccuccaccgcguccucgucaaggccaacgaccucggccagcccgacucccucuucuccgucgucaucgucaaccucuucgucaacgaguccgucaccaacgccacccucaucaacgagcucguccgcaaguccaucgaggcccccgucacccccaacaccgagaucgccgacgucuccucccccaccuccgacuacgucaagauccucgucgccgccgucgccggcaccaucaccgucgucgucgucaucuucaucaccgccgucguccgcugccgccaggccccccaccucaaggccgcccagaagaacaugcagaacuccgagugggccacccccaaccccgagaaccgccagaugaucaugaugaagaagaagaagaagaagaagaagcacucccccaagaaccuccuccucaacgucgucaccaucgaggagaccaaggccgacgacgucgacuccgacggcaaccgcgucacccucgaccuccccaucgaccucgaggagcagaccaugggcaaguacaacugggucaccacccccaccaccuucaagcccgacucccccgaccucgcccgccacuacaaguccgccuccccccagcccgccuuccagauccagcccgagaccccccucaaccucaagcaccacaucauccaggagcucccccucgacaacaccuucgucgccugcgacuccaucuccaacugcuccuccuccuccuccgaccccuacuccgucuccgacugcggcuaccccgucaccaccuucgagguccccgucuccguccacacccgccccaccgacucccgcaccuga

SEQ ID NO: 47351 - RNA, 5889 nt, Artificial Sequence
  derived and/or modified sequence opt2 from PCDH15__Homo_sapiens__NP_001136235
auguuccgccaguucuaccucuggaccugccucgccuccggcaucauccucggcucccucuucgagaucugccucggccaguacgacgacgacuggcaguacgaggacugcaagcucgcccgcggcggcccccccgccaccaucgucgccaucgacgaggagucccgcaacggcaccauccucgucgacaacaugcucaucaagggcaccgccggcggccccgaccccaccaucgagcucucccucaaggacaacgucgacuacuggguccucauggaccccgucaagcagaugcucuuccucaacuccaccggccgcguccucgaccgcgacccccccaugaacauccacuccaucgucguccagguccagugcaucaacaagaaggucggcaccaucaucuaccacgagguccgcaucgucguccgcgaccgcaacgacaacucccccaccuucaagcacgaguccuacuacgccaccgucaacgagcucacccccgucggcaccaccaucuucaccggcuucuccggcgacaacggcgccaccgacaucgacgacggccccaacggccagaucgaguacgucauccaguacaaccccgacgaccccaccuccaacgacaccuucgagaucccccucaugcucaccggcaacaucguccuccgcaagcgccucaacuacgaggacaagacccgcuacuucgucaucauccaggccaacgaccgcgcccagaaccucaacgagcgccgcaccaccaccaccacccucaccgucgacguccucgacggcgacgaccucggccccauguuccuccccugcguccucguccccaacacccgcgacugccgcccccucaccuaccaggccgccauccccgagcuccgcacccccgaggagcucaaccccaucaucgucaccccccccauccaggccaucgaccaggaccgcaacauccagccccccuccgaccgccccggcauccucuacuccauccucgucggcacccccgaggacuacccccgcuucuuccacaugcacccccgcaccgccgagcucucccuccucgagcccgucaaccgcgacuuccaccagaaguucgaccucgucaucaaggccgagcaggacaacggccacccccuccccgccuucgccggccuccacaucgagauccucgacgagaacaaccagucccccuacuucaccaugcccuccuaccagggcuacauccucgaguccgcccccgucggcgccaccaucuccgacucccucaaccucaccuccccccuccgcaucgucgcccucgacaaggacaucgaggacaccaaggaccccgagcuccaccucuuccucaacgacuacaccuccgucuucaccgucacccagaccggcaucacccgcuaccucacccuccuccagcccgucgaccgcgaggagcagcagaccuacaccuucuccaucaccgccuucgacggcguccaggaguccgagcccgucaucgucaacauccaggucauggacgccaacgacaacacccccaccuuccccgagaucuccuacgacgucuacgucuacaccgacaugcgccccggcgacuccgucauccagcucaccgccgucgacgccgacgagggcuccaacggcgagaucaccuacgagauccucgucggcgcccagggcgacuucaucaucaacaagaccaccggccucaucaccaucgcccccggcgucgagaugaucgucggccgcaccuacgcccucaccguccaggccgccgacaacgccccccccgccgagcgccgcaacuccaucugcaccgucuacaucgagguccucccccccaacaaccagucccccccccgcuucccccagcucauguacucccucgagaucuccgaggccaugcgcgucggcgccguccuccucaaccuccaggccaccgaccgcgagggcgacuccaucaccuacgccaucgagaacggcgacccccagcgcgucuucaaccucuccgagaccaccggcauccucacccucggcaaggcccucgaccgcgaguccaccgaccgcuacauccucaucaucaccgccuccgacggccgccccgacggcaccuccaccgccaccgucaacaucgucgucaccgacgucaacgacaacgcccccgucuucgaccccuaccucccccgcaaccucuccgucgucgaggaggaggccaacgccuucgucggccaggucaaggccaccgaccccgacgccggcaucaacggccagguccacuacucccucggcaacuucaacaaccucuuccgcaucaccuccaacggcuccaucuacaccgccgucaagcucaaccgcgagguccgcgacuacuacgagcucgucgucgucgccaccgacggcgccguccacccccgccacuccacccucacccucgccaucaagguccucgacaucgacgacaacucccccgucuucaccaacuccaccuacaccguccucgucgaggagaaccuccccgccggcaccaccauccuccagaucgaggccaaggacgucgaccucggcgccaacgucuccuaccgcauccgcucccccgaggucaagcacuucuucgcccuccaccccuucaccggcgagcucucccuccuccgcucccucgacuacgaggccuuccccgaccaggaggccuccaucaccuuccucgucgaggccuucgacaucuacggcaccaugccccccggcaucgccaccgucaccgucaucgucaaggacaugaacgacuacccccccgucuucuccaagcgcaucuacaagggcauggucgcccccgacgccgucaagggcacccccaucaccaccgucuacgccgaggacgccgacccccccggccuccccgccucccgcguccgcuaccgcgucgacgacguccaguuccccuaccccgccuccaucuucgaggucgaggaggacuccggccgcgucaucacccgcgucaaccucaacgaggagcccaccaccaucuucaagcucgucgucgucgccuucgacgacggcgagcccgucauguccuccuccgccaccgucaagauccucguccuccaccccggcgagaucccccgcuucacccaggaggaguaccgccccccccccgucuccgagcucgccaccaagggcaccauggucggcgucaucuccgccgccgccaucaaccaguccaucgucuacuccaucgucuccggcaacgaggaggacaccuucggcaucaacaacaucaccggcgucaucuacgucaacggcccccucgacuacgagacccgcaccuccuacguccuccgcguccaggccgacucccucgaggucguccucgccaaccuccgcguccccuccaaguccaacaccgccaaggucuacaucgagauccaggacgagaacaaccacccccccgucuuccagaagaaguucuacaucggcggcgucuccgaggacgcccgcauguucaccuccguccuccgcgucaaggccaccgacaaggacaccggcaacuacuccgucauggccuaccgccucaucaucccccccaucaaggagggcaaggagggcuucgucgucgagaccuacaccggccucaucaagaccgccaugcucuuccacaacaugcgccgcuccuacuucaaguuccaggucaucgccaccgacgacuacggcaagggccucuccggcaaggccgacguccucgucuccgucgucaaccagcucgacaugcaggucaucgucuccaacgucccccccacccucgucgagaagaagaucgaggaccucaccgagauccucgaccgcuacguccaggagcagauccccggcgccaaggucgucgucgaguccaucggcgcccgccgccacggcgacgccuucucccucgaggacuacaccaagugcgaccucaccgucuacgccaucgacccccagaccaaccgcgccaucgaccgcaacgagcucuucaaguuccucgacggcaagcuccucgacaucaacaaggacuuccagcccuacuacggcgagggcggccgcauccucgagauccgcacccccgaggccgucaccuccaucaagaagcgcggcgagucccucggcuacaccgagggcgcccuccucgcccucgccuucaucaucauccucugcugcauccccgccauccucgucguccucgucuccuaccgccaguucaagguccgccaggccgagugcaccaagaccgcccgcauccaggccgcccuccccgccgccaagcccgccguccccgcccccgcccccgucgccgcccccccccccccccccccccccccccccggcgcccaccucuacgaggagcucggcgacuccuccaugcacaaccucuuccuccucuaccacuuccagcagucccgcggcaacaacuccgucuccgaggaccgcaagcaccagcaggucgucaugcccuucuccuccaacaccaucgaggcccacaaguccgcccacgucgacggcucccucaaguccaacaagcucaaguccgcccgcaaguucaccuuccucuccgacgaggacgaccucuccgcccacaacccccucuacaaggagaacaucucccaggucuccaccaacuccgacaucucccagcgcaccgacuucgucgaccccuucucccccaagauccaggccaaguccaagucccuccgcggcccccgcgagaagauccagcgccucuggucccaguccgucucccucccccgccgccucaugcgcaagguccccaaccgccccgagaucaucgaccuccagcaguggcagggcacccgccagaaggccgagaacgagaacaccggcaucugcaccaacaagcgcggcuccuccaacccccuccucaccaccgaggaggccaaccucaccgagaaggaggagauccgccagggcgagacccucaugaucgagggcaccgagcagcucaagucccucuccuccgacuccuccuucugcuucccccgcccccacuucuccuucuccacccuccccaccgucucccgcaccgucgagcucaaguccgagcccaacgucaucuccucccccgccgagugcucccucgagcucucccccucccgccccugcguccuccacuccucccucucccgccgcgagacccccaucugcaugcuccccaucgagaccgagcgcaacaucuucgagaacuucgcccacccccccaacaucucccccuccgccugcccccuccccccccccccccccaucuccccccccucccccccccccgcccccgccccccucgcccccccccccgacaucucccccuucucccucuucugccccccccccuccccccccuccaucccccucccccuccccccccccaccuucuucccccucuccgucuccaccuccggcccccccacccccccccuccucccccccuuccccaccccccuccccccccccccccccuccauccccugcccccccccccccuccgccuccuuccucuccaccgagugcgucugcaucaccggcgucaagugcaccaccaaccucaugcccgccgagaagaucaaguccuccaugacccagcucuccaccaccaccgucugcaagaccgacccccagcgcgagcccaagggcauccuccgccacgucaagaaccucgccgagcucgagaaguccgucgccaacauguacucccagaucgagaagaacuaccuccgcaccaacgucuccgagcuccagaccaugugccccuccgaggucaccaacauggagaucaccuccgagcagaacaagggcucccucaacaacaucgucgagggcaccgagaagcagucccacucccaguccaccucccucuga

SEQ ID NO: 47352 - RNA, 3480 nt, Artificial Sequence
  derived and/or modified sequence opt2 from PCDH17__Homo_sapiens__XP_005266414
auguaccucuccaucugcugcugcuuccuccucugggcccccgcccucacccucaagaaccucaacuacuccguccccgaggagcagggcgccggcaccgucaucggcaacaucggccgcgacgcccgccuccagcccggccucccccccgccgagcgcggcggcggcggccgcuccaaguccggcuccuaccgcguccucgagaacuccgccccccaccuccucgacgucgacgccgacuccggccuccucuacaccaagcagcgcaucgaccgcgagucccucugccgccacaacgccaagugccagcucucccucgaggucuucgccaacgacaaggagaucugcaugaucaaggucgagauccaggacaucaacgacaacgcccccuccuucuccuccgaccagaucgagauggacaucuccgagaacgccgcccccggcacccgcuucccccucaccuccgcccacgaccccgacgccggcgagaacggccuccgcaccuaccuccucacccgcgacgaccacggccucuucggccucgacgucaagucccgcggcgacggcaccaaguuccccgagcucgucauccagaaggcccucgaccgcgagcagcagaaccaccacacccucguccucaccgcccucgacggcggcgagcccccccgcuccgccaccguccagaucaacgucaaggucaucgacuccaacgacaacucccccgucuucgaggcccccuccuaccucgucgagcuccccgagaacgccccccucggcaccgucgucaucgaccucaacgccaccgacgccgacgagggccccaacggcgagguccucuacuccuucuccuccuacguccccgaccgcguccgcgagcucuucuccaucgaccccaagaccggccucauccgcgucaagggcaaccucgacuacgaggagaacggcaugcucgagaucgacguccaggcccgcgaccucggccccaaccccauccccgcccacugcaaggucaccgucaagcucaucgaccgcaacgacaacgcccccuccaucggcuucgucuccguccgccagggcgcccucuccgaggccgccccccccggcaccgucaucgcccucguccgcgucaccgaccgcgacuccggcaagaacggccagcuccagugccgcguccucggcggcggcggcaccggcggcggcggcggccucggcggccccggcggcuccguccccuucaagcucgaggagaacuacgacaacuucuacaccgucgucaccgaccgcccccucgaccgcgagacccaggacgaguacaacgucaccaucgucgcccgcgacggcggcucccccccccucaacuccaccaaguccuucgccaucaagauccucgacgagaacgacaaccccccccgcuucaccaagggccucuacguccuccagguccacgagaacaacauccccggcgaguaccucggcuccguccucgcccaggaccccgaccucggccagaacggcaccgucuccuacuccauccuccccucccacaucggcgacgucuccaucuacaccuacgucuccgucaaccccaccaacggcgccaucuacgcccuccgcuccuucaacuucgagcagaccaaggccuucgaguucaagguccucgccaaggacuccggcgcccccgcccaccucgaguccaacgccaccguccgcgucaccguccucgacgucaacgacaacgcccccgucaucguccuccccacccuccagaacgacaccgccgagcuccaggucccccgcaacgccggccucggcuaccucgucuccaccguccgcgcccucgacuccgacuucggcgaguccggccgccucaccuacgagaucgucgacggcaacgacgaccaccucuucgagaucgaccccuccuccggcgagauccgcacccuccaccccuucugggaggacgucacccccgucgucgagcucgucgucaaggucaccgaccacggcaagcccacccucuccgccgucgccaagcucaucauccgcuccgucuccggcucccuccccgagggcgucccccgcgucaacggcgagcagcaccacugggacaugucccucccccucaucgucacccucuccaccaucuccaucauccuccucgccgccaugaucaccaucgccgucaagugcaagcgcgagaacaaggagauccgcaccuacaacugccgcaucgccgaguacucccacccccagcucggcggcggcaagggcaagaagaagaagaucaacaagaacgacaucaugcucguccaguccgaggucgaggagcgcaacgccaugaacgucaugaacgucgucuccucccccucccucgccaccucccccauguacuucgacuaccagacccgccucccccucuccuccccccgcuccgaggucauguaccucaagcccgccuccaacaaccucaccgucccccagggccacgccggcugccacaccuccuucaccggccagggcaccaacgccuccgagacccccgccacccgcauguccaucauccagaccgacaacuuccccgccgagcccaacuacaugggcucccgccagcaguucguccaguccuccuccaccuucaaggaccccgagcgcgccucccuccgcgacuccggccacggcgacuccgaccaggccgacuccgaccaggacaccaacaagggcuccugcugcgacauguccguccgcgaggcccucaagaugaagaccaccuccaccaagucccagccccucgagcaggagcccgaggagugcgucaacugcaccgacgagugccgcguccucggccacuccgaccgcugcuggaugccccaguuccccgccgccaaccaggccgagaacgccgacuaccgcaccaaccucuucguccccaccgucgaggccaacgucgagaccgagaccuacgagaccgucaaccccaccggcaagaagaccuucugcaccuucggcaaggacaagcgcgagcacaccauccucaucgccaacgucaagcccuaccucaaggccaagcgcgcccucuccccccuccuccaggagguccccuccgccuccuccucccccaccaaggccugcaucgagcccugcaccuccaccaagggcucccucgacggcugcgaggccaagcccggcgcccucgccgaggccuccucccaguaccuccccaccgacucccaguaccucucccccuccaagcagccccgcgacccccccuucauggccuccgaccagauggcccgcgucuucgccgacguccacucccgcgccucccgcgacuccuccgagaugggcgccguccucgagcagcucgaccaccccaaccgcgaccucggccgcgaguccgucgacgccgaggaggucguccgcgagaucgacaagcuccuccaggacugccgcggcaacgaccccgucgccguccgcaaguga

SEQ ID NO: 47353 - RNA, 3405 nt, Artificial Sequence
  derived and/or modified sequence opt2 from PCDH18__Homo_sapiens__NP_001287757
augcaccagaugaacgccaagaugcacuuccgcuucgucuucgcccuccucaucgucuccuucaaccacgacguccucggcaagaaccucaaguaccgcaucuacgaggagcagcgcgucggcuccgucaucgcccgccucuccgaggacgucgccgacguccuccucaagcuccccaaccccuccaccguccgcuuccgcgccaugcagcgcggcaacuccccccuccucgucgucaacgaggacaacggcgagaucuccaucggcgccaccaucgaccgcgagcagcucugccagaagaaccucaacugcuccaucgaguucgacgucaucacccuccccaccgagcaccuccagcucuuccacaucgaggucgagguccucgacaucaacgacaacuccccccaguucucccgcucccucauccccaucgagaucuccgaguccgccgccgucggcacccgcaucccccucgacuccgccuucgaccccgacgucggcgagaacucccuccacaccuacucccucuccgccaacgacuucuucaacaucgagguccgcacccgcaccgacggcgccaaguacgccgagcucaucgucguccgcgagcucgaccgcgagcucaaguccuccuacgagcuccagcucaccgccuccgacaugggcgucccccagcgcuccggcuccuccauccucaagaucuccaucuccgacuccaacgacaacucccccgccuucgagcagcaguccuacaucauccagcuccucgagaacucccccgucggcacccuccuccucgaccucaacgccaccgaccccgacgagggcgccaacggcaagaucgucuacuccuucuccucccacgucucccccaagaucauggagaccuucaagaucgacuccgagcgcggccaccucacccucuucaagcaggucgacuacgagaucaccaaguccuacgagaucgacguccaggcccaggaccucggccccaacuccauccccgcccacugcaagaucaucaucaaggucgucgacgucaacgacaacaagcccgagaucaacaucaaccucaugucccccggcaaggaggagaucuccuacaucuucgagggcgaccccaucgacaccuucgucgcccucguccgcguccaggacaaggacuccggccucaacggcgagaucgucugcaagcuccacggccacggccacuucaagcuccagaagaccuacgagaacaacuaccucauccucaccaacgccacccucgaccgcgagaagcgcuccgaguacucccucaccgucaucgccgaggaccgcggcacccccucccucuccaccgucaagcacuucaccguccagaucaacgacaucaacgacaaccccccccacuuccagcgcucccgcuacgaguucgucaucuccgagaacaacucccccggcgccuacaucaccaccgucaccgccaccgaccccgaccucggcgagaacggccaggucaccuacaccauccucgaguccuucauccucggcuccuccaucaccaccuacgucaccaucgaccccuccaacggcgccaucuacgcccuccgcaucuucgaccacgaggaggucucccagaucaccuucgucgucgaggcccgcgacggcggcucccccaagcagcucgucuccaacaccaccgucguccucaccaucaucgacgagaacgacaacguccccgucgucaucggccccgcccuccgcaacaacaccgccgagaucaccauccccaagggcgccgaguccggcuuccacgucacccgcauccgcgccaucgaccgcgacuccggcgucaacgccgagcucuccugcgccaucgucgccggcaacgaggagaacaucuucaucaucgacccccgcuccugcgacauccacaccaacgucuccauggacuccguccccuacaccgagugggagcucuccgucaucauccaggacaagggcaacccccagcuccacaccaagguccuccucaagugcaugaucuucgaguacgccgaguccgucaccuccaccgccaugaccuccgucucccaggccucccucgacgucuccaugaucaucaucaucucccucggcgccaucugcgccguccuccucgucaucaugguccucuucgccacccgcugcaaccgcgagaagaaggacacccgcuccuacaacugccgcgucgccgaguccaccuaccagcaccaccccaagcgccccucccgccagauccacaagggcgacaucacccucguccccaccaucaacggcacccuccccauccgcucccaccaccgcuccucccccuccuccucccccacccucgagcgcggccagaugggcucccgccagucccacaacucccaccagucccucaacucccucgucaccaucuccuccaaccacguccccgagaacuucucccucgagcucacccacgccacccccgccgucgaggucucccagcuccucuccaugcuccaccagggccaguaccagccccgccccuccuuccgcggcaacaaguacucccgcuccuaccgcuacgcccuccaggacauggacaaguucucccucaaggacuccggccgcggcgacuccgaggccggcgacuccgacuacgaccucggccgcgacucccccaucgaccgccuccucggcgagggcuucuccgaccucuuccucaccgacggccgcauccccgccgccaugcgccucugcaccgaggagugccgcguccucggccacuccgaccagugcuggaugcccccccuccccucccccuccuccgacuaccgcuccaacauguucauccccggcgaggaguuccccacccagccccagcagcagcacccccaccagucccucgaggacgacgcccagcccgccgacuccggcgagaagaagaaguccuucuccaccuucggcaaggacucccccaacgacgaggacaccggcgacaccuccaccuccucccuccucuccgagauguccuccgucuuccagcgccuccucccccccucccucgacaccuacuccgagugcuccgaggucgaccgcuccaacucccucgagcgccgcaagggcccccuccccgccaagaccgucggcuacccccagggcgucgccgccugggccgccuccacccacuuccagaaccccaccaccaacugcggccccccccucggcacccacuccuccguccagcccuccuccaaguggcuccccgccauggaggagauccccgagaacuacgaggaggacgacuucgacaacguccucaaccaccucaacgacggcaagcacgagcucauggacgccuccgagcucgucgccgagaucaacaagcuccuccaggacguccgccaguccuga

SEQ ID NO: 47354 - RNA, 3306 nt, Artificial Sequence
  derived and/or modified sequence opt2 from PCDH19__Homo_sapiens__NP_001098713
auggagucccuccuccuccccguccuccuccuccucgccauccucuggacccaggccgccgcccucaucaaccucaaguacuccgucgaggaggagcagcgcgccggcaccgucaucgccaacgucgccaaggacgcccgcgaggccggcuucgcccucgacccccgccaggccuccgccuuccgcgucgucuccaacuccgccccccaccucgucgacaucaaccccuccuccggccuccucgucaccaagcagaagaucgaccgcgaccuccucugccgccagucccccaagugcaucaucucccucgaggucauguccuccuccauggagaucugcgucaucaaggucgagaucaaggaccucaacgacaacgcccccuccuuccccgccgcccagaucgagcucgagaucuccgaggccgccucccccggcacccgcaucccccucgacuccgccuacgaccccgacuccggcuccuucggcguccagaccuacgagcucacccccaacgagcucuucggccucgagaucaagacccgcggcgacggcucccgcuucgccgagcucgucgucgagaagucccucgaccgcgagacccagucccacuacuccuuccgcaucaccgcccucgacggcggcgaccccccccgccucggcaccgucggccucuccaucaaggucaccgacuccaacgacaacaaccccgucuucuccgaguccaccuacgccgucuccguccccgagaacuccccccccaacacccccgucauccgccucaacgccuccgaccccgacgagggcaccaacggccaggucgucuacuccuucuacggcuacgucaacgaccgcacccgcgagcucuuccagaucgacccccacuccggccucgucaccgucaccggcgcccucgacuacgaggagggccacgucuacgagcucgacguccaggccaaggaccucggccccaacuccauccccgcccacugcaaggucaccgucuccguccucgacaccaacgacaacccccccgucaucaaccuccucuccgucaacuccgagcucgucgaggucuccgaguccgccccccccggcuacgucaucgcccucguccgcgucuccgaccgcgacuccggccucaacggccgcguccagugccgccuccucggcaacguccccuuccgccuccaggaguacgaguccuucuccaccauccucgucgacggccgccucgaccgcgagcagcacgaccaguacaaccucaccauccaggcccgcgacggcggcguccccaugcuccaguccgccaaguccuucaccguccucaucaccgacgagaacgacaaccacccccacuucuccaagcccuacuaccaggucaucguccaggagaacaacacccccggcgccuaccuccucuccgucuccgcccgcgaccccgaccucggccucaacggcuccgucuccuaccagaucguccccucccagguccgcgacaugcccgucuucaccuacgucuccaucaaccccaacuccggcgacaucuacgcccuccgcuccuucaaccacgagcagaccaaggccuucgaguucaagguccucgccaaggacggcggccuccccucccuccaguccaacgccaccguccgcgucaucauccucgacgucaacgacaacacccccgucaucaccgcccccccccucaucaacggcaccgccgaggucuacaucccccgcaacuccggcaucggcuaccucgucaccgucgucaaggccgaggacuacgacgagggcgagaacggccgcgucaccuacgacaugaccgagggcgaccgcggcuucuucgagaucgaccaggucaacggcgagguccgcaccacccgcaccuucggcgaguccuccaaguccuccuacgagcucaucgucgucgcccacgaccacggcaagaccucccucuccgccuccgcccucguccucaucuaccucucccccgcccucgacgcccaggaguccaugggcuccgucaaccucucccucaucuucaucaucgcccucggcuccaucgccggcauccucuucgucaccaugaucuucgucgccaucaagugcaagcgcgacaacaaggagauccgcaccuacaacugccgcaucgccgaguacuccuacggccaccagaagaaguccuccaagaagaagaagaucuccaagaacgacauccgccucgucccccgcgacgucgaggagaccgacaagaugaacgucgucuccugcuccucccucaccuccucccucaacuacuucgacuaccaccagcagacccucccccucggcugccgccgcuccgaguccaccuuccucaacgucgagaaccagaacacccgcaacaccuccgccaaccacaucuaccaccacuccuucaacucccagggcccccagcagcccgaccucaucaucaacggcgucccccuccccgagaccgagaacuacuccuucgacuccaacuacgucaacucccgcgcccaccucaucaaguccuccuccaccuucaaggaccucgagggcaacucccucaaggacuccggccacgaggaguccgaccagaccgacuccgagcacgacguccagcgcucccucuacugcgacaccgccgucaacgacguccucaacaccuccgucaccuccaugggcucccagaugcccgaccacgaccagaacgagggcuuccacugccgcgaggagugccgcauccucggccacuccgaccgcugcuggaugccccgcaaccccaugcccauccgcuccaagucccccgagcacguccgcaacaucaucgcccucuccaucgaggccaccgccgccgacgucgaggccuacgacgacugcggccccaccaagcgcaccuucgccaccuucggcaaggacgucuccgaccaccccgccgaggagcgccccacccucaagggcaagcgcaccgucgacgucaccaucugcucccccaaggucaacuccgucauccgcgaggccggcaacggcugcgaggccaucucccccgucaccuccccccuccaccucaaguccucccuccccaccaagcccuccgucuccuacaccaucgcccucgccccccccgcccgcgaccucgagcaguacgucaacaacgucaacaacggccccacccgccccuccgaggccgagccccgcggcgccgacuccgagaaggucaugcacgaggucucccccauccucaaggagggccgcaacaaggagucccccggcgucaagcgccucaaggacaucguccucuga

SEQ ID NO: 47355 - RNA, 3231 nt, Artificial Sequence
  derived and/or modified sequence opt2 from PCDH1__Homo_sapiens__NP_001265542
augcgcuuccgcgaccucuccuucuggaaccgcggcuccguccucggccucaccgcccucgucgagaaccgcgucuccgucggcgaggcccuccucauccucggccccccccgcauggagcaccuccgccacucccccggccccggcggccagcgccuccuccuccccuccaugcuccucgcccuccuccuccuccucgcccccucccccggccacgccacccgcgucgucuacaagguccccgaggagcagccccccaacacccucaucggcucccucgccgccgacuacggcuuccccgacgucggccaccucuacaagcucgaggucggcgcccccuaccuccgcgucgacggcaagaccggcgacaucuucaccaccgagaccuccaucgaccgcgagggccuccgcgagugccagaaccagcuccccggcgaccccugcauccucgaguucgaggucuccaucaccgaccucguccagaacggcuccccccgccuccucgagggccagaucgagguccaggacaucaacgacaacacccccaacuucgccucccccgucaucacccucgccauccccgagaacaccaacaucggcucccucuuccccaucccccucgccuccgaccgcgacgccggccccaacggcgucgccuccuacgagcuccaggccggccccgaggcccaggagcucuucggccuccaggucgccgaggaccaggaggagaagcagccccagcucaucgucaugggcaaccucgaccgcgagcgcugggacuccuacgaccucaccaucaagguccaggacggcggcucccccccccgcgccuccuccgcccuccuccgcgucaccguccucgacaccaacgacaacgcccccaaguucgagcgccccuccuacgaggccgagcucuccgagaacucccccaucggccacuccgucauccaggucaaggccaacgacuccgaccagggcgccaacgccgagaucgaguacaccuuccaccaggcccccgaggucguccgccgccuccuccgccucgaccgcaacaccggccucaucaccguccagggccccgucgaccgcgaggaccucuccacccuccgcuucuccguccucgccaaggaccgcggcaccaaccccaaguccgcccgcgcccaggucgucgucaccgucaaggacaugaacgacaacgcccccaccaucgagauccgcggcaucggccucgucacccaccaggacggcauggccaacaucuccgaggacgucgccgaggagaccgccgucgcccucguccaggucuccgaccgcgacgagggcgagaacgccgccgucaccugcgucgucgccggcgacguccccuuccagcuccgccaggccuccgagaccggcuccgacuccaagaagaaguacuuccuccagaccaccaccccccucgacuacgagaaggucaaggacuacaccaucgagaucgucgccgucgacuccggcaaccccccccucuccuccaccaacucccucaagguccaggucgucgacgucaacgacaacgcccccgucuucacccaguccgucaccgaggucgccuuccccgagaacaacaagcccggcgaggucaucgccgagaucaccgccuccgacgccgacuccggcuccaacgccgagcucgucuacucccucgagcccgagcccgccgccaagggccucuucaccaucucccccgagaccggcgagauccaggucaagaccucccucgaccgcgagcagcgcgaguccuacgagcucaaggucgucgccgccgaccgcggcucccccucccuccagggcaccgccaccguccucgucaacguccucgacugcaacgacaacgaccccaaguucaugcucuccggcuacaacuucuccgucauggagaacaugcccgcccucucccccgucggcauggucaccgucaucgacggcgacaagggcgagaacgcccagguccagcucuccgucgagcaggacaacggcgacuucgucauccagaacggcaccggcaccauccucuccucccucuccuucgaccgcgagcagcaguccaccuacaccuuccagcucaaggccgucgacggcggcguccccccccgcuccgccuacgucggcgucaccaucaacguccucgacgagaacgacaacgcccccuacaucaccgcccccuccaacaccucccacaagcuccucaccccccagacccgccucggcgagaccgucucccaggucgccgccgaggacuucgacuccggcgucaacgccgagcucaucuacuccaucgccggcggcaaccccuacggccucuuccagaucggcucccacuccggcgccaucacccucgagaaggagaucgagcgccgccaccacggccuccaccgccucgucgucaaggucuccgaccgcggcaagcccccccgcuacggcaccgcccucguccaccucuacgucaacgagacccucgccaaccgcacccuccucgagacccuccucggccacucccucgacaccccccucgacaucgacaucgccggcgaccccgaguacgagcgcuccaagcagcgcggcaacauccucuucggcgucgucgccggcgucgucgccgucgcccuccucaucgcccucgccguccucguccgcuacugccgccagcgcgaggccaaguccggcuaccaggccggcaagaaggagaccaaggaccucuacgcccccaagcccuccggcaaggccuccaagggcaacaaguccaagggcaagaaguccaagucccccaagcccgucaagcccgucgaggacgaggacgaggccggccuccagaagucccucaaguucaaccucauguccgacgcccccggcgacuccccccgcauccaccucccccucaacuacccccccggcucccccgaccucggccgccacuaccgcuccaacuccccccuccccuccauccagcuccagccccagucccccuccgccuccaagaagcaccaggucguccaggaccucccccccgccaacaccuucgucggcaccggcgacaccaccuccaccggcuccgagcaguacuccgacuacuccuaccgcaccaacccccccaaguaccccuccaagcaggucggccagcccuuccagcucuccaccccccagccccucccccaccccuaccacggcgccaucuggaccgaggucugggaguga

SEQ ID NO: 47356 - RNA, 2856 nt, Artificial Sequence
  derived and/or modified sequence opt2 from PCDH20__Homo_sapiens__NP_073754
augcgcggccgcggcaacgcccgcuccucccaggcccucggcgucuccuggugccccgccaccuggcacccccgccucgacaugggccgccuccaccgcccccgcuccuccaccuccuaccgcaaccucccccaccucuuccucuucuuccucuucgucggccccuucuccugccucggcuccuacucccgcgccaccgagcuccucuacucccucaacgagggccuccccgccggcguccucaucggcucccucgccgaggaccuccgccuccucccccgcuccgccggccgccccgacccccagucccagcuccccgagcgcaccggcgccgaguggaaccccccccucuccuucucccucgccucccgcggccucuccggccaguacgucacccucgacaaccgcuccggcgagcuccacaccuccgcccaggagaucgaccgcgaggcccucugcgucgagggcggcggcggcaccgccugguccggcuccgucuccaucuccuccucccccuccgacuccugccuccuccuccucgacguccucguccucccccaggaguacuuccgcuucgucaaggucaagaucgccauccgcgacaucaacgacaacgccccccaguuccccgucucccagaucuccgucuggguccccgagaacgcccccgucaacacccgccucgccaucgagcaccccgccgucgaccccgacgucggcaucaacggcguccagaccuaccgccuccucgacuaccacggcauguucacccucgacgucgaggagaacgagaacggcgagcgcacccccuaccucaucgucaugggcgcccucgaccgcgagacccaggaccaguacgucuccaucaucaucgccgaggacggcggcucccccccccuccucggcuccgccacccucaccaucggcaucuccgacaucaacgacaacugcccccucuucaccgacucccagaucaacgucaccgucuacggcaacgccaccgucggcacccccaucgccgccguccaggccgucgacaaggaccucggcaccaacgcccagaucaccuacuccuacucccagaaggucccccaggccuccaaggaccucuuccaccucgacgagaacaccggcgucaucaagcucuucuccaagaucggcggcuccguccucgagucccacaagcucaccauccucgccaacggccccggcugcauccccgccgucaucaccgcccucgucuccaucaucaaggucaucuuccgcccccccgagaucgucccccgcuacaucgccaacgagaucgacggcgucgucuaccucaaggagcucgagcccgucaacacccccaucgccuucuucaccauccgcgaccccgagggcaaguacaaggucaacugcuaccucgacggcgagggccccuuccgccucucccccuacaagcccuacaacaacgaguaccuccucgagaccaccaagcccauggacuacgagcuccagcaguucuacgaggucgccgucgucgccuggaacuccgagggcuuccacgucaagcgcgucaucaagguccagcuccucgacgacaacgacaacgcccccaucuuccuccagccccucaucgagcucaccaucgaggagaacaacucccccaacgccuuccucaccaagcucuacgccaccgacgccgacuccgaggagcgcggccaggucuccuacuuccucggccccgacgcccccuccuacuucucccucgacuccgucaccggcauccucaccgucuccacccagcucgaccgcgaggagaaggagaaguaccgcuacaccguccgcgccgucgacugcggcaagcccccccgcgaguccgucgccaccgucgcccucaccguccucgacaagaacgacaacuccccccgcuucaucaacaaggacuucuccuucuucguccccgagaacuuccccggcuacggcgagaucggcgucaucuccgucaccgacgccgacgccggccgcaacggcugggucgcccucuccgucgucaaccaguccgacaucuucgucaucgacaccggcaagggcaugcuccgcgccaaggucucccucgaccgcgagcagcaguccuccuacacccucugggucgaggccgucgacggcggcgagcccgcccucuccuccaccgccaagaucaccauccuccuccucgacaucaacgacaaccccccccucguccucuucccccaguccaacauguccuaccuccucguccuccccuccacccuccccggcucccccgucaccgaggucuacgccgucgacaaggacaccggcaugaacgccgucaucgccuacuccaucaucggccgccgcggcccccgccccgaguccuuccgcaucgaccccaagaccggcaacaucacccucgaggaggcccuccuccagaccgacuacggccuccaccgccuccucgucaaggucuccgaccacggcuaccccgagccccuccacuccaccgucauggucaaccucuucgucaacgacaccgucuccaacgaguccuacaucgagucccuccuccgcaaggagcccgagaucaacaucgaggagaaggagccccagaucuccaucgagcccacccaccgcaaggucgaguccgucuccugcaugcccacccucgucgcccucuccgucaucucccucggcuccaucacccucgucaccggcaugggcaucuacaucugccuccgcaagggcgagaagcacccccgcgaggacgagaaccucgagguccagaucccccucaagggcaagaucgaccuccacaugcgcgagcgcaagcccauggacaucuccaacaucuga

SEQ ID NO: 47357 - RNA, 3768 nt, Artificial Sequence
  derived and/or modified sequence opt2 from PCDH7__Homo_sapiens__NP_001166994
augcuccgcaugcgcaccgccggcugggcccgcggcuggugccucggcugcugccuccuccucccccucucccucucccucgccgccgccaagcagcuccuccgcuaccgccucgccgaggagggccccgccgacguccgcaucggcaacgucgccuccgaccucggcaucgucaccggcuccggcgaggucaccuucucccucgaguccggcuccgaguaccucaagaucgacaaccucaccggcgagcucuccaccuccgagcgccgcaucgaccgcgagaagcucccccagugccagaugaucuucgacgagaacgagugcuuccucgacuucgaggucuccgucaucggccccucccaguccugggucgaccucuucgagggccaggucaucguccucgacaucaacgacaacacccccaccuuccccucccccguccucacccucaccgucgaggagaaccgccccgucggcacccucuaccuccuccccaccgccaccgaccgcgacuucggccgcaacggcaucgagcgcuacgagcuccuccaggagcccggcggcggcggcuccggcggcgagucccgccgcgccggcgccgccgacuccgcccccuaccccggcggcggcggcaacggcgccuccggcggcggcuccggcggcuccaagcgccgccucgacgccuccgagggcggcggcggcaccaaccccggcggccgcuccuccgucuucgagcuccaggucgccgacacccccgacggcgagaagcagccccagcucaucgucaagggcgcccucgaccgcgagcagcgcgacuccuacgagcucacccuccgcguccgcgacggcggcgaccccccccgcuccucccaggccauccuccgcguccucaucaccgacgucaacgacaacuccccccgcuucgagaaguccgucuacgaggccgaccucgccgagaacuccgcccccggcacccccauccuccagcuccgcgccgccgaccucgacgucggcgucaacggccagaucgaguacgucuucggcgccgccaccgaguccguccgccgccuccuccgccucgacgagaccuccggcuggcucuccguccuccaccgcaucgaccgcgaggaggucaaccagcuccgcuucaccgucauggcccgcgaccgcggccagccccccaagaccgacaaggccaccgucguccucaacaucaaggacgagaacgacaacguccccuccaucgagauccgcaagaucggccgcaucccccucaaggacggcgucgccaacgucgccgaggacguccucgucgacacccccaucgcccucguccaggucuccgaccgcgaccagggcgagaacggcgucgucaccugcaccgucgucggcgacguccccuuccagcucaagcccgccuccgacaccgagggcgaccagaacaagaagaaguacuuccuccacaccuccaccccccucgacuacgaggccacccgcgaguucaacgucgucaucgucgccgucgacuccggcucccccucccucuccuccaacaacucccucaucgucaaggucggcgacaccaacgacaacccccccauguucggccaguccgucgucgaggucuacuuccccgagaacaacauccccggcgagcgcgucgccaccguccucgccaccgacgccgacuccggcaagaacgccgagaucgccuacucccucgacuccuccgucaugggcaucuucgccaucgaccccgacuccggcgacauccucgucaacaccguccucgaccgcgagcagaccgaccgcuacgaguucaaggucaacgccaaggacaagggcauccccguccuccagggcuccaccaccgucaucguccaggucgccgacaagaacgacaacgaccccaaguucaugcaggacgucuucaccuucuacgucaaggagaaccuccagcccaacucccccgucggcauggucaccgucauggacgccgacaagggccgcaacgccgagaugucccucuacaucgaggagaacaacaacaucuucuccaucgagaacgacaccggcaccaucuacuccaccauguccuucgaccgcgagcaccagaccaccuacaccuuccgcgucaaggccgucgacggcggcgaccccccccgcuccgccaccgccaccgucucccucuucgucauggacgagaacgacaacgcccccaccgucacccuccccaagaacaucuccuacacccuccucccccccuccuccaacguccgcaccgucgucgccaccguccucgccaccgacuccgacgacggcaucaacgccgaccucaacuacuccaucgucggcggcaaccccuucaagcucuucgagaucgaccccaccuccggcgucgucucccucgucggcaagcucacccagaagcacuacggccuccaccgccucgucguccaggucaacgacuccggccagcccucccaguccaccaccacccucguccacgucuucgucaacgaguccgucuccaacgccaccgccaucgacucccagaucgcccgcucccuccacaucccccucacccaggacaucgccggcgaccccuccuacgagaucuccaagcagcgccucuccaucgucaucggcgucgucgccggcaucaugaccgucauccucaucauccucaucgucgucauggcccgcuacugccgcuccaagaacaagaacggcuacgaggccggcaagaaggaccacgaggacuucuucaccccccagcagcacgacaaguccaagaagcccaagaaggacaagaagaacaagaaguccaagcagccccucuacuccuccaucgucaccgucgaggccuccaagcccaacggccagcgcuacgacuccgucaacgagaagcucuccgacucccccuccaugggccgcuaccgcuccgucaacggcggccccggcucccccgaccucgcccgccacuacaaguccuccuccccccuccccaccguccagcuccacccccagucccccaccgccggcaagaagcaccaggccguccaggaccucccccccgccaacaccuucgucggcgccggcgacaacaucuccaucggcuccgaccacugcuccgaguacuccugccagaccaacaacaaguacuccaagcagcccuuccgccgcgucaccuucuccgucgucucccagccccaggacccccaccagggcucccuccaguccugcuacgacuccggccucgaggaguccgagacccccuccuccaaguccuccuccggcccccgccucggcgcccucccccuccccgaggacaacuacgagcgcaccacccccgacggcuccgucggcgaggccgagcacauggagaacgacucccgcccccuccccgacgucgcccucaccggcaagugcacccgcgagugcgacgaguacggccacuccgacuccugcuggaugcccguccgcaccucccccgagcgcaagaagucccagcccaagcucuccaccuucaugcccgucgacgagcgcggcucccaggagaagcucgccaacggcgaggccgccaucaugggcgaccgcaaccgcaaccuccucaacaagaagcucaccuccuccuacgagaccuucuccgccgccuccuucuccaagaacgaggaggccaaccccgaggacaucccccucaccaagaccggcgaguacaagcccucccccgucaacacccucacccgccgcgaggucuaccucuga

SEQ ID NO: 47358 - RNA, 3213 nt, Artificial Sequence
  derived and/or modified sequence opt2 from PCDH8__Homo_sapiens__NP_002581
augucccccguccgccgcuggggcucccccugccucuucccccuccagcucuucucccucugcuggguccucuccgucgcccaguccaagaccguccgcuacuccaccuucgaggaggacgcccccggcaccgucaucggcacccucgccgaggaccuccacaugaaggucuccggcgacaccuccuuccgccucaugaagcaguucaacuccucccuccuccgcguccgcgagggcgacggccagcucaccgucggcgacgccggccucgaccgcgagcgccucugcggccaggccccccagugcguccucgccuucgacgucgucuccuucucccaggagcaguuccgccucguccacgucgaggucgagguccgcgacgucaacgaccacgccccccgcuucccccgcgcccagauccccgucgaggucuccgagggcgccgccgucggcacccgcaucccccucgagguccccgucgacgaggacgucggcgccaacggccuccagaccguccgccucgccgagccccacucccccuuccgcgucgagcuccagacccgcgccgacggcgcccagugcgccgaccucguccuccuccaggagcucgaccgcgagucccaggccgccuacucccucgagcucgucgcccaggacggcggccgccccccccgcuccgccaccgccgcccucuccguccgcguccucgacgccaacgaccacucccccgccuucccccagggcgccgucgccgaggucgagcucgccgaggacgcccccgucggcucccuccuccucgaccucgacgccgccgaccccgacgagggccccaacggcgacgucgucuucgccuucggcgcccgcaccccccccgaggcccgccgccucuuccgccucgacccccgcuccggccgccucacccucgccggccccgucgacuacgagcgccaggacaccuacgagcucgacguccgcgcccaggaccgcggccccggcccccgcgccgccaccugcaaggucaucguccgcauccgcgacgucaacgacaacgcccccgacaucgccaucaccccccucgccgcccccggcgcccccgccaccucccccuucgccgccgccgccgccgccgccgcccucggcggcgccgacgccuccucccccgccggcgccggcacccccgaggccggcgccaccucccucguccccgagggcgccgcccgcgagucccucgucgcccucgucuccaccuccgaccgcgacuccggcgccaacggccagguccgcugcgcccucuacggccacgagcacuuccgccuccagcccgccuacgccggcuccuaccucgucgucaccgccgccucccucgaccgcgagcgcaucgccgaguacaaccucacccucgucgccgaggaccgcggcgcccccccccuccgcaccguccgccccuacaccguccgcgucggcgacgagaacgacaacgccccccucuucacccgccccgucuacgaggucuccguccgcgagaacaacccccccggcgccuaccucgccaccgucgccgcccgcgaccgcgaccucggccgcaacggccaggucaccuaccgccuccucgaggccgaggucggccgcgccggcggcgccgucuccaccuacgucuccgucgaccccgccaccggcgccaucuacgcccuccgcuccuucgacuacgagacccuccgccagcucgacguccgcauccaggccuccgacggcggcuccccccagcucuccuccuccgcccucguccagguccgcguccucgaccagaacgaccacgcccccguccucguccaccccgcccccgccaacggcucccucgaggucgccguccccggccgcaccgccaaggacaccgucgucgcccgcguccaggcccgcgacgccgacgagggcgccaacggcgagcucgccuucgagcuccagcagcaggagccccgcgaggccuucgccaucggccgccgcaccggcgagauccuccucaccggcgaccucucccaggagccccccggccgcgucuuccgcgcccuccucgucaucuccgacggcggccgccccccccucaccaccaccgccaccgucuccuucgucgucaccgccggcggcggccgcggccccgccgcccccgccuccgccggcucccccgagcgcucccgcccccccggcucccgccucggcgucuccggcuccguccuccagugggacaccccccucaucgucaucaucguccucgccggcuccugcacccuccuccucgccgccaucaucgccaucgccaccaccugcaaccgccgcaagaaggagguccgcaagggcggcgcccuccgcgaggagcgccccggcgccgccggcggcggcgccuccgcccccggcucccccgaggaggccgcccgcggcgccggcccccgccccaacauguucgacguccucaccuuccccggcaccggcaaggcccccuucggcucccccgccgccgacgcccccccccccgccgucgccgccgccgagguccccggcuccgagggcggcuccgccaccggcgaguccgccugccacuucgagggccagcagcgccuccgcggcgcccacgccgagcccuacggcgccucccccggcuucggcaaggagcccgccccccccgucgccgucuggaagggccacuccuucaacaccaucuccggccgcgaggccgagaaguucuccggcaaggacuccggcaagggcgacuccgacuucaacgacuccgacuccgacaucuccggcgacgcccucaagaaggaccucaucaaccacaugcaguccggccucugggccugcaccgccgagugcaagauccucggccacuccgaccgcugcuggucccccuccugcuccggccccaacgcccaccccuccccccacccccccgcccagauguccaccuucugcaaguccaccucccucccccgcgacccccuccgccgcgacaacuacuaccaggcccagcuccccaagaccgucggccuccaguccgucuacgagaagguccuccaccgcgacuacgaccgcaccgucacccuccucucccccccccgccccggccgccuccccgaccuccaggagaucggcgucccccucuaccaguccccccccggccgcuaccucucccccaagaagggcgccaacgagaacgucuga

SEQ ID NO: 47359 - RNA, 3612 nt, Artificial Sequence
  derived and/or modified sequence opt2 from PCDH9__Homo_sapiens__NP_065136
auggaccuccgcgacuucuaccuccucgccgcccucaucgccugccuccgccucgacuccgccaucgcccaggagcucaucuacaccauccgcgaggagcuccccgagaacguccccaucggcaacauccccaaggaccucaacaucucccacaucaacgccgccaccggcaccuccgccucccucgucuaccgccucgucuccaaggccggcgacgccccccucgucaaggucuccuccuccaccggcgagaucuucaccaccuccaaccgcaucgaccgcgagaagcucugcgccggcgccuccuacgccgaggagaacgagugcuucuucgagcucgaggucgucauccuccccaacgacuucuuccgccucaucaagaucaagaucaucgucaaggacaccaacgacaacgcccccauguuccccucccccgucaucaacaucuccauccccgagaacacccucaucaacucccgcuuccccauccccuccgccaccgaccccgacaccggcuucaacggcguccagcacuacgagcuccucaacggccaguccgucuucggccucgacaucgucgagacccccgagggcgagaaguggccccagcucaucguccagcagaaccucgaccgcgagcagaaggacaccuacgucaugaagaucaaggucgaggacggcggcaccccccagaaguccuccaccgccauccuccaggucaccgucuccgacgucaacgacaaccgccccgucuucaaggagggccaggucgagguccacauccccgagaacgcccccgucggcaccuccgucauccagcuccacgccaccgacgccgacaucggcuccaacgccgagauccgcuacaucuucggcgcccaggucgcccccgccaccaagcgccucuucgcccucaacaacaccaccggccucaucaccguccagcgcucccucgaccgcgaggagaccgccauccacaaggucaccguccucgccuccgacggcuccuccacccccgcccgcgccaccgucaccaucaacgucaccgacgucaacgacaacccccccaacaucgaccuccgcuacaucaucucccccaucaacggcaccgucuaccucuccgagaaggaccccgucaacaccaagaucgcccucaucaccgucuccgacaaggacaccgacgucaacggcaaggucaucugcuucaucgagcgcgagguccccuuccaccucaaggccgucuacgacaaccaguaccuccucgagaccuccucccuccucgacuacgagggcaccaaggaguucuccuucaagaucgucgccuccgacuccggcaagcccucccucaaccagaccgcccucguccgcgucaagcucgaggacgagaacgacaacccccccaucuucaaccagcccgucaucgagcucuccgucuccgagaacaaccgccgcggccucuaccucaccaccaucuccgccaccgacgaggacuccggcaagaacgccgacaucgucuaccagcucggccccaacgccuccuucuucgaccucgaccgcaagaccggcguccucaccgccucccgcgucuucgaccgcgaggagcaggagcgcuucaucuucaccgucaccgcccgcgacaacggcacccccccccuccagucccaggccgccgucaucgucaccguccucgacgagaacgacaacucccccaaguucacccacaaccacuuccaguucuucgucuccgagaaccuccccaaguacuccaccgucggcgucaucaccgucaccgacgccgacgccggcgagaacaaggccgucacccucuccauccucaacgacaacgacaacuucguccucgaccccuacuccggcgucaucaaguccaacgucuccuucgaccgcgagcagcaguccuccuacaccuucgacgucaaggccaccgacggcggccagcccccccgcuccuccaccgccaaggucaccaucaacgucauggacgucaacgacaacucccccgucgucaucuccccccccuccaacaccuccuucaagcucgucccccucuccgccauccccggcuccgucgucgccgaggucuucgccgucgacgucgacaccggcaugaacgccgagcucaaguacaccaucgucuccggcaacaacaagggccucuuccgcaucgaccccgucaccggcaacaucacccucgaggagaagcccgcccccaccgacgucggccuccaccgccucgucgucaacaucuccgaccucggcuaccccaagucccuccacacccucguccucgucuuccucuacgucaacgacaccgccggcaacgccuccuacaucuacgaccucauccgccgcaccauggagaccccccucgaccgcaacaucggcgacuccucccagcccuaccagaacgaggacuaccucaccaucaugaucgccaucaucgccggcgccauggucgucaucgucgucaucuucgucaccguccucguccgcugccgccacgccucccgcuucaaggccgcccagcgcuccaagcagggcgccgaguggaugucccccaaccaggagaacaagcagaacaagaagaagaagcgcaagaagcgcaagucccccaaguccucccuccucaacuucgucaccaucgaggaguccaagcccgacgacgccguccacgagcccaucaacggcaccaucucccuccccgccgagcucgaggagcaguccaucggccgcuucgacuggggccccgccccccccaccaccuucaagcccaacucccccgaccucgccaagcacuacaaguccgccuccccccagcccgccuuccaccucaagcccgacacccccgucuccgucaagaagcaccacgucauccaggagcucccccucgacaacaccuucgucggcggcugcgacacccucuccaagcgcuccuccaccuccuccgaccacuucuccgccuccgagugcuccucccagggcggcuucaagaccaagggcccccuccacacccgccagucccagcgccgcgucaccuuccaccuccccgacggcucccaggaguccugcuccgacuccggccucggcgaccacgagcccgucggcuccggcacccucaucucccacccccucccccucguccagccccaggacgaguucuacgaccaggccucccccgacaagcgcaccgaggccgacggcaacuccgaccccaacuccgacggcccccucggcccccgcggccucgccgaggccaccgagaugugcacccaggagugccucguccucggccacuccgacaacugcuggaugccccccggccucggccccuaccagcaccccaaguccccccucuccaccuucgccccccagaaggagugggucaagaaggacaagcucgucaacggccacacccucacccgcgccuggaaggaggacuccaaccgcaaccaguucaacgaccgcaagcaguacggcuccaacgagggccacuucaacaacggcucccacaugaccgacaucccccucgccaaccucaaguccuacaagcaggccggcggcgccaccgagucccccaaggagcaccagcucuga

SEQ ID NO: 47360 - RNA, 2853 nt, Artificial Sequence
  derived and/or modified sequence opt2 from PCDHA1__Homo_sapiens__NP_061723
auggucuucucccgccgcggcggccucggcgcccgcgaccuccuccucuggcuccuccuccucgccgccugggaggucggcuccggccagcuccacuacuccauccccgaggaggccaagcacggcaccuucgucggccgcgucgcccaggaccucggccucgagcucgccgagcucgucccccgccucuuccgcgucgccuccaagacccaccgcgaccuccucgaggucaaccuccagaacggcauccucuucgucaacucccgcaucgaccgcgaggagcucugccagugguccgccgagugcuccauccaccucgagcucaucgccgaccgcccccuccaggucuuccacgucgaggucaaggucaaggacaucaacgacaacccccccgucuuccgcggccgcgagcagaucaucuucauccccgagucccgccuccucaacucccgcuuccccaucgagggcgccgccgacgccgacaucggcgccaacgcccuccucaccuacacccucucccccuccgacuacuucucccucgacgucgaggccuccgacgagcucuccaagucccucuggcucgagcuccgcaaguaccucgaccgcgaggagacccccgagcuccaccuccuccucaccgccaccgacggcggcaagcccgagcuccagggcaccgucgagcuccucaucaccguccucgacgucaacgacaacgccccccucuucgaccaggccgucuaccgcguccaccuccucgagaccaccgccaacggcacccucgucaccacccucaacgccuccgacgccgacgagggcgucaacggcgaggucgucuucuccuucgacuccggcaucucccgcgacauccaggagaaguucaaggucgacuccuccuccggcgagauccgccucaucgacaagcucgacuacgaggagaccaaguccuacgagauccaggucaaggccgucgacaagggcuccccccccauguccaaccacugcaagguccucgucaagguccucgacgucaacgacaacgcccccgagcucgccgucaccucccucuaccuccccauccgcgaggacgccccccucuccaccgucaucgcccucaucaccgucuccgaccgcgacuccggcgccaacggccaggucaccugcucccucaugccccacguccccuucaagcucgucuccaccuucaagaacuacuacucccucguccucgacuccgcccucgaccgcgagucccucuccgucuacgagcucgucgucaccgcccgcgacggcggcucccccucccucugggccaccgcccgcgucuccgucgaggucgccgacgucaacgacaacgcccccgccuucgcccagcccgaguacaccgucuucgucaaggagaacaacccccccggcugccacaucuucaccgucuccgcccgcgacgccgacgcccaggagaacgcccucgucuccuacucccucgucgagcgccgcgucggcgagcgcgcccucuccaacuacgucuccguccacgccgaguccggcaaggucuacgcccuccagccccucgaccacgaggagcucgagcuccuccaguuccaggucuccgcccgcgacgccggcguccccccccucggcuccaacgucacccuccaggucuucguccucgacgagaacgacaacgcccccgcccuccucgccccccgcgucggcggcaccaucggcgccgucuccgagcucgucccccgccucgucggcgccggccacgucgucgccaagguccgcgccgucgacgccgacuccggcuacaacgccuggcucuccuacgagcuccagcccgccgccggcggcgcccgcauccccuuccgcgucggccucuacaccggcgagaucuccaccacccgcguccucgacgaggccgaccucucccgcuaccgccuccucguccucgucaaggaccacggcgagcccgcccucaccgccaccgccaccguccucgucucccucgucgaguccggccaggcccccaaggccuccucccgcgccuccgucggcgucgccggccccgaggccgcccucgucgacgucaacgucuaccucaucaucgccaucugcgccgucuccucccuccucguccucacccuccuccucuacaccgcccuccgcugcuccgucccccccaccgagggcgccuacguccccggcaagcccacccucgucugcuccuccgcccucggcuccugguccaacucccagcagcgccgccagcgcgucugcuccuccgagggcccccccaagaccgaccucauggccuucucccccggccucucccccucccucaacaccuccgagcgcaacgagcagcccgaggccaaccucgaccucuccggcaacccccgccagcccaaccccgacuggcgcuacuccgccucccuccgcgccggcaugcacuccuccguccaccucgaggaggccggcauccuccgcgccggccccggcggccccgaccagcaguggcccaccgucuccuccgccacccccgagcccgaggccggcgaggucuccccccccgucggcgccggcgucaacuccaacuccuggaccuucaaguacggccccggcaaccccaagcaguccggccccggcgagcuccccgacaaguucaucauccccggcucccccgccaucaucuccauccgccaggagcccaccaacucccagaucgacaaguccgacuucaucaccuucggcaagaaggaggagaccaagaagaagaagaagaagaagaagggcaacaagacccaggagaagaaggagaagggcaacuccaccaccgacaacuccgaccaguga

SEQ ID NO: 47361 - RNA, 2844 nt, Artificial Sequence
  derived and/or modified sequence opt2 from PCDHA4__Homo_sapiens__NP_061730
auggaguucuccuggggcuccggccaggagucccgccgccuccuccuccuccuccuccuccucgccgccugggaggccggcaacggccagcuccacuacuccgucuccgaggaggccaagcacggcaccuucgucggccgcaucgcccaggaccucggccucgagcucgccgagcucgucccccgccucuuccgcgucgccuccaagggccgcggcggccuccucgaggucaaccuccagaacggcauccucuucgucaacucccgcaucgaccgcgaggagcucugccgccgcuccgccgagugcuccauccaccucgaggucaucgucgaccgcccccuccaggucuuccacgucgacgucgagguccgcgacaucaacgacaacccccccgucuuccccgccacccagaagaaccucuccaucgccgagucccgcccccucgacucccgcuucccccucgagggcgccuccgacgccgacaucggcgagaacgcccuccucaccuaccgccucucccccaacgaguacuucucccucgagaagccccccgacgacgagcucgucaagggccucggccucauccuccgcaagucccucgaccgcgaggaggcccccgagaucuuccucguccucaccgccaccgacggcggcaagcccgagcucaccggcaccguccagcuccucaucaccguccucgacgccaacgacaacgcccccgccuucgaccgcaccaucuacaagguccgccuccucgagaacguccccaacggcacccucgucaucaagcucaacgccuccgaccucgacgagggccucaacggcgacaucgucuacuccuucuccaacgacaucucccccaacgucaaguccaaguuccacaucgaccccaucaccggccagaucaucgucaagggcuacaucgacuucgaggaguccaaguccuacgagaucaucgucgagggcaucgacaagggccagcucccccucuccggccacugccgcgucaucgucgaggucgaggacaacaacgacaacguccccgaccucgaguucaagucccucucccuccccauccgcgaggacgccccccucggcaccgucaucgcccucaucuccgucuccgacaaggacaugggcgucaacggccucgucaccugcucccucaccucccacguccccuucaagcucgucuccaccuucaagaacuacuacucccucguccucgacuccgcccucgaccgcgaguccgucuccgccuacgagcucgucgucaccgcccgcgacggcggcucccccucccucugggccaccgccuccgucuccgucgaggucgccgacgucaacgacaacgcccccgccuucgcccagcccgaguacaccgucuucgucaaggagaacaacccccccggcugccacaucuucaccgucuccgccugggacgccgacgcccaggagaacgcccucgucuccuacucccucgucgagcgccgcgucggcgagcgcgcccucuccuccuacgucuccguccacgccgaguccggcaaggucuacgcccuccagccccucgaccacgaggagcucgagcuccuccaguuccaggucaccgcccgcgacgccggcguccccccccucggcuccaacgucacccuccaggucuucguccucgacgagaacgacaacgcccccgcccuccucgccccccgcgccggcggcaccggcggcgccgucuccgagcucguccccugguccgucggcgucggccacgucgucgccaagguccgcgccgucgacgccgacuccggcuacaacgccuggcucuccuacgagcuccagcccggcaccggcggcgcccgcauccccuuccgcgucggccucuacaccggcgagaucuccaccacccgcgcccucgacgagaccgacgccccccgccaccgccuccucguccucgucaaggaccacggcgagcccgcccucaccgccaccgccaccguccucgucucccucgucgaguccggccaggcccccaaggccuccucccgcgcccucgucggcgccgucggccccgacgccgcccucgucgacgucaacgucuaccucaucaucgccaucugcgccgucuccucccuccucguccucacccuccuccucuacaccgcccuccgcugcuccgcccuccccaccgagggcgccugcgcccccggcaagcccacccucgucugcuccuccgccgucggcuccugguccuacucccagcagcgccgcccccgcgucugcuccggcgagggcccccccaagaccgaccucauggccuucucccccucccuccccgacucccgcgaccgcgaggaccagcuccagaccaccgaggaguccuucgccaagccccgccagcccaaccccgacuggcgcuacuccgccucccuccgcgccggcaugcacuccuccguccaccucgaggaggccggcauccuccgcgccggccccggcggccccgaccagcaguggcccaccgucuccuccgccacccccgagcccgaggccggcgaggucuccccccccgucggcgccggcgucaacuccaacuccuggaccuucaaguacggccccggcaaccccaagcaguccggccccggcgagcuccccgacaaguucaucauccccggcucccccgccaucaucuccauccgccaggagcccaccaacucccagaucgacaaguccgacuucaucaccuucggcaagaaggaggagaccaagaagaagaagaagaagaagaagggcaacaagacccaggagaagaaggagaagggcaacuccaccaccgacaacuccgaccaguga

SEQ ID NO: 47362 - RNA, 2853 nt, Artificial Sequence
  derived and/or modified sequence opt2 from PCDHA6__Homo_sapiens__NP_061732
auggucuucacccccgaggaccgccucggcaagcagugccuccuccucccccuccuccuccucgccgccuggaaggucggcuccggccagcuccacuacuccguccccgaggaggccaagcacggcaccuucgucggccgcaucgcccaggaccucggccucgagcucgccgagcucgucccccgccucuuccgcauggccuccaaggaccgcgaggaccuccucgaggucaaccuccagaacggcauccucuucgucaacucccgcaucgaccgcgaggagcucugcggccgcuccgccgagugcuccauccaccucgaggucaucgucgaccgcccccuccaggucuuccacgucgacgucgagguccgcgacaucaacgacaaccccccccucuuccccgucgaggagcagcgcguccucaucuacgagucccgccuccccgacuccgucuucccccucgagggcgccuccgacgccgacgucggcuccaacuccauccucaccuacaagcucuccuccuccgaguacuucggccucgacgucaagaucaacuccgacgacaacaagcagaucggccuccuccucaagaagucccucgaccgcgaggaggcccccgcccacaaccucuuccucaccgccaccgacggcggcaagcccgagcucaccggcaccguccagcuccucgucaccguccucgacgucaacgacaacgcccccaccuucgagcaguccgaguacgagguccgcaucuucgagaacgccgacaacggcaccaccgucauccgccucaacgccuccgaccgcgacgagggcgccaacggcgccaucuccuacuccuucaacucccucgucgccgccauggucaucgaccacuucuccaucgaccgcaacaccggcgagaucgucauccgcggcaaccucgacuucgagcaggagaaccucuacaagauccucaucgacgccaccgacaagggccacccccccauggccggccacugcaccguccucguccgcauccucgacaagaacgacaacguccccgagaucgcccucaccucccucucccuccccguccgcgaggacgcccaguucggcaccgucaucgcccucaucuccgucaacgaccucgacuccggcgccaacggccaggucaacugcucccucaccccccacguccccuucaagcucgucuccaccuucaagaacuacuacucccucguccucgacuccgcccucgaccgcgaguccgucuccgccuacgagcucgucgucaccgcccgcgacggcggcucccccucccucugggccaccgccucccucuccgucgaggucgccgacaugaacgacaacgcccccgccuucgcccagcccgaguacaccgucuucgucaaggagaacaacccccccggcugccacaucuucaccgucuccgcccgcgacgccgacgcccaggagaacgcccucgucuccuacucccucgucgagcgccgcgucggcgagcgcgcccucuccuccuacaucuccguccacgccgaguccggcaaggucuacgcccuccagccccucgaccacgaggagcucgagcuccuccaguuccaggucuccgcccgcgacgccggcguccccccccucggcuccaacgucacccuccaggucuucguccucgacgagaacgacaacgcccccgcccuccucgccccccgcgucggcggcaccggcggcgccgucuccgagcucgucccccgcucccucggcgccggccaggucgucgccaagguccgcgccgucgacgccgacuccggcuacaacgccuggcucuccuacgagcuccagccccccgccuccuccgcccgcuuccccuuccgcgucggccucuacaccggcgagaucuccaccacccgcguccucgacgaggccgacuccccccgccaccgccuccucguccucgucaaggaccacggcgagcccgcccucaccgccaccgccaccguccucgucucccucgucgaguccggccaggcccccaaggccuccucccgcgccuccgucggcgccgccggccccgaggccgcccucgucgacgucaacgucuaccucaucaucgccaucugcgccgucuccucccuccucguccucacccuccuccucuacaccgcccuccgcugcuccgccccccccaccgagggcgccugcaccgccgacaagcccacccucgucugcuccuccgccgucggcuccugguccuacucccagcagcgccgccagcgcgucugcuccggcgagggcccccccaagauggaccucauggccuucucccccucccucucccccugccccaucaugaugggcaaggccgagaaccaggaccucaacgaggaccacgacgccaagccccgccagcccaaccccgacuggcgcuacuccgccucccuccgcgccggcaugcacuccuccguccaccucgaggaggccggcauccuccgcgccggccccggcggccccgaccagcaguggcccaccgucuccuccgccacccccgagcccgaggccggcgaggucuccccccccgucggcgccggcgucaacuccaacuccuggaccuucaaguacggccccggcaaccccaagcaguccggccccggcgagcuccccgacaaguucaucauccccggcucccccgccaucaucuccauccgccaggagcccaccaacucccagaucgacaaguccgacuucaucaccuucggcaagaaggaggagaccaagaagaagaagaagaagaagaagggcaacaagacccaggagaagaaggagaagggcaacuccaccaccgacaacuccgaccaguga

SEQ ID NO: 47363 - RNA, 2457 nt, Artificial Sequence
  derived and/or modified sequence opt2 from PCDHB1__Homo_sapiens__NP_037472
auggccggcacccgccgcaagucccuccagaaccgccaggucggcucccuccucaucuuccucugcaucuccgucggcgacgccaccaccauccgcuacuccgucgccgaggagauggaguccggcuccuucgucgccaacgucgccaaggaccucggccucgaggucggcaagcucgccgcccgcggcgcccgccucgucuccgagggcaacaagaugcacuuccgccuccaccgcaagaccggcgaccucuucgucaaggagaagcucgaccgcgagucccucugcggcaaggccgaccccugcguccuccacuucgaggucguccucgucgagccccuccaguccuuccgcgccgagguccgcgucuucgacaucaacgacaacgcccccgucuuccucaacaaggagccccuccucaagauccccgaguccaccccccucggcucccgcuucccccuccaguccgcccaggaccucgacgucggccucaacggccuccagaacuacacccucuccgccaacggcuacuuccaccuccacacccgcuucugcucccacggccccaaguacgccgagcucguccucaacaagccccucgaccgcgaggagcagcccgaggucaaccucaccaucaccgccgucgacggcggcuccccccccaaguccggcaccgcccacauccacgucgucguccucgacgucaacgaccacgucccccaguucucccgccucgucuaccgcgcccaggucuccgagaacucccccaacggcucccucgucgccaccgucaccgccgucgaccucgacgagggcaccaacaaggccaucaccuacucccucgcccagaaccccgaggccauccucaagaccuuccagaucgacccccagaacggcgagguccgccuccgcggcccccucgacuucgaggccaucgagaccuacgacaucgacauccaggccaccgacggcggcggccucuccgcccacuccaagguccucgucgaggucgucgacgucaacgacaacccccccgaggucauggucuccuccgucuccuccccccuccccgaggacucccccccccagaccgucgucgcccucuucaccauccgcgaccgcgacauccgcgucggcggcaaggucaccugcuuccuccgcgaggaccuccccuucgucaucaagcccaccuucggcaacuccuacucccucgucaccgaccgcucccucgaccgcgaggaggucuccggcuacaacaucaccaucgucgccauggacaccggcccccccucccucuccgccgagaccaugaucgagguccucaucuccgacgucaacgacaacccccccaucuuccgcgaggacuccuacauccucaccguccgcgagaacaacucccccgccgucuucaucggcaagguccacgccgaggaccucgaccucggcgagaacgcccagaucaccuacucccuccucccccccaagaacggcgaccucuccgucuucgccuacaucuccaucaacuccggcaacggcaagcucuacgcccuccgcaccauggacuacgaggccauccaggacuuccaguucgucgucaaggccaccgacggcggcuuccucucccucuccucccaggucaccguccgcgucgucguccucgacgacaacgacaaccgccccaugauccucuacccccuccagaacggcacccuccccugcaacgaccucgucccccgcuccgccgaggccggcuaccucgucaccaaggucgucgccgucgacggcgacuccggccagaacuccuggcucuccuaccaccuccucaaggccaccgaccucggccucuucuccguccagcgccagaacggcgagauccacacccuccgccagaucuccgagcgcgaccccaugaugcagaagcucaucauccucguccaggaccacggccagcccgcccucuccaccaccgucucccucaacauccuccucgucgacggcuucuccgagcccuaccuccaguuccaggaccccaccaagcacucccgcaaggucaaccccuccaccaaguaccucgucaucucccucgucauccucuccuuccucuuccuccucuccgucaucgucaucuucaucauccacgucuaccagaagaucaaguaccgcgagaaguucaccauccaggagcacuucuacgacgacugcaacuucuccaacaaccucguccagggccagggcaacggcucccucucccgccccugccccuacgagaugugcuccgccaccggcaccggcaacuccgaguuccgcuuccucaagcgcuucaugcccaacuuccccuucccccacgccaccggcgagaucaagauggaggccggcuccucccucccccccaacuccgaccgcaacaagucccagcgccucgagggccacgaccaggucuccgacgacuacauguga

SEQ ID NO: 47364 - RNA, 2397 nt, Artificial Sequence
  derived and/or modified sequence opt2 from PCDHB2__Homo_sapiens__NP_061759
auggaggccggcgagggcaaggagcgcguccccaagcagcgccagguccucaucuucuucguccuccucggcaucgcccaggccuccugccagccccgccacuacuccgucgccgaggagaccgaguccggcuccuucgucgccaaccuccucaaggaccucggccucgagaucggcgagcucgccguccgcggcgcccgcgucgucuccaagggcaagaagaugcaccuccaguucgaccgccagaccggcgaccuccuccucaacgagaagcucgaccgcgaggagcucugcggccccaccgagcccugcguccuccccuuccagguccuccucgagaacccccuccaguucuuccaggccgagcuccgcauccgcgacgucaacgaccacucccccgucuuccucgacaaggagauccuccucaagauccccgaguccaucacccccggcaccaccuuccucaucgagcgcgcccaggaccucgacgucggcaccaacucccuccagaacuacaccaucucccccaacuuccacuuccaccucaaccuccaggacucccucgacggcaucauccucccccagcucguccucaaccgcgcccucgaccgcgaggagcagcccgagauccgccucacccucaccgcccucgacggcggcucccccccccgcuccggcaccgcccucguccgcaucgaggucgucgacaucaacgacaacguccccgaguucgccaagcuccucuacgagguccagauccccgaggacucccccgucggcucccaggucgccaucgucuccgcccgcgaccucgacaucggcaccaacggcgagaucuccuacgccuucucccaggccuccgaggacauccgcaagaccuuccgccucuccgccaaguccggcgagcuccuccuccgccagaagcucgacuucgaguccauccagaccuacaccgucaacauccaggccaccgacggcggcggccucuccggcaccugcgucgucuucguccaggucauggaccucaacgacaacccccccgagcucaccauguccacccucaucaaccagauccccgagaaccuccaggacacccucaucgccgucuucuccgucuccgaccccgacuccggcgacaacggccgcauggucugcuccauccaggacgaccuccccuucuuccucaagcccuccgucgagaacuucuacacccucgucaucuccaccgcccucgaccgcgagacccgcuccgaguacaacaucaccaucaccgucaccgacuucggcaccccccgccucaagaccgagcacaacaucaccguccucgucuccgacgucaacgacaacgcccccgccuucacccagaccuccuacacccucuucguccgcgagaacaacucccccgcccuccacaucggcuccgucuccgccaccgaccgcgacuccggcaccaacgcccaggucaccuacucccuccuccccccccaggacccccaccucccccucgccucccucgucuccaucaacgccgacaacggccaccucuucgcccuccagucccucgacuacgaggcccuccaggccuucgaguuccgcgucggcgccgccgaccgcggcucccccgcccucuccuccgaggcccucguccgcguccucguccucgacgccaacgacaacucccccuucguccucuacccccuccagaacggcuccgcccccugcaccgagcucgucccccgcgccgccgagcccggcuaccucgucaccaaggucgucgccgucgacggcgacuccggccagaacgccuggcucuccuaccagcuccucaaggccaccgagcccggccucuucggcgucugggcccacaacggcgagguccgcaccgcccgccuccuccgcgagcgcgacgccgccaagcagcgccucgucguccucgucaaggacaacggcgagcccccccgcuccgccaccgccacccuccacguccuccucgucgacggcuucucccagcccuaccuccuccuccccgaggccgcccccgcccaggcccaggccgaccuccucaccgucuaccucgucgucgcccucgccuccgucuccucccucuuccucuucuccguccuccucuucgucgccguccgccucugccgccgcucccgcgccgccuccgucggccgcugcuccguccccgagggccccuuccccggccagauggucgacgucuccggcaccggcacccucucccaguccuaccaguacgaggucugccucaccggcggcuccggcaccaacgaguucaaguuccucaagcccaucauccccaacuucgucgcccagggcgccgagcgcgucuccgaggccaaccccuccuuccgcaaguccuucgaguucaccuga

SEQ ID NO: 47365 - RNA, 2391 nt, Artificial Sequence
  derived and/or modified sequence opt2 from PCDHB3__Homo_sapiens__NP_061760
auggaggccggcggcgagcgcuuccuccgccagcgccagguccuccuccucuucgucuuccucggcggcucccucgccggcuccgagucccgccgcuacuccgucgccgaggagaaggagaagggcuuccucaucgccaaccucgccaaggaccucggccuccgcgucgaggagcucgccgcccgcggcgcccaggucgucuccaagggcaacaagcagcacuuccagcucucccaccagaccggcgaccuccuccucaacgagaagcucgaccgcgaggagcucugcggccccaccgagcccugcauccuccacuuccagauccuccuccagaacccccuccaguucgucaccaacgagcuccgcaucaucgacgucaacgaccacucccccgucuucuucgagaacgagaugcaccucaagauccucgaguccacccuccccggcaccgucaucccccucggcaacgccgaggaccucgacgucggccgcaacucccuccagaacuacaccaucacccccaacucccacuuccacguccucacccgcucccgccgcgacggccgcaaguaccccgagcucguccucgacaaggcccucgaccgcgaggagcagcccgagcucucccucacccucaccgcccucgacggcggcucccccccccgcuccggcaccgcccagaucaacauccagguccucgacaucaacgacaacgcccccgaguucgcccagccccucuacgaggucgccguccucgagaacacccccgucaacuccgucaucgucaccgucuccgccuccgaccucgacaccggcuccuucggcaccaucuccuacgccuucuuccacgccuccgaggagauccgcaagaccuuccagcucaaccccaucaccggcgacaugcagcucgucaaguaccucaacuucgaggccaucaacuccuacgaggucgacaucgaggccaaggacggcggcggccucuccggcaaguccaccgucaucguccaggucgucgacgucaacgacaacccccccgagcucacccucuccuccgucaacucccccauccccgagaacuccggcgagaccguccucgccgucuucuccgucuccgaccucgacuccggcgacaacggccgcgucaugugcuccaucgagaacaaccuccccuucuuccucaagcccuccgucgagaacuucuacacccucgucuccgagggcgcccucgaccgcgagacccgcuccgaguacaacaucaccaucaccaucaccgaccucggcaccccccgccucaagaccaaguacaacaucaccguccucgucuccgacgucaacgacaacgcccccgccuucacccagaucuccuacacccucuucguccgcgagaacaacucccccgcccuccacaucggcuccgucuccgccaccgaccgcgacuccggcaccaacgcccaggucaccuacucccuccuccccccccaggacccccaccucccccucuccucccucgucuccaucaacgccgacaacggccaccucuucgcccuccgcucccucgacuacgaggcccuccaggccuucgaguuccgcgucggcgccaccgaccgcggcucccccgcccucuccuccgaggcccucguccgcguccucguccucgacgccaacgacaacucccccuucguccucuacccccuccagaacggcuccgcccccugcaccgagcucgucccccgcgccgccgagcccggcuaccucgucaccaaggucgucgccgucgacggcgacuccggccagaacgccuggcucuccuaccagcuccucaaggccaccgagcccggccucuucggcgucugggcccacaacggcgagguccgcaccgcccgccuccucuccgagcgcgacgccgccaagcaccgccucgucguccucgucaaggacaacggcgagcccccccgcuccgccaccgccacccuccacguccuccucgucgacggcuucucccagcccuaccucccccuccccgaggccgcccccgcccaggcccaggccgaccuccucaccgucuaccucgucgucgcccucgccuccgucuccucccucuuccucuucuccguccuccucuucgucgccguccgccucugccgccgcucccgcgccgccuccgucggccgcugcuccguccccgagggccccuuccccggccagauggucgacgucuccggcaccggcacccucucccaguccuaccaguacgaggucugccucaccggcggcuccggcaccaacgaguucaaguuccucaagcccaucauccccaacuucgucgcccagggcgccgagcgcgucuccgaggccaaccccuccuuccgcaaguccuucgaguucuccuga

SEQ ID NO: 47366 - RNA, 2406 nt, Artificial Sequence
  derived and/or modified sequence opt2 from PCDHB8__Homo_sapiens__NP_061993
auggaggccuccggcaagcucaucugccgccagcgccagguccucuucuccuuccuccuccucggccucucccucgccggcgccgccgagccccgcuccuacuccgucgucgaggagaccgagggcuccuccuucgucaccaaccucgccaaggaccucggccucgagcagcgcgaguucucccgccgcggcguccgcgucgucucccgcggcaacaagcuccaccuccagcucaaccaggagaccgccgaccuccuccucaacgagaagcucgaccgcgaggaccucugcggccacaccgagcccugcguccuccgcuuccagguccuccucgagucccccuucgaguucuuccaggccgagcuccaggucaucgacaucaacgaccacucccccgucuuccucgacaagcagaugcucgucaaggucuccgaguccuccccccccggcaccgccuucccccucaagaacgccgaggaccucgacaucggccagaacaacaucgagaacuacaucaucucccccaacuccuacuuccgcguccucacccgcaagcgcuccgacggccgcaaguaccccgagcucguccucgacaaggcccucgaccgcgaggaggaggccgagcuccgccucacccucaccgcccucgacggcggcucccccccccgcuccggcaccgcccaggucuacaucgaggucgucgacgucaacgacaacgcccccgaguucgagcagcccuucuaccgcguccagaucuccgaggacucccccaucuccuuccucgucgucaaggucuccgccaccgacgucgacaccggcgucaacggcgagaucuccuacucccucuuccaggccuccgacgagaucuccaagaccuucaaggucgacuuccucaccggcgagauccgccucaagaagcagcucgacuucgagaaguuccaguccuacgaggucaacaucgaggcccgcgacgccggcggcuucuccggcaagugcaccguccucauccaggucaucgacgucaacgaccacgcccccgaggucaccauguccgccuucaccucccccauccccgagaacgcccccgagaccgucgucgcccucuucuccgucuccgaccucgacuccggcgagaacggcaagaucuccugcuccauccaggaggaccuccccuuccuccucaaguccuccgucggcaacuucuacacccuccucaccgagaccccccucgaccgcgagucccgcgccgaguacaacgucaccaucaccgucaccgaccucggcaccccccgccucaccacccaccucaacaugaccguccucgucuccgacgucaacgacaacgcccccgccuucacccagaccuccuacacccucuucguccgcgagaacaacucccccgcccuccacaucggcuccgucuccgccaccgaccgcgacuccggcaccaacgcccaggucaccuacucccuccuccccccccaggacccccaccucccccucgccucccucgucuccaucaacaccgacaacggccaccucuucgcccuccgcucccucgacuacgaggcccuccaggccuucgaguuccgcgucggcgccuccgaccgcggcucccccgcccucuccuccgaggcccucguccgcguccucguccucgacgccaacgacaacucccccuucguccucuacccccuccagaacggcuccgcccccugcaccgagcucgucccccgcgccgccgagcccggcuaccucgucaccaaggucgucgccgucgacggcgacuccggccagaacgccuggcucuccuaccagcuccucaaggccaccgagcccggccucuucggcgucugggcccacaacggcgagguccgcaccgcccgccuccucuccgagcgcgacgccgccaagcagcgccucgucguccucgucaaggacaacggcgagccccccugcuccgccaccgccacccuccacguccuccucgucgacggcuucucccagcccuaccucccccuccccgaggccgcccccgcccagggccaggccgacucccucaccgucuaccucgucgucgcccucgccuccgucuccucccucuuccucuucuccguccuccucuucgucgccguccuccucugccgccgcucccgcgccgccuccgucggccgcugcuccguccccgagggccccuuccccggccaccucgucgacguccgcggcaccggcucccucucccagaacuaccaguacgaggucugccucgccggcggcuccggcaccaacgaguuccagcuccucaagcccguccuccccaacauccagggccacuccuucggccccgagauggagcagaacuccaacuuccgcaacggcuucggcuucucccuccagcucaaguga

SEQ ID NO: 47367 - RNA, 2808 nt, Artificial Sequence
  derived and/or modified sequence opt2 from PCDHGA11__Homo_sapiens__NP_061737
auggccaaccgccuccagcgcggcgaccgcucccgccuccuccuccuccucugcaucuuccucggcacccuccgcggcuuccgcgcccgccagauccgcuacuccguccccgaggagaccgagaagggcuccuucgucggcaacaucuccaaggaccucggccucgagccccgcgagcucgccaagcgcggcguccgcaucgucucccgcggcaagacccagcucuucgccgucaacccccgcuccggcucccucaucaccgccggccgcaucgaccgcgaggagcucugcgagaccgucuccuccugcuuccucaacauggagcuccucgucgaggacacccucaagaucuacggcgucgaggucgagaucaucgacaucaacgacaacgcccccuccuuccaggaggacgaggucgagaucaaggucuccgagcacgccauccccggcgcccgcuucgcccuccccaacgcccgcgaccccgacgucggcgucaacucccuccaguccuaccagcucucccccaacaacuacuucucccuccagcuccgcggccgcaccgacggcgccaagaaccccgagcucguccucgagggcucccucgaccgcgagaaggaggccgcccaccuccuccuccucaccgcccucgacggcggcgaccccauccgcaagggcgccguccccauccgcgucgucguccucgacgucaacgaccacauccccauguucacccaguccgucuaccgcgucuccguccccgagaacaucuccuccggcacccgcguccucauggucaacgccaccgaccccgacgagggcaucaacggcgaggucauguacuccuuccgcaacauggaguccaaggccuccgagaucuuccagcucgacucccagaccggcgagguccagguccgcggcucccucgacuucgagaaguaccgcuucuacgagauggagauccagggccaggacggcggcggccucuucaccaccaccaccaugcucaucaccgucgucgacgucaacgacaacgcccccgagaucaccaucaccuccuccaucaacuccauccucgagaacuccccccccggcaccgucaucgcccuccucaacguccaggaccaggacuccggcgagaacggccaggucuccugcuucauccccaaccaccuccccuucaagcucgagaagaccuacggcaacuacuacaagcucaucaccucccgcguccucgaccgcgagcucguccaguccuacaacaucacccucaccgccaccgaccagggcucccccccccucuccgccgagacccacgucuggcucaacgucgccgacgacaacgacaacccccccgucuucccccacuccuccuacuccgccuacauccccgagaacaacccccgcggcgccuccaucuucuccgucaccgcccucgaccccgacuccaagcagaacgcccucgucaccuacucccucaccgacgacaccguccagggcgucccccucuccuccuacgucuccaucaacuccaacaccggcguccucuacgcccuccaguccuucgacuacgagcaguuccgcgaccucgagcuccgcgucaucgcccgcgacuccggcgaccccccccucuccuccaacgucucccucucccucuucguccucgaccagaacgacaacgcccccgagauccucuaccccgcccuccccaccgacggcuccaccggcgucgagcucgccccccgcuccgccgagcccggcuaccucgucaccaaggucgucgccgucgacaaggacuccggccagaacgccuggcucuccuaccgccuccucaaggccuccgagcccggccucuucgccgucggcgagcacaccggcgagguccgcaccgcccgcgcccuccucgaccgcgacgcccucaagcagucccucgucgucgccguccaggaccacggccagcccccccucuccgccaccgucacccucaccgucgccgucgccgacuccauccccgagguccucgccgaccucggcucccucgagucccucgccaacuccgagaccuccgaccucucccucuaccucgucgucgccgucgccgccgucuccugcaucuuccucgucuucgucaucguccuccucgcccuccgccucuggcgcuggcacaagucccgccuccuccaggccuccgagggcggccucgccggcaugcccaccucccacuucgucggcgucgacggcguccaggccuuccuccagaccuacucccacgaggucucccucaucgccgacucccagaagucccaccucaucuucccccagcccaacuacggcgacacccucaucucccaggaguccugcgagaaguccgagccccuccucaucgccgaggacuccgccaucauccucggcaagugcgaccccaccuccaaccagcaggccccccccaacaccgacuggcgcuucucccaggcccagcgccccggcaccuccggcucccagaacggcgacgacaccggcaccuggcccaacaaccaguucgacaccgagaugcuccaggccaugauccucgccuccgccuccgaggccgccgacggcuccuccacccucggcggcggcgccggcaccaugggccucuccgcccgcuacggcccccaguucacccuccagcacguccccgacuaccgccagaacgucuacauccccggcuccaacgccacccucaccaacgccgccggcaagcgcgacggcaaggcccccgccggcggcaacggcaacaagaagaaguccggcaagaaggagaagaaguga

SEQ ID NO: 47368 - RNA, 2799 nt, Artificial Sequence
  derived and/or modified sequence opt2 from PCDHGA3__Homo_sapiens__NP_061739
augaccaacugccucuccuuccgcaacggccgcggccucgcccuccucugcgcccuccucggcacccucugcgagaccggcuccggccagauccgcuacuccgucuccgaggagcucgacaagggcuccuucgucggcaacaucgccaacgaccucggccucgagccccgcgagcucgccgagcgcggcguccgcaucgucucccgcggccgcacccagcucuucucccucaacccccaguccggcucccucgucaccgccgagcgcaucgaccgcgaggagcucugcgcccagaucccccucugccucgucaagaucaacauccucgucgaggacaagcucaagaucuucgaggucgagaucgagaucaaggacaucaacgacaacgcccccaacuuccccaccgaggagcucgagaucaagaucggcgagcucaccguccccggcacccgcuuccccaucaagaccgccuucgaccccgacgucggcaucaacucccuccagaacuacaagcucucccccaacgacuacuucucccucgccgucaacuccgucuccgagggcgccaaguaccccgagcucguccucgagcgcgcccucgaccgcgagaagaaggagauccaccagcucguccucgucgccuccgacggcggcgaccccguccacuccggcaaccuccacauccaggucaucguccucgacgccaacgacaacccccccauguucacccagcccgaguaccgcgucuccgucugggagaacguccccgucggcacccgccuccucaccgucaacgccaccgaccccgacgagggcuucaacgcccaggucuccuacauccucgacaagaugcccggcaagaucgccgagaucuuccaccucaacuccgucuccggcgaggucuccauccucaagucccucgacuacgaggacgccauguucuacgagaucaagaucgaggcccaggacggccccggccuccucucccgcgccaagauccucgucaccguccucgacgucaacgacaacgcccccgagaucaccaucaccucccucaccuccuccguccccgaggagggcaccgucggccgcgagaucgcccucaucgacguccacgaccgcgacuccggccagaacggccaggucgaggucuucguccucggcaaccuccccuucaagcucgagaaguccaucgaccaguacuaccgccucgucaccgccaccucccucgaccgcgagcagaucuccgaguacaacaucucccuccgcgccuccgacggcggcucccccccccucuccaccgagacccacaucacccuccacgucaucgacaucaacgacaacccccccaccuucccccaccucuccuacuccgccuacauccccgagaacaacccccgcggcgccuccaucuucuccgucaccgcccaggaccccgacuccaacaacaacgcccgcaucaccuacgcccucaccgaggacacccuccagggcgccccccucuccuccuucgucuccaucaacuccaacaccggcguccucuacgcccuccgcuccuucgacuacgagcaguuccgcgaccucaagcuccucgucaccgccuccgacuccggcaaccccccccucuccuccaacgucucccucaaccucuucguccucgaccagaacgacaacgcccccgagauccucuaccccgcccuccccaccgacggcuccaccggcgucgagcucgccccccgcuccgccgagcccggcuaccucgucaccaaggucgucgccgucgaccgcgacuccggccagaacgccuggcucuccuaccgccuccucaaggccuccgagcccggccucuucuccgucggccuccacaccggcgagguccgcaccgcccgcgcccuccucgaccgcgacgcccucaagcagucccucgucgucgccguccaggaccacggccagcccccccucuccgccaccgucacccucaccgucgccgucgccgaccgcauccccgacauccucgccgaccucggcucccucgagcccuccgccaagcccaacgacuccgaccucacccucuaccucgucgucgccgucgccgccgucuccugcgucuuccucgccuucgucaucguccuccucgcccuccgccuccgccgcuggcacaagucccgccuccuccaggccuccggcggcggccucgccuccacccccggcucccacuucgucggcgccgacggcguccgcgccuuccuccagaccuacucccacgaggucucccucaccgccgacucccgcaagucccaccucaucuucccccagcccaacuacgccgacacccucaucucccaggaguccugcgagaaguccgagccccuccucaucacccaggaccuccucgagaugaagggcgacuccaaccuccuccagcaggccccccccaacaccgacuggcgcuucucccaggcccagcgccccggcaccuccggcucccagaacggcgacgacaccggcaccuggcccaacaaccaguucgacaccgagaugcuccaggccaugauccucgccuccgccuccgaggccgccgacggcuccuccacccucggcggcggcgccggcaccaugggccucuccgcccgcuacggcccccaguucacccuccagcacguccccgacuaccgccagaacgucuacauccccggcuccaacgccacccucaccaacgccgccggcaagcgcgacggcaaggcccccgccggcggcaacggcaacaagaagaaguccggcaagaaggagaagaaguga

SEQ ID NO: 47369 - RNA, 2772 nt, Artificial Sequence
  derived and/or modified sequence opt2 from PCDHGB4__Homo_sapiens__NP_003727
augggcuccggcgccggcgagcucggccgcgccgagcgccuccccguccucuuccucuuccuccucucccucuucugccccgcccucugcgagcagauccgcuaccgcauccccgaggagaugcccaagggcuccgucgucggcaaccucgccaccgaccucggcuucuccguccaggagcuccccacccgcaagcuccgcgucuccuccgagaagcccuacuucaccgucuccgccgaguccggcgagcuccucgucuccucccgccucgaccgcgaggagaucugcggcaagaagcccgccugcgcccucgaguucgaggccgucgccgagaacccccucaacuucuaccacgucaacgucgagaucgaggacaucaacgaccacacccccaaguucacccagaacuccuucgagcuccagaucuccgaguccgcccagcccggcacccgcuucauccucggcuccgcccacgacgccgacaucggcuccaacacccuccagaacuaccagcucucccccuccgaccacuucucccucaucaacaaggagaaguccgacggcuccaaguaccccgagaugguccucaagaccccccucgaccgcgagaagcagaaguccuaccaccucacccucaccgcccucgacuucggcgcccccccccucuccuccaccgcccagauccacguccucgucaccgacgccaacgacaacgcccccgucuucucccaggacgucuaccgcgucucccucuccgagaacgucuaccccggcaccaccguccuccaggucaccgccaccgaccaggacgagggcgucaacgccgagaucaccuucuccuucuccgaggccucccagaucacccaguucgaccucaacuccaacaccggcgagaucaccguccucaacacccucgacuucgaggaggucaaggaguacuccaucguccucgaggcccgcgacggcggcggcaugaucgcccagugcaccgucgaggucgaggucaucgacgagaacgacaacgcccccgaggucaucuuccagucccuccccaaccucaucauggaggacgccgagcucggcacccacaucgcccuccucaagguccgcgacaaggacucccgccacaacggcgaggucaccugcaagcucgagggcgacguccccuucaagauccucaccuccucccgcaacaccuacaagcucgucaccgacgccguccucgaccgcgagcagaaccccgaguacaacaucaccgucaccgccaccgaccgcggcaagcccccccucuccuccuccuccuccaucacccuccacaucggcgacgucaacgacaacgcccccgucuucucccaguccuccuacaucguccacgucgccgagaacaacccccccggcgccuccaucucccagguccgcgccuccgaccccgaccucggccccaacggccaggucuccuacugcaucauggccuccgaccucgagcagcgcgagcucuccuccuacgucuccaucuccgccgaguccggcgucgucuucgcccagcgcgccuucgaccacgagcagcuccgcgccuucgagcucacccuccaggcccgcgaccagggcucccccgcccucuccgccaacgucucccuccgcguccucgucgacgaccgcaacgacaacgccccccgcguccucuaccccgcccucggccccgacggcuccgcccucuucgacauggucccccacgccgccgagcccggcuaccucgucaccaaggucgucgccgucgacgccgacuccggccacaacgccuggcucuccuaccacguccuccaggccuccgagcccggccucuucucccucggccuccgcaccggcgagguccgcaccgcccgcgcccucggcgaccgcgacgccguccgccagcgccuccucgucgccguccgcgacggcggccagcccccccucuccgccaccgccacccuccaccucgucuucgccgacucccuccaggagguccuccccgacaucaccgaccgccccgaccccuccgaccuccaggccgagcuccaguucuaccucgucgucgcccucgcccucaucuccguccucuuccucgucgccaugauccucgccaucgcccuccgccuccgccgcuccuccucccccgccuccugguccugcuuccagcccggccucugcgucaaguccgaguccgucgucccccccaacuacuccgagggcacccuccccuacuccuacaaccucugcgucgcccacaccggcaagaccgaguucaacuuccucaagugcuccgagcagcucuccuccggccaggacauccucugcggcgacuccuccggcgcccucuucccccucugcaacuccuccgagcucaccucccaccagcaggccccccccaacaccgacuggcgcuucucccaggcccagcgccccggcaccuccggcucccagaacggcgacgacaccggcaccuggcccaacaaccaguucgacaccgagaugcuccaggccaugauccucgccuccgccuccgaggccgccgacggcuccuccacccucggcggcggcgccggcaccaugggccucuccgcccgcuacggcccccaguucacccuccagcacguccccgacuaccgccagaacgucuacauccccggcuccaacgccacccucaccaacgccgccggcaagcgcgacggcaaggcccccgccggcggcaacggcaacaagaagaaguccggcaagaaggagaagaaguga

SEQ ID NO: 47370 - RNA, 2793 nt, Artificial Sequence
  derived and/or modified sequence opt2 from PCDHGB6__Homo_sapiens__NP_061749
augggcggcuccugcgcccagcgccgccgcgccggcccccgccagguccucuucccccuccuccucccccucuucuaccccacccucuccgagcccauccgcuacuccauccccgaggagcucgccaagggcuccgucgucggcaaccucgccaaggaccucggccucuccguccucgacgucuccgcccgcaagcuccgcgucuccgccgagaagcuccacuucuccgucgacgccgaguccggcgaccuccucgucaagaaccgcaucgaccgcgagcagaucugcaaggagcgccgccgcugcgagcuccagcucgaggccgucgucgagaacccccucaacaucuuccacgucaucgucgucaucgaggacgucaacgaccacgccccccaguucgacaagaaggagauccaccucgagaucuucgaguccgccuccgccggcacccgccucucccucgaccccgccaccgaccccgacaucaacaucaacuccaucaaggacuacaagaucaacuccaaccccuacuucucccucaugguccgcgucaacuccgacggcggcaaguaccccgagcucucccucgagaagcuccucgaccgcgaggagcagcgcucccacucccucauccucaccgcccucgacggcggcgaccccccccgcuccgccaccgcccacaucgagaucuccgucaaggacaccaacgacaacccccccgucuucucccgcgacgaguaccgcaucucccucuccgagaaccucccccccggcucccccguccuccaggucaccgccaccgaccaggacgagggcgucaacgccgagaucaacuacuacuuccgcuccaccgcccaguccaccaagcacauguucucccucgacgagaagaccggcaugaucaagaacaaccaguccuucgacuucgaggacgucgagcgcuacaccauggaggucgaggccaaggacggcggcggccucuccacccagugcaaggucaucaucgagauccucgacgagaacgacaacucccccgagaucaucaucaccucccucuccgaccagauccucgagaacuccccccccggcauggucgucgcccucuucaagacccgcgaccucgacuucggcggcaacggcgagguccgcugcaacaucgagaccgacauccccuucaagaucuacuccuccuccaacaacuacuacaagcucgucaccgacggcgcccucgaccgcgagcagacccccgaguacaacgucaccaucgucgccaccgaccgcggcaagcccccccucuccuccucccgcuccaucacccucuacgucgccgacaucaacgacaacgcccccgucuucgaccagaccuccuacgucguccacgucgccgagaacaacccccccggcgccuccaucgcccaggucuccgccuccgaccccgaccucggccucaacggccacaucuccuacuccaucgucgccuccgaccucgagccccucgccgucuccuccuacgucuccgucuccgcccaguccggcgucgucuucgcccagcgcgccuucgaccacgagcagcuccgcgccuucgcccucacccuccaggcccgcgaccacggcucccccacccucuccgccaacgucucccuccgcguccucgucggcgaccgcaacgacaacgccccccgcguccucuaccccgcccucggccccgacggcuccgccuucuucgacauggucccccgcuccgccgagcccggcuaccucgucaccaaggucgucgccgucgacgccgacuccggccacaacgccuggcucuccuaccacguccuccaggccuccgagcccggccucuucucccucggccuccgcaccggcgagguccgcaccgcccgcgcccucggcgaccgcgacgccgcccgccagcgccuccucgucgccguccgcgacggcggccagcccccccucuccgccaccgccacccuccaccucgucuucgccgacaaccuccaggagauccuccccgaccucuccgaccgccccguccucuccgacccccaggccgagcuccaguucuaccucgucgucgcccucgcccucaucuccguccucuuccuccucgccgucauccucgccaucgcccuccgccuccgccgcucccucucccccgccaccugggacugcuuccaccccggccucugcgucaaguccggccccgucgucccccccaacuacuccgagggcacccuccccuacuccuacaaccucugcaucgcccacaccggcaccaaggaguucaacuuccucaagugcuccgucccccuccacuccaacgaggacauggucugcuccgucucccccggcgcccucauccccccccacggcggcgaggaccucaccucccaccccgagacccucaccucccaggccccccccaacaccgacuggcgcuucucccaggcccagcgccccggcaccuccggcucccagaacggcgacgacaccggcaccuggcccaacaaccaguucgacaccgagaugcuccaggccaugauccucgccuccgccuccgaggccgccgacggcuccuccacccucggcggcggcgccggcaccaugggccucuccgcccgcuacggcccccaguucacccuccagcacguccccgacuaccgccagaacgucuacauccccggcuccaacgccacccucaccaacgccgccggcaagcgcgacggcaaggcccccgccggcggcaacggcaacaagaagaaguccggcaagaaggagaagaaguga

SEQ ID NO: 47371 - RNA, 2805 nt, Artificial Sequence
  derived and/or modified sequence opt2 from PCDHGC3__Homo_sapiens__NP_002579
augguccccgaggccuggcgcuccggccucgucuccaccggccgcgucgucggcguccuccuccuccucggcgcccucaacaaggccuccaccgucauccacuacgagauccccgaggagcgcgagaagggcuucgccgucggcaacgucgucgccaaccucggccucgaccucggcucccucuccgcccgccgcuuccgcgucgucuccggcgccucccgccgcuucuucgaggucaaccgcgagaccggcgagauguucgucaacgaccgccucgaccgcgaggagcucugcggcacccuccccuccugcaccgucacccucgagcucgucgucgagaacccccucgagcucuucuccgucgaggucgucauccaggacaucaacgacaacaaccccgccuuccccacccaggagaugaagcucgagaucuccgaggccgucgcccccggcacccgcuucccccucgaguccgcccacgaccccgacgucggcuccaacucccuccagaccuacgagcucucccgcaacgaguacuucgcccuccgcguccagacccgcgaggacuccaccaaguacgccgagcucguccucgagcgcgcccucgaccgcgagcgcgagcccucccuccagcucguccucaccgcccucgacggcggcacccccgcccucuccgccucccuccccauccacaucaagguccucgacgccaacgacaacgcccccgucuucaaccagucccucuaccgcgcccgcguccucgaggacgcccccuccggcacccgcgucguccagguccucgccaccgaccucgacgagggccccaacggcgagaucaucuacuccuucggcucccacaaccgcgccggcguccgccagcucuucgcccucgaccucgucaccggcaugcucaccaucaagggccgccucgacuucgaggacaccaagcuccacgagaucuacauccaggccaaggacaagggcgccaaccccgagggcgcccacugcaagguccucgucgaggucgucgacgucaacgacaacgcccccgagaucaccgucaccuccgucuacucccccguccccgaggacgccccccucggcaccgucaucgcccuccucuccgucaccgaccucgacgccggcgagaacggccucgucaccugcgaggucccccccggccuccccuucucccucaccuccucccucaagaacuacuucacccucaagaccuccgccgaccucgaccgcgagaccguccccgaguacaaccucuccaucaccgcccgcgacgccggcacccccucccucuccgcccucaccaucguccgcguccaggucuccgacaucaacgacaaccccccccaguccucccaguccuccuacgacgucuacaucgaggagaacaaccuccccggcgcccccauccucaaccucuccgucugggaccccgacgccccccagaacgcccgccucuccuucuuccuccucgagcagggcgccgagaccggccucgucggccgcuacuucaccaucaaccgcgacaacggcaucgucuccucccucgucccccucgacuacgaggaccgccgcgaguucgagcucaccgcccacaucuccgacggcggcacccccguccucgccaccaacaucuccgucaacaucuucgucaccgaccgcaacgacaacgccccccagguccucuacccccgccccggcggcuccuccgucgagaugcucccccgcggcaccuccgccggccaccucgucucccgcgucgucggcugggacgccgacgccggccacaacgccuggcucuccuacucccuccucggcucccccaaccagucccucuucgccaucggccuccacaccggccagaucuccaccgcccgccccguccaggacaccgacuccccccgccagacccucaccguccucaucaaggacaacggcgagcccucccucuccaccaccgccacccucaccgucuccgucaccgaggacucccccgaggcccgcgccgaguuccccuccggcuccgccccccgcgagcagaagaagaaccucaccuucuaccuccuccucucccucauccucgucuccgucggcuucgucgucaccgucuucggcgucaucaucuucaaggucuacaaguggaagcagucccgcgaccucuaccgcgcccccgucuccucccucuaccgcacccccggccccucccuccacgccgacgccguccgcggcggccucauguccccccaccucuaccaccaggucuaccucaccaccgacucccgccgcuccgacccccuccucaagaagcccggcgccgccuccccccucgccucccgccagaacacccuccgcuccugcgaccccgucuucuaccgccagguccucggcgccgaguccgccccccccggccagcaggccccccccaacaccgacuggcgcuucucccaggcccagcgccccggcaccuccggcucccagaacggcgacgacaccggcaccuggcccaacaaccaguucgacaccgagaugcuccaggccaugauccucgccuccgccuccgaggccgccgacggcuccuccacccucggcggcggcgccggcaccaugggccucuccgcccgcuacggcccccaguucacccuccagcacguccccgacuaccgccagaacgucuacauccccggcuccaacgccacccucaccaacgccgccggcaagcgcgacggcaaggcccccgccggcggcaacggcaacaagaagaaguccggcaagaaggagaagaaguga

SEQ ID NO: 47372 - RNA, 1299 nt, Artificial Sequence
  derived and/or modified sequence opt2 from PCED1B__Homo_sapiens__NP_001268358
augauccuccuccgcgccuccgagguccgccagcuccuccacaacaaguucgucgucauccucggcgacuccguccaccgcgccgucuacaaggaccucguccuccuccuccagaaggaccgccuccucacccccggccagcuccgcgcccgcggcgagcucaacuucgagcaggacgagcucgucgacggcggccagcgcggccacaugcacaacggccucaacuaccgcgagguccgcgaguuccgcuccgaccaccaccucguccgcuucuacuuccucacccgcgucuacuccgacuaccuccagaccauccucaaggagcuccaguccggcgagcacgcccccgaccucgucaucaugaacuccugccucugggacaucucccgcuacggccccaacuccuggcgcuccuaccucgagaaccucgagaaccucuuccagugccucggccagguccuccccgaguccugccuccucgucuggaacaccgccaugcccgucggcgaggaggucaccggcggcuuccucccccccaagcuccgccgccagaaggccaccuuccucaagaacgaggucgucaaggccaacuuccacuccgccaccgaggcccgcaagcacaacuucgacguccucgaccuccacuuccacuuccgccacgcccgcgagaaccuccacugggacggcguccacuggaacggccgcguccaccgcugccucucccagcuccuccucgcccacgucgccgacgccuggggcgucgagcucccccaccgccaccccgucggcgaguggaucaagaagaagaagcccggcccccgcgucgagggccccccccaggccaaccgcaaccaccccgcccucccccucucccccccccuccccucccccaccuaccgcccccuccucggcuuccccccccagcgccucccccuccucccccuccucuccccccagccccccccccccauccuccaccaccagggcaugccccgcuucccccagggcccccccgacgccugcuucuccuccgaccacaccuuccaguccgaccaguucuacugccacuccgacguccccuccuccgcccacgccggcuucuucgucgaggacaacuucauggucggcccccagcuccccaugcccuucuuccccaccccccgcuaccagcgccccgcccccgucguccaccgcggcuucggccgcuaccgcccccgcggccccuacacccccuggggccagcgcccccgccccuccaagcgccgcgcccccgccaaccccgagccccgcccccaguga

SEQ ID NO: 47373 - RNA, 4668 nt, Artificial Sequence
  derived and/or modified sequence opt2 from PCF11__Homo_sapiens__NP_056969
auguccgagcagacccccgccgaggccggcgccgccggcgcccgcgaggacgccugccgcgacuaccaguccucccucgaggaccucaccuucaacuccaagccccacaucaacaugcucaccauccucgccgaggagaaccuccccuucgccaaggagaucgucucccucaucgaggcccagaccgccaaggcccccuccuccgagaagcuccccgucauguaccucauggacuccaucgucaagaacgucggccgcgaguaccucaccgccuucaccaagaaccucgucgccaccuucaucugcgucuucgagaaggucgacgagaacacccgcaagucccucuucaagcuccgcuccaccugggacgagaucuucccccucaagaagcucuacgcccucgacguccgcgucaacucccucgaccccgccuggcccaucaagccccucccccccaacgucaacaccuccuccauccacgucaaccccaaguuccucaacaagucccccgaggagcccuccacccccggcaccgucgucuccucccccuccaucuccaccccccccaucguccccgacauccagaagaaccucacccaggagcagcucauccgccagcagcuccucgccaagcagaagcagcuccucgagcuccagcagaagaagcucgagcucgagcucgagcaggccaaggcccagcucgccgucucccucuccguccagcaggagaccuccaaccucggccccggcuccgcccccuccaagcuccacgucucccagaucccccccauggccgucaaggccccccaccagguccccguccaguccgagaagucccgccccggccccucccuccagauccaggaccucaagggcaccaaccgcgacccccgccucaaccgcaucucccagcacucccacggcaaggaccagucccaccgcaaggaguuccucaugaacacccucaaccaguccgacaccaagaccuccaagaccauccccuccgagaagcucaacuccuccaagcaggagaaguccaaguccggcgagaagaucaccaagaaggagcucgaccagcucgacuccaaguccaaguccaaguccaagucccccuccccccucaagaacaagcucucccacaccaaggaccucaagaaccaggaguccgaguccaugcgccucuccgacaugaacaagcgcgacccccgccucaagaagcaccuccaggacaagaccgacggcaaggacgacgacgucaaggagaagcgcaagaccgccgagaagaaggacaaggacgagcacaugaaguccuccgagcaccgccucgccggcucccgcaacaagaucaucaacggcaucguccagaagcaggacaccaucaccgaggaguccgagaagcagggcaccaagcccggccgcuccuccacccgcaagcgcucccgcucccgcucccccaagucccgcucccccaucauccacucccccaagcgccgcgaccgccgcucccccaagcgccgccagcgcuccaugucccccaccuccacccccaaggccggcaagauccgccaguccggcgccaagcagucccacauggaggaguucaccccccccucccgcgaggaccgcaacgccaagcgcuccaccaagcaggacauccgcgacccccgccgcaugaagaagaccgaggaggagcgcccccaggagaccaccaaccagcacuccaccaaguccggcaccgagcccaaggagaacgucgagaacuggcaguccuccaaguccgccaagcgcuggaaguccggcugggaggagaacaagucccuccagcaggucgacgagcacuccaagcccccccaccuccgccaccgcgaguccugguccuccaccaagggcauccucuccccccgcgcccccaagcagcagcagcaccgccucuccgucgacgccaaccuccagauccccaaggagcucacccucgccuccaagcgcgagcuccuccagaagaccuccgagcgccucgccuccggcgagaucacccaggacgacuuccucgucgucguccaccagauccgccagcucuuccaguaccaggagggcguccgcgaggagcagcgcucccccuucaacgaccgcuucccccucaagcgcccccgcuacgaggacuccgacaagcccuucgucgacucccccgccucccgcuucgccggccucgacaccaaccagcgccucaccgcccucgccgaggaccgcccccucuucgacggccccucccgccccuccgucgcccgcgacggccccaccaagaugaucuucgagggccccaacaagcucuccccccgcaucgacggcccccccacccccgccucccuccgcuucgacggcucccccggccagaugggcggcggcggcccccuccgcuucgagggcccccagggccagcucggcggcggcugcccccuccgcuucgagggcccccccggccccgucggcaccccccuccgcuucgagggccccaucggccaggccggcggcggcggcuuccgcuucgagggcucccccggccuccgcuucgagggcucccccggcggccuccgcuucgagggccccggcggccagcccgucggcggccuccgcuucgagggccaccgcggccagcccgucggcggccuccgcuucgagggcccccacggccagcccgucggcggccuccgcuucgacaacccccgcggccagcccgucggcggccuccgcuucgagggcggccacggccccuccggcgccgccauccgcuucgacggcccccacggccagcccggcggcggcauccgcuucgagggcccccuccuccagcagggcgucggcaugcgcuucgagggcccccacggccaguccgucgccggccuccgcuucgagggccagcacaaccagcucggcggcaaccuccgcuucgagggcccccacggccagcccggcgucggcauccgcuucgagggcccccucguccagcagggcggcggcaugcgcuucgagggccccuccguccccggcggcggccuccgcaucgagggcccccucggccagggcggcccccgcuucgagggcugccacgcccuccgcuucgacggccagcccggccagcccucccuccucccccgcuucgacggccuccacggccagcccggcccccgcuucgagcgcacccccggccagcccggcccccagcgcuucgacggcccccccggccagcagguccagccccgcuucgacggcgucccccagcgcuucgacggcccccagcaccagcaggccucccgcuucgacaucccccucggccuccagggcacccgcuucgacaaccaccccucccagcgccucgaguccgucuccuucaaccagaccggccccuacaacgacccccccggcaacgccuucaacgcccccucccagggccuccaguuccagcgccacgagcagaucuucgacuccccccagggccccaacuucaacggcccccacggccccggcaaccaguccuucuccaacccccucaaccgcgccuccggccacuacuucgacgagaagaaccuccaguccucccaguucggcaacuucggcaacauccccgcccccaugaccgucggcaacauccaggccucccagcagguccucuccggcgucgcccagcccgucgccuucggccagggccagcaguuccuccccguccacccccagaaccccggcuucguccagaaccccuccggcgcccuccccaaggccuaccccgacaaccaccucucccaggucgacgucaacgagcucuucuccaagcuccucaagaccggcauccucaagcucucccagaccgacuccgccaccacccaggucuccgaggucaccgcccagcccccccccgaggaggaggaggaccagaacgaggaccaggacguccccgaccucaccaacuucaccgucgaggagcucaagcagcgcuacgacuccgucaucaaccgccucuacaccggcauccagugcuacuccugcggcaugcgcuucaccaccucccagaccgacgucuacgccgaccaccucgacuggcacuaccgccagaaccgcaccgagaaggacgucucccgcaaggucacccaccgccgcugguacuacucccucaccgacuggaucgaguucgaggagaucgccgaccucgaggagcgcgccaagucccaguucuucgagaagguccacgaggaggucguccucaagacccaggaggccgccaaggagaaggaguuccaguccguccccgccggccccgccggcgccgucgaguccugcgagaucugccaggagcaguucgagcaguacugggacgaggaggaggaggaguggcaccucaagaacgccauccgcgucgacggcaagaucuaccaccccuccugcuacgaggacuaccagaacaccuccuccuucgacugcacccccucccccuccaagacccccgucgagaacccccucaacaucaugcucaacaucgucaagaacgagcuccaggagcccugcgacucccccaaggucaaggaggagcgcaucgacaccccccccgccugcaccgaggaguccaucgccacccccuccgagaucaagaccgagaacgacaccgucgaguccgucuga

SEQ ID NO: 47374 - RNA, 780 nt, Artificial Sequence
  derived and/or modified sequence opt2 from PCGF1__Homo_sapiens__NP_116062
auggccuccccccagggcggccagaucgccaucgccaugcgccuccgcaaccagcuccaguccgucuacaagauggacccccuccgcaacgaggaggagguccgcgucaagaucaaggaccucaacgagcacaucgucugcugccucugcgccggcuacuucgucgacgccaccaccaucaccgagugccuccacaccuucugcaaguccugcaucgucaaguaccuccagaccuccaaguacugccccaugugcaacaucaagauccacgagacccagccccuccucaaccucaagcucgaccgcgucaugcaggacaucgucuacaagcucguccccggccuccaggacuccgaggagaagcgcauccgcgaguucuaccagucccgcggccucgaccgcgucacccagcccaccggcgaggagcccgcccucuccaaccucggccuccccuucuccuccuucgaccacuccaaggcccacuacuaccgcuacgacgagcagcucaaccucugccucgagcgccucuccuccggcaaggacaagaacaaguccguccuccagaacaaguacguccgcugcuccguccgcgccgagguccgccaccuccgccgcguccucugccaccgccucaugcucaacccccagcacguccagcuccucuucgacaacgagguccuccccgaccacaugaccaugaagcagaucuggcucucccgcugguucggcaagcccuccccccuccuccuccaguacuccgucaaggagaagcgccgcuga

SEQ ID NO: 47375 - RNA, 1035 nt, Artificial Sequence
  derived and/or modified sequence opt2 from PCGF2__Homo_sapiens__XP_005257698
augcaccgcaccacccgcaucaagaucaccgagcucaacccccaccucaugugcgcccucugcggcggcuacuucaucgacgccaccaccaucgucgagugccuccacuccuucugcaagaccugcaucguccgcuaccucgagaccaacaaguacugccccaugugcgacguccagguccacaagacccgcccccuccucuccauccgcuccgacaagacccuccaggacaucgucuacaagcucguccccggccucuucaaggacgagaugaagcgccgccgcgacuucuacgccgccuacccccucaccgagguccccaacggcuccaacgaggaccgcggcgagguccucgagcaggagaagggcgcccucuccgacgacgagaucgucucccucuccaucgaguucuacgagggcgcccgcgaccgcgacgagaagaagggcccccucgagaacggcgacggcgacaaggagaagaccggcguccgcuuccuccgcugccccgccgccaugaccgucaugcaccucgccaaguuccuccgcaacaagauggacguccccuccaaguacaaggucgagguccucuacgaggacgagccccucaaggaguacuacacccucauggacaucgccuacaucuaccccuggcgccgcaacggcccccucccccucaaguaccgcguccagcccgccugcaagcgccucacccucgccaccguccccacccccuccgagggcaccaacaccuccggcgccuccgagugcgaguccgucuccgacaaggcccccucccccgccacccuccccgccaccuccuccucccuccccucccccgccacccccucccacggcucccccuccucccacggcccccccgccacccaccccaccucccccaccccccccuccaccgccuccggcgccaccaccgccgccaacggcggcucccucaacugccuccagacccccuccuccaccucccgcggccgcaagaugaccgucaacggcgcccccguccccccccucaccuga

SEQ ID NO: 47376 - RNA, 627 nt, Artificial Sequence
  derived and/or modified sequence opt2 from PCGF3__Homo_sapiens__XP_006713915
augaccgucugccgcuccugccucgucaaguaccucgaggagaacaacaccugccccaccugccgcaucgucauccaccagucccacccccuccaguacaucggccacgaccgcaccaugcaggacaucgucuacaagcucguccccggccuccaggaggccgagaugcgcaagcagcgcgaguucuaccacaagcucggcauggagguccccggcgacaucaagggcgagaccugcuccgccaagcagcaccucgacucccaccgcaacggcgagaccaaggccgacgacuccuccaacaaggaggccgccgaggagaagcccgaggaggacaacgacuaccaccgcuccgacgagcaggucuccaucugccucgagugcaacuccuccaagcuccgcggccucaagcgcaaguggauccgcugcuccgcccaggccaccguccuccaccucaagaaguucaucgccaagaagcucaaccucuccuccuucaacgagcucgacauccucugcaacgaggagauccucggcaaggaccacacccucaaguucgucgucgucacccgcuggcgcuucaagaaggccccccuccuccuccacuaccgccccaagauggaccuccucuga

SEQ ID NO: 47377 - RNA, 1053 nt, Artificial Sequence
  derived and/or modified sequence opt2 from PCGF6__Homo_sapiens__NP_001011663
auggagggcgucgccgucgucaccgccggcuccgucggcgccgccaagaccgagggcgccgccgcccuccccccccccccccccgucuccccccccgcccucacccccgcccccgccgccggcgaggagggccccgccccccucuccgagaccggcgcccccggcugcuccggcucccgcccccccgagcucgagcccgagcgcucccucggccgcuuccgcggccgcuucgaggacgaggacgaggagcucgaggaggaggaggagcucgaggaggaggaggaggaggaggaggaggacaugucccacuucucccuccgccucgagggcggccgccaggacuccgaggacgaggaggagcgccucaucaaccucuccgagcucacccccuacauccucugcuccaucugcaagggcuaccucaucgacgccaccaccaucaccgagugccuccacaccuucugcaaguccugcaucguccgccacuucuacuacuccaaccgcugccccaagugcaacaucgucguccaccagacccagccccucuacaacauccgccucgaccgccagcuccaggacaucgucuacaagcucgucaucaaccucgaggagcgcgagaagaagcagaugcacgacuucuacaaggagcgcggccucgagguccccaagcccgccgucccccagcccguccccuccuccaagggccgcuccaagaagguccucgaguccgucuuccgcaucccccccgagcucgacaugucccuccuccucgaguucaucggcgccaacgagggcaccggccacuucaagccccucgagaagaaguucguccgcgucuccggcgaggccaccaucggccacgucgagaaguuccuccgccgcaagaugggccucgaccccgccugccaggucgacaucaucugcggcgaccaccuccucgagcaguaccagacccuccgcgagauccgccgcgccaucggcgacgccgccaugcaggacggccuccucguccuccacuacggccucgucgucuccccccucaagaucaccuga

SEQ ID NO: 47378 - RNA, 3537 nt, Artificial Sequence
  derived and/or modified sequence opt2 from PC__Homo_sapiens__XP_011543388
augcucaaguuccgcaccguccacggcggccuccgccuccucggcauccgccgcaccuccaccgcccccgccgccucccccaacguccgccgccucgaguacaagcccaucaagaaggucauggucgccaaccgcggcgagaucgccauccgcgucuuccgcgccugcaccgagcucggcauccgcaccgucgccaucuacuccgagcaggacaccggccagaugcaccgccagaaggccgacgaggccuaccucaucggccgcggccucgcccccguccaggccuaccuccacauccccgacaucaucaaggucgccaaggagaacaacgucgacgccguccaccccggcuacggcuuccucuccgagcgcgccgacuucgcccaggccugccaggacgccggcguccgcuucaucggccccucccccgaggucguccgcaagaugggcgacaaggucgaggcccgcgccaucgccaucgccgccggcguccccgucguccccggcaccgacgcccccaucaccucccuccacgaggcccacgaguucuccaacaccuacggcuuccccaucaucuucaaggccgccuacggcggcggcggccgcggcaugcgcgucguccacuccuacgaggagcucgaggagaacuacacccgcgccuacuccgaggcccucgccgccuucggcaacggcgcccucuucgucgagaaguucaucgagaagccccgccacaucgagguccagauccucggcgaccaguacggcaacauccuccaccucuacgagcgcgacugcuccauccagcgccgccaccagaaggucgucgagaucgcccccgccgcccaccucgacccccagcuccgcacccgccucaccuccgacuccgucaagcucgccaagcaggucggcuacgagaacgccggcaccgucgaguuccucgucgaccgccacggcaagcacuacuucaucgaggucaacucccgccuccaggucgagcacaccgucaccgaggagaucaccgacgucgaccucguccacgcccagauccacgucgccgagggccgcucccuccccgaccucggccuccgccaggagaacauccgcaucaacggcugcgccauccagugccgcgucaccaccgaggaccccgcccgcuccuuccagcccgacaccggccgcaucgaggucuuccgcuccggcgagggcaugggcauccgccucgacaacgccuccgccuuccagggcgccgucaucuccccccacuacgacucccuccucgucaaggucaucgcccacggcaaggaccaccccaccgccgccaccaagaugucccgcgcccucgccgaguuccgcguccgcggcgucaagaccaacaucgccuuccuccagaacguccucaacaaccagcaguuccucgccggcaccgucgacacccaguucaucgacgagaaccccgagcucuuccagcuccgccccgcccagaaccgcgcccagaagcuccuccacuaccucggccacgucauggucaacggccccaccacccccauccccgucaaggccucccccucccccaccgaccccgucguccccgccguccccaucggccccccccccgccggcuuccgcgacauccuccuccgcgagggccccgagggcuucgcccgcgccguccgcaaccaccccggccuccuccucauggacaccaccuuccgcgacgcccaccagucccuccucgccacccgcguccgcacccacgaccucaagaagaucgcccccuacgucgcccacaacuucuccaagcucuucuccauggagaacuggggcggcgccaccuucgacgucgccaugcgcuuccucuacgagugccccuggcgccgccuccaggagcuccgcgagcucauccccaacauccccuuccagaugcuccuccgcggcgccaacgccgucggcuacaccaacuaccccgacaacgucgucuucaaguucugcgaggucgccaaggagaacggcauggacgucuuccgcgucuucgacucccucaacuaccuccccaacaugcuccucggcauggaggccgccggcuccgccggcggcgucgucgaggccgccaucuccuacaccggcgacgucgccgaccccucccgcaccaaguacucccuccaguacuacaugggccucgccgaggagcucguccgcgccggcacccacauccucugcaucaaggacauggccggccuccucaagcccaccgccugcaccaugcucgucuccucccuccgcgaccgcuuccccgaccucccccuccacauccacacccacgacaccuccggcgccggcgucgccgccaugcucgccugcgcccaggccggcgccgacgucgucgacgucgccgccgacuccauguccggcaugaccucccagcccuccaugggcgcccucgucgccugcacccgcggcaccccccucgacaccgagguccccauggagcgcgucuucgacuacuccgaguacugggagggcgcccgcggccucuacgccgccuucgacugcaccgccaccaugaaguccggcaacuccgacgucuacgagaacgagauccccggcggccaguacaccaaccuccacuuccaggcccacuccaugggccucggcuccaaguucaaggaggucaagaaggccuacgucgaggccaaccagaugcucggcgaccucaucaaggucacccccuccuccaagaucgucggcgaccucgcccaguucaugguccagaacggccucucccgcgccgaggccgaggcccaggccgaggagcucuccuucccccgcuccgucgucgaguuccuccagggcuacaucggcgucccccacggcggcuuccccgagcccuuccgcuccaagguccucaaggaccucccccgcgucgagggccgccccggcgccucccuccccccccucgaccuccaggcccucgagaaggagcucgucgaccgccacggcgaggaggucacccccgaggacguccucuccgccgccauguaccccgacgucuucgcccacuucaaggacuucaccgccaccuucggcccccucgacucccucaacacccgccucuuccuccagggccccaagaucgccgaggaguucgaggucgagcucgagcgcggcaagacccuccacaucaaggcccucgccgucuccgaccucaaccgcgccggccagcgccaggucuucuucgagcucaacggccagcuccgcuccauccucgucaaggacacccaggccaugaaggagaugcacuuccaccccaaggcccucaaggacgucaagggccagaucggcgcccccaugcccggcaaggucaucgacaucaaggucgucgccggcgccaaggucgccaagggccagccccucugcguccucuccgccaugaagauggagaccgucgucaccucccccauggagggcaccguccgcaagguccacgucaccaaggacaugacccucgagggcgacgaccucauccucgagaucgaguga

SEQ ID NO: 47379 - RNA, 1200 nt, Artificial Sequence
  derived and/or modified sequence opt2 from PCID2__Homo_sapiens__NP_001120675
auggcccacaucaccaucaaccaguaccuccagcaggucuacgaggccaucgacucccgcgacggcgccuccugcgccgagcucgucuccuucaagcacccccacgucgccaacccccgccuccagauggccucccccgaggagaagugccagcagguccucgagccccccuacgacgagauguucgccgcccaccuccgcugcaccuacgccgucggcaaccacgacuucaucgaggccuacaagugccagaccgucaucguccaguccuuccuccgcgccuuccaggcccacaaggaggagaacugggcccuccccgucauguacgccgucgcccucgaccuccgcgucuucgccaacaacgccgaccagcagcucgucaagaagggcaaguccaaggucggcgacaugcucgagaaggccgccgagcuccucauguccugcuuccgcgucugcgccuccgacacccgcgccggcaucgaggacuccaagaaguggggcaugcucuuccucgucaaccagcucuucaagaucuacuucaagaucaacaagcuccaccucugcaagccccucauccgcgccaucgacuccuccaaccucaaggacgacuacuccaccgcccagcgcgucaccuacaaguacuacgucggccgcaaggccauguucgacuccgacuucaagcaggccgaggaguaccucuccuucgccuucgagcacugccaccgcuccucccagaagaacaagcgcaugauccucaucuaccuccuccccgucaagaugcuccucggccacaugcccaccgucgagcuccucaagaaguaccaccucaugcaguucgccgaggucacccgcgccgucuccgagggcaaccuccuccuccuccacgaggcccucgccaagcacgaggccuucuucauccgcugcggcaucuuccucauccucgagaagcucaagaucaucaccuaccgcaaccucuucaagaaggucuaccuccuccucaagacccaccagcucucccucgacgccuuccucgucgcccucaaguucaugcaggucgaggacgucgacaucgacgagguccagugcauccucgccaaccucaucuacaugggccacgucaagggcuacaucucccaccagcaccagaagcucgucgucuccaagcagaaccccuuccccccccucuccaccgucugcuga

SEQ ID NO: 47380 - RNA, 1869 nt, Artificial Sequence
  derived and/or modified sequence opt2 from PCK1__Homo_sapiens__NP_002582
augcccccccagcuccagaacggccucaaccucuccgccaaggucguccagggcucccucgacucccucccccaggccguccgcgaguuccucgagaacaacgccgagcucugccagcccgaccacauccacaucugcgacggcuccgaggaggagaacggccgccuccucggccagauggaggaggagggcauccuccgccgccucaagaaguacgacaacugcuggcucgcccucaccgacccccgcgacgucgcccgcaucgaguccaagaccgucaucgucacccaggagcagcgcgacaccguccccauccccaagaccggccucucccagcucggccgcuggauguccgaggaggacuucgagaaggccuucaacgcccgcuuccccggcugcaugaagggccgcaccauguacgucauccccuucuccaugggcccccucggcuccccccucuccaagaucggcaucgagcucaccgacucccccuacgucgucgccuccaugcgcaucaugacccgcaugggcacccccguccucgaggccgucggcgacggcgaguucgucaagugccuccacuccgucggcugcccccucccccuccagaagccccucgucaacaacuggcccugcaaccccgagcucacccucaucgcccaccuccccgaccgccgcgagaucaucuccuucggcuccggcuacggcggcaacucccuccucggcaagaagugcuucgcccuccgcauggccucccgccucgccaaggaggagggcuggcucgccgagcacaugcucauccucggcaucaccaaccccgagggcgagaagaaguaccucgccgccgccuuccccuccgccugcggcaagaccaaccucgccaugaugaaccccucccuccccggcuggaaggucgagugcgucggcgacgacaucgccuggaugaaguucgacgcccagggccaccuccgcgccaucaaccccgagaacggcuucuucggcgucgcccccggcaccuccgucaagaccaaccccaacgccaucaagaccauccagaagaacaccaucuucaccaacgucgccgagaccuccgacggcggcgucuacugggagggcaucgacgagccccucgccuccggcgucaccaucaccuccuggaagaacaaggagugguccuccgaggacggcgagcccugcgcccaccccaacucccgcuucugcacccccgccucccagugccccaucaucgacgccgccugggagucccccgagggcguccccaucgagggcaucaucuucggcggccgccgccccgccggcgucccccucgucuacgaggcccucuccuggcagcacggcgucuucgucggcgccgccaugcgcuccgaggccaccgccgccgccgagcacaagggcaagaucaucaugcacgaccccuucgccaugcgccccuucuucggcuacaacuucggcaaguaccucgcccacuggcucuccauggcccagcaccccgccgccaagcuccccaagaucuuccacgucaacugguuccgcaaggacaaggagggcaaguuccucuggcccggcuucggcgagaacucccgcguccucgaguggauguucaaccgcaucgacggcaaggccuccaccaagcucacccccaucggcuacauccccaaggaggacgcccucaaccucaagggccucggccacaucaacaugauggagcucuucuccaucuccaaggaguucugggagaaggaggucgaggacaucgagaaguaccucgaggaccaggucaacgccgaccuccccugcgagaucgagcgcgagauccucgcccucaagcagcgcaucucccagauguga

SEQ ID NO: 47381 - RNA, 1326 nt, Artificial Sequence
  derived and/or modified sequence opt2 from PCK2__Homo_sapiens__NP_001018083
auggccgcccucuaccgccccggccuccgccucaacuggcacggccucuccccccucggcuggcccuccugccgcuccauccagacccuccgcguccucuccggcgaccucggccagcuccccaccggcauccgcgacuucgucgagcacuccgcccgccucugccagcccgagggcauccacaucugcgacggcaccgaggccgagaacaccgccacccucacccuccucgagcagcagggccucauccgcaagcuccccaaguacaacaacugcuggcucgcccgcaccgaccccaaggacgucgcccgcgucgaguccaagaccgucaucgucacccccucccagcgcgacaccgucccccucccccccggcggcgcccgcggccagcucggcaacuggaugucccccgccgacuuccagcgcgccgucgacgagcgcuuccccggcugcaugcagggccgcaccauguacguccuccccuucuccaugggccccgucggcuccccccucucccgcaucggcguccagcucaccgacuccgccuacgucgucgccuccaugcgcaucaugacccgccucggcacccccguccuccaggcccucggcgacggcgacuucgucaagugccuccacuccgucggccagccccucaccggccagggcgagcccgucucccaguggcccugcaaccccgagaagacccucaucggccacguccccgaccagcgcgagaucaucuccuucggcuccggcuacggcggcaacucccuccucggcaagaagugcuucgcccuccgcaucgccucccgccucgcccgcgacgagggcuggcucgccgagcacaugcucauccucggcaucaccucccccgccggcaagaagcgcuacgucgccgccgccuuccccuccgccugcggcaagaccaaccucgccaugaugcgccccgcccuccccggcuggaaggucgagugcgucggcgacgacaucgccuggaugcgcuucgacuccgagggccgccuccgcgccaucaaccccgagaacggcuucuucggcgucgcccccggcaccuccgccaccaccaaccccaacgccauggccaccauccaguccaacaccaucuucaccaacgucgccgagaccuccgacggcggcgucuacugggagggcaucgaccagccccucccccccggcgucaccgucaccuccuggcucggcaagcccuggaagcccggcaugugcggcggcgagggcgucgcccagccccccggccucuccacccucauggucgagaagcucuccccccagccccccaccaucuucuga

SEQ ID NO: 47382 - RNA, 14808 nt, Artificial Sequence
  derived and/or modified sequence opt2 from PCLO__Homo_sapiens__NP_055325
augggcaacgaggccucccucgagggcgagggccuccccgagggccucgccgccgccgccgccgccggcggcggcgccuccggcgccggcucccccucccacaccgccauccccgccggcauggaggccgaccucucccagcucuccgaggaggagcgccgccagaucgccgccgucaugucccgcgcccagggccuccccaagggcuccgucccccccgccgccgccgagucccccuccaugcaccgcaagcaggagcucgacuccucccacccccccaagcaguccggccgcccccccgaccccggccgccccgcccagcccggccucuccaagucccgcaccaccgacaccuuccgcuccgagcagaagcuccccggccgcucccccuccaccaucucccucaaggaguccaagucccgcaccgaccucaaggaggagcacaaguccuccaugaugcccggcuuccucuccgaggucaacgcccucuccgccgucuccuccgucgucaacaaguucaaccccuucgaccucaucuccgacuccgaggccucccaggaggagaccaccaagaagcagaaggucguccagaaggagcagggcaagcccgagggcaucaucaagcccccccuccagcagcagccccccaagcccauccccaagcagcagggccccggccgcgacccccuccagcaggacggcacccccaaguccaucuccucccagcagcccgagaagaucaagucccagccccccggcaccggcaagcccauccagggccccacccagaccccccagaccgaccacgccaagcucccccuccagcgcgacgccucccgcccccagaccaagcaggccgacaucguccgcggcgaguccgucaagcccucccuccccucccccuccaagccccccauccagcagcccacccccggcaagccccccgcccagcagcccggccacgagaagucccagcccggccccgccaagccccccgcccagcccuccggccucaccaagccccucgcccagcagcccggcaccgucaagccccccguccagccccccggcaccaccaagccccccgcccagccccucggccccgccaagccccccgcccagcagaccggcuccgagaagcccuccuccgagcagcccggccccaaggcccucgcccagccccccggcgucggcaagacccccgcccagcagcccggccccgccaagccccccacccagcaggucggcacccccaagccccucgcccagcagcccggccuccagucccccgccaaggcccccggccccaccaagacccccguccagcagcccggccccggcaagauccccgcccagcaggccggccccggcaagaccuccgcccagcagaccggccccaccaagccccccucccagcuccccggccccgccaagccccccccccagcagcccggccccgccaagccccccccccagcagcccggcuccgccaagccccccucccagcagcccggcuccaccaagccccccccccagcagcccggccccgccaagcccuccccccagcagcccggcuccaccaagccccccucccagcagcccggcuccgccaagcccuccgcccagcagcccucccccgccaagcccuccgcccagcaguccaccaagcccgucucccagaccggcuccggcaagccccuccagccccccaccgucucccccuccgccaagcagccccccucccagggccuccccaagaccaucugcccccucugcaacaccaccgagcuccuccuccacguccccgagaaggccaacuucaacaccugcaccgagugccagaccaccgucugcucccucugcggcuucaaccccaacccccaccucaccgaggucaaggaguggcucugccucaacugccagaugaagcgcgcccucggcggcgaccucgcccccguccccuccuccccccagcccaagcucaagaccgcccccgucaccaccaccuccgccgucuccaaguccuccccccagccccagcagaccucccccaagaaggacgccgcccccaagcaggaccucuccaaggcccccgagcccaagaagccccccccccucgucaagcagcccacccuccacggcucccccuccgccaaggccaagcagccccccgaggccgacucccucuccaagcccgccccccccaaggagcccuccguccccuccgagcaggacaaggcccccgucgccgacgacaagcccaagcagcccaagauggucaagcccaccaccgaccucgucuccuccuccuccgccaccaccaagcccgacauccccuccuccaagguccagucccaggccgaggagaagaccacccccccccucaagaccgacuccgccaagcccucccaguccuucccccccaccggcgagaaggucucccccuucgacuccaaggccaucccccgccccgccuccgacuccaagaucaucucccaccccggccccuccuccgaguccaagggccagaagcaggucgaccccguccagaagaaggaggagcccaagaaggcccagaccaagaugucccccaagcccgacgccaagcccaugcccaagggcucccccaccccccccggcccccgccccaccgccggccagaccguccccaccccccagcagucccccaagccccaggagcagucccgccgcuucucccucaaccucggcuccaucaccgacgcccccaagucccagcccaccaccccccaggagaccgucaccggcaagcucuucggcuucggcgccuccaucuucucccaggccuccaaccucaucuccaccgccggccagcccggcccccacucccaguccggccccggcgcccccaugaagcaggcccccgcccccucccagccccccaccucccagggcccccccaaguccaccggccaggccccccccgcccccgccaaguccauccccgucaagaaggagaccaaggcccccgccgccgagaagcucgagcccaaggccgagcaggcccccaccgucaagcgcaccgagaccgagaagaagcccccccccaucaaggacuccaagucccucaccgccgagccccagaaggccguccuccccaccaagcucgagaagucccccaagcccgaguccaccugcccccucugcaagaccgagcucaacaucggcuccaaggacccccccaacuucaacaccugcaccgagugcaagaaccaggucugcaaccucugcggcuucaaccccaccccccaccucaccgagauccaggaguggcucugccucaacugccagacccagcgcgccaucuccggccagcucggcgacauccgcaagaugccccccgcccccuccggccccaaggccucccccaugcccguccccaccgaguccuccucccagaagaccgccguccccccccaggucaagcucgucaagaagcaggagcaggaggucaagaccgaggccgagaaggucauccucgagaaggucaaggagacccucuccauggagaagaucccccccauggucaccaccgaccagaagcaggaggaguccaagcucgagaaggacaaggccuccgcccuccaggagaagaagccccuccccgaggagaagaagcucauccccgaggaggagaagauccgcuccgaggagaagaagccccuccucgaggagaagaagcccacccccgaggacaagaagcuccuccccgaggccaagaccuccgcccccgaggagcagaagcacgaccuccucaagucccagguccagaucgccgaggagaagcucgagggccgcgucgcccccaagaccguccaggagggcaagcagccccagaccaagauggagggccuccccuccggcaccccccagucccuccccaaggaggacgacaagaccaccaagaccaucaaggagcagccccagccccccugcaccgccaagcccgaccaggucgagcccggcaaggagaagaccgagaaggaggacgacaaguccgacaccuccuccucccagcagcccaaguccccccagggccucuccgacaccggcuacuccuccgacggcaucuccuccucccucggcgagauccccucccucauccccaccgacgagaaggacauccucaagggccucaagaaggacuccuucucccaggaguccucccccuccucccccuccgaccucgccaagcucgaguccaccguccucuccauccucgaggcccaggccuccacccucgccgacgagaaguccgagaagaagacccagccccacgaggucucccccgagcagcccaaggaccaggagaagacccagucccucuccgagacccucgagaucaccaucuccgaggaggagaucaaggagucccaggaggagcgcaaggacaccuucaagaaggacucccagcaggacauccccuccuccaaggaccacaaggagaaguccgaguucgucgacgacaucaccacccgccgcgagcccuacgacuccgucgaggaguccuccgaguccgagaacucccccgucccccagcgcaagcgccgcaccuccgucggcuccuccuccuccgacgaguacaagcaggaggacucccagggcuccggcgaggaggaggacuucauccgcaagcagaucaucgagauguccgccgacgaggacgccuccggcuccgaggacgacgaguucauccgcaaccagcucaaggagaucuccuccuccaccgagucccagaagaaggaggagaccaagggcaagggcaagaucaccgccggcaagcaccgccgccucacccgcaaguccuccaccuccaucgacgaggacgccggccgccgccacuccuggcacgacgaggacgacgaggccuucgacgagucccccgagcucaaguaccgcgagaccaagucccaggaguccgaggagcucgucgucaccggcggcggcggccuccgccgcuucaagaccaucgagcucaacuccaccaucgccgacaaguacuccgccgaguccucccagaagaagaccucccucuacuucgacgaggagcccgagcucgagauggagucccucaccgacucccccgaggaccgcucccgcggcgagggcuccuccucccuccacgccuccuccuucacccccggcaccucccccaccuccgucuccucccucgacgaggacuccgacuccucccccucccacaagaagggcgaguccaagcagcagcgcaaggcccgccaccgcccccacggcccccuccuccccaccaucgaggacuccuccgaggaggaggagcuccgcgaggaggaggagcuccucaaggagcaggagaagcagcgcgagaucgagcagcagcagcgcaaguccuccuccaagaaguccaagaaggacaaggacgagcuccgcgcccagcgccgccgcgagcgccccaagaccccccccuccaaccucucccccaucgaggacgccucccccaccgaggagcuccgccaggccgccgagauggaggagcuccaccgcuccuccugcuccgaguacucccccuccaucgaguccgaccccgagggcuucgagaucucccccgagaagaucaucgagguccagaaggucuacaagcuccccaccgccgucucccucuacucccccaccgacgagcaguccaucaugcagaaggagggcucccagaaggcccucaaguccgccgaggagauguacgaggagaugaugcacaagacccacaaguacaaggccuuccccgccgccaacgagcgcgacgaggucuucgagaaggagccccucuacggcggcaugcucaucgaggacuacaucuacgagucccucgucgaggacaccuacaacggcuccgucgacggcucccuccucacccgccaggaggaggagaacggcuucaugcagcagaagggccgcgagcagaagauccgccucuccgagcagaucuacgaggaccccaugcagaagaucaccgaccuccagaaggaguucuacgagcucgagucccuccacuccgucgucccccaggaggacaucgucuccuccuccuucaucauccccgagucccacgagaucgucgaccucggcaccauggucaccuccaccgaggaggagcgcaagcuccucgacgccgacgccgccuacgaggagcucaugaagcgccagcagaugcagcucacccccggcuccucccccacccaggcccccaucggcgaggacaugaccgaguccaccauggacuucgaccgcaugcccgacgccucccucaccuccuccguccucuccggcgccucccucaccgacuccaccuccuccgccacccucuccauccccgacgucaagaucacccagcacuucuccaccgaggagaucgaggacgaguacgucaccgacuacacccgcgagauccaggagaucaucgcccacgagucccucauccucaccuacuccgagcccuccgaguccgccaccuccgucccccccuccgacacccccucccucaccuccuccgucuccuccgucugcaccaccgacuccuccucccccaucaccacccucgacuccaucaccaccgucuacaccgagcccgucgacaugaucaccaaguucgaggacuccgaggagaucuccuccuccaccuacuuccccggcuccaucaucgacuaccccgaggagaucuccgucucccucgaccgcaccgccccccccgacggccgcgccuccgccgaccacaucgucaucucccucuccgacauggccuccuccaucaucgaguccgucguccccaagcccgagggccccgucgccgacaccgucuccaccgaccuccucaucuccgagaaggaccccgucaagaaggccaagaaggagaccggcaacggcaucauccucgagguccucgaggccuaccgcgacaagaaggagcucgaggccgagcgcaccaaguccucccucuccgagaccgucuucgaccacccccccuccuccgucaucgcccuccccaugaaggagcagcucuccaccaccuacuucaccuccggcgagaccuucggccaggagaagcccgccucccagcuccccuccggcucccccuccgucuccucccuccccgccaagccccgccccuucuuccgcuccuccucccucgacaucuccgcccagcccccccccccccccccccccccccccccccccccccccccccccccccccccccccccccccccccuccccccccccaccucccccaagcccaccauccuccccaagaagaagcucaccgucgccucccccgucaccaccgccaccccccucuucgacgccgucaccacccucgagaccaccgccguccuccgcuccaacggccuccccgucacccgcaucugcaccaccgcccccccccccgucccccccaagcccuccuccauccccuccggccucgucuucacccaccgccccgagcccuccaagccccccaucgcccccaagcccgucaucccccagcuccccaccaccacccagaagcccaccgacauccaccccaagcccaccggccucucccucaccuccuccaugacccucaaccucgucaccuccgccgacuacaagcuccccucccccaccuccccccucuccccccacuccaacaaguccuccccccgcuucuccaagucccucaccgagaccuacgucgucaucacccuccccuccgagcccggcacccccaccgacuccuccgccucccaggccaucaccuccuggccccucggcucccccuccaaggaccucgucuccgucgagcccgucuucuccgucgucccccccgucaccgccgucgagauccccaucuccuccgagcagaccuucuacaucuccggcgcccuccagaccuucuccgccacccccgucaccgcccccuccuccuuccaggccgcccccaccuccgucacccaguuccucaccaccgaggucuccaagaccgaggucuccgccacccgcuccaccgcccccuccgucggccucuccuccaucuccaucaccaucccccccgagccccucgcccucgacaacauccaccucgagaagccccaguacaaggaggacggcaagcuccagcucgucggcgacgucaucgaccuccgcaccguccccaaggucgaggucaagaccaccgacaagugcaucgaccucuccgccuccaccauggacgucaagcgccagaucaccgccaacgaggucuacggcaagcagaucuccgccguccagcccuccaucaucaaccucuccgucaccuccuccaucgucacccccgucucccucgccaccgagaccgucaccuucgucaccugcaccgccuccgccuccuacaccaccggcaccgagucccucgucggcgccgagcacgccaugaccaccccccuccagcucaccaccuccaagcacgccgagccccccuaccgcauccccuccgaccaggucuuccccaucgcccgcgaggaggcccccaucaaccucucccucggcacccccgcccacgccgucacccucgccaucaccaagcccgucaccgucccccccgucggcgucaccaacggcuggaccgacuccaccgucucccagggcaucaccgacggcgaggucgucgaccucuccaccaccaagucccaccgcaccgucgucaccauggacgaguccaccuccuccgucaugaccaagaucaucgaggacgagaagcccgucgaccucaccgccggccgccgcgccgucugcugcgacgucgucuacaagcuccccuucggccgcuccugcaccgcccagcagcccgccaccacccuccccgaggaccgcuucggcuaccgcgacgaccacuaccaguacgaccgcuccggccccuacggcuaccgcggcaucggcggcaugaagcccuccauguccgacaccaaccucgccgaggccggccacuucuucuacaaguccaagaacgccuucgacuacuccgagggcaccgacaccgccgucgaccucaccuccggccgcgucaccaccggcgaggucauggacuacuccuccaagaccaccggccccuaccccgagacccgccaggucaucuccggcgccggcaucuccaccccccaguacuccaccgcccgcaugacccccccccccggcccccaguacugcgucggcuccguccuccgcuccuccaacggcgucgucuacuccuccgucgccacccccacccccuccaccuucgccaucaccacccagcccggcuccaucuucuccaccaccguccgcgaccucuccggcauccacaccgccgacgccgucaccucccuccccgccaugcaccacucccagcccaugccccgcuccuacuucaucaccaccggcgccuccgagaccgacaucgccgucaccggcaucgacaucuccgccucccuccagaccaucaccauggagucccucaccgccgagaccaucgacuccguccccacccucaccaccgccuccgaggucuuccccgaggucgucggcgacgaguccgcccuccucaucguccccgaggaggacaagcagcagcagcagcucgaccucgagcgcgagcuccucgagcucgagaagaucaagcagcagcgcuucgccgaggagcucgagugggagcgccaggagauccagcgcuuccgcgagcaggagaagaucaugguccagaagaagcucgaggagcuccaguccaugaagcagcaccuccucuuccagcaggaggaggagcgccaggcccaguucaugaugcgccaggagacccucgcccagcagcagcuccagcucgagcagauccagcagcuccagcagcagcuccaccagcagcucgaggagcagaagauccgccagaucuaccaguacaacuacgaccccuccggcaccgccuccccccagaccaccaccgagcaggccauccucgagggccaguacgccgcccucgagggcucccaguucugggccaccgaggacgccaccaccaccgccuccgccgucgucgccaucgagaucccccagucccagggcugguacaccguccaguccgacggcgucacccaguacaucgccccccccggcauccucuccaccgucuccgagaucccccucaccgacgucgucgucaaggaggagaagcagcccaagaagcgcuccuccggcgccaagguccgcggccaguacgacgacaugggcgagaacaugaccgacgacccccgcuccuucaagaagaucgucgacuccggcguccagaccgacgacgaggacgccaccgaccgcuccuacgucucccgccgccgccgcaccaagaaguccgucgacaccuccguccagaccgacgacgaggaccaggacgagugggacaugcccacccgcucccgccgcaaggcccgcgucggcaaguacggcgacuccaugaccgaggccgacaagaccaagccccucuccaaggucuccuccaucgccguccagaccgucgccgagaucuccguccagaccgagcccgucggcaccauccgcacccccuccauccgcgcccgcgucgacgccaaggucgagaucaucaagcacaucuccgcccccgagaagaccuacaagggcggcucccucggcugccagaccgaggccgacuccgacacccaguccccccaguaccucuccgccaccuccccccccaaggacaagaagcgccccaccccccucgagaucggcuacuccucccaccuccgcgccgacuccaccguccagcucgcccccuccccccccaagucccccaagguccucuacucccccaucuccccccucucccccggcaaggcccucgaguccgccuucguccccuacgagaagccccuccccgacgacaucuccccccagaagguccuccaccccgacauggccaaggucccccccgccucccccaagaccgccaagaugaugcagcgcuccauguccgaccccaagccccucucccccaccgccgacgaguccucccgcgcccccuuccaguacaccgagggcuacaccaccaagggcucccagaccaugaccuccuccggcgcccagaagaaggucaagcgcacccuccccaaccccccccccgaggagaucuccaccggcacccaguccaccuucuccaccaugggcaccgucucccgccgccgcaucugccgcaccaacaccauggcccgcgccaagauccuccaggacaucgaccgcgagcucgaccucgucgagcgcgaguccgccaagcuccgcaagaagcaggccgagcucgacgaggaggagaaggagaucgacgccaagcuccgcuaccucgagaugggcaucaaccgccgcaaggaggcccuccucaaggagcgcgagaagcgcgagcgcgccuaccuccagggcgucgccgaggaccgcgacuacauguccgacuccgaggucuccuccacccgccccacccgcaucgagucccagcacggcaucgagcgcccccgcaccgccccccagaccgaguucucccaguucauccccccccagacccagaccgagucccagcucgucccccccaccucccccuacacccaguaccaguacuccucccccgcccuccccacccaggcccccaccuccuacacccagcagucccacuucgagcagcagacccucuaccaccagcaggucucccccuaccagacccagcccaccuuccaggccgucgccaccauguccuucaccccccagguccagcccacccccaccccccagcccuccuaccagcuccccucccagaugauggucauccagcagaagccccgccagaccacccucuaccucgagcccaagaucaccuccaacuacgaggucauccgcaaccagccccucaugaucgcccccgucuccaccgacaacaccuucgccgucucccaccucggcuccaaguacaacucccucgaccuccgcaucggccucgaggagcgcuccuccauggccuccucccccaucuccuccaucuccgccgacuccuucuacgccgacaucgaccaccacaccccccgcaacuacguccucaucgacgacaucggcgagaucaccaagggcaccgccgcccucuccaccgccuucucccuccacgagaaggaccucuccaagaccgaccgccuccuccgcaccaccgagacccgccgcucccaggaggucaccgacuuccucgccccccuccaguccuccucccgccuccacuccuacgucaaggccgaggaggaccccauggaggaccccuacgagcucaagcuccucaagcaccagaucaagcaggaguuccgccgcggcaccgagucccucgaccaccucgccggccucucccacuacuaccacgccgacaccuccuaccgccacuuccccaaguccgagaaguacuccaucucccgccucacccucgagaagcaggccgccaagcagcuccccgccgccauccucuaccagaagcaguccaagcacaagaagucccucaucgaccccaagauguccaaguucucccccauccaggagucccgcgaccucgagcccgacuacuccuccuacaugaccuccuccaccuccuccaucggcggcaucuccucccgcgcccgccuccuccaggacgacaucaccuucggccuccgcaagaacaucaccgaccagcagaaguucaugggcuccucccucggcaccggccucggcacccucggcaacaccauccgcuccgcccuccaggacgaggccgacaagcccuacuccuccggcucccgcucccgccccuccucccgccccuccuccgucuacggccucgaccucuccaucaagcgcgacuccuccuccuccucccuccgccucaaggcccaggaggccgaggcccucgacgucuccuucucccacgccuccuccuccgcccgcaccaagcccaccucccuccccaucucccagucccgcggccgcauccccaucgucgcccagaacuccgaggaggaguccccccucucccccgucggccagcccaugggcauggcccgcgccgccgccggcccccucccccccaucuccgccgacacccgcgaccaguucggcuccucccacucccuccccgagguccagcagcacaugcgcgaggagucccgcacccgcggcuacgaccgcgacaucgccuucaucauggacgacuuccagcacgccauguccgacuccgaggccuaccaccuccgccgcgaggagaccgacugguucgacaagccccgcgagucccgccucgagaacggccacggccucgaccgcaagcuccccgagcgccucguccacucccgcccccucucccagcaccaggagcagaucauccagaugaacggcaagaccaugcacuacaucuucccccacgcccgcaucaagaucacccgcgacuccaaggaccacaccgucuccggcaacggccucggcauccgcaucgucggcggcaaggagauccccggccacuccggcgagaucggcgccuacaucgccaagauccuccccggcggcuccgccgagcagaccggcaagcucauggagggcaugcagguccucgaguggaacggcaucccccucaccuccaagaccuacgaggagguccaguccaucaucucccagcaguccggcgaggccgagaucugcguccgccucgaccucaacaugcucuccgacuccgagaacucccagcaccucgagcuccacgagccccccaaggccgucgacaaggccaagucccccggcgucgaccccaagcagcucgccgccgagcuccagaaggucucccuccagcaguccccccucguccucuccuccgucgucgagaagggcucccacguccacuccggccccaccuccgccggcuccuccuccguccccucccccggccagcccggcucccccuccgucuccaagaagaagcacggcuccuccaagcccaccgacggcaccaaggucgucucccaccccaucaccggcgagauccagcuccagaucaacuacgaccucggcaaccucaucauccacauccuccaggcccgcaaccucgucccccgcgacaacaacggcuacuccgaccccuucgucaaggucuaccuccuccccggccgcggccaggucauggucguccagaacgccuccgccgaguacaagcgccgcaccaagcacguccagaagucccucaaccccgaguggaaccagaccgucaucuacaaguccaucuccauggagcagcucaagaagaagacccucgaggucaccgucugggacuacgaccgcuucuccuccaacgacuuccucggcgagguccucaucgaccucuccuccaccucccaccucgacaacaccccccgcugguacccccucaaggagcagaccgaguccaucgaccacggcaagucccacuccucccaguccucccagcagucccccaagcccuccgucaucaagucccgcucccacggcaucuuccccgaccccuccaaggacaugcagguccccaccaucgagaagucccacuccucccccggcuccuccaaguccuccuccgagggccaccuccgcucccacggccccucccgcucccaguccaagaccuccgucacccagacccaccucgaggacgccggcgccgccaucgccgccgccgaggccgccguccagcagcuccgcauccagcccuccaagcgccgcaaguga

SEQ ID NO: 47383 - RNA, 6075 nt, Artificial Sequence
  derived and/or modified sequence opt2 from PCM1__Homo_sapiens__NP_006188
auggccaccggcggcggccccuucgaggacggcaugaacgaccaggaccuccccaacugguccaacgagaacgucgacgaccgccucaacaacauggacuggggcgcccagcagaagaaggccaaccgcuccuccgagaagaacaagaagaaguucggcgucgaguccgacaagcgcgucaccaacgacaucucccccgaguccucccccggcgucggccgccgccgcaccaagaccccccacaccuucccccacucccgcuacaugucccagauguccguccccgagcaggccgagcucgagaagcucaagcagcgcaucaacuucuccgaccucgaccagcgcuccaucggcuccgacucccagggccgcgccaccgccgccaacaacaagcgccagcucuccgagaaccgcaagcccuucaacuuccuccccaugcagaucaacaccaacaaguccaaggacgccuccaccuccccccccaaccgcgagaccaucggcuccgcccagugcaaggagcucuucgccuccgcccucuccaacgaccuccuccagaacugccaggucuccgaggaggacggccgcggcgagcccgccauggaguccucccagaucgucucccgccucguccagauccgcgacuacaucaccaaggccuccuccaugcgcgaggaccucgucgagaagaacgagcgcuccgccaacgucgagcgccucacccaccucaucgaccaccucaaggagcaggagaaguccuacaugaaguuccucaagaagauccucgcccgcgacccccagcaggagcccauggaggagaucgagaaccucaagaagcagcacgaccuccucaagcgcaugcuccagcagcaggagcagcuccgcgcccuccagggccgccaggccgcccuccucgcccuccagcacaaggccgagcaggccaucgccgucauggacgacuccgucgucgccgagaccgccggcucccucuccggcgucuccaucaccuccgagcucaacgaggagcucaacgaccucauccagcgcuuccacaaccagcuccgcgacucccagccccccgccguccccgacaaccgccgccaggccgagucccucucccucacccgcgaggucucccagucccgcaagcccuccgccuccgagcgccuccccgacgagaaggucgagcucuucuccaagaugcgcguccuccaggagaagaagcagaagauggacaagcuccucggcgagcuccacacccuccgcgaccagcaccucaacaacuccuccuccuccccccagcgcuccgucgaccagcgcuccaccuccgcccccuccgccuccgucggccucgcccccgucgucaacggcgaguccaacucccucaccuccuccguccccuaccccaccgccucccucgucucccagaacgaguccgagaacgagggccaccucaaccccuccgagaagcuccagaagcucaacgagguccgcaagcgccucaacgagcuccgcgagcucguccacuacuacgagcagaccuccgacaugaugaccgacgccgucaacgagaaccgcaaggacgaggagaccgaggaguccgaguacgacuccgagcacgagaacuccgagcccgucaccaacauccgcaacccccaggucgccuccaccuggaacgaggucaacucccacuccaacgcccagugcgucuccaacaaccgcgacggccgcaccgucaacuccaacugcgagaucaacaaccgcuccgccgccaacauccgcgcccucaacaugccccccucccucgacugccgcuacaaccgcgagggcgagcaggagauccacgucgcccagggcgaggacgacgaggaggaggaggaggaggccgaggaggagggcgucuccggcgccucccucuccucccaccgcuccucccucgucgacgagcaccccgaggacgccgaguucgagcagaagaucaaccgccucauggccgccaagcagaagcuccgccagcuccaggaccucgucgccaugguccaggacgacgacgccgcccagggcgucaucuccgccuccgccuccaaccucgacgacuucuaccccgccgaggaggacaccaagcagaacuccaacaacacccgcggcaacgccaacaagacccagaaggacaccggcgucaacgagaaggcccgcgagaaguucuacgaggccaagcuccagcagcagcagcgcgagcucaagcagcuccaggaggagcgcaagaagcucaucgacauccaggagaagauccaggcccuccagaccgccugccccgaccuccagcucuccgccgccuccgucggcaacugccccaccaagaaguacaugcccgccgucaccuccacccccaccgucaaccagcacgagaccuccaccuccaaguccgucuucgagcccgaggacuccuccaucgucgacaacgagcucugguccgagaugcgccgccacgagaugcuccgcgaggagcuccgccagcgccgcaagcagcucgaggcccucauggccgagcaccagcgccgccagggccucgccgagaccgccucccccgucgccgucucccuccgcuccgacggcuccgagaaccucugcaccccccagcagucccgcaccgagaagaccauggccaccuggggcggcuccacccagugcgcccucgacgaggagggcgacgaggacggcuaccucuccgagggcaucguccgcaccgacgaggaggaggaggaggagcaggacgccuccuccaacgacaacuucuccgucugccccuccaacuccgucaaccacaacuccuacaacggcaaggagaccaagaaccgcuggaagaacaacugccccuucuccgccgacgagaacuaccgcccccucgccaagacccgccagcagaacaucuccaugcagcgccaggagaaccuccgcugggucuccgagcucuccuacgucgaggagaaggagcaguggcaggagcagaucaaccagcucaagaagcagcucgacuucuccgucuccaucugccagacccucaugcaggaccagcagacccucuccugccuccuccagacccuccucaccggccccuacuccgucaugcccuccaacgucgccuccccccagguccacuucaucaugcaccagcucaaccagugcuacacccagcucaccuggcagcagaacaacguccagcgccucaagcagaugcucaacgagcucaugcgccagcagaaccagcaccccgagaagcccggcggcaaggagcgcggcuccuccgccucccacccccccucccccucccucuucugccccuucuccuuccccacccagcccgucaaccucuucaacauccccggcuucaccaacuucuccuccuucgcccccggcaugaacuucuccccccucuuccccuccaacuucggcgacuucucccagaacaucuccacccccuccgagcagcagcagccccucgcccagaacuccuccggcaagaccgaguacauggccuuccccaagcccuucgaguccuccuccuccaucggcgccgagaagccccgcaacaagaagcuccccgaggaggaggucgaguccucccgcacccccuggcucuacgagcaggagggcgaggucgagaagcccuucaucaagaccggcuucuccgucuccgucgagaaguccaccuccuccaaccgcaagaaccagcucgacaccaacggccgccgccgccaguucgacgaggagucccucgaguccuucuccuccaugcccgaccccgucgaccccaccaccgucaccaagaccuucaagacccgcaaggccuccgcccaggccucccucgccuccaaggacaagacccccaaguccaaguccaagaagcgcaacuccacccagcucaagucccgcgucaagaacauccgcuacgaguccgccuccauguccuccaccugcgagcccugcaagucccgcaaccgccacuccgcccagaccgaggagcccguccaggccaaggucuucucccgcaagaaccacgagcagcucgagaagaucaucaagugcaaccgcuccaccgagaucuccuccgagaccggcuccgacuucuccauguucgaggcccuccgcgacaccaucuacuccgaggucgccacccucaucucccagaacgagucccgcccccacuuccucaucgagcucuuccacgagcuccagcuccucaacaccgacuaccuccgccagcgcgcccucuacgcccuccaggacaucgucucccgccacaucuccgagucccacgagaagggcgagaacgucaaguccgucaacuccggcaccuggaucgccuccaacuccgagcucacccccuccgagucccucgccaccaccgacgacgagaccuucgagaagaacuucgagcgcgagacccacaagaucuccgagcagaacgacgccgacaacgccuccguccucuccgucuccuccaacuucgagcccuucgccaccgacgaccucggcaacaccgucauccaccucgaccaggcccucgcccgcaugcgcgaguacgagcgcaugaagaccgaggccgaguccaacuccaacaugcgcugcaccugccgcaucaucgaggacggcgacggcgccggcgccggcaccaccgucaacaaccucgaggagacccccgucaucgagaaccgcuccucccagcagcccgucuccgaggucuccaccauccccugcccccgcaucgacacccagcagcucgaccgccagaucaaggccaucaugaaggaggucauccccuuccucaaggagcacauggacgaggucugcuccucccagcuccucaccuccguccgccgcaugguccucacccucacccagcagaacgacgaguccaaggaguucgucaaguucuuccacaagcagcucggcuccauccuccaggacucccucgccaaguucgccggccgcaagcucaaggacugcggcgaggaccuccucgucgagaucuccgagguccucuucaacgagcucgccuucuucaagcucaugcaggaccucgacaacaacuccaucaccgucaagcagcgcugcaagcgcaagaucgaggccaccggcgucauccaguccugcgccaaggaggccaagcgcauccucgaggaccacggcucccccgccggcgagaucgacgacgaggacaaggacaaggacgagaccgagaccgucaagcagacccagaccuccgaggucuacgacggccccaagaacguccgcuccgacaucuccgaccaggaggaggacgaggaguccgagggcugccccgucuccaucaaccucuccaaggccgagacccaggcccucaccaacuacggcuccggcgaggacgagaacgaggacgaggagauggaggaguucgaggagggccccgucgacguccagaccucccuccaggccaacaccgaggccaccgaggagaacgagcacgacgagcagguccuccagcgcgacuucaagaagaccgccgaguccaagaacgucccccucgagcgcgaggccaccuccaagaacgaccagaacaacugccccgucaagcccugcuaccucaacauccucgaggacgagcagccccucaacuccgccgcccacaaggaguccccccccaccgucgacuccacccagcagcccaacccccucccccuccgccuccccgagauggagccccucgucccccgcgucaaggaggucaaguccgcccaggagacccccgaguccucccucgccggcucccccgacaccgagucccccguccucgucaacgacuacgaggccgaguccggcaacaucucccagaaguccgacgaggaggacuucgucaaggucgaggaccucccccucaagcucaccaucuacuccgaggccgaccuccgcaagaagauggucgaggaggagcagaagaaccaccucuccggcgagaucugcgagaugcagaccgaggagcucgccggcaacuccgagacccucaaggagcccgagaccgucggcgcccaguccaucuga

SEQ ID NO: 47384 - RNA, 861 nt, Artificial Sequence
  derived and/or modified sequence opt2 from PCMT1__Homo_sapiens__NP_001238978
augcccggcgcccgcuccggcggcuccggcggcgacggcuccaacuccggcuccuacuccggcgacgccuccggcgccgucaccgucugggaggucgucucccuccucggcaagcuccucggcaccgucgucgcccucaaggucguccucuaccuccuccgcgucugccucgccauggccuggaaguccggcggcgccucccacuccgagcucauccacaaccuccgcaagaacggcaucaucaagaccgacaaggucuucgaggucaugcucgccaccgaccgcucccacuacgccaagugcaaccccuacauggacuccccccaguccaucggcuuccaggccaccaucuccgccccccacaugcacgccuacgcccucgagcuccucuucgaccagcuccacgagggcgccaaggcccucgacgucggcuccggcuccggcauccucaccgccugcuucgcccgcauggucggcugcaccggcaaggucaucggcaucgaccacaucaaggagcucgucgacgacuccgucaacaacguccgcaaggacgaccccacccuccucuccuccggccgcguccagcucgucgucggcgacggccgcaugggcuacgccgaggaggcccccuacgacgccauccacgucggcgccgccgcccccgucgucccccaggcccucaucgaccagcucaagcccggcggccgccucauccuccccgucggccccgccggcggcaaccagaugcucgagcaguacgacaagcuccaggacggcuccaucaagaugaagccccucaugggcgucaucuacgucccccucaccgacaaggagaagcaguggucccgcgacgagcucuga

SEQ ID NO: 47385 - RNA, 846 nt, Artificial Sequence
  derived and/or modified sequence opt2 from PCMTD1__Homo_sapiens__NP_001273711
augcccggcccccgccgccuccgcucccccggcggcuccggcugcuccucccgcggcuccggcccccgccucuccacccgccgcuggcgccccugcugcuacugcggcggcuccggcgucuggcuccuccgcaccccccccucccccuccgccuggcccgcccgccgcugcccccgccaccgcuucgaguucugcgagcccgccuucgucgucggcaacugccuccagaucgccuccgacucccaccaguacgaccgcaucuacugcggcgccggcguccagaaggaccacgagaacuacaugaagauccuccucaaggucggcggcauccucgucaugcccaucgaggaccagcucacccagaucaugcgcaccggccagaacaccugggaguccaagaacauccucgccgucuccuucgccccccucguccagcccuccaagaacgacaacggcaagcccgacuccgucggccucccccccugcgccguccgcaaccuccaggaccucgcccgcaucuacauccgccgcacccuccgcaacuucaucaacgacgagaugcaggccaagggcaucccccagcgcgccccccccaagcgcaagcgcaagcgcgucaagcagcgcaucaacaccuacgucuucgucggcaaccagcucaucccccagccccucgacuccgaggaggacgagaagauggaggaggacaacaaggaggaggaggagaaggaccacaacgaggccaugaagcccgaggagcccccccagaaccuccuccgcgagaagaucaugaagcucccccuccccgagucccucaaggccuaccucaccuacuuccgcgacaaguga

SEQ ID NO: 47386 - RNA, 786 nt, Artificial Sequence
  derived and/or modified sequence opt2 from PCNA__Homo_sapiens__NP_872590
auguucgaggcccgccucguccagggcuccauccucaagaagguccucgaggcccucaaggaccucaucaacgaggccugcugggacaucuccuccuccggcgucaaccuccaguccauggacuccucccacgucucccucguccagcucacccuccgcuccgagggcuucgacaccuaccgcugcgaccgcaaccucgccaugggcgucaaccucaccuccauguccaagauccucaagugcgccggcaacgaggacaucaucacccuccgcgccgaggacaacgccgacacccucgcccucgucuucgaggcccccaaccaggagaaggucuccgacuacgagaugaagcucauggaccucgacgucgagcagcucggcauccccgagcaggaguacuccugcgucgucaagaugcccuccggcgaguucgcccgcaucugccgcgaccucucccacaucggcgacgccgucgucaucuccugcgccaaggacggcgucaaguucuccgccuccggcgagcucggcaacggcaacaucaagcucucccagaccuccaacgucgacaaggaggaggaggccgucaccaucgagaugaacgagcccguccagcucaccuucgcccuccgcuaccucaacuucuucaccaaggccaccccccucuccuccaccgucacccucuccauguccgccgacgucccccucgucgucgaguacaagaucgccgacaugggccaccucaaguacuaccucgcccccaagaucgaggacgaggagggcuccuga

SEQ ID NO: 47387 - RNA, 10011 nt, Artificial Sequence
  derived and/or modified sequence opt2 from PCNT__Homo_sapiens__NP_006022
auggaggucgagcaggagcagcgccgccgcaaggucgaggccggccgcaccaagcucgcccacuuccgccagcgcaagaccaagggcgacuccucccacuccgagaagaagaccgccaagcgcaagggcuccgccgucgacgccuccguccaggaggagucccccgucaccaaggaggacuccgcccucugcggcggcggcgacaucugcaaguccaccuccugcgacgacacccccgacggcgccggcggcgccuucgccgcccagcccgaggacugcgacggcgagaagcgcgaggaccucgagcagcuccagcagaagcaggucaacgaccacccccccgagcagugcggcauguucaccgucuccgaccacccccccgagcagcacggcauguucaccgucggcgaccacccccccgagcagcgcggcauguucaccgucuccgaccacccccccgagcagcacggcauguucaccgucuccgaccacccccccgagcagcgcggcauguucaccaucuccgaccaccagcccgagcagcgcggcauguucaccgucuccgaccacacccccgagcagcgcggcaucuucaccaucuccgaccaccccgccgagcagcgcggcauguucaccaaggagugcgagcaggagugcgagcucgccaucaccgaccucgaguccggccgcgaggacgaggccggccuccaccagucccaggccguccacggccucgagcucgaggcccuccgccucucccucuccaacaugcacaccgcccagcucgagcucacccaggccaaccuccagaaggagaaggagaccgcccucaccgagcuccgcgagaugcucaacucccgccgcgcccaggagcucgcccuccuccagucccgccagcagcacgagcucgagcuccuccgcgagcagcacgcccgcgagaaggaggaggucguccuccgcugcggccaggaggccgccgagcucaaggagaagcuccaguccgagauggagaagaacgcccagaucgucaagacccucaaggaggacugggaguccgagaaggaccucugccucgagaaccuccgcaaggagcucuccgccaagcaccaguccgagauggaggaccuccagaaccaguuccagaaggagcucgccgagcagcgcgccgagcucgagaagaucuuccaggacaagaaccaggccgagcgcgcccuccgcaaccucgagucccaccaccaggccgccaucgagaagcuccgcgaggaccuccaguccgagcacggccgcugccucgaggaccucgaguucaaguucaaggaguccgagaaggagaagcagcucgagcucgagaaccuccaggccuccuacgaggaccucaaggcccagucccaggaggagauccgccgccucuggucccagcucgacuccgcccgcaccucccgccaggagcucuccgagcuccacgagcagcuccucgcccgcaccucccgcgucgaggaccucgagcagcucaagcagcgcgagaagacccagcacgaguccgagcucgagcagcuccgcaucuacuucgagaagaagcuccgcgacgccgagaagaccuaccaggaggaccucacccuccuccagcagcgccuccagggcgcccgcgaggacgcccuccucgacuccgucgaggucggccucuccugcgucggccucgaggagaagcccgagaagggccgcaaggaccacgucgacgagcucgagcccgagcgccacaaggagucccucccccgcuuccaggccgagcucgaggagucccaccgccaccagcucgaggcccucgaguccccccucugcauccagcacgagggccacgucuccgaccgcugcugcgucgagaccuccgcccucggccacgaguggcgccucgagcccuccgagggccacucccaggagcuccccuggguccaccuccagggcguccaggacggcgaccucgaggccgacaccgagcgcgccgcccgcguccucggccucgagaccgagcacaagguccagcucucccuccuccagaccgagcucaaggaggagaucgagcuccucaagaucgagaaccgcaaccucuacggcaagcuccagcacgagacccgccucaaggacgaccucgagaaggucaagcacaaccucaucgaggaccaccagaaggagcucaacaacgccaagcagaagaccgagcucaugaagcaggaguuccagcgcaaggagaccgacuggaaggucaugaaggaggagcuccagcgcgaggccgaggagaagcucacccucaugcuccucgagcuccgcgagaaggccgaguccgagaagcagaccaucaucaacaaguucgagcuccgcgaggccgagaugcgccagcuccaggaccagcaggccgcccagauccucgaccucgagcgcucccucaccgagcagcagggccgccuccagcagcucgagcaggaccucaccuccgacgacgcccuccacugcucccagugcggccgcgagccccccaccgcccaggacggcgagcucgccgcccuccacgucaaggaggacugcgcccuccagcucaugcucgcccgcucccgcuuccucgaggagcgcaaggagaucaccgagaaguucuccgccgagcaggacgccuuccuccaggaggcccaggagcagcacgcccgcgagcuccagcuccuccaggagcgccaccagcagcagcuccucuccgucaccgccgagcucgaggcccgccaccaggccgcccucggcgagcucaccgccucccucgaguccaagcagggcgcccuccucgccgcccgcgucgccgagcuccagaccaagcacgccgccgaccucggcgcccucgagacccgccaccucuccucccucgacucccucgaguccugcuaccucuccgaguuccagaccauccgcgaggagcaccgccaggcccucgagcuccuccgcgccgacuucgaggagcagcucuggaagaaggacucccuccaccagaccauccucacccaggagcucgagaagcucaagcgcaagcacgagggcgagcuccaguccguccgcgaccaccuccgcaccgaggucuccaccgagcucgccggcaccgucgcccacgagcuccagggcguccaccagggcgaguucggcuccgagaagaagaccgcccuccacgagaaggaggagacccuccgccuccaguccgcccaggcccagcccuuccaccaggaggagaaggagucccucucccuccagcuccagaagaagaaccaccagguccagcagcucaaggaccagguccucucccucucccacgagaucgaggagugccgcuccgagcucgagguccuccagcagcgccgcgagcgcgagaaccgcgagggcgccaaccuccucuccaugcucaaggccgacgucaaccucucccacuccgagcgcggcgcccuccaggacgcccuccgccgccuccucggccucuucggcgagacccuccgcgccgccgucacccuccgcucccgcaucggcgagcgcgucggccucugccucgacgacgccggcgccggccucgcccucuccaccgcccccgcccucgaggagaccugguccgacgucgcccuccccgagcucgaccgcacccucuccgagugcgccgagauguccuccgucgccgagaucuccucccacaugcgcgaguccuuccucaugucccccgaguccguccgcgagugcgagcagcccauccgccgcgucuuccagucccucucccucgccgucgacggccucauggagauggcccucgacuccucccgccagcucgaggaggcccgccagauccacucccgcuucgagaaggaguucuccuucaagaacgaggagaccgcccaggucguccgcaagcaccaggagcuccucgagugccucaaggaggaguccgccgccaaggccgagcucgcccucgagcuccacaagacccagggcacccucgagggcuucaaggucgagaccgccgaccucaaggagguccucgccggcaaggaggacuccgagcaccgccucguccucgagcucgagucccuccgccgccagcuccagcaggccgcccaggagcaggccgcccuccgcgaggagugcacccgccucuggucccgcggcgaggccaccgccaccgacgccgaggcccgcgaggccgcccuccgcaaggaggucgaggaccucaccaaggagcaguccgagacccgcaagcaggccgagaaggaccgcuccgcccuccucucccagaugaagauccucgaguccgagcucgaggagcagcucucccagcaccgcggcugcgccaagcaggccgaggccgucaccgcccucgagcagcaggucgccucccucgacaagcaccuccgcaaccagcgccaguucauggacgagcaggccgccgagcgcgagcacgagcgcgaggaguuccagcaggagauccagcgccucgagggccagcuccgccaggccgccaagccccagcccuggggcccccgcgacucccagcaggccccccucgacggcgaggucgagcuccuccagcagaagcuccgcgagaagcucgacgaguucaacgagcucgccauccagaaggaguccgccgaccgccagguccucaugcaggaggaggagaucaagcgccucgaggagaugaacaucaacauccgcaagaaggucgcccagcuccaggaggaggucgagaagcagaagaacaucgucaagggccucgagcaggacaaggagguccucaagaagcagcagauguccucccuccuccucgccuccacccuccaguccacccucgacgccggccgcugccccgagccccccuccggcuccccccccgagggccccgagauccagcucgaggucacccagcgcgcccuccuccgccgcgaguccgagguccucgaccucaaggagcagcucgagaagaugaagggcgaccucgaguccaagaacgaggagauccuccaccucaaccucaagcucgacaugcagaacucccagaccgccgucucccuccgcgagcucgaggaggagaacaccucccucaaggucaucuacacccgcuccuccgagaucgaggagcucaaggccaccaucgagaaccuccaggagaaccagaagcgccuccagaaggagaaggccgaggagaucgagcagcuccacgaggucaucgagaagcuccagcacgagcucucccucaugggccccgucguccacgaggucuccgacucccaggccggcucccuccaguccgagcuccucugcucccaggccggcggcccccgcggccaggcccuccagggcgagcucgaggccgcccucgaggccaaggaggcccucucccgccuccucgccgaccaggagcgccgccacucccaggcccucgaggcccuccagcagcgccuccagggcgccgaggaggccgccgagcuccagcucgccgagcucgagcgcaacgucgcccuccgcgaggccgaggucgaggacauggccucccgcauccaggaguucgaggccgcccucaaggccaaggaggccaccaucgccgagcgcaaccucgagaucgacgcccucaaccagcgcaaggccgcccacuccgccgagcucgaggccguccuccucgcccucgcccgcauccgccgcgcccucgagcagcagccccucgccgccggcgccgccccccccgagcuccaguggcuccgcgcccagugcgcccgccucucccgccagcuccagguccuccaccagcgcuuccuccgcugccaggucgagcucgaccgccgccaggcccgccgcgccaccgcccacacccgcguccccggcgcccacccccagccccgcauggacggcggcgccaaggcccaggucaccggcgacgucgaggccucccacgacgccgcccucgagcccgucguccccgacccccagggcgaccuccagcccguccucgucacccucaaggacgccccccucugcaagcaggagggcgucauguccguccucaccgucugccagcgccagcuccaguccgagcuccuccucgucaagaacgagaugcgccucucccucgaggacggcggcaagggcaaggagaagguccucgaggacugccagcuccccaaggucgaccucgucgcccaggucaagcagcuccaggagaagcucaaccgccuccucuacuccaugaccuuccagaacgucgacgccgccgacaccaagucccucuggcccauggccuccgcccaccuccucgaguccuccugguccgacgacuccugcgacggcgaggagcccgacaucuccccccacaucgacaccugcgacgccaacaccgccaccggcggcgucaccgacgucaucaagaaccaggccaucgacgccugcgacgccaacaccacccccggcggcgucaccgacgucaucaagaacugggacucccucauccccgacgagaugcccgacucccccauccaggagaaguccgagugccaggacaugucccucuccucccccaccuccguccucggcggcucccgccaccagucccacaccgccgaggccggcccccgcaagucccccgucggcaugcucgaccucuccuccugguccucccccgagguccuccgcaaggacuggacccucgagcccuggcccucccuccccgucaccccccacuccggcgcccucucccucugcuccgccgacaccucccucggcgaccgcgccgacaccucccucccccagacccagggccccggccuccucugcucccccggcgucuccgccgccgcccucgcccuccagugggccgaguccccccccgccgacgaccaccacguccagcgcaccgccgucgagaaggacgucgaggacuucaucaccaccuccuucgacucccaggagacccucuccucccccccccccggccucgagggcaaggccgaccgcuccgagaaguccgacggcuccggcuucggcgcccgccucucccccggcuccggcggccccgaggcccagaccgccggccccgucacccccgccuccaucuccggccgcuuccagccccuccccgaggccaugaaggagaaggagguccgccccaagcacgucaaggcccuccuccagaugguccgcgacgagucccaccagauccucgcccucuccgagggccucgccccccccuccggcgagccccaccccccccgcaaggaggacgagauccaggacaucucccuccacggcggcaagacccaggagguccccaccgccugccccgacuggcgcggcgaccuccuccaggucguccaggaggccuucgagaaggagcaggagaugcagggcgucgagcuccagccccgccucuccggcuccgaccucggcggccacuccucccuccucgagcgccucgagaagaucauccgcgagcagggcgaccuccaggagaagucccucgagcaccuccgccuccccgaccgcuccucccuccucuccgagauccaggcccuccgcgcccagcuccgcaugacccaccuccagaaccaggagaagcuccagcaccuccgcaccgcccucaccuccgccgaggcccgcggcucccagcaggagcaccagcuccgccgccaggucgagcuccucgccuacaaggucgagcaggagaagugcaucgccggcgaccuccagaagacccucuccgaggagcaggagaaggccaacuccguccagaagcuccucgccgccgagcagaccgucguccgcgaccucaaguccgaccucugcgagucccgccagaaguccgagcagcucucccgcucccucugcgagguccagcaggagguccuccagcuccgcuccaugcucuccuccaaggagaacgagcucaaggccgcccuccaggagcucgaguccgagcagggcaagggccgcgcccuccagucccagcucgaggaggagcagcuccgccaccuccagcgcgagucccaguccgccaaggcccucgaggagcuccgcgccucccucgagacccagcgcgcccaguccucccgccucugcgucgcccucaagcacgagcagaccgccaaggacaaccuccagaaggagcuccgcaucgagcacucccgcugcgaggcccuccucgcccaggagcgcucccagcucuccgagcuccagaaggaccucgccgccgagaagucccgcacccucgagcucuccgaggcccuccgccacgagcgccuccucaccgagcagcucucccagcgcacccaggaggccugcguccaccaggacacccaggcccaccacgcccuccuccagaagcucaaggaggagaagucccgcgucgucgaccuccaggccaugcucgagaagguccagcagcaggcccuccacucccagcagcagcucgaggccgaggcccagaagcacugcgaggcccuccgccgcgagaaggaggucuccgccacccucaaguccaccgucgaggcccuccacacccagaagcgcgagcuccgcugcucccucgagcgcgagcgcgagaagcccgccuggcuccaggccgagcucgagcagucccacccccgccucaaggagcaggagggccgcaaggccgcccgccgcuccgccgaggcccgccagucccccgccgccgccgagcaguggcgcaaguggcagcgcgacaaggagaagcuccgcgagcucgagcuccagcgccagcgcgaccuccacaagaucaagcagcuccagcagaccguccgcgaccucgaguccaaggacgagguccccggcucccgccuccaccucggcuccgcccgccgcgccgccggcuccgacgccgaccaccuccgcgagcagcagcgcgagcucgaggccaugcgccagcgccuccucuccgccgcccgccuccucaccuccuucaccucccaggccgucgaccgcaccgucaacgacuggaccuccuccaacgagaaggccgucaugucccuccuccacacccucgaggagcucaaguccgaccucucccgccccaccuccucccagaagaagauggccgccgagcuccaguuccaguucgucgacguccuccucaaggacaacgucucccucaccaaggcccucuccaccgucacccaggagaagcucgagcucucccgcgccgucuccaagcucgagaagcuccucaagcaccaccuccagaagggcugcucccccucccgcuccgagcgcuccgccuggaagcccgacgagaccgccccccaguccucccuccgccgccccgaccccggccgccucccccccgccgccuccgaggaggcccacaccuccaacgucaagauggagaagcucuaccuccacuaccuccgcgccgaguccuuccgcaaggcccucaucuaccagaagaaguaccuccuccuccucaucggcggcuuccaggacuccgagcaggagacccucuccaugaucgcccaccucggcgucuuccccuccaaggccgagcgcaagaucaccucccgccccuucacccgcuuccgcaccgccguccgcgucgucaucgccauccuccgccuccgcuuccucgucaagaaguggcaggaggucgaccgcaagggcgcccucgcccagggcaaggccccccgccccggcccccgcgcccgccagccccagucccccccccgcacccgcgaguccccccccacccgcgacguccccuccggccacacccgcgaccccgcccgcggccgccgccucgccgccgccgccuccccccacuccggcggccgcgccacccccucccccaacucccgccucgagcgcucccucaccgccucccaggaccccgagcacucccucaccgaguacauccaccaccucgaggucauccagcagcgccucggcggcguccuccccgacuccaccuccaagaaguccugccaccccaugaucaagcaguga

SEQ ID NO: 47388 - RNA, 6414 nt, Artificial Sequence
  derived and/or modified sequence opt2 from PCNXL2__Homo_sapiens__NP_055616
auggucucccagguccuccagcuccuccgccagggcgucugggccgcccucaccggcggcugguaccacgaccccgagcaguccaaguucaccaacuccugccaccucuaccucuggcucuuccuccuccuccucccccucgcccuccaccucgccuucccccccaacgccaucaucgucuucuucuacugcuccgccgucaccaucuucuucaccaucaucaagcucgucuccuaccgccuccaccucauguucgacaagggcgaggucauccagcagaagcccucccgcaaggaggagaagcccaacaaggacaaggaggccaagggcgagcacaucaccaaccaccgcaaccccuccaacaaccgccagauccacaacggcaagaaggaggaggccucccgcaaccucuccacccccccccuccgcugcuccucccgcggccaguccaucaccucccaccacuccuccggcccccucgagcucuccgcccaggagaccgucgaggaccucaagggcgucauccuccucgaggaccaccccaucgcccccgucuccuccaccucccccggcaucaaggucgagucccuccccgccucccaggcccacaugcucgagaccaccaccaaguccgucauccccgucaagcccgucgccaccgagacccucaucaacggcaagggcaaggagcgcggcggcaagggccagcccccccuccgccaccgcuccgagggcggccucgucgacaagggcccccucaagaagcucccccaccucucccucucccaguacgaccuccucgagaccgacgucuccuuccagcccuggggcuccgagaacuccguccucauccccgagcccgucuccugcccccgcggcuccauccgcgagcgcguccaguccaaguccccccaggacucccucuccuccuccugcccccagugcgacaccaucgucgccaagcccgucgaggagcccgccgacaccuccugccaggucgacaccuccugccagggcgaccucccccuccaccaggaggucgacuccuccgacuccgaggucgccgucacccucaucgacaccucccagcccggcgacccccucucccuccacgagcccaucaagaucgucaucaccauguccuccacccccaacuccaugaccgaccucgaguccucccuccaccuccgcgucgucggcaccgagaagaccuccgucaaguccgacgccgagcccaccaaccccggcgccgccggcucccccaacgccgagcagaucuccauccccgucaucacccucgaccuccccgagggcggcggcggcggcguccccugccccgagggcaacggcuccgagcgcacccccgagcgccucaagacccgcgucuccaccaaccagugcuccggcuacggcuccggcgagggcggcaacgccaucaaggaccacuccuccuccucccgcgagcccugggaguccgucucccgccucacccccgacaccggcuccgaguccaaggucggcaaggagggccagaccaaccucgaccccuccuccugcaaguccucccacgagaagcgccacgcccgcguccucuccgucgacuccggcaccgacgucuuccucuccaaguccuccgccgagaucgucaacgacaccgagaagaccaugcccaccuccaaguccgaccucgaggccaaggagggccagaugcccaacgaguccaacuuccucgaguucgucucccuccucgaguccaucaacaccuccaagaugaccgccuccucccagcucaacggcuccgccgagcagaacgaggaguccggccuccuccgcgacaacugcucccaggagaagaaggaggagauccucgagaacgagaagcccuccggccacuccuccaagcagggcaagcccgaccuccagucccaggaccacaccuccaccggccccgccugcacccagcccgccaagaccaccgccuucuuccagggcaaccgccagcgccagaucaucuaccgcgucaccucccagcaggacuccuccguccuccaggucaucuccggccccgagaccuccguccaggaggagaucuccgucgacgccaugcacgucuucaucgacgagcacggcgagauccgcuccugcuaccucaaguccggcaaccagaaggagggcccccuccagccccuccccuccaacaacgacugccucucccaggcccgcgagaugcaggucuccuccuccuccaccaccaccuccgagucccaggaccccuccuccggcgaccccgccgucuccgcccuccagcagcagcuccuccucauggucgcccgccgcacccaguccgagaccccccgccacgucucccaggaccucgaggccuccuccugcuccuccacccagggcaaguucaaccgcgagcaguucuacaaguucaucaucuuccccggcaaguggaucaaggucugguacgaccgccucacccuccucgcccuccucgaccgcaccgaggacaucaaggagaacguccucgccauccuccucaucguccucgucucccuccucggcuuccucacccucucccagggcuucugcaaggacauguggguccuccucuucugccucgucauggccuccugccaguacucccuccucaaguccguccagcccgaccccgccucccccauccacggccacaaccagaucaucaccuacucccgccccaucuacuucugcguccucugcggccucauccuccuccucgacaccggcgccaaggcccgccacccccccuccuacgucgucuacggccucaagcucuucucccccgucuuccuccaguccgcccgcgacuaccucaucgucuuccucuacugcuuccccgccaucucccuccucggccucuucccccagaucaacaccuucugcaccuaccuccucgagcagaucgacaugcucuucuucggcggcuccgccgucuccggcaucaccuccgccgucuacuccgucgcccgcuccguccucgccgccgcccuccuccacgccgucugcuucuccgccgucaaggagcccugguccaugcagcacauccccgcccucuucuccgccuucugcggccuccucgucgcccucuccuaccaccucucccgccaguccuccgaccccuccguccucauguccuucauccagugccgccucuuccccaaguuccuccaccagaaccucgccgaguccgccgccgacccccuccccaagaagaugaaggacuccgucaccgacguccucaagugggaccucaucgucugcgccgucgucgccguccucuccuucgccgucuccgccuccaccgucuuccucucccuccgccccuuccucuccaucguccucuucgcccucgccggcgccgucggcuucgucacccacuacguccucccccagcuccgcaagcaccaccccuggauguggaucucccaccccauccucaagaacaaggaguaccaccagcgcgagguccgcgacgucgcccaccucaugugguucgagcgccucuacgucuggcuccagugcuucgagaaguacauccucuaccccgcccucauccucaacgcccucaccaucgacgccuuccucaucuccaaccaccgccgccucggcacccacugggacaucuuccucaugaucaucgccggcaugaagcuccuccgcaccuccuucugcaaccccgucuaccaguucaucaaccucuccuucaccgucaucuucuuccacuucgacuacaaggacaucuccgaguccuuccuccucgacuucuucauggucuccauccucuucuccaagcucggcgaccuccuccacaagcuccaguucguccucaccuacgucgcccccuggcagauggccuggggcuccuccuuccacgucuucgcccagcucuucgccaucccccacuccgccaugcucuucuuccagaccaucgccaccuccaucuucuccaccccccucucccccuuccucggcuccgucaucuucaucaccuccuacguccgccccgucaaguucugggagaagaacuacaacacccgccgcgucgacaacuccaacacccgccucgccguccagaucgagcgcgaccccggcaacgacgacaacaaccucaacuccaucuucuacgagcaccucacccgcacccuccaggagucccucugcggcgaccucguccucggccgcuggggcaacuacuccuccggcgacugcuucauccucgccuccgacgaccucaacgccuucguccaccucaucgagaucggcaacggccucgucaccuuccagcuccgcggccucgaguuccgcggcaccuacugccagcagcgcgaggucgaggccaucauggagggcgacgaggaggaccgcggcugcugcugcugcaagcccggccaccucccccaccuccucuccugcaacgccgccuuccaccuccgcuggcucaccugggagaucacccagacccaguacauccucgagggcuacuccauccucgacaacaacgccgccaccaugcuccaggucuucgaccuccgccgcauccucauccgcuacuacaucaaguccaucaucuacuacauggucaccucccccaagcuccucuccuggaucaagaacgagucccuccucaagucccuccagcccuucgccaaguggcacuacaucgagcgcgaccucgccauguucaacaucaacaucgacgacgacuacguccccugccuccagggcaucacccgcgccuccuucugcaacgucuaccucgaguggauccagcacugcgcccgcaagcgccaggagcccuccaccacccucgacuccgacgaggacuccccccucgucacccucuccuucgcccucugcacccucggccgccgcgcccucggcaccgccgcccacaacauggccaucucccucgacuccuuccucuacggccuccacguccucuucaagggcgacuuccgcaucaccgcccgcgacgagugggucuucgccgacauggaccuccuccacaaggucgucgcccccgccauccgcaugucccucaagcuccaccaggaccaguucaccugccccgacgaguacgaggaccccgccguccucuacgaggccauccaguccuucgagaagaaggucgucaucugccacgagggcgaccccgccuggcgcggcgccguccucuccaacaaggaggagcuccucacccuccgccacgucgucgacgagggcgccgacgaguacaaggucaucaugcuccaccgcuccuuccucuccuucaaggucaucaaggucaacaaggagugcguccgcggccucugggccggccagcagcaggagcucaucuuccuccgcaaccgcaaccccgagcgcggcuccauccagaacaacaagcagguccuccgcaaccucaucaacuccuccugcgaccagccccucggcuaccccauguacgucuccccccucaccaccuccuaccucggcacccaccgccagcucaagaacaucuggggcggccccaucacccucgaccgcauccgcaccugguucuggaccaaguggguccgcaugcgcaaggacugcaacgcccgccagcacuccggcggcaacaucgaggacgucgacggcggcggcgcccccaccaccggcggcaacaacgcccccuccggcggcucccaggaguccuccgccgagcagccccgcaagggcggcgcccagcacggcgucuccuccugcgagggcacccagcgcaccggccgccgcaagggccgcucccaguccguccaggcccacuccgcccucucccagcgcccccccaugcucuccuccuccggccccauccucgagucccgccagaccuuccuccagaccuccaccuccguccacgagcucgcccagcgccucuccggcucccgccucucccuccacgccuccgccaccucccuccacucccagcccccccccgucaccaccaccggccaccucuccguccgcgagcgcgccgaggcccucauccgcuccucccucggcuccuccaccuccuccacccucuccuuccucuucggcaagcgcuccuucuccuccgcccucgucaucuccggccucuccgccgccgagggcggcaacaccuccgacacccaguccuccuccuccgucaacaucgucaugggccccuccgcccgcgccgccucccaggccacccgccaccucuccgagcccugcgagccccccgacgccaccgagcagggccagcuccacgaccgcugccucgccgaggccgucgccgacacccucggcgucgucugccgccgcgccucccaggaggacaugggccucgacgacaccgccucccagcaguccgucuccgacgagcaguga

SEQ ID NO: 47389 - RNA, 2817 nt, Artificial Sequence
  derived and/or modified sequence opt2 from PCNXL4__Homo_sapiens__NP_071940
augcccgcccucgagcacaugaaccagauccuccacauccucuucgucuuccuccccuuccucugggcccucggcacccuccccccccccgacgcccuccuccucugggccauggagcagguccucgaguucggccucggcggcuccuccauguccacccaccuccgccuccucgucauguucaucauguccgccggcaccgccaucgccuccuacuucauccccuccaccgucggcgucguccucuucaugaccggcuucggcuuccuccucucccucaaccucuccgacaugggccacaagaucggcaccaaguccaaggaccuccccuccggccccgagaagcacuucuccuggaaggagugccucuucuacaucaucauccucguccucgcccuccucgagaccucccuccuccaccacuucgccggcuucucccagaucuccaaguccaacucccaggccaucgucggcuacggccucaugauccuccucaucauccucuggauccuccgcgagauccaguccgucuacaucaucggcaucuuccgcaaccccuucuaccccaaggacguccagaccgucaccgucuucuucgagaagcagacccgccucaugaagaucggcaucguccgccgcauccuccucacccucgucucccccuucgccaugaucgccuuccucucccucgacuccucccuccagggccuccacuccgucuccgucugcaucggcuucacccgcgccuuccgcauggucuggcagaacaccgagaacgcccuccucgagaccgucaucgucuccaccguccaccucaucuccuccaccgacaucugguggaaccgcucccucgacaccggccuccgccuccuccucgucggcaucauccgcgaccgccucauccaguucaucuccaagcuccaguucgccgucaccguccuccucaccuccuggaccgagaagaagcagcgccgcaagaccaccgccacccucugcauccucaacaucgucuucucccccuucguccucgucaucaucgucuucuccacccuccucuccuccccccuccucccccucuucacccuccccgucuuccucgucggcuucccccgccccauccaguccuggcccggcgccgccggcaccaccgccugcgucugcgccgacaccgucuacuacuaccagauggucccccgccucaccgccguccuccagaccgccauggccgccggcucccucggccuccuccuccccggcucccacuaccucggccgcuuccaggaccgccucauguggaucaugauccucgagugcggcuacaccuacugcuccaucaacaucaagggccucgagcuccaggagaccuccugccacaccgccgaggcccgccgcgucgacgaggucuucgaggacgccuucgagcaggaguacacccgcgucugcucccucaacgagcacuucggcaacguccucacccccugcaccguccuccccgucaagcucuacuccgacgcccgcaacguccucuccggcaucaucgacucccacgagaaccucaaggaguucaagggcgaccucaucaagguccucgucuggauccucguccaguacugcuccaagcgccccggcaugaaggagaacguccacaacaccgagaacaagggcaaggccccccucaugcuccccgcccucaacacccuccccccccccaagucccccgaggacaucgacucccucaacuccgagaccuucaacgacugguccgacgacaacaucuucgacgacgagcccaccaucaagaaggucaucgaggagaagcaccagcucaaggaccuccccggcaccaaccucuucauccccggcuccgucgagucccagcgcgucggcgaccacuccaccggcaccguccccgagaacgaccucuacaaggccguccuccucggcuaccccgccgucgacaagggcaagcaggaggacaugcccuacaucccccucauggaguucuccugcucccacucccaccucgucugccuccccgccgaguggcgcaccuccugcaugcccuccuccaagaugaaggagauguccucccucuuccccgaggacugguaccaguucguccuccgccagcucgagugcuaccacuccgaggagaaggccuccaacguccucgaggagaucgccaaggacaagguccucaaggacuucuacguccacaccgucaugaccugcuacuucucccucuucggcaucgacaacauggcccccucccccggccacauccuccgcgucuacggcggcguccuccccugguccgucgcccucgacuggcucaccgagaagcccgagcucuuccagcucgcccucaaggccuuccgcuacacccucaagcucaugaucgacaaggccucccucggccccaucgaggacuuccgcgagcucaucaaguaccucgaggaguacgagcgcgacugguacaucggccucgucuccgacgagaaguggaaggaggccauccuccaggagaagcccuaccucuucucccucggcuacgacuccaacaugggcaucuacaccggccgcguccucucccuccaggagcuccucauccaggucggcaagcucaaccccgaggccguccgcggccagugggccaaccucuccugggagcuccucuacgccaccaacgacgacgaggagcgcuacuccauccaggcccacccccuccuccuccgcaaccucaccguccaggccgccgagcccccccucggcuaccccaucuacuccuccaagccccuccacauccaccucuacuga

SEQ ID NO: 47390 - RNA, 1248 nt, Artificial Sequence
  derived and/or modified sequence opt2 from PCOLCE2__Homo_sapiens__NP_037495
augcgcggcgccaacgccugggccccccucugccuccuccucgccgccgccacccagcucucccgccagcagucccccgagcgccccgucuucaccugcggcggcauccucaccggcgaguccggcuucaucggcuccgagggcuuccccggcgucuacccccccaacuccaagugcaccuggaagaucaccguccccgagggcaaggucgucguccucaacuuccgcuucaucgaccucgaguccgacaaccucugccgcuacgacuucgucgacgucuacaacggccacgccaacggccagcgcaucggccgcuucugcggcaccuuccgccccggcgcccucgucuccuccggcaacaagaugaugguccagaugaucuccgacgccaacaccgccggcaacggcuucauggccauguucuccgccgccgagcccaacgagcgcggcgaccaguacugcggcggccuccucgaccgccccuccggcuccuucaagacccccaacuggcccgaccgcgacuaccccgccggcgucaccugcgucuggcacaucgucgcccccaagaaccagcucaucgagcucaaguucgagaaguucgacgucgagcgcgacaacuacugccgcuacgacuacgucgccgucuucaacggcggcgaggucaacgacgcccgccgcaucggcaaguacugcggcgacuccccccccgcccccaucgucuccgagcgcaacgagcuccucauccaguuccucuccgaccucucccucaccgccgacggcuucaucggccacuacaucuuccgccccaagaagcuccccaccaccaccgagcagcccgucaccaccaccuuccccgucaccaccggccucaagcccaccgucgcccucugccagcagaagugccgccgcaccggcacccucgagggcaacuacugcuccuccgacuucguccucgccggcaccgucaucaccaccaucacccgcgacggcucccuccacgccaccgucuccaucaucaacaucuacaaggagggcaaccucgccauccagcaggccggcaagaacauguccgcccgccucaccgucgucugcaagcagugcccccuccuccgccgcggccucaacuacaucaucaugggccaggucggcgaggacggccgcggcaagaucaugcccaacuccuucaucaugauguucaagaccaagaaccagaagcuccucgacgcccucaagaacaagcagugcuga

SEQ ID NO: 47391 - RNA, 1350 nt, Artificial Sequence
  derived and/or modified sequence opt2 from PCOLCE__Homo_sapiens__NP_002584
augcuccccgccgccaccgccucccuccucggcccccuccucaccgccugcgcccuccuccccuucgcccagggccagacccccaacuacacccgccccgucuuccucugcggcggcgacgucaagggcgaguccggcuacgucgccuccgagggcuuccccaaccucuacccccccaacaaggagugcaucuggaccaucaccguccccgagggccagaccgucucccucuccuuccgcgucuucgaccucgagcuccaccccgccugccgcuacgacgcccucgaggucuucgccggcuccggcaccuccggccagcgccucggccgcuucugcggcaccuuccgccccgccccccucgucgcccccggcaaccaggucacccuccgcaugaccaccgacgagggcaccggcggccgcggcuuccuccucugguacuccggccgcgccaccuccggcaccgagcaccaguucugcggcggccgccucgagaaggcccagggcacccucaccacccccaacuggcccgaguccgacuacccccccggcaucuccugcuccuggcacaucaucgccccccccgaccaggucaucgcccucaccuucgagaaguucgaccucgagcccgacaccuacugccgcuacgacuccgucuccgucuucaacggcgccgucuccgacgacucccgccgccucggcaaguucugcggcgacgccguccccggcuccaucuccuccgagggcaacgagcuccucguccaguucgucuccgaccucuccgucaccgccgacggcuucuccgccuccuacaagacccucccccgcggcaccgccaaggagggccagggccccggccccaagcgcggcaccgagcccaaggucaagcucccccccaagucccagccccccgagaagaccgaggagucccccuccgcccccgacgcccccaccugccccaagcagugccgccgcaccggcacccuccaguccaacuucugcgccuccucccucgucgucaccgccaccgucaaguccaugguccgcgagcccggcgagggccucgccgucaccgucucccucaucggcgccuacaagaccggcggccucgaccuccccuccccccccaccggcgccucccucaaguucuacguccccugcaagcagugcccccccaugaagaagggcgucuccuaccuccucaugggccaggucgaggagaaccgcggccccguccucccccccgaguccuucgucguccuccaccgccccaaccaggaccagauccucaccaaccucuccaagcgcaagugccccucccagcccguccgcgccgccgccucccaggacuga

SEQ ID NO: 47392 - RNA, 411 nt, Artificial Sequence
  derived and/or modified sequence opt2 from PCP2__Homo_sapiens__NP_777555
augauggaccaggaggagaagaccgaggagggcuccggccccugcgccgaggccggcucccccgaccaggagggcuucuucaaccuccucucccacguccagggcgaccgcauggagggccagcgcugcucccuccaggccggccccggccagaccaccaagucccaguccgaccccacccccgagauggacucccucauggacaugcucgccuccacccagggccgccgcauggacgaccagcgcgucaccgucuccucccuccccggcuuccagcccgucggcuccaaggacggcgcccagaagcgcgccggcacccucuccccccagccccuccucaccccccaggaccccaccgcccucggcuuccgccgcaacuccuccccccagccccccacccaggcccccuga

SEQ ID NO: 47393 - RNA, 189 nt, Artificial Sequence
  derived and/or modified sequence opt2 from PCP4__Homo_sapiens__NP_006189
auguccgagcgccagggcgccggcgccaccaacggcaaggacaagaccuccggcgagaacgacggccagaagaagguccaggaggaguucgacaucgacauggacgcccccgagaccgagcgcgccgccgucgccauccagucccaguuccgcaaguuccagaagaagaaggccggcucccaguccuga

SEQ ID NO: 47394 - RNA, 2262 nt, Artificial Sequence
  derived and/or modified sequence opt2 from PCSK1__Homo_sapiens__NP_000430
auggagcgccgcgccuggucccuccagugcaccgccuucguccucuucugcgccuggugcgcccucaacuccgccaaggccaagcgccaguucgucaacgagugggccgccgagauccccggcggccccgaggccgccuccgccaucgccgaggagcucggcuacgaccuccucggccagaucggcucccucgagaaccacuaccucuucaagcacaagaaccacccccgccgcucccgccgcuccgccuuccacaucaccaagcgccucuccgacgacgaccgcgucaucugggccgagcagcaguacgagaaggagcgcuccaagcgcuccgcccuccgcgacuccgcccucaaccucuucaacgaccccauguggaaccagcagugguaccuccaggacacccgcaugaccgccgcccuccccaagcucgaccuccacgucauccccgucuggcagaagggcaucaccggcaagggcgucgucaucaccguccucgacgacggccucgaguggaaccacaccgacaucuacgccaacuacgaccccgaggccuccuacgacuucaacgacaacgaccacgaccccuucccccgcuacgaccccaccaacgagaacaagcacggcacccgcugcgccggcgagaucgccaugcaggccaacaaccacaagugcggcgucggcgucgccuacaacuccaaggucggcggcauccgcaugcucgacggcaucgucaccgacgccaucgaggccuccuccaucggcuucaaccccggccacgucgacaucuacuccgccuccuggggccccaacgacgacggcaagaccgucgagggccccggccgccucgcccagaaggccuucgaguacggcgucaagcagggccgccagggcaagggcuccaucuucgucugggccuccggcaacggcggccgccagggcgacaacugcgacugcgacggcuacaccgacuccaucuacaccaucuccaucuccuccgccucccagcagggccucucccccugguacgccgagaagugcuccuccacccucgccaccuccuacuccuccggcgacuacaccgaccagcgcaucaccuccgccgaccuccacaacgacugcaccgagacccacaccggcaccuccgccuccgccccccucgccgccggcaucuucgcccucgcccucgaggccaaccccaaccucaccuggcgcgacaugcagcaccucgucgucuggaccuccgaguacgacccccucgccaacaaccccggcuggaagaagaacggcgccggccucauggucaacucccgcuucggcuucggccuccucaacgccaaggcccucgucgaccucgccgacccccgcaccuggcgcuccguccccgagaagaaggagugcgucgucaaggacaacgacuucgagccccgcgcccucaaggccaacggcgaggucaucaucgagauccccacccgcgccugcgagggccaggagaacgccaucaagucccucgagcacguccaguucgaggccaccaucgaguacucccgccgcggcgaccuccacgucacccucaccuccgccgccggcaccuccaccguccuccucgccgagcgcgagcgcgacaccucccccaacggcuucaagaacugggacuucauguccguccacaccuggggcgagaaccccaucggcaccuggacccuccgcaucaccgacauguccggccgcauccagaacgagggccgcaucgucaacuggaagcucauccuccacggcaccuccucccagcccgagcacaugaagcagccccgcgucuacaccuccuacaacaccguccagaacgaccgccgcggcgucgagaagauggucgaccccggcgaggagcagcccacccaggagaaccccaaggagaacacccucgucuccaagucccccuccuccuccuccgucggcggccgccgcgacgagcucgaggagggcgcccccucccaggccaugcuccgccuccuccaguccgccuucuccaagaacuccccccccaagcagucccccaagaagucccccuccgccaagcucaacauccccuacgagaacuucuacgaggcccucgagaagcucaacaagcccucccagcucaaggacuccgaggacucccucuacaacgacuacgucgacgucuucuacaacaccaagcccuacaagcaccgcgacgaccgccuccuccaggcccucgucgacauccucaacgaggagaacuga

SEQ ID NO: 47395 - RNA, 783 nt, Artificial Sequence
  derived and/or modified sequence opt2 from PCSK1N__Homo_sapiens__NP_037403
auggccggcuccccccuccucuggggcccccgcgccggcggcgucggccuccucguccuccuccuccucggccucuuccgccccccccccgcccucugcgcccgccccgucaaggagccccgcggccucuccgccgccucccccccccucgccgagaccggcgccccccgccgcuuccgccgcuccgucccccgcggcgaggccgccggcgccguccaggagcucgcccgcgcccucgcccaccuccucgaggccgagcgccaggagcgcgcccgcgccgaggcccaggaggccgaggaccagcaggcccgcguccucgcccagcuccuccgcgucuggggcgccccccgcaacuccgaccccgcccucggccucgacgacgaccccgacgcccccgccgcccagcucgcccgcgcccuccuccgcgcccgccucgaccccgccgcccucgccgcccagcucguccccgcccccguccccgccgccgcccuccgcccccgcccccccgucuacgacgacggccccgccggccccgacgccgaggaggccggcgacgagacccccgacgucgaccccgagcuccuccgcuaccuccucggccgcauccucgccggcuccgccgacuccgagggcgucgccgccccccgccgccuccgccgcgccgccgaccacgacgucggcuccgagcucccccccgagggcguccucggcgcccuccuccgcgucaagcgccucgagacccccgccccccagguccccgcccgccgccuccucccccccuga

SEQ ID NO: 47396 - RNA, 1860 nt, Artificial Sequence
  derived and/or modified sequence opt2 from PCSK2__Homo_sapiens__NP_001188457
auggucuucgccuccgccgagcgccccgucuucaccaaccacuuccucgucgagcuccacaagggcggcgaggacaaggcccgccaggucgccgccgagcacggcuucggcguccgcaagcuccccuucgccgagggccucuaccacuucuaccacaacggccucgccaaggccaagcgccgccgcucccuccaccacaagcagcagcucgagcgcgacccccgcgucaagauggcccuccagcaggagggcuucgaccgcaagaagcgcggcuaccgcgacaucaacgagaucgacaucaacaugaacgacccccucuucaccaagcagugguaccucaucaacaccggccaggccgacggcacccccggccucgaccucaacgucgccgaggccugggagcucggcuacaccggcaagggcgucaccaucggcaucauggacgacggcaucgacuaccuccaccccgaccucgccuccaacuacaacgccgaggccuccuacgacuucuccuccaacgaccccuaccccuacccccgcuacaccgacgacugguucaacucccacggcacccgcugcgccggcgaggucuccgccgccgccaacaacaacaucugcggcgucggcgucgccuacaacuccaaggucgccggcauccgcaugcucgaccagcccuucaugaccgacaucaucgaggccuccuccaucucccacaugccccagcucaucgacaucuacuccgccuccuggggccccaccgacaacggcaagaccgucgacggcccccgcgagcucacccuccaggccauggccgacggcgucaacaagggccgcggcggcaagggcuccaucuacgucugggccuccggcgacggcggcuccuacgacgacugcaacugcgacggcuacgccuccuccauguggaccaucuccaucaacuccgccaucaacgacggccgcaccgcccucuacgacgaguccugcuccuccacccucgccuccaccuucuccaacggccgcaagcgcaaccccgaggccggcgucgccaccaccgaccucuacggcaacugcacccuccgccacuccggcaccuccgccgccgcccccgaggccgccggcgucuucgcccucgcccucgaggccaaccucggccucaccuggcgcgacaugcagcaccucaccguccucaccuccaagcgcaaccagcuccacgacgagguccaccaguggcgccgcaacggcgucggccucgaguucaaccaccucuucggcuacggcguccucgacgccggcgccauggucaagauggccaaggacuggaagaccguccccgagcgcuuccacugcgucggcggcuccguccaggaccccgagaagauccccuccaccggcaagcucguccucacccucaccaccgacgccugcgagggcaaggagaacuucguccgcuaccucgagcacguccaggccgucaucaccgucaacgccacccgccgcggcgaccucaacaucaacaugaccucccccaugggcaccaaguccauccuccucucccgccgcccccgcgacgacgacuccaaggucggcuucgacaaguggcccuucaugaccacccacaccuggggcgaggacgcccgcggcaccuggacccucgagcucggcuucgucggcuccgccccccagaagggcguccucaaggaguggacccucaugcuccacggcacccaguccgcccccuacaucgaccaggucguccgcgacuaccaguccaagcucgccauguccaagaaggaggagcucgaggaggagcucgacgaggccgucgagcgcucccucaaguccauccucaacaagaacuga

SEQ ID NO: 47397 - RNA, 2268 nt, Artificial Sequence
  derived and/or modified sequence opt2 from PCSK4__Homo_sapiens__NP_060043
augcgccccgcccccaucgcccucuggcuccgccucguccucgcccucgcccucguccgcccccgcgccgucggcugggcccccguccgcgcccccaucuacgucuccuccugggccguccaggucucccagggcaaccgcgaggucgagcgccucgcccgcaaguucggcuucgucaaccucggccccaucuuccccgacggccaguacuuccaccuccgccaccgcggcgucguccagcagucccucaccccccacuggggccaccgccuccaccucaagaagaaccccaagguccagugguuccagcagcagacccuccagcgccgcgucaagcgcuccgucgucguccccaccgaccccugguucuccaagcagugguacaugaacuccgaggcccagcccgaccucuccauccuccaggccuggucccagggccucuccggccagggcaucgucgucuccguccucgacgacggcaucgagaaggaccaccccgaccucugggccaacuacgacccccucgccuccuacgacuucaacgacuacgaccccgacccccagccccgcuacacccccuccaaggagaaccgccacggcacccgcugcgccggcgaggucgccgccauggccaacaacggcuucugcggcgucggcgucgccuucaacgcccgcaucggcggcguccgcaugcucgacggcaccaucaccgacgucaucgaggcccagucccucucccuccagccccagcacauccacaucuacuccgccuccuggggccccgaggacgacggccgcaccgucgacggccccggcauccucacccgcgaggccuuccgccgcggcgucaccaagggccgcggcggccucggcacccucuucaucugggccuccggcaacggcggccuccacuacgacaacugcaacugcgacggcuacaccaacuccauccacacccucuccgucggcuccaccacccagcagggccgcguccccugguacuccgaggccugcgccuccacccucaccaccaccuacuccuccggcgucgccaccgacccccagaucgucaccaccgaccuccaccacggcugcaccgaccagcacaccggcaccuccgccuccgccccccucgccgccggcaugaucgcccucgcccucgaggccaaccccuuccucaccuggcgcgacaugcagcaccucgucguccgcgccuccaagcccgcccaccuccaggccgaggacuggcgcaccaacggcgucggccgccaggucucccaccacuacggcuacggccuccucgacgccggccuccucgucgacaccgcccgcaccuggcuccccacccagccccagcgcaagugcgccguccgcguccagucccgccccacccccauccucccccucaucuacauccgcgagaacgucuccgccugcgccggccuccacaacuccauccgcucccucgagcacguccaggcccagcucacccucuccuacucccgccgcggcgaccucgagaucucccucaccucccccaugggcacccgcuccacccucgucgccauccgcccccucgacgucuccaccgagggcuacaacaacugggucuucauguccacccacuucugggacgagaacccccagggcgucuggacccucggccucgagaacaagggcuacuacuucaacaccggcacccucuaccgcuacacccuccuccucuacggcaccgccgaggacaugaccgcccgccccaccggcccccaggucaccuccuccgccugcguccagcgcgacaccgagggccucugccaggccugcgacggccccgccuacauccucggccagcucugccucgccuacugccccccccgcuucuucaaccacacccgccucgucaccgccggccccggccacaccgccgcccccgcccuccgcgucugcuccuccugccacgccuccugcuacaccugccgcggcggcuccccccgcgacugcaccuccugcccccccuccuccacccucgaccagcagcagggcuccugcaugggccccaccacccccgacucccgcccccgccuccgcgccgccgccugcccccaccaccgcugccccgccuccgccaugguccucucccuccucgccgucacccucggcggccccguccucugcggcauguccauggaccucccccucuacgccuggcucucccgcgcccgcgccacccccaccaagccccaggucuggcuccccgccggcaccuga

SEQ ID NO: 47398 - RNA, 5583 nt, Artificial Sequence
  derived and/or modified sequence opt2 from PCSK5__Homo_sapiens__NP_001177411
augggcuggggcucccgcugcugcugccccggccgccucgaccuccucugcguccucgcccuccucggcggcugccuccuccccgucugccgcacccgcgucuacaccaaccacugggccgucaagaucgccggcggcuuccccgaggccaaccgcaucgccuccaaguacggcuucaucaacaucggccagaucggcgcccucaaggacuacuaccacuucuaccacucccgcaccaucaagcgcuccgucaucuccucccgcggcacccacuccuucaucuccauggagcccaaggucgaguggauccagcagcaggucgucaagaagcgcaccaagcgcgacuacgacuucucccgcgcccaguccaccuacuucaacgaccccaaguggcccuccaugugguacaugcacugcuccgacaacacccaccccugccaguccgacaugaacaucgagggcgccuggaagcgcggcuacaccggcaagaacaucgucgucaccauccucgacgacggcaucgagcgcacccaccccgaccucaugcagaacuacgacgcccucgccuccugcgacgucaacggcaacgaccucgaccccaugccccgcuacgacgccuccaacgagaacaagcacggcacccgcugcgccggcgaggucgccgccgccgccaacaacucccacugcaccgucggcaucgccuucaacgccaagaucggcggcguccgcaugcucgacggcgacgucaccgacauggucgaggccaaguccgucuccuucaacccccagcacguccacaucuacuccgccuccuggggccccgacgacgacggcaagaccgucgacggccccgccccccucacccgccaggccuucgagaacggcguccgcaugggccgccgcggccucggcuccgucuucgucugggccuccggcaacggcggccgcuccaaggaccacugcuccugcgacggcuacaccaacuccaucuacaccaucuccaucuccuccaccgccgaguccggcaagaagcccugguaccucgaggagugcuccuccacccucgccaccaccuacuccuccggcgaguccuacgacaagaagaucaucaccaccgaccuccgccagcgcugcaccgacaaccacaccggcaccuccgccuccgcccccauggccgccggcaucaucgcccucgcccucgaggccaaccccuuccucaccuggcgcgacguccagcacgucaucguccgcaccucccgcgccggccaccucaacgccaacgacuggaagaccaacgccgccggcuucaaggucucccaccucuacggcuucggccucauggacgccgaggccauggucauggaggccgagaaguggaccaccgucccccgccagcacgucugcgucgaguccaccgaccgccagaucaagaccauccgccccaacuccgccguccgcuccaucuacaaggccuccggcugcuccgacaaccccaaccgccacgucaacuaccucgagcacgucgucguccgcaucaccaucacccacccccgccgcggcgaccucgccaucuaccucaccucccccuccggcacccgcucccagcuccucgccaaccgccucuucgaccacuccauggagggcuucaagaacugggaguucaugaccauccacugcuggggcgagcgcgccgccggcgacuggguccucgaggucuacgacacccccucccagcuccgcaacuucaagacccccggcaagcucaaggaguggucccucguccucuacggcaccuccguccagcccuacucccccaccaacgaguuccccaaggucgagcgcuuccgcuacucccgcgucgaggaccccaccgacgacuacggcaccgaggacuacgccggccccugcgaccccgagugcuccgaggucggcugcgacggccccggccccgaccacugcaacgacugccuccacuacuacuacaagcucaagaacaacacccgcaucugcgucuccuccugcccccccggccacuaccacgccgacaagaagcgcugccgcaagugcgcccccaacugcgaguccugcuucggcucccacggcgaccagugcauguccugcaaguacggcuacuuccucaacgaggagaccaacuccugcgucacccacugccccgacggcuccuaccaggacaccaagaagaaccucugccgcaagugcuccgagaacugcaagaccugcaccgaguuccacaacugcaccgagugccgcgacggccucucccuccagggcucccgcugcuccgucuccugcgaggacggccgcuacuucaacggccaggacugccagcccugccaccgcuucugcgccaccugcgccggcgccggcgccgacggcugcaucaacugcaccgagggcuacuucauggaggacggccgcugcguccaguccugcuccaucuccuacuacuucgaccacuccuccgagaacggcuacaaguccugcaagaagugcgacaucuccugccucaccugcaacggccccggcuucaagaacugcaccuccugccccuccggcuaccuccucgaccucggcaugugccagaugggcgccaucugcaaggacggcgaguacgucgacgagcacggccacugccagaccugcgaggccuccugcgccaagugccagggccccacccaggaggacugcaccaccugccccaugacccgcaucuucgacgacggccgcugcgucuccaacugccccuccuggaaguucgaguucgagaaccagugccaccccugccaccacaccugccagcgcugccagggcuccggccccacccacugcaccuccugcggcgccgacaacuacggccgcgagcacuuccucuaccagggcgagugcggcgacuccugccccgagggccacuacgccaccgagggcaacaccugccuccccugccccgacaacugcgagcucugccacuccguccacgucugcacccgcugcaugaagggcuacuucaucgcccccaccaaccacaccugccagaagcucgagugcggccagggcgagguccaggaccccgacuacgaggagugcguccccugcgaggagggcugccucggcugcucccucgacgaccccggcaccugcaccuccugcgccaugggcuacuaccgcuucgaccaccacugcuacaagaccugccccgagaagaccuacuccgaggaggucgagugcaaggccugcgacuccaacugcggcuccugcgaccagaacggcugcuacuggugcgaggagggcuucuuccuccucggcggcuccugcguccgcaagugcggccccggcuucuacggcgaccaggagaugggcgagugcgaguccugccaccgcgccugcgagaccugcaccggccccggccacgacgagugcuccuccugccaggagggccuccagcuccuccgcggcaugugcguccacgccaccaagacccaggaggagggcaaguucuggaacgacauccuccgcaagcuccagcccugccacuccuccugcaagaccugcaacggcuccgccacccucugcaccuccugccccaagggcgccuaccuccucgcccaggccugcgucuccuccugcccccagggcaccuggcccuccguccgcuccggcuccugcgagaacugcaccgaggccugcgccaucugcuccggcgccgaccucugcaagaagugccagaugcagcccggccacccccucuuccuccacgagggccgcugcuacuccaagugccccgagggcuccuacgccgaggacggcaucugcgagcgcugcuccucccccugccgcaccugcgagggcaacgccaccaacugccacuccugcgagggcggccacguccuccaccacggcgucugccaggagaacugccccgagcgccacgucgccgucaagggcgucugcaagcacugccccgagaugugccaggacugcauccacgagaagaccugcaaggagugcacccccgaguucuuccuccacgacgacaugugccaccaguccugcccccgcggcuucuacgccgacucccgccacugcguccccugccacaaggacugccucgagugcuccggccccaaggccgacgacugcgagcucugccucgaguccuccuggguccucuacgacggccucugccucgaggagugccccgccggcaccuacuacgagaaggagaccaaggagugccgcgacugccacaaguccugccucaccugcuccuccuccggcaccugcaccaccugccagaagggccucaucaugaacccccgcggcuccugcauggccaacgagaagugcucccccuccgaguacugggacgaggacgcccccggcugcaagcccugccacgucaagugcuuccacugcaugggccccgccgaggaccagugccagaccugccccaugaacucccuccuccucaacaccaccugcgucaaggacugccccgagggcuacuacgccgacgaggacuccaaccgcugcgcccacugccacuccuccugccgcaccugcgagggccgccacucccgccagugccacuccugccgccccggcugguuccagcucggcaaggagugccuccuccagugccgcgagggcuacuacgccgacaacuccaccggccgcugcgagcgcugcaaccgcuccugcaagggcugccagggcccccgccccaccgacugccucuccugcgaccgcuucuucuuccuccuccgcuccaagggcgagugccaccgcuccugccccgaccacuacuacgucgagcaguccacccagaccugcgagcgcugccaccccaccugcgaccagugcaagggcaagggcgcccucaacugccucuccugcgucugguccuaccaccucaugggcggcaucugcaccuccgacugccucgucggcgaguaccgcgucggcgagggcgagaaguucaacugcgagaagugccacgaguccugcauggagugcaagggccccggcgccaagaacugcacccucugccccgccaaccucguccuccacauggacgacucccacugccuccacugcugcaacaccuccgacccccccuccgcccaggagugcugcgacugccaggacaccaccgacgagugcauccuccgcaccuccaagguccgccccgccaccgagcacuucaagaccgcccucuucaucaccuccuccaugaugcucguccuccuccucggcgccgccgucgucgucuggaagaagucccgcggccgcguccagcccgccgccaaggccggcuacgagaagcucgccgaccccaacaaguccuacuccuccuacaaguccuccuaccgcgaguccaccuccuucgaggaggaccaggucaucgaguaccgcgaccgcgacuacgacgaggacgacgacgacgacaucgucuacaugggccaggacggcaccgucuaccgcaaguucaaguacggccuccucgacgacgacgacaucgacgagcucgaguacgacgacgaguccuacuccuacuaccaguga

SEQ ID NO: 47399 - RNA, 2910 nt, Artificial Sequence
  derived and/or modified sequence opt2 from PCSK6__Homo_sapiens__NP_002561
augcccccccgcgccccccccgcccccggcccccgcccccccccccgcgccgccgccgccaccgacaccgccgccggcgccggcggcgccggcggcgccggcggcgccggcggccccggcuuccgcccccucgccccccgccccuggcgcuggcuccuccuccucgcccuccccgccgccugcuccgccccccccccccgccccgucuacaccaaccacugggccguccagguccucggcggccccgccgaggccgaccgcgucgccgccgcccacggcuaccucaaccucggccagaucggcaaccucgaggacuacuaccacuucuaccacuccaagaccuucaagcgcuccacccucuccucccgcggcccccacaccuuccuccgcauggacccccaggucaaguggcuccagcagcaggaggucaagcgccgcgucaagcgccagguccgcuccgacccccaggcccucuacuucaacgaccccaucugguccaacaugugguaccuccacugcggcgacaagaacucccgcugccgcuccgagaugaacguccaggccgccuggaagcgcggcuacaccggcaagaacgucgucgucaccauccucgacgacggcaucgagcgcaaccaccccgaccucgcccccaacuacgacuccuacgccuccuacgacgucaacggcaacgacuacgaccccuccccccgcuacgacgccuccaacgagaacaagcacggcacccgcugcgccggcgaggucgccgccuccgccaacaacuccuacugcaucgucggcaucgccuacaacgccaagaucggcggcauccgcaugcucgacggcgacgucaccgacgucgucgaggccaagucccucggcauccgccccaacuacaucgacaucuacuccgccuccuggggccccgacgacgacggcaagaccgucgacggccccggccgccucgccaagcaggccuucgaguacggcaucaagaagggccgccagggccucggcuccaucuucgucugggccuccggcaacggcggccgcgagggcgacuacugcuccugcgacggcuacaccaacuccaucuacaccaucuccgucuccuccgccaccgagaacggcuacaagcccugguaccucgaggagugcgccuccacccucgccaccaccuacuccuccggcgccuucuacgagcgcaagaucgucaccaccgaccuccgccagcgcugcaccgacggccacaccggcaccuccgucuccgcccccauggucgccggcaucaucgcccucgcccucgaggccaacucccagcucaccuggcgcgacguccagcaccuccucgucaagaccucccgccccgcccaccucaaggccuccgacuggaaggucaacggcgccggccacaaggucucccacuucuacggcuucggccucgucgacgccgaggcccucgucgucgaggccaagaaguggaccgccguccccucccagcacaugugcgucgccgccuccgacaagcgcccccgcuccaucccccucguccagguccuccgcaccaccgcccucaccuccgccugcgccgagcacuccgaccagcgcgucgucuaccucgagcacgucgucguccgcaccuccaucucccacccccgccgcggcgaccuccagaucuaccucgucucccccuccggcaccaagucccagcuccucgccaagcgccuccucgaccucuccaacgagggcuucaccaacugggaguucaugaccguccacugcuggggcgagaaggccgagggccaguggacccucgagauccaggaccuccccucccagguccgcaaccccgagaagcagggcaagcucaaggaguggucccucauccucuacggcaccgccgagcaccccuaccacaccuucuccgcccaccagucccgcucccgcaugcucgagcucuccgcccccgagcucgagccccccaaggccgcccucucccccucccaggucgagguccccgaggacgaggaggacuacaccgcccaguccacccccggcuccgccaacauccuccagaccuccgucugccaccccgagugcggcgacaagggcugcgacggccccaacgccgaccagugccucaacugcguccacuucucccucggcuccgucaagaccucccgcaagugcgucuccgucugcccccucggcuacuucggcgacaccgccgcccgccgcugccgccgcugccacaagggcugcgagaccugcuccucccgcgccgccacccagugccucuccugccgccgcggcuucuaccaccaccaggagaugaacaccugcgucacccucugccccgccggcuucuacgccgacgagucccagaagaacugccucaagugccaccccuccugcaagaagugcgucgacgagcccgagaagugcaccgucugcaaggagggcuucucccucgcccgcggcuccugcauccccgacugcgagcccggcaccuacuucgacuccgagcucauccgcugcggcgagugccaccacaccugcggcaccugcgucggccccggccgcgaggagugcauccacugcgccaagaacuuccacuuccacgacuggaagugcguccccgccugcggcgagggcuucuaccccgaggagaugcccggccucccccacaaggucugccgccgcugcgacgagaacugccucuccugcgccggcuccucccgcaacugcucccgcugcaagaccggcuucacccagcucggcaccuccugcaucaccaaccacaccugcuccaacgccgacgagaccuucugcgagauggucaaguccaaccgccucugcgagcgcaagcucuucauccaguucugcugccgcaccugccuccucgccggcuga

SEQ ID NO: 47400 - RNA, 2358 nt, Artificial Sequence
  derived and/or modified sequence opt2 from PCSK7__Homo_sapiens__NP_004707
augcccaagggccgccagaaggucccccaccucgacgccccccucggccuccccaccugccucuggcucgagcucgccggccucuuccuccucguccccugggucaugggccucgccggcaccggcggccccgacggccagggcaccggcggccccuccugggccguccaccucgagucccucgagggcgacggcgaggaggagacccucgagcagcaggccgacgcccucgcccaggccgccggccucgucaacgccggccgcaucggcgagcuccagggccacuaccucuucguccagcccgccggccaccgccccgcccucgaggucgaggccauccgccagcaggucgaggccguccucgccggccacgaggccguccgcuggcacuccgagcagcgccuccuccgccgcgccaagcgcuccguccacuucaacgaccccaaguacccccagcaguggcaccucaacaaccgccgcucccccggccgcgacaucaacgucaccggcgucugggagcgcaacgucaccggccgcggcgucaccgucgucgucgucgacgacggcgucgagcacaccauccaggacaucgcccccaacuacucccccgagggcuccuacgaccucaacuccaacgaccccgaccccaugccccaccccgacgucgagaacggcaaccaccacggcacccgcugcgccggcgagaucgccgccguccccaacaacuccuucugcgccgucggcgucgccuacggcucccgcaucgccggcauccgcguccucgacggcccccucaccgacuccauggaggccgucgccuucaacaagcacuaccagaucaacgacaucuacuccugcuccuggggccccgacgacgacggcaagaccgucgacggcccccaccagcucggcaaggccgcccuccagcacggcgucaucgccggccgccagggcuucggcuccaucuucgucgucgccuccggcaacggcggccagcacaacgacaacugcaacuacgacggcuacgccaacuccaucuacaccgucaccaucggcgccgucgacgaggagggccgcaugcccuucuacgccgaggagugcgccuccaugcucgccgucaccuucuccggcggcgacaagaugcuccgcuccaucgucaccaccgacugggaccuccagaagggcaccggcugcaccgagggccacaccggcaccuccgccgccgccccccucgccgccggcaugaucgcccucaugcuccagguccgccccugccucaccuggcgcgacguccagcacaucaucgucuucaccgccacccgcuacgaggaccgccgcgccgagugggucaccaacgaggccggcuucucccacucccaccagcacggcuucggccuccucaacgccuggcgccucgucaacgccgccaagaucuggaccuccguccccuaccucgccuccuacgucucccccguccucaaggagaacaaggccaucccccaguccccccgcucccucgagguccucuggaacgucucccgcauggaccucgagauguccggccucaagacccucgagcacgucgccgucaccgucuccaucacccacccccgccgcggcucccucgagcucaagcucuucugccccuccggcaugaugucccucaucggcgccccccgcuccauggacuccgaccccaacggcuucaacgacuggaccuucuccaccguccgcugcuggggcgagcgcgcccgcggcaccuaccgccucgucauccgcgacgucggcgacgaguccuuccaggucggcauccuccgccaguggcagcucacccucuacggcuccgucugguccgccgucgacauccgcgaccgccagcgccuccucgaguccgccauguccggcaaguaccuccacgacgacuucgcccuccccugcccccccggccucaagauccccgaggaggacggcuacaccaucacccccaacacccucaagacccucguccucgucggcugcuucaccgucuucuggaccgucuacuacaugcucgaggucuaccucucccagcgcaacgucgccuccaaccaggucugccgcuccggccccugccacuggccccaccgcucccgcaaggccaaggaggagggcaccgagcucgaguccgucccccucugcuccuccaaggaccccgacgaggucgagaccgagucccgcggcccccccaccaccuccgaccuccucgcccccgaccuccucgagcagggcgacuggucccucucccagaacaaguccgcccucgacugcccccaccagcaccucgacgucccccacggcaaggaggagcagaucugcuga

SEQ ID NO: 47401 - RNA, 429 nt, Artificial Sequence
  derived and/or modified sequence opt2 from PCTP__Homo_sapiens__NP_001095872
auggacuccgacuaccgcaagcagugggaccaguacgucaaggagcucuacgagcaggagugcaacggcgagaccgucgucuacugggaggucaaguaccccuuccccauguccaaccgcgacuacgucuaccuccgccagcgccgcgaccucgacauggagggccgcaagauccacgucauccucgcccgcuccaccuccaugccccagcucggcgagcgcuccggcgucauccgcgucaagcaguacaagcagucccucgccaucgaguccgacggcaagaagggcuccaaggucuucauguacuacuucgacaaccccggcggccagauccccuccuggcucaucaacugggccgccaagaacggcguccccaacuuccucaaggacauggcccgcgccugccagaacuaccucaagaagaccuga

SEQ ID NO: 47402 - RNA, 1104 nt, Artificial Sequence
  derived and/or modified sequence opt2 from PCYT1A__Homo_sapiens__NP_005008
auggacgcccagugcuccgccaaggucaacgcccgcaagcgccgcaaggaggcccccggccccaacggcgccaccgaggaggacggcguccccuccaagguccagcgcugcgccgucggccuccgccagcccgcccccuucuccgacgagaucgaggucgacuucuccaagcccuacguccgcgucaccauggaggaggccucccgcggcacccccugcgagcgccccguccgcgucuacgccgacggcaucuucgaccucuuccacuccggccacgcccgcgcccucaugcaggccaagaaccucuuccccaacaccuaccucaucgucggcgucugcuccgacgagcucacccacaacuucaagggcuucaccgucaugaacgagaacgagcgcuacgacgccguccagcacugccgcuacgucgacgaggucguccgcaacgcccccuggacccucacccccgaguuccucgccgagcaccgcaucgacuucgucgcccacgacgacauccccuacuccuccgccggcuccgacgacgucuacaagcacaucaaggaggccggcauguucgcccccacccagcgcaccgagggcaucuccaccuccgacaucaucacccgcaucguccgcgacuacgacgucuacgcccgccgcaaccuccagcgcggcuacaccgccaaggagcucaacgucuccuucaucaacgagaagaaguaccaccuccaggagcgcgucgacaaggucaagaagaaggucaaggacgucgaggagaaguccaaggaguucguccagaaggucgaggagaaguccaucgaccucauccagaagugggaggagaagucccgcgaguucaucggcuccuuccucgagauguucggccccgagggcgcccucaagcacaugcucaaggagggcaagggccgcaugcuccaggccaucucccccaagcagucccccuccuccucccccacccgcgagcgcucccccucccccuccuuccgcuggcccuucuccggcaagaccuccccccccugcucccccgccaaccucucccgccacaaggccgccgccuacgacaucuccgaggacgaggaggacuga

SEQ ID NO: 47403 - RNA, 1056 nt, Artificial Sequence
  derived and/or modified sequence opt2 from PCYT1B__Homo_sapiens__NP_001156736
auggucggccaccaggagugcaucauggaggaggacaaccgcgccccccagcucuggcgcaagacccucaccgcccccgcccccuucgccgacgagaccaacugccagugccaggccccccacgagaagcucaccaucgcccaggcccgccucggcacccccgccgaccgccccguccgcgucuacgccgacggcaucuucgaccucuuccacuccggccacgcccgcgcccucaugcaggccaagacccucuuccccaacuccuaccuccucgucggcgucugcuccgacgaccucacccacaaguucaagggcuucaccgucaugaacgaggccgagcgcuacgaggcccuccgccacugccgcuacgucgacgaggucauccgcgacgcccccuggacccucacccccgaguuccucgagaagcacaagaucgacuucgucgcccacgacgacauccccuacuccuccgccggcuccgacgacgucuacaagcacaucaaggaggccggcauguucguccccacccagcgcaccgagggcaucuccaccuccgacaucaucacccgcaucguccgcgacuacgacgucuacgcccgccgcaaccuccagcgcggcuacaccgccaaggagcucaacgucuccuucaucaacgagaagcgcuaccgcuuccagaaccaggucgacaagaugaaggagaaggucaagaacgucgaggagcgcuccaaggaguucgucaaccgcgucgaggagaagucccacgaccucauccagaagugggaggagaagucccgcgaguucaucggcaacuuccucgagcucuucggccccgacggcgccuggaagcagauguuccaggagcgcuccucccgcaugcuccaggcccucucccccaagcagucccccgucuccucccccacccgcucccgcucccccucccgcucccccucccccaccuucuccuggcucccccucaagaccuccccccccuccucccccaaggccgccuccgccuccaucuccuccauguccgagggcgacgaggacgagaaguga

SEQ ID NO: 47404 - RNA, 546 nt, Artificial Sequence
  derived and/or modified sequence opt2 from PDAP1__Homo_sapiens__NP_055706
augcccaagggcggccgcaagggcggccacaagggccgcgcccgccaguacaccucccccgaggagaucgacgcccagcuccaggccgagaagcagaaggcccgcgaggaggaggagcagaaggagggcggcgacggcgccgccggcgaccccaagaaggagaagaagucccucgacuccgacgaguccgaggacgaggaggacgacuaccagcagaagcgcaagggcgucgagggccucaucgacaucgagaaccccaaccgcgucgcccagaccaccaagaaggucacccagcucgaccucgacggccccaaggagcucucccgccgcgagcgcgaggagaucgagaagcagaaggccaaggagcgcuacaugaagaugcaccucgccggcaagaccgagcaggccaaggccgaccucgcccgccucgccaucauccgcaagcagcgcgaggaggccgcccgcaagaaggaggaggagcgcaaggccaaggacgacgccacccucuccggcaagcgcaugcagucccucucccucaacaaguga

SEQ ID NO: 47405 - RNA, 639 nt, Artificial Sequence
  derived and/or modified sequence opt2 from PDCD10__Homo_sapiens__NP_665859
augcgcaugaccauggaggagaugaagaacgaggccgagaccaccuccauggucuccaugccccucuacgccgucauguaccccgucuucaacgagcucgagcgcgucaaccucuccgccgcccagacccuccgcgccgccuucaucaaggccgagaaggagaaccccggccucacccaggacaucaucaugaagauccucgagaagaaguccgucgaggucaacuucaccgagucccuccuccgcauggccgccgacgacgucgaggaguacaugaucgagcgccccgagcccgaguuccaggaccucaacgagaaggcccgcgcccucaagcagauccucuccaagauccccgacgagaucaacgaccgcguccgcuuccuccagaccaucaaggacaucgccuccgccaucaaggagcuccucgacaccgucaacaacgucuucaagaaguaccaguaccagaaccgccgcgcccucgagcaccagaagaaggaguucgucaaguacuccaaguccuucuccgacacccucaagaccuacuucaaggacggcaaggccaucaacgucuucgucuccgccaaccgccucauccaccagaccaaccucauccuccagaccuucaagaccgucgccuga

SEQ ID NO: 47406 - RNA, 867 nt, Artificial Sequence
  derived and/or modified sequence opt2 from PDCD1__Homo_sapiens__NP_005009
augcagaucccccaggcccccuggcccgucgucugggccguccuccagcucggcuggcgccccggcugguuccucgacucccccgaccgccccuggaacccccccaccuucucccccgcccuccucgucgucaccgagggcgacaacgccaccuucaccugcuccuucuccaacaccuccgaguccuucguccucaacugguaccgcaugucccccuccaaccagaccgacaagcucgccgccuuccccgaggaccgcucccagcccggccaggacugccgcuuccgcgucacccagcuccccaacggccgcgacuuccacauguccgucguccgcgcccgccgcaacgacuccggcaccuaccucugcggcgccaucucccucgcccccaaggcccagaucaaggagucccuccgcgccgagcuccgcgucaccgagcgccgcgccgagguccccaccgcccaccccucccccuccccccgccccgccggccaguuccagacccucgucgucggcgucgucggcggccuccucggcucccucguccuccucgucuggguccucgccgucaucugcucccgcgccgcccgcggcaccaucggcgcccgccgcaccggccagccccucaaggaggaccccuccgccguccccgucuucuccgucgacuacggcgagcucgacuuccaguggcgcgagaagacccccgagccccccguccccugcguccccgagcagaccgaguacgccaccaucgucuuccccuccggcaugggcaccuccucccccgcccgccgcggcuccgccgacggcccccgcuccgcccagccccuccgccccgaggacggccacugcuccuggccccucuga

SEQ ID NO: 47407 - RNA, 822 nt, Artificial Sequence
  derived and/or modified sequence opt2 from PDCD1LG2__Homo_sapiens__NP_079515
augaucuuccuccuccucaugcucucccucgagcuccagcuccaccagaucgccgcccucuucaccgucaccguccccaaggagcucuacaucaucgagcacggcuccaacgucacccucgagugcaacuucgacaccggcucccacgucaaccucggcgccaucaccgccucccuccagaaggucgagaacgacaccuccccccaccgcgagcgcgccacccuccucgaggagcagcucccccucggcaaggccuccuuccacaucccccagguccagguccgcgacgagggccaguaccagugcaucaucaucuacggcgucgccugggacuacaaguaccucacccucaaggucaaggccuccuaccgcaagaucaacacccacauccucaagguccccgagaccgacgaggucgagcucaccugccaggccaccggcuacccccucgccgaggucuccuggcccaacgucuccguccccgccaacaccucccacucccgcacccccgagggccucuaccaggucaccuccguccuccgccucaagcccccccccggccgcaacuucuccugcgucuucuggaacacccacguccgcgagcucacccucgccuccaucgaccuccagucccagauggagccccgcacccaccccaccuggcuccuccacaucuucauccccuucugcaucaucgccuucaucuucaucgccaccgucaucgcccuccgcaagcagcucugccagaagcucuacuccuccaaggacaccaccaagcgccccgucaccaccaccaagcgcgaggucaacuccgccaucuga

SEQ ID NO: 47408 - RNA, 936 nt, Artificial Sequence
  derived and/or modified sequence opt2 from PDCD2__Homo_sapiens__NP_001186391
auggccgccgccggcgcccgccccgucgagcucggcuucgccgaguccgcccccgccuggcgccuccgcuccgagcaguuccccuccaaggucuacgccccccuccccggccgccccgacgccuuccaccgcugcaucuuccucuucugcugccgcgagcagcccugcugcgccggccuccgcgucuuccgcaaccagcucccccgcaagaacgacuucuacuccuacgagccccccuccgagaaccccccccccgagaccggcgaguccgucugccuccagcucaaguccggcgcccaccucugccgcgucugcggcugccucggccccaagaccugcucccgcugccacaaggccuacuacugcuccaaggagcaccagacccucgacuggcgccucggccacaagcaggccugcgcccagcccgaccaccucgaccacaucauccccgaccacaacuuccucuuccccgaguucgagaucgucaucgagaccgaggacgagaucaugcccgaggucgucgagaaggaggacuacuccgagaucaucggcuccaugggcgaggcccucgaggaggagcucgacuccauggccaagcacgagucccgcgaggacaagaucuuccagaaguucaagacccagaucgcccucgagcccgagcagauccuccgcuacggccgcggcaucgcccccaucuggaucuccggcgagaacaucccccaggagaaggacauccccgacugccccugcggcgccaagcgcauccucgaguuccaggucaugccccagcuccucaacuaccucaaggccgaccgccucggcaaguccaucgacuggggcauccucgccgucuucaccugcgccgaguccugcucccucggcaccggcuacaccgaggaguucgucuggaagcaggacgucaccgacacccccuga

SEQ ID NO: 47409 - RNA, 1368 nt, Artificial Sequence
  derived and/or modified sequence opt2 from PDCD4__Homo_sapiens__NP_001186421
auggacgucgagaacgagcagauccucaacgucaaccccgccgagaacgccggcaccgaggagaucaagaacgagaucaacggcaacuggaucuccgccuccuccaucaacgaggcccgcaucaacgccaaggccaagcgccgccuccgcaagaacuccucccgcgacuccggccgcggcgacuccgucuccgacuccggcuccgacgcccuccgcuccggccucaccguccccaccucccccaagggccgccuccucgaccgccgcucccgcuccggcaagggccgcggccuccccaagaagggcggcgccggcggcaagggcgucuggggcacccccggccaggucuacgacgucgaggaggucgacgucaaggaccccaacuacgacgacgaccaggagaacugcgucuacgagaccgucguccucccccucgacgagcgcgccuucgagaagacccucacccccaucauccaggaguacuucgagcacggcgacaccaacgaggucgccgagaugcuccgcgaccucaaccucggcgagaugaaguccggcguccccguccucgccgucucccucgcccucgagggcaaggccucccaccgcgagaugaccuccaagcuccucuccgaccucugcggcaccgucauguccaccaccgacgucgagaaguccuucgacaagcuccucaaggaccuccccgagcucgcccucgacaccccccgcgccccccagcucgucggccaguucaucgcccgcgccgucggcgacggcauccucugcaacaccuacaucgacuccuacaagggcaccgucgacugcguccaggcccgcgccgcccucgacaaggccaccguccuccucuccauguccaagggcggcaagcgcaaggacuccgucuggggcuccggcggcggccagcaguccgucaaccaccucgucaaggagaucgacaugcuccucaaggaguaccuccucuccggcgacaucuccgaggccgagcacugccucaaggagcucgaggucccccacuuccaccacgagcucgucuacgaggccaucaucaugguccucgaguccaccggcgaguccaccuucaagaugauccucgaccuccucaagucccucuggaaguccuccaccaucaccgucgaccagaugaagcgcggcuacgagcgcaucuacaacgagauccccgacaucaaccucgacgucccccacuccuacuccguccucgagcgcuucgucgaggagugcuuccaggccggcaucaucuccaagcagcuccgcgaccucugccccucccgcggccgcaagcgcuucgucuccgagggcgacggcggccgccucaagcccgaguccuacuga

SEQ ID NO: 47410 - RNA, 378 nt, Artificial Sequence
  derived and/or modified sequence opt2 from PDCD5__Homo_sapiens__NP_004699
auggccgacgaggagcucgaggcccuccgccgccagcgccucgccgagcuccaggccaagcacggcgaccccggcgacgccgcccagcaggaggccaagcaccgcgaggccgagaugcgcaacuccauccucgcccagguccucgaccaguccgcccgcgcccgccucuccaaccucgcccucgucaagcccgagaagaccaaggccgucgagaacuaccucauccagauggcccgcuacggccagcucuccgagaaggucuccgagcagggccucaucgagauccucaagaaggucucccagcagaccgagaagaccaccaccgucaaguucaaccgccgcaaggucauggacuccgacgaggacgacgacuacuga

SEQ ID NO: 47411 - RNA, 570 nt, Artificial Sequence
  derived and/or modified sequence opt2 from PDCD6__Homo_sapiens__NP_001254485
auggccgccuacuccuaccgccccggccccggcgccggccccggccccgccgccggcgccgcccuccccgaccaguccuuccucuggaacgucuuccagcgcgucgacaaggaccgcuccggcgucaucuccgacaccgagcuccagcaggcccucuccaacggcaccuggacccccuucaaccccgucaccguccgcuccaucaucuccauguucgaccgcgagaacaaggccggcgucaacuucuccgaguucaccggcgucuggaaguacaucaccgacuggcagaacgucuuccgcaccuacgaccgcgacaacuccggcaugaucgacaagaacgagcucaagcaggcccucuccggcuaccgccucuccgaccaguuccacgacauccucauccgcaaguucgaccgccagggccgcggccagaucgccuucgacgacuucauccagggcugcaucguccuccagcgccucaccgacaucuuccgccgcuacgacaccgaccaggacggcuggauccaggucuccuacgagcaguaccucuccauggucuucuccaucgucuga

SEQ ID NO: 47412 - RNA, 2622 nt, Artificial Sequence
  derived and/or modified sequence opt2 from PDCD6IP__Homo_sapiens__NP_001155901
auggccaccuucaucuccguccagcucaagaagaccuccgaggucgaccucgccaagccccucgucaaguucauccagcagaccuaccccuccggcggcgaggagcaggcccaguacugccgcgccgccgaggagcucuccaagcuccgccgcgccgccgucggccgcccccucgacaagcacgagggcgcccucgagacccuccuccgcuacuacgaccagaucugcuccaucgagcccaaguuccccuucuccgagaaccagaucugccucaccuucaccuggaaggacgccuucgacaagggcucccucuucggcggcuccgucaagcucgcccucgccucccucggcuacgagaaguccugcguccucuucaacugcgccgcccucgccucccagaucgccgccgagcagaaccucgacaacgacgagggccucaagaucgccgccaagcacuaccaguucgccuccggcgccuuccuccacaucaaggagaccguccucuccgcccucucccgcgagcccaccgucgacaucucccccgacaccgucggcacccucucccucaucaugcucgcccaggcccaggaggucuucuuccucaaggccacccgcgacaagaugaaggacgccaucaucgccaagcucgccaaccaggccgccgacuacuucggcgacgccuucaagcagugccaguacaaggacacccuccccaaguacuucuacuuccaggaggucuuccccguccucgccgccaagcacugcaucaugcaggccaacgccgaguaccaccaguccauccucgccaagcagcagaagaaguucggcgaggagaucgcccgccuccagcacgccgccgagcucaucaagaccgucgccucccgcuacgacgaguacgucaacgucaaggacuucuccgacaagaucaaccgcgcccucgccgccgccaagaaggacaacgacuucaucuaccacgaccgcguccccgaccucaaggaccucgaccccaucggcaaggccacccucgucaaguccacccccgucaacguccccaucucccagaaguucaccgaccucuucgagaagaugguccccgucuccguccagcagucccucgccgccuacaaccagcgcaaggccgaccucgucaaccgcuccaucgcccagaugcgcgaggccaccacccucgccaacggcguccucgccucccucaaccuccccgccgccaucgaggacgucuccggcgacaccgucccccaguccauccucaccaagucccgcuccgucaucgagcagggcggcauccagaccgucgaccagcucaucaaggagcuccccgagcuccuccagcgcaaccgcgagauccucgacgagucccuccgccuccucgacgaggaggaggccaccgacaacgaccuccgcgccaaguucaaggagcgcuggcagcgcacccccuccaacgagcucuacaagccccuccgcgccgagggcaccaacuuccgcaccguccucgacaaggccguccaggccgacggccaggucaaggagugcuaccagucccaccgcgacaccaucguccuccucugcaagcccgagcccgagcucaacgccgccauccccuccgccaaccccgccaagaccaugcagggcuccgaggucgucaacguccucaagucccuccucuccaaccucgacgaggucaagaaggagcgcgagggccucgagaacgaccucaaguccgucaacuucgacaugaccuccaaguuccucaccgcccucgcccaggacggcgucaucaacgaggaggcccucuccgucaccgagcucgaccgcgucuacggcggccucaccaccaagguccaggagucccucaagaagcaggagggccuccucaagaacauccaggucucccaccaggaguucuccaagaugaagcaguccaacaacgaggccaaccuccgcgaggagguccucaagaaccucgccaccgccuacgacaacuucgucgagcucgucgccaaccucaaggagggcaccaaguucuacaacgagcucaccgagauccucguccgcuuccagaacaagugcuccgacaucgucuucgcccgcaagaccgagcgcgacgagcuccucaaggaccuccagcaguccaucgcccgcgagcccuccgcccccuccauccccacccccgccuaccaguccucccccgccggcggccacgcccccaccccccccacccccgccccccgcaccaugccccccaccaagccccagccccccgcccgcccccccccccccguccuccccgccaaccgcgcccccuccgccaccgcccccucccccgucggcgccggcaccgccgcccccgcccccucccagacccccggcuccgccccccccccccaggcccagggcccccccuaccccaccuaccccggcuaccccggcuacugccagaugcccaugcccaugggcuacaaccccuacgccuacggccaguacaacaugcccuacccccccgucuaccaccagucccccggccaggcccccuaccccggcccccagcagcccuccuaccccuucccccagcccccccagcaguccuacuacccccagcaguga

SEQ ID NO: 47413 - RNA, 1458 nt, Artificial Sequence
  derived and/or modified sequence opt2 from PDCD7__Homo_sapiens__NP_005698
auggcccucccccccuucuucggccagggccgccccggccccccccccccccagccccccccccccgcccccuucggcugccccccccccccccuccccucccccgccuucccccccccccucccccagcgccccggccccuuccccggcgccuccgcccccuuccuccagcccccccucgcccuccagccccgcgccuccgccgaggccucccgcggcggcggcggcgccggcgccuucuaccccguccccccccccccccucccccccccccccccccagugccgccccuuccccggcaccgacgccggcgagcgcccccgcccccccccccccggccccggcccccccugguccccccgcuggcccgaggccccccccccccccgccgacguccucggcgacgccgcccuccagcgccuccgcgaccgccaguggcucgaggccgucuucggcaccccccgccgcgccggcugccccgucccccagcgcacccacgccggccccucccucggcgagguccgcgcccgccuccuccgcgcccuccgccucguccgccgccuccgcggccucucccaggcccuccgcgaggccgaggccgacggcgccgccuggguccuccucuacucccagaccgccccccuccgcgccgagcucgccgagcgccuccagccccucacccaggccgccuacgucggcgaggcccgccgccgccucgagcgcguccgccgccgccgccuccgccuccgcgagcgcgcccgcgagcgcgaggccgagcgcgaggccgaggccgcccgcgccgucgagcgcgagcaggagaucgaccgcuggcgcgucaagugcguccaggaggucgaggagaagaagcgcgagcaggagcucaaggccgccgccgacggcguccucuccgagguccgcaagaagcaggccgacaccaagcgcauggucgacauccuccgcgcccucgagaagcuccgcaagcuccgcaaggaggccgccgcccgcaagggcgucugcccccccgccuccgccgacgagaccuucacccaccaccuccagcgccuccgcaagcucaucaagaagcgcuccgagcucuacgaggccgaggagcgcgcccuccgcgucaugcucgagggcgagcaggaggaggagcgcaagcgcgagcucgagaagaagcagcgcaaggagaaggagaagauccuccuccagaagcgcgagaucgaguccaagcucuucggcgaccccgacgaguucccccucgcccaccuccucgagcccuuccgccaguacuaccuccaggccgagcacucccuccccgcccucauccagauccgccacgacugggaccaguaccucguccccuccgaccaccccaagggcaacuucgucccccagggcuggguccuccccccccuccccuccaacgacaucugggccaccgccgucaagcuccacuga

SEQ ID NO: 47414 - RNA, 585 nt, Artificial Sequence
  derived and/or modified sequence opt2 from PDC__Homo_sapiens__NP_072098
auguccuccccccagucccgcaacggcaaggacuccaaggagcgcgucucccgcaagauguccauccaggaguacgagcucauccacaaggagaaggaggacgagaacugccuccgcaaguaccgccgccagugcaugcaggacaugcaccagaagcucuccuucggcccccgcuacggcuucgucuacgagcucgagaccggcaagcaguuccucgagaccaucgagaaggagcucaagaucaccaccaucgucguccacaucuacgaggacggcaucaagggcugcgacgcccucaacuccucccucaccugccucgccgccgaguaccccaucgucaaguucugcaagaucaaggccuccaacaccggcgccggcgaccgcuucucccucgacguccuccccacccuccucaucuacaagggcggcgagcucaucuccaacuucaucuccgucgccgagcaguucgccgaggaguucuucgccggcgacgucgaguccuuccucaacgaguacggccuccuccccgagcgcgagguccacguccucgagcacaccaagaucgaggaggaggacgucgaguga

SEQ ID NO: 47415 - RNA, 726 nt, Artificial Sequence
  derived and/or modified sequence opt2 from PDCL2__Homo_sapiens__NP_689614
augcaggaccccaacgaggacaccgaguggaacgacauccuccgcgacuucggcauccucccccccaaggaggaguccaaggacgagaucgaggagaugguccuccgccuccagaaggaggccauggucaagcccuucgagaagaugacccucgcccagcucaaggaggccgaggacgaguucgacgaggaggacaugcaggccgucgagaccuaccgcaagaagcgccuccaggaguggaaggcccucaagaagaagcagaaguucggcgagcuccgcgagaucuccggcaaccaguacgucaacgaggucaccaacgccgaggaggacgucugggucaucauccaccucuaccgcuccuccauccccaugugccuccucgucaaccagcaccucucccuccucgcccgcaaguuccccgagaccaaguucgucaaggccaucgucaacuccugcauccagcacuaccacgacaacugccuccccaccaucuucgucuacaagaacggccagaucgaggccaaguucaucggcaucaucgagugcggcggcaucaaccucaagcucgaggagcucgaguggaagcucgccgaggucggcgccauccagaccgaccucgaggagaacccccgcaaggacauggucgacaugauggucuccuccauccgcaacaccuccauccacgacgacuccgacuccuccaacuccgacaacgacaccaaguga

SEQ ID NO: 47416 - RNA, 720 nt, Artificial Sequence
  derived and/or modified sequence opt2 from PDCL3__Homo_sapiens__NP_076970
augcaggaccccaacgccgacaccgaguggaacgacauccuccgcaagaagggcauccucccccccaaggagucccucaaggagcucgaggaggaggccgaggaggagcagcgcauccuccagcaguccgucgucaagaccuacgaggacaugacccucgaggagcucgaggaccacgaggacgaguucaacgaggaggacgagcgcgccaucgagauguaccgccgccgccgccucgccgaguggaaggccaccaagcucaagaacaaguucggcgagguccucgagaucuccggcaaggacuacguccaggaggucaccaaggccggcgagggccucugggucauccuccaccucuacaagcagggcaucccccucugcgcccucaucaaccagcaccucuccggccucgcccgcaaguuccccgacgucaaguucaucaaggccaucuccaccaccugcauccccaacuaccccgaccgcaaccuccccaccaucuucgucuaccucgagggcgacaucaaggcccaguucaucggcccccucgucuucggcggcaugaaccucacccgcgacgagcucgaguggaagcucuccgaguccggcgccaucaugaccgaccucgaggagaaccccaagaagcccaucgaggacguccuccucuccuccguccgccgcuccguccucaugaagcgcgacuccgacuccgagggcgacuga

SEQ ID NO: 47417 - RNA, 2370 nt, Artificial Sequence
  derived and/or modified sequence opt2 from PDE10A__Homo_sapiens__NP_001124162
auggaggacggccccuccaacaacgccuccugcuuccgccgccucaccgagugcuuccucucccccucccucaccgacgagaaggucaaggccuaccucucccuccacccccagguccucgacgaguucgucuccgaguccgucuccgccgagaccgucgagaaguggcucaagcgcaagaacaacaaguccgaggacgaguccgcccccaaggaggucucccgcuaccaggacaccaacaugcagggcgucgucuacgagcucaacuccuacaucgagcagcgccucgacaccggcggcgacaaccagcuccuccucuacgagcucuccuccaucaucaagaucgccaccaaggccgacggcuucgcccucuacuuccucggcgagugcaacaacucccucugcaucuucaccccccccggcaucaaggagggcaagccccgccucauccccgccggccccaucacccagggcaccaccgucuccgccuacgucgccaagucccgcaagacccuccucgucgaggacauccucggcgacgagcgcuucccccgcggcaccggccucgaguccggcacccgcauccaguccguccucugccuccccaucgucaccgccaucggcgaccucaucggcauccucgagcucuaccgccacuggggcaaggaggccuucugccucucccaccaggaggucgccaccgccaaccucgccugggccuccgucgccauccaccagguccaggucugccgcggccucgccaagcagaccgagcucaacgacuuccuccucgacgucuccaagaccuacuucgacaacaucgucgccaucgacucccuccucgagcacaucaugaucuacgccaagaaccucgucaacgccgaccgcugcgcccucuuccaggucgaccacaagaacaaggagcucuacuccgaccucuucgacaucggcgaggagaaggagggcaagcccgucuucaagaagaccaaggagauccgcuucuccaucgagaagggcaucgccggccaggucgcccgcaccggcgagguccucaacauccccgacgccuacgccgacccccgcuucaaccgcgaggucgaccucuacaccggcuacaccacccgcaacauccucugcaugcccaucgucucccgcggcuccgucaucggcgucguccagauggucaacaagaucuccggcuccgccuucuccaagaccgacgagaacaacuucaagauguucgccgucuucugcgcccucgcccuccacugcgccaacauguaccaccgcauccgccacuccgagugcaucuaccgcgucaccauggagaagcucuccuaccacuccaucugcaccuccgaggaguggcagggccucaugcaguucacccuccccguccgccucugcaaggagaucgagcucuuccacuucgacaucggccccuucgagaacauguggcccggcaucuucgucuacaugguccaccgcuccugcggcaccuccugcuucgagcucgagaagcucugccgcuucaucauguccgucaagaagaacuaccgccgcguccccuaccacaacuggaagcacgccgucaccgucgcccacugcauguacgccauccuccagaacaaccacacccucuucaccgaccucgagcgcaagggccuccucaucgccugccucugccacgaccucgaccaccgcggcuucuccaacuccuaccuccagaaguucgaccacccccucgccgcccucuacuccaccuccaccauggagcagcaccacuucucccagaccgucuccauccuccagcucgagggccacaacaucuucuccacccucuccuccuccgaguacgagcagguccucgagaucauccgcaaggccaucaucgccaccgaccucgcccucuacuucggcaaccgcaagcagcucgaggagauguaccagaccggcucccucaaccucaacaaccagucccaccgcgaccgcgucaucggccucaugaugaccgccugcgaccucugcuccgucaccaagcucuggcccgucaccaagcucaccgccaacgacaucuacgccgaguucugggccgagggcgacgagaugaagaagcucggcauccagcccauccccaugauggaccgcgacaagaaggacgaggucccccagggccagcucggcuucuacaacgccgucgccauccccugcuacaccacccucacccagauccucccccccaccgagccccuccucaaggccugccgcgacaaccucucccagugggagaaggucauccgcggcgaggagaccgccaccuggaucuccucccccuccgucgcccagaaggccgccgccuccgaggacuga

SEQ ID NO: 47418 - RNA, 1470 nt, Artificial Sequence
  derived and/or modified sequence opt2 from PDE11A__Homo_sapiens__NP_001070664
augucccccaagugcuccgccgacgccgagaacuccuucaaggaguccauggagaaguccuccuacuccgacuggcucaucaacaacuccaucgccgagcucgucgccuccaccggccuccccgucaacaucuccgacgccuaccaggacccccgcuucgacgccgaggccgaccagaucuccggcuuccacauccgcuccguccucugcguccccaucuggaacuccaaccaccagaucaucggcgucgcccagguccucaaccgccucgacggcaagcccuucgacgacgccgaccagcgccucuucgaggccuucgucaucuucugcggccucggcaucaacaacaccaucauguacgaccaggucaagaaguccugggccaagcaguccgucgcccucgacguccucuccuaccacgccaccugcuccaaggccgaggucgacaaguucaaggccgccaacaucccccucgucuccgagcucgccaucgacgacauccacuucgacgacuucucccucgacgucgacgccaugaucaccgccgcccuccgcauguucauggagcucggcaugguccagaaguucaagaucgacuacgagacccucugccgcuggcuccucaccguccgcaagaacuaccgcaugguccucuaccacaacuggcgccacgccuucaacgucugccagcucauguucgccaugcucaccaccgccggcuuccaggacauccucaccgaggucgagauccucgccgucaucgucggcugccucugccacgaccucgaccaccgcggcaccaacaacgccuuccaggccaaguccggcuccgcccucgcccagcucuacggcaccuccgccacccucgagcaccaccacuucaaccacgccgucaugauccuccaguccgagggccacaacaucuucgccaaccucuccuccaaggaguacuccgaccucaugcagcuccucaagcaguccauccucgccaccgaccucacccucuacuucgagcgccgcaccgaguucuucgagcucgucuccaagggcgaguacgacuggaacaucaagaaccaccgcgacaucuuccgcuccaugcucaugaccgccugcgaccucggcgccgucaccaagcccugggagaucucccgccaggucgccgagcucgucaccuccgaguucuucgagcagggcgaccgcgagcgccucgagcucaagcucacccccuccgccaucuucgaccgcaaccgcaaggacgagcucccccgccuccagcucgaguggaucgacuccaucugcaugccccucuaccaggcccucgucaaggucaacgucaagcucaagcccaugcucgacuccgucgccaccaaccgcuccaagugggaggagcuccaccagaagcgccuccucgccuccaccgccuccuccucccccgccuccgucauggucgccaaggaggaccgcaacuga

SEQ ID NO: 47419 - RNA, 1830 nt, Artificial Sequence
  derived and/or modified sequence opt2 from PDE12__Homo_sapiens__NP_808881
auguggcgccuccccggcgcccgcgccgcccuccgcgucauccgcaccgccgucgagaagcucucccgcgccgaggccggcucccagaccgccgccggcgccauggagcgcgccgucguccgcugcguccccuccgagcccaagcucucccucuccuucgcccucgccgacggcucccacaagaacaugcagcgcgaccaguccgagccccucggccgcguccucucccgcaucgccaccaacgcccucaagggccacgccaaggccgccgccgccaagaagucccgcaagucccgccccaacgccuccggcggcgccgccugcuccggccccggccccgagcccgccgucuucugcgagcccgucgucaagcucuacuaccgcgaggaggccgucgccgaggacguccucaacgucgacgccuggcaggacggcgccguccuccagaucggcgacgucaaguacaaggucgagcgcaacccccccgccuucaccgagcuccagcucccccgcuacaucauggccggcuuccccgucugccccaagcucucccucgaguucggcgaccccgccuccucccucuuccgcugguacaaggaggccaagcccggcgccgccgagcccgaggucggcguccccuccucccucucccccuccucccccuccuccuccuggaccgagaccgacgucgaggagcgcgucuacacccccuccaacgccgacaucggccuccgccucaagcuccacugcacccccggcgacggccagcgcuucggccacucccgcgagcucgaguccgucugcgucgucgaggccggccccggcaccugcaccuucgaccaccgccaccucuacaccaagaaggucaccgaggacgcccucauccgcaccgucuccuacaacauccucgccgacaccuacgcccagaccgaguucucccgcaccguccucuaccccuacugcgcccccuacgcccucgagcucgacuaccgccagaaccucauccagaaggagcucaccggcuacaacgccgacgucaucugccuccaggaggucgaccgcgccgucuucuccgacucccucguccccgcccucgaggccuucggccucgagggcgucuuccgcaucaagcagcacgagggccucgccaccuucuaccgcaaguccaaguucucccuccucucccagcacgacaucuccuucuacgaggcccucgaguccgacccccuccacaaggagcuccucgagaagcucguccucuaccccuccgcccaggagaagguccuccagcgcuccuccguccuccaggucuccguccuccaguccaccaaggacuccuccaagcgcaucugcgucgccaacacccaccucuacuggcaccccaagggcggcuacauccgccucauccagauggccgucgcccucgcccacauccgccacgucuccugcgaccucuaccccggcauccccgucaucuucugcggcgacuucaacuccacccccuccaccggcauguaccacuucgucaucaacggcuccauccccgaggaccacgaggacugggccuccaacggcgaggaggagcgcugcaacaugucccucacccacuucuucaagcucaaguccgccugcggcgagcccgccuacaccaacuacgucggcggcuuccacggcugccucgacuacaucuucaucgaccucaacgcccucgaggucgagcaggucaucccccuccccucccacgaggaggucaccacccaccaggcccuccccuccgucucccaccccuccgaccacaucgcccucgucugcgaccucaaguggaaguga

SEQ ID NO: 47420 - RNA, 1608 nt, Artificial Sequence
  derived and/or modified sequence opt2 from PDE1A__Homo_sapiens__NP_001003683
augggcuccuccgccaccgagaucgaggagcucgagaacaccaccuucaaguaccucaccggcgagcagaccgagaagauguggcagcgccucaagggcauccuccgcugccucgucaagcagcucgagcgcggcgacgucaacgucgucgaccucaagaagaacaucgaguacgccgccuccguccucgaggccgucuacaucgacgagacccgccgccuccucgacaccgaggacgagcucuccgacauccagaccgacuccguccccuccgagguccgcgacuggcucgccuccaccuucacccgcaagaugggcaugaccaagaagaagcccgaggagaagcccaaguuccgcuccaucguccacgccguccaggccggcaucuucgucgagcgcauguaccgcaagaccuaccacauggucggccucgccuaccccgccgccgucaucgucacccucaaggacgucgacaagugguccuucgacgucuucgcccucaacgaggccuccggcgagcacucccucaaguucaugaucuacgagcucuucacccgcuacgaccucaucaaccgcuucaagauccccgucuccugccucaucaccuucgccgaggcccucgaggucggcuacuccaaguacaagaaccccuaccacaaccucauccacgccgccgacgucacccagaccguccacuacaucaugcuccacaccggcaucaugcacuggcucaccgagcucgagauccucgccauggucuucgccgccgccauccacgacuacgagcacaccggcaccaccaacaacuuccacauccagacccgcuccgacgucgccauccucuacaacgaccgcuccguccucgagaaccaccacgucuccgccgccuaccgccucaugcaggaggaggagaugaacauccucaucaaccucuccaaggacgacuggcgcgaccuccgcaaccucgucaucgagaugguccucuccaccgacauguccggccacuuccagcagaucaagaacauccgcaacucccuccagcagcccgagggcaucgaccgcgccaagaccaugucccucauccuccacgccgccgacaucucccaccccgccaaguccuggaagcuccacuaccgcuggaccauggcccucauggaggaguucuuccuccagggcgacaaggaggccgagcucggccuccccuucuccccccucugcgaccgcaaguccaccauggucgcccagucccagaucggcuucaucgacuucaucgucgagcccaccuucucccuccucaccgacuccaccgagaagaucgucaucccccucaucgaggaggccuccaaggccgagaccuccuccuacgucgccuccuccuccaccaccaucgucggccuccacaucgccgacgcccuccgccgcuccaacaccaagggcuccauguccgacggcuccuacucccccgacuacucccucgccgccgucgaccucaaguccuucaagaacaaccucgucgacaucauccagcagaacaaggagcgcuggaaggagcucgccgcccaggaggcccgcaccuccucccagaagugcgaguucauccaccaguga

SEQ ID NO: 47421 - RNA, 1611 nt, Artificial Sequence
  derived and/or modified sequence opt2 from PDE1B__Homo_sapiens__NP_000915
auggagcucuccccccgcuccccccccgagaugcucgaggaguccgacugccccuccccccucgagcucaaguccgcccccuccaagaagauguggaucaagcuccgcucccuccuccgcuacauggucaagcagcucgagaacggcgagaucaacaucgaggagcucaagaagaaccucgaguacaccgccucccuccucgaggccgucuacaucgacgagacccgccagauccucgacaccgaggacgagcuccaggagcuccgcuccgacgccguccccuccgagguccgcgacuggcucgccuccaccuucacccagcaggcccgcgccaagggccgccgcgccgaggagaagcccaaguuccgcuccaucguccacgccguccaggccggcaucuucgucgagcgcauguuccgccgcaccuacaccuccgucggccccaccuacuccaccgccguccucaacugccucaagaaccucgaccucuggugcuucgacgucuucucccucaaccaggccgccgacgaccacgcccuccgcaccaucgucuucgagcuccucacccgccacaaccucaucucccgcuucaagauccccaccgucuuccucauguccuuccucgacgcccucgagaccggcuacggcaaguacaagaaccccuaccacaaccagauccacgccgccgacgucacccagaccguccacugcuuccuccuccgcaccggcaugguccacugccucuccgagaucgagcuccucgccaucaucuucgccgccgccauccacgacuacgagcacaccggcaccaccaacuccuuccacauccagaccaaguccgagugcgccaucgucuacaacgaccgcuccguccucgagaaccaccacaucuccuccgucuuccgccucaugcaggacgacgagaugaacaucuucaucaaccucaccaaggacgaguucgucgagcuccgcgcccucgucaucgagaugguccucgccaccgacauguccugccacuuccagcaggucaagaccaugaagaccgcccuccagcagcucgagcgcaucgacaagcccaaggcccucucccuccuccuccacgccgccgacaucucccaccccaccaagcaguggcucguccacucccgcuggaccaaggcccucauggaggaguucuuccgccagggcgacaaggaggccgagcucggccuccccuucuccccccucugcgaccgcaccuccacccucgucgcccagucccagaucggcuucaucgacuucaucgucgagcccaccuucuccguccucaccgacgucgccgagaaguccguccagccccucgccgacgaggacuccaaguccaagaaccagcccuccuuccaguggcgccagcccucccucgacgucgaggucggcgaccccaaccccgacgucgucuccuuccgcuccaccugggucaagcgcauccaggagaacaagcagaaguggaaggagcgcgccgccuccggcaucaccaaccagauguccaucgacgagcucucccccugcgaggaggaggccccccccucccccgccgaggacgagcacaaccagaacggcaaccucgacuga

SEQ ID NO: 47422 - RNA, 2130 nt, Artificial Sequence
  derived and/or modified sequence opt2 from PDE1C__Homo_sapiens__NP_001177986
auggagucccccaccaaggagaucgaggaguucgaguccaacucccucaaguaccuccagcccgagcagaucgagaagaucuggcuccgccuccgcggccuccgcaaguacaagaagaccucccagcgccuccgcucccucgucaagcagcucgagcgcggcgaggccuccgucgucgaccucaagaagaaccucgaguacgccgccaccguccucgaguccgucuacaucgacgagacccgccgccuccucgacaccgaggacgagcucuccgacauccaguccgacgccguccccuccgagguccgcgacuggcucgccuccaccuucacccgccagaugggcaugaugcuccgccgcuccgacgagaagccccgcuucaaguccaucguccacgccguccaggccggcaucuucgucgagcgcauguaccgccgcaccuccaacauggucggccucuccuacccccccgccgucaucgaggcccucaaggacgucgacaagugguccuucgacgucuucucccucaacgaggccuccggcgaccacgcccucaaguucaucuucuacgagcuccucacccgcuacgaccucaucucccgcuucaagauccccaucuccgcccucgucuccuucgucgaggcccucgaggucggcuacuccaagcacaagaaccccuaccacaaccucaugcacgccgccgacgucacccagaccguccacuaccuccucuacaagaccggcgucgccaacuggcucaccgagcucgagaucuucgccaucaucuucuccgccgccauccacgacuacgagcacaccggcaccaccaacaacuuccacauccagacccgcuccgaccccgccauccucuacaacgaccgcuccguccucgagaaccaccaccucuccgccgccuaccgccuccuccaggacgacgaggagaugaacauccucaucaaccucuccaaggacgacuggcgcgaguuccgcacccucgucaucgagauggucauggccaccgacauguccugccacuuccagcagaucaaggccaugaagaccgcccuccagcagcccgaggccaucgagaagcccaaggcccucucccucaugcuccacaccgccgacaucucccaccccgccaaggccugggaccuccaccaccgcuggaccaugucccuccucgaggaguucuuccgccagggcgaccgcgaggccgagcucggccuccccuucuccccccucugcgaccgcaaguccaccauggucgcccagucccaggucggcuucaucgacuucaucgucgagcccaccuucaccguccucaccgacaugaccgagaagaucgucuccccccucaucgacgagaccucccagaccggcggcaccggccagcgccgcuccucccucaacuccaucuccuccuccgacgccaagcgcuccggcgucaagaccuccggcuccgagggcuccgcccccaucaacaacuccgucaucuccgucgacuacaaguccuucaaggccaccuggaccgaggucguccacaucaaccgcgagcgcuggcgcgccaagguccccaaggaggagaaggccaagaaggaggccgaggagaaggcccgccucgccgccgaggagcagcagaaggagauggaggccaagucccaggccgaggagggcgccuccggcaaggccgagaagaagaccuccggcgagaccaagaaccaggucaacggcacccgcgccaacaaguccgacaacccccgcggcaagaacuccaaggccgagaaguccuccggcgagcagcagcagaacggcgacuucaaggacggcaagaacaagaccgacaagaaggaccacuccaacaucggcaacgacuccaagaagaccgacggcaccaagcagcgcucccacggcucccccgcccccuccaccuccuccaccugccgccucacccuccccgucaucaagcccccccuccgccacuucaagcgccccgccuacgccuccuccuccuacgcccccuccgucuccaagaagaccgacgagcaccccgcccgcuacaagaugcucgaccagcgcaucaagaugaagaagauccagaacaucucccacaacuggaaccgcaaguga

SEQ ID NO: 47423 - RNA, 2805 nt, Artificial Sequence
  derived and/or modified sequence opt2 from PDE2A__Homo_sapiens__NP_001137311
augguccucguccuccaccacauccucaucgccgucguccaguuccuccgccgcggccagcaggucuuccucaagcccgacgagccccccccccccccccagcccugcgccgacucccuccaggacgcccuccucucccucggcuccgucaucgacaucuccggccuccagcgcgccgucaaggaggcccucuccgccguccucccccgcgucgagaccgucuacaccuaccuccucgacggcgagucccagcucgucugcgaggaccccccccacgagcucccccaggagggcaagguccgcgaggccaucaucucccagaagcgccucggcugcaacggccucggcuucuccgaccuccccggcaagccccucgcccgccucgucgccccccucgcccccgacacccagguccucgucaugccccucgccgacaaggaggccggcgccgucgccgccgucauccucguccacugcggccagcucuccgacaacgaggaguggucccuccaggccgucgagaagcacacccucgucgcccuccgccgcguccagguccuccagcagcgcggcccccgcgaggccccccgcgccguccagaacccccccgagggcaccgccgaggaccagaagggcggcgccgccuacaccgaccgcgaccgcaagauccuccagcucugcggcgagcucuacgaccucgacgccuccucccuccagcucaagguccuccaguaccuccagcaggagacccgcgccucccgcugcugccuccuccucgucuccgaggacaaccuccagcucuccugcaaggucaucggcgacaagguccucggcgaggaggucuccuucccccucaccggcugccucggccaggucgucgaggacaagaaguccauccagcucaaggaccucaccuccgaggacguccagcagcuccaguccaugcucggcugcgagcuccaggccaugcucugcguccccgucaucucccgcgccaccgaccaggucgucgcccucgccugcgccuucaacaagcucgagggcgaccucuucaccgacgaggacgagcacgucauccagcacugcuuccacuacaccuccaccguccucaccuccacccucgccuuccagaaggagcagaagcucaagugcgagugccaggcccuccuccaggucgccaagaaccucuucacccaccucgacgacgucuccguccuccuccaggagaucaucaccgaggcccgcaaccucuccaacgccgagaucugcuccgucuuccuccucgaccagaacgagcucgucgccaaggucuucgacggcggcgucgucgacgacgaguccuacgagauccgcauccccgccgaccagggcaucgccggccacgucgccaccaccggccagauccucaacauccccgacgccuacgcccacccccucuucuaccgcggcgucgacgacuccaccggcuuccgcacccgcaacauccucugcuuccccaucaagaacgagaaccaggaggucaucggcgucgccgagcucgucaacaagaucaacggccccugguucuccaaguucgacgaggaccucgccaccgccuucuccaucuacugcggcaucuccaucgcccacucccuccucuacaagaaggucaacgaggcccaguaccgcucccaccucgccaacgagaugaugauguaccacaugaaggucuccgacgacgaguacaccaagcuccuccacgacggcauccagcccgucgccgccaucgacuccaacuucgccuccuucaccuacaccccccgcucccuccccgaggacgacaccuccauggccauccucuccaugcuccaggacaugaacuucaucaacaacuacaagaucgacugccccacccucgcccgcuucugccucauggucaagaagggcuaccgcgacccccccuaccacaacuggaugcacgccuucuccgucucccacuucugcuaccuccucuacaagaaccucgagcucaccaacuaccucgaggacaucgagaucuucgcccucuucaucuccugcaugugccacgaccucgaccaccgcggcaccaacaacuccuuccaggucgccuccaaguccguccucgccgcccucuacuccuccgagggcuccgucauggagcgccaccacuucgcccaggccaucgccauccucaacacccacggcugcaacaucuucgaccacuucucccgcaaggacuaccagcgcaugcucgaccucaugcgcgacaucauccucgccaccgaccucgcccaccaccuccgcaucuucaaggaccuccagaagauggccgaggucggcuacgaccgcaacaacaagcagcaccaccgccuccuccucugccuccucaugaccuccugcgaccucuccgaccagaccaagggcuggaagaccacccgcaagaucgccgagcucaucuacaaggaguucuucucccagggcgaccucgagaaggccaugggcaaccgccccauggagaugauggaccgcgagaaggccuacauccccgagcuccagaucuccuucauggagcacaucgccaugcccaucuacaagcuccuccaggaccucuuccccaaggccgccgagcucuacgagcgcgucgccuccaaccgcgagcacuggaccaaggucucccacaaguucaccauccgcggccuccccuccaacaacucccucgacuuccucgacgaggaguacgagguccccgaccucgacggcacccgcgcccccaucaacggcugcugcucccucgacgccgaguga

SEQ ID NO: 47424 - RNA, 3426 nt, Artificial Sequence
  derived and/or modified sequence opt2 from PDE3A__Homo_sapiens__NP_000912
auggccguccccggcgacgccgcccgcguccgcgacaagcccguccacuccggcgucucccaggcccccaccgccggccgcgacugccaccaccgcgccgaccccgccuccccccgcgacuccggcugccgcggcugcuggggcgaccucguccuccagccccuccgcuccucccgcaagcucuccuccgcccucugcgccggcucccucuccuuccuccucgcccuccucguccgccucguccgcggcgaggucggcugcgaccucgagcagugcaaggaggccgccgccgccgaggaggaggaggccgcccccggcgccgagggcggcgucuuccccggcccccgcggcggcgcccccggcggcggcgcccgccucucccccuggcuccagcccuccgcccuccucuucucccuccucugcgccuucuucuggaugggccucuaccuccuccgcgccggcguccgccucccccucgccgucgcccuccucgccgccugcugcggcggcgaggcccucguccagaucggccucggcgucggcgaggaccaccuccucucccuccccgccgccggcgucguccucuccugccucgccgccgccaccuggcucguccuccgccuccgccucggcguccucaugaucgcccucaccuccgccguccgcaccgucucccucaucucccucgagcgcuucaaggucgccuggcgccccuaccucgccuaccucgccggcguccucggcauccuccucgcccgcuacgucgagcagauccucccccaguccgccgaggccgccccccgcgagcaccucggcucccagcucaucgccggcaccaaggaggacauccccgucuucaagcgccgccgccgcuccuccuccgucgucuccgccgagauguccggcugcuccuccaagucccaccgccgcaccucccuccccugcaucccccgcgagcagcucaugggccacuccgagugggaccacaagcgcggcccccgcggcucccaguccuccggcaccuccaucaccgucgacaucgccgucaugggcgaggcccacggccucaucaccgaccuccucgccgaccccucccucccccccaacgucugcaccucccuccgcgccgucuccaaccuccucuccacccagcucaccuuccaggccauccacaagccccgcgucaaccccgucaccucccucuccgagaacuacaccugcuccgacuccgaggaguccuccgagaaggacaagcucgccauccccaagcgccuccgccgcucccucccccccggccuccuccgccgcgucuccuccaccuggaccaccaccaccuccgccaccggccuccccacccucgagcccgcccccguccgccgcgaccgcuccaccuccaucaagcuccaggaggcccccuccuccucccccgacuccuggaacaaccccgucaugaugacccucaccaagucccgcuccuucaccuccuccuacgccaucuccgccgccaaccacgucaaggccaagaagcagucccgccccggcgcccucgccaagaucuccccccucuccucccccugcuccuccccccuccagggcacccccgccuccucccucgucuccaagaucuccgccguccaguuccccgaguccgccgacaccaccgccaagcagucccucggcucccaccgcgcccucaccuacacccaguccgcccccgaccucuccccccagauccucaccccccccgucaucugcuccuccugcggccgccccuacucccagggcaaccccgccgacgagccccucgagcgcuccggcgucgccacccgcacccccucccgcaccgacgacaccgcccaggucaccuccgacuacgagaccaacaacaacuccgacuccuccgacaucguccagaacgaggacgagaccgagugccuccgcgagccccuccgcaaggccuccgccugcuccaccuacgcccccgagaccaugauguuccucgacaagcccauccucgcccccgagccccucgucauggacaaccucgacuccaucauggagcagcucaacaccuggaacuuccccaucuucgaccucgucgagaacaucggccgcaagugcggccgcauccucucccaggucuccuaccgccucuucgaggacaugggccucuucgaggccuucaagauccccauccgcgaguucaugaacuacuuccacgcccucgagaucggcuaccgcgacauccccuaccacaaccgcauccacgccaccgacguccuccacgccgucugguaccucaccacccagcccauccccggccucuccaccgucaucaacgaccacggcuccaccuccgacuccgacuccgacuccggcuucacccacggccacaugggcuacgucuucuccaagaccuacaacgucaccgacgacaaguacggcugccucuccggcaacauccccgcccucgagcucauggcccucuacgucgccgccgccaugcacgacuacgaccaccccggccgcaccaacgccuuccucgucgccaccuccgccccccaggccguccucuacaacgaccgcuccguccucgagaaccaccacgccgccgccgccuggaaccucuucaugucccgccccgaguacaacuuccucaucaaccucgaccacgucgaguucaagcacuuccgcuuccucgucaucgaggccauccucgccaccgaccucaagaagcacuucgacuucgucgccaaguucaacggcaaggucaacgacgacgucggcaucgacuggaccaacgagaacgaccgccuccucgucugccagaugugcaucaagcucgccgacaucaacggccccgccaagugcaaggagcuccaccuccaguggaccgacggcaucgucaacgaguucuacgagcagggcgacgaggaggccucccucggccuccccaucucccccuucauggaccgcuccgccccccagcucgccaaccuccaggaguccuucaucucccacaucgucggcccccucugcaacuccuacgacuccgccggccucaugcccggcaagugggucgaggacuccgacgaguccggcgacaccgacgaccccgaggaggaggaggaggaggcccccgcccccaacgaggaggagaccugcgagaacaacgagucccccaagaagaagaccuucaagcgccgcaagaucuacugccagaucacccagcaccuccuccagaaccacaagauguggaagaaggucaucgaggaggagcagcgccucgccggcaucgagaaccagucccucgaccagaccccccagucccacuccuccgagcagauccaggccaucaaggaggaggaggaggagaagggcaagccccgcggcgaggagauccccacccagaagcccgaccaguga

SEQ ID NO: 47425 - RNA, 3339 nt, Artificial Sequence
  derived and/or modified sequence opt2 from PDE3B__Homo_sapiens__NP_000913
augcgccgcgacgagcgcgacgccaaggccaugcgcucccuccagccccccgacggcgccggcuccccccccgagucccuccgcaacggcuacgucaaguccugcgucuccccccuccgccaggaccccccccgcggcuucuucuuccaccucugccgcuucugcaacgucgagcuccgccccccccccgccuccccccagcagccccgccgcugcucccccuucugccgcgcccgccucucccucggcgcccucgccgccuucguccucgcccuccuccucggcgccgagcccgaguccugggccgccggcgccgccuggcuccgcacccuccucuccgucugcucccacucccucuccccccucuucuccaucgccugcgccuucuucuuccucaccugcuuccucacccgcaccaagcgcggccccggccccggccgcuccugcggcuccugguggcuccucgcccuccccgccugcugcuaccucggcgacuuccucgucuggcaguggugguccuggcccuggggcgacggcgacgccggcuccgccgccccccacaccccccccgaggccgccgccggccgccuccuccucguccucuccugcgucggccuccuccucacccucgcccacccccuccgccuccgccacugcguccucguccuccuccucgccuccuucgucuggugggucuccuucaccucccucggcucccuccccuccgcccuccgcccccuccucuccggccucgucggcggcgccggcugccuccucgcccucggccucgaccacuucuuccagauccgcgaggccccccuccacccccgccucuccuccgccgccgaggagaagguccccgucauccgcccccgccgccgcuccuccugcgucucccucggcgagaccgccgccuccuacuacggcuccugcaagaucuuccgccgccccucccuccccugcaucucccgcgagcagaugauccucugggacugggaccucaagcagugguacaagccccacuaccagaacuccggcggcggcaacggcgucgaccucuccguccucaacgaggcccgcaacauggucuccgaccuccucaccgaccccucccuccccccccaggucaucuccucccuccgcuccaucuccucccucaugggcgccuucuccggcuccugccgccccaagaucaacccccucacccccuuccccggcuucuaccccugcuccgagaucgaggaccccgccgagaagggcgaccgcaagcucaacaagggccucaaccgcaacucccuccccaccccccagcuccgccgcuccuccggcaccuccggccuccuccccgucgagcaguccucccgcugggaccgcaacaacggcaagcgcccccaccaggaguucggcaucuccucccagggcugcuaccucaacggccccuucaacuccaaccuccucaccauccccaagcagcgcuccuccuccgucucccucacccaccacgucggccuccgccgcgccggcguccucuccucccucucccccgucaacuccuccaaccacggccccgucuccaccggcucccucaccaaccgcucccccaucgaguuccccgacaccgccgacuuccucaacaagcccuccgucauccuccagcgcucccucggcaacgcccccaacacccccgacuucuaccagcagcuccgcaacuccgacuccaaccucugcaacuccugcggccaccagaugcucaaguacgucuccaccuccgaguccgacggcaccgacugcugcuccggcaaguccggcgaggaggagaacaucuucuccaaggaguccuucaagcucauggagacccagcaggaggaggagaccgagaagaaggacucccgcaagcucuuccaggagggcgacaaguggcucaccgaggaggcccaguccgagcagcagaccaacaucgagcaggaggucucccucgaccucauccucgucgaggaguacgacucccucaucgagaagauguccaacuggaacuuccccaucuucgagcucgucgagaagaugggcgagaaguccggccgcauccucucccaggucauguacacccucuuccaggacaccggccuccucgagaucuucaagauccccacccagcaguucaugaacuacuuccgcgcccucgagaacggcuaccgcgacauccccuaccacaaccgcauccacgccaccgacguccuccacgccgucugguaccucaccacccgccccguccccggccuccagcagauccacaacggcugcggcaccggcaacgagaccgacuccgacggccgcaucaaccacggccgcaucgccuacaucuccuccaaguccugcuccaaccccgacgaguccuacggcugccucuccuccaacauccccgcccucgagcucauggcccucuacgucgccgccgccaugcacgacuacgaccaccccggccgcaccaacgccuuccucgucgccaccaacgccccccaggccguccucuacaacgaccgcuccguccucgagaaccaccacgccgccuccgccuggaaccucuaccucucccgccccgaguacaacuuccuccuccaccucgaccacgucgaguucaagcgcuuccgcuuccucgucaucgaggccauccucgccaccgaccucaagaagcacuucgacuuccucgccgaguucaacgccaaggccaacgacgucaacuccaacggcaucgagugguccaacgagaacgaccgccuccucgucugccaggucugcaucaagcucgccgacaucaacggccccgccaagguccgcgaccuccaccucaaguggaccgagggcaucgucaacgaguucuacgagcagggcgacgaggaggccaaccucggccuccccaucucccccuucauggaccgcuccuccccccagcucgccaagcuccaggaguccuucaucacccacaucgucggcccccucugcaacuccuacgacgccgccggccuccuccccggccaguggcucgaggccgaggaggacaacgacaccgaguccggcgacgacgaggacggcgaggagcucgacaccgaggacgaggagauggagaacaaccucaaccccaagcccccccgccgcaagucccgccgccgcaucuucugccagcucaugcaccaccucaccgagaaccacaagaucuggaaggagaucgucgaggaggaggagaagugcaaggccgacggcaacaagcuccaggucgagaacuccucccucccccaggccgacgagauccaggucaucgaggaggccgacgaggaggaguga

SEQ ID NO: 47426 - RNA, 2661 nt, Artificial Sequence
  derived and/or modified sequence opt2 from PDE4A__Homo_sapiens__NP_001104777
auggagccccccaccguccccuccgagcgcucccucucccucucccuccccggcccccgcgagggccaggccacccucaagccccccccccagcaccucuggcgccagccccgcacccccauccgcauccagcagcgcggcuacuccgacuccgccgagcgcgccgagcgcgagcgccagccccaccgccccaucgagcgcgccgacgccauggacaccuccgaccgccccggccuccgcaccacccgcauguccuggcccuccuccuuccacggcaccggcaccggcuccggcggcgccggcggcggcuccucccgccgcuucgaggccgagaacggccccacccccucccccggccgcuccccccucgacucccaggccucccccggccucguccuccacgccggcgccgccaccucccagcgccgcgaguccuuccucuaccgcuccgacuccgacuacgacaugucccccaagaccaugucccgcaacuccuccgucaccuccgaggcccacgccgaggaccucaucgucacccccuucgcccagguccucgccucccuccgcuccguccgcuccaacuucucccuccucaccaacguccccguccccuccaacaagcgcuccccccucggcggccccacccccgucugcaaggccacccucuccgaggagaccugccagcagcucgcccgcgagacccucgaggagcucgacuggugccucgagcagcucgagaccaugcagaccuaccgcuccgucuccgagauggccucccacaaguucaagcgcaugcucaaccgcgagcucacccaccucuccgagaugucccgcuccggcaaccaggucuccgaguacaucuccaccaccuuccucgacaagcagaacgaggucgagauccccucccccaccaugaaggagcgcgagaagcagcaggccccccgcccccgccccucccagcccccccccccccccgucccccaccuccagcccaugucccagaucaccggccucaagaagcucaugcacuccaacucccucaacaacuccaacaucccccgcuucggcgucaagaccgaccaggaggagcuccucgcccaggagcucgagaaccucaacaaguggggccucaacaucuucugcgucuccgacuacgccggcggccgcucccucaccugcaucauguacaugaucuuccaggagcgcgaccuccucaagaaguuccgcauccccgucgacaccauggucaccuacaugcucacccucgaggaccacuaccacgccgacgucgccuaccacaacucccuccacgccgccgacguccuccaguccacccacguccuccucgccacccccgcccucgacgccgucuucaccgaccucgagauccucgccgcccucuucgccgccgccauccacgacgucgaccaccccggcgucuccaaccaguuccucaucaacaccaacuccgagcucgcccucauguacaacgacgaguccguccucgagaaccaccaccucgccgucggcuucaagcuccuccaggaggacaacugcgacaucuuccagaaccucuccaagcgccagcgccagucccuccgcaagauggucaucgacaugguccucgccaccgacauguccaagcacaugacccuccucgccgaccucaagaccauggucgagaccaagaaggucaccuccuccggcguccuccuccucgacaacuacuccgaccgcauccagguccuccgcaacaugguccacugcgccgaccucuccaaccccaccaagccccucgagcucuaccgccaguggaccgaccgcaucauggccgaguucuuccagcagggcgaccgcgagcgcgagcgcggcauggagaucucccccaugugcgacaagcacaccgccuccgucgagaagucccaggucggcuucaucgacuacaucguccacccccucugggagaccugggccgaccucguccaccccgacgcccaggagauccucgacacccucgaggacaaccgcgacugguacuacuccgccauccgccagucccccucccccccccccgaggaggagucccgcggccccggccaccccccccuccccgacaaguuccaguucgagcucacccucgaggaggaggaggaggaggagaucuccauggcccagauccccugcaccgcccaggaggcccucaccgcccagggccucuccggcgucgaggaggcccucgacgccaccaucgccugggaggccucccccgcccaggagucccucgaggucauggcccaggaggccucccucgaggccgagcucgaggccgucuaccucacccagcaggcccaguccaccggcuccgcccccgucgcccccgacgaguucuccucccgcgaggaguucgucgucgccgucucccacuccucccccuccgcccucgcccuccaguccccccuccuccccgccuggcgcacccucuccgucuccgagcacgcccccggccuccccggccuccccuccaccgccgccgaggucgaggcccagcgcgagcaccaggccgccaagcgcgccugcuccgccugcgccggcaccuucggcgaggacaccuccgcccuccccgcccccggcggcggcggcuccggcggcgaccccaccuga

SEQ ID NO: 47427 - RNA, 2430 nt, Artificial Sequence
  derived and/or modified sequence opt2 from PDE4D__Homo_sapiens__NP_001098101
auggaggccgagggcuccuccgcccccgcccgcgccggcuccggcgagggcuccgacuccgccggcggcgccacccucaaggcccccaagcaccucuggcgccacgagcagcaccaccaguacccccuccgccagccccaguuccgccuccuccacccccaccaccaccucccccccccccccccccccuccccccagccccagccccagugcccccuccagcccccccccccccccccccuccccccccccccccccccccccggcgccgcccgcggccgcuacgccuccuccggcgccaccggccgcguccgccaccgcggcuacuccgacaccgagcgcuaccucuacugccgcgccauggaccgcaccuccuacgccgucgagaccggccaccgccccggccucaagaagucccgcauguccuggcccuccuccuuccagggccuccgccgcuucgacgucgacaacggcaccuccgccggccgcuccccccucgaccccaugaccucccccggcuccggccucauccuccaggccaacuucguccacucccagcgccgcgaguccuuccucuaccgcuccgacuccgacuacgaccucucccccaaguccaugucccgcaacuccuccaucgccuccgacauccacggcgacgaccucaucgucacccccuucgcccagguccucgccucccuccgcaccguccgcaacaacuucgccgcccucaccaaccuccaggaccgcgcccccuccaagcgcucccccaugugcaaccagcccuccaucaacaaggccaccaucaccgaggaggccuaccagaagcucgccuccgagacccucgaggagcucgacuggugccucgaccagcucgagacccuccagacccgccacuccgucuccgagauggccuccaacaaguucaagcgcaugcucaaccgcgagcucacccaccucuccgagaugucccgcuccggcaaccaggucuccgaguucaucuccaacaccuuccucgacaagcagcacgaggucgagauccccucccccacccagaaggagaaggagaagaagaagcgccccaugucccagaucuccggcgucaagaagcucaugcacuccuccucccucaccaacuccuccaucccccgcuucggcgucaagaccgagcaggaggacguccucgccaaggagcucgaggacgucaacaaguggggccuccacgucuuccgcaucgccgagcucuccggcaaccgcccccucaccgucaucaugcacaccaucuuccaggagcgcgaccuccucaagaccuucaagauccccgucgacacccucaucaccuaccucaugacccucgaggaccacuaccacgccgacgucgccuaccacaacaacauccacgccgccgacgucguccaguccacccacguccuccucuccacccccgcccucgaggccgucuucaccgaccucgagauccucgccgccaucuucgccuccgccauccacgacgucgaccaccccggcgucuccaaccaguuccucaucaacaccaacuccgagcucgcccucauguacaacgacuccuccguccucgagaaccaccaccucgccgucggcuucaagcuccuccaggaggagaacugcgacaucuuccagaaccucaccaagaagcagcgccagucccuccgcaagauggucaucgacaucguccucgccaccgacauguccaagcacaugaaccuccucgccgaccucaagaccauggucgagaccaagaaggucaccuccuccggcguccuccuccucgacaacuacuccgaccgcauccagguccuccagaacaugguccacugcgccgaccucuccaaccccaccaagccccuccagcucuaccgccaguggaccgaccgcaucauggaggaguucuuccgccagggcgaccgcgagcgcgagcgcggcauggagaucucccccaugugcgacaagcacaacgccuccgucgagaagucccaggucggcuucaucgacuacaucguccacccccucugggagaccugggccgaccucguccaccccgacgcccaggacauccucgacacccucgaggacaaccgcgagugguaccaguccaccaucccccagucccccucccccgcccccgacgaccccgaggagggccgccagggccagaccgagaaguuccaguucgagcucacccucgaggaggacggcgaguccgacaccgagaaggacuccggcucccaggucgaggaggacaccuccugcuccgacuccaagacccucugcacccaggacuccgaguccaccgagaucccccucgacgagcaggucgaggaggaggccgucggcgaggaggaggagucccagcccgaggccugcgucaucgacgaccgcucccccgacaccuga

SEQ ID NO: 47428 - RNA, 2628 nt, Artificial Sequence
  derived and/or modified sequence opt2 from PDE5A__Homo_sapiens__NP_001074
auggagcgcgccggccccuccuucggccagcagcgccagcagcagcagccccagcagcagaagcagcagcagcgcgaccaggacuccgucgaggccuggcucgacgaccacugggacuucaccuucuccuacuucguccgcaaggccacccgcgagauggucaacgccugguucgccgagcgcguccacaccauccccgucugcaaggagggcauccgcggccacaccgaguccugcuccugcccccuccagcaguccccccgcgccgacaacuccgcccccggcacccccacccgcaagaucuccgccuccgaguucgaccgcccccuccgccccaucgucgucaaggacuccgagggcaccgucuccuuccucuccgacuccgagaagaaggagcagaugccccucacccccccccgcuucgaccacgacgagggcgaccagugcucccgccuccucgagcucgucaaggacaucuccucccaccucgacgucaccgcccucugccacaagaucuuccuccacauccacggccucaucuccgccgaccgcuacucccucuuccucgucugcgaggacuccuccaacgacaaguuccucaucucccgccucuucgacgucgccgagggcuccacccucgaggaggucuccaacaacugcauccgccucgaguggaacaagggcaucgucggccacgucgccgcccucggcgagccccucaacaucaaggacgccuacgaggacccccgcuucaacgccgaggucgaccagaucaccggcuacaagacccaguccauccucugcaugcccaucaagaaccaccgcgaggaggucgucggcgucgcccaggccaucaacaagaaguccggcaacggcggcaccuucaccgagaaggacgagaaggacuucgccgccuaccucgccuucugcggcaucguccuccacaacgcccagcucuacgagaccucccuccucgagaacaagcgcaaccagguccuccucgaccucgccucccucaucuucgaggagcagcagucccucgaggucauccucaagaagaucgccgccaccaucaucuccuucaugcagguccagaagugcaccaucuucaucgucgacgaggacugcuccgacuccuucuccuccgucuuccacauggagugcgaggagcucgagaaguccuccgacacccucacccgcgagcacgacgccaacaagaucaacuacauguacgcccaguacgucaagaacaccauggagccccucaacauccccgacgucuccaaggacaagcgcuuccccuggaccaccgagaacaccggcaacgucaaccagcagugcauccgcucccuccucugcacccccaucaagaacggcaagaagaacaaggucaucggcgucugccagcucgucaacaagauggaggagaacaccggcaaggucaagcccuucaaccgcaacgacgagcaguuccucgaggccuucgucaucuucugcggccucggcauccagaacacccagauguacgaggccgucgagcgcgccauggccaagcagauggucacccucgagguccucuccuaccacgccuccgccgccgaggaggagacccgcgagcuccagucccucgccgccgccgucguccccuccgcccagacccucaagaucaccgacuucuccuucuccgacuucgagcucuccgaccucgagaccgcccucugcaccauccgcauguucaccgaccucaaccucguccagaacuuccagaugaagcacgagguccucugccgcuggauccucuccgucaagaagaacuaccgcaagaacgucgccuaccacaacuggcgccacgccuucaacaccgcccagugcauguucgccgcccucaaggccggcaagauccagaacaagcucaccgaccucgagauccucgcccuccucaucgccgcccucucccacgaccucgaccaccgcggcgucaacaacuccuacauccagcgcuccgagcacccccucgcccagcucuacugccacuccaucauggagcaccaccacuucgaccagugccucaugauccucaacucccccggcaaccagauccucuccggccucuccaucgaggaguacaagaccacccucaagaucaucaagcaggccauccucgccaccgaccucgcccucuacaucaagcgccgcggcgaguucuucgagcucauccgcaagaaccaguucaaccucgaggacccccaccagaaggagcucuuccucgccaugcucaugaccgccugcgaccucuccgccaucaccaagcccuggcccauccagcagcgcaucgccgagcucgucgccaccgaguucuucgaccagggcgaccgcgagcgcaaggagcucaacaucgagcccaccgaccucaugaaccgcgagaagaagaacaagauccccuccaugcaggucggcuucaucgacgccaucugccuccagcucuacgaggcccucacccacgucuccgaggacugcuucccccuccucgacggcugccgcaagaaccgccagaaguggcaggcccucgccgagcagcaggagaagaugcucaucaacggcgaguccggccaggccaagcgcaacuga

SEQ ID NO: 47429 - RNA, 2583 nt, Artificial Sequence
  derived and/or modified sequence opt2 from PDE6A__Homo_sapiens__NP_000431
augggcgaggucaccgccgaggaggucgagaaguuccucgacuccaacaucggcuucgccaagcaguacuacaaccuccacuaccgcgccaagcucaucuccgaccuccucggcgccaaggaggccgccgucgacuucuccaacuaccacucccccuccuccauggaggaguccgagaucaucuucgaccuccuccgcgacuuccaggagaaccuccagaccgagaagugcaucuucaacgucaugaagaagcucugcuuccuccuccaggccgaccgcaugucccucuucauguaccgcacccgcaacggcaucgccgagcucgccacccgccucuucaacguccacaaggacgccguccucgaggacugccucgucaugcccgaccaggagaucgucuucccccucgacaugggcaucgucggccacgucgcccacuccaagaagaucgccaacguccccaacaccgaggaggacgagcacuucugcgacuucgucgacauccucaccgaguacaagaccaagaacauccucgccucccccaucaugaacggcaaggacgucgucgccaucaucauggccgucaacaaggucgacggcucccacuucaccaagcgcgacgaggagauccuccucaaguaccucaacuucgccaaccucaucaugaaggucuaccaccucuccuaccuccacaacugcgagacccgccgcggccagauccuccucugguccggcuccaaggucuucgaggagcucaccgacaucgagcgccaguuccacaaggcccucuacaccguccgcgccuuccucaacugcgaccgcuacuccgucggccuccucgacaugaccaagcagaaggaguucuucgacgucuggcccguccucaugggcgaggucccccccuacuccggcccccgcacccccgacggccgcgagaucaacuucuacaaggucaucgacuacauccuccacggcaaggaggacaucaaggucauccccaaccccccccccgaccacugggcccucgucuccggccuccccgccuacgucgcccagaacggccucaucugcaacaucaugaacgcccccgccgaggacuucuucgccuuccagaaggagccccucgacgaguccggcuggaugaucaagaacguccucuccaugcccaucgucaacaagaaggaggagaucgucggcgucgccaccuucuacaaccgcaaggacggcaagcccuucgacgagauggacgagacccucauggagucccucacccaguuccucggcugguccguccucaaccccgacaccuacgaguccaugaacaagcucgagaaccgcaaggacaucuuccaggacaucgucaaguaccacgucaagugcgacaacgaggagauccagaagauccucaagacccgcgaggucuacggcaaggagcccugggagugcgaggaggaggagcucgccgagauccuccaggccgagcuccccgacgccgacaaguacgagaucaacaaguuccacuucuccgaccucccccucaccgagcucgagcucgucaagugcggcauccagauguacuacgagcucaaggucgucgacaaguuccacaucccccaggaggcccucguccgcuucauguacucccucuccaagggcuaccgcaagaucaccuaccacaacuggcgccacggcuucaacgucggccagaccauguucucccuccucgucaccggcaagcucaagcgcuacuucaccgaccucgaggcccucgccauggucaccgccgccuucugccacgacaucgaccaccgcggcaccaacaaccucuaccagaugaagucccagaacccccucgccaagcuccacggcuccuccauccucgagcgccaccaccucgaguucggcaagacccuccuccgcgacgagucccucaacaucuuccagaaccucaaccgccgccagcacgagcacgccauccacaugauggacaucgccaucaucgccaccgaccucgcccucuacuucaagaagcgcaccauguuccagaagaucgucgaccaguccaagaccuacgaguccgagcaggaguggacccaguacaugaugcucgagcagacccgcaaggagaucgucauggccaugaugaugaccgccugcgaccucuccgccaucaccaagcccugggagguccagucccaggucgcccuccucgucgccgccgaguucugggagcagggcgaccucgagcgcaccguccuccagcagaaccccauccccaugauggaccgcaacaaggccgacgagcuccccaagcuccaggucggcuucaucgacuucgucugcaccuucgucuacaaggaguucucccgcuuccacgaggagaucacccccaugcucgacggcaucaccaacaaccgcaaggaguggaaggcccucgccgacgaguacgacgccaagaugaagguccaggaggagaagaagcagaagcagcaguccgccaaguccgccgccgccggcaaccagcccggcggcaaccccucccccggcggcgccaccaccuccaaguccugcugcauccaguga

SEQ ID NO: 47430 - RNA, 2565 nt, Artificial Sequence
  derived and/or modified sequence opt2 from PDE6B__Homo_sapiens__NP_000274
augucccucuccgaggagcaggcccgcuccuuccucgaccagaaccccgacuucgcccgccaguacuucggcaagaagcucucccccgagaacgucgccgccgccugcgaggacggcugcccccccgacugcgacucccuccgcgaccucugccaggucgaggaguccaccgcccuccucgagcucguccaggacaugcaggaguccaucaacauggagcgcgucgucuucaagguccuccgccgccucugcacccuccuccaggccgaccgcugcucccucuucauguaccgccagcgcaacggcgucgccgagcucgccacccgccucuucuccguccagcccgacuccguccucgaggacugccucgucccccccgacuccgagaucgucuucccccucgacaucggcgucgucggccacgucgcccagaccaagaagauggucaacgucgaggacgucgccgagugcccccacuucuccuccuucgccgacgagcucaccgacuacaagaccaagaacaugcucgccacccccaucaugaacggcaaggacgucgucgccgucaucauggccgucaacaagcucaacggccccuucuucaccuccgaggacgaggacgucuuccucaaguaccucaacuucgccacccucuaccucaagaucuaccaccucuccuaccuccacaacugcgagacccgccgcggccagguccuccucugguccgccaacaaggucuucgaggagcucaccgacaucgagcgccaguuccacaaggccuucuacaccguccgcgccuaccucaacugcgagcgcuacuccgucggccuccucgacaugaccaaggagaaggaguucuucgacgucugguccguccucaugggcgagucccagcccuacuccggcccccgcacccccgacggccgcgagaucgucuucuacaaggucaucgacuacauccuccacggcaaggaggagaucaaggucauccccacccccuccgccgaccacugggcccucgccuccggccuccccuccuacgucgccgaguccggcuucaucugcaacaucaugaacgccuccgccgacgagauguucaaguuccaggagggcgcccucgacgacuccggcuggcucaucaagaacguccucuccaugcccaucgucaacaagaaggaggagaucgucggcgucgccaccuucuacaaccgcaaggacggcaagcccuucgacgagcaggacgagguccucauggagucccucacccaguuccucggcugguccgucaugaacaccgacaccuacgacaagaugaacaagcucgagaaccgcaaggacaucgcccaggacaugguccucuaccacgucaagugcgaccgcgacgagauccagcucauccuccccacccgcgcccgccucggcaaggagcccgccgacugcgacgaggacgagcucggcgagauccucaaggaggagcuccccggccccaccaccuucgacaucuacgaguuccacuucuccgaccucgagugcaccgagcucgaccucgucaagugcggcauccagauguacuacgagcucggcgucguccgcaaguuccagaucccccaggagguccucguccgcuuccucuucuccaucuccaagggcuaccgccgcaucaccuaccacaacuggcgccacggcuucaacgucgcccagaccauguucacccuccucaugaccggcaagcucaaguccuacuacaccgaccucgaggccuucgccauggucaccgccggccucugccacgacaucgaccaccgcggcaccaacaaccucuaccagaugaagucccagaacccccucgccaagcuccacggcuccuccauccucgagcgccaccaccucgaguucggcaaguuccuccucuccgaggagacccucaacaucuaccagaaccucaaccgccgccagcacgagcacgucauccaccucauggacaucgccaucaucgccaccgaccucgcccucuacuucaagaagcgcgccauguuccagaagaucgucgacgaguccaagaacuaccaggacaagaaguccugggucgaguaccucucccucgagaccacccgcaaggagaucgucauggccaugaugaugaccgccugcgaccucuccgccaucaccaagcccugggagguccaguccaaggucgcccuccucgucgccgccgaguucugggagcagggcgaccucgagcgcaccguccucgaccagcagcccauccccaugauggaccgcaacaaggccgccgagcuccccaagcuccaggucggcuucaucgacuucgucugcaccuucgucuacaaggaguucucccgcuuccacgaggagauccuccccauguucgaccgccuccagaacaaccgcaaggaguggaaggcccucgccgacgaguacgaggccaaggucaaggcccucgaggagaaggaggaggaggagcgcgucgccgccaagaaggucggcaccgagaucugcaacggcggccccgcccccaaguccuccaccugcugcauccucuga

SEQ ID NO: 47431 - RNA, 2577 nt, Artificial Sequence
  derived and/or modified sequence opt2 from PDE6C__Homo_sapiens__NP_006195
augggcgagaucaaccaggucgccgucgagaaguaccucgaggagaacccccaguucgccaaggaguacuucgaccgcaagcuccgcgucgagguccucggcgagaucuucaagaacucccagguccccguccaguccuccauguccuucuccgagcucacccaggucgaggaguccgcccucugccucgagcuccucuggaccguccaggaggagggcggcacccccgagcagggcguccaccgcgcccuccagcgccucgcccaccuccuccaggccgaccgcugcuccauguuccucugccgcucccgcaacggcauccccgaggucgccucccgccuccucgacgucacccccaccuccaaguucgaggacaaccucgucggccccgacaaggaggucgucuucccccucgacaucggcaucgucggcugggccgcccacaccaagaagacccacaacguccccgacgucaagaagaacucccacuucuccgacuucauggacaagcagaccggcuacgucaccaagaaccuccucgccacccccaucgucgucggcaaggagguccucgccgucaucauggccgucaacaaggucaacgccuccgaguucuccaagcaggacgaggaggucuucuccaaguaccucaacuucgucuccaucauccuccgccuccaccacaccuccuacauguacaacaucgagucccgccgcucccagauccucaugugguccgccaacaaggucuucgaggagcucaccgacgucgagcgccaguuccacaaggcccucuacaccguccgcuccuaccucaacugcgagcgcuacuccaucggccuccucgacaugaccaaggagaaggaguucuacgacgaguggcccaucaagcucggcgaggucgagcccuacaagggccccaagacccccgacggccgcgaggucaacuucuacaagaucaucgacuacauccuccacggcaaggaggagaucaaggucauccccaccccccccgccgaccacuggacccucaucuccggccuccccaccuacgucgccgagaacggcuucaucugcaacaugaugaacgcccccgccgacgaguacuucaccuuccagaagggccccgucgacgagaccggcugggucaucaagaacguccucucccuccccaucgucaacaagaaggaggacaucgucggcgucgccaccuucuacaaccgcaaggacggcaagcccuucgacgagcacgacgaguacaucaccgagacccucacccaguuccucggcuggucccuccucaacaccgacaccuacgacaagaugaacaagcucgagaaccgcaaggacaucgcccaggagaugcucaugaaccagaccaaggccacccccgaggagaucaaguccauccucaaguuccaggagaagcucaacgucgacgucaucgacgacugcgaggagaagcagcucgucgccauccucaaggaggaccuccccgacccccgcuccgccgagcucuacgaguuccgcuucuccgacuucccccucaccgagcacggccucaucaagugcggcauccgccucuucuucgagaucaacgucgucgagaaguucaagguccccgucgagguccucacccgcuggauguacaccguccgcaagggcuaccgcgccgucaccuaccacaacuggcgccacggcuucaacgucggccagaccauguucacccuccucaugaccggccgccucaagaaguacuacaccgaccucgaggccuucgccaugcucgccgccgccuucugccacgacaucgaccaccgcggcaccaacaaccucuaccagaugaaguccaccuccccccucgcccgccuccacggcuccuccauccucgagcgccaccaccucgaguacuccaagacccuccuccaggacgagucccucaacaucuuccagaaccucaacaagcgccaguucgagaccgucauccaccucuucgaggucgccaucaucgccaccgaccucgcccucuacuucaagaagcgcaccauguuccagaagaucgucgacgccugcgagcagaugcagaccgaggaggaggccaucaaguacgucaccgucgaccccaccaagaaggagaucaucauggccaugaugaugaccgccugcgaccucuccgccaucaccaagcccugggagguccagucccaggucgcccucauggucgccaacgaguucugggagcagggcgaccucgagcgcaccguccuccagcagcagcccauccccaugauggaccgcaacaagcgcgacgagcuccccaagcuccaggucggcuucaucgacuucgucugcaccuucgucuacaaggaguucucccgcuuccacaaggagaucacccccaugcucuccggccuccagaacaaccgcgucgaguggaagucccucgccgacgaguacgacgccaagaugaaggucaucgaggaggaggccaagaagcaggagggcggcgccgagaaggccgccgaggacuccggcggcggcgacgacaagaaguccaagaccugccucaugcucuga

SEQ ID NO: 47432 - RNA, 453 nt, Artificial Sequence
  derived and/or modified sequence opt2 from PDE6D__Homo_sapiens__NP_002592
auguccgccaaggacgagcgcgcccgcgagauccuccgcggcuucaagcucaacuggaugaaccuccgcgacgccgagaccggcaagauccucuggcagggcaccgaggaccucuccguccccggcgucgagcacgaggcccgcguccccaagaagauccucaagugcaaggccgucucccgcgagcucaacuucuccuccaccgagcagauggagaaguuccgccucgagcagaaggucuacuucaagggccagugccucgaggagugguucuucgaguucggcuucgucauccccaacuccaccaacaccuggcagucccucaucgaggccgcccccgagucccagaugaugcccgccuccguccucaccggcaacgucaucaucgagaccaaguucuucgacgacgaccuccucgucuccaccucccgcguccgccucuucuacgucuga

SEQ ID NO: 47433 - RNA, 264 nt, Artificial Sequence
  derived and/or modified sequence opt2 from PDE6G__Homo_sapiens__NP_002593
augaaccucgagccccccaaggccgaguuccgcuccgccacccgcgucgccggcggccccgucaccccccgcaagggcccccccaaguucaagcagcgccagacccgccaguucaaguccaagccccccaagaagggcguccagggcuucggcgacgacauccccggcauggagggccucggcaccgacaucaccgucaucugccccugggaggccuucaaccaccucgagcuccacgagcucgcccaguacggcaucaucuga

SEQ ID NO: 47434 - RNA, 252 nt, Artificial Sequence
  derived and/or modified sequence opt2 from PDE6H__Homo_sapiens__NP_006196
auguccgacaacaccacccuccccgcccccgccuccaaccagggccccaccaccccccgcaagggcccccccaaguucaagcagcgccagacccgccaguucaaguccaagccccccaagaagggcgucaagggcuucggcgacgacauccccggcauggagggccucggcaccgacaucaccgucaucugccccugggaggccuucucccaccucgagcuccacgagcucgcccaguucggcaucaucuga

SEQ ID NO: 47435 - RNA, 1449 nt, Artificial Sequence
  derived and/or modified sequence opt2 from PDE7A__Homo_sapiens__NP_001229247
auggaggucugcuaccagcuccccguccucccccucgaccgccccgucccccagcacguccucucccgccgcggcgccaucuccuucuccuccuccuccgcccucuucggcugccccaacccccgccagcucucccagcgccgcggcgccaucuccuacgacuccuccgaccagaccgcccucuacauccgcaugcucggcgacguccgcguccgcucccgcgccggcuucgaguccgagcgccgcggcucccaccccuacaucgacuuccgcaucuuccacucccaguccgagaucgaggucuccgucuccgcccgcaacauccgccgccuccucuccuuccagcgcuaccuccgcuccucccgcuucuuccgcggcaccgccgucuccaacucccucaacauccucgacgacgacuacaacggccaggccaagugcaugcucgagaaggucggcaacuggaacuucgacaucuuccucuucgaccgccucaccaacggcaacucccucgucucccucaccuuccaccucuucucccuccacggccucaucgaguacuuccaccucgacaugaugaagcuccgccgcuuccucgucaugauccaggaggacuaccacucccagaaccccuaccacaacgccguccacgccgccgacgucacccaggccaugcacugcuaccucaaggagcccaagcucgccaacuccgucacccccugggacauccuccucucccucaucgccgccgccacccacgaccucgaccaccccggcgucaaccagcccuuccucaucaagaccaaccacuaccucgccacccucuacaagaacaccuccguccucgagaaccaccacuggcgcuccgccgucggccuccuccgcgaguccggccucuucucccaccucccccucgagucccgccagcagauggagacccagaucggcgcccucauccucgccaccgacaucucccgccagaacgaguaccucucccucuuccgcucccaccucgaccgcggcgaccucugccucgaggacacccgccaccgccaccucguccuccagauggcccucaagugcgccgacaucugcaaccccugccgcaccugggagcucuccaagcagugguccgagaaggucaccgaggaguucuuccaccagggcgacaucgagaagaaguaccaccucggcgucuccccccucugcgaccgccacaccgaguccaucgccaacauccagaucggcuucaugaccuaccucgucgagccccucuucaccgagugggcccgcuucuccaacacccgccucucccagaccaugcucggccacgucggccucaacaaggccuccuggaagggccuccagcgcgagcaguccuccuccgaggacaccgacgccgccuucgagcucaacucccagcuccucccccaggagaaccgccucuccuga

SEQ ID NO: 47436 - RNA, 1353 nt, Artificial Sequence
  derived and/or modified sequence opt2 from PDE7B__Homo_sapiens__NP_061818
auguccugccucauggucgagcgcugcggcgagauccucuucgagaaccccgaccagaacgccaagugcgucugcaugcucggcgacauccgccuccgcggccagaccggcguccgcgccgagcgccgcggcuccuaccccuucaucgacuuccgccuccucaacuccaccaccuacuccggcgagaucggcaccaagaagaaggucaagcgccuccucuccuuccagcgcuacuuccacgccucccgccuccuccgcggcaucaucccccaggccccccuccaccuccucgacgaggacuaccucggccaggcccgccacaugcucuccaaggucggcaugugggacuucgacaucuuccucuucgaccgccucaccaacggcaacucccucgucacccuccucugccaccucuucaacacccacggccucauccaccacuucaagcucgacauggucacccuccaccgcuuccucgucaugguccaggaggacuaccacucccagaaccccuaccacaacgccguccacgccgccgacgucacccaggccaugcacugcuaccucaaggagcccaagcucgccuccuuccucaccccccucgacaucaugcucggccuccucgccgccgccgcccacgacgucgaccaccccggcgucaaccagcccuuccucaucaagaccaaccaccaccucgccaaccucuaccagaacauguccguccucgagaaccaccacuggcgcuccaccaucggcaugcuccgcgagucccgccuccucgcccaccuccccaaggagaugacccaggacaucgagcagcagcucggcucccucauccucgccaccgacaucaaccgccagaacgaguuccucacccgccucaaggcccaccuccacaacaaggaccuccgccucgaggacgcccaggaccgccacuucaugcuccagaucgcccucaagugcgccgacaucugcaaccccugccgcaucugggagauguccaagcagugguccgagcgcgucugcgaggaguucuaccgccagggcgagcucgagcagaaguucgagcucgagaucuccccccucugcaaccagcagaaggacuccauccccuccauccagaucggcuucauguccuacaucgucgagccccucuuccgcgagugggcccacuucaccggcaacuccacccucuccgagaacaugcucggccaccucgcccacaacaaggcccaguggaagucccuccucccccgccagcaccgcucccgcggcuccuccggcuccggccccgaccacgaccacgccggccagggcaccgaguccgaggagcaggagggcgacucccccuga

SEQ ID NO: 47437 - RNA, 2490 nt, Artificial Sequence
  derived and/or modified sequence opt2 from PDE8A__Homo_sapiens__NP_002596
augggcugcgcccccuccauccacaucuccgagcgccucgucgccgaggacgcccccucccccgccgcccccccccucuccuccggcggcccccgccucccccagggccagaagaccgccgcccucccccgcacccgcggcgccggccuccucgaguccgagcuccgcgacggcuccggcaagaaggucgccgucgccgacguccaguucggccccaugcgcuuccaccaggaccagcuccagguccuccucgucuucaccaaggaggacaaccagugcaacggcuucugccgcgccugcgagaaggccggcuucaagugcaccgucaccaaggaggcccaggccguccucgccugcuuccucgacaagcaccacgacaucaucaucaucgaccaccgcaacccccgccagcucgacgccgaggcccucugccgcuccauccgcuccuccaagcucuccgagaacaccgucaucgucggcgucguccgccgcgucgaccgcgaggagcucuccgucaugcccuucaucuccgccggcuucacccgccgcuacgucgagaaccccaacaucauggccugcuacaacgagcuccuccagcucgaguucggcgagguccgcucccagcucaagcuccgcgccugcaacuccgucuucaccgcccucgagaacuccgaggacgccaucgagaucaccuccgaggaccgcuucauccaguacgccaaccccgccuucgagaccaccaugggcuaccaguccggcgagcucaucggcaaggagcucggcgagguccccaucaacgagaagaaggccgaccuccucgacaccaucaacuccugcauccgcaucggcaaggaguggcagggcaucuacuacgccaagaagaagaacggcgacaacauccagcagaacgucaagaucauccccgucaucggccagggcggcaagauccgccacuacgucuccaucauccgcgucugcaacggcaacaacaaggccgagaagaucuccgagugcguccaguccgacacccacaccgacaaccagaccggcaagcacaaggaccgccgcaagggcucccucgacgucaaggccgucgccucccgcgccaccgaggucuccucccagcgccgccacuccuccauggcccgcauccacuccaugaccaucgaggcccccaucaccaaggucaucaacaucaucaacgccgcccaggaguccucccccaugcccgucaccgaggcccucgaccgcguccucgagauccuccgcaccaccgagcucuacuccccccaguucggcgccaaggacgacgacccccacgccaacgaccucgucggcggccucauguccgacggccuccgccgccucuccggcaacgaguacguccucuccaccaagaacacccagauggucuccuccaacaucaucacccccaucucccucgacgacguccccccccgcaucgcccgcgccauggagaacgaggaguacugggacuucgacaucuucgagcucgaggccgccacccacaaccgcccccucaucuaccucggccucaagauguucgcccgcuucggcaucugcgaguuccuccacugcuccgaguccacccuccgcuccuggcuccagaucaucgaggccaacuaccacuccuccaaccccuaccacaacuccacccacuccgccgacguccuccacgccaccgccuacuuccucuccaaggagcgcaucaaggagacccucgaccccaucgacgaggucgccgcccucaucgccgccaccauccacgacgucgaccaccccggccgcaccaacuccuuccucugcaacgccggcuccgagcucgccauccucuacaacgacaccgccguccucgagucccaccacgccgcccucgccuuccagcucaccaccggcgacgacaagugcaacaucuucaagaacauggagcgcaacgacuaccgcacccuccgccagggcaucaucgacaugguccucgccaccgagaugaccaagcacuucgagcacgucaacaaguucgucaacuccaucaacaagccccucgccacccucgaggagaacggcgagaccgacaagaaccaggaggucaucaacaccaugcuccgcacccccgagaaccgcacccucaucaagcgcaugcucaucaagugcgccgacgucuccaaccccugccgcccccuccaguacugcaucgagugggccgcccgcaucuccgaggaguacuucucccagaccgacgaggagaagcagcagggccuccccgucgucaugcccgucuucgaccgcaacaccugcuccauccccaagucccagaucuccuucaucgacuacuucaucaccgacauguucgacgccugggacgccuucgucgaccuccccgaccucaugcagcaccucgacaacaacuucaaguacuggaagggccucgacgagaugaagcuccgcaaccuccgccccccccccgaguga

SEQ ID NO: 47438 - RNA, 2367 nt, Artificial Sequence
  derived and/or modified sequence opt2 from PDE8B__Homo_sapiens__NP_001025022
augggcugcgcccccuccauccacgucucccaguccggcgucaucuacugccgcgacuccgacgaguccuccuccccccgccagaccaccuccgucucccagggccccgccgccccccuccccggccucuucguccagaccgacgccgccgacgccaucccccccucccgcgccuccggcccccccuccgucgcccgcguccgccgcgcccgcaccgagcucggcuccggcuccuccgccggcuccgccgcccccgccgccaccaccucccgcggccgccgccgccacugcugcuccuccgccgaggccgagacccagaccugcuacaccuccgucaagcaggucuccuccgccgagguccgcaucggccccaugcgccucacccaggaccccauccagguccuccucaucuucgccaaggaggacucccaguccgacggcuucuggugggccugcgaccgcgccggcuaccgcugcaacaucgcccgcacccccgaguccgcccucgagugcuuccucgacaagcaccacgagaucaucgucaucgaccaccgccagacccagaacuucgacgccgaggccgucugccgcuccauccgcgccaccaaccccuccgagcacaccgucauccucgccgucgucucccgcgucuccgacgaccacgaggaggccuccguccucccccuccuccacgccggcuucaaccgccgcuucauggagaacuccuccaucaucgccugcuacaacgagcucauccagaucgagcacggcgagguccgcucccaguucaagcuccgcgccugcaacuccgucuucaccgcccucgaccacugccacgaggccaucgagaucaccuccgacgaccacgucauccagauccacaagauccaccgcgacuccggcgacaacucccagaccgagccccacuccuuccgcuacaagaaccgccgcaaggaguccaucgacgucaaguccaucuccucccgcggcuccgacgcccccucccuccagaaccgccgcuaccccuccauggcccgcauccacuccaugaccaucgaggcccccaucaccaaggucaucaacaucaucaacgccgcccaggagaacucccccgucaccgucgccgaggcccucgaccgcguccucgagauccuccgcaccaccgagcucuacuccccccagcucggcaccaaggacgaggacccccacaccuccgaccucgucggcggccucaugaccgacggccuccgccgccucuccggcaacgaguacgucuucaccaagaacguccaccagucccacucccaccucgccaugcccaucaccaucaacgacgucccccccugcaucucccagcuccucgacaacgaggaguccugggacuucaacaucuucgagcucgaggccaucacccacaagcgcccccucgucuaccucggccucaaggucuucucccgcuucggcgucugcgaguuccucaacugcuccgagaccacccuccgcgccugguuccaggucaucgaggccaacuaccacuccuccaacgccuaccacaacuccacccacgccgccgacguccuccacgccaccgccuucuuccucggcaaggagcgcgucaagggcucccucgaccagcucgacgaggucgccgcccucaucgccgccaccguccacgacgucgaccaccccggccgcaccaacuccuuccucugcaacgccggcuccgagcucgccguccucuacaacgacaccgccguccucgagucccaccacaccgcccucgccuuccagcucaccgucaaggacaccaagugcaacaucuucaagaacaucgaccgcaaccacuaccgcacccuccgccaggccaucaucgacaugguccucgccaccgagaugaccaagcacuucgagcacgucaacaaguucgucaacuccaucaacaagcccauggccgccgagaucgagggcuccgacugcgagugcaaccccgccggcaagaacuuccccgagaaccagauccucaucaagcgcaugaugaucaagugcgccgacgucgccaaccccugccgcccccucgaccucugcaucgagugggccggccgcaucuccgaggaguacuucgcccagaccgacgaggagaagcgccagggccuccccgucgucaugcccgucuucgaccgcaacaccugcuccauccccaagucccagaucuccuucaucgacuacuucaucaccgacauguucgacgccugggacgccuucgcccaccuccccgcccucaugcagcaccucgccgacaacuacaagcacuggaagacccucgacgaccucaagugcaagucccuccgccuccccuccgacuccuga

SEQ ID NO: 47439 - RNA, 1602 nt, Artificial Sequence
  derived and/or modified sequence opt2 from PDE9A__Homo_sapiens__NP_001001567
augggcuccggcuccuccuccuaccgccccaaggccaucuaccucgacaucgacggccgcauccagaaggucaucuucuccaaguacugcaacuccuccgacaucauggaccucuucugcaucgccaccggccucccccgcaacaccaccaucucccuccucaccaccgacgacgccauggucuccaucgaccccaccaugcccgccaacuccgagcgcacccccuacaagguccgccccgucgccaucaagcagcucuccgagcgcgaggagcucauccaguccguccucgcccaggucgccgagcaguucucccgcgccuucaagaucaacgagcucaaggccgaggucgccaaccaccucgccguccucgagaagcgcgucgagcucgagggccucaaggucgucgagaucgagaagugcaaguccgacaucaagaagaugcgcgaggagcucgccgcccgcuccucccgcaccaacugccccugcaaguacuccuuccucgacaaccacaagaagcucaccccccgccgcgacguccccaccuaccccaaguaccuccucucccccgagaccaucgaggcccuccgcaagcccaccuucgacgucuggcucugggagcccaacgagaugcucuccugccucgagcacauguaccacgaccucggccucguccgcgacuucuccaucaaccccgucacccuccgccgcuggcucuucugcguccacgacaacuaccgcaacaaccccuuccacaacuuccgccacugcuucugcgucgcccagaugauguacuccauggucuggcucugcucccuccaggagaaguucucccagaccgacauccucauccucaugaccgccgccaucugccacgaccucgaccaccccggcuacaacaacaccuaccagaucaacgcccgcaccgagcucgccguccgcuacaacgacaucuccccccucgagaaccaccacugcgccgucgccuuccagauccucgccgagcccgagugcaacaucuucuccaacaucccccccgacggcuucaagcagauccgccagggcaugaucacccucauccucgccaccgacauggcccgccacgccgagaucauggacuccuucaaggagaagauggagaacuucgacuacuccaacgaggagcacaugacccuccucaagaugauccucaucaagugcugcgacaucuccaacgagguccgccccauggaggucgccgagcccugggucgacugccuccucgaggaguacuucaugcaguccgaccgcgagaaguccgagggccuccccgucgcccccuucauggaccgcgacaaggucaccaaggccaccgcccagaucggcuucaucaaguucguccucauccccauguucgagaccgucaccaagcucuuccccauggucgaggagaucaugcuccagccccucugggagucccgcgaccgcuacgaggagcucaagcgcaucgacgacgccaugaaggagcuccagaagaagaccgacucccucaccuccggcgccaccgagaagucccgcgagcgcucccgcgacgucaagaacuccgagggcgacugcgccuga

SEQ ID NO: 47440 - RNA, 732 nt, Artificial Sequence
  derived and/or modified sequence opt2 from PDF__Homo_sapiens__NP_071736
auggcccgccucuggggcgcccucucccucuggccccucugggccgccguccccuggggcggcgccgccgccgucggcguccgcgccugcuccuccaccgccgcccccgacggcgucgagggccccgcccuccgccgcuccuacuggcgccaccuccgccgccucguccucggcccccccgagccccccuucucccacgucugccaggucggcgaccccguccuccgcggcgucgccgcccccgucgagcgcgcccagcucggcggccccgagcuccagcgccucacccagcgccucguccaggucaugcgccgccgccgcugcgucggccucuccgccccccagcucggcgucccccgccagguccucgcccucgagcuccccgaggcccucugccgcgagugccccccccgccagcgcgcccuccgccagauggagcccuucccccuccgcgucuucgucaaccccucccuccgcguccucgacucccgccucgucaccuuccccgagggcugcgaguccgucgccggcuuccucgccugcgucccccgcuuccaggccguccagaucuccggccucgaccccaacggcgagcaggucgucuggcaggccuccggcugggccgcccgcaucauccagcacgagauggaccaccuccagggcugccucuucaucgacaagauggacucccgcaccuucaccaacgucuacuggaugaaggucaacgacuga

SEQ ID NO: 47441 - RNA, 636 nt, Artificial Sequence
  derived and/or modified sequence opt2 from PDGFA__Homo_sapiens__NP_002598
augcgcacccucgccugccuccuccuccucggcugcggcuaccucgcccacguccucgccgaggaggccgagaucccccgcgaggucaucgagcgccucgcccgcucccagauccacuccauccgcgaccuccagcgccuccucgagaucgacuccgucggcuccgaggacucccucgacaccucccuccgcgcccacggcguccacgccaccaagcacguccccgagaagcgcccccuccccauccgccgcaagcgcuccaucgaggaggccguccccgccgucugcaagacccgcaccgucaucuacgagaucccccgcucccaggucgaccccaccuccgccaacuuccucaucuggccccccugcgucgaggucaagcgcugcaccggcugcugcaacaccuccuccgucaagugccagcccucccgcguccaccaccgcuccgucaaggucgccaaggucgaguacguccgcaagaagcccaagcucaaggagguccagguccgccucgaggagcaccucgagugcgccugcgccaccaccucccucaaccccgacuaccgcgaggaggacaccggccgcccccgcgaguccggcaagaagcgcaagcgcaagcgccucaagcccaccuga

SEQ ID NO: 47442 - RNA, 726 nt, Artificial Sequence
  derived and/or modified sequence opt2 from PDGFB__Homo_sapiens__NP_002599
augaaccgcugcugggcccucuuccucucccucugcugcuaccuccgccucgucuccgccgagggcgaccccauccccgaggagcucuacgagaugcucuccgaccacuccauccgcuccuucgacgaccuccagcgccuccuccacggcgaccccggcgaggaggacggcgccgagcucgaccucaacaugacccgcucccacuccggcggcgagcucgagucccucgcccgcggccgccgcucccucggcucccucaccaucgccgagcccgccaugaucgccgagugcaagacccgcaccgaggucuucgagaucucccgccgccucaucgaccgcaccaacgccaacuuccucgucuggccccccugcgucgagguccagcgcugcuccggcugcugcaacaaccgcaacguccagugccgccccacccagguccagcuccgccccguccagguccgcaagaucgagaucguccgcaagaagcccaucuucaagaaggccaccgucacccucgaggaccaccucgccugcaagugcgagaccgucgccgccgcccgccccgucacccgcucccccggcggcucccaggagcagcgcgccaagaccccccagacccgcgucaccauccgcaccguccgcguccgccgcccccccaagggcaagcaccgcaaguucaagcacacccacgacaagaccgcccucaaggagacccucggcgccuga

SEQ ID NO: 47443 - RNA, 1038 nt, Artificial Sequence
  derived and/or modified sequence opt2 from PDGFC__Homo_sapiens__NP_057289
augucccucuucggccuccuccuccucaccuccgcccucgccggccagcgccagggcacccaggccgaguccaaccucuccuccaaguuccaguucuccuccaacaaggagcagaacggcguccaggacccccagcacgagcgcaucaucaccgucuccaccaacggcuccauccacuccccccgcuucccccacaccuacccccgcaacaccguccucgucuggcgccucgucgccgucgaggagaacgucuggauccagcucaccuucgacgagcgcuucggccucgaggaccccgaggacgacaucugcaaguacgacuucgucgaggucgaggagcccuccgacggcaccauccucggccgcuggugcggcuccggcaccguccccggcaagcagaucuccaagggcaaccagauccgcauccgcuucgucuccgacgaguacuuccccuccgagcccggcuucugcauccacuacaacaucgucaugccccaguucaccgaggccgucucccccuccguccucccccccuccgcccucccccucgaccuccucaacaacgccaucaccgccuucuccacccucgaggaccucauccgcuaccucgagcccgagcgcuggcagcucgaccucgaggaccucuaccgccccaccuggcagcuccucggcaaggccuucgucuucggccgcaagucccgcgucgucgaccucaaccuccucaccgaggagguccgccucuacuccugcaccccccgcaacuucuccgucuccauccgcgaggagcucaagcgcaccgacaccaucuucuggcccggcugccuccucgucaagcgcugcggcggcaacugcgccugcugccuccacaacugcaacgagugccagugcguccccuccaaggucaccaagaaguaccacgagguccuccagcuccgccccaagaccggcguccgcggccuccacaagucccucaccgacgucgcccucgagcaccacgaggagugcgacugcgucugccgcggcuccaccggcggcuga

SEQ ID NO: 47444 - RNA, 1113 nt, Artificial Sequence
  derived and/or modified sequence opt2 from PDGFD__Homo_sapiens__NP_079484
augcaccgccucaucuucgucuacacccucaucugcgccaacuucugcuccugccgcgacaccuccgccaccccccaguccgccuccaucaaggcccuccgcaacgccaaccuccgccgcgacgaguccaaccaccucaccgaccucuaccgccgcgacgagaccauccaggucaagggcaacggcuacguccaguccccccgcuuccccaacuccuacccccgcaaccuccuccucaccuggcgccuccacucccaggagaacacccgcauccagcucgucuucgacaaccaguucggccucgaggaggccgagaacgacaucugccgcuacgacuucgucgaggucgaggacaucuccgagaccuccaccaucauccgcggccgcuggugcggccacaaggagguccccccccgcaucaagucccgcaccaaccagaucaagaucaccuucaaguccgacgacuacuucgucgccaagcccggcuucaagaucuacuacucccuccucgaggacuuccagcccgccgccgccuccgagaccaacugggaguccgucaccuccuccaucuccggcgucuccuacaacucccccuccgucaccgaccccacccucaucgccgacgcccucgacaagaagaucgccgaguucgacaccgucgaggaccuccucaaguacuucaaccccgaguccuggcaggaggaccucgagaacauguaccucgacaccccccgcuaccgcggccgcuccuaccacgaccgcaaguccaaggucgaccucgaccgccucaacgacgacgccaagcgcuacuccugcaccccccgcaacuacuccgucaacauccgcgaggagcucaagcucgccaacgucgucuucuucccccgcugccuccucguccagcgcugcggcggcaacugcggcugcggcaccgucaacuggcgcuccugcaccugcaacuccggcaagaccgucaagaaguaccacgagguccuccaguucgagcccggccacaucaagcgccgcggccgcgccaagaccauggcccucgucgacauccagcucgaccaccacgagcgcugcgacugcaucugcuccucccgccccccccgcuga

SEQ ID NO: 47445 - RNA, 3345 nt, Artificial Sequence
  derived and/or modified sequence opt2 from PDGFRA__Homo_sapiens__XP_006714102
augcucccccgccucguccucaacuccugggcccagaugaucugccucccccagcuccccaaguucccccgcgccaugggcaccucccaccccgccuuccucguccucggcugccuccucaccggccucucccucauccucugccagcucucccuccccuccauccuccccaacgagaacgagaaggucguccagcucaacuccuccuucucccuccgcugcuucggcgaguccgaggucuccuggcaguaccccauguccgaggaggaguccuccgacgucgagauccgcaacgaggagaacaacuccggccucuucgucaccguccucgaggucuccuccgccuccgccgcccacaccggccucuacaccugcuacuacaaccacacccagaccgaggagaacgagcucgagggccgccacaucuacaucuacguccccgaccccgacgucgccuucgucccccucggcaugaccgacuaccucgucaucgucgaggacgacgacuccgccaucauccccugccgcaccaccgaccccgagacccccgucacccuccacaacuccgagggcgucguccccgccuccuacgacucccgccagggcuucaacggcaccuucaccgucggccccuacaucugcgaggccaccgucaagggcaagaaguuccagaccauccccuucaacgucuacgcccucaaggccaccuccgagcucgaccucgagauggaggcccucaagaccgucuacaaguccggcgagaccaucgucgucaccugcgccgucuucaacaacgaggucgucgaccuccaguggaccuaccccggcgaggucaagggcaagggcaucaccaugcucgaggagaucaagguccccuccaucaagcucgucuacacccucaccguccccgaggccaccgucaaggacuccggcgacuacgagugcgccgcccgccaggccacccgcgaggucaaggagaugaagaaggucaccaucuccguccacgagaagggcuucaucgagaucaagcccaccuucucccagcucgaggccgucaaccuccacgaggucaagcacuucgucgucgagguccgcgccuacccccccccccgcaucuccuggcucaagaacaaccucacccucaucgagaaccucaccgagaucaccaccgacgucgagaagauccaggagauccgcuaccgcuccaagcucaagcucauccgcgccaaggaggaggacuccggccacuacaccaucgucgcccagaacgaggacgccgucaaguccuacaccuucgagcuccucacccagguccccuccuccauccucgaccucgucgacgaccaccacggcuccaccggcggccagaccguccgcugcaccgccgagggcaccccccuccccgacaucgaguggaugaucugcaaggacaucaagaagugcaacaacgagaccuccuggaccauccucgccaacaacgucuccaacaucaucaccgagauccacucccgcgaccgcuccaccgucgagggccgcgucaccuucgccaaggucgaggagaccaucgccguccgcugccucgccaagaaccuccucggcgccgagaaccgcgagcucaagcucgucgcccccacccuccgcuccgagcucaccgucgccgccgccguccucguccuccucgucaucgucaucaucucccucaucguccucgucgucaucuggaagcagaagccccgcuacgagauccgcuggcgcgucaucgaguccaucucccccgacggccacgaguacaucuacgucgaccccaugcagcuccccuacgacucccgcugggaguucccccgcgacggccucguccucggccgcguccucggcuccggcgccuucggcaaggucgucgagggcaccgccuacggccucucccgcucccagcccgucaugaaggucgccgucaagaugcucaagcccaccgcccgcuccuccgagaagcaggcccucauguccgagcucaagaucaugacccaccucggcccccaccucaacaucgucaaccuccucggcgccugcaccaaguccggccccaucuacaucaucaccgaguacugcuucuacggcgaccucgucaacuaccuccacaagaaccgcgacuccuuccucucccaccaccccgagaagcccaagaaggagcucgacaucuucggccucaaccccgccgacgaguccacccgcuccuacgucauccucuccuucgagaacaacggcgacuacauggacaugaagcaggccgacaccacccaguacguccccaugcucgagcgcaaggaggucuccaaguacuccgacauccagcgcucccucuacgaccgccccgccuccuacaagaagaaguccaugcucgacuccgaggucaagaaccuccucuccgacgacaacuccgagggccucacccuccucgaccuccucuccuucaccuaccaggucgcccgcggcauggaguuccucgccuccaagaacugcguccaccgcgaccucgccgcccgcaacguccuccucgcccagggcaagaucgucaagaucugcgacuucggccucgcccgcgacaucaugcacgacuccaacuacgucuccaagggcuccaccuuccuccccgucaaguggauggcccccgaguccaucuucgacaaccucuacaccacccucuccgacgucugguccuacggcauccuccucugggagaucuucucccucggcggcacccccuaccccggcaugauggucgacuccaccuucuacaacaagaucaaguccggcuaccgcauggccaagcccgaccacgccaccuccgaggucuacgagaucauggucaagugcuggaacuccgagcccgagaagcgccccuccuucuaccaccucuccgagaucgucgagaaccuccuccccggccaguacaagaaguccuacgagaagauccaccucgacuuccucaaguccgaccaccccgccgucgcccgcaugcgcgucgacuccgacaacgccuacaucggcgucaccuacaagaacgaggaggacaagcucaaggacugggagggcggccucgacgagcagcgccucuccgccgacuccggcuacaucaucccccuccccgacaucgaccccguccccgaggaggaggaccucggcaagcgcaaccgccacuccucccagaccuccgaggaguccgccaucgagaccggcuccuccuccuccaccuucaucaagcgcgaggacgagaccaucgaggacaucgacaugauggacgacaucggcaucgacuccuccgaccucgucgaggacuccuuccucuga

SEQ ID NO: 47446 - RNA, 3321 nt, Artificial Sequence
  derived and/or modified sequence opt2 from PDGFRB__Homo_sapiens__NP_002600
augcgccuccccggcgccaugcccgcccucgcccucaagggcgagcuccuccuccucucccuccuccuccuccucgagccccagaucucccagggccucgucgucaccccccccggccccgagcucguccucaacgucuccuccaccuucguccucaccugcuccggcuccgcccccgucgucugggagcgcaugucccaggagcccccccaggagauggccaaggcccaggacggcaccuucuccuccguccucacccucaccaaccucaccggccucgacaccggcgaguacuucugcacccacaacgacucccgcggccucgagaccgacgagcgcaagcgccucuacaucuucguccccgaccccaccgucggcuuccuccccaacgacgccgaggagcucuucaucuuccucaccgagaucaccgagaucaccauccccugccgcgucaccgacccccagcucgucgucacccuccacgagaagaagggcgacgucgcccuccccguccccuacgaccaccagcgcggcuucuccggcaucuucgaggaccgcuccuacaucugcaagaccaccaucggcgaccgcgaggucgacuccgacgccuacuacgucuaccgccuccaggucuccuccaucaacgucuccgucaacgccguccagaccgucguccgccagggcgagaacaucacccucaugugcaucgucaucggcaacgaggucgucaacuucgaguggaccuacccccgcaaggaguccggccgccucgucgagcccgucaccgacuuccuccucgacaugcccuaccacauccgcuccauccuccacauccccuccgccgagcucgaggacuccggcaccuacaccugcaacgucaccgaguccgucaacgaccaccaggacgagaaggccaucaacaucaccgucgucgaguccggcuacguccgccuccucggcgaggucggcacccuccaguucgccgagcuccaccgcucccgcacccuccaggucgucuucgaggccuaccccccccccaccguccucugguucaaggacaaccgcacccucggcgacuccuccgccggcgagaucgcccucuccacccgcaacgucuccgagacccgcuacgucuccgagcucacccucguccgcgucaaggucgccgaggccggccacuacaccaugcgcgccuuccacgaggacgccgagguccagcucuccuuccagcuccagaucaacguccccguccgcguccucgagcucuccgagucccaccccgacuccggcgagcagaccguccgcugccgcggccgcggcaugccccagcccaacaucaucugguccgccugccgcgaccucaagcgcugcccccgcgagcucccccccacccuccucggcaacuccuccgaggaggagucccagcucgagaccaacgucaccuacugggaggaggagcaggaguucgaggucgucuccacccuccgccuccagcacgucgaccgcccccucuccguccgcugcacccuccgcaacgccgucggccaggacacccaggaggucaucgucgucccccacucccuccccuucaaggucgucgucaucuccgccauccucgcccucgucguccucaccaucaucucccucaucauccucaucaugcucuggcagaagaagccccgcuacgagauccgcuggaaggucaucgaguccgucuccuccgacggccacgaguacaucuacgucgaccccaugcagcuccccuacgacuccaccugggagcucccccgcgaccagcucguccucggccgcacccucggcuccggcgccuucggccaggucgucgaggccaccgcccacggccucucccacucccaggccaccaugaaggucgccgucaagaugcucaaguccaccgcccgcuccuccgagaagcaggcccucauguccgagcucaagaucaugucccaccucggcccccaccucaacgucgucaaccuccucggcgccugcaccaagggcggccccaucuacaucaucaccgaguacugccgcuacggcgaccucgucgacuaccuccaccgcaacaagcacaccuuccuccagcaccacuccgacaagcgccgcccccccuccgccgagcucuacuccaacgcccuccccgucggccucccccuccccucccacgucucccucaccggcgaguccgacggcggcuacauggacauguccaaggacgaguccgucgacuacguccccaugcucgacaugaagggcgacgucaaguacgccgacaucgaguccuccaacuacauggcccccuacgacaacuacguccccuccgcccccgagcgcaccugccgcgccacccucaucaacgagucccccguccucuccuacauggaccucgucggcuucuccuaccaggucgccaacggcauggaguuccucgccuccaagaacugcguccaccgcgaccucgccgcccgcaacguccucaucugcgagggcaagcucgucaagaucugcgacuucggccucgcccgcgacaucaugcgcgacuccaacuacaucuccaagggcuccaccuuccucccccucaaguggauggcccccgaguccaucuucaacucccucuacaccacccucuccgacgucugguccuucggcauccuccucugggagaucuucacccucggcggcacccccuaccccgagcuccccaugaacgagcaguucuacaacgccaucaagcgcggcuaccgcauggcccagcccgcccacgccuccgacgagaucuacgagaucaugcagaagugcugggaggagaaguucgagauccgcccccccuucucccagcucguccuccuccucgagcgccuccucggcgagggcuacaagaagaaguaccagcaggucgacgaggaguuccuccgcuccgaccaccccgccauccuccgcucccaggcccgccuccccggcuuccacggccuccgcuccccccucgacaccuccuccguccucuacaccgccguccagcccaacgagggcgacaacgacuacaucaucccccuccccgaccccaagcccgaggucgccgacgagggcccccucgagggcucccccucccucgccuccuccacccucaacgaggucaacaccuccuccaccaucuccugcgacuccccccucgagccccaggacgagcccgagcccgagccccagcucgagcuccaggucgagcccgagcccgagcucgagcagcuccccgacuccggcugccccgccccccgcgccgaggccgaggacuccuuccucuga

SEQ ID NO: 47447 - RNA, 1128 nt, Artificial Sequence
  derived and/or modified sequence opt2 from PDGFRL__Homo_sapiens__XP_011542860
augaaggucuggcuccuccucggccuccuccucguccacgaggcccucgaggacgucaccggccagcaccuccccaagaacaagcgccccaaggagcccggcgagaaccgcaucaagcccaccaacaagaaggucaagcccaagauccccaagaugaaggaccgcgacuccgccaacuccgcccccaagacccaguccaucaugaugcagguccucgacaagggccgcuuccagaagcccgccgccacccucucccuccucgccggccagaccgucgagcuccgcugcaagggcucccgcaucggcugguccuaccccgccuaccucgacaccuucaaggacucccgccucuccgucaagcagaacgagcgcuacggccagcucacccucgucaacuccaccuccgccgacaccggcgaguucuccugcuggguccagcucugcuccggcuacaucugccgcaaggacgaggccaagaccggcuccaccuacaucuucuucaccgagaagggcgagcucuucguccccucccccuccuacuucgacgucgucuaccucaaccccgaccgccaggccgucguccccugccgcgucaccguccucuccgccaaggucacccuccaccgcgaguuccccgccaaggagauccccgccaacggcaccgacaucgucuacgacaugaagcgcggcuucgucuaccuccagccccacuccgagcaccagggcgucgucuacugccgcgccgaggccggcggccgcucccagaucuccgucaaguaccagcuccucuacgucgccguccccuccggcccccccuccaccaccauccucgccuccuccaacaaggucaaguccggcgacgacaucuccguccucugcaccguccucggcgagcccgacgucgaggucgaguucaccuggaucuuccccggccagaaggacgagcgccccgucaccauccaggacaccuggcgccucauccaccgcggccucggccacaccacccgcaucucccaguccgucaucaccgucgaggacuucgagaccaucgacgccggcuacuacaucugcaccgcccagaaccuccagggccagaccaccgucgccaccaccgucgaguucuccuga

SEQ ID NO: 47448 - RNA, 1173 nt, Artificial Sequence
  derived and/or modified sequence opt2 from PDHA1__Homo_sapiens__NP_000275
augcgcaagaugcucgccgccgucucccgcguccucuccggcgccucccagaagcccgccucccgcguccucgucgccucccgcaacuucgccaacgacgccaccuucgagaucaagaagugcgaccuccaccgccucgaggagggcccccccgucaccaccguccucacccgcgaggacggccucaaguacuaccgcaugaugcagaccguccgccgcauggagcucaaggccgaccagcucuacaagcagaagaucauccgcggcuucugccaccucugcgacggccaggaggccugcugcgucggccucgaggccggcaucaaccccaccgaccaccucaucaccgccuaccgcgcccacggcuucaccuucacccgcggccucuccguccgcgagauccucgccgagcucaccggccgcaagggcggcugcgccaagggcaagggcggcuccaugcacauguacgccaagaacuucuacggcggcaacggcaucgucggcgcccaggucccccucggcgccggcaucgcccucgccugcaaguacaacggcaaggacgaggucugccucacccucuacggcgacggcgccgccaaccagggccagaucuucgaggccuacaacauggccgcccucuggaagcuccccugcaucuucaucugcgagaacaaccgcuacggcaugggcaccuccgucgagcgcgccgccgccuccaccgacuacuacaagcgcggcgacuucauccccggccuccgcgucgacggcauggacauccucugcguccgcgaggccacccgcuucgccgccgccuacugccgcuccggcaagggccccauccucauggagcuccagaccuaccgcuaccacggccacuccauguccgaccccggcgucuccuaccgcacccgcgaggagauccaggagguccgcuccaaguccgaccccaucaugcuccucaaggaccgcauggucaacuccaaccucgccuccgucgaggagcucaaggagaucgacgucgagguccgcaaggagaucgaggacgccgcccaguucgccaccgccgaccccgagcccccccucgaggagcucggcuaccacaucuacuccuccgacccccccuucgagguccgcggcgccaaccaguggaucaaguucaaguccgucuccuga

SEQ ID NO: 47449 - RNA, 1080 nt, Artificial Sequence
  derived and/or modified sequence opt2 from PDHB__Homo_sapiens__NP_000916
auggccgccgucuccggccucguccgccgcccccuccgcgaggucuccggccuccucaagcgccgcuuccacuggaccgcccccgccgcccuccaggucaccguccgcgacgccaucaaccagggcauggacgaggagcucgagcgcgacgagaaggucuuccuccucggcgaggaggucgcccaguacgacggcgccuacaaggucucccgcggccucuggaagaaguacggcgacaagcgcaucaucgacacccccaucuccgagaugggcuucgccggcaucgccgucggcgccgccauggccggccuccgccccaucugcgaguucaugaccuucaacuucuccaugcaggccaucgaccaggucaucaacuccgccgccaagaccuacuacauguccggcggccuccagcccguccccaucgucuuccgcggccccaacggcgccuccgccggcgucgccgcccagcacucccagugcuucgccgccugguacggccacugccccggccucaaggucgucucccccuggaacuccgaggacgccaagggccucaucaaguccgccauccgcgacaacaaccccgucgucguccucgagaacgagcucauguacggcguccccuucgaguucccccccgaggcccaguccaaggacuuccucauccccaucggcaaggccaagaucgagcgccagggcacccacaucaccgucgucucccacucccgccccgucggccacugccucgaggccgccgccguccucuccaaggagggcgucgagugcgaggucaucaacaugcgcaccauccgccccauggacauggagaccaucgaggccuccgucaugaagaccaaccaccucgucaccgucgagggcggcuggccccaguucggcgucggcgccgagaucugcgcccgcaucauggagggccccgccuucaacuuccucgacgcccccgccguccgcgucaccggcgccgacguccccaugcccuacgccaagauccucgaggacaacuccaucccccaggucaaggacaucaucuucgccaucaagaagacccucaacaucuga

SEQ ID NO: 47450 - RNA, 1461 nt, Artificial Sequence
  derived and/or modified sequence opt2 from PDHX__Homo_sapiens__NP_001128496
augcaguccggcggcgccgagggcucccccggcgccggccgcaccggccgcggccccggcuccggcaaggccccccccgccgagaucuccuccggcgcccccgacuuccccggcggcgaccccaucaagauccucaugcccucccucucccccaccauggaggagggcaacaucgucaaguggcucaagaaggagggcgaggccgucuccgccggcgacgcccucugcgagaucgagaccgacaaggccgucgucacccucgacgccuccgacgacggcauccucgccaagaucgucgucgaggagggcuccaagaacauccgccucggcucccucaucggccucaucgucgaggagggcgaggacuggaagcacgucgagauccccaaggacgucggcccccccccccccgucuccaagcccuccgagccccgccccucccccgagccccagaucuccauccccgucaagaaggagcacauccccggcacccuccgcuuccgccucucccccgccgcccgcaacauccucgagaagcacucccucgacgccucccagggcaccgccaccggcccccgcggcaucuucaccaaggaggacgcccucaagcucguccagcucaagcagaccggcaagaucaccgagucccgccccacccccgcccccaccgccacccccaccgcccccuccccccuccaggccaccgccggccccuccuacccccgccccgucaucccccccgucuccacccccggccagcccaacgccgucggcaccuucaccgagauccccgccuccaacauccgccgcgucaucgccaagcgccucaccgaguccaaguccaccgucccccacgccuacgccaccgccgacugcgaccucggcgccguccucaagguccgccaggaccucgucaaggacgacaucaaggucuccgucaacgacuucaucaucaaggccgccgccgucacccucaagcagaugcccgacgucaacgucuccugggacggcgagggccccaagcagcuccccuucaucgacaucuccgucgccgucgccaccgacaagggccuccucacccccaucaucaaggacgccgccgccaagggcauccaggagaucgccgacuccgucaaggcccucuccaagaaggcccgcgacggcaagcuccuccccgaggaguaccagggcggcuccuucuccaucuccaaccucggcauguucggcaucgacgaguucaccgccgucaucaaccccccccaggccugcauccucgccgucggccgcuuccgccccguccucaagcucaccgaggacgaggagggcaacgccaagcuccagcagcgccagcucaucaccgucaccauguccuccgacucccgcgucgucgacgacgagcucgccacccgcuuccucaaguccuucaaggccaaccucgagaaccccauccgccucgccuga

SEQ ID NO: 47451 - RNA, 1578 nt, Artificial Sequence
  derived and/or modified sequence opt2 from PDIA2__Homo_sapiens__NP_006840
augucccgccagcuccuccccguccuccuccuccuccuccuccgcgccuccugccccuggggccaggagcagggcgcccgcucccccuccgaggagccccccgaggaggagauccccaaggaggacggcauccucguccucucccgccacacccucggccucgcccuccgcgagcaccccgcccuccucgucgaguucuacgcccccuggugcggccacugccaggcccucgcccccgaguacuccaaggccgccgccguccucgccgccgaguccauggucgucacccucgccaaggucgacggccccgcccagcgcgagcucgccgaggaguucggcgucaccgaguaccccacccucaaguucuuccgcaacggcaaccgcacccaccccgaggaguacaccggcccccgcgacgccgagggcaucgccgaguggcuccgccgccgcgucggccccuccgccaugcgccucgaggacgaggccgccgcccaggcccucaucggcggccgcgaccucgucgucaucggcuucuuccaggaccuccaggacgaggacgucgccaccuuccucgcccucgcccaggacgcccucgacaugaccuucggccucaccgaccgcccccgccucuuccagcaguucggccucaccaaggacaccgucguccucuucaagaaguucgacgagggccgcgccgacuuccccgucgacgaggagcucggccucgaccucggcgaccucucccgcuuccucgucacccacuccaugcgccucgucaccgaguucaacucccagaccuccgccaagaucuucgccgcccgcauccucaaccaccuccuccucuucgucaaccagacccucgccgcccaccgcgagcuccucgccggcuucggcgaggccgccccccgcuuccgcggccagguccucuucgucgucgucgacgucgccgccgacaacgagcacguccuccaguacuucggccucaaggccgaggccgcccccacccuccgccucgucaaccucgagaccaccaagaaguacgcccccgucgacggcggccccgucaccgccgccuccaucaccgccuucugccacgccguccucaacggccaggucaagcccuaccuccucucccaggagaucccccccgacugggaccagcgccccgucaagacccucgucggcaagaacuucgagcaggucgccuucgacgagaccaagaacgucuucgucaaguucuacgcccccuggugcacccacugcaaggagauggcccccgccugggaggcccucgccgagaaguaccaggaccacgaggacaucaucaucgccgagcucgacgccaccgccaacgagcucgacgccuucgccguccacggcuuccccacccucaaguacuuccccgccggccccggccgcaaggucaucgaguacaaguccacccgcgaccucgagaccuucuccaaguuccucgacaacggcggcguccuccccaccgaggagccccccgaggagcccgccgcccccuuccccgagccccccgccaacuccaccaugggcuccaaggaggagcucuga

SEQ ID NO: 47452 - RNA, 1518 nt, Artificial Sequence
  derived and/or modified sequence opt2 from PDIA3__Homo_sapiens__NP_005304
augcgccuccgccgccucgcccucuuccccggcgucgcccuccuccucgccgccgcccgccucgccgccgccuccgacguccucgagcucaccgacgacaacuucgagucccgcaucuccgacaccggcuccgccggccucaugcucgucgaguucuucgcccccuggugcggccacugcaagcgccucgcccccgaguacgaggccgccgccacccgccucaagggcaucgucccccucgccaaggucgacugcaccgccaacaccaacaccugcaacaaguacggcgucuccggcuaccccacccucaagaucuuccgcgacggcgaggaggccggcgccuacgacggcccccgcaccgccgacggcaucgucucccaccucaagaagcaggccggccccgccuccgucccccuccgcaccgaggaggaguucaagaaguucaucuccgacaaggacgccuccaucgucggcuucuucgacgacuccuucuccgaggcccacuccgaguuccucaaggccgccuccaaccuccgcgacaacuaccgcuucgcccacaccaacgucgagucccucgucaacgaguacgacgacaacggcgagggcaucauccucuuccgccccucccaccucaccaacaaguucgaggacaagaccgucgccuacaccgagcagaagaugaccuccggcaagaucaagaaguucauccaggagaacaucuucggcaucugcccccacaugaccgaggacaacaaggaccucauccagggcaaggaccuccucaucgccuacuacgacgucgacuacgagaagaacgccaagggcuccaacuacuggcgcaaccgcgucaugauggucgccaagaaguuccucgacgccggccacaagcucaacuucgccgucgccucccgcaagaccuucucccacgagcucuccgacuucggccucgaguccaccgccggcgagauccccgucgucgccauccgcaccgccaagggcgagaaguucgucaugcaggaggaguucucccgcgacggcaaggcccucgagcgcuuccuccaggacuacuucgacggcaaccucaagcgcuaccucaaguccgagcccauccccgaguccaacgacggccccgucaaggucgucgucgccgagaacuucgacgagaucgucaacaacgagaacaaggacguccucaucgaguucuacgcccccuggugcggccacugcaagaaccucgagcccaaguacaaggagcucggcgagaagcucuccaaggaccccaacaucgucaucgccaagauggacgccaccgccaacgacguccccucccccuacgagguccgcggcuuccccaccaucuacuucucccccgccaacaagaagcucaaccccaagaaguacgagggcggccgcgagcucuccgacuucaucuccuaccuccagcgcgaggccaccaacccccccgucauccaggaggagaagcccaagaagaagaagaaggcccaggaggaccucuga

SEQ ID NO: 47453 - RNA, 1938 nt, Artificial Sequence
  derived and/or modified sequence opt2 from PDIA4__Homo_sapiens__NP_004902
augcgcccccgcaaggccuuccuccuccuccuccuccucggccucguccagcuccucgccgucgccggcgccgagggccccgacgaggacuccuccaaccgcgagaacgccaucgaggacgaggaggaggaggaggaggaggacgacgacgaggaggaggacgaccucgaggucaaggaggagaacggcguccucguccucaacgacgccaacuucgacaacuucgucgccgacaaggacaccguccuccucgaguucuacgcccccuggugcggccacugcaagcaguucgcccccgaguacgagaagaucgccaacauccucaaggacaaggacccccccauccccgucgccaagaucgacgccaccuccgccuccguccucgccucccgcuucgacgucuccggcuaccccaccaucaagauccucaagaagggccaggccgucgacuacgagggcucccgcacccaggaggagaucgucgccaagguccgcgaggucucccagcccgacuggacccccccccccgaggucacccucguccucaccaaggagaacuucgacgaggucgucaacgacgccgacaucauccucgucgaguucuacgcccccuggugcggccacugcaagaagcucgcccccgaguacgagaaggccgccaaggagcucuccaagcgcuccccccccaucccccucgccaaggucgacgccaccgccgagaccgaccucgccaagcgcuucgacgucuccggcuaccccacccucaagaucuuccgcaagggccgccccuacgacuacaacggcccccgcgagaaguacggcaucgucgacuacaugaucgagcaguccggcccccccuccaaggagauccucacccucaagcagguccaggaguuccucaaggacggcgacgacgucaucaucaucggcgucuucaagggcgaguccgaccccgccuaccagcaguaccaggacgccgccaacaaccuccgcgaggacuacaaguuccaccacaccuucuccaccgagaucgccaaguuccucaaggucucccagggccagcucgucgucaugcagcccgagaaguuccaguccaaguacgagccccgcucccacaugauggacguccagggcuccacccaggacuccgccaucaaggacuucguccucaaguacgcccucccccucgucggccaccgcaaggucuccaacgacgccaagcgcuacacccgccgcccccucgucgucgucuacuacuccgucgacuucuccuucgacuaccgcgccgccacccaguucuggcgcuccaagguccucgaggucgccaaggacuuccccgaguacaccuucgccaucgccgacgaggaggacuacgccggcgaggucaaggaccucggccucuccgaguccggcgaggacgucaacgccgccauccucgacgaguccggcaagaaguucgccauggagcccgaggaguucgacuccgacacccuccgcgaguucgucaccgccuucaagaagggcaagcucaagcccgucaucaagucccagcccguccccaagaacaacaagggccccgucaaggucgucgucggcaagaccuucgacuccaucgucauggaccccaagaaggacguccucaucgaguucuacgcccccuggugcggccacugcaagcagcucgagcccgucuacaacucccucgccaagaaguacaagggccagaagggccucgucaucgccaagauggacgccaccgccaacgacguccccuccgaccgcuacaaggucgagggcuuccccaccaucuacuucgcccccuccggcgacaagaagaaccccgucaaguucgagggcggcgaccgcgaccucgagcaccucuccaaguucaucgaggagcacgccaccaagcucucccgcaccaaggaggagcucuga

SEQ ID NO: 47454 - RNA, 1560 nt, Artificial Sequence
  derived and/or modified sequence opt2 from PDIA5__Homo_sapiens__NP_006801
auggcccgcgccggccccgccuggcuccuccucgccaucugggucguccuccccuccuggcucuccuccgccaaggucuccucccucaucgagcgcaucuccgaccccaaggaccucaagaagcuccuccgcacccgcaacaacguccucguccucuacuccaaguccgaggucgccgccgagaaccaccuccgccuccucuccaccgucgcccaggccgucaagggccagggcaccaucugcugggucgacugcggcgacgccgagucccgcaagcucugcaagaagaugaaggucgaccucucccccaaggacaagaaggucgagcucuuccacuaccaggacggcgccuuccacaccgaguacaaccgcgccgucaccuucaaguccaucgucgccuuccucaaggaccccaagggccccccccucugggaggaggaccccggcgccaaggacgucguccaccucgacuccgagaaggacuuccgccgccuccucaagaaggaggagaagccccuccucaucauguucuacgcccccuggugcuccaugugcaagcgcaugaugccccacuuccagaaggccgccacccagcuccgcggccacgccguccucgccggcaugaacgucuacuccuccgaguucgagaacaucaaggaggaguacuccguccgcggcuuccccaccaucugcuacuucgagaagggccgcuuccucuuccaguacgacaacuacggcuccaccgccgaggacaucgucgaguggcucaagaacccccagcccccccagccccagguccccgagacccccugggccgacgagggcggcuccgucuaccaccucaccgacgaggacuucgaccaguucgucaaggagcacuccuccguccucgucauguuccacgcccccuggugcggccacugcaagaagaugaagcccgaguucgagaaggccgccgaggcccuccacggcgaggccgacuccuccggcguccucgccgccgucgacgccaccgucaacaaggcccucgccgagcgcuuccacaucuccgaguuccccacccucaaguacuucaagaacggcgagaaguacgccguccccguccuccgcaccaagaagaaguuccucgaguggaugcagaaccccgaggccccccccccccccgagcccaccugggaggagcagcagaccuccguccuccaccucgucggcgacaacuuccgcgagacccucaagaagaagaagcacacccucgucauguucuacgcccccuggugcccccacugcaagaaggucaucccccacuucaccgccaccgccgacgccuucaaggacgaccgcaagaucgccugcgccgccgucgacugcgucaaggacaagaaccaggaccucugccagcaggaggccgucaagggcuaccccaccuuccacuacuaccacuacggcaaguucgccgagaaguacgacuccgaccgcaccgagcucggcuucaccaacuacauccgcgcccuccgcgagggcgaccacgagcgccucggcaagaagaaggaggagcucuga

SEQ ID NO: 47455 - RNA, 1479 nt, Artificial Sequence
  derived and/or modified sequence opt2 from PDIA6__Homo_sapiens__NP_001269633
augcgccgcgaccuccgcgagaagcucgucugggucugccgcccccucgcccccgucgagguccccgccaacaucuccuccgacuuccagcccugcucccccaccucccccgcccacucccucucccgcaagucccccaucauguaccccuccaccaccauggccaacgcccccggccucgucuccugcaccuucuuccucgccgucaacggccucuacuccuccuccgacgacgucaucgagcucacccccuccaacuucaaccgcgaggucauccaguccgacucccucuggcucgucgaguucuacgcccccuggugcggccacugccagcgccucacccccgaguggaagaaggccgccaccgcccucaaggacgucgucaaggucggcgccgucgacgccgacaagcaccacucccucggcggccaguacggcguccagggcuuccccaccaucaagaucuucggcuccaacaagaaccgccccgaggacuaccagggcggccgcaccggcgaggccaucgucgacgccgcccucuccgcccuccgccagcucgucaaggaccgccucggcggccgcuccggcggcuacuccuccggcaagcagggccgcuccgacuccuccuccaagaaggacgucaucgagcucaccgacgacuccuucgacaagaacguccucgacuccgaggacgucuggauggucgaguucuacgcccccuggugcggccacugcaagaaccucgagcccgagugggccgccgccgccuccgaggucaaggagcagaccaagggcaaggucaagcucgccgccgucgacgccaccgucaaccagguccucgccucccgcuacggcauccgcggcuuccccaccaucaagaucuuccagaagggcgagucccccgucgacuacgacggcggccgcacccgcuccgacaucgucucccgcgcccucgaccucuucuccgacaacgcccccccccccgagcuccucgagaucaucaacgaggacaucgccaagcgcaccugcgaggagcaccagcucugcgucgucgccguccucccccacauccucgacaccggcgccgccggccgcaacuccuaccucgagguccuccucaagcucgccgacaaguacaagaagaagauguggggcuggcucuggaccgaggccggcgcccaguccgagcucgagaccgcccucggcaucggcggcuucggcuaccccgccauggccgccaucaacgcccgcaagaugaaguucgcccuccucaagggcuccuucuccgagcagggcaucaacgaguuccuccgcgagcucuccuucggccgcggcuccaccgcccccgucggcggcggcgccuuccccaccaucgucgagcgcgagcccugggacggccgcgacggcgagcuccccgucgaggacgacaucgaccucuccgacgucgagcucgacgaccucggcaaggacgagcucuga

SEQ ID NO: 47456 - RNA, 1371 nt, Artificial Sequence
  derived and/or modified sequence opt2 from PDK1__Homo_sapiens__NP_001265478
augcgccucgcccgccuccuccgcggcgccgcccucgccggccccggccccggccuccgcgccgccggcuucucccgcuccuucuccuccgacuccggcuccucccccgccuccgagcgcggcguccccggccaggucgacuucuacgcccgcuucucccccuccccccucuccaugaagcaguuccucgacuucggcuccgucaacgccugcgagaagaccuccuucauguuccuccgccaggagcuccccguccgccucgccaacaucaugaaggagaucucccuccuccccgacaaccuccuccgcacccccuccguccagcucguccaguccugguacauccagucccuccaggagcuccucgacuucaaggacaaguccgccgaggacgccaaggccaucuacgagcgcccccgccgcaccuggcuccaggucuccucccucugcugcauggccugcaagaugaucuucaccgacaccgucauccgcauccgcaaccgccacaacgacgucauccccaccauggcccagggcgucaucgaguacaaggaguccuucggcgucgaccccgucaccucccagaacguccaguacuuccucgaccgcuucuacaugucccgcaucuccauccgcaugcuccucaaccagcacucccuccucuucggcggcaagggcaagggcucccccucccaccgcaagcacaucggcuccaucaaccccaacugcaacguccucgaggucaucaaggacggcuacgagaacgcccgccgccucugcgaccucuacuacaucaacucccccgagcucgagcucgaggagcucaacgccaagucccccggccagcccauccaggucgucuacguccccucccaccucuaccacauggucuucgagcucuucaagaacgccaugcgcgccaccauggagcaccacgccaaccgcggcgucuacccccccauccagguccacgucacccucggcaacgaggaccucaccgucaagauguccgaccgcggcggcggcgucccccuccgcaagaucgaccgccucuucaacuacauguacuccaccgccccccgcccccgcgucgagaccucccgcgccgucccccucgccggcuucggcuacggccuccccaucucccgccucuacgcccaguacuuccagggcgaccucaagcucuacucccucgagggcuacggcaccgacgccgucaucuacaucaaggcccucuccaccgacuccaucgagcgccuccccgucuacaacaaggccgccuggaagcacuacaacaccaaccacgaggccgacgacuggugcguccccucccgcgagcccaaggacaugaccaccuuccgcuccgccuga

SEQ ID NO: 47457 - RNA, 1032 nt, Artificial Sequence
  derived and/or modified sequence opt2 from PDK2__Homo_sapiens__NP_001186828
augaaggagaucaaccuccuccccgaccgcguccucuccacccccuccguccagcucguccaguccugguacguccagucccuccucgacaucauggaguuccucgacaaggaccccgaggaccaccgcacccucucccaguucaccgacgcccucgucaccauccgcaaccgccacaacgacgucguccccaccauggcccagggcguccucgaguacaaggacaccuacggcgacgaccccgucuccaaccagaacauccaguacuuccucgaccgcuucuaccucucccgcaucuccauccgcaugcucaucaaccagcacacccucaucuucgacggcuccaccaaccccgcccaccccaagcacaucggcuccaucgaccccaacugcaacgucuccgaggucgucaaggacgccuacgacauggccaagcuccucugcgacaaguacuacauggccucccccgaccucgagauccaggagaucaacgccgccaacuccaagcagcccauccacauggucuacguccccucccaccucuaccacaugcucuucgagcucuucaagaacgccaugcgcgccaccgucgagucccacgaguccucccucauccucccccccaucaaggucauggucgcccucggcgaggaggaccucuccaucaagauguccgaccgcggcggcggcgucccccuccgcaagaucgagcgccucuucuccuacauguacuccaccgcccccaccccccagcccggcaccggcggcaccccccucgccggcuucggcuacggccuccccaucucccgccucuacgccaaguacuuccagggcgaccuccagcucuucuccauggagggcuucggcaccgacgccgucaucuaccucaaggcccucuccaccgacuccgucgagcgccuccccgucuacaacaaguccgccuggcgccacuaccagaccauccaggaggccggcgacuggugcguccccuccaccgagcccaagaacaccuccaccuaccgcgucuccuga

SEQ ID NO: 47458 - RNA, 1248 nt, Artificial Sequence
  derived and/or modified sequence opt2 from PDK3__Homo_sapiens__NP_001135858
augcgccucuuccgcuggcuccucaagcagcccguccccaagcagaucgagcgcuacucccgcuucucccccuccccccucuccaucaagcaguuccucgacuucggccgcgacaacgccugcgagaagaccuccuacauguuccuccgcaaggagcuccccguccgccucgccaacaccaugcgcgaggucaaccuccuccccgacaaccuccucaaccgccccuccgucggccucguccaguccugguacaugcaguccuuccucgagcuccucgaguacgagaacaagucccccgaggacccccagguccucgacaacuuccuccagguccucaucaagguccgcaaccgccacaacgacgucguccccaccauggcccagggcgucaucgaguacaaggagaaguucggcuucgaccccuucaucuccaccaacauccaguacuuccucgaccgcuucuacaccaaccgcaucuccuuccgcaugcucaucaaccagcacacccuccucuucggcggcgacaccaaccccguccaccccaagcacaucggcuccaucgaccccaccugcaacgucgccgacgucgucaaggacgccuacgagaccgccaagaugcucugcgagcaguacuaccucgucgcccccgagcucgaggucgaggaguucaacgccaaggcccccgacaagcccauccaggucgucuacguccccucccaccucuuccacaugcucuucgagcucuucaagaacuccaugcgcgccaccgucgagcucuacgaggaccgcaaggagggcuaccccgccgucaagacccucgucacccucggcaaggaggaccucuccaucaagaucuccgaccucggcggcggcgucccccuccgcaagaucgaccgccucuucaacuacauguacuccaccgccccccgccccucccucgagcccacccgcgccgccccccucgccggcuucggcuacggccuccccaucucccgccucuacgcccgcuacuuccagggcgaccucaagcucuacuccauggagggcgucggcaccgacgccgucaucuaccucaaggcccucuccuccgaguccuucgagcgccuccccgucuucaacaaguccgccuggcgccacuacaagaccacccccgaggccgacgacugguccaaccccuccuccgagccccgcgacgccuccaaguacaaggccaagcaggacaagaucaagaccaaccgcaccuucuga

SEQ ID NO: 47459 - RNA, 1236 nt, Artificial Sequence
  derived and/or modified sequence opt2 from PDK4__Homo_sapiens__NP_002603
augaaggccgcccgcuucguccuccgcuccgccggcucccucaacggcgccggccucgucccccgcgaggucgagcacuucucccgcuacucccccuccccccucuccaugaagcagcuccucgacuucggcuccgagaacgccugcgagcgcaccuccuucgccuuccuccgccaggagcuccccguccgccucgccaacauccucaaggagaucgacauccuccccacccagcucgucaacaccuccuccguccagcucgucaaguccugguacauccagucccucauggaccucgucgaguuccacgagaagucccccgacgaccagaaggcccucuccgacuucgucgacacccucaucaagguccgcaaccgccaccacaacgucguccccaccauggcccagggcaucaucgaguacaaggacgccugcaccgucgaccccgucaccaaccagaaccuccaguacuuccucgaccgcuucuacaugaaccgcaucuccacccgcaugcucaugaaccagcacauccucaucuucuccgacucccagaccggcaaccccucccacaucggcuccaucgaccccaacugcgacgucgucgccgucguccaggacgccuucgagugcucccgcaugcucugcgaccaguacuaccucuccucccccgagcucaagcucacccaggucaacggcaaguuccccgaccagcccauccacaucgucuacguccccucccaccuccaccacaugcucuucgagcucuucaagaacgccaugcgcgccaccgucgagcaccaggagaaccagcccucccucacccccaucgaggucaucgucguccucggcaaggaggaccucaccaucaagaucuccgaccgcggcggcggcgucccccuccgcaucaucgaccgccucuucuccuacaccuacuccaccgcccccacccccgucauggacaacucccgcaacgccccccucgccggcuucggcuacggccuccccaucucccgccucuacgccaaguacuuccagggcgaccucaaccucuacucccucuccggcuacggcaccgacgccaucaucuaccucaaggcccucuccuccgaguccaucgagaagcuccccgucuucaacaaguccgccuucaagcacuaccagauguccuccgaggccgacgacuggugcauccccucccgcgagcccaagaaccucgccaaggaggucgccauguga

SEQ ID NO: 47460 - RNA, 990 nt, Artificial Sequence
  derived and/or modified sequence opt2 from PDLIM1__Homo_sapiens__NP_066272
augaccacccagcagaucgaccuccagggccccggccccuggggcuuccgccucgucggcggcaaggacuucgagcagccccucgccaucucccgcgucacccccggcuccaaggccgcccucgccaaccucugcaucggcgacgucaucaccgccaucgacggcgagaacaccuccaacaugacccaccucgaggcccagaaccgcaucaagggcugcaccgacaaccucacccucaccgucgcccgcuccgagcacaaggucugguccccccucgucaccgaggagggcaagcgccaccccuacaagaugaaccucgccuccgagccccaggagguccuccacaucggcuccgcccacaaccgcuccgccaugcccuucaccgccucccccgccuccuccaccaccgcccgcgucaucaccaaccaguacaacaaccccgccggccucuacuccuccgagaacaucuccaacuucaacaacgcccucgaguccaagaccgccgccuccggcgucgaggccaacucccgcccccucgaccacgcccagccccccuccucccucgucaucgacaaggaguccgaggucuacaagaugcuccaggagaagcaggagcucaacgagccccccaagcaguccaccuccuuccucguccuccaggagauccucgaguccgaggagaagggcgaccccaacaagcccuccggcuuccgcuccgucaaggcccccgucaccaaggucgccgccuccaucggcaacgcccagaagcuccccaugugcgacaagugcggcaccggcaucgucggcgucuucgucaagcuccgcgaccgccaccgccaccccgagugcuacgucugcaccgacugcggcaccaaccucaagcagaagggccacuucuucgucgaggaccagaucuacugcgagaagcacgcccgcgagcgcgucaccccccccgagggcuacgaggucgucaccgucuuccccaaguga

SEQ ID NO: 47461 - RNA, 1809 nt, Artificial Sequence
  derived and/or modified sequence opt2 from PDLIM2__Homo_sapiens__NP_067643
augcgcggcggccgcgcccgccccgccugggaguccuucaugggccuccccccccgcuccuccgccaaguggggcgccggccagucccucgaccgccucugcugcgcccccggcucccgcggccucgccggcgcccccggccgcaugcgcgccccccccgccggccgcucccagcccgccggcggccccggcgacucccucccccacccccccggcggccucggccccggcggcuccgccugggcccgccgcgccgaggccgccgccucccgcgcccgcggcggcggccgcggcggccccggcaucaccugggccgaggccggccccggcgcccccggcggccucucccccgaguccggccgccgccagcgcgagcgcuggcgccuccccgccuucccccccucccgcgccugggcccccucccgcaccggcgagcgccagcccggcgagcgcgcccaccuccgccucuccgcccgccccgcccuccccggcgccggccuccucuccgccccccucuccgcccgcaaccccggccucguccgcggccccgcccccuggucccucgccuccgccggcgcccccccccgcgccgcccucucccccgccggcgcccuccuccuccagccccccgcccgccgcguccucugcccccgcuccgagggcggcucccgcaccggccgcgccggccccuccggcugggcccccccccgcggcgcccgcuccgccgaguccaccgaccgccucaagggcauggcccucaccgucgacgucgccggccccgcccccuggggcuuccgcaucaccggcggccgcgacuuccacacccccaucauggucaccaaggucgccgagcgcggcaaggccaaggacgccgaccuccgccccggcgacaucaucgucgccaucaacggcgaguccgccgagggcaugcuccacgccgaggcccaguccaagauccgccagucccccuccccccuccgccuccagcucgaccgcucccaggccaccucccccggccagaccaacggcgacuccucccucgagguccucgccacccgcuuccagggcuccguccgcaccuacaccgagucccaguccucccuccgcuccuccuacuccucccccaccucccucuccccccgcgccggcucccccuucucccccccccccuccuccuccucccucaccggcgaggccgccaucucccgcuccuuccagucccucgccugcucccccggccuccccgccgccgaccgccucuccuacuccggccgccccggcucccgccaggccggccucggccgcgccggcgacuccgccguccucguccucccccccucccccggcccccgcuccucccgccccuccauggacuccgagggcggcucccuccuccucgacgaggacuccgaggucuucaagaugcuccaggagaaccgcgagggccgcgccgccccccgccaguccuccuccuuccgccuccuccaggaggcccucgaggccgaggagcgcggcggcacccccgccuuccuccccuccucccucuccccccaguccucccuccccgccucccgcgcccucgccaccccccccaagcuccacaccugcgagaagugcuccaccuccaucgccaaccaggccguccgcauccaggagggccgcuaccgccaccccggcugcuacaccugcgccgacugcggccucaaccucaagaugcgcggccacuucugggucggcgacgagcucuacugcgagaagcacgcccgccagcgcuacuccgcccccgccacccucuccucccgcgccuga

SEQ ID NO: 47462 - RNA, 951 nt, Artificial Sequence
  derived and/or modified sequence opt2 from PDLIM3__Homo_sapiens__NP_001107579
augccccagaccgucauccuccccggccccgcccccuggggcuuccgccucuccggcggcaucgacuucaaccagccccucgucaucacccgcaucacccccggcuccaaggccgccgccgccaaccucugccccggcgacgucauccucgccaucgacggcuucggcaccgaguccaugacccacgccgacgcccaggaccgcaucaaggccgccgcccaccagcucugccucaagaucgaccgcggcgagacccaccucugguccccccaggucuccgaggacggcaaggcccaccccuucaagaucaaccucgaguccgagccccaggaguucaagcccaucggcaccgcccacaaccgccgcgcccagcccuucgucgccgccgccaacaucgacgacaagcgccaggucgucuccgccuccuacaacucccccaucggccucuacuccaccuccaacauccaggacgcccuccacggccagcuccgcggccucauccccuccuccccccagaacgagcccaccgccuccgucccccccgaguccgacgucuaccgcaugcuccacgacaaccgcaacgagcccacccagccccgccaguccggcuccuuccgcguccuccagggcauggucgacgacggcuccgacgaccgccccgccggcacccgcuccguccgcgcccccgucaccaagguccacggcggcuccggcggcgcccagcgcaugccccucugcgacaagugcggcuccggcaucgucggcgccgucgucaaggcccgcgacaaguaccgccaccccgagugcuucgucugcgccgacugcaaccucaaccucaagcagaagggcuacuucuucaucgagggcgagcucuacugcgagacccacgcccgcgcccgcaccaagccccccgagggcuacgacaccgucacccucuaccccaaggccuga

SEQ ID NO: 47463 - RNA, 741 nt, Artificial Sequence
  derived and/or modified sequence opt2 from PDLIM4__Homo_sapiens__NP_001124499
augccccacuccgucacccuccgcggccccucccccuggggcuuccgccucgucggcggccgcgacuucuccgccccccucaccaucucccgcguccacgccggcuccaaggccgcccucgccgcccucugccccggcgaccucauccaggccaucaacggcgaguccaccgagcucaugacccaccucgaggcccagaaccgcaucaagggcugccacgaccaccucacccucuccgucucccgccccgagggccgcuccuggcccuccgcccccgacgacuccaaggcccaggcccaccgcauccacaucgaccccgagauccaggacggcucccccaccaccucccgccgccccuccggcaccggcaccggccccgaggacggccgccccucccucggcucccccuacggccagcccccccgcuuccccgucccccacaacggcuccuccgaggccacccuccccgcccagauguccacccuccacgucucccccccccccuccgccgaccccgcccgcggccucccccgcucccgcgacugccgcgucgaccucggcuccgaggucuaccgcaugcuccgcgagcccgccgagcccgucgccgccgagcccaagcaguccggcuccuuccgcuaccuccagggcaugcucgaggccggcgagggcggcgcccccuccucccgccacggcaccuccuccaccauccccuccgccuccugcgccgucaccgccgccuga

SEQ ID NO: 47464 - RNA, 1464 nt, Artificial Sequence
  derived and/or modified sequence opt2 from PDLIM5__Homo_sapiens__NP_001011513
auguccaacuacuccgucucccucgucggccccgcccccuggggcuuccgccuccagggcggcaaggacuucaacaugccccucaccaucuccucccucaaggacggcggcaaggccgcccaggccaacguccgcaucggcgacgucguccucuccaucgacggcaucaacgcccagggcaugacccaccucgaggcccagaacaagaucaagggcugcaccggcucccucaacaugacccuccagcgcgccuccgccgcccccaagcccgagcccguccccguccagaagcccaccgucaccuccgucugcuccgagaccucccaggagcucgccgagggccagcgccgcggcucccagggcgacuccaagcagcagaacggccccccccgcaagcacaucgucgagcgcuacaccgaguucuaccacguccccacccacuccgacgccuccaagaagcgccucaucgaggacaccgaggacuggcgcccccgcaccggcaccacccagucccgcuccuuccgcauccucgcccagaucaccggcaccgagcaccucaaggaguccgaggccgacaacaccaagaaggccaacaacucccaggagcccuccccccagcucgccuccuccgucgccuccacccgcuccaugcccgagucccucgacucccccaccuccggccgccccggcgucaccucccucaccaccgccgccgccuucaagcccgucggcuccaccggcgucaucaagucccccuccuggcagcgccccaaccagggcguccccuccaccggccgcaucuccaacuccgccaccuacuccggcuccgucgcccccgccaacuccgcccucggccagacccagcccuccgaccaggacacccucguccagcgcgccgagcacauccccgccggcaagcgcacccccaugugcgcccacugcaaccaggucauccgcggccccuuccucgucgcccucggcaaguccuggcaccccgaggaguucaacugcgcccacugcaagaacaccauggccuacaucggcuucgucgaggagaagggcgcccucuacugcgagcucugcuacgagaaguucuucgcccccgagugcggccgcugccagcgcaagauccucggcgaggucaucuccgcccucaagcagaccuggcacgucuccugcuucgucugcgucgccugcggcaagcccauccgcaacaacgucuuccaccucgaggacggcgagcccuacugcgagaccgacuacuacgcccucuucggcaccaucugccacggcugcgaguuccccaucgaggccggcgacauguuccucgaggcccucggcuacaccuggcacgacaccugcuucgucugcuccgucugcugcgagucccucgagggccagaccuucuucuccaagaaggacaagccccucugcaagaagcacgcccacuccgucaacuucuga

SEQ ID NO: 47465 - RNA, 1374 nt, Artificial Sequence
  derived and/or modified sequence opt2 from PDLIM7__Homo_sapiens__NP_005442
auggacuccuucaaggucguccucgagggccccgcccccuggggcuuccgccuccagggcggcaaggacuucaacgucccccucuccaucucccgccucacccccggcggcaaggccgcccaggccggcgucgccgucggcgacuggguccucuccaucgacggcgagaacgccggcucccucacccacaucgaggcccagaacaagauccgcgccugcggcgagcgccucucccucggccucucccgcgcccagcccguccaguccaagccccagaaggccuccgcccccgccgccgaccccccccgcuacaccuucgcccccuccgucucccucaacaagaccgcccgccccuucggcgcccccccccccgccgacuccgccccccagcagaacggccagccccuccgcccccucguccccgacgccuccaagcagcgccucauggagaacaccgaggacuggcgcccccgccccggcaccggccagucccgcuccuuccgcauccucgcccaccucaccggcaccgaguucaugcaggaccccgacgaggagcaccucaagaaguccucccaggucccccgcaccgaggcccccgcccccgccuccuccaccccccaggagcccuggcccggccccaccgcccccucccccaccucccgcccccccugggccgucgaccccgccuucgccgagcgcuacgcccccgacaagaccuccaccguccucacccgccacucccagcccgccacccccaccccccuccagucccgcaccuccaucguccaggccgccgccggcggcguccccggcggcggcuccaacaacggcaagacccccgucugccaccagugccacaaggucauccgcggccgcuaccucgucgcccucggccacgccuaccaccccgaggaguucgucugcucccagugcggcaagguccucgaggagggcggcuucuucgaggagaagggcgccaucuucugcccccccugcuacgacguccgcuacgcccccuccugcgccaagugcaagaagaagaucaccggcgagaucaugcacgcccucaagaugaccuggcacguccacugcuucaccugcgccgccugcaagacccccauccgcaaccgcgccuucuacauggaggagggcguccccuacugcgagcgcgacuacgagaagauguucggcaccaagugccacggcugcgacuucaagaucgacgccggcgaccgcuuccucgaggcccucggcuucuccuggcacgacaccugcuucgucugcgccaucugccagaucaaccucgagggcaagaccuucuacuccaagaaggaccgcccccucugcaagucccacgccuucucccacgucuga

SEQ ID NO: 47466 - RNA, 1689 nt, Artificial Sequence
  derived and/or modified sequence opt2 from PDP1__Homo_sapiens__NP_001155251
augugcgucugccccggcccccgccgcaucggcauccccguccgcuccuccucccucccccucuucuccgacgccaugcccgcccccacccagcucuucuucccccucauccgcaacugcgagcucucccgcaucuacggcaccgccugcuacugccaccacaagcaccucugcugcuccuccuccuacaucccccagucccgccuccgcuacaccccccaccccgccuacgccaccuucugccgccccaaggagaacugguggcaguacacccagggccgccgcuacgccuccaccccccagaaguucuaccucacccccccccaggucaacuccauccucaaggccaacgaguacuccuucaagguccccgaguucgacggcaagaacgucuccuccauccucggcuucgacuccaaccagcuccccgccaacgcccccaucgaggaccgccgcuccgccgccaccugccuccagacccgcggcaugcuccucggcgucuucgacggccacgccggcugcgccugcucccaggccgucuccgagcgccucuucuacuacaucgccgucucccuccucccccacgagacccuccucgagaucgagaacgccgucgaguccggccgcgcccuccuccccauccuccaguggcacaagcaccccaacgacuacuucuccaaggaggccuccaagcucuacuucaacucccuccgcaccuacuggcaggagcucaucgaccucaacaccggcgaguccaccgacaucgacgucaaggaggcccucaucaacgccuucaagcgccucgacaacgacaucucccucgaggcccaggucggcgaccccaacuccuuccucaacuaccucguccuccgcgucgccuucuccggcgccaccgccugcgucgcccacgucgacggcgucgaccuccacgucgccaacaccggcgacucccgcgccaugcucggcguccaggaggaggacggcuccugguccgccgucacccucuccaacgaccacaacgcccagaacgagcgcgagcucgagcgccucaagcucgagcaccccaaguccgaggccaaguccgucgucaagcaggaccgccuccucggccuccucaugcccuuccgcgccuucggcgacgucaaguucaagugguccaucgaccuccagaagcgcgucaucgaguccggccccgaccagcucaacgacaacgaguacaccaaguucaucccccccaacuaccacaccccccccuaccucaccgccgagcccgaggucaccuaccaccgccuccgcccccaggacaaguuccucguccucgccaccgacggccucugggagaccaugcaccgccaggacgucguccgcaucgucggcgaguaccucaccggcaugcaccaccagcagcccaucgccgucggcggcuacaaggucacccucggccagaugcacggccuccucaccgagcgccgcaccaagauguccuccgucuucgaggaccagaacgccgccacccaccucauccgccacgccgucggcaacaacgaguucggcaccgucgaccacgagcgccucuccaagaugcucucccuccccgaggagcucgcccgcauguaccgcgacgacaucaccaucaucgucguccaguucaacucccacgucgucggcgccuaccagaaccaggaguga

SEQ ID NO: 47467 - RNA, 1590 nt, Artificial Sequence
  derived and/or modified sequence opt2 from PDP2__Homo_sapiens__NP_065837
auguccuccaccgucuccuacuggauccucaacuccacccgcaacuccaucgccacccuccagggcggccgccgccucuacucccgcuacgucuccaaccgcaacaagcucaaguggcgccucuucucccgcgucccccccacccucaacuccucccccugcggcggcuucacccucugcaaggccuaccgccacaccuccaccgaggaggacgacuuccaccuccagcucucccccgagcagaucaacgagguccuccgcgccggcgagaccacccacaagauccucgaccucgagucccgcguccccaacuccguccuccgcuucgaguccaaccagcucgccgccaacucccccgucgaggaccgccgcggcgucgccuccugccuccagaccaacggccucauguucggcaucuucgacggccacggcggccacgccugcgcccaggccgucuccgagcgccucuucuacuacgucgccgucucccucaugucccaccagacccucgagcacauggagggcgccauggaguccaugaagccccuccuccccauccuccacuggcucaagcaccccggcgacuccaucuacaaggacgucaccuccguccaccucgaccaccuccgcgucuacuggcaggagcuccucgaccuccacauggagaugggccucuccaucgaggaggcccucauguacuccuuccagcgccucgacuccgacaucucccucgagauccaggccccccucgaggacgaggucacccgcaaccucucccuccaggucgccuucuccggcgccaccgccugcauggcccacgucgacggcauccaccuccacgucgccaacgccggcgacugccgcgccauccucggcguccaggaggacaacggcaugugguccugccucccccucacccgcgaccacaacgccuggaaccaggccgagcucucccgccucaagcgcgagcaccccgaguccgaggaccgcaccaucaucauggaggaccgccuccucggcguccucauccccugccgcgccuucggcgacguccagcucaagugguccaaggagcuccagcgcuccauccucgagcgcggcuucaacaccgaggcccucaacaucuaccaguucacccccccccacuacuacaccccccccuaccucaccgccgagcccgaggucaccuaccaccgccuccgcccccaggacaaguuccucguccucgccuccgacggccucugggacaugcucuccaacgaggacgucguccgccucgucgucggccaccucgccgaggccgacuggcacaagaccgaccucgcccagcgccccgccaaccucggccucaugcagucccuccuccuccagcgcaaggccuccggccuccacgaggccgaccagaacgccgccacccgccucauccgccacgccaucggcaacaacgaguacggcgagauggaggccgagcgccucgccgccaugcucacccuccccgaggaccucgcccgcauguaccgcgacgacaucaccgucaccgucgucuacuucaacuccgaguccaucggcgccuacuacaagggcggcuga

SEQ ID NO: 47468 - RNA, 1365 nt, Artificial Sequence
  derived and/or modified sequence opt2 from PDPK1__Homo_sapiens__NP_001248745
auggcccgcaccaccucccagcucuacgacgccguccccauccaguccuccgucguccucugcuccugccccucccccuccaugguccgcacccagaccgaguccuccaccccccccggcauccccggcggcucccgccagggccccgccauggacggcaccgccgccgagccccgccccggcgccggcucccuccagcacgcccagccccccccccagccccgcaagaagcgccccgaggacuucaaguucggcaagauccucggcgagggcuccuucuccaccgucguccucgcccgcgagcucgccaccucccgcgaguacgccaucaagauccucgagaagcgccacaucaucaaggagaacaagguccccuacgucacccgcgagcgcgacgucaugucccgccucgaccaccccuucuucgucaagcucuacuucaccuuccaggacgacgagaagcucuacuucggccucuccuacgccaagaacggcgagcuccucaaguacauccgcaagaucggcuccuucgacgagaccugcacccgcuucuacaccgccgagaucgucuccgcccucgaguaccuccacggcaagggcaucauccaccgcgaccucaagcccgagaacauccuccucaacgaggacaugcacauccagaucaccgacuucggcaccgccaagguccucucccccgaguccaagcaggcccgcgccaacuccuucgucggcaccgcccaguacgucucccccgagcuccucaccgagaaguccgccugcaaguccuccgaccucugggcccucggcugcaucaucuaccagcucgucgccggccucccccccuuccgcgccggcaacgaguaccucaucuuccagaagaucaucaagcucgaguacgacuuccccgagaaguucuuccccaaggcccgcgaccucgucgagaagcuccucguccucgacgccaccaagcgccucggcugcgaggagauggagggcuacggcccccucaaggcccaccccuucuucgaguccgucaccugggagaaccuccaccagcagaccccccccaagcucaccgccuaccuccccgccauguccgaggacgacgaggacugcuacggcaacuacgacaaccuccucucccaguucggcugcaugcaggucuccuccuccuccuccucccacucccucuccgccuccgacaccggccucccccagcgcuccggcuccaacaucgagcaguacauccacgaccucgacuccaacuccuucgagcucgaccuccaguucuccgaggacgagaagcgccuccuccucgagaagcaggccggcggcaaccccugccucaccggccgcaucaucuga

SEQ ID NO: 47469 - RNA, 2640 nt, Artificial Sequence
  derived and/or modified sequence opt2 from PDPR__Homo_sapiens__NP_060460
augauguucuaccgccuccucuccaucgucggccgccagcgcgccucccccggcuggcagaacugguccuccgcccgcaacuccaccuccgccgccgaggcccgcuccauggcccuccccacccaggcccaggucgucaucugcggcggcggcaucaccggcaccuccgucgccuaccaccucuccaagaugggcuggaaggacaucguccuccucgagcagggccgccucgccgccggcuccacccgcuucugcgccggcauccucuccaccgcccgccaccucaccaucgagcagaagauggccgacuacuccaacaagcucuacuaccagcucgagcaggagaccggcauccagaccggcuacacccgcaccggcuccaucuuccucgcccagacccaggaccgccucaucucccucaagcgcaucaacgccggccucaacgucaucggcauccccuccgagaucaucucccccaagaaggucgccgagcuccaccaccuccucaacguccacgaccucgucggcgccaugcacguccccgaggacgccgucgucuccuccgccgacgucgcccucgcccucgccuccgccgccucccagaacggcguccagaucuacgaccgcaccuccguccuccacgucauggucaagaagggccaggucaccggcgucgagaccgacaagggccagaucgagugccaguacuucgucaacugcgccggccagugggccuacgagcucggccucuccaacgaggagcccgucuccaucccccuccacgccugcgagcacuucuaccuccucacccgcccccucgagaccccccuccaguccuccacccccaccaucgucgacgccgacggccgcaucuacauccgcaacuggcagggcggcauccucuccggcggcuucgagaagaaccccaagcccaucuucaccgagggcaagaaccagcucgagauccagaaccuccaggaggacugggaccacuucgagccccuccucuccucccuccuccgccgcaugcccgagcucgagacccucgagaucaugaagcucgucaacugccccgagaccuucacccccgacaugcgcugcaucaugggcgagucccccgccguccagggcuacuucguccucgccggcaugaacuccgccggccucuccuucggcggcggcgccggcaaguaccucgccgaguggaugguccacggcuaccccuccgagaacgucugggagcucgaccucaagcgcuucggcgcccuccaguccucccgcaccuuccuccgccaccgcgucauggaggucaugccccucauguacgaccucaaggucccccgcugggacuuccagaccggccgccagcuccgcaccuccccccucuacgaccgccucgacgcccagggcgcccgcuggauggagaagcacggcuucgagcgccccaaguacuucgucccccccgacaaggaccuccucgcccucgagcaguccaagaccuucuacaagcccgacugguucgacaucgucgaguccgaggucaagugcugcaaggaggccgucugcgucaucgacauguccuccuucaccaaguucgagaucaccuccaccggcgaccaggcccucgagguccuccaguaccucuucuccaacgaccucgacguccccgucggccacaucguccacaccggcaugcucaacgagggcggcggcuacgagaacgacugcuccaucgcccgccucaacaagcgcuccuucuucaugaucucccccaccgaccagcagguccacugcugggccuggcucaagaagcacaugcccaaggacuccaaccuccuccucgaggacgucaccuggaaguacaccgcccucaaccucaucggcccccgcgccgucgacguccucuccgagcucuccuacgcccccaugacccccgaccacuuccccucccucuucugcaaggagauguccgucggcuacgccaacggcauccgcgucauguccaugacccacaccggcgagcccggcuucaugcucuacauccccaucgaguacgcccuccacgucuacaacgaggucauguccgucggccagaaguacggcauccgcaacgccggcuacuacgcccuccgcucccuccgcaucgagaaguucuucgccuucuggggccaggacaucaacaaccucaccaccccccucgagugcggccgcgagucccgcgucaagcucgagaagggcauggacuucaucggccgcgacgcccuccuccagcagaagcagaacggcgucuacaagcgccucaccauguucauccucgacgaccacgacuccgaccucgaccucuggcccugguggggcgagcccaucuaccgcaacggccaguacgucggcaagaccaccuccuccgccuacuccuacucccucgagcgccacgucugccucggcuucguccacaacuucuccgaggacaccggcgaggagcaggucgucaccgccgacuucaucaaccgcggcgaguacgagaucgacaucgccggcuaccgcuuccaggccaaggccaagcucuaccccgucgccucccucuucacccagaagcgccgcaaggacgacauggagcucuccgaccuccacggcaaguga

SEQ ID NO: 47470 - RNA, 402 nt, Artificial Sequence
  derived and/or modified sequence opt2 from PDRG1__Homo_sapiens__NP_110442
augcucucccccgaggccgagcgcguccuccgcuaccucgucgaggucgaggagcucgccgaggagguccucgccgacaagcgccagaucgucgaccucgacaccaagcgcaaccagaaccgcgagggccuccgcgcccuccagaaggaccucucccucuccgaggacgucauggucugcuucggcaacauguucaucaagaugccccaccccgagaccaaggagaugaucgagaaggaccaggaccaccucgacaaggagaucgagaagcuccgcaagcagcucaaggucaaggucaaccgccucuucgaggcccagggcaagcccgagcucaagggcuucaaccucaacccccucaaccaggacgagcucaaggcccucaaggucauccucaagggcuga

SEQ ID NO: 47471 - RNA, 4014 nt, Artificial Sequence
  derived and/or modified sequence opt2 from PDS5A__Homo_sapiens__NP_001093869
auggacuucaccgcccagcccaagcccgccaccgcccucugcggcgucgucuccgccgacggcaagaucgccuacccccccggcgucaaggagaucaccgacaagaucaccaccgacgagaugaucaagcgccucaagauggucgucaagaccuucauggacauggaccaggacuccgaggacgagaagcagcaguaccucccccucgcccuccaccucgccuccgaguucuuccuccgcaaccccaacaaggacguccgccuccucgucgccugcugccucgccgacaucuuccgcaucuacgcccccgaggcccccuacaccucccacgacaagcucaaggacaucuuccucuucaucacccgccagcucaagggccucgaggacaccaaguccccccaguucaaccgcuacuucuaccuccucgagaaccucgccugggucaaguccuacaacaucugcuucgagcucgaggacugcaacgagaucuucauccagcucuuccgcacccucuucuccgucaucaacaacucccacaacaagaagguccagaugcacaugcucgaccucauguccuccaucaucauggagggcgacggcgucacccaggagcuccucgacuccauccucaucaaccucauccccgcccacaagaaccucaacaagcaguccuucgaccucgccaagguccuccucaagcgcaccguccagaccaucgaggccugcaucgccaacuucuucaaccagguccucguccucggccgcuccuccgucuccgaccucuccgagcacgucuucgaccucauccaggagcucuucgccaucgacccccaccuccuccucuccgucaugccccagcucgaguucaagcucaaguccaacgacggcgaggagcgccucgccgucguccgccuccucgccaagcucuucggcuccaaggacuccgaccucgccacccagaaccgcccccucuggcagugcuuccucggccgcuucaacgacauccacguccccguccgccucgaguccgucaaguucgccucccacugccucaugaaccaccccgaccucgccaaggaccucaccgaguaccucaagguccgcucccacgaccccgaggaggccauccgccacgacgucaucgucaccaucaucaccgccgccaagcgcgaccucgcccucgucaacgaccagcuccucggcuucguccgcgagcgcacccucgacaagcgcuggcgcguccgcaaggaggccaugaugggccucgcccagcucuacaagaaguacugccuccacggcgaggccggcaaggaggccgccgagaaggucuccuggaucaaggacaagcuccuccacaucuacuaccagaacuccaucgacgacaagcuccucgucgagaagaucuucgcccaguaccucgucccccacaaccucgagaccgaggagcgcaugaagugccucuacuaccucuacgccucccucgaccccaacgccgucaaggcccucaacgagauguggaagugccagaacaugcuccgcucccacguccgcgagcuccucgaccuccacaagcagcccaccuccgaggccaacugcuccgccauguucggcaagcucaugaccaucgccaagaaccuccccgaccccggcaaggcccaggacuucgucaagaaguucaaccagguccucggcgacgacgagaagcuccgcucccagcucgagcuccucaucucccccaccugcuccugcaagcaggccgacaucugcguccgcgagaucgcccgcaagcucgccaaccccaagcagcccaccaaccccuuccucgagauggucaaguuccuccucgagcgcaucgcccccguccacaucgacuccgaggccaucuccgcccucgucaagcucaugaacaaguccaucgagggcaccgccgacgacgaggaggagggcgucucccccgacaccgccauccgcuccggccucgagcuccucaagguccucuccuucacccaccccaccuccuuccacuccgccgagaccuacgagucccuccuccagugccuccgcauggaggacgacaaggucgccgaggccgccauccagaucuuccgcaacaccggccacaagaucgagaccgaccucccccagauccgcuccacccucauccccauccuccaccagaaggccaagcgcggcaccccccaccaggccaagcaggccguccacugcauccacgccaucuucaccaacaaggagguccagcucgcccagaucuucgagccccucucccgcucccucaacgccgacguccccgagcagcucaucaccccccucgucucccucggccacaucuccaugcucgcccccgaccaguucgccucccccaugaaguccgucgucgccaacuucaucgucaaggaccuccucaugaacgaccgcuccaccggcgagaagaacggcaagcucuggucccccgacgaggaggucucccccgagguccucgccaagguccaggccaucaagcuccucguccgcuggcuccucggcaugaagaacaaccaguccaaguccgccaacuccacccuccgccuccucuccgccaugcucgucuccgagggcgaccucaccgagcagaagcgcaucuccaaguccgacaugucccgccuccgccucgccgccggcuccgccaucaugaagcucgcccaggagcccugcuaccacgagaucaucacccccgagcaguuccagcucugcgcccucgucaucaacgacgagugcuaccagguccgccagaucuucgcccagaagcuccacaaggcccucgucaagcuccuccucccccucgaguacauggccaucuucgcccucugcgccaaggaccccgucaaggagcgccgcgcccacgcccgccagugccuccucaagaacaucuccauccgccgcgaguacaucaagcagaaccccauggccaccgagaagcuccucucccuccuccccgaguacgucguccccuacaugauccaccuccucgcccacgaccccgacuucacccgcucccaggacgucgaccagcuccgcgacaucaaggagugccucugguucaugcucgagguccucaugaccaagaacgagaacaacucccacgccuucaugaagaagauggccgagaacaucaagcucacccgcgacgcccagucccccgacgaguccaagaccaacgagaagcucuacaccgucugcgacgucgcccucugcgucaucaacuccaaguccgcccucugcaacgccgacucccccaaggaccccguccuccccaugaaguucuucacccagcccgagaaggacuucugcaacgacaaguccuacaucuccgaggagacccgcguccuccuccucaccggcaagcccaagcccgccggcguccucggcgccgucaacaagccccucuccgccaccggccgcaagcccuacguccgcuccaccggcaccgagaccggcuccaacaucaacgucaacuccgagcucaaccccuccaccggcaaccgcucccgcgagcaguccuccgaggccgccgagaccggcgucuccgagaacgaggagaaccccguccgcaucaucuccgucacccccgucaagaacaucgaccccgucaagaacaaggagaucaacuccgaccaggccacccagggcaacaucuccuccgaccgcggcaagaagcgcaccgucaccgccgccggcgccgagaacauccagcagaagaccgacgagaaggucgacgaguccggcccccccgcccccuccaagccccgccgcggccgccgccccaaguccgagucccagggcaacgccaccaagaacgacgaccucaacaagcccaucaacaagggccgcaagcgcgccgccgucggccaggagucccccggcggccucgaggccggcaacgccaaggcccccaagcuccaggaccucgccaagaaggccgcccccgccgagcgccagaucgaccuccagcgcuga

SEQ ID NO: 47472 - RNA, 4344 nt, Artificial Sequence
  derived and/or modified sequence opt2 from PDS5B__Homo_sapiens__NP_055847
auggcccacuccaagacccgcaccaacgacggcaagaucaccuacccccccggcgucaaggagaucuccgacaagaucuccaaggaggagaugguccgccgccucaagauggucgucaagaccuucauggacauggaccaggacuccgaggaggagaaggagcucuaccucaaccucgcccuccaccucgccuccgacuucuuccucaagcaccccgacaaggacguccgccuccucgucgccugcugccucgccgacaucuuccgcaucuacgcccccgaggcccccuacaccucccccgacaagcucaaggacaucuucauguucaucacccgccagcucaagggccucgaggacaccaaguccccccaguucaaccgcuacuucuaccuccucgagaacaucgccugggucaaguccuacaacaucugcuucgagcucgaggacuccaacgagaucuucacccagcucuaccgcacccucuucuccgucaucaacaacggccacaaccagaagguccacaugcacauggucgaccucauguccuccaucaucugcgagggcgacaccgucucccaggagcuccucgacaccguccucgucaaccucguccccgcccacaagaaccucaacaagcaggccuacgaccucgccaaggcccuccucaagcgcaccgcccaggccaucgagcccuacaucaccaacuucuucaaccagguccucaugcucggcaagaccuccaucuccgaccucuccgagcacgucuucgaccucauccucgagcucuacaacaucgacucccaccuccuccucuccguccucccccagcucgaguucaagcucaaguccaacgacaacgaggagcgccuccaggucgucaagcuccucgccaagauguucggcgccaaggacuccgagcucgccucccagaacaagccccucuggcagugcuaccucggccgcuucaacgacauccacguccccauccgccucgagugcgucaaguucgccucccacugccucaugaaccaccccgaccucgccaaggaccucaccgaguaccucaagguccgcucccacgaccccgaggaggccauccgccacgacgucaucgucuccaucgucaccgccgccaagaaggacauccuccucgucaacgaccaccuccucaacuucguccgcgagcgcacccucgacaagcgcuggcgcguccgcaaggaggccaugaugggccucgcccagaucuacaagaaguacgcccuccaguccgccgccggcaaggacgccgccaagcagaucgccuggaucaaggacaagcuccuccacaucuacuaccagaacuccaucgacgaccgccuccucgucgagcgcaucuucgcccaguacauggucccccacaaccucgagaccaccgagcgcaugaagugccucuacuaccucuacgccacccucgaccucaacgccgucaaggcccucaacgagauguggaagugccagaaccuccuccgccaccaggucaaggaccuccucgaccucaucaagcagcccaagaccgacgccuccgucaaggccaucuucuccaaggucauggucaucacccgcaaccuccccgaccccggcaaggcccaggacuucaugaagaaguucacccagguccucgaggacgacgagaagauccgcaagcagcucgagguccucgucucccccaccugcuccugcaagcaggccgagggcugcguccgcgagaucaccaagaagcucggcaaccccaagcagcccaccaaccccuuccucgagaugaucaaguuccuccucgagcgcaucgcccccguccacaucgacaccgaguccaucuccgcccucaucaagcaggucaacaaguccaucgacggcaccgccgacgacgaggacgagggcguccccaccgaccaggccauccgcgccggccucgagcuccucaagguccucuccuucacccaccccaucuccuuccacuccgccgagaccuucgagucccuccucgccugccucaagauggacgacgagaaggucgccgaggccgcccuccagaucuucaagaacaccggcuccaagaucgaggaggacuucccccacauccgcuccgcccuccuccccguccuccaccacaaguccaagaagggccccccccgccaggccaaguacgccauccacugcauccacgccaucuucuccuccaaggagacccaguucgcccagaucuucgagccccuccacaagucccucgaccccuccaaccucgagcaccucaucaccccccucgucaccaucggccacaucgcccuccucgcccccgaccaguucgccgccccccucaagucccucgucgccaccuucaucgucaaggaccuccucaugaacgaccgccuccccggcaagaagaccaccaagcucuggguccccgacgaggaggucucccccgagaccauggucaagauccaggccaucaagaugaugguccgcuggcuccucggcaugaagaacaaccacuccaaguccggcaccuccacccuccgccuccucaccaccauccuccacuccgacggcgaccucaccgagcagggcaagaucuccaagcccgacaugucccgccuccgccucgccgccggcuccgccaucgucaagcucgcccaggagcccugcuaccacgagaucaucacccucgagcaguaccagcucugcgcccucgccaucaacgacgagugcuaccagguccgccaggucuucgcccagaagcuccacaagggccucucccgccuccgccucccccucgaguacauggccaucugcgcccucugcgccaaggaccccgucaaggagcgccgcgcccacgcccgccagugccucgucaagaacaucaacguccgccgcgaguaccucaagcagcacgccgccgucuccgagaagcuccucucccuccuccccgaguacgucguccccuacaccauccaccuccucgcccacgaccccgacuacgucaagguccaggacaucgagcagcucaaggacgucaaggagugccucugguucguccucgagauccucauggccaagaacgagaacaacucccacgccuucauccgcaagauggucgagaacaucaagcagaccaaggacgcccagggccccgacgacgccaagaugaacgagaagcucuacaccgucugcgacgucgccaugaacaucaucauguccaaguccaccaccuacucccucgagucccccaaggaccccguccuccccgcccgcuucuucacccagcccgacaagaacuucuccaacaccaagaacuaccucccccccgagaugaaguccuucuucacccccggcaagcccaagaccaccaacguccucggcgccgucaacaagccccucuccuccgccggcaagcagucccagaccaaguccucccgcauggagaccgucuccaacgccuccuccuccuccaaccccuccucccccggccgcaucaagggccgccucgacuccuccgagauggaccacuccgagaacgaggacuacaccauguccuccccccuccccggcaagaaguccgacaagcgcgacgacuccgaccucguccgcuccgagcucgagaagccccgcggccgcaagaagacccccgucaccgagcaggaggagaagcucggcauggacgaccucaccaagcucguccaggagcagaagcccaagggcucccagcgcucccgcaagcgcggccacaccgccuccgaguccgacgagcagcaguggcccgaggagaagcgccucaaggaggacauccucgagaacgaggacgagcagaacuccccccccaagaagggcaagcgcggccgcccccccaagccccucggcggcggcacccccaaggaggagcccaccaugaagaccuccaagaagggcuccaagaagaaguccggcccccccgcccccgaggaggaggaggaggaggagcgccaguccggcaacaccgagcagaaguccaaguccaagcagcaccgcgucucccgccgcgcccagcagcgcgccgagucccccgaguccuccgccaucgaguccacccaguccaccccccagaagggccgcggccgccccuccaagacccccucccccucccagcccaagaagaacguccgcgucggccgcuccaagcaggccgccaccaaggagaacgacuccuccgaggaggucgacgucuuccagggcuccucccccgucgacgacaucccccaggaggagaccgaggaggaggaggucuccaccgucaacguccgccgccgcuccgccaagcgcgagcgccgcuga

SEQ ID NO: 47473 - RNA, 1248 nt, Artificial Sequence
  derived and/or modified sequence opt2 from PDSS1__Homo_sapiens__NP_055132
auggccucccgcugguggcgcuggcgccgcggcugcuccuggaagcccgccgcccgcucccccggccccggcucccccggccgcgccggcccccucggccccuccgccgccgccgagguccgcgcccagguccaccgccgcaagggccucgaccucucccagauccccuacaucaaccucgucaagcaccucaccuccgccugccccaacgucugccgcaucucccgcuuccaccacaccacccccgacuccaagacccacuccggcgagaaguacaccgaccccuucaagcucggcuggcgcgaccucaagggccucuacgaggacauccgcaaggagcuccucaucuccaccuccgagcucaaggagauguccgaguacuacuucgacggcaagggcaaggccuuccgccccaucaucgucgcccucauggcccgcgccugcaacauccaccacaacaacucccgccacguccaggccucccagcgcgccaucgcccucaucgccgagaugauccacaccgccucccucguccacgacgacgucaucgacgacgccuccucccgccgcggcaagcacaccgucaacaagaucuggggcgagaagaaggccguccucgccggcgaccucauccucuccgccgccuccaucgcccucgcccgcaucggcaacaccaccgucaucuccauccucacccaggucaucgaggaccucguccgcggcgaguuccuccagcucggcuccaaggagaacgagaacgagcgcuucgcccacuaccucgagaagaccuucaagaagaccgccucccucaucgccaacuccugcaaggccgucuccguccucggcugccccgaccccgucguccacgagaucgccuaccaguacggcaagaacgucggcaucgccuuccagcucaucgacgacguccucgacuucaccuccugcuccgaccagaugggcaagcccaccuccgccgaccucaagcucggccucgccaccggccccguccucuucgccugccagcaguuccccgagaugaacgccaugaucaugcgccgcuucucccuccccggcgacgucgaccgcgcccgccaguacguccuccaguccgacggcguccagcagaccaccuaccucgcccagcaguacugccacgaggccauccgcgagaucuccaagcuccgccccucccccgagcgcgacgcccucauccagcucuccgagaucguccucacccgcgacaaguga

SEQ ID NO: 47474 - RNA, 1200 nt, Artificial Sequence
  derived and/or modified sequence opt2 from PDSS2__Homo_sapiens__NP_065114
augaacuuccgccagcuccuccuccaccucccccgcuaccucggcgccuccggcuccccccgccgccucugguggucccccucccucgacaccaucuccuccgucggcuccuggcgcggccgcuccuccaagucccccgcccacuggaaccaggucgucuccgaggccgagaagaucgucggcuaccccaccuccuucaugucccuccgcugccuccucuccgacgagcucuccaacaucgccaugcagguccgcaagcucgucggcacccagcacccccuccucaccaccgcccgcggccucguccacgacuccuggaacucccuccagcuccgcggccucgucguccuccucaucuccaaggccgccggccccuccuccgucaacaccuccugccagaacuacgacauggucuccggcaucuacuccugccagcgcucccucgccgagaucaccgagcucauccacaucgcccuccucguccaccgcggcaucgucaaccucaacgagcuccaguccuccgacggcccccucaaggacaugcaguucggcaacaagaucgccauccucuccggcgacuuccuccucgccaacgccugcaacggccucgcccuccuccagaacaccaaggucgucgagcuccucgccuccgcccucauggaccucguccagggcgucuaccacgagaacuccaccuccaaggaguccuacaucaccgacgacaucggcaucuccaccuggaaggagcagaccuuccucucccacggcgcccuccucgccaaguccugccaggccgccauggagcucgccaagcacgacgccgagguccagaacauggccuuccaguacggcaagcacauggccaugucccacaagaucaacuccgacguccagcccuucaucaaggagaagaccuccgacuccaugaccuucaaccucaacuccgcccccgucguccuccaccaggaguuccucggccgcgaccucuggaucaagcagaucggcgaggcccaggagaagggccgccucgacuacgccaagcuccgcgagcgcaucaaggccggcaagggcgucaccuccgccaucgaccucugccgcuaccacggcaacaaggcccucgaggcccucgaguccuucccccccuccgaggcccgcuccgcccucgagaacaucgucuucgccgucacccgcuucuccuga

SEQ ID NO: 47475 - RNA, 852 nt, Artificial Sequence
  derived and/or modified sequence opt2 from PDX1__Homo_sapiens__NP_000200
augaacggcgaggagcaguacuacgccgccacccagcucuacaaggaccccugcgccuuccagcgcggccccgcccccgaguucuccgccuccccccccgccugccucuacaugggccgccagcccccccccccccccccccaccccuuccccggcgcccucggcgcccucgagcagggcuccccccccgacaucucccccuacgagguccccccccucgccgacgaccccgccgucgcccaccuccaccaccaccuccccgcccagcucgcccucccccacccccccgccggccccuuccccgagggcgccgagcccggcguccucgaggagcccaaccgcguccagcuccccuuccccuggaugaaguccaccaaggcccacgccuggaagggccagugggccggcggcgccuacgccgccgagcccgaggagaacaagcgcacccgcaccgccuacacccgcgcccagcuccucgagcucgagaaggaguuccucuucaacaaguacaucucccgcccccgccgcgucgagcucgccgucaugcucaaccucaccgagcgccacaucaagaucugguuccagaaccgccgcaugaaguggaagaaggaggaggacaagaagcgcggcggcggcaccgccgucggcggcggcggcgucgccgagcccgagcaggacugcgccgucaccuccggcgaggagcuccucgcccucccccccccccccccccccggcggcgccgucccccccgccgcccccgucgccgcccgcgagggccgccucccccccggccucuccgccuccccccagcccuccuccgucgccccccgccgcccccaggagccccgcuga

SEQ ID NO: 47476 - RNA, 2283 nt, Artificial Sequence
  derived and/or modified sequence opt2 from PDXDC1__Homo_sapiens__NP_001272374
auggacgccucccucgagaagaucgccgaccccacccucgccgagaugggcaagaaccucaaggaggccgucaagaugcucgaggacucccagcgcaccgaggaggagaacggcaagaagcucaucuccggcgacauccccggcccccuccagggccgcauccagaacaucggcgagcagggccacauggcccuccucggccacucccucggcgccuacaucuccacccucgacaaggagaagcuccgcaagcucaccacccgcauccucuccgacaccacccucuggcucugccgcaucuuccgcuacgagaacggcugcgccuacuuccacgaggaggagcgcgagggccucgccaagaucugccgccucgccauccacucccgcuacgaggacuucgucgucgacggcuucaacguccucuacaacaagaagcccgucaucuaccucuccgccgccgcccgccccggccucggccaguaccucugcaaccagcucggccuccccuuccccugccucugccgcguccccugcaacaccgucuucggcucccagcaccagauggacgucgccuuccucgagaagcucaucaaggacgacaucgagcgcggccgccucccccuccuccucgucgccaacgccggcaccgccgccgucggccacaccgacaagaucggccgccucaaggagcucugcgagcaguacggcaucuggcuccacgucgagggcgucaaccucgccacccucgcccucggcuacgucuccuccuccguccucgccgccgccaagugcgacuccaugaccaugacccccggccccuggcucggccuccccgccguccccgccgucacccucuacaagcacgacgaccccgcccucacccucgucgccggccucaccuccaacaagcccaccgacaagcuccgcgcccucccccucuggcucucccuccaguaccucggccucgacggcuucgucgagcgcaucaagcacgccugccagcucucccagcgccuccaggagucccucaagaaggucaacuacaucaagauccucgucgaggacgagcucuccucccccgucgucgucuuccgcuucuuccaggagcuccccggcuccgaccccgucuucaaggccguccccguccccaacaugacccccuccggcgucggccgcgagcgccacuccugcgacgcccucaaccgcuggcucggcgagcagcucaagcagcucguccccgccuccggccucaccgucauggaccucgaggccgagggcaccugccuccgcuucuccccccucaugaccgccgccguccucggcacccgcggcgaggacgucgaccagcucgucgccugcaucgaguccaagcuccccguccucugcugcacccuccagcuccgcgaggaguucaagcaggaggucgaggccaccgccggccuccucuacgucgacgaccccaacugguccggcaucggcgucguccgcuacgagcacgccaacgacgacaaguccucccucaaguccgaccccgagggcgagaacauccacgccggccuccucaagaagcucaacgagcucgaguccgaccucaccuucaagaucggccccgaguacaaguccaugaaguccugccucuacgucggcauggccuccgacaacgucgacgccgccgagcucgucgagaccaucgccgccaccgcccgcgagaucgaggagaacucccgccuccucgagaacaugaccgaggucguccgcaagggcauccaggaggcccaggucgagcuccagaaggccuccgaggagcgccuccucgaggagggcguccuccgccagauccccgucgucggcuccguccucaacugguucucccccguccaggcccuccagaagggccgcaccuucaaccucaccgccggcucccucgaguccaccgagcccaucuacgucuacaaggcccagggcgccggcgucacccucccccccacccccuccggcucccgcaccaagcagcgccuccccggccagaagcccuucaagcgcucccuccgcggcuccgacgcccucuccgagaccuccuccgucucccacaucgaggaccucgagaaggucgagcgccucuccuccggccccgagcagaucacccucgaggccuccuccaccgagggccaccccggcgcccccuccccccagcacaccgaccagaccgaggccuuccagaagggcgucccccaccccgaggacgaccacucccaggucgagggccccgagucccuccgcuga

SEQ ID NO: 47477 - RNA, 939 nt, Artificial Sequence
  derived and/or modified sequence opt2 from PDXK__Homo_sapiens__NP_003672
auggaggaggagugccgcguccucuccauccagucccacgucauccgcggcuacgucggcaaccgcgccgccaccuucccccuccagguccucggcuucgagaucgacgccgucaacuccguccaguucuccaaccacaccggcuacgcccacuggaagggccagguccucaacuccgacgagcuccaggagcucuacgagggccuccgccucaacaacaugaacaaguacgacuacguccucaccggcuacacccgcgacaaguccuuccucgccauggucgucgacaucguccaggagcucaagcagcagaacccccgccucgucuacgucugcgaccccguccucggcgacaagugggacggcgagggcuccauguacguccccgaggaccuccuccccgucuacaaggagaaggucgucccccucgccgacaucaucacccccaaccaguucgaggccgagcuccucuccggccgcaagauccacucccaggaggaggcccuccgcgucauggacaugcuccacuccaugggccccgacaccgucgucaucaccuccuccgaccuccccuccccccagggcuccaacuaccucaucguccucggcucccagcgccgccgcaaccccgccggcuccgucgucauggagcgcauccgcauggacauccgcaaggucgacgccgucuucgucggcaccggcgaccucuucgccgccaugcuccucgccuggacccacaagcaccccaacaaccucaaggucgccugcgagaagaccgucuccacccuccaccacguccuccagcgcaccauccagugcgccaaggcccaggccggcgagggcguccgccccucccccaugcagcucgagcuccgcaugguccaguccaagcgcgacaucgaggaccccgagaucgucguccaggccaccguccucuga

SEQ ID NO: 47478 - RNA, 891 nt, Artificial Sequence
  derived and/or modified sequence opt2 from PDXP__Homo_sapiens__NP_064711
auggcccgcugcgagcgccuccgcggcgccgcccuccgcgacguccucggccgcgcccagggcguccucuucgacugcgacggcguccucuggaacggcgagcgcgccguccccggcgcccccgagcuccucgagcgccucgcccgcgccggcaaggccgcccucuucgucuccaacaacucccgccgcgcccgccccgagcucgcccuccgcuucgcccgccucggcuucggcggccuccgcgccgagcagcucuucuccuccgcccucugcgccgcccgccuccuccgccagcgccuccccggcccccccgacgcccccggcgccgucuucguccucggcggcgagggccuccgcgccgagcuccgcgccgccggccuccgccucgccggcgaccccuccgccggcgacggcgccgccccccgcguccgcgccguccucgucggcuacgacgagcacuucuccuucgccaagcuccgcgaggccugcgcccaccuccgcgaccccgagugccuccucgucgccaccgaccgcgaccccuggcacccccucuccgacggcucccgcacccccggcaccggcucccucgccgccgccgucgagaccgccuccggccgccaggcccucgucgucggcaagcccucccccuacauguucgagugcaucaccgagaacuucuccaucgaccccgcccgcacccucauggucggcgaccgccucgagaccgacauccucuucggccaccgcugcggcaugaccaccguccucacccucaccggcgucucccgccucgaggaggcccaggccuaccucgccgccggccagcacgaccucgucccccacuacuacgucgaguccaucgccgaccucaccgagggccucgaggacuga

SEQ ID NO: 47479 - RNA, 765 nt, Artificial Sequence
  derived and/or modified sequence opt2 from PDYN__Homo_sapiens__XP_011527552
auggccuggcagggccucguccucgccgccugccuccucauguuccccuccaccaccgccgacugccucucccgcugcucccucugcgccgucaagacccaggacggccccaagcccaucaacccccucaucugcucccuccagugccaggccgcccuccuccccuccgaggagugggagcgcugccaguccuuccucuccuucuucacccccuccacccucggccucaacgacaaggaggaccucggcuccaaguccgucggcgagggccccuacuccgagcucgccaagcucuccggcuccuuccucaaggagcucgagaaguccaaguuccuccccuccaucuccaccaaggagaacacccucuccaagucccucgaggagaagcuccgcggccucuccgacggcuuccgcgagggcgccgaguccgagcucaugcgcgacgcccagcucaacgacggcgccauggagaccggcacccucuaccucgccgaggaggaccccaaggagcaggucaagcgcuacggcggcuuccuccgcaaguaccccaagcgcuccuccgaggucgccggcgagggcgacggcgacuccaugggccacgaggaccucuacaagcgcuacggcggcuuccuccgccgcauccgccccaagcucaagugggacaaccagaagcgcuacggcggcuuccuccgccgccaguucaaggucgucacccgcucccaggaggaccccaacgccuacuccggcgagcucuucgacgccuga

SEQ ID NO: 47480 - RNA, 8520 nt, Artificial Sequence
  derived and/or modified sequence opt2 from PDZD2__Homo_sapiens__NP_835260
augcccaucacccaggacaacgccguccuccaccucccccuccucuaccaguggcuccagaacucccuccaggagggcggcgacggccccgagcagcgccucugccaggccgccauccagaagcuccaggaguacauccagcucaacuucgccgucgacgaguccaccgucccccccgaccacuccccccccgagauggagaucugcaccgucuaccucaccaaggagcucggcgacaccgagaccgucggccucuccuucggcaacauccccgucuucggcgacuacggcgagaagcgccgcggcggcaagaagcgcaagacccaccagggccccguccucgacgucggcugcaucugggucaccgagcuccgcaagaacucccccgccggcaaguccggcaagguccgccuccgcgacgagauccucucccucaacggccagcucauggucggcgucgacgucuccggcgccuccuaccucgccgagcagugcuggaacggcggcuucaucuaccucaucaugcuccgccgcuucaagcacaaggcccacuccaccuacaacggcaacuccuccaacuccuccgagcccggcgagacccccacccucgagcucggcgaccgcaccgccaagaagggcaagcgcacccgcaaguucggcgucaucucccgcccccccgccaacaaggcccccgaggaguccaagggcuccgccggcugcgaggucuccuccgaccccuccaccgagcucgagaacggccccgaccccgagcucggcaacggccacgucuuccagcucgagaacggccccgacucccucaaggaggucgccggcccccaccucgagcgcuccgaggucgaccgcggcaccgagcaccgcauccccaagaccgacgccccccucaccaccuccaacgacaagcgccgcuucuccaagggcggcaagaccgacuuccaguccuccgacugccucgcccgcgaggaggucggccgcaucuggaagauggagcuccucaaggaguccgacggccucggcauccaggucuccggcggccgcggcuccaagcgcuccccccacgccaucgucgucacccaggucaaggagggcggcgccgcccaccgcgacggccgccucucccucggcgacgagcuccucgucaucaacggccaccuccucgucggccucucccacgaggaggccgucgccauccuccgcuccgccaccggcaugguccagcucgucgucgccuccaaggagaacuccgccgaggaccuccuccgccucaccuccaagucccuccccgaccucaccuccuccgucgaggacgucuccuccuggaccgacaacgaggaccaggaggccgacggcgaggaggacgagggcaccuccuccuccguccagcgcgccaugcccggcaccgacgagccccaggacgucugcggcgccgaggaguccaagggcaaccucgagucccccaagcagggcuccaacaagaucaagcucaagucccgccucuccggcggcguccaccgccucgaguccgucgaggaguacaacgagcucaugguccgcaacggcgacccccgcauccgcaugcucgaggucucccgcgacggccgcaagcacucccucccccagcuccucgacuccuccuccgccucccaggaguaccacaucgucaagaaguccacccgcucccucuccaccacccaggucgagucccccuggcgccucauccgccccuccgucaucuccaucaucggccucuacaaggagaagggcaagggccucggcuucuccaucgccggcggccgcgacugcauccgcggccagaugggcaucuucgucaagaccaucuuccccaacggcuccgccgccgaggacggccgccucaaggagggcgacgagauccucgacgucaacggcauccccaucaagggccucaccuuccaggaggccauccacaccuucaagcagauccgcuccggccucuucguccucaccguccgcaccaagcucgucucccccucccucacccccugcuccacccccacccacaugucccgcuccgccucccccaacuucaacaccuccggcggcgccuccgccggcggcuccgacgagggcuccuccuccucccucggccgcaagacccccggccccaaggaccgcaucgucauggaggucacccucaacaaggagccccgcgucggccucggcaucggcgccugcugccucgcccucgagaacuccccccccggcaucuacauccacucccucgcccccggcuccgucgccaagauggaguccaaccucucccgcggcgaccagauccucgaggucaacuccgucaacguccgccacgccgcccucuccaagguccacgccauccucuccaagugcccccccggccccguccgccucgucaucggccgccaccccaaccccaaggucuccgagcaggagauggacgaggucaucgcccgcuccaccuaccaggaguccaaggaggccaacuccucccccggccucggcaccccccucaagucccccucccucgccaagaaggacucccucaucuccgaguccgagcucucccaguacuucgcccacgacguccccggcccccucuccgacuucauggucgccggcuccgaggacgaggaccaccccggcuccggcugcuccaccuccgaggagggcucccucccccccuccaccuccacccacaaggagcccggcaagccccgcgccaacucccucgucacccucggcucccaccgcgccuccggccucuuccacaagcaggucaccgucgcccgccaggccucccuccccggcuccccccaggcccuccgcaacccccuccuccgccagcgcaaggucggcugcuacgacgccaacgacgccuccgacgaggaggaguucgaccgcgagggcgacugcaucucccuccccggcgcccuccccggccccauccgcccccucuccgaggacgacccccgccgcgucuccaucuccuccuccaagggcauggacguccacaaccaggaggagcgcccccgcaagacccucgucuccaaggccaucuccgccccccuccucggcuccuccgucgaccucgaggaguccauccccgagggcauggucgacgccgccuccuacgccgccaaccucaccgacuccgccgaggcccccaagggcucccccggcuccugguggaagaaggagcucuccggcuccuccuccgcccccaagcucgaguacaccguccgcaccgacacccagucccccaccaacaccggcucccccuccuccccccagcagaaguccgagggccucggcucccgccaccgccccgucgcccgcgucuccccccacugcaagcgcuccgaggccgaggccaagcccuccggcucccagaccgucaaccucaccggccgcgccaacgaccccugcgaccucgacucccgcguccaggccaccuccgucaaggucaccgucgccggcuuccagcccggcggcgccgucgagaaggagucccucggcaagcucaccaccggcgacgccugcgucuccaccuccugcgagcucgccuccgcccucucccaccucgacgccucccaccucaccgagaaccuccccaaggccgccuccgagcucggccagcagcccaugaccgagcucgacuccuccuccgaccucaucuccucccccggcaagaagggcgccgcccaccccgaccccuccaagaccuccgucgacaccggccaggucucccgccccgagaaccccucccagcccgccuccccccgcgucaccaagugcaaggcccgcucccccguccgccucccccacgagggcucccccucccccggcgagaaggccgccgccccccccgacuacuccaagacccgcuccgccuccgagaccuccaccccccacaacacccgccgcgucgccgcccuccgcggcgccggccccggcgccgagggcaugacccccgccggcgccguccuccccggcgacccccucaccucccaggagcagcgccagggcgcccccggcaaccacuccaaggcccucgagaugaccggcauccacgcccccgaguccucccaggagcccucccuccucgagggcgccgacuccgucuccucccgcgccccccaggccucccucuccaugcuccccuccaccgacaacaccaaggaggccugcggccacgucuccggccacugcugccccggcggcucccgcgagucccccgucaccgacaucgacuccuucaucaaggagcucgacgccuccgccgcccgcucccccuccucccagaccggcgacuccggcucccaggagggcuccgcccagggccacccccccgccggcgccggcggcggcuccuccugccgcgccgagcccguccccggcggccagaccuccuccccccgccgcgccugggccgccggcgcccccgccuacccccagugggccucccagcccuccguccucgacuccaucaaccccgacaagcacuucaccgucaacaagaacuuccucuccaacuacucccgcaacuucuccuccuuccacgaggacuccaccucccucuccggccucggcgacuccaccgagcccucccucuccuccauguacggcgacgccgaggacuccuccuccgaccccgagucccucaccgaggccccccgcgccuccgcccgcgacggcuggucccccccccgcucccgcgucucccuccacaaggaggaccccuccgaguccgaggaggagcagaucgagaucugcuccacccgcggcugccccaacccccccuccucccccgcccaccuccccacccaggccgccaucugccccgccuccgccaagguccucucccucaaguacuccaccccccgcgaguccgucgccuccccccgcgagaaggccgccugccuccccggcuccuacaccuccggccccgacuccucccagcccuccucccuccucgagauguccucccaggagcacgagacccacgccgacaucuccaccucccagaaccaccgccccuccugcgccgaggagaccaccgaggucaccuccgccuccuccgccauggagaacuccccccucuccaaggucgcccgccacuuccacuccccccccaucauccucuccucccccaacauggucaacggccucgagcacgaccuccucgacgacgagacccucaaccaguacgagaccuccaucaacgccgccgccucccucuccuccuucuccgucgacguccccaagaacggcgaguccguccucgagaaccuccacaucuccgagucccaggaccucgacgaccuccuccagaagcccaagaugaucgcccgccgccccaucauggccugguucaaggagaucaacaagcacaaccagggcacccaccuccgcuccaagaccgagaaggagcagccccucaugcccgcccgcucccccgacuccaagauccagauggucuccuccucccagaagaagggcgucaccgucccccacucccccccccagcccaagaccaaccucgagaacaaggaccucuccaagaagucccccgccgagaugcuccucaccaacggccagaaggccaagugcggccccaagcucaagcgccucucccucaagggcaaggccaaggucaacuccgaggcccccgccgccaacgccgucaaggccggcggcaccgaccaccgcaagccccucaucuccccccagaccucccacaagacccucuccaaggccgucucccagcgccuccacgucgccgaccacgaggaccccgaccgcaacaccaccgccgccccccgcuccccccagugcguccucgaguccaagcccccccucgccaccuccggcccccucaagcccuccgucuccgacaccuccauccgcaccuucgucuccccccucaccucccccaagcccguccccgagcagggcauguggucccgcuuccacauggccguccucuccgagcccgaccgcggcugccccaccacccccaagucccccaagugccgcgccgagggccgcgccccccgcgccgacuccggccccgucucccccgccgccucccgcaacggcauguccgucgccggcaaccgccaguccgagccccgccucgccucccacgucgccgccgacaccgcccagccccgccccaccggcgagaagggcggcaacaucauggccuccgaccgccucgagcgcaccaaccagcucaagaucgucgagaucuccgccgaggccgucuccgagaccgucugcggcaacaagcccgccgaguccgaccgccgcggcggcugccucgcccagggcaacugccaggagaaguccgagauccgccucuaccgccaggucgccgaguccuccaccucccaccccuccucccuccccucccacgccucccaggccgagcaggagaugucccgcuccuucuccauggccaagcucgccuccuccuccuccucccuccagaccgccauccgcaaggccgaguacucccagggcaaguccucccucauguccgacucccgcggcgucccccgcaacuccauccccggcggccccuccggcgaggaccaccucuacuucaccccccgccccgccacccgcaccuacuccaugcccgcccaguucuccucccacuucggccgcgagggccaccccccccacucccucggccgcucccgcgacucccagguccccgucaccuccuccgucguccccgaggccaaggccucccgcggcggccuccccucccucgccaacggccagggcaucuacuccgucaagccccuccucgacaccucccgcaaccuccccgccaccgacgagggcgacaucaucuccguccaggagaccuccugccucgucaccgacaagaucaaggucacccgccgccacuacugcuacgagcagaacuggccccacgaguccaccuccuucuucuccgucaagcagcgcaucaaguccuucgagaaccucgccaacgccgaccgccccgucgccaaguccggcgccucccccuuccucuccgucuccuccaagccccccaucggccgccgcuccuccggcuccaucgucuccggcucccucggccaccccggcgacgccgccgcccgccuccuccgccgcucccucuccuccugcuccgagaaccaguccgaggccggcacccuccucccccagauggccaagucccccuccaucaugacccucaccaucucccgccagaacccccccgagaccuccuccaagggcuccgacuccgagcucaagaagucccucggcccccucggcauccccacccccaccaugacccucgccucccccgucaagcgcaacaaguccuccguccgccacacccagcccucccccgucucccgcuccaagcuccaggagcuccgcgcccucuccaugcccgaccucgacaagcucugcuccgaggacuacuccgccggccccuccgccguccucuucaagaccgagcucgagaucaccccccgccgcucccccggcccccccgccggcggcgucuccugccccgagaagggcggcaaccgcgccugccccggcggcuccggccccaagaccuccgccgccgagacccccuccuccgccuccgacaccggcgaggccgcccaggaccuccccuuccgccgcuccugguccgucaaccucgaccagcuccucgucuccgccggcgaccagcagcgccuccaguccguccucuccuccgucggcuccaaguccaccauccucacccucauccaggaggccaaggcccaguccgagaacgaggaggacgucugcuucaucguccucaaccgcaaggagggcuccggccucggcuucuccgucgccggcggcaccgacgucgagcccaaguccaucaccguccaccgcgucuucucccagggcgccgccucccaggagggcaccaugaaccgcggcgacuuccuccucuccgucaacggcgccucccucgccggccucgcccacggcaacguccucaagguccuccaccaggcccagcuccacaaggacgcccucgucgucaucaagaagggcauggaccagccccgccccuccgcccgccaggagccccccaccgccaacggcaagggccuccucucccgcaagaccaucccccucgagcccggcaucggccgcuccgucgccguccacgacgcccucugcgucgagguccucaagaccuccgccggccucggccucucccucgacggcggcaaguccuccgucaccggcgacggcccccucgucaucaagcgcgucuacaagggcggcgccgccgagcaggccggcaucaucgaggccggcgacgagauccucgccaucaacggcaagccccucgucggccucaugcacuucgacgccuggaacaucaugaaguccguccccgagggccccguccagcuccucauccgcaagcaccgcaacuccuccuga

SEQ ID NO: 47481 - RNA, 2328 nt, Artificial Sequence
  derived and/or modified sequence opt2 from PDZD4__Homo_sapiens__NP_001290441
augggcugcaacaugugcgucguccagaagcccgaggagcaguacaaggucaugcuccaggucaacggcaaggagcucuccaagcucucccaggagcagacccuccaggcccuccgcuccuccaaggagccccucgucauccagguccuccgccgcuccccccgccuccgcggcgacuccuccugccacgaccuccagcucgucgacuccggcacccagaccgacaucaccuucgagcacaucauggcccucggcaagcuccgcccccccaccccccccauggucauccucgagcccuacguccucuccgagcucccccccaucucccacgaguacuacgaccccgccgaguucauggagggcggcccccaggaggccgaccgccucgacgagcucgaguacgaggaggucgagcucuacaaguccucccaccgcgacaagcucggccucauggucugcuaccgcaccgacgacgaggaggaccucggcaucuacgucggcgaggucaaccccaacuccaucgccgccaaggacggccgcauccgcgagggcgaccgcaucauccagaucaacggcgucgacguccagaaccgcgaggaggccgucgccauccucucccaggaggagaacaccaacaucucccuccucgucgcccgccccgagucccagcucgccaagcgcuggaaggacuccgaccgcgacgacuuccucgacgacuucggcuccgagaacgagggcgagcuccgcgcccgcaagcucaaguccccccccgcccagcagcccggcaacgaggaggagaagggcgcccccgacgccggccccggccucuccaacucccaggagcucgacuccggcgucggccgcaccgacgaguccacccgcaacgaggaguccuccgagcacgaccuccucggcgacgagccccccuccuccaccaacacccccggcucccuccgcaaguucggccuccagggcgacgcccuccagucccgcgacuuccacuucuccauggacucccuccucgccgagggcgccggccucggcggcggcgacguccccggccucaccgacgaggaguacgagcgcuaccgcgagcuccucgagaucaagugccaccucgagaacggcaaccagcucggccuccucuucccccgcgccuccggcggcaacuccgcccucgacgucaaccgcaacgagucccucggccacgagauggccaugcucgaggaggagcuccgccaccucgaguucaagugccgcaacauccuccgcgcccagaagaugcagcagcuccgcgagcgcugcaugaaggccuggcuccucgaggaggagucccucuacgaccucgccgccuccgagcccaagaagcacgagcucuccgacaucuccgagcuccccgagaaguccgacaaggacuccaccuccgccuacaacaccggcgaguccugccgcuccaccccccuccucgucgagccccuccccgaguccccccuccgccgcgccauggccggcaacuccaaccucaaccgcaccccccccggccccgccgucgccacccccgccaaggccgcccccccccccggcucccccgccaaguuccgcucccucucccgcgaccccgaggccggccgccgccagcacgccgaggagcgcggccgccgcaaccccaagaccggccucacccucgagcgcgucggccccgaguccucccccuaccucucccgccgccaccgcggccagggccaggagggcgagcacuaccacuccugcguccagcucgcccccacccgcggccucgaggagcucggccacggcccccucucccucgccggcggcccccgcgucggcggcgucgccgccgccgccaccgaggccccccgcauggaguggaaggucaagguccgcuccgacggcacccgcuacgucgccaagcgccccguccgcgaccgccuccucaaggcccgcgcccucaagauccgcgaggagcgcuccggcaugaccaccgacgacgacgccgucuccgagaugaagaugggccgcuacugguccaaggaggagcgcaagcagcaccucauccgcgcccgcgagcagcgcaagcgccgcgaguucaugaugcagucccgccucgagugccuccgcgagcagcagaacggcgacuccaagcccgagcucaacaucaucgcccucucccaccgcaagaccaugaagaagcgcaacaagaagauccucgacaacuggaucaccauccaggagaugcucgcccacggcgcccgcuccgccgacggcaagcgcgucuacaacccccuccucuccgucaccaccgucuga

SEQ ID NO: 47482 - RNA, 3102 nt, Artificial Sequence
  derived and/or modified sequence opt2 from PDZD7__Homo_sapiens__NP_001182192
auggcccagggcuucgccgucggcuucgacccccucggccucggcgaccucuccuccggcucccucuccucccucuccucccgcggccaccucggcuccgacuccggcuccaccgccacccgcuaccuccuccgcaagcagcagcgccuccucaacggccccccccgcggcauccgcgccuccucccccaugggccgcgucauccucaucaacucccccaucgaggccaacuccgacgaguccgacaucauccacuccguccgcgucgagaagucccccgccggccgccucggcuucuccguccgcggcggcuccgagcacggccucggcaucuucgucuccaaggucgaggagggcuccuccgccgagcgcgccggccucugcgucggcgacaagaucaccgaggucaacggccucucccucgaguccaccaccaugggcuccgccgucaagguccucaccuccuccucccgccuccacaugaugguccgccgcaugggccgcguccccggcaucaaguucuccaaggagaagaccaccugggucgacgucgucaaccgccgccucgucgucgagaagugcggcuccacccccuccgacaccuccuccgaggacggcguccgccgcaucguccaccucuacaccaccuccgacgacuucugccucggcuucaacauccgcggcggcaaggaguucggccucggcaucuacgucuccaaggucgaccacggcggccucgccgaggagaacggcaucaaggucggcgaccagguccucgccgccaacggcguccgcuucgacgacaucucccacucccaggccgucgagguccucaagggccagacccacaucaugcucaccaucaaggagaccggccgcuaccccgccuacaaggagauggucuccgaguacugcuggcucgaccgccucuccaacggcguccuccagcagcucucccccgccuccgaguccuccuccuccgucuccuccugcgccuccuccgcccccuacuccuccggcucccuccccuccgaccgcauggacaucugccucggccaggaggagcccggcucccgcggccccggcuggggccgcgccgacaccgccaugcagaccgagcccgacgccggcggccgcgucgagaccuggugcuccguccgccccaccgucauccuccgcgacaccgccauccgcuccgacggcccccaccccggccgccgccucgacuccgcccucuccgagucccccaagaccgcccuccuccucgcccucucccgcccccgcccccccaucacccgcucccaguccuaccucacccucugggaggagaagcagcagcgcaagaaggagaaguccggcucccccggcgagaagggcgcccuccagcgcuccaagacccucaugaaccucuucuucaagggcggccgccagggccgccucgcccgcgacggccgccgcgaggccuggacccucgacuccggcucccucgccaagaccuacccccgccucgacaucgagaaggccggcggcgucggccccguccagaaguucgucaccuggcgccuccgccgcgaccaggagcgcggccgcgcccuccucuccgcccgcuccggcucccccuccucccagcuccccaacgucgacgagcagguccaggccugggagucccgccgcccccucauccaggaccucgcccagcgccuccucaccgacgacgagguccucgccgucacccgccacugcucccgcuacguccacgagggcggcaucgaggaccucguccgcccccuccucgccauccucgaccgccccgagaagcuccuccuccuccaggacauccgcuccgucgucgcccccaccgaccucggccgcuucgacuccauggucaugcucgucgagcucgaggccuucgaggcccucaagucccgcgccguccgcccccccgcccuccgccccgcccgccaggacaccccccccaagcgccaccucaucacccccguccccgacucccgcggcggcuucuaccuccuccccgucaacggcuuccccgaggaggaggacaacggcgagcuccgcgagcgccucggcgcccucaaggucucccccuccgccuccgccccccgccacccccacaagggcauccccccccuccaggacguccccgucgacgccuucaccccccuccgcaucgccugcaccccccccccccagcucccccccgucgccccccgcccccuccgccccaacuggcuccucaccgagccccucucccgcgagcaccccccccagucccagauccgcggccgcgcccagucccgcucccgcucccgcucccgcucccgcucccgcuccucccgcggccagggcaagucccccggccgccgcucccccucccccguccccacccccgcccccuccaugaccaacggccgcuaccacaagccccgcaaggcccgccccccccucccccgcccccucgacggcgaggccgccaaggucggcgccaagcagggccccuccgaguccggcaccgagggcaccgccaaggaggccgccaugaagaaccccuccggcgagcucaagaccgucacccucuccaagaugaagcagucccucggcaucuccaucuccggcggcaucgaguccaagguccagcccauggucaagaucgagaagaucuuccccggcggcgccgccuuccucuccggcgcccuccaggccggcuucgagcucgucgccgucgacggcgagaaccucgagcaggucacccaccagcgcgccgucgacaccauccgccgcgccuaccgcaacaaggcccgcgagcccauggagcucgucguccgcguccccggccccuccccccgccccucccccuccgacuccuccgcccucaccgacggcggccuccccgccgaccaccuccccgcccaccagccccucgacgccgcccccguccccgcccacuggcuccccgagccccccaccaacccccagaccccccccaccgacgcccgccuccuccagcccacccccucccccgcccccucccccgcccuccagacccccgacuccaagcccgcccccuccccccgcauccccuga

SEQ ID NO: 47483 - RNA, 3465 nt, Artificial Sequence
  derived and/or modified sequence opt2 from PDZD8__Homo_sapiens__NP_776152
augggccuccuccucaugauccucgccuccgccguccucggcuccuuccucacccuccucgcccaguucuuccuccucuaccgccgccagcccgagccccccgccgacgaggccgcccgcgccggcgagggcuuccgcuacaucaagcccguccccggccuccuccuccgcgaguaccucuacggcggcggccgcgacgaggagcccuccggcgccgcccccgagggcggcgccacccccaccgccgcccccgagacccccgccccccccacccgcgagaccugcuacuuccucaacgccaccauccucuuccucuuccgcgagcuccgcgacaccgcccucacccgccgcugggucaccaagaagaucaaggucgaguucgaggagcuccuccagaccaagaccgccggccgccuccucgagggccucucccuccgcgacgucuuccucggcgagaccguccccuucaucaagaccauccgccucguccgccccgucguccccuccgccaccggcgagcccgacggccccgagggcgaggcccuccccgccgccugccccgaggagcucgccuucgaggccgaggucgaguacaacggcggcuuccaccucgccaucgacgucgaccucgucuucggcaaguccgccuaccucuucgucaagcucucccgcgucgucggccgccuccgccucgucuucacccgcguccccuucacccacugguucuucuccuucgucgaggacccccucaucgacuucgagguccgcucccaguucgagggccgccccaugccccagcucaccuccaucaucgucaaccagcucaagaagaucaucaagcgcaagcacacccuccccaacuacaagauccgcuucaagcccuucuuccccuaccagacccuccagggcuucgaggaggacgaggagcacauccacauccagcagugggcccucaccgagggccgccucaaggucacccuccucgagugcucccgccuccucaucuucggcuccuacgaccgcgaggccaacguccacugcacccucgagcucuccuccuccgucugggaggagaagcagcgcuccuccaucaagaccgucgagcucaucaagggcaaccuccaguccgucggccucacccuccgccucguccaguccaccgacggcuacgccggccacgucaucaucgagaccgucgcccccaacucccccgccgccaucgccgaccuccagcgcggcgaccgccucaucgccaucggcggcgucaagaucaccuccacccuccagguccucaagcucaucaagcaggccggcgaccgcguccucgucuacuacgagcgccccgucggccaguccaaccagggcgccguccuccaggacaacuucggccagcucgaggagaacuuccucuccuccuccugccaguccggcuacgaggaggaggccgccggccucaccgucgacaccgagucccgcgagcucgacuccgaguucgaggaccucgccuccgacguccgcgcccagaacgaguucaaggacgaggcccagucccucucccacucccccaagcgcguccccaccacccucuccaucaagccccucggcgccaucucccccguccucaaccgcaagcucgccgucggcucccacccccucccccccaagauccaguccaaggacggcaacaagccccccccccucaagaccuccgagaucaccgaccccgcccaggucuccaagcccacccagggcuccgccuucaagccccccguccccccccgcccccaggccaaggucccccuccccuccgccgacgcccccaaccaggccgagcccgacguccucgucgagaagcccgagaaggucgucccccccccccucgucgacaaguccgccgagaagcaggccaagaacgucgacgccaucgacgacgccgccgcccccaagcaguuccucgccaagcaggaggucgccaaggacgucaccuccgagaccuccugccccaccaaggacuccuccgacgaccgccagaccugggaguccuccgagauccucuaccgcaacaagcucggcaaguggacccgcacccgcgccuccugccucuucgacaucgaggccugccaccgcuaccucaacaucgcccucuggugccgcgaccccuucaagcucggcggccucaucugccucggccacgucucccucaagcucgaggacgucgcccucggcugccucgccaccuccaacaccgaguaccucuccaagcuccgccucgaggcccccucccccaaggccaucgucacccgcaccgcccuccgcaaccucuccaugcagaagggcuucaacgacaaguucugcuacggcgacaucaccauccacuucaaguaccucaaggagggcgaguccgaccaccacgucgucaccaacgucgagaaggagaaggagccccaccucgucgaggaggucuccguccuccccaaggaggagcaguucgucggccagaugggccucaccgagaacaagcacuccuuccaggacacccaguuccagaaccccaccuggugcgacuacugcaagaagaaggucuggaccaaggccgccucccagugcauguucugcgccuacgucugccacaagaagugccaggagaagugccucgccgagaccuccgucugcggcgccaccgaccgccgcaucgaccgcacccucaagaaccuccgccucgagggccaggagacccuccucggccuccccccccgcgucgacgccgaggccuccaaguccgucaacaagaccaccggccucacccgccacaucaucaacaccuccucccgccuccucaaccuccgccaggucuccaagacccgccucuccgagcccggcaccgaccucgucgagcccucccccaagcacacccccaacaccuccgacaacgagggcuccgacaccgaggucugcggccccaacucccccuccaagcgcggcaacuccaccggcaucaagcucguccgcaaggagggcggccucgacgacuccgucuucaucgccgucaaggagaucggccgcgaccucuaccgcggccuccccaccgaggagcgcauccagaagcucgaguucaugcucgacaagcuccagaacgagaucgaccaggagcucgagcacaacaacucccucguccgcgaggagaaggagaccaccgacacccgcaagaagucccuccucuccgccgcccucgccaaguccggcgagcgccuccaggcccucacccuccucaugauccacuaccgcgccggcaucgaggacaucgagacccucgagucccucucccucgaccagcacuccaagaagaucuccaaguacaccgacgacaccgaggaggaccucgacaacgagaucucccagcucaucgacucccagcccuucuccuccaucuccgacgaccucuucggccccuccgaguccgucuga

SEQ ID NO: 47484 - RNA, 1539 nt, Artificial Sequence
  derived and/or modified sequence opt2 from PDZK1__Homo_sapiens__XP_011507918
augaccuccaccuucaacccccgcgagugcaagcucuccaagcaggagggccagaacuacggcuucuuccuccgcaucgagaaggacaccgagggccaccucguccgcgucgucgagaagugcucccccgccgagaaggccggccuccaggacggcgaccgcguccuccgcaucaacggcgucuucgucgacaaggaggagcacaugcaggucgucgaccucguccgcaaguccggcaacuccgucacccuccucguccucgacggcgacuccuacgagaaggccgucaagacccgcgucgaccucaaggagcucggccagucccagaaggagcagggccucuccgacaacauccucucccccgucaugaacggcggcguccagaccuggacccagccccgccucugcuaccucgucaaggagggcggcuccuacggcuucucccucaagaccguccagggcaagaagggcgucuacaugaccgacaucaccccccagggcgucgccaugcgcgccggcguccucgccgacgaccaccucaucgaggucaacggcgagaacgucgaggacgccucccacgaggaggucgucgagaaggucaagaaguccggcucccgcgucauguuccuccucgucgacaaggagaccgacaagcgccacgucgagcagaagauccaguucaagcgcgagaccgccucccucaagcuccucccccaccagccccgcaucgucgagaugaagaagggcuccaacggcuacggcuucuaccuccgcgccggcuccgagcagaagggccagaucaucaaggacaucgacuccggcucccccgccgaggaggccggccucaagaacaacgaccucgucgucgccgucaacggcgaguccgucgagacccucgaccacgacuccgucgucgagaugauccgcaagggcggcgaccagaccucccuccucgucgucgacaaggagaccgacaacauguaccgccucgcccacuucucccccuuccucuacuaccagucccaggagcuccccaacggcuccgucaaggaggcccccgcccccacccccaccucccucgaggucuccuccccccccgacaccaccgaggaggucgaccacaagcccaagcucugccgccucgccaagggcgagaacggcuacggcuuccaccucaacgccauccgcggccuccccggcuccuucaucaaggagguccagaagggcggccccgccgaccucgccggccucgaggacgaggacgucaucaucgaggucaacggcgucaacguccucgacgagcccuacgagaaggucgucgaccgcauccaguccuccggcaagaacgucacccuccucgucugcggcaagaaggccuacgacuacuuccaggccaagaagauccccaucgucuccucccucgccgacccccucgacaccccccccgacuccaaggagggcaucgucgucgaguccaaccacgacucccacauggccaaggagcgccucuacaccaucgccgucaacugcaugcucuga

SEQ ID NO: 47485 - RNA, 2367 nt, Artificial Sequence
  derived and/or modified sequence opt2 from PDZRN3__Homo_sapiens__NP_001290070
augaagauggagcacaagcgcaugauccuccucuucuccaaguucacccucauccacaagccccacggcggccgcugguaccucgucaacggccgcgaccucucccgcgccacccacgaccaggccgucgaggccuucaagaccgccaaggagcccaucgucguccagguccuccgccgcaccccccgcaccaagauguucaccccccccuccgagucccagcucgucgacaccggcacccagaccgacaucaccuucgagcacaucauggcccucaccaagauguccucccccuccccccccguccucgaccccuaccuccuccccgaggagcaccccuccgcccacgaguacuacgaccccaacgacuacaucggcgacauccaccaggagauggaccgcgaggagcucgagcucgaggaggucgaccucuaccgcaugaacucccaggacaagcucggccucaccgucugcuaccgcaccgacgacgaggacgacaucggcaucuacaucuccgagaucgaccccaacuccaucgccgccaaggacggccgcauccgcgagggcgaccgcaucauccagaucaacggcaucgagguccagaaccgcgaggaggccgucgcccuccucaccuccgaggagaacaagaacuucucccuccucaucgcccgccccgagcuccagcucgacgagggcuggauggacgacgaccgcaacgacuuccucgacgaccuccacauggacaugcucgaggagcagcaccaccaggccaugcaguucaccgccuccguccuccagcagaagaagcacgacgaggacggcggcaccaccgacaccgccaccauccucuccaaccagcacgagaaggacuccggcgucggccgcaccgacgaguccacccgcaacgacgaguccuccgagcaggagaacaacggcgacgacgccaccgccuccuccaacccccucgccggccagcgcaagcucaccugcucccaggacacccucggcuccggcgaccuccccuucuccaacgaguccuucaucuccgccgacugcaccgacgccgacuaccucggcauccccgucgacgagugcgagcgcuuccgcgagcuccucgagcucaagugccaggucaaguccgccacccccuacggccucuacuaccccuccggcccccucgacgccggcaaguccgaccccgaguccgucgacaaggagcucgagcuccucaacgaggagcuccgcuccaucgagcucgagugccucuccaucguccgcgcccacaagaugcagcagcucaaggagcaguaccgcgaguccuggaugcuccacaacuccggcuuccgcaacuacaacaccuccaucgacguccgccgccacgagcucuccgacaucaccgagcuccccgagaaguccgacaaggacuccuccuccgccuacaacaccggcgaguccugccgcuccaccccccucacccucgagaucucccccgacaacucccuccgccgcgccgccgagggcaucuccugccccuccuccgagggcgccgucggcaccaccgaggccuacggccccgccuccaagaaccuccucuccaucaccgaggaccccgaggucggcacccccaccuacucccccucccucaaggagcucgaccccaaccagccccucgaguccaaggagcgccgcgccuccgacggcucccgcucccccacccccucccagaagcucggcuccgccuaccuccccuccuaccaccacucccccuacaagcacgcccacauccccgcccacgcccagcacuaccaguccuacaugcagcucauccagcagaaguccgccgucgaguacgcccagucccagaugucccucgucuccaugugcaaggaccucuccucccccacccccuccgagccccgcauggaguggaaggucaagauccgcuccgacggcacccgcuacaucaccaagcgccccguccgcgaccgccuccuccgcgagcgcgcccucaagauccgcgaggagcgcuccggcaugaccaccgacgacgacgccgucuccgagaugaagaugggccgcuacugguccaaggaggagcgcaagcagcaccucgucaaggccaaggagcagcgccgccgccgcgaguucaugaugcagucccgccucgacugccucaaggagcagcaggccgccgacgaccgcaaggagaugaacauccucgagcucucccacaagaagaugaugaagaagcgcaacaagaagaucuucgacaacuggaugaccauccaggagcuccucacccacggcaccaagucccccgacggcacccgcgucuacaacuccuuccucuccgucaccaccgucuga

SEQ ID NO: 47486 - RNA, 3111 nt, Artificial Sequence
  derived and/or modified sequence opt2 from PDZRN4__Homo_sapiens__NP_001158067
augggcuucgcccucgagcgcuucgccgaggccgucgaccccgcccucgagugcaagcucugcggccagguccucgaggagccccucugcacccccugcggccacgucuucugcgccuccugccuccuccccugggccguccgccgccgccgcugcccccuccagugccagccccucgcccccggcgagcucuaccgcguccucccccuccgcucccucauccagaagcuccgcguccagugcgacuaccgcgcccgcggcugcggccacuccguccgccuccacgagcucgaggcccacgucgagcacugcgacuucggccccgcccgccgccuccgcucccgcggcggcugcgccuccggccucggcggcggcgagguccccgcccgcggcggcugcggccccaccccccgcgccggccgcggcggcggcgcccgcggcggcccccccggcggccgcuggggccgcggccgcggccccggcccccgcguccucgccuggcgccgccgcgagaaggcccuccucgcccagcucugggcccuccagggcgagguccagcucaccgcccgccgcuaccaggagaaguucacccaguacauggcccacguccgcaacuucgucggcgaccucggcggcggccaccgccgcgacggcgagcacaagcccuucaccaucguccucgagcgcgagaacgacacccucggcuucaacaucaucggcggccgccccaaccagaacaaccaggagggcaccuccaccgagggcaucuacgucuccaagauccucgagaacggccccgccgaccgcgccgacggccucgagauccacgacaagaucauggaggucaacggcaaggaccucuccaaggccacccacgaggaggccgucgaggccuuccgcaacgccaaggagcccaucgucguccagguccuccgccgcaccccccucucccgccccgccuacggcauggccuccgagguccagcucaugaacgccuccacccagaccgacaucaccuucgagcacaucauggcccucgccaagcuccgcccccccaccccccccguccccgacaucugccccuuccuccucuccgacuccugccacucccuccaccccauggagcacgaguucuacgaggacaacgaguacaucuccucccuccccgccgacgccgaccgcaccgaggacuucgaguacgaggaggucgagcucugccgcgucuccucccaggagaagcucggccucaccgucugcuaccgcaccgacgacgaggaggacaccggcaucuacgucuccgaggucgaccccaacuccaucgccgccaaggacggccgcauccgcgagggcgaccgcauccuccagaucaacggcgaggacguccagaaccgcgaggaggccgucgcccuccucuccaacgacgagugcaagcgcaucguccuccucgucgcccgccccgagauccagcucgacgagggcuggcucgaggacgagcgcaacgaguuccucgaggagcucaaccucgagaugcucgaggaggagcacaacgaggccaugcagcccaccgccaacgaggucgagcagcccaagaagcaggaggaggaggagggcaccaccgacaccgccaccuccuccuccaacaaccacgagaaggacuccggcgucggccgcaccgacgagucccuccgcaacgacgaguccuccgagcaggagaacgccgccgaggaccccaacuccaccucccucaaguccaagcgcgaccucggccagucccaggacacccucggcuccgucgagcuccaguacaacgagucccucgucuccggcgaguacaucgacuccgacugcaucggcaaccccgacgaggacugcgagcgcuuccgccagcuccucgagcucaagugcaagauccgcaaccacggcgaguacgaccucuacuacuccuccuccaccaucgagugcaaccagggcgagcaggagggcgucgagcacgagcuccagcuccucaacgaggagcuccgcaacaucgagcucgagugccagaacaucaugcaggcccaccgccuccagaaggucaccgaccaguacggcgacaucuggacccuccacgacggcggcuuccgcaacuacaacaccuccaucgacaugcagcgcggcaagcucgacgacaucauggagcaccccgagaaguccgacaaggacuccuccuccgccuacaacaccgccgaguccugccgcuccaccccccucaccgucgaccgcucccccgacuccucccucccccgcgucaucaaccucaccaacaagaagaaccuccgcuccaccauggccgccacccaguccuccuccggccaguccuccaaggaguccaccuccaccaaggccaagaccaccgagcagggcugcuccgccgaguccaaggagaagguccucgagggcuccaagcuccccgaccaggagaaggccgucuccgagcacauccccuaccucucccccuaccacuccuccuccuaccgcuacgccaacauccccgcccacgcccgccacuaccaguccuacaugcagcucauccagcagaaguccgccgucgaguacgcccagucccagcucucccucgucuccaugugcaaggagucccagaagugcuccgagcccaagauggaguggaaggucaagauccgcuccgacggcacccgcuacaucaccaagcgccccguccgcgaccgcauccucaaggagcgcgcccucaagaucaaggaggagcgcuccggcaugaccaccgacgacgacaccauguccgagaugaagaugggccgcuacugguccaaggaggagcgcaagcagcaccucguccgcgccaaggagcagcgccgccgccgcgaguucaugaugcgcucccgccucgagugccucaaggaguccccccaguccggcuccgagggcaagaaggagaucaacaucaucgagcucucccacaagaagaugaugaagaagcgcaacaagaagauccucgacaacuggaugaccauccaggagcucaugacccacggcgccaagucccccgacggcacccgcguccacaacgccuuccucuccgucaccaccgucuga

SEQ ID NO: 47487 - RNA, 456 nt, Artificial Sequence
  derived and/or modified sequence opt2 from PEA15__Homo_sapiens__NP_001284505
auggaggacgagggcaacaagcucugccaggccccccccuggcccggccagaccucccccgucauggccgaguacggcacccuccuccaggaccucaccaacaacaucacccucgaggaccucgagcagcucaaguccgccugcaaggaggacauccccuccgagaaguccgaggagaucaccaccggcuccgccugguucuccuuccucgagucccacaacaagcucgacaaggacaaccucuccuacaucgagcacaucuucgagaucucccgccgccccgaccuccucaccauggucgucgacuaccgcacccgcguccucaagaucuccgaggaggacgagcucgacaccaagcucacccgcauccccuccgccaagaaguacaaggacaucauccgccagcccuccgaggaggagaucaucaagcucgcccccccccccaagaaggccuga

SEQ ID NO: 47488 - RNA, 5241 nt, Artificial Sequence
  derived and/or modified sequence opt2 from PEAK1__Homo_sapiens__NP_079052
auguccgccugcaacaccuucaccgagcacgucuggaagcccggcgagugcaagaacugcuucaagcccaagucccuccaccagcucccccccgaccccgagaaggcccccaucacccacggcaacgucaagaccaacgccaaccacuccaacaaccaccgcauccgcaacaccggcaacuuccgcccccccgucgccaagaagcccaccaucgccgucaagcccaccaugaucgucgccgacggccaguccaucugcggcgagcucuccauccaggagcacugcgagaacaagcccgucaucaucggcuggaaccgcaaccgcgccgcccucucccagaagccccucaacaacaacaacgaggacgacgagggcaucucccacguccccaagcccuacggcaacaacgacuccgccaagaagauguccgacaacaacaacggccucaccgagguccucaaggagaucgccggccucgacaccgccccccagauccgcggcaacgagaccaacucccgcgagaccuuccucggccgcaucaacgacugcuacaagcgcucccucgagcgcaagcucccccccuccugcaugaucggcggcaucaaggagacccagggcaagcacgucauccucuccggcuccaccgaggucaucuccaacgagggcggccgcuucugcuaccccgaguucuccuccggcgaggaguccgaggaggacguccucuucuccaacauggaggaggagcacgaguccugggacgaguccgacgaggagcuccucgccauggagauccgcaugcgcggccagccccgcuucgccaacuuccgcgccaacacccucucccccguccgcuucuucgucgacaagaaguggaacaccaucccccuccgcaacaagucccuccagcgcaucugcgccgucgacuacgacgacuccuacgacgagauccucaacggcuacgaggagaacuccgucgucuccuacggccagggcuccauccaguccauggucuccuccgacuccaccucccccgacuccucccucaccgaggagucccgcuccgagaccgccuccucccucucccagaagaucugcaacggcggccucucccccggcaaccccggcgacuccaaggacaugaaggagaucgagcccaacuacgagucccccuccuccaacaaccaggacaaggacuccucccaggccuccaaguccuccaucaagguccccgagacccacaaggccguccucgcccuccgccucgaggagaaggacggcaagaucgccguccagaccgagaaggaggaguccaaggccuccaccgacgucgccggccaggccgucaccaucaaccucguccccaccgaggagcaggccaagcccuaccgcgucgucaaccucgagcagccccucugcaagcccuacaccgucgucgacgucuccgccgccauggccuccgagcaccucgagggccccgucaacucccccaagaccaaguccuccuccuccacccccaacucccccgucaccuccuccucccucacccccggccagaucuccgcccacuuccagaaguccuccgccauccgcuaccaggaggucuggaccuccuccaccuccccccgccagaagauccccaaggucgagcucaucaccuccggcaccggccccaacguccccccccgcaagaacugccacaaguccgcccccaccucccccaccgccaccaacaucuccuccaagaccauccccgucaagucccccaaccucuccgagaucaaguucaacuccuacaacaacgccggcaugccccccuuccccaucaucauccacgacgagcccaccuacgcccgcuccuccaagaacgccaucaagguccccaucgucaucaaccccaacgccuacgacaaccucgccaucuacaaguccuuccucggcaccuccggcgagcucuccgucaaggagaagaccaccuccgucaucucccacaccuacgaggagaucgagaccgaguccaagguccccgacaacaccaccuccaagaccaccgacugccuccagaccaagggcuucuccaacuccaccgagcacaagcgcggcuccgucgcccagaagguccaggaguucaacaacugccucaaccgcggccaguccuccccccagcgcuccuacuccuccucccacuccucccccgccaagauccagcgcgccacccaggagcccgucgccaagaucgagggcacccaggagucccagauggucggcuccuccuccacccgcgagaaggccuccaccguccucucccagaucgucgccuccauccagcccccccaguccccccccgagaccccccaguccggccccaaggccugcuccgucgaggagcucuacgccaucccccccgacgccgacgucgccaaguccacccccaaguccacccccguccgccccaagucccucuucaccucccagcccuccggcgaggccgaggccccccagaccaccgacucccccaccaccaagguccagaaggaccccuccaucaagcccgucacccccucccccuccaagcucgucaccuccccccaguccgagccccccgcccccuucccccccccccgcuccaccuccucccccuaccacgccggcaaccuccuccagcgccacuucaccaacuggaccaagcccaccucccccacccgcuccaccgaggccgaguccguccuccacuccgagggcucccgccgcgccgccgacgccaagcccaagcgcuggaucuccuucaaguccuucuuccgccgccgcaagaccgacgaggaggacgacaaggagaaggagcgcgagaagggcaagcucgucggccucgacggcaccgucauccacaugcucccccccccccccguccagcgccaccacugguucaccgaggccaagggcgaguccuccgagaagcccgccaucgucuucauguaccgcugcgaccccgcccagggccagcucuccgucgaccaguccaaggcccgcaccgaccaggccgccgucauggagaagggccgcgccgagaacgcccuccuccaggacuccgagaagaagcgcucccacuccucccccucccagauccccaagaagauccucucccacaugacccacgaggucaccgaggacuucuccccccgcgacccccgcaccgucgucggcaagcaggacggccgcggcugcaccuccgucaccaccgcccucucccuccccgagcucgagcgcgaggacggcaaggaggacaucuccgaccccauggaccccaaccccugcuccgccaccuacuccaaccucggccagucccgcgccgccaugaucccccccaagcagccccgccagcccaagggcgccgucgacgacgccaucgccuucggcggcaagaccgaccaggaggcccccaacgccucccagcccaccccccccccccuccccaagaagaugaucauccgcgccaacaccgagcccaucuccaaggaccuccagaaguccauggaguccucccucugcgucauggccaaccccaccuacgacaucgaccccaacugggacgccuccuccgccggcuccuccaucuccuacgagcucaagggccucgacaucgaguccuacgacucccucgagcgcccccuccgcaaggagcgccccguccccuccgccgccaacuccaucuccucccucaccacccucuccaucaaggaccgcuucuccaacuccauggagucccucuccucccgccgcggccccuccugccgccagggccgcggcauccagaagccccagcgccaggcccucuaccgcggccucgagaaccgcgaggaggucgucggcaagauccgcucccuccacaccgacgcccucaagaagcucgccgucaagugcgaggaccucuucauggccggccagaaggaccagcuccgcuucggcgucgacuccugguccgacuuccgccucaccuccgacaagcccugcugcgaggccggcgacgccgucuacuacaccgccuccuacgccaaggacccccucaacaacuacgccgucaagaucugcaaguccaaggccaaggagucccagcaguacuaccacucccucgccguccgccagucccucgccguccacuucaacauccagcaggacugcggccacuuccucgccgagguccccaaccgccuccuccccugggaggaccccgacgaccccgagaaggacgaggacgacauggaggagaccgaggaggacgccaagggcgagaccgacggcaagaaccccaagcccugcuccgaggccgccuccucccagaaggagaaccagggcgucauguccaagaagcagcgcucccacgucgucgucaucacccgcgagguccccugccucaccgucgccgacuucguccgcgacucccucgcccagcacggcaagucccccgaccucuacgagcgccaggucugccuccuccuccuccagcucugcuccggccucgagcaccucaagcccuaccacgucacccacugcgaccuccgccucgagaaccuccuccucguccacuaccagcccggcggcaccgcccagggcuucggccccgccgagcccucccccaccuccuccuaccccacccgccucaucgucuccaacuucucccaggccaagcagaagucccaccucgucgaccccgagauccuccgcgaccagucccgccucgcccccgagaucaucaccgccacccaguacaagaagugcgacgaguuccagaccggcauccucaucuacgagaugcuccaccuccccaaccccuucgacgagaaccccgagcucaaggagcgcgaguacacccgcgccgaccucccccgcauccccuuccgcucccccuacucccgcggccuccagcagcucgccuccugccuccucaaccccaaccccuccgagcgcauccucaucuccgacgccaagggcauccuccagugccuccucuggggcccccgcgaggaccucuuccagaccuucaccgccugccccucccucguccagcgcaacacccuccuccagaacuggcucgacaucaagcgcacccuccucaugaucaaguucgccgagaagucccucgaccgcgagggcggcaucucccucgaggacuggcucugcgcccaguaccucgccuucgccaccaccgacucccucuccugcaucgucaagauccuccagcaccgcuga

SEQ ID NO: 47489 - RNA, 3114 nt, Artificial Sequence
  derived and/or modified sequence opt2 from PEAR1__Homo_sapiens__NP_001073940
augucccccccccucugcccccuccuccuccucgccgucggccuccgccucgccggcacccucaaccccuccgaccccaacaccugcuccuucugggaguccuucaccaccaccaccaaggagucccacucccgccccuucucccuccuccccuccgagcccugcgagcgccccugggagggcccccacaccugcccccagcccaccgucgucuaccgcaccgucuaccgccaggucgucaagaccgaccaccgccagcgccuccagugcugccacggcuucuacgagucccgcggcuucugcgucccccucugcgcccaggagugcguccacggccgcugcgucgcccccaaccagugccagugcguccccggcuggcgcggcgacgacugcuccuccgagugcgcccccggcauguggggcccccagugcgacaagcccugcuccugcggcaacaacuccuccugcgaccccaaguccggcgucugcuccugccccuccggccuccagccccccaacugccuccagcccugcacccccggcuacuacggccccgccugccaguuccgcugccagugccacggcgcccccugcgacccccagaccggcgccugcuucugccccgccgagcgcaccggccccuccugcgacgucuccugcucccagggcaccuccggcuucuucugccccuccacccacuccugccagaacggcggcgucuuccagaccccccagggcuccugcuccugcccccccggcuggaugggcaccaucugcucccuccccugccccgagggcuuccacggccccaacugcucccaggagugccgcugccacaacggcggccucugcgaccgcuucaccggccagugccgcugcgcccccggcuacaccggcgaccgcugccgcgaggagugccccgucggccgcuucggccaggacugcgccgagaccugcgacugcgcccccgacgcccgcugcuuccccgccaacggcgccugccucugcgagcacggcuucaccggcgaccgcugcaccgaccgccucugccccgacggcuucuacggccucuccugccaggcccccugcaccugcgaccgcgagcacucccucuccugccaccccaugaacggcgagugcuccugccuccccggcugggccggccuccacugcaacgaguccugcccccaggacacccacggccccggcugccaggagcacugccucugccuccacggcggcgucugccaggccaccuccggccucugccagugcgcccccggcuacaccggcccccacugcgccucccucugcccccccgacaccuacggcgucaacugcuccgcccgcugcuccugcgagaacgccaucgccugcucccccaucgacggcgagugcgucugcaaggagggcuggcagcgcggcaacugcuccguccccugcccccccggcaccuggggcuucuccugcaacgccuccugccagugcgcccacgaggccgucugcuccccccagaccggcgccugcaccugcacccccggcuggcacggcgcccacugccagcuccccugccccaagggccaguucggcgagggcugcgccucccgcugcgacugcgaccacuccgacggcugcgaccccguccacggccgcugccagugccaggccggcuggaugggcgcccgcugccaccucuccugccccgagggccucuggggcgucaacugcuccaacaccugcaccugcaagaacggcggcaccugccuccccgagaacggcaacugcgucugcgcccccggcuuccgcggccccuccugccagcgcuccugccagcccggccgcuacggcaagcgcugcguccccugcaagugcgccaaccacuccuucugccaccccuccaacggcaccugcuacugccucgccggcuggaccggccccgacugcucccagcccugcccccccggccacuggggcgagaacugcgcccagaccugccagugccaccacggcggcaccugccacccccaggacggcuccugcaucugcccccucggcuggaccggccaccacugccucgagggcugcccccucggcaccuucggcgccaacugcucccagcccugccagugcggccccggcgagaagugccaccccgagaccggcgccugcgucugcccccccggccacuccggcgcccccugccgcaucggcauccaggagcccuucaccgucaugcccaccacccccgucgccuacaacucccucggcgccgucaucggcaucgccguccucggcucccucgucgucgcccucgucgcccucuucaucggcuaccgccacuggcagaagggcaaggagcaccaccaccucgccgucgccuacuccuccggccgccucgacggcuccgaguacgucaugcccgacgucccccccuccuacucccacuacuacuccaaccccuccuaccacacccucucccagugcucccccaacccccccccccccaacaagguccccggcccccucuucgccucccuccagaaccccgagcgccccggcggcgcccagggccacgacaaccacaccacccuccccgccgacuggaagcaccgccgcgagcccccccccggcccccucgaccgcggcuccucccgccucgaccgcuccuacuccuacuccuacuccaacggccccggccccuucuacaacaagggccucaucuccgaggaggagcucggcgccuccgucgccucccucuccuccgagaaccccuacgccaccauccgcgaccuccccucccuccccggcggcccccgcgaguccuccuacauggagaugaagggcccccccuccggcucccccccccgccagcccccccaguucugggacucccagcgccgccgccagccccagccccagcgcgacuccggcaccuacgagcagcccuccccccucauccacgaccgcgacuccgucggcucccagcccccccucccccccggccucccccccggccacuacgacucccccaagaacucccacauccccggccacuacgaccucccccccguccgccacccccccucccccccccuccgccgccaggaccgcuga

SEQ ID NO: 47490 - RNA, 564 nt, Artificial Sequence
  derived and/or modified sequence opt2 from PEBP1__Homo_sapiens__NP_002558
augcccgucgaccucuccaagugguccggcccccucucccuccaggaggucgacgagcagccccagcacccccuccacgucaccuacgccggcgccgccgucgacgagcucggcaagguccucacccccacccaggucaagaaccgccccaccuccaucuccugggacggccucgacuccggcaagcucuacacccucguccucaccgaccccgacgcccccucccgcaaggaccccaaguaccgcgaguggcaccacuuccucgucgucaacaugaagggcaacgacaucuccuccggcaccguccucuccgacuacgucggcuccggcccccccaagggcaccggccuccaccgcuacgucuggcucgucuacgagcaggaccgcccccucaagugcgacgagcccauccucuccaaccgcuccggcgaccaccgcggcaaguucaaggucgccuccuuccgcaagaaguacgagcuccgcgcccccgucgccggcaccugcuaccaggccgagugggacgacuacguccccaagcucuacgagcagcucuccggcaaguga

SEQ ID NO: 47491 - RNA, 684 nt, Artificial Sequence
  derived and/or modified sequence opt2 from PEBP4__Homo_sapiens__NP_659399
augggcuggaccaugcgccucgucaccgccgcccuccuccucggccucaugauggucgucaccggcgacgaggacgagaacucccccugcgcccacgaggcccuccucgacgaggacacccucuucugccagggccucgaggucuucuaccccgagcucggcaacaucggcugcaaggucguccccgacugcaacaacuaccgccagaagaucaccuccuggauggagcccaucgucaaguuccccggcgccgucgacggcgccaccuacauccucgucauggucgaccccgacgcccccucccgcgccgagccccgccagcgcuucuggcgccacuggcucgucaccgacaucaagggcgccgaccucaagaagggcaagauccagggccaggagcucuccgccuaccaggcccccuccccccccgcccacuccggcuuccaccgcuaccaguucuucgucuaccuccaggagggcaaggucaucucccuccuccccaaggagaacaagacccgcggcuccuggaagauggaccgcuuccucaaccgcuuccaccucggcgagcccgaggccuccacccaguucaugacccagaacuaccaggacucccccacccuccaggccccccgcgagcgcgccuccgagcccaagcacaagaaccaggccgagaucgccgccugcuga

SEQ ID NO: 47492 - RNA, 2160 nt, Artificial Sequence
  derived and/or modified sequence opt2 from PECAM1__Homo_sapiens__XP_005276938
augcagccccgcugggcccagggcgccaccauguggcucggcguccuccucacccuccuccucugcuccucccucgagggccaggagaacuccuucaccaucaacuccgucgacaugaagucccuccccgacuggaccguccagaacggcaagaaccucacccuccagugcuucgccgacgucuccaccaccucccacgucaagccccagcaccagaugcucuucuacaaggacgacguccucuucuacaacaucuccuccaugaaguccaccgaguccuacuucauccccgagguccgcaucuacgacuccggcaccuacaagugcaccgucaucgucaacaacaaggagaagaccaccgccgaguaccagguccucgucgagggcguccccuccccccgcgucacccucgacaagaaggaggccauccagggcggcaucguccgcgucaacugcuccguccccgaggagaaggcccccauccacuucaccaucgagaagcucgagcucaacgagaagauggucaagcucaagcgcgagaagaacucccgcgaccagaacuucgucauccucgaguuccccgucgaggagcaggaccgcguccucuccuuccgcugccaggcccgcaucaucuccggcauccacaugcagaccuccgaguccaccaaguccgagcucgucaccgucaccgaguccuucuccacccccaaguuccacaucucccccaccggcaugaucauggagggcgcccagcuccacaucaagugcaccauccaggucacccaccucgcccaggaguuccccgagaucaucauccagaaggacaaggccaucgucgcccacaaccgccacggcaacaaggccgucuacuccgucauggccauggucgagcacuccggcaacuacaccugcaaggucgaguccucccgcaucuccaaggucuccuccaucgucgucaacaucaccgagcucuucuccaagcccgagcucgaguccuccuucacccaccucgaccagggcgagcgccucaaccucuccugcuccauccccggcgccccccccgccaacuucaccauccagaaggaggacaccaucgucucccagacccaggacuucaccaagaucgccuccaaguccgacuccggcaccuacaucugcaccgccggcaucgacaaggucgucaagaaguccaacaccguccagaucgucgucugcgagaugcucucccagccccgcaucuccuacgacgcccaguucgaggucaucaagggccagaccaucgagguccgcugcgaguccaucuccggcacccuccccaucuccuaccagcuccucaagaccuccaagguccucgagaacuccaccaagaacuccaacgaccccgccgucuucaaggacaaccccaccgaggacgucgaguaccagugcgucgccgacaacugccacucccacgccaagaugcucuccgagguccuccgcgucaaggucaucgcccccgucgacgagguccagaucuccauccucuccuccaaggucgucgaguccggcgaggacaucguccuccagugcgccgucaacgagggcuccggccccaucaccuacaaguucuaccgcgagaaggagggcaagcccuucuaccagaugaccuccaacgccacccaggccuucuggaccaagcagaaggccuccaaggagcaggagggcgaguacuacugcaccgccuucaaccgcgccaaccacgccuccuccgucccccgcuccaagauccucaccguccgcgucauccucgcccccuggaagaagggccucaucgccgucgucaucaucggcgucaucaucgcccuccucaucaucgccgccaagugcuacuuccuccgcaaggccaaggccaagcagaugcccgucgagaugucccgccccgccgucccccuccucaacuccaacaacgagaagauguccgaccccaacauggaggccaacucccacuacggccacaacgacgacguccgcaaccacgccaugaagcccaucaacgacaacaaggagccccucaacuccgacguccaguacaccgagguccaggucuccuccgccgagucccacaaggacgccgucgagucccgcuacucccgcaccgagggcucccucgacggcaccuga

SEQ ID NO: 47493 - RNA, 912 nt, Artificial Sequence
  derived and/or modified sequence opt2 from PECR__Homo_sapiens__NP_060911
auggccuccugggccaagggccgcuccuaccucgcccccggccuccuccagggccaggucgccaucgucaccggcggcgccaccggcaucggcaaggccaucgucaaggagcuccucgagcucggcuccaacgucgucaucgccucccgcaagcucgagcgccucaaguccgccgccgacgagcuccaggccaaccucccccccaccaagcaggcccgcgucauccccauccagugcaacauccgcaacgaggaggaggucaacaaccucgucaaguccacccucgacaccuucggcaagaucaacuuccucgucaacaacggcggcggccaguuccucucccccgccgagcacaucuccuccaagggcuggcacgccguccucgagaccaaccucaccggcaccuucuacaugugcaaggccgucuacuccuccuggaugaaggagcacggcggcuccaucgucaacaucaucguccccaccaaggccggcuucccccucgccguccacuccggcgccgcccgcgccggcgucuacaaccucaccaagucccucgcccucgagugggccugcuccggcauccgcaucaacugcgucgcccccggcgucaucuacucccagaccgccgucgagaacuacggcuccuggggccaguccuucuucgagggcuccuuccagaagauccccgccaagcgcaucggcguccccgaggaggucuccuccgucgucugcuuccuccucucccccgccgccuccuucaucaccggccaguccgucgacgucgacggcggccgcucccucuacacccacuccuacgagguccccgaccacgacaacuggcccaagggcgccggcgaccucuccgucgucaagaagaugaaggagaccuucaaggagaaggccaagcucuga

SEQ ID NO: 47494 - RNA, 978 nt, Artificial Sequence
  derived and/or modified sequence opt2 from PEG10__Homo_sapiens__NP_001035242
augaccgagcgccgccgcgacgagcucuccgaggagaucaacaaccuccgcgagaaggucaugaagcaguccgaggagaacaacaaccuccagucccagguccagaagcucaccgaggagaacaccacccuccgcgagcaggucgagcccacccccgaggacgaggacgacgacaucgagcuccgcggcgccgccgccgccgccgccccccccccccccaucgaggaggagugccccgaggaccuccccgagaaguucgacggcaaccccgacaugcucgcccccuucauggcccagugccagaucuucauggagaaguccacccgcgacuucuccgucgaccgcguccgcgucugcuucgucaccuccaugaugaccggccgcgccgcccgcugggccuccgccaagcucgagcgcucccacuaccucaugcacaacuaccccgccuucaugauggagaugaagcacgucuucgaggacccccagcgccgcgaggucgccaagcgcaagauccgccgccuccgccagggcaugggcuccgucaucgacuacuccaacgccuuccagaugaucgcccaggaccucgacuggaacgagcccgcccucaucgaccaguaccacgagggccucuccgaccacauccaggaggagcucucccaccucgaggucgccaagucccucuccgcccucaucggccagugcauccacaucgagcgccgccucgcccgcgccgccgccgcccgcaagccccgcucccccccccgcgcccucguccucccccacaucgccucccaccaccaggucgaccccaccgagcccgucggcggcgcccgcaugcgccucacccaggaggagaaggagcgccgccgcaagcucaaccucugccucuacugcggcaccggcggccacuacgccgacaacugccccgccaaggccuccaaguccucccccgccggcaacucccccgccccccucuga

SEQ ID NO: 47495 - RNA, 4389 nt, Artificial Sequence
  derived and/or modified sequence opt2 from PEG3__Homo_sapiens__NP_001139657
auguaccagcccgaggacgacaacaacuccgacgucaccuccgacgacgacaugacccgcaaccgccgcgaguccucccccccccacuccguccacuccuucuccgaccgcgacugggaccgccgcggccgcucccgcgacauggagccccgcgaccgcuggucccacacccgcaacccccgcucccgcaugcccccccgcgaccucucccuccccgucgucgccaagaccuccuucgagauggaccgcgaggacgaccgcgacucccgcgccuacgagucccgcucccaggacgccgaguccuaccagaacgucgucgaccucgccgaggaccgcaagccccacaacaccauccaggacaacauggagaacuaccgcaagcuccucucccucguccagcucgccgaggacgacggccacucccacaugacccagggccacuccucccgcuccaagcgcuccgccuaccccuccaccucccgcggccucaagaccaugcccgaggccaagaaguccacccaccgccgcggcaucugcgaggacgaguccucccacggcgucaucauggagaaguucaucaaggacgucucccgcuccuccaaguccggccgcgcccgcgaguccuccgaccgcucccagcgcuucccccgcauguccgacgacaacuggaaggacaucucccucaacaagcgcgaguccgucauccagcagcgcgucuacgagggcaacgccuuccgcggcggcuuccgcuucaacuccacccucgucucccgcaagcgcguccucgagcgcaagcgccgcuaccacuucgacaccgacggcaagggcuccauccacgaccagaagggcugcccccgcaagaagcccuucgagugcggcuccgagaugcgcaaggccauguccgucuccucccucuccucccucuccucccccuccuucaccgagucccagcccaucgacuucggcgccaugcccuacgucugcgacgagugcggccgcuccuucuccgucaucuccgaguucgucgagcaccagaucaugcacacccgcgagaaccucuacgaguacggcgaguccuucauccacuccgucgccgucuccgagguccagaagucccaggucggcggcaagcgcuucgagugcaaggacugcggcgagaccuucaacaaguccgccgcccucgccgagcaccgcaagauccacgcccgcggcuaccucgucgagugcaagaaccaggagugcgaggaggccuucaugcccucccccaccuucuccgagcuccagaagaucuacggcaaggacaaguucuacgagugccgcgucugcaaggagaccuuccuccacuccuccgcccucaucgagcaccagaagauccacuucggcgacgacaaggacaacgagcgcgagcacgagcgcgagcgcgagcgcgagcgcggcgagaccuuccgccccucccccgcccucaacgaguuccagaagauguacggcaaggagaagauguacgagugcaaggucugcggcgagaccuuccuccacuccuccucccucaaggagcaccagaagauccacacccgcggcaaccccuucgagaacaagggcaaggucugcgaggagaccuucauccccggccagucccucaagcgccgccagaagaccuacaacaaggagaagcucugcgacuucaccgacggccgcgacgccuucaugcaguccuccgagcucuccgagcaccagaagauccacucccgcaagaaccucuucgagggccgcggcuacgagaaguccgucauccacuccggccccuucaccgagucccagaagucccacaccaucacccgcccccucgaguccgacgaggacgagaaggccuucaccaucuccuccaaccccuacgagaaccagaagauccccaccaaggagaacgucuacgaggccaaguccuacgagcgcuccgucauccacucccucgccuccgucgaggcccagaagucccacuccgucgccggccccuccaagcccaaggucauggccgaguccaccauccaguccuucgacgccaucaaccaccagcgcguccgcgccggcggcaacaccuccgagggccgcgaguacucccgcuccgucauccacucccucgucgccuccaagcccccccgcucccacaacggcaacgagcucgucgaguccaacgagaagggcgaguccuccaucuacaucuccgaccucaacgacaagcgccagaagauccccgcccgcgagaaccccugcgagggcggcuccaagaaccgcaacuacgaggacuccgucauccaguccgucuuccgcgccaagccccagaaguccguccccggcgagggcuccggcgaguucaagaaggacggcgaguucuccguccccuccuccaacguccgcgaguaccagaaggcccgcgccaagaagaaguacaucgagcaccgcuccaacgagaccuccgucauccacucccuccccuucggcgagcagaccuuccgcccccgcggcaugcucuacgagugccaggagugcggcgagugcuucgcccacuccuccgaccucaccgagcaccagaagauccacgaccgcgagaagcccuccggcucccgcaacuacgagugguccgucauccgcucccucgcccccaccgacccccagaccuccuacgcccaggagcaguacgccaaggagcaggcccgcaacaagugcaaggacuuccgccaguucuucgccaccuccgaggaccucaacaccaaccagaagaucuacgaccaggagaagucccacggcgaggagucccagggcgagaacaccgacggcgaggagacccacuccgaggagacccacggccaggagaccaucgaggaccccgucauccagggcuccgacauggaggacccccagaaggacgaccccgacgacaagaucuacgagugcgaggacugcggccucggcuucgucgaccucaccgaccucaccgaccaccagaagguccacucccgcaagugccucgucgacucccgcgaguacacccacuccgucauccacacccacuccaucuccgaguaccagcgcgacuacaccggcgagcagcucuacgagugccccaagugcggcgaguccuucauccacuccuccuuccucuucgagcaccagcgcauccacgagcaggaccagcucuacuccaugaagggcugcgacgacggcuucaucgcccuccuccccaugaagccccgccgcaaccgcgccgccgagcgcaaccccgcccucgccggcuccgccauccgcugccuccucugcggccagggcuucauccacuccuccgcccucaacgagcacaugcgccuccaccgcgaggacgaccuccucgagcagucccagauggccgaggaggccaucauccccggccucgcccucaccgaguuccagcgcucccagaccgaggagcgccucuucgagugcgccgucugcggcgaguccuucgucaaccccgccgagcucgccgaccacgucaccguccacaagaacgagcccuacgaguacggcuccuccuacacccacaccuccuuccucaccgagccccucaagggcgccauccccuucuacgagugcaaggacugcggcaaguccuucauccacuccaccguccucaccaagcacaaggagcuccaccucgaggaggaggaggaggacgaggccgccgccgccgccgccgccgccgcccaggaggucgaggccaacguccacgucccccaggucguccuccgcauccagggccucaacgucgaggccgccgagcccgaggucgaggccgccgagcccgaggucgaggccgccgagcccgaggucgaggccgccgagcccaacggcgaggccgagggccccgacggcgaggccgccgagcccaucggcgaggccggccagcccaacggcgaggccgagcagcccaacggcgacgccgacgagcccgacggcgccggcaucgaggaccccgaggagcgcgccgaggagcccgagggcaaggccgaggagcccgagggcgacgccgacgagcccgacggcgucggcaucgaggaccccgaggagggcgaggaccaggagauccaggucgaggagcccuacuacgacugccacgagugcaccgagaccuucaccuccuccaccgccuucuccgagcaccucaagacccacgccuccaugaucaucuucgagcccgccaacgccuucggcgagugcuccggcuacaucgagcgcgccuccaccuccaccggcggcgccaaccaggccgacgagaaguacuucaagugcgacgucugcggccagcucuucaacgaccgccucucccucgcccgccaccagaacacccacaccggcuga

SEQ ID NO: 47496 - RNA, 1257 nt, Artificial Sequence
  derived and/or modified sequence opt2 from PELI1__Homo_sapiens__XP_011531296
auguucucccccgaccaggagaaccaccccuccaaggcccccgucaaguacggcgagcucaucguccucggcuacaacggcucccuccccaacggcgaccgcggccgccgcaagucccgcuucgcccucuucaagcgccccaaggccaacggcgucaagcccuccaccguccacaucgccugcaccccccaggccgccaaggccaucuccaacaaggaccagcacuccaucuccuacacccucucccgcgcccagaccgucgucgucgaguacacccacgacuccaacaccgacauguuccagaucggccgcuccaccgagucccccaucgacuucgucgucaccgacaccguccccggcucccaguccaacuccgacacccaguccguccaguccaccaucucccgcuucgccugccgcaucaucugcgagcgcaacccccccuucaccgcccgcaucuacgccgccggcuucgacuccuccaagaacaucuuccucggcgagaaggccgccaaguggaagaccuccgacggccagauggacggccucaccaccaacggcguccucgucaugcacccccgcaacggcuucaccgaggacuccaagcccggcaucuggcgcgagaucuccgucugcggcaacgucuucucccuccgcgagacccgcuccgcccagcagcgcggcaagauggucgagaucgagaccaaccagcuccaggacggcucccucaucgaccucugcggcgccacccuccucuggcgcaccgccgagggccucucccacacccccaccgucaagcaccucgaggcccuccgccaggagaucaacgccgcccgcccccagugccccgucggcuucaacacccucgccuuccccuccaugaagcgcaaggacgucgucgacgagaagcagcccugggucuaccucaacugcggccacguccacggcuaccacaacuggggcaacaaggaggagcgcgacggcaaggaccgcgagugccccaugugccgcuccgucggccccuacgucccccucuggcucggcugcgaggccggcuucuacgucgacgccggcccccccacccacgccuucucccccugcggccacgucugcuccgagaagaccaccgccuacuggucccagaucccccucccccacggcacccacaccuuccacgccgccugccccuucugcgcccaccagcucgccggcgagcagggcuacauccgccucaucuuccagggcccccucgacuga

SEQ ID NO: 47497 - RNA, 1263 nt, Artificial Sequence
  derived and/or modified sequence opt2 from PELI2__Homo_sapiens__NP_067078
auguucucccccggccaggaggagcacugcgcccccaacaaggagcccgucaaguacggcgagcucgucguccucggcuacaacggcgcccuccccaacggcgaccgcggccgccgcaagucccgcuucgcccucuacaagcgccccaaggccaacggcgucaagcccuccaccguccacgucaucuccaccccccaggccuccaaggccaucuccugcaagggccagcacuccaucuccuacacccucucccgcaaccagaccgucgucgucgaguacacccacgacaaggacaccgacauguuccaggucggccgcuccaccgagucccccaucgacuucgucgucaccgacaccaucuccggcucccagaacaccgacgaggcccagaucacccaguccaccaucucccgcuucgccugccgcaucgucugcgaccgcaacgagcccuacaccgcccgcaucuucgccgccggcuucgacuccuccaagaacaucuuccucggcgagaaggccgccaaguggaagaaccccgacggccacauggacggccucaccaccaacggcguccucgucaugcacccccgcggcggcuucaccgaggagucccagcccggcgucuggcgcgagaucuccgucugcggcgacgucuacacccuccgcgagacccgcuccgcccagcagcgcggcaagcucgucgaguccgagaccaacguccuccaggacggcucccucaucgaccucugcggcgccacccuccucuggcgcaccgccgacggccucuuccacacccccacccagaagcacaucgaggcccuccgccaggagaucaacgccgcccgcccccagugccccgucggccucaacacccucgccuuccccuccaucaaccgcaaggaggucgucgaggagaagcagcccugggccuaccucuccugcggccacguccacggcuaccacaacuggggccaccgcuccgacaccgaggccaacgagcgcgagugccccaugugccgcaccgucggccccuacgucccccucuggcucggcugcgaggccggcuucuacgucgacgccggcccccccacccacgccuucacccccugcggccacgucugcuccgagaaguccgccaaguacuggucccagaucccccucccccacggcacccacgccuuccacgccgccugccccuucugcgccacccagcucgucggcgagcagaacugcaucaagcucaucuuccagggccccaucgacuga

SEQ ID NO: 47498 - RNA, 2721 nt, Artificial Sequence
  derived and/or modified sequence opt2 from PELP1__Homo_sapiens__NP_001265170
auggagcucgccgucgccguccuccgcgaccuccuccgcuacgccgcccagcuccccgcccucuuccgcgacaucuccaugaaccaccuccccggccuccucaccucccuccucggccuccgccccgagugcgagcaguccgcccucgagggcaugaaggccugcaugaccuacuucccccgcgccugcggcucccucaagggcaagcucgccuccuucuuccucucccgcgucgacgcccucuccccccagcuccagcagcucgccugcgagugcuacucccgccuccccucccucggcgccggcuucucccagggccucaagcacaccgaguccugggagcaggagcuccacucccuccucgccucccuccacacccuccucggcgcccucuacgagggcgccgagaccgcccccguccagaacgagggccccggcgucgagaugcuccucuccuccgaggacggcgacgcccacguccuccuccagcuccgccagcgcuucuccggccucgcccgcugccucggccucaugcucuccuccgaguucggcgcccccgucuccguccccguccaggagauccucgacuucaucugccgcacccucuccgucuccuccaagaacaucucccuccacggcgacggcccccuccgccuccuccuccuccccuccauccaccucgaggcccucgaccuccucuccgcccucauccucgccugcggcucccgccuccuccgcuucggcauccucaucggccgccuccucccccagguccucaacuccugguccaucggccgcgacucccucucccccggccaggagcgccccuacuccaccguccgcaccaaggucuacgccauccucgagcucuggguccaggucugcggcgccuccgccggcaugcuccagggcggcgccuccggcgaggcccuccucacccaccuccucuccgacaucuccccccccgccgacgcccucaagcuccgcuccccccgcggcucccccgacggcucccuccagaccggcaagcccuccgcccccaagaagcucaagcucgacgucggcgaggccauggccccccccucccaccgcaagggcgacuccaacgccaacuccgacgucugcgccgccgcccuccgcggccucucccgcaccauccucaugugcggcccccucaucaaggaggagacccaccgccgccuccacgaccucguccucccccucgucaugggcguccagcagggcgagguccucggcuccucccccuacaccuccucccgcugccgccgcgagcucuacugccuccuccucgcccuccuccucgcccccuccccccgcugcccccccccccucgccugcgcccuccaggccuucucccucggccagcgcgaggacucccucgaggucuccuccuucugcuccgaggcccucgucaccugcgccgcccucacccacccccgcguccccccccuccagcccaugggccccaccugccccacccccgcccccguccccccccccgaggcccccucccccuuccgcgccccccccuuccacccccccggccccaugcccuccgucggcuccaugcccuccgccggccccaugcccuccgccggccccaugcccuccgccggccccguccccuccgcccgccccggcccccccaccaccgccaaccaccucggccucuccguccccggccucgucuccguccccccccgccuccuccccggccccgagaaccaccgcgccggcuccaacgaggaccccauccucgcccccuccggcacccccccccccaccaucccccccgacgagaccuucggcggccgcgucccccgccccgccuucguccacuacgacaaggaggaggccuccgacgucgagaucucccucgaguccgacuccgacgacuccgucgucaucguccccgagggccuccccccccuccccccccccccccccuccggcgccacccccccccccaucgcccccaccggcccccccaccgccuccccccccguccccgccaaggaggagcccgaggagcuccccgccgcccccggcccccuccccccccccccccccccccccccccccguccccggccccgucacccucccccccccccagcucguccccgagggcacccccggcggcggcggcccccccgcccucgaggaggaccucaccgucaucaacaucaacuccuccgacgaggaggaggaggaggaggaggaggaggaggaggaggaggaggaggaggaggaggaggaggaggacuucgaggaggaggaggaggacgaggaggaguacuucgaggaggaggaggaggaggaggaggaguucgaggaggaguucgaggaggaggagggcgagcucgaggaggaggaggaggaggaggacgaggaggaggaggaggagcucgaggaggucgagcgcgagggcgagucccccgccgccggcccccccccccaggagcucgucgaggaggagcccuccgccccccccacccuccucgaggaggagaccgaggacggcuccgacaagguccagcccccccccgagacccccgccgaggaggagauggagaccgagaccgaggccgaggcccuccaggagaaggagcaggacgacaccgccgccaugcucgccgacuucaucgacugcccccccgacgacgagaagccccccccccccaccgagcccgacuccuga

SEQ ID NO: 47499 - RNA, 645 nt, Artificial Sequence
  derived and/or modified sequence opt2 from PEMT__Homo_sapiens__NP_001254480
augaagcgcuccggcaaccccggcgccgaggccgacuucugcgucaugacccgccuccucggcuacgucgacccccucgaccccuccuucgucgccgccgucaucaccaucaccuucaacccccucuacuggaacgucgucgcccgcugggagcacaagacccgcaagcucucccgcgccuucggcucccccuaccucgccugcuacucccucuccgucaccauccuccuccucaacuuccuccgcucccacugcuucacccaggccaugcucucccagccccgcauggagucccucgacacccccgccgccuacucccucggccucgcccuccucggccucggcgucguccucguccucuccuccuucuucgcccucggcuucgccggcaccuuccucggcgacuacuucggcauccucaaggaggcccgcgucaccgucuuccccuucaacauccucgacaaccccauguacuggggcuccaccgccaacuaccucggcugggccaucaugcacgccucccccaccggccuccuccucaccguccucgucgcccucaccuacaucgucgcccuccucuacgaggagcccuucaccgccgagaucuaccgccagaaggccuccggcucccacaagcgcuccuga

SEQ ID NO: 47500 - RNA, 804 nt, Artificial Sequence
  derived and/or modified sequence opt2 from PENK__Homo_sapiens__NP_001129162
auggcccgcuuccucacccucugcaccuggcuccuccuccucggccccggccuccucgccaccguccgcgccgagugcucccaggacugcgccaccugcuccuaccgccucguccgccccgccgacaucaacuuccucgccugcgucauggagugcgagggcaagcuccccucccucaagaucugggagaccugcaaggagcuccuccagcucuccaagcccgagcucccccaggacggcaccuccacccuccgcgagaacuccaagcccgaggagucccaccuccucgccaagcgcuacggcggcuucaugaagcgcuacggcggcuucaugaagaagauggacgagcucuaccccauggagcccgaggaggaggccaacggcuccgagauccucgccaagcgcuacggcggcuucaugaagaaggacgccgaggaggacgacucccucgccaacuccuccgaccuccucaaggagcuccucgagaccggcgacaaccgcgagcgcucccaccaccaggacggcuccgacaacgaggaggaggucuccaagcgcuacggcggcuucaugcgcggccucaagcgcuccccccagcucgaggacgaggccaaggagcuccagaagcgcuacggcggcuucaugcgccgcgucggccgccccgagugguggauggacuaccagaagcgcuacggcggcuuccucaagcgcuucgccgaggcccuccccuccgacgaggagggcgaguccuacuccaaggagguccccgagauggagaagcgcuacggcggcuucaugcgcuucuga

SEQ ID NO: 47501 - RNA, 1482 nt, Artificial Sequence
  derived and/or modified sequence opt2 from PEPD__Homo_sapiens__NP_000276
auggccgccgccaccggccccuccuucuggcucggcaacgagacccucaaggucccccucgcccucuucgcccucaaccgccagcgccucugcgagcgccuccgcaagaaccccgccguccaggccggcuccaucgucguccuccagggcggcgaggagacccagcgcuacugcaccgacaccggcguccucuuccgccaggaguccuucuuccacugggccuucggcgucaccgagcccggcugcuacggcgucaucgacgucgacaccggcaaguccacccucuucgucccccgccuccccgccucccacgccaccuggaugggcaagauccacuccaaggagcacuucaaggagaaguacgccgucgacgacguccaguacgucgacgagaucgccuccguccucaccucccagaagcccuccguccuccucacccuccgcggcgucaacaccgacuccggcuccgucugccgcgaggccuccuucgacggcaucuccaaguucgaggucaacaacaccauccuccaccccgagaucgucgagugccgcgucuucaagaccgacauggagcucgagguccuccgcuacaccaacaagaucuccuccgaggcccaccgcgaggucaugaaggccgucaaggucggcaugaaggaguacgagcucgagucccucuucgagcacuacugcuacucccgcggcggcaugcgccacuccuccuacaccugcaucugcggcuccggcgagaacuccgccguccuccacuacggccacgccggcgcccccaacgaccgcaccauccagaacggcgacaugugccucuucgacaugggcggcgaguacuacugcuucgccuccgacaucaccugcuccuuccccgccaacggcaaguucaccgccgaccagaaggccgucuacgaggccguccuccgcuccucccgcgccgucaugggcgccaugaagcccggcgucugguggcccgacaugcaccgccucgccgaccgcauccaccucgaggagcucgcccacaugggcauccucuccggcuccgucgacgccaugguccaggcccaccucggcgccgucuucaugccccacggccucggccacuuccucggcaucgacguccacgacgucggcggcuaccccgagggcgucgagcgcaucgacgagcccggccuccgcucccuccgcaccgcccgccaccuccagcccggcaugguccucaccgucgagcccggcaucuacuucaucgaccaccuccucgacgaggcccucgccgaccccgcccgcgccuccuuccucaaccgcgagguccuccagcgcuuccgcggcuucggcggcguccgcaucgaggaggacgucgucgucaccgacuccggcaucgagcuccucaccugcgucccccgcaccgucgaggagaucgaggccugcauggccggcugcgacaaggccuucacccccuucuccggccccaaguga

SEQ ID NO: 47502 - RNA, 3873 nt, Artificial Sequence
  derived and/or modified sequence opt2 from PER1__Homo_sapiens__NP_002607
auguccggcccccucgagggcgccgacggcggcggcgacccccgccccggcgaguccuucugccccggcggcguccccucccccggccccccccagcaccgccccugccccggccccucccucgccgacgacaccgacgccaacuccaacggcuccuccggcaacgaguccaacggccacgagucccgcggcgccucccagcgcuccucccacuccuccuccuccggcaacggcaaggacuccgcccuccucgagaccaccgaguccuccaaguccaccaacucccagucccccuccccccccuccuccuccaucgccuacucccuccucuccgccuccuccgagcaggacaaccccuccaccuccggcugcuccuccgagcaguccgcccgcgcccgcacccagaaggagcucaugaccgcccuccgcgagcucaagcuccgccucccccccgagcgccgcggcaagggccgcuccggcacccucgccacccuccaguacgcccucgccugcgucaagcagguccaggccaaccaggaguacuaccagcaguggucccucgaggagggcgagcccugcuccauggacauguccaccuacacccucgaggagcucgagcacaucaccuccgaguacacccuccagaaccaggacaccuucuccgucgccgucuccuuccucaccggccgcaucgucuacaucuccgagcaggccgccguccuccuccgcugcaagcgcgacgucuuccgcggcacccgcuucuccgagcuccucgccccccaggacgucggcgucuucuacggcuccaccgcccccucccgccuccccaccuggggcaccggcgccuccgccggcuccggccuccgcgacuucacccaggagaaguccgucuucugccgcauccgcggcggccccgaccgcgaccccggcccccgcuaccagcccuuccgccucacccccuacgucaccaagauccgcgucuccgacggcgcccccgcccagcccugcugccuccucaucgccgagcgcauccacuccggcuacgaggccccccgcaucccccccgacaagcgcaucuucaccacccgccacacccccuccugccucuuccaggacgucgacgagcgcgccgccccccuccucggcuaccucccccaggaccuccucggcgcccccguccuccucuuccuccaccccgaggaccgcccccucaugcucgccauccacaagaagauccuccagcucgccggccagcccuucgaccacucccccauccgcuucugcgcccgcaacggcgaguacgucaccauggacaccuccugggccggcuucguccaccccuggucccgcaaggucgccuucguccucggccgccacaagguccgcaccgccccccucaacgaggacgucuucaccccccccgcccccucccccgcccccucccucgacaccgacauccaggagcucuccgagcagauccaccgccuccuccuccagcccguccacucccccucccccaccggccucugcggcgucggcgccgucaccucccccggcccccuccacucccccggcuccuccuccgacuccaacggcggcgacgccgagggccccggcccccccgcccccgucaccuuccagcagaucugcaaggacguccaccucgucaagcaccagggccagcagcucuucaucgagucccgcgcccgcccccagucccgcccccgccuccccgccaccggcaccuucaaggccaaggcccuccccugccagucccccgaccccgagcucgaggccggcuccgcccccguccaggccccccucgcccucguccccgaggaggccgagcgcaaggaggccuccuccugcuccuaccagcagaucaacugccucgacuccauccuccgcuaccucgaguccugcaaccuccccuccaccaccaagcgcaagugcgccuccuccuccuccuacaccaccuccuccgccuccgacgacgaccgccagcgcaccggccccgucuccgucggcaccaagaaggacccccccuccgccgcccucuccggcgagggcgccaccccccgcaaggagcccgucgucggcggcacccucuccccccucgcccucgccaacaaggccgaguccgucgucuccgucaccucccagugcuccuucuccuccaccaucguccacgucggcgacaagaagccccccgaguccgacaucaucaugauggaggaccuccccggccucgcccccggccccgcccccucccccgcccccucccccaccgucgcccccgaccccgcccccgacgccuaccgccccgucggccucaccaaggccguccucucccuccacacccagaaggaggagcaggccuuccucucccgcuuccgcgaccucggccgccuccgcggccucgacuccuccuccaccgcccccuccgcccucggcgagcgcggcugccaccacggccccgccccccccucccgccgccaccacugccgcuccaaggccaagcgcucccgccaccaccagaacccccgcgccgaggcccccugcuacgucucccaccccucccccgucccccccuccacccccuggcccaccccccccgccaccacccccuuccccgccgucguccagcccuacccccuccccgucuucuccccccgcggcggcccccagccccucccccccgcccccaccuccgucccccccgccgccuuccccgccccccucgucacccccauggucgcccucguccuccccaacuaccucuuccccacccccuccuccuaccccuacggcgcccuccagacccccgccgagggcccccccacccccgccucccacucccccucccccucccuccccgcccucgcccccucccccccccaccgccccgacuccccccucuucaacucccgcugcuccuccccccuccagcucaaccuccuccagcucgaggagcucccccgcgccgagggcgccgccgucgccggcggccccggcuccuccgccggcccccccccccccuccgccgaggccgccgagcccgaggcccgccucgccgaggucaccgaguccuccaaccaggacgcccucuccggcuccuccgaccuccucgagcuccuccuccaggaggacucccgcuccggcaccggcuccgccgccuccggcucccucggcuccggccucggcuccggcuccggcuccggcucccacgagggcggcuccaccuccgccuccaucacccgcuccucccaguccucccacaccuccaaguacuucggcuccaucgacuccuccgaggccgaggccggcgccgcccgcggcggcgccgagcccggcgaccaggucaucaaguacguccuccaggaccccaucuggcuccucauggccaacgccgaccagcgcgucaugaugaccuaccagguccccucccgcgacaugaccuccguccucaagcaggaccgcgagcgccuccgcgccaugcagaagcagcagccccgcuucuccgaggaccagcgccgcgagcucggcgccguccacuccuggguccgcaagggccagcucccccgcgcccucgacgucauggccugcgucgacugcggcuccuccacccaggaccccggccaccccgacgacccccucuucuccgagcucgacggccucggccucgagcccauggaggagggcggcggcgagcagggcuccuccggcggcggcuccggcgagggcgagggcugcgaggaggcccagggcggcgccaaggccuccuccucccaggaccucgccauggaggaggaggaggagggccgcuccuccuccucccccgcccuccccaccgccggcaacugcaccuccuga

SEQ ID NO: 47503 - RNA, 3768 nt, Artificial Sequence
  derived and/or modified sequence opt2 from PER2__Homo_sapiens__NP_073728
augaacggcuacgccgaguucccccccucccccuccaaccccaccaaggagcccgucgagccccagcccucccaggucccccuccaggaggacgucgacauguccuccggcuccuccggccacgagaccaacgagaacugcuccaccggccgcgacucccagggcuccgacugcgacgacuccggcaaggagcucggcaugcucgucgagccccccgacgcccgccagucccccgacaccuucucccucaugauggccaaguccgagcacaaccccuccaccuccggcugcuccuccgaccaguccuccaaggucgacacccacaaggagcucaucaagacccucaaggagcucaagguccaccuccccgccgacaagaaggccaagggcaaggccuccacccucgccacccucaaguacgcccuccgcuccgucaagcaggucaaggccaacgaggaguacuaccagcuccucauguccuccgagggccaccccugcggcgccgacguccccuccuacaccgucgaggagauggaguccgucaccuccgagcacaucgucaagaacgccgacauguucgccgucgccgucucccucgucuccggcaagauccucuacaucuccgaccaggucgccuccaucuuccacugcaagcgcgacgccuucuccgacgccaaguucgucgaguuccucgccccccacgacgucggcgucuuccacuccuucaccucccccuacaagcucccccucugguccaugugcuccggcgccgacuccuucacccaggagugcauggaggagaaguccuucuucugccgcgucuccguccgcaagucccacgagaacgagauccgcuaccaccccuuccgcaugacccccuaccucgucaagguccgcgaccagcagggcgccgagucccagcucugcugccuccuccucgccgagcgcguccacuccggcuacgaggccccccgcaucccccccgagaagcgcaucuucaccaccacccacacccccaacugccucuuccaggacgucgacgagcgcgccgucccccuccucggcuaccucccccaggaccucaucgagacccccguccucguccagcuccaccccuccgaccgcccccucaugcucgccauccacaagaagauccuccaguccggcggccagcccuucgacuacucccccauccgcuuccgcgcccgcaacggcgaguacaucacccucgacaccuccugguccuccuucaucaaccccuggucccgcaagaucuccuucaucaucggccgccacaagguccgcgucggcccccucaacgaggacgucuucgccgcccaccccugcaccgaggagaaggcccuccaccccuccauccaggagcucaccgagcagauccaccgccuccuccuccagcccgucccccacuccggcuccuccggcuacggcucccucggcuccaacggcucccacgagcaccucaugucccagaccuccuccuccgacuccaacggccacgaggacucccgccgccgccgcgccgagaucugcaagaacggcaacaagaccaagaaccgcucccacuacucccacgaguccggcgagcagaagaagaaguccgucaccgagaugcagaccaacccccccgccgagaagaaggccguccccgccauggagaaggacucccucggcgucuccuuccccgaggagcucgccugcaagaaccagcccaccugcuccuaccagcagaucuccugccucgacuccgucauccgcuaccucgaguccugcaacgaggccgccacccucaagcgcaagugcgaguuccccgccaacguccccgcccuccgcuccuccgacaagcgcaaggccaccgucucccccggcccccacgccggcgaggccgagccccccucccgcgucaacucccgcaccggcgucggcacccaccucaccucccucgcccuccccggcaaggccgaguccgucgccucccucaccucccagugcuccuacuccuccaccaucguccacgucggcgacaagaagccccagcccgagcucgagauggucgaggacgccgccuccggccccgagucccucgacugccucgccggccccgcccucgccugcggccucucccaggagaaggagcccuucaagaagcucggccucaccaaggagguccucgccgcccacacccagaaggaggagcaguccuuccuccagaaguucaaggagauccgcaagcucuccaucuuccagucccacugccacuacuaccuccaggagcgcuccaagggccagcccuccgagcgcaccgcccccggccuccgcaacaccuccggcaucgacucccccuggaagaagaccggcaagaaccgcaagcucaaguccaagcgcgucaagccccgcgacuccuccgaguccaccggcuccggcggccccgucuccgcccgccccccccucgucggccucaacgccaccgccuggucccccuccgacaccucccaguccuccugccccgccguccccuuccccgcccccguccccgccgccuacucccuccccgucuuccccgcccccggcaccgucgccgccccccccgcccccccccacgccuccuucaccguccccgccguccccgucgaccuccagcaccaguucgccguccagcccccccccuuccccgccccccucgcccccgucauggccuucaugcuccccuccuacuccuuccccuccggcacccccaaccucccccaggccuucuuccccucccagccccaguuccccucccaccccacccucaccuccgagauggccuccgccucccagcccgaguuccccucccgcaccuccaucccccgccagcccugcgccugccccgccacccgcgccaccccccccuccgccaugggccgcgccucccccccccucuuccagucccgcuccuccuccccccuccagcucaaccuccuccagcucgaggaggcccccgagggcggcaccggcgccaugggcaccaccggcgccaccgagaccgccgccgucggcgccgacugcaagcccggcaccucccgcgaccagcagcccaaggccccccucacccgcgacgagcccuccgacacccagaacuccgacgcccucuccaccuccuccggccuccucaaccuccuccucaacgaggaccucugcuccgccuccggcuccgccgccuccgagucccucggcuccggcucccucggcugcgacgccucccccuccggcgccggcuccuccgacaccucccacaccuccaaguacuucggcuccaucgacuccuccgagaacaaccacaaggccaagaugaacaccggcauggaggaguccgagcacuucaucaagugcguccuccaggaccccaucuggcuccucauggccgacgccgacuccuccgucaugaugaccuaccagcuccccucccgcaaccucgaggccguccucaaggaggaccgcgagaagcucaagcuccuccagaagcuccagccccgcuucaccgagucccagaagcaggagcuccgcgagguccaccaguggaugcagaccggcggccuccccgccgccaucgacgucgccgagugcgucuacugcgagaacaaggagaagggcaacaucugcauccccuacgaggaggacauccccucccucggccucuccgaggucuccgacaccaaggaggacgagaacggcuccccccucaaccaccgcaucgaggagcagaccuga

SEQ ID NO: 47504 - RNA, 3576 nt, Artificial Sequence
  derived and/or modified sequence opt2 from PER3__Homo_sapiens__NP_001276790
augccccgcggcgaggcccccggccccggccgccgcggcgccaaggacgaggcccucggcgaggaguccggcgagcgcuggucccccgaguuccaccuccagcgcaagcucgccgacuccucccacuccgagcagcaggaccgcaaccgcgucuccgaggagcucaucauggucguccaggagaugaagaaguacuuccccuccgagcgccgcaacaagcccuccacccucgacgcccucaacuacgcccuccgcugcguccacuccguccaggccaacuccgaguucuuccagauccucucccagaacggcgccccccaggccgacgucuccauguacucccucgaggagcucgccaccaucgccuccgagcacaccuccaagaacaccgacaccuucgucgccgucuucuccuuccucuccggccgccucguccacaucuccgagcaggccgcccucauccucaaccgcaagaaggacguccucgccuccucccacuucgucgaccuccucgccccccaggacaugcgcgucuucuacgcccacaccgcccgcgcccagcuccccuucuggaacaacuggacccagcgcgccgccgcccgcuacgagugcgcccccgucaagcccuucuucugccgcauccgcggcggcgaggaccgcaagcaggagaagugccacucccccuuccgcaucauccccuaccucauccacguccaccaccccgcccagcccgagcucgaguccgagcccugcugccucaccgucgucgagaagauccacuccggcuacgaggccccccgcauccccgucaacaagcgcaucuucaccaccacccacacccccggcugcgucuuccucgaggucgacgagaaggccgucccccuccucggcuaccucccccaggaccucaucggcaccuccauccucuccuaccuccaccccgaggaccgcucccucauggucgccauccaccagaagguccucaaguacgccggccacccccccuucgagcacucccccauccgcuucugcacccagaacggcgacuacaucauccucgacuccuccugguccuccuucgucaaccccuggucccgcaagaucuccuucaucaucggccgccacaagguccgcaccuccccccucaacgaggacgucuucgccaccaagaucaagaagaugaacgacaacgacaaggacaucaccgagcuccaggagcagaucuacaagcuccuccuccagcccguccacgucuccgucuccuccggcuacggcucccucggcuccuccggcucccaggagcagcucgucuccaucgccuccuccuccgaggccuccggccaccgcgucgaggagaccaaggccgagcagaugacccuccagcaggucuacgccuccgucaacaagaucaagaaccucggccagcagcucuacaucgaguccaugaccaaguccuccuucaagcccgucaccggcacccgcaccgagcccaacggcggcggcgaguccgccaacggcggcggcgagugcaagaccuucaccuccuuccaccagacccucaagaacaacuccgucuacaccgagcccugcgaggaccuccgcaacgacgagcacucccccuccuaccagcagaucaacugcaucgacuccgucauccgcuaccucaaguccuacaacauccccgcccucaagcgcaagugcaucuccugcaccaacaccaccuccuccuccuccgaggaggacaagcagaaccacaaggccgacgacguccaggcccuccaggccggccuccagauccccgccauccccaaguccgagaugcccaccaacggccgcuccaucgacaccggcggcggcgccccccagauccucuccaccgccaugcucucccucggcuccggcaucucccagugcggcuacuccuccaccaucguccacguccccccccccgagaccgcccgcgacgccacccucuucugcgagcccuggacccucaacaugcagcccgccccccucaccuccgaggaguucaagcacgucggccucaccgccgccguccucuccgcccacacccagaaggaggagcagaacuacgucgacaaguuccgcgagaagauccucuccucccccuacuccuccuaccuccagcaggagucccgcuccaaggccaaguacuccuacuuccagggcgacuccaccuccaagcagacccgcuccgccggcugccgcaagggcaagcacaagcgcaagaagcuccccgagccccccgacuccuccuccuccaacaccggcuccggcccccgccgcggcgcccaccagaacgcccagcccugcugccccuccgccgccuccuccccccacaccuccucccccaccuucccccccgccgccaugguccccucccaggcccccuaccucguccccgccuucccccuccccgccgccaccucccccggccgcgaguacgccgcccccggcaccgcccccgagggccuccacggccucccccucuccgagggccuccagcccuaccccgccuuccccuuccccuaccucgacaccuucaugaccgucuuccuccccgacccccccgucugcccccuccucucccccuccuuccuccccugccccuuccucggcgccaccgccuccuccgccaucucccccuccauguccuccgccaugucccccacccucgaccccccccccuccgucaccucccagcgccgcgaggaggagaagugggaggcccaguccgagggccaccccuucaucaccucccgcuccuccuccccccuccagcucaaccuccuccaggaggagaugccccgccccuccgagucccccgaccagaugcgccgcaacaccugcccccagaccgaguacugcgucaccggcaacaacggcuccgaguccucccccgccaccaccggcgcccucuccaccggcucccccccccgcgagaaccccucccaccccaccgccuccgcccucuccaccggcuccccccccaugaagaaccccucccaccccaccgccuccacccucuccaugggccucccccccucccgcacccccucccaccccaccgccaccguccucuccaccggcuccccccccuccgagucccccucccgcaccggcuccgccgccuccggcuccuccgacuccuccaucuaccucaccuccuccgucuacuccuccaagaucucccagaacggccagcagucccaggacguccagaagaaggagaccuuccccaacgucgccgaggagcccaucuggcgcaugauccgccagacccccgagcgcauccucaugaccuaccagguccccgagcgcgucaaggaggucguccucaaggaggaccucgagaagcucgaguccaugcgccagcagcagccccaguucucccacggccagaaggaggagcucgccaaggucuacaacuggauccagucccagaccgucacccaggagaucgacauccaggccugcgucaccugcgagaacgaggacuccgccgacggcgccgccaccuccugcggccagguccucgucgaggacuccugcuga

SEQ ID NO: 47505 - RNA, 2091 nt, Artificial Sequence
  derived and/or modified sequence opt2 from PERM1__Homo_sapiens__NP_001278296
augcccacccaggacggccagcuccgccgccccgcccgcccccccggcccccgcgccuggauggagccccgcggcggcggcuccucccaguucuccuccugccccggccccgccuccuccggcgaccagaugcagcgccuccuccagggccccgccccccgcccccccggcgagccccccggcucccccaagucccccggccacuccaccggcucccagcgcccccccgacucccccggcgcccccccccgcucccccucccgcaagaagcgccgcgccgucggcgccaagggcggcggccacaccggcgccuccgccuccgcccagaccggcuccccccuccuccccgccgccucccccgagaccgccaagcucauggccaaggccggccaggaggagcucggccccggccccgccggcgcccccgagcccggcccccgcucccccguccaggaggaccgccccggccccggccucggccucuccacccccguccccgucaccgagcagggcaccgaccagauccgcaccccccgccgcgccaagcuccacaccgucuccaccaccgucugggaggcccuccccgacgucucccgcgccaaguccgacauggccgucuccacccccgccuccgagccccagcccgaccgcgacauggccgucuccacccccgccuccgagccccaguccgaccgcgacauggccgucuccacccccgccuccgagccccagcccgacaccgacauggccgucuccacccccgccuccgagccccagcccgaccgcgacauggccgucuccauccccgccuccaagccccaguccgacaccgccgucuccacccccgccuccgagccccaguccuccgucgcccucuccacccccaucuccaagccccagcucgacaccgacgucgccgucuccacccccgccuccaagcacggccucgacgucgcccuccccaccgccggccccgucgccaagcucgaggucgccuccuccccccccgucuccgaggccgucccccgcaugaccgaguccuccggccucgucuccacccccgucccccgcgccgacgccgccggccucgccuggccccccacccgccgcgccggccccgacgucgucgagauggaggccgucgucuccgagcccuccgccggcgcccccggcugcugcuccggcgcccccgcccucggccucacccaggucccccgcaagaagaagguccgcuucuccgucgccggccccucccccaacaagcccggcuccggccaggccuccgcccgccccuccgccccccagaccgccaccggcgcccacggcggccccggcgccugggaggccgucgccgucggcccccgcccccaccagccccgcauccucaagcaccucccccgccccccccccuccgccgucacccgcgucggccccggcuccuccuucgccgucacccuccccgaggccuacgaguucuucuucugcgacaccaucgaggagaacgaggaggccgaggccgccgccgccggccaggaccccgccggcguccaguggcccgacaugugcgaguucuucuuccccgacgucggcgcccagcgcucccgccgccgcggcucccccgagccccucccccgcgccgaccccguccccgcccccauccccggcgaccccguccccaucuccauccccgaggucuacgagcacuucuucuucggcgaggaccgccucgagggcguccucggccccgccgucccccucccccuccaggcccucgagcccccccgcuccgccuccgagggcgccggccccggcaccccccucaagcccgccgucgucgagcgccuccaccucgcccuccgccgcgccggcgagcuccgcggccccguccccuccuucgccuucucccagaacgacaugugccucgucuucgucgccuucgccaccugggccguccgcaccuccgacccccacacccccgacgccuggaagaccgcccuccucgccaacgucggcaccaucuccgccauccgcuacuuccgccgccaggucggccagggccgccgcucccacucccccucccccuccuccuga

SEQ ID NO: 47506 - RNA, 582 nt, Artificial Sequence
  derived and/or modified sequence opt2 from PERP__Homo_sapiens__NP_071404
augauccgcugcggccucgccugcgagcgcugccgcuggauccucccccuccuccuccucuccgccaucgccuucgacaucaucgcccucgccggccgcggcuggcuccaguccuccgaccacggccagaccuccucccucugguggaagugcucccaggagggcggcggcuccggcuccuacgaggagggcugccagucccucauggaguacgccuggggccgcgccgccgccgccaugcucuucugcggcuucaucauccucgucaucugcuucauccucuccuucuucgcccucugcggcccccagaugcucgucuuccuccgcgucaucggcggccuccucgcccucgccgccgucuuccagaucaucucccucgucaucuaccccgucaaguacacccagaccuucacccuccacgccaaccccgccgucaccuacaucuacaacugggccuacggcuucggcugggccgccaccaucauccucaucggcugcgccuucuucuucugcugccuccccaacuacgaggacgaccuccucggcaacgccaagccccgcuacuucuacaccuccgccuga

SEQ ID NO: 47507 - RNA, 1752 nt, Artificial Sequence
  derived and/or modified sequence opt2 from PES1__Homo_sapiens__NP_001230154
augggcggccucgagaagaagaaguacgagcgcggcuccgccaccaacuacaucacccgcaacaaggcccgcaagaagcuccagcucucccucgccgacuuccgccgccucugcauccucaagggcaucuacccccacgagcccaagcacaagaagaaggucaacaagggcuccaccgccgcccgcaccuucuaccucaucaaggacauccgcuuccuccuccacgagcccaucgucaacaaguuccgcgaguacaaggucuucguccgcaagcuccgcaaggccuacggcaaguccgaguggaacaccgucgagcgccucaaggacaacaagcccaacuacaagcucgaccacaucaucaaggagcgcuaccccaccuucaucgacgcccuccgcgaccucgacgacgcccucuccaugugcuuccucuucuccaccuucccccgcaccggcaagugccacguccagaccauccagcucugccgccgccucaccgucgaguucaugcacuacaucaucgccgcccgcgcccuccgcaaggucuuccucuccaucaagggcaucuacuaccaggccgagguccucggccagcccaucgucuggaucacccccuacgccuucucccacgaccaccccaccgacgucgacuaccgcgucauggccaccuucaccgaguucuacaccacccuccucggcuucgucaacuuccgccucuaccagcuccucaaccuccacuacccccccaagcucgagggccaggcccaggccgaggccaaggccggcgagggcaccuacgcccucgacuccgaguccugcauggagaagcucgccgcccucuccgccucccucgcccgcgucgucguccccgccaccgaggaggaggccgaggucgacgaguuccccaccgacggcgaggaggaccgccgcaaggagcucgaggcccaggagaagcacaagaagcucuucgagggccucaaguucuuccucaaccgcgaggucccccgcgaggcccucgccuucaucauccgcuccuucggcggcgaggucuccugggacaagucccucugcaucggcgccaccuacgacgucaccgacucccgcaucacccaccagaucgucgaccgccccggccagcagaccuccgucaucggccgcugcuacguccagccccagugggucuucgacuccgucaacgcccgccuccuccuccccgucgccgaguacuucuccggcguccagcuccccccccaccucucccccuucgucaccgagaaggagggcgacuacgucccccccgagaagcucaagcuccucgcccuccagcgcggcgaggaccccggcaaccucaacgaguccgaggaggaggaggaggaggacgacaacaacgagggcgacggcgacgaggagggcgagaacgaggaggaggaggaggacgccgaggccggcuccgagaaggaggaggaggcccgccucgccgcccucgaggagcagcgcauggagggcaagaagccccgcgucauggccggcacccucaagcucgaggacaagcagcgccucgcccaggaggaggaguccgaggccaagcgccucgccaucaugaugaugaagaagcgcgagaaguaccucuaccagaagaucauguucggcaagcgccgcaagauccgcgaggccaacaagcucgccgagaagcgcaaggcccacgacgaggccguccgcuccgagaagaaggccaagaaggcccgccccgaguga

SEQ ID NO: 47508 - RNA, 222 nt, Artificial Sequence
  derived and/or modified sequence opt2 from PET100__Homo_sapiens__NP_001164626
augggcgucaagcucgagaucuuccgcaugaucaucuaccucaccuuccccgucgccauguucugggucuccaaccaggccgagugguucgaggacgacgucauccagcgcaagcgcgagcucuggccccccgagaagcuccaggagaucgaggaguucaaggagcgccuccgcaagcgccgcgaggagaagcuccuccgcgacgcccagcagaacuccuga

SEQ ID NO: 47509 - RNA, 246 nt, Artificial Sequence
  derived and/or modified sequence opt2 from PET117__Homo_sapiens__NP_001158283
augucccgcuccuccaaggucguccucggccucuccguccuccucaccgccgccaccgucgccggcguccacgucaagcagcagugggaccagcagcgccuccgcgacggcgucauccgcgacaucgagcgccagauccgcaagaaggagaacauccgccuccucggcgagcagaucauccucaccgagcagcucgaggccgagcgcgagaagaugcuccucgccaagggcucccagaaguccuga

SEQ ID NO: 47510 - RNA, 744 nt, Artificial Sequence
  derived and/or modified sequence opt2 from PEX11A__Homo_sapiens__NP_003838
auggacgccuucacccgcuucaccaaccagacccagggccgcgaccgccucuuccgcgccacccaguacaccugcaugcuccuccgcuaccuccucgagcccaaggccggcaaggagaaggucgucaugaagcucaagaagcucgaguccuccgucuccaccggccgcaagugguuccgccucggcaacgucguccacgccauccaggccaccgagcaguccauccacgccaccgaccucgucccccgccucugccucacccucgccaaccucaaccgcgucaucuacuucaucugcgacaccauccucuggguccgcuccgucggccucaccuccggcaucaacaaggagaaguggcgcacccgcgccgcccaccacuacuacuacucccuccuccucucccucguccgcgaccucuacgagaucucccuccagaugaagcgcgucaccugcgaccgcgccaagaaggagaaguccgccucccaggacccccucugguucuccgucgccgaggaggagaccgaguggcuccaguccuuccuccuccuccucuuccgcucccucaagcagcaccccccccuccuccucgacaccgucaagaaccucugcgacauccucaacccccucgaccagcucggcaucuacaaguccaaccccggcaucaucggccucggcggccucgucuccuccaucgccggcaugaucaccgucgccuacccccagaugaagcucaagacccgcuga

SEQ ID NO: 47511 - RNA, 1080 nt, Artificial Sequence
  derived and/or modified sequence opt2 from PEX12__Homo_sapiens__NP_000277
auggccgagcacggcgcccacuucaccgccgccuccgucgccgacgaccagcccuccaucuucgaggucgucgcccaggacucccucaugaccgccguccgccccgcccuccagcacgucgucaagguccucgccgaguccaaccccacccacuacggcuuccucuggcgcugguucgacgagaucuucacccuccucgaccuccuccuccagcagcacuaccucucccgcaccuccgccuccuucuccgagaacuucuacggccucaagcgcaucgucaugggcgacacccacaagucccagcgccucgccuccgccggccuccccaagcagcagcucuggaaguccaucauguuccucguccuccuccccuaccucaaggucaagcucgagaagcucgucuccucccuccgcgaggaggacgaguacuccauccacccccccuccucccgcuggaagcgcuucuaccgcgccuuccucgccgccuaccccuucgucaacauggccugggagggcugguuccucguccagcagcuccgcuacauccucggcaaggcccagcaccacuccccccuccuccgccucgccggcguccagcucggccgccucaccguccaggacauccaggcccucgagcacaagcccgccaaggccuccaugaugcagcagcccgcccgcuccgucuccgagaagaucaacuccgcccucaagaaggccgucggcggcgucgcccucucccucuccaccggccucuccgucggcgucuucuuccuccaguuccucgacuggugguacuccuccgagaaccaggagaccaucaagucccucaccgcccuccccaccccccccccccccguccaccucgacuacaacuccgacuccccccuccuccccaagaugaagaccgucugcccccucugccgcaagacccgcgucaacgacaccguccucgccaccuccggcuacgucuucugcuaccgcugcgucuuccacuacguccgcucccaccaggccugccccaucaccggcuaccccaccgagguccagcaccucaucaagcucuacucccccgagaacuga

SEQ ID NO: 47512 - RNA, 1212 nt, Artificial Sequence
  derived and/or modified sequence opt2 from PEX13__Homo_sapiens__NP_002609
auggccucccagcccccccccccccccaagcccugggagacccgccgcauccccggcgccggccccggccccggccccggccccaccuuccaguccgccgaccucggccccacccucaugacccgccccggccagcccgcccucacccgcguccccccccccauccucccccgccccucccagcagaccggcuccuccuccgucaacaccuuccgccccgccuacuccuccuucuccuccggcuacggcgccuacggcaacuccuucuacggcggcuacucccccuacuccuacggcuacaacggccucggcuacaaccgccuccgcgucgacgaccucccccccucccgcuucguccagcaggccgaggaguccucccgcggcgccuuccaguccaucgaguccaucguccacgccuucgccuccgucuccaugaugauggacgccaccuucuccgccgucuacaacuccuuccgcgccguccucgacgucgccaaccacuucucccgccucaagauccacuucaccaaggucuucuccgccuucgcccucguccgcaccauccgcuaccucuaccgccgccuccagcgcaugcucggccuccgccgcggcuccgagaacgaggaccucugggccgaguccgagggcaccgucgccugccucggcgccgaggaccgcgccgccaccuccgccaaguccuggcccaucuuccucuucuucgccgucauccucggcggccccuaccucaucuggaagcuccucuccacccacuccgacgaggucaccgacuccaucaacugggccuccggcgaggacgaccacgucgucgcccgcgccgaguacgacuucgccgccgucuccgaggaggagaucuccuuccgcgccggcgacaugcucaaccucgcccucaaggagcagcagcccaagguccgcggcuggcuccucgccucccucgacggccagaccaccggccucauccccgccaacuacgucaagauccucggcaagcgcaagggccgcaagaccgucgaguccuccaaggucuccaagcagcagcaguccuucaccaaccccacccucaccaagggcgccaccgucgccgacucccucgacgagcaggaggccgccuucgaguccgucuucgucgagaccaacaagguccccgucgcccccgacuccaucggcaaggacggcgagaagcaggaccucuga

SEQ ID NO: 47513 - RNA, 1077 nt, Artificial Sequence
  derived and/or modified sequence opt2 from PEX14__Homo_sapiens__XP_011539880
augcucaacaagcucaucugccucaugaucgccaccgccgucaaguuccuccagaacucccgcguccgccaguccccccucgccacccgccgcgccuuccucaagaagaagggccucaccgacgaggagaucgacauggccuuccagcaguccggcaccgccgccgacgagcccuccucccucggccccgccacccaggucguccccguccagcccccccaccucaucucccagcccuacucccccgccggcucccgcuggcgcgacuacggcgcccucgccaucaucauggccggcaucgccuucggcuuccaccagcucuacaagaaguaccuccucccccucauccucggcggccgcgaggaccgcaagcagcucgagcgcauggaggccggccucuccgagcucuccggcuccgucgcccagaccgucacccagcuccagaccacccucgccuccguccaggagcuccucauccagcagcagcagaagauccaggagcucgcccacgagcucgccgccgccaaggccaccaccuccaccaacuggauccucgagucccagaacaucaacgagcucaaguccgagaucaacucccucaagggccuccuccucaaccgccgccaguucccccccucccccuccgcccccaagauccccuccuggcagauccccgucaagucccccucccccuccucccccgccgccgucaaccaccacuccuccuccgacaucucccccgucuccaacgaguccaccuccuccucccccggcaaggagggccacucccccgagggcuccaccgucaccuaccaccuccucggcccccaggaggagggcgagggcgucgucgacgucaagggccagguccgcauggagguccagggcgaggaggagaagcgcgaggacaaggaggacgaggaggacgaggaggacgacgacgucucccacgucgacgaggaggacugccucggcguccagcgcgaggaccgccgcggcggcgacggccagaucaacgagcaggucgagaagcuccgccgccccgagggcgccuccaacgaguccgagcgcgacuga

SEQ ID NO: 47514 - RNA, 1011 nt, Artificial Sequence
  derived and/or modified sequence opt2 from PEX16__Homo_sapiens__NP_004804
auggagaagcuccgccuccucggccuccgcuaccaggaguacgucacccgccaccccgccgccaccgcccagcucgagaccgccguccgcggcuucuccuaccuccucgccggccgcuucgccgacucccacgagcucuccgagcucgucuacuccgccuccaaccuccucguccuccucaacgacggcauccuccgcaaggagcuccgcaagaagcuccccgucucccucucccagcagaagcuccucaccuggcucuccguccucgagugcgucgaggucuucauggagaugggcgccgccaaggucuggggcgaggucggccgcuggcucgucaucgcccucauccagcucgccaaggccguccuccgcaugcuccuccuccucugguucaaggccggccuccagaccuccccccccaucgucccccucgaccgcgagacccaggcccagccccccgacggcgaccacucccccggcaaccacgagcaguccuacgucggcaagcgcuccaaccgcgucguccgcacccuccagaacacccccucccuccacucccgccacuggggcgccccccagcagcgcgagggccgccagcagcagcaccacgaggagcucuccgccacccccaccccccucggccuccaggagaccaucgccgaguuccucuacaucgcccgcccccuccuccaccuccucucccucggccucuggggccagcgcuccuggaagcccuggcuccucgccggcgucgucgacgucaccucccucucccuccucuccgaccgcaagggccucacccgccgcgagcgccgcgagcuccgccgccgcaccauccuccuccucuacuaccuccuccgcucccccuucuacgaccgcuucuccgaggcccgcauccucuuccuccuccagcuccucgccgaccacguccccggcgucggccucgucacccgcccccucauggacuaccuccccaccuggcagaagaucuacuucuacuccuggggcuga

SEQ ID NO: 47515 - RNA, 840 nt, Artificial Sequence
  derived and/or modified sequence opt2 from PEX19__Homo_sapiens__NP_001180573
auggccgccgccgaggagggcugcuccgucggcgccgaggccgaccgcgagcucgaggagcuccucgaguccgcccucgacgacuucgacaaggccaagcccucccccgccccccccuccaccaccaccgcccccgacgccuccggcccccagaagcgcucccccggcgacaccgccaaggacgcccucuucgccucccaggagaaguucuuccaggagcucuucgacuccgagcucgccucccaggccaccgccgaguucgagaaggccaugaaggagcucgccgaggaggagccccaccucgucgagcaguuccagaagcucuccgaggccgccggccgcgucggcuccgacaugaccucccagcaggaguucaccuccugccucaaggagacccucuccggccucgccaagaacgccaccgaccuccagaacuccuccauguccgaggaggagcucaccaaggccauggagggccucggcauggacgagggcgacggcgagggcaacauccuccccaucaugcaguccaucaugcagaaccuccucuccaaggacguccucuaccccucccucaaggagaucaccgagaaguaccccgaguggcuccagucccaccgcgagucccucccccccgagcaguucgagaaguaccaggagcagcacuccgucaugugcaagaucugcgagcaguucgaggccgagacccccaccgacuccgagaccacccagaaggcccgcuucgagaugguccucgaccucaugcagcagcuccaggaccucggccacccccccaaggagcucgccggcgagaugguccccgucgucaacuccgucuga

SEQ ID NO: 47516 - RNA, 3852 nt, Artificial Sequence
  derived and/or modified sequence opt2 from PEX1__Homo_sapiens__NP_000457
auguggggcuccgaccgccucgccggcgccggcggcggcggcgccgccgucaccgucgccuucaccaacgcccgcgacugcuuccuccaccucccccgccgccucgucgcccagcuccaccuccuccagaaccaggccaucgaggucgucuggucccaccagcccgccuuccucuccugggucgagggccgccacuucuccgaccagggcgagaacgucgccgagaucaaccgccaggucggccagaagcucggccucuccaacggcggccaggucuuccucaagcccugcucccacgucgucuccugccagcaggucgaggucgagccccucuccgccgacgacugggagauccucgagcuccacgccgucucccucgagcagcaccuccucgaccagauccgcaucgucuuccccaaggccaucuuccccgucugggucgaccagcagaccuacaucuucauccagaucgucgcccucauccccgccgccuccuacggccgccucgagaccgacaccaagcuccucauccagcccaagacccgccgcgccaaggagaacaccuucuccaaggccgacgccgaguacaagaagcuccacuccuacggccgcgaccagaagggcaugaugaaggagcuccagaccaagcagcuccaguccaacaccgucggcaucaccgaguccaacgagaacgaguccgagauccccgucgacuccuccuccgucgccucccucuggaccaugaucggcuccaucuucuccuuccaguccgagaagaagcaggagaccuccuggggccucaccgagaucaacgccuucaagaacaugcaguccaaggucgucccccucgacaacaucuuccgcgucugcaagucccagccccccuccaucuacaacgccuccgccaccuccgucuuccacaagcacugcgccauccacgucuuccccugggaccaggaguacuucgacgucgagcccuccuucaccgucaccuacggcaagcucgucaagcuccucucccccaagcagcagcaguccaagaccaagcagaacguccucucccccgagaaggagaagcagauguccgagccccucgaccagaagaagauccgcuccgaccacaacgaggaggacgagaaggccugcguccuccaggucgucuggaacggccucgaggagcucaacaacgccaucaaguacaccaagaacgucgagguccuccaccucggcaaggucuggauccccgacgaccuccgcaagcgccucaacaucgagaugcacgccgucguccgcaucacccccgucgaggucacccccaagaucccccgcucccucaagcuccagccccgcgagaaccuccccaaggacaucuccgaggaggacaucaagaccgucuucuacuccuggcuccagcaguccaccaccaccaugcucccccucgucaucuccgaggaggaguucaucaagcucgagaccaaggacggccucaaggaguucucccucuccaucguccacuccugggagaaggagaaggacaagaacaucuuccuccucucccccaaccuccuccagaagaccaccauccagguccuccucgaccccauggucaaggaggagaacuccgaggagaucgacuucauccuccccuuccucaagcucuccucccucggcggcgucaacucccucggcgucuccucccucgagcacaucacccacucccuccucggccgcccccucucccgccagcucaugucccucgucgccggccuccgcaacggcgcccuccuccucaccggcggcaagggcuccggcaaguccacccucgccaaggccaucugcaaggaggccuucgacaagcucgacgcccacgucgagcgcgucgacugcaaggcccuccgcggcaagcgccucgagaacauccagaagacccucgaggucgccuucuccgaggccgucuggaugcagcccuccgucguccuccucgacgaccucgaccucaucgccggccuccccgccguccccgagcacgagcacucccccgacgccguccagucccagcgccucgcccacgcccucaacgacaugaucaaggaguucaucuccaugggcucccucgucgcccucaucgccaccucccagucccagcagucccuccacccccuccucgucuccgcccagggcguccacaucuuccagugcguccagcacauccagccccccaaccaggagcagcgcugcgagauccucugcaacgucaucaagaacaagcucgacugcgacaucaacaaguucaccgaccucgaccuccagcacgucgccaaggagaccggcggcuucgucgcccgcgacuucaccguccucgucgaccgcgccauccacucccgccucucccgccaguccaucuccacccgcgagaagcucguccucaccacccucgacuuccagaaggcccuccgcggcuuccuccccgccucccuccgcuccgucaaccuccacaagccccgcgaccucggcugggacaagaucggcggccuccacgagguccgccagauccucauggacaccauccagcuccccgccaaguaccccgagcucuucgccaaccuccccauccgccagcgcaccggcauccuccucuacggcccccccggcaccggcaagacccuccucgccggcgucaucgcccgcgagucccgcaugaacuucaucuccgucaagggccccgagcuccucuccaaguacaucggcgccuccgagcaggccguccgcgacaucuucauccgcgcccaggccgccaagcccugcauccucuucuucgacgaguucgaguccaucgccccccgccgcggccacgacaacaccggcgucaccgaccgcgucgucaaccagcuccucacccagcucgacggcgucgagggccuccagggcgucuacguccucgccgccaccucccgccccgaccucaucgaccccgcccuccuccgccccggccgccucgacaagugcgucuacugccccccccccgaccaggucucccgccucgagauccucaacguccucuccgacucccucccccucgccgacgacgucgaccuccagcacgucgccuccgucaccgacuccuucaccggcgccgaccucaaggcccuccucuacaacgcccagcucgaggcccuccacggcaugcuccucuccuccggccuccaggacggcuccuccuccuccgacuccgaccucucccucuccuccauggucuuccucaaccacuccuccggcuccgacgacuccgccggcgacggcgagugcggccucgaccagucccucgucucccucgagauguccgagauccuccccgacgaguccaaguucaacauguaccgccucuacuucggcuccuccuacgaguccgagcucggcaacggcaccuccuccgaccucuccucccagugccucuccgcccccuccuccaugacccaggaccuccccggcguccccggcaaggaccagcucuucucccagccccccguccuccgcaccgccucccaggagggcugccaggagcucacccaggagcagcgcgaccagcuccgcgccgacaucuccaucaucaagggccgcuaccgcucccaguccggcgaggacgaguccaugaaccagcccggccccaucaagacccgccucgccaucucccagucccaccucaugaccgcccucggccacacccgccccuccaucuccgaggacgacuggaagaacuucgccgagcucuacgaguccuuccagaaccccaagcgccgcaagaaccaguccggcaccauguuccgccccggccagaaggucacccucgccuga

SEQ ID NO: 47517 - RNA, 918 nt, Artificial Sequence
  derived and/or modified sequence opt2 from PEX26__Homo_sapiens__NP_001121121
augaaguccgacuccuccaccuccgccgccccccuccgcggccucggcggcccccuccgcuccuccgagcccguccgcgccguccccgcccgcgcccccgccgucgaccuccucgaggaggccgccgaccuccucgucguccaccucgacuuccgcgccgcccucgagaccugcgagcgcgccuggcagucccucgccaaccacgccgucgccgaggagcccgccggcaccucccucgaggucaagugcucccucugcgucgucggcauccaggcccucgccgagauggaccgcuggcaggagguccucuccuggguccuccaguacuaccagguccccgagaagcucccccccaagguccucgagcucugcauccuccucuacuccaagaugcaggagcccggcgccguccucgacgucgucggcgccuggcuccaggaccccgccaaccagaaccuccccgaguacggcgcccucgccgaguuccacguccagcgcguccuccucccccucggcugccucuccgaggccgaggagcucgucgucggcuccgccgccuucggcgaggagcgccgccucgacguccuccaggccauccacaccgcccgccagcagcagaagcaggagcacuccggcuccgaggaggcccagaagcccaaccucgagggcuccgucucccacaaguuccucucccuccccaugcucguccgccagcucugggacuccgccgucucccacuucuucucccuccccuucaagaagucccuccucgccgcccucauccucugccuccucgucguccgcuucgaccccgccucccccuccucccuccacuuccucuacaagcucgcccagcucuuccgcuggauccgcaaggccgccuucucccgccucuaccagcuccgcauccgcgacuga

SEQ ID NO: 47518 - RNA, 918 nt, Artificial Sequence
  derived and/or modified sequence opt2 from PEX2__Homo_sapiens__NP_001165558
auggccucccgcaaggagaacgccaaguccgccaaccgcguccuccgcaucucccagcucgacgcccucgagcucaacaaggcccucgagcagcucgucuggucccaguucacccagugcuuccacggcuucaagcccggccuccucgcccgcuucgagcccgaggucaaggccugccucugggucuuccucuggcgcuucaccaucuacuccaagaacgccaccgucggccaguccguccucaacaucaaguacaagaacgacuucucccccaaccuccgcuaccagccccccuccaagaaccagaagaucugguacgccgucugcaccaucggcggccgcuggcucgaggagcgcugcuacgaccucuuccgcaaccaccaccucgccuccuucggcaaggucaagcagugcgucaacuucgucaucggccuccucaagcucggcggccucaucaacuuccucaucuuccuccagcgcggcaaguucgccacccucaccgagcgccuccucggcauccacuccgucuucugcaagccccagaacauccgcgaggucggcuucgaguacaugaaccgcgagcuccucuggcacggcuucgccgaguuccucaucuuccuccucccccucaucaacguccagaagcucaaggccaagcucuccuccuggugcaucccccucaccggcgcccccaacuccgacaacacccucgccaccuccggcaaggagugcgcccucugcggcgaguggcccaccaugccccacaccaucggcugcgagcacaucuucugcuacuucugcgccaaguccuccuuccucuucgacgucuacuucaccugccccaagugcggcaccgagguccacucccuccagccccucaaguccggcaucgagauguccgaggucaacgcccucuga

SEQ ID NO: 47519 - RNA, 1122 nt, Artificial Sequence
  derived and/or modified sequence opt2 from PEX3__Homo_sapiens__NP_003621
augcuccgcuccgucuggaacuuccucaagcgccacaagaagaagugcaucuuccucggcaccguccucggcggcgucuacauccucggcaaguacggccagaagaagauccgcgagauccaggagcgcgaggccgccgaguacaucgcccaggcccgccgccaguaccacuucgaguccaaccagcgcaccugcaacaugaccguccucuccaugcuccccacccuccgcgaggcccucaugcagcagcucaacuccgagucccucaccgcccuccucaagaaccgccccuccaacaagcucgagaucugggaggaccucaagaucaucuccuucacccgcuccaccgucgccgucuacuccaccugcaugcucgucguccuccuccgcguccagcucaacaucaucggcggcuacaucuaccucgacaacgccgccgucggcaagaacggcaccaccauccucgccccccccgacguccagcagcaguaccucuccuccauccagcaccuccucggcgacggccucaccgagcucaucaccgucaucaagcaggccguccagaagguccucggcuccgucucccucaagcacucccucucccuccucgaccucgagcagaagcucaaggagauccgcaaccucgucgagcagcacaaguccuccuccuggaucaacaaggacggcuccaagccccuccucugccacuacaugaugcccgacgaggagaccccccucgccguccaggccugcggccucuccccccgcgacaucaccaccaucaagcuccucaacgagacccgcgacaugcucgagucccccgacuucuccaccguccucaacaccugccucaaccgcggcuucucccgccuccucgacaacauggccgaguucuuccgccccaccgagcaggaccuccagcacggcaacuccaugaacucccucuccuccgucucccucccccucgccaagaucauccccaucgucaacggccagauccacuccgucugcuccgagacccccucccacuucguccaggaccuccucaccauggagcaggucaaggacuucgccgccaacgucuacgaggccuucuccaccccccagcagcucgagaaguga

SEQ ID NO: 47520 - RNA, 1896 nt, Artificial Sequence
  derived and/or modified sequence opt2 from PEX5__Homo_sapiens__NP_000310
auggccaugcgcgagcucgucgaggccgagugcggcggcgccaacccccucaugaagcucgccggccacuucacccaggacaaggcccuccgccaggagggccuccgccccggccccuggccccccggcgcccccgccuccgaggccgccuccaagccccucggcgucgccuccgaggacgagcucgucgccgaguuccuccaggaccagaacgccccccucgucucccgcgccccccagaccuucaagauggacgaccuccucgccgagaugcagcagaucgagcaguccaacuuccgccaggccccccagcgcgcccccggcgucgccgaccucgcccucuccgagaacugggcccaggaguuccucgccgccggcgacgccgucgacgucacccaggacuacaacgagaccgacuggucccaggaguucaucuccgaggucaccgacccccucuccgucucccccgcccgcugggccgaggaguaccucgagcaguccgaggagaagcucuggcucggcgagcccgagggcaccgccaccgaccgcugguacgacgaguaccaccccgaggaggaccuccagcacaccgccuccgacuucgucgccaaggucgacgaccccaagcucgccaacuccgaguuccucaaguucguccgccagaucggcgagggccaggucucccucgaguccggcgccggcuccggccgcgcccaggccgagcagugggccgccgaguucauccagcagcagggcaccuccgacgccugggucgaccaguucacccgccccgucaacaccuccgcccucgacauggaguucgagcgcgccaaguccgccaucgagcuccaggccgagcucgaggagauggccaagcgcgacgccgaggcccaccccuggcucuccgacuacgacgaccucaccuccgccaccuacgacaagggcuaccaguucgaggaggagaacccccuccgcgaccacccccagcccuucgaggagggccuccgccgccuccaggagggcgaccuccccaacgccguccuccucuucgaggccgccguccagcaggaccccaagcacauggaggccuggcaguaccucggcaccacccaggccgagaacgagcaggagcuccucgccaucuccgcccuccgccgcugccucgagcucaagcccgacaaccagaccgcccucauggcccucgccgucuccuucaccaacgagucccuccagcgccaggccugcgagacccuccgcgacuggcuccgcuacacccccgccuacgcccaccucgucacccccgccgaggagggcgccggcggcgccggccucggccccuccaagcgcauccucggcucccuccucuccgacucccucuuccucgaggucaaggagcucuuccucgccgccguccgccucgaccccaccuccaucgaccccgacguccagugcggccucggcguccucuucaaccucuccggcgaguacgacaaggccgucgacugcuucaccgccgcccucuccguccgccccaacgacuaccuccucuggaacaagcucggcgccacccucgccaacggcaaccaguccgaggaggccgucgccgccuaccgccgcgcccucgagcuccagcccggcuacauccgcucccgcuacaaccucggcaucuccugcaucaaccucggcgcccaccgcgaggccgucgagcacuuccucgaggcccucaacaugcagcgcaagucccgcggcccccgcggcgagggcggcgccauguccgagaacaucugguccacccuccgccucgcccucuccaugcucggccaguccgacgccuacggcgccgccgacgcccgcgaccucuccacccuccucaccauguucggccucccccaguga

SEQ ID NO: 47521 - RNA, 1875 nt, Artificial Sequence
  derived and/or modified sequence opt2 from PEX5L__Homo_sapiens__NP_001243679
auguaccagggccacaugcaggucgucggcgucacccucaagaagaaguggcacugccuccagaaguccgaccucacccucgcccucggcaagggcucccgcgccgccgacaaggccgucgccauggucaugaaggagaucccccgcgaggaguccgccgaggagaagccccuccucaccaugaccucccagcucgucaacgagcagcaggagucccgcccccuccucucccccuccaucgacgacuuccucugcgagaccaaguccgaggccaucgcccgccccgucaccuccaacaccgccguccucaccaccggccucgaccuccucgaccucuccgagcccgucucccagacccagaccaaggccaagaaguccgagcccuccuccaagaccuccucccucaagaagaaggccgacggcuccgaccucaucuccaccgacgccgagcagcgcggccagccccuccgcguccccgagaccuccucccucgaccucgacauccagacccagcucgagaagugggacgacgucaaguuccacggcgaccgcaacaccaagggccaccccauggccgagcgcaaguccuccuccucccgcaccggcuccaaggagcuccucugguccuccgagcaccgcucccagcccgagcucuccggcggcaaguccgcccucaacuccgaguccgccuccgagcucgagcucgucgcccccacccaggcccgccucaccaaggagcaccgcuggggcuccgcccuccucucccgcaaccacucccucgaggaggaguucgagcgcgccaaggccgccgucgaguccgacaccgaguucugggacaagaugcaggccgagugggaggagauggcccgccgcaacuggaucuccgagaaccaggaggcccagaaccaggucaccaucuccgccuccgagaagggcuacuacuuccacaccgagaaccccuucaaggacuggcccggcgccuucgaggagggccucaagcgccucaaggagggcgaccuccccgucaccauccucuucauggaggccgccauccuccaggaccccggcgacgccgaggccuggcaguuccucggcaucacccaggccgagaacgagaacgagcaggccgccaucgucgcccuccagcgcugccucgagcuccagcccaacaaccucaaggcccucauggcccucgccgucuccuacaccaacaccggccaccagcaggacgccugcgacgcccucaagaacuggaucaagcagaaccccaaguacaaguaccucgucaaguccaagaagggcucccccggccucacccgccgcauguccaagucccccgucgacuccuccguccucgagggcgucaaggagcucuaccucgaggccgcccaccagaacggcgacaugaucgaccccgaccuccagaccggccucggcguccucuuccaccucuccggcgaguucaaccgcgccaucgacgccuucaacgccgcccucaccguccgccccgaggacuacucccucuggaaccgccucggcgccacccucgccaacggcgaccgcuccgaggaggccgucgaggccuacacccgcgcccucgagauccagcccggcuucauccgcucccgcuacaaccucggcaucuccugcaucaaccucggcgccuaccgcgaggccgucuccaacuuccucaccgcccucucccuccagcgcaagucccgcaaccagcagcaggucccccaccccgccaucuccggcaacaucugggccgcccuccgcaucgcccucucccucauggaccagcccgagcucuuccaggccgccaaccucggcgaccucgacguccuccuccgcgccuucaaccucgaccccuga

SEQ ID NO: 47522 - RNA, 2943 nt, Artificial Sequence
  derived and/or modified sequence opt2 from PEX6__Homo_sapiens__NP_000278
auggcccucgccguccuccgcguccucgagcccuuccccaccgagacccccccccucgccguccuccucccccccggcggccccuggcccgccgccgagcucggccucguccucgcccuccgccccgccggcgagucccccgccggccccgcccuccucgucgccgcccucgagggccccgacgccggcaccgaggagcagggccccggccccccccagcuccucgucucccgcgcccuccuccgccuccucgcccucggcuccggcgccuggguccgcgcccgcgccguccgccgcccccccgcccucggcugggcccuccucggcaccucccucggccccggccucggcccccgcgucggcccccuccucguccgccgcggcgagacccuccccguccccggcccccgcguccucgagacccgccccgcccuccagggccuccucggccccggcacccgccucgccgucaccgagcuccgcggccgcgcccgccucugccccgaguccggcgacuccucccgccccccccccccccccgucgucuccuccuucgccgucuccggcaccguccgccgccuccagggcguccucggcggcaccggcgacucccucggcgucucccgcuccugccuccgcggccucggccucuuccagggcgagugggucugggucgcccaggcccgcgaguccuccaacaccucccagccccaccucgcccgcguccagguccucgagccccgcugggaccucuccgaccgccucggccccggcuccggcccccucggcgagccccucgccgacggccucgcccucguccccgccacccucgccuucaaccucggcugcgacccccucgagaugggcgagcuccgcauccagcgcuaccucgagggcuccaucgcccccgaggacaagggcuccugcucccuccuccccggcccccccuucgcccgcgagcuccacaucgagaucgucuccuccccccacuacuccaccaacggcaacuacgacggcguccucuaccgccacuuccagaucccccgcgucguccaggagggcgacguccucugcguccccaccaucggccaggucgagauccucgagggcucccccgagaagcucccccgcuggcgcgagauguucuucaaggucaagaagaccgucggcgaggcccccgacggccccgccuccgccuaccucgccgacaccacccacaccucccucuacauggucggcuccacccucucccccguccccuggcuccccuccgaggaguccacccucugguccucccucuccccccccggccucgaggcccucgucuccgagcucugcgccguccucaagccccgccuccagcccggcggcgcccuccucaccggcaccuccuccguccuccuccgcggcccccccggcugcggcaagaccaccgucgucgccgccgccugcucccaccucggccuccaccuccucaagguccccugcuccucccucugcgccgaguccuccggcgccgucgagaccaagcuccaggccaucuucucccgcgcccgccgcugccgccccgccguccuccuccucaccgccgucgaccuccucggccgcgaccgcgacggccucggcgaggacgcccgcgucauggccguccuccgccaccuccuccucaacgaggacccccucaacuccugccccccccucauggucgucgccaccaccucccgcgcccaggaccuccccgccgacguccagaccgccuucccccacgagcucgagguccccgcccucuccgagggccagcgccucuccauccuccgcgcccucaccgcccaccucccccucggccaggaggucaaccucgcccagcucgcccgccgcugcgccggcuucgucgucggcgaccucuacgcccuccucacccacuccucccgcgccgccugcacccgcaucaagaacuccggccucgccggcggccucaccgaggaggacgagggcgagcucugcgccgccggcuucccccuccucgccgaggacuucggccaggcccucgagcagcuccagaccgcccacucccaggccgucggcgcccccaagauccccuccgucuccuggcacgacgucggcggccuccaggaggucaagaaggagauccucgagaccauccagcucccccucgagcaccccgagcuccucucccucggccuccgccgcuccggccuccuccuccacggcccccccggcaccggcaagacccuccucgccaaggccgucgccaccgagugcucccucaccuuccucuccgucaagggccccgagcucaucaacauguacgucggccaguccgaggagaacguccgcgaggucuucgcccgcgcccgcgccgccgcccccugcaucaucuucuucgacgagcucgacucccucgcccccucccgcggccgcuccggcgacuccggcggcgucauggaccgcgucgucucccagcuccucgccgagcucgacggccuccacuccacccaggacgucuucgucaucggcgccaccaaccgccccgaccuccucgaccccgcccuccuccgccccggccgcuucgacaagcucgucuucgucggcgccaacgaggaccgcgccucccagcuccgcguccucuccgccaucacccgcaaguucaagcucgagcccuccgucucccucgucaacguccucgacugcugccccccccagcucaccggcgccgaccucuacucccucugcuccgacgccaugaccgccgcccucaagcgccgcguccacgaccucgaggagggccucgagcccggcuccuccgcccucaugcucaccauggaggaccuccuccaggccgccgcccgccuccagcccuccgucuccgagcaggagcuccuccgcuacaagcgcauccagcgcaaguucgccgccugcuga

SEQ ID NO: 47523 - RNA, 972 nt, Artificial Sequence
  derived and/or modified sequence opt2 from PEX7__Homo_sapiens__NP_000279
auguccgccgucugcggcggcgccgcccgcaugcuccgcacccccggccgccacggcuacgccgccgaguucucccccuaccuccccggccgccucgccugcgccaccgcccagcacuacggcaucgccggcugcggcacccuccucauccucgaccccgacgaggccggccuccgccucuuccgcuccuucgacuggaacgacggccucuucgacgucaccugguccgagaacaacgagcacguccucaucaccugcuccggcgacggcucccuccagcucugggacaccgccaaggccgccggcccccuccaggucuacaaggagcacgcccaggaggucuacuccgucgacuggucccagacccgcggcgagcagcucgucgucuccggcuccugggaccagaccgucaagcucugggaccccaccgucggcaagucccucugcaccuuccgcggccacgaguccaucaucuacuccaccaucugguccccccacauccccggcugcuucgccuccgccuccggcgaccagacccuccgcaucugggacgucaaggccgccggcguccgcaucgucauccccgcccaccaggccgagauccucuccugcgacuggugcaaguacaacgagaaccuccucgucaccggcgccgucgacugcucccuccgcggcugggaccuccgcaacguccgccagcccgucuucgagcuccucggccacaccuacgccauccgccgcgucaaguucucccccuuccacgccuccguccucgccuccugcuccuacgacuucaccguccgcuucuggaacuucuccaagcccgacucccuccucgagaccgucgagcaccacaccgaguucaccugcggccucgacuucucccuccagucccccacccaggucgccgacugcuccugggacgagaccaucaagaucuacgaccccgccugccucaccauccccgccuga

SEQ ID NO: 47524 - RNA, 306 nt, Artificial Sequence
  derived and/or modified sequence opt2 from PF4__Homo_sapiens__NP_002610
auguccuccgccgccggcuucugcgccucccgccccggccuccucuuccucggccuccuccuccucccccucgucgucgccuucgccuccgccgaggccgaggaggacggcgaccuccagugccucugcgucaagaccaccucccagguccgcccccgccacaucaccucccucgaggucaucaaggccggcccccacugccccaccgcccagcucaucgccacccucaagaacggccgcaagaucugccucgaccuccaggccccccucuacaagaagaucaucaagaagcuccucgaguccuga

SEQ ID NO: 47525 - RNA, 315 nt, Artificial Sequence
  derived and/or modified sequence opt2 from PF4V1__Homo_sapiens__NP_002611
auguccuccgccgcccgcucccgccucacccgcgccacccgccaggagaugcucuuccucgcccuccuccuccuccccgucgucgucgccuucgcccgcgccgaggccgaggaggacggcgaccuccagugccucugcgucaagaccaccucccagguccgcccccgccacaucaccucccucgaggucaucaaggccggcccccacugccccaccgcccagcucaucgccacccucaagaacggccgcaagaucugccucgaccuccaggcccuccucuacaagaagaucaucaaggagcaccucgaguccuga

SEQ ID NO: 47526 - RNA, 405 nt, Artificial Sequence
  derived and/or modified sequence opt2 from PFDN4__Homo_sapiens__NP_002614
auggccgccaccaugaagaaggccgccgccgaggacgucaacgucaccuucgaggaccagcagaagaucaacaaguucgcccgcaacaccucccgcaucaccgagcucaaggaggagaucgaggucaagaagaagcagcuccagaaccucgaggacgccugcgacgacaucaugcucgccgacgacgacugccucaugauccccuaccagaucggcgacgucuucaucucccacucccaggaggagacccaggagaugcucgaggaggccaagaagaaccuccaggaggagaucgacgcccucgagucccgcgucgaguccauccagcgcguccucgccgaccucaagguccagcucuacgccaaguucggcuccaacaucaaccucgaggccgacgaguccuga

SEQ ID NO: 47527 - RNA, 465 nt, Artificial Sequence
  derived and/or modified sequence opt2 from PFDN5__Homo_sapiens__NP_002615
auggcccaguccaucaacaucaccgagcucaaccucccccagcucgagaugcucaagaaccagcucgaccaggaggucgaguuccucuccaccuccaucgcccagcucaaggucguccagaccaaguacgucgaggccaaggacugccucaacguccucaacaaguccaacgagggcaaggagcuccucgucccccucaccuccuccauguacguccccggcaagcuccacgacgucgagcacguccucaucgacgucggcaccggcuacuacgucgagaagaccgccgaggacgccaaggacuucuucaagcgcaagaucgacuuccucaccaagcagauggagaagauccagcccgcccuccaggagaagcacgccaugaagcaggccgucauggagaugaugucccagaagauccagcagcucaccgcccucggcgccgcccaggccaccgccaaggccuga

SEQ ID NO: 47528 - RNA, 390 nt, Artificial Sequence
  derived and/or modified sequence opt2 from PFDN6__Homo_sapiens__NP_001252525
auggccgagcucauccagaagaagcuccagggcgaggucgagaaguaccagcagcuccagaaggaccucuccaaguccauguccggccgccagaagcucgaggcccagcucaccgagaacaacaucgucaaggaggagcucgcccuccucgacggcuccaacgucgucuucaagcuccucggccccguccucgucaagcaggagcucggcgaggcccgcgccaccgucggcaagcgccucgacuacaucaccgccgagaucaagcgcuacgagucccagcuccgcgaccucgagcgccaguccgagcagcagcgcgagacccucgcccagcuccagcaggaguuccagcgcgcccaggccgccaaggccggcgcccccggcaaggccuga

SEQ ID NO: 47529 - RNA, 1350 nt, Artificial Sequence
  derived and/or modified sequence opt2 from PFKFB1__Homo_sapiens__NP_001258733
augucccccgagaugggcgagcucacccagacccgccuccagaagaucuggaucccccacuccuccggcuccucccgccuccagcgccgccgcggcuccuccaucccccaguucaccaacucccccaccauggucaucauggucggccuccccgcccgcggcaagaccuacaucuccaccaagcucacccgcuaccucaacuggaucggcacccccaccaaggacaacauggaggcccuccagauccgcaagcagugcgcccucgccgcccucaaggacguccacaacuaccucucccacgaggagggccacgucgccgucuucgacgccaccaacaccacccgcgagcgccgcucccucauccuccaguucgccaaggagcacggcuacaaggucuucuucaucgaguccaucugcaacgaccccggcaucaucgccgagaacauccgccaggucaagcucggcucccccgacuacaucgacugcgaccgcgagaagguccucgaggacuuccucaagcgcaucgagugcuacgaggucaacuaccagccccucgacgaggagcucgacucccaccucuccuacaucaagaucuucgacgucggcacccgcuacauggucaaccgcguccaggaccacauccagucccgcaccgucuacuaccucaugaacauccacgucaccccccgcuccaucuaccucugccgccacggcgaguccgagcucaacauccgcggccgcaucggcggcgacuccggccucuccguccgcggcaagcaguacgccuacgcccucgccaacuucauccagucccagggcaucuccucccucaaggucuggaccucccacaugaagcgcaccauccagaccgccgaggcccucggcguccccuacgagcaguggaaggcccucaacgagaucgacgccggcgucugcgaggagaugaccuacgaggagauccaggagcacuaccccgaggaguucgcccuccgcgaccaggacaaguaccgcuaccgcuaccccaagggcgaguccuacgaggaccucguccagcgccucgagcccgucaucauggagcucgagcgccaggagaacguccucgucaucugccaccaggccgucaugcgcugccuccucgccuacuuccucgacaaguccuccgacgagcuccccuaccucaagugcccccuccacaccguccucaagcucacccccgucgccuacggcugcaaggucgaguccaucuaccucaacgucgaggccgucaacacccaccgcgagaagcccgagaacgucgacaucacccgcgagcccgaggaggcccucgacaccguccccgcccacuacuga

SEQ ID NO: 47530 - RNA, 1416 nt, Artificial Sequence
  derived and/or modified sequence opt2 from PFKFB2__Homo_sapiens__NP_001018063
auguccggcgccuccuccuccgagcagaacaacaacuccuacgagaccaagacccccaaccuccgcauguccgagaagaagugcuccugggccuccuacaugaccaacucccccacccucaucgucaugaucggccuccccgcccgcggcaagaccuacgucuccaagaagcucacccgcuaccucaacuggaucggcguccccaccaaggucuucaaccucggcgucuaccgccgcgaggccgucaaguccuacaaguccuacgacuucuuccgccacgacaacgaggaggccaugaagauccgcaagcagugcgcccucgucgcccucgaggacgucaaggccuaccucaccgaggagaacggccagaucgccgucuucgacgccaccaacaccacccgcgagcgccgcgacaugauccucaacuucgccgagcagaacuccuucaaggucuucuucgucgaguccgucugcgacgaccccgacgucaucgccgccaacauccucgaggucaaggucuccucccccgacuaccccgagcgcaaccgcgagaacgucauggaggacuuccucaagcgcaucgagugcuacaaggucaccuaccgcccccucgaccccgacaacuacgacaaggaccucuccuucaucaaggucaucaacgucggccagcgcuuccucgucaaccgcguccaggacuacauccaguccaagaucgucuacuaccucaugaacauccacguccagccccgcaccaucuaccucugccgccacggcgaguccgaguucaaccuccucggcaagaucggcggcgacuccggccucuccguccgcggcaagcaguucgcccaggcccuccgcaaguuccucgaggagcaggagaucaccgaccucaaggucuggaccucccagcucaagcgcaccauccagaccgccgagucccucggcguccccuacgagcaguggaagauccucaacgagaucgacgccggcgucugcgaggagaugaccuacgccgagaucgagaagcgcuaccccgaggaguucgcccuccgcgaccaggagaaguaccucuaccgcuaccccggcggcgaguccuaccaggaccucguccagcgccucgagcccgucaucauggagcucgagcgccagggcaacguccucgucaucucccaccaggccgucaugcgcugccuccucgccuacuuccucgacaagggcgccgacgagcuccccuaccuccgcugcccccuccacaccaucuucaagcucacccccgucgccuacggcugcaaggucgagaccaucaagcucaacgucgaggccgucaacacccaccgcgacaagcccaccgccgccgagaccacccucgccguccgccgccgccccuccgccgccucccucaugcuccccugcuga

SEQ ID NO: 47531 - RNA, 1503 nt, Artificial Sequence
  derived and/or modified sequence opt2 from PFKFB3__Homo_sapiens__NP_001138915
augcccuuccgcaaggccugcggccccaagcucaccaacucccccaccgucaucgucauggucggccuccccgcccgcggcaagaccuacaucuccaagaagcucacccgcuaccucaacuggaucggcguccccaccaaggucuucaacgucggcgaguaccgccgcgaggccgucaagcaguacuccuccuacaacuucuuccgccccgacaacgaggaggccaugaagguccgcaagcagugcgcccucgccgcccuccgcgacgucaaguccuaccucgccaaggagggcggccagaucgccgucuucgacgccaccaacaccacccgcgagcgccgccacaugauccuccacuucgccaaggagaacgacuucaaggccuucuucaucgaguccgucugcgacgaccccaccgucgucgccuccaacaucauggaggucaagaucuccucccccgacuacaaggacugcaacuccgccgaggccauggacgacuucaugaagcgcaucuccugcuacgaggccuccuaccagccccucgaccccgacaagugcgaccgcgaccucucccucaucaaggucaucgacgucggccgccgcuuccucgucaaccgcguccaggaccacauccagucccgcaucgucuacuaccucaugaacauccacguccagccccgcaccaucuaccucugccgccacggcgagaacgagcacaaccuccagggccgcaucggcggcgacuccggccucuccucccgcggcaagaaguucgccuccgcccucuccaaguucgucgaggagcagaaccucaaggaccuccgcgucuggaccucccagcucaaguccaccauccagaccgccgaggcccuccgccuccccuacgagcaguggaaggcccucaacgagaucgacgccggcgucugcgaggagcucaccuacgaggagauccgcgacaccuaccccgaggaguacgcccuccgcgagcaggacaaguacuacuaccgcuaccccaccggcgaguccuaccaggaccucguccagcgccucgagcccgucaucauggagcucgagcgccaggagaacguccucgucaucugccaccaggccguccuccgcugccuccucgccuacuuccucgacaaguccgccgaggagaugcccuaccucaagugcccccuccacaccguccucaagcucacccccgucgccuacggcugccgcgucgaguccaucuaccucaacgucgaguccgucugcacccaccgcgagcgcuccgaggacgccaagaagggccccaacccccucaugcgccgcaacuccgucaccccccucgccucccccgagcccaccaagaagccccgcaucaacuccuucgaggagcacgucgccuccaccuccgccgcccuccccuccugccucccccccgagguccccacccagcuccccggccagaacaugaagggcucccgcuccuccgccgacuccucccgcaagcacuga

SEQ ID NO: 47532 - RNA, 1410 nt, Artificial Sequence
  derived and/or modified sequence opt2 from PFKFB4__Homo_sapiens__NP_004558
auggccuccccccgcgagcucacccagaacccccucaagaagaucuggaugcccuacuccaacggccgccccgcccuccacgccugccagcgcggcgucugcaugaccaacugccccacccucaucgucauggucggccuccccgcccgcggcaagaccuacaucuccaagaagcucacccgcuaccucaacuggaucggcguccccacccgcgaguucaacgucggccaguaccgccgcgacgucgucaagaccuacaaguccuucgaguucuuccuccccgacaacgaggagggccucaagauccgcaagcagugcgcccucgccgcccuccgcgacguccgccgcuuccucuccgaggagggcggccacgucgccgucuucgacgccaccaacaccacccgcgagcgccgcgccaccaucuucaacuucggcgagcagaacggcuacaagaccuucuucgucgaguccaucugcgucgaccccgaggucaucgccgccaacaucguccaggucaagcucggcucccccgacuacgucaaccgcgacuccgacgaggccaccgaggacuucaugcgccgcaucgagugcuacgagaacuccuacgagucccucgacgaggaccucgaccgcgaccucuccuacaucaagaucauggacgucggccaguccuacgucgucaaccgcgucgccgaccacauccagucccgcaucgucuacuaccucaugaacauccacgucaccccccgcuccaucuaccucugccgccacggcgaguccgagcucaaccucaagggccgcaucggcggcgaccccggccucuccccccgcggccgcgaguucgccaagucccucgcccaguucaucuccgaccagaacaucaaggaccucaaggucuggaccucccagaugaagcgcaccauccagaccgccgaggcccucggcguccccuacgagcaguggaagguccucaacgagaucgacgccggcgucugcgaggagaugaccuacgaggagauccaggacaacuacccccucgaguucgcccuccgcgaccaggacaaguaccgcuaccgcuaccccaagggcgaguccuacgaggaccucguccagcgccucgagcccgucaucauggagcucgagcgccaggagaacguccucgucaucugccaccaggccgucaugcgcugccuccucgccuacuuccucgacaaggccgccgagcagcuccccuaccucaagugcccccuccacaccguccucaagcucacccccgucgccuacggcugcaaggucgaguccaucuuccucaacgucgccgccgucaacacccaccgcgaccgcccccagaacgucgacaucucccgcccccccgaggaggcccucgucaccguccccgcccaccaguga

SEQ ID NO: 47533 - RNA, 2343 nt, Artificial Sequence
  derived and/or modified sequence opt2 from PFKL__Homo_sapiens__NP_002617
auggccgccgucgaccucgagaagcuccgcgccuccggcgccggcaaggccaucggcguccucaccuccggcggcgacgcccagggcaugaacgccgccguccgcgccgucacccgcaugggcaucuacgucggcgccaaggucuuccucaucuacgagggcuacgagggccucgucgagggcggcgagaacaucaagcaggccaacuggcucuccgucuccaacaucauccagcucggcggcaccaucaucggcuccgcccgcugcaaggccuucaccacccgcgagggccgccgcgccgccgccuacaaccucguccagcacggcaucaccaaccucugcgucaucggcggcgacggcucccucaccggcgccaacaucuuccgcuccgaguggggcucccuccucgaggagcucgucgccgagggcaagaucuccgagaccaccgcccgcaccuacucccaccucaacaucgccggccucgucggcuccaucgacaacgacuucugcggcaccgacaugaccaucggcaccgacuccgcccuccaccgcaucauggaggucaucgacgccaucaccaccaccgcccagucccaccagcgcaccuucguccucgaggucaugggccgccacugcggcuaccucgcccucgucuccgcccucgccuccggcgccgacuggcucuucauccccgaggccccccccgaggacggcugggagaacuucaugugcgagcgccucggcgagacccgcucccgcggcucccgccucaacaucaucaucaucgccgagggcgccaucgaccgcaacggcaagcccaucuccuccuccuacgucaaggaccucgucguccagcgccucggcuucgacacccgcgucaccguccucggccacguccagcgcggcggcacccccuccgccuucgaccgcauccucuccuccaagaugggcauggaggccgucauggcccuccucgaggccacccccgacacccccgccugcgucgucacccucuccggcaaccaguccguccgccucccccucauggagugcguccagaugaccaaggagguccagaaggccauggacgacaagcgcuucgacgaggccacccagcuccgcggcggcuccuucgagaacaacuggaacaucuacaagcuccucgcccaccagaagccccccaaggagaaguccaacuucucccucgccauccucaacgucggcgcccccgccgccggcaugaacgccgccguccgcuccgccguccgcaccggcaucucccacggccacaccgucuacgucguccacgacggcuucgagggccucgccaagggccagguccaggaggucggcuggcacgacgucgccggcuggcucggccgcggcggcuccaugcucggcaccaagcgcacccuccccaagggccagcucgaguccaucgucgagaacauccgcaucuacggcauccacgcccuccucgucgucggcggcuucgaggccuacgagggcguccuccagcucgucgaggcccgcggccgcuacgaggagcucugcaucgucaugugcgucauccccgccaccaucuccaacaacguccccggcaccgacuucucccucggcuccgacaccgccgucaacgccgccauggaguccugcgaccgcaucaagcaguccgccuccggcaccaagcgccgcgucuucaucgucgagaccaugggcggcuacugcggcuaccucgccaccgucaccggcaucgccgucggcgccgacgccgccuacgucuucgaggaccccuucaacauccacgaccucaaggucaacgucgagcacaugaccgagaagaugaagaccgacauccagcgcggccucguccuccgcaacgagaagugccacgacuacuacaccaccgaguuccucuacaaccucuacuccuccgagggcaagggcgucuucgacugccgcaccaacguccucggccaccuccagcagggcggcgcccccacccccuucgaccgcaacuacggcaccaagcucggcgucaaggccaugcucuggcucuccgagaagcuccgcgaggucuaccgcaagggccgcgucuucgccaacgcccccgacuccgccugcgucaucggccucaagaagaaggccgucgccuucucccccgucaccgagcucaagaaggacaccgacuucgagcaccgcaugccccgcgagcagugguggcucucccuccgccucaugcucaagaugcucgcccaguaccgcaucuccauggccgccuacgucuccggcgagcucgagcacgucacccgccgcacccucuccauggacaagggcuucuga

SEQ ID NO: 47534 - RNA, 2556 nt, Artificial Sequence
  derived and/or modified sequence opt2 from PFKM__Homo_sapiens__NP_001160158
augcacaaggacgaguuccaccucaaguucuucaugugcgucauccagucccgccagcucguccgcaccccccagcgcaccgccggcgaggccuccaccuccuccaugcucauccccaagcccccccccaagaccgacauccucaagucccucgacaccauggacgaccccgacaccgucggcuccauccccgucuucaagaccgaguggaucaugacccacgaggagcaccacgccgccaagacccucggcaucggcaaggccaucgccguccucaccuccggcggcgacgcccagggcaugaacgccgccguccgcgccgucguccgcgucggcaucuucaccggcgcccgcgucuucuucguccacgagggcuaccagggccucgucgacggcggcgaccacaucaaggaggccaccugggaguccgucuccaugaugcuccagcucggcggcaccgucaucggcuccgcccgcugcaaggacuuccgcgagcgcgagggccgccuccgcgccgccuacaaccucgucaagcgcggcaucaccaaccucugcgucaucggcggcgacggcucccucaccggcgccgacaccuuccgcuccgagugguccgaccuccucuccgaccuccagaaggccggcaagaucaccgacgaggaggccaccaaguccuccuaccucaacaucgucggccucgucggcuccaucgacaacgacuucugcggcaccgacaugaccaucggcaccgacuccgcccuccaccgcaucauggagaucgucgacgccaucaccaccaccgcccagucccaccagcgcaccuucguccucgaggucaugggccgccacugcggcuaccucgcccucgucaccucccucuccugcggcgccgacugggucuucauccccgagugcccccccgacgacgacugggaggagcaccucugccgccgccucuccgagacccgcacccgcggcucccgccucaacaucaucaucgucgccgagggcgccaucgacaagaacggcaagcccaucaccuccgaggacaucaagaaccucgucgucaagcgccucggcuacgacacccgcgucaccguccucggccacguccagcgcggcggcacccccuccgccuucgaccgcauccucggcucccgcaugggcgucgaggccgucauggcccuccucgagggcacccccgacacccccgccugcgucgucucccucuccggcaaccaggccguccgccucccccucauggagugcguccaggucaccaaggacgucaccaaggccauggacgagaagaaguucgacgaggcccucaagcuccgcggccgcuccuucaugaacaacugggaggucuacaagcuccucgcccacguccgcccccccgucuccaaguccggcucccacaccgucgccgucaugaacgucggcgcccccgccgccggcaugaacgccgccguccgcuccaccguccgcaucggccucauccagggcaaccgcguccucgucguccacgacggcuucgagggccucgccaagggccagaucgaggaggccggcugguccuacgucggcggcuggaccggccagggcggcuccaagcucggcaccaagcgcacccuccccaagaaguccuucgagcagaucuccgccaacaucaccaaguucaacauccagggccucgucaucaucggcggcuucgaggccuacaccggcggccucgagcucauggagggccgcaagcaguucgacgagcucugcauccccuucgucgucauccccgccaccgucuccaacaacguccccggcuccgacuucuccgucggcgccgacaccgcccucaacaccaucugcaccaccugcgaccgcaucaagcaguccgccgccggcaccaagcgccgcgucuucaucaucgagaccaugggcggcuacugcggcuaccucgccaccauggccggccucgccgccggcgccgacgccgccuacaucuucgaggagcccuucaccauccgcgaccuccaggccaacgucgagcaccucguccagaagaugaagaccaccgucaagcgcggccucguccuccgcaacgagaagugcaacgagaacuacaccaccgacuucaucuucaaccucuacuccgaggagggcaagggcaucuucgacucccgcaagaacguccucggccacaugcagcagggcggcucccccacccccuucgaccgcaacuucgccaccaagaugggcgccaaggccaugaacuggauguccggcaagaucaaggaguccuaccgcaacggccgcaucuucgccaacacccccgacuccggcugcguccucggcaugcgcaagcgcgcccucgucuuccagcccgucgccgagcucaaggaccagaccgacuucgagcaccgcauccccaaggagcagugguggcucaagcuccgccccauccucaagauccucgccaaguacgagaucgaccucgacaccuccgaccacgcccaccucgagcacaucacccgcaagcgcuccggcgaggccgccgucuga

SEQ ID NO: 47535 - RNA, 2331 nt, Artificial Sequence
  derived and/or modified sequence opt2 from PFKP__Homo_sapiens__NP_001229268
augugcggcuacgagcgcugccgccccugccgcggcgcccacggcuaccuccgcggcggccagggcguccuccaccuccgcggccuccccggccacggcggccgccgccucaagcaccgccgcggccgccucggcgagugccuccagcaccccgccuccggcgccguccgcggcgacuggcgcgagaagcccggcugcuggucccaccgcuuccccugccccggccgccacgcccucgucggcggcaccaucaucggcuccgcccgcugccaggccuuccgcacccgcgagggccgccucaaggccgccugcaaccuccuccagcgcggcaucaccaaccucugcgucaucggcggcgacggcucccucaccggcgccaaccucuuccgcaaggagugguccggccuccucgaggagcucgcccgcaacggccagaucgacaaggaggccguccagaaguacgccuaccucaacgucgucggcauggucggcuccaucgacaacgacuucugcggcaccgacaugaccaucggcaccgacuccgcccuccaccgcaucaucgaggucgucgacgccaucaugaccaccgcccagucccaccagcgcaccuucguccucgaggucaugggccgccacugcggcuaccucgcccucgucuccgcccucgccugcggcgccgacugggucuuccuccccgaguccccccccgaggagggcugggaggagcagaugugcgucaagcucuccgagaaccgcgcccgcaagaagcgccucaacaucaucaucgucgccgagggcgccaucgacacccagaacaagcccaucaccuccgagaagaucaaggagcucgucgucacccagcucggcuacgacacccgcgucaccauccucggccacguccagcgcggcggcacccccuccgccuucgaccgcauccucgccucccgcaugggcgucgaggccgucaucgcccuccucgaggccacccccgacacccccgccugcgucgucucccucaacggcaaccacgccguccgccucccccucauggagugcguccagaugacccaggacguccagaaggccauggacgagcgccgcuuccaggacgccguccgccuccgcggccgcuccuucgccggcaaccucaacaccuacaagcgccucgccaucaagcuccccgacgaccagauccccaagaccaacugcaacgucgccgucaucaacgucggcgcccccgccgccggcaugaacgccgccguccgcuccgccguccgcgucggcaucgccgacggccaccgcaugcucgccaucuacgacggcuucgacggcuucgccaagggccagaucaaggagaucggcuggaccgacgucggcggcuggaccggccagggcggcuccauccucggcaccaagcgcguccuccccggcaaguaccucgaggagaucgccacccagaugcgcacccacuccaucaacgcccuccucaucaucggcggcuucgaggccuaccucggccuccucgagcucuccgccgcccgcgagaagcacgaggaguucugcguccccauggucaugguccccgccaccgucuccaacaacguccccggcuccgacuucuccaucggcgccgacaccgcccucaacaccaucaccgacaccugcgaccgcaucaagcaguccgccuccggcaccaagcgccgcgucuucaucaucgagaccaugggcggcuacugcggcuaccucgccaacaugggcggccucgccgccggcgccgacgccgccuacaucuucgaggagcccuucgacauccgcgaccuccaguccaacgucgagcaccucaccgagaagaugaagaccaccauccagcgcggccucguccuccgcaacgaguccugcuccgagaacuacaccaccgacuucaucuaccagcucuacuccgaggagggcaagggcgucuucgacugccgcaagaacguccucggccacaugcagcagggcggcgcccccucccccuucgaccgcaacuucggcaccaagaucuccgcccgcgccauggaguggaucaccgccaagcucaaggaggcccgcggccgcggcaagaaguucaccaccgacgacuccaucugcguccucggcaucuccaagcgcaacgucaucuuccagcccgucgccgagcucaagaagcagaccgacuucgagcaccgcauccccaaggagcagugguggcucaagcuccgcccccucaugaagauccucgccaaguacaaggccuccuacgacgucuccgacuccggccagcucgagcacguccagcccugguccgucuga

SEQ ID NO: 47536 - RNA, 423 nt, Artificial Sequence
  derived and/or modified sequence opt2 from PFN1__Homo_sapiens__NP_005013
auggccggcuggaacgccuacaucgacaaccucauggccgacggcaccugccaggacgccgccaucgucggcuacaaggacucccccuccgucugggccgccguccccggcaagaccuucgucaacaucacccccgccgaggucggcguccucgucggcaaggaccgcuccuccuucuacgucaacggccucacccucggcggccagaagugcuccgucauccgcgacucccuccuccaggacggcgaguucuccauggaccuccgcaccaaguccaccggcggcgcccccaccuucaacgucaccgucaccaagaccgacaagacccucguccuccucaugggcaaggagggcguccacggcggccucaucaacaagaagugcuacgagauggccucccaccuccgccgcucccaguacuga

SEQ ID NO: 47537 - RNA, 423 nt, Artificial Sequence
  derived and/or modified sequence opt2 from PFN2__Homo_sapiens__NP_002619
auggccggcuggcaguccuacgucgacaaccucaugugcgacggcugcugccaggaggccgccaucgucggcuacugcgacgccaaguacgucugggccgccaccgccggcggcgucuuccaguccaucacccccaucgagaucgacaugaucgucggcaaggaccgcgagggcuucuucaccaacggccucacccucggcgccaagaagugcuccgucauccgcgacucccucuacgucgacggcgacugcaccauggacauccgcaccaagucccagggcggcgagcccaccuacaacgucgccgucggccgcgccggccgcgcccucgucaucgucaugggcaaggagggcguccacggcggcacccucaacaagaaggccuacgagcucgcccucuaccuccgccgcuccgacgucuga

SEQ ID NO: 47538 - RNA, 1167 nt, Artificial Sequence
  derived and/or modified sequence opt2 from PGA3__Homo_sapiens__NP_001073275
augaaguggcuccuccuccucggccucgucgcccucuccgagugcaucauguacaaggucccccucauccgcaagaagucccuccgccgcacccucuccgagcgcggccuccucaaggacuuccucaagaagcacaaccucaaccccgcccgcaaguacuucccccaguggaaggcccccacccucgucgacgagcagccccucgagaacuaccucgacauggaguacuucggcaccaucggcaucggcacccccgcccaggacuucaccgucgucuucgacaccggcuccuccaaccucuggguccccuccgucuacugcuccucccucgccugcaccaaccacaaccgcuucaaccccgaggacuccuccaccuaccaguccaccuccgagaccgucuccaucaccuacggcaccggcuccaugaccggcauccucggcuacgacaccguccaggucggcggcaucuccgacaccaaccagaucuucggccucuccgagaccgagcccggcuccuuccucuacuacgcccccuucgacggcauccucggccucgccuaccccuccaucuccuccuccggcgccacccccgucuucgacaacaucuggaaccagggccucgucucccaggaccucuucuccgucuaccucuccgccgacgaccaguccggcuccgucgucaucuucggcggcaucgacuccuccuacuacaccggcucccucaacuggguccccgucaccgucgagggcuacuggcagaucaccgucgacuccaucaccaugaacggcgaggccaucgccugcgccgagggcugccaggccaucgucgacaccggcaccucccuccucaccggccccaccucccccaucgccaacauccaguccgacaucggcgccuccgagaacuccgacggcgacauggucgucuccugcuccgccaucuccucccuccccgacaucgucuucaccaucaacggcguccaguaccccgucccccccuccgccuacauccuccaguccgagggcuccugcaucuccggcuuccagggcaugaaccuccccaccgaguccggcgagcucuggauccucggcgacgucuucauccgccaguacuucaccgucuucgaccgcgccaacaaccaggucggccucgcccccgucgccuga

SEQ ID NO: 47539 - RNA, 1167 nt, Artificial Sequence
  derived and/or modified sequence opt2 from PGA4__Homo_sapiens__NP_001073276
augaaguggcuccuccuccucggccucgucgcccucuccgagugcaucauguacaaggucccccucauccgcaagaagucccuccgccgcacccucuccgagcgcggccuccucaaggacuuccucaagaagcacaaccucaaccccgcccgcaaguacuucccccagugggaggcccccacccucgucgacgagcagccccucgagaacuaccucgacauggaguacuucggcaccaucggcaucggcacccccgcccaggacuucaccgucgucuucgacaccggcuccuccaaccucuggguccccuccgucuacugcuccucccucgccugcaccaaccacaaccgcuucaaccccgaggacuccuccaccuaccaguccaccuccgagaccgucuccaucaccuacggcaccggcuccaugaccggcauccucggcuacgacaccguccaggucggcggcaucuccgacaccaaccagaucuucggccucuccgagaccgagcccggcuccuuccucuacuacgcccccuucgacggcauccucggccucgccuaccccuccaucuccuccuccggcgccacccccgucuucgacaacaucuggaaccagggccucgucucccaggaccucuucuccgucuaccucuccgccgacgaccaguccggcuccgucgucaucuucggcggcaucgacuccuccuacuacaccggcucccucaacuggguccccgucaccgucgagggcuacuggcagaucaccgucgacuccaucaccaugaacggcgaggccaucgccugcgccgagggcugccaggccaucgucgacaccggcaccucccuccucaccggccccaccucccccaucgccaacauccaguccgacaucggcgccuccgagaacuccgacggcgacauggucgucuccugcuccgccaucuccucccuccccgacaucgucuucaccaucaacggcguccaguaccccgucccccccuccgccuacauccuccaguccgagggcuccugcaucuccggcuuccagggcaugaaccuccccaccgaguccggcgagcucuggauccucggcgacgucuucauccgccaguacuucaccgucuucgaccgcgccaacaaccaggucggccucgcccccgucgccuga

SEQ ID NO: 47540 - RNA, 1167 nt, Artificial Sequence
  derived and/or modified sequence opt2 from PGA5__Homo_sapiens__NP_055039
augaaguggcuccuccuccucggccucgucgcccucuccgagugcaucauguacaaggucccccucauccgcaagaagucccuccgccgcacccucuccgagcgcggccuccucaaggacuuccucaagaagcacaaccucaaccccgcccgcaaguacuucccccagugggaggcccccacccucgucgacgagcagccccucgagaacuaccucgacauggaguacuucggcaccaucggcaucggcacccccgcccaggacuucaccgucgucuucgacaccggcuccuccaaccucuggguccccuccgucuacugcuccucccucgccugcaccaaccacaaccgcuucaaccccgaggacuccuccaccuaccaguccaccuccgagaccgucuccaucaccuacggcaccggcuccaugaccggcauccucggcuacgacaccguccaggucggcggcaucuccgacaccaaccagaucuucggccucuccgagaccgagcccggcuccuuccucuacuacgcccccuucgacggcauccucggccucgccuaccccuccaucuccuccuccggcgccacccccgucuucgacaacaucuggaaccagggccucgucucccaggaccucuucuccgucuaccucuccgccgacgacaaguccggcuccgucgucaucuucggcggcaucgacuccuccuacuacaccggcucccucaacuggguccccgucaccgucgagggcuacuggcagaucaccgucgacuccaucaccaugaacggcgagaccaucgccugcgccgagggcugccaggccaucgucgacaccggcaccucccuccucaccggccccaccucccccaucgccaacauccaguccgacaucggcgccuccgagaacuccgacggcgacauggucgucuccugcuccgccaucuccucccuccccgacaucgucuucaccaucaacggcguccaguaccccgucccccccuccgccuacauccuccaguccgagggcuccugcaucuccggcuuccagggcaugaacguccccaccgaguccggcgagcucuggauccucggcgacgucuucauccgccaguacuucaccgucuucgaccgcgccaacaaccaggucggccucgcccccgucgccuga

SEQ ID NO: 47541 - RNA, 765 nt, Artificial Sequence
  derived and/or modified sequence opt2 from PGAM1__Homo_sapiens__NP_002620
auggccgccuacaagcucguccucauccgccacggcgaguccgccuggaaccucgagaaccgcuucuccggcugguacgacgccgaccucucccccgccggccacgaggaggccaagcgcggcggccaggcccuccgcgacgccggcuacgaguucgacaucugcuucaccuccguccagaagcgcgccauccgcacccucuggaccguccucgacgccaucgaccagauguggcuccccgucguccgcaccuggcgccucaacgagcgccacuacggcggccucaccggccucaacaaggccgagaccgccgccaagcacggcgaggcccaggucaagaucuggcgccgcuccuacgacgucccccccccccccauggagcccgaccaccccuucuacuccaacaucuccaaggaccgccgcuacgccgaccucaccgaggaccagcuccccuccugcgagucccucaaggacaccaucgcccgcgcccuccccuucuggaacgaggagaucgucccccagaucaaggagggcaagcgcguccucaucgccgcccacggcaacucccuccgcggcaucgucaagcaccucgagggccucuccgaggaggccaucauggagcucaaccuccccaccggcauccccaucgucuacgagcucgacaagaaccucaagcccaucaagcccaugcaguuccucggcgacgaggagaccguccgcaaggccauggaggccgucgccgcccagggcaaggccaagaaguga

SEQ ID NO: 47542 - RNA, 762 nt, Artificial Sequence
  derived and/or modified sequence opt2 from PGAM2__Homo_sapiens__NP_000281
auggccacccaccgccucgucaugguccgccacggcgaguccaccuggaaccaggagaaccgcuucugcggcugguucgacgccgagcucuccgagaagggcaccgaggaggccaagcgcggcgccaaggccaucaaggacgccaagauggaguucgacaucugcuacaccuccguccucaagcgcgccauccgcacccucugggccauccucgacggcaccgaccagauguggcuccccgucguccgcaccuggcgccucaacgagcgccacuacggcggccucaccggccucaacaaggccgagaccgccgccaagcacggcgaggagcaggucaagaucuggcgccgcuccuucgacaucccccccccccccauggacgagaagcaccccuacuacaacuccaucuccaaggagcgccgcuacgccggccucaagcccggcgagcuccccaccugcgagucccucaaggacaccaucgcccgcgcccuccccuucuggaacgaggagaucgucccccagaucaaggccggcaagcgcguccucaucgccgcccacggcaacucccuccgcggcaucgucaagcaccucgagggcauguccgaccaggccaucauggagcucaaccuccccaccggcauccccaucgucuacgagcucaacaaggagcucaagcccaccaagcccaugcaguuccucggcgacgaggagaccguccgcaaggccauggaggccgucgccgcccagggcaaggccaaguga

SEQ ID NO: 47543 - RNA, 765 nt, Artificial Sequence
  derived and/or modified sequence opt2 from PGAM4__Homo_sapiens__NP_001025062
auggccgccuacaagcucguccucauccgccacggcgaguccaccuggaaccucgagaaccgcuucuccugcugguacgacgccgaccucucccccgccggccacgaggaggccaagcgcggcggccaggcccuccgcgacgccggcuacgaguucgacaucugccucaccuccguccagaagcgcgucauccgcacccucuggaccguccucgacgccaucgaccagauguggcuccccgucguccgcaccuggcgccucaacgagcgccacuacggcggccucaccggccucaacaaggccgagaccgccgccaagcacggcgaggcccaggucaagaucuggcgccgcuccuacgacgucccccccccccccauggagcccgaccaccccuucuacuccaacaucuccaaggaccgccgcuacgccgaccucaccgaggaccagcuccccuccuacgagucccccaaggacaccaucgcccgcgcccuccccuucuggaacgaggagaucgucccccagaucaaggagggcaagcgcguccucaucgccgcccacggcaacucccuccagggcaucgccaagcacgucgagggccucuccgaggaggccaucauggagcucaaccuccccaccggcauccccaucgucuacgagcucgacaagaaccucaagcccaucaagcccaugcaguuccucggcgacgaggagaccgucugcaaggccaucgaggccgucgccgcccagggcaaggccaagaaguga

SEQ ID NO: 47544 - RNA, 2769 nt, Artificial Sequence
  derived and/or modified sequence opt2 from PGAP1__Homo_sapiens__NP_079265
auguuccuccacuccgucaaccucuggaaccucgccuucuacgucuucauggucuuccucgccacccucggccucugggacgucuucuucggcuucgaggagaacaagugcuccauguccuacauguucgaguaccccgaguaccagaagaucgagcuccccaagaagcucgccaagcgcuaccccgccuacgagcucuaccucuacggcgagggcuccuacgccgaggagcacaagauccucccccucaccggcauccccguccucuuccuccccggcaacgccggcuccuacaagcagguccgcuccaucggcuccaucgcccuccgcaaggccgaggacaucgacuucaaguaccacuucgacuucuucuccgucaacuucaacgaggagcucgucgcccucuacggcggcucccuccagaagcagaccaaguucguccacgagugcaucaagaccauccucaagcucuacaagggccaggaguucgcccccaaguccgucgccaucaucggccacuccaugggcggccucgucgcccgcgcccuccucacccucaagaacuucaagcacgaccucaucaaccuccucaucacccaggccaccccccacgucgcccccgucaugccccucgaccgcuucaucaccgacuucuacaccaccgucaacaacuacuggauccucaacgcccgccacaucaaccucaccacccucuccgucgccggcggcuuccgcgacuaccagguccgcuccggccucaccuuccuccccaagcucucccaccacaccuccgcccucuccgucgucuccuccgccguccccaagaccugggucuccaccgaccaccucuccaucgucuggugcaagcagcuccagcucaccaccguccgcgccuucuucgaccucaucgacgccgacaccaagcagaucacccagaacuccaagaagaagcucuccguccucuaccaccacuucauccgccaccccuccaagcacuucgaggagaaccccgccaucaucuccgaccucaccggcaccuccauguggguccucgucaaggucuccaaguggaccuacgucgccuacaacgaguccgagaagaucuacuucaccuucccccucgagaaccaccgcaagaucuacacccacgucuacugccaguccaccaugcucgacaccaacuccuggaucuucgccugcaucaacuccaccuccaugugccuccagggcgucgaccucuccuggaaggccgagcuccuccccaccaucaaguaccucacccuccgccuccaggacuaccccucccucucccaccucgucgucuacguccccuccguccgcggcuccaaguucgucgucgacugcgaguucuucaagaaggagaagcgcuacauccagcuccccgucacccaccucuucuccuucggccucuccucccgcaaggucguccucaacaccaacggccucuacuacaaccucgagcuccucaacuucggccagaucuaccaggccuucaagaucaacgucgucuccaagugcuccgccgucaaggaggagaucaccuccaucuaccgccuccacauccccugguccuacgaggacucccucaccaucgcccaggcccccuccuccaccgagaucucccucaagcuccacaucgcccagcccgagaacaacacccacgucgcccucuucaagauguacaccuccuccgacugccgcuacgaggucaccgucaagaccuccuucucccagauccucggccaggucguccgcuuccacggcggcgcccuccccgccuacgucgucuccaacauccuccucgccuaccgcggccagcucuacucccucuucuccaccggcugcugccucgaguacgccaccaugcucgacaaggaggccaagcccuacaaggucgaccccuucgucaucaucaucaaguuccuccucggcuacaagugguucaaggagcucugggacguccuccuccuccccgagcucgacgccgucauccucaccugccaguccaugugcuucccccucaucucccucauccucuuccucuucggcaccugcaccgccuacugguccggccuccucuccuccgccuccguccgccuccucuccucccucuggcucgcccucaagcgccccuccgagcuccccaaggacaucaagaugaucucccccgaccuccccuuccucaccaucguccucaucaucgucuccuggaccaccugcggcgcccucgccauccuccucuccuaccucuacuacgucuucaaggucguccaccuccaggccucccucaccaccuucaagaacucccagcccgucaaccccaagcacucccgccgcuccgagaagaaguccaaccaccacaaggacuccuccauccaccaccuccgccucuccgccaacgacgccgaggacucccuccgcaugcacuccaccgucaucaaccuccucaccuggaucguccuccucuccaugcccucccucaucuacuggcucaagaaccuccgcuacuacuucaagcucaaccccgaccccugcaagccccucgccuucauccucauccccaccauggccauccucggcaacaccuacaccgucuccaucaaguccuccaagcuccucaagaccaccucccaguucccccucccccucgccgucggcgucaucgccuucggcuccgcccaccucuaccgccuccccugcuucgucuucaucccccuccuccuccacgcccucugcaacuucauguga

SEQ ID NO: 47545 - RNA, 924 nt, Artificial Sequence
  derived and/or modified sequence opt2 from PGAP2__Homo_sapiens__NP_001138910
auggcccgccucggcuccaccggcggcgucuccggccgcgucgucacccagcaccgcgacuccgcccccuuccucggcgccccccgccucggccuccgcgagcucggccccauccgcggcaccgcccccgaguggcacggccgcuggaacgccgccgagcgcuccgacaagauguaccaggucccccucccccucgaccgcgacggcacccucguccgccuccgcuucaccauggucgcccucgucaccgucugcugcccccucgucgccuuccucuucugcauccucuggucccuccucuuccacuucaaggagaccaccgccacccacugcggcguccccaacuaccuccccuccgucuccuccgccaucggcggcgaggucccccagcgcuacgucuggcgcuucugcaucggccuccacuccgccccccgcuuccucgucgccuucgccuacuggaaccacuaccucuccugcaccucccccugcuccugcuaccgcccccucugccgccucaacuucggccucaacgucgucgagaaccucgcccuccucguccucaccuacgucuccuccuccgaggacuucaccauccacgagaacgccuucaucgucuucaucgccuccucccucggccacaugcuccucaccugcauccucuggcgccucaccaagaagcacaccgaccgcaaguccuacuccuggaagcagcgccucuucaucaucaacuucaucuccuucuucuccgcccucgccgucuacuuccgccacaacauguacugcgaggccggcgucuacaccaucuucgccauccucgaguacaccgucguccucaccaacauggccuuccacaugaccgccuggugggacuucggcaacaaggagcuccucaucaccucccagcccgaggagaagcgcuucuga

SEQ ID NO: 47546 - RNA, 810 nt, Artificial Sequence
  derived and/or modified sequence opt2 from PGAP3__Homo_sapiens__NP_001278655
auggccggccucgccgcccgccucguccuccucgccggcgccgccgcccucgccuccggcucccagggcgaccgcgagcccgucuaccgcgacugcguccuccagugcgaggagcagaacugcuccggcggcgcccucaaccacuuccgcucccgccagcccaucuacaugucccucgccggcuggaccugccgcgacgacugcaaguacgagugcaugugggucaccgucggccucuaccuccaggagggccacaaggucccccaguuccacggcaaggucucccucaacgccugguucugguccaccgucuuccacacccgcgacaccgaccucaccgagaagauggacuacuucugcgccuccaccgucauccuccacuccaucuaccucugcugcguccgcaccgucggccuccagcaccccgccgucgucuccgccuuccgcgcccuccuccuccucaugcucaccguccacgucuccuaccucucccucauccgcuucgacuacggcuacaaccucgucgccaacgucgccaucggccucgucaacgucgucugguggcucgccuggugccucuggaaccagcgccgccucccccacguccgcaagugcgucgucgucguccuccuccuccagggccucucccuccucgagcuccucgacuuccccccccucuucuggguccucgacgcccacgccaucuggcacaucuccaccauccccguccacguccucuucuucuccuuccucgaggacgacucccucuaccuccucaaggaguccgaggacaaguucaagcucgacuga

SEQ ID NO: 47547 - RNA, 2430 nt, Artificial Sequence
  derived and/or modified sequence opt2 from PGBD1__Homo_sapiens__NP_001171672
auguacgaggcccuccccggccccgcccccgagaacgaggacggccucgucaaggucaaggaggaggaccccaccugggagcaggucugcaacucccaggagggcuccucccacacccaggagaucugccgccuccgcuuccgccacuucugcuaccaggaggcccacggcccccaggaggcccucgcccagcuccgcgagcucugccaccaguggcuccgccccgagaugcacaccaaggagcagaucauggagcuccucguccucgagcaguuccucaccauccuccccaaggagcuccagcccugcgucaagaccuacccccucgaguccggcgaggaggccgucaccguccucgagaaccucgagaccggcuccggcgacaccggccagcaggccuccgucuacauccagggccaggacaugcaccccauggucgccgaguaccagggcgucucccucgagugccagucccuccagcuccuccccggcaucaccacccucaagugcgagcccccccagcgcccccagggcaacccccaggaggucuccggccccgucccccacggcuccgcccaccuccaggagaagaacccccgcgacaaggccgucguccccgucuucaaccccguccgcucccagacccucgucaagaccgaggaggagaccgcccaggccgucgccgccgagaaguggucccaccucucccucacccgccgcaaccucugcggcaacuccgcccaggagaccgucaugucccucucccccaugaccgaggagaucgucaccaaggaccgccucuucaaggccaagcaggagaccuccgaggagauggagcaguccggcgaggccuccggcaagcccaaccgcgagugcgccccccagauccccugcuccacccccaucgccaccgagcgcaccgucgcccaccucaacacccucaaggaccgccaccccggcgaccucugggcccgcaugcacaucuccucccucgaguacgccgccggcgacaucacccgcaagggccgcaagaaggacaaggcccgcgucuccgagcuccuccagggccucuccuucuccggcgacuccgacgucgagaaggacaacgagcccgagauccagcccgcccagaagaagcucaaggucuccugcuuccccgagaaguccuggaccaagcgcgacaucaagcccaacuuccccuccugguccgcccucgacuccggccuccucaaccucaaguccgagaagcucaaccccgucgagcucuucgagcucuucuucgacgacgagaccuucaaccucaucgucaacgagaccaacaacuacgccucccagaagaacgucucccucgaggucaccguccaggagaugcgcugcgucuucggcguccuccuccucuccggcuucaugcgccacccccgccgcgagauguacugggaggucuccgacaccgaccagaaccucguccgcgacgccauccgccgcgaccgcuucgagcucaucuucuccaaccuccacuucgccgacaacggccaccucgaccagaaggacaaguucaccaagcuccgcccccucaucaagcagaugaacaagaacuuccuccucuacgccccccucgaggaguacuacugcuucgacaaguccaugugcgagugcuucgacuccgaccaguuccucaacggcaagcccauccgcaucggcuacaagaucuggugcggcaccaccacccagggcuaccucgucugguucgagcccuaccaggaggaguccaccaugaaggucgacgaggaccccgaccucggccucggcggcaaccucgucaugaacuucgccgacguccuccucgagcgcggccaguaccccuaccaccucugcuucgacuccuucuucaccuccgucaagcuccucuccgcccucaagaagaagggcguccgcgccaccggcaccauccgcgagaaccgcaccgagaagugcccccucaugaacgucgagcacaugaagaagaugaagcgcggcuacuucgacuuccgcaucgaggagaacaacgagaucauccucugccgcugguacggcgacggcaucaucucccucugcuccaacgccgucggcaucgagcccgucaacgaggucuccugcugcgacgccgacaacgaggagaucccccagaucucccagcccuccaucgucaaggucuacgacgagugcaaggagggcgucgccaagauggaccagaucaucuccaaguaccgcguccgcauccgcuccaagaagugguacuccauccucgucuccuacaugaucgacgucgccaugaacaacgccuggcagcuccaccgcgccugcaaccccggcgccucccucgacccccucgacuuccgccgcuucgucgcccacuucuaccucgagcacaacgcccaccucuccgacuga

SEQ ID NO: 47548 - RNA, 1575 nt, Artificial Sequence
  derived and/or modified sequence opt2 from PGBD5__Homo_sapiens__NP_001245240
auggccgagggcggcggcggcgcccgccgccgcgcccccgcccuccucgaggccgcccgcgcccgcuacgagucccuccacaucuccgacgacgucuucggcgaguccggccccgacuccggcggcaaccccuucuacuccaccuccgccgccucccgcuccuccuccgccgccuccuccgacgacgagcgcgagccccccggcccccccggcgccgcccccccccccccccgcgcccccgacgcccaggagcccgaggaggacgaggccggcgccggcugguccgccgcccuccgcgaccgcccccccccccgcuucgaggacaccggcggccccacccgcaagaugccccccuccgccuccgccgucgacuucuuccagcucuucguccccgacaacguccucaagaacauggucguccagaccaacauguacgccaagaaguuccaggagcgcuucggcuccgacggcgccugggucgaggucacccucaccgagaugaaggccuuccucggcuacaugaucuccaccuccaucucccacugcgaguccguccucuccaucugguccggcggcuucuacuccaaccgcucccucgcccucgucaugucccaggcccgcuucgagaagauccucaaguacuuccacgucgucgccuuccgcuccucccagaccacccacggccucuacaagguccagcccuuccucgacucccuccagaacuccuucgacuccgccuuccgccccucccagacccagguccuccacgagccccucaucgacgaggaccccgucuucaucgccaccugcaccgagcgcgagcuccgcaagcgcaagaagcgcaaguucucccucuggguccgccagugcuccuccaccggcuucaucauccagaucuacguccaccucaaggagggcggcggccccgacggccucgacgcccucaagaacaagccccagcuccacuccauggucgcccgcucccucugccgcaacgccgccggcaagaacuacaucaucuucaccggccccuccaucaccucccucacccucuucgaggaguucgagaagcagggcaucuacugcugcggccuccuccgcgcccgcaaguccgacugcaccggccucccccucuccaugcucaccaaccccgccaccccccccgcccgcggccaguaccagaucaagaugaagggcaacaugucccucaucugcugguacaacaagggccacuuccgcuuccucaccaacgccuacucccccguccagcagggcgucaucaucaagcgcaaguccggcgagauccccugcccccucgccgucgaggccuucgccgcccaccucuccuacaucugccgcuacgacgacaaguacuccaaguacuucaucucccacaagcccaacaagaccuggcagcaggucuucugguucgccaucuccaucgccaucaacaacgccuacauccucuacaagauguccgacgccuaccacgucaagcgcuacucccgcgcccaguucggcgagcgccucguccgcgagcuccucggccucgaggacgccucccccacccacuga

SEQ ID NO: 47549 - RNA, 948 nt, Artificial Sequence
  derived and/or modified sequence opt2 from PGC__Homo_sapiens__NP_001159896
augaaguggauggucgucguccucgucugccuccagcuccucgaggccgccgucgucaaggucccccucaagaaguucaaguccauccgcgagaccaugaaggagaagggccuccucggcgaguuccuccgcacccacaaguacgaccccgccuggaaguaccgcuucggcgaccucuccgucaccuacgagcccauggccuacauggacgccgccuacuucggcgagaucuccaucggcacccccccccagaacuuccucguccucuucgacaccggcuccuccaaccucuggguccccuccgucuacugccagucccaggccugcaccucccacucccgcuucaaccccuccgaguccuccaccuacuccaccaacggccagaccuucucccuccaguacggcuccggcucccucaccggcuucuucggcuacgacacccucaccguccaguccauccagguccccaaccaggaguucggccucuccgagaacgagcccggcaccaacuucgucuacgcccaguucgacggcaucaugggccucgccuaccccgcccucuccgucgacgaggccaccaccgccaugcagggcaugguccaggagggcgcccucaccucccccgucuucuccgucuaccucuccaaccucguccucgaguccuccggccucggcccccuccucacccccucccgcgccgccccccccuccuccacccuccagcuccccgagaagccccucgagcagaccuggaacauccucacccccuucaccaagacccuccccgucuccaaccucucccgcaaggucaccuccugggccggcgucggcauccccgucaccugccuccccgaggccggcuccggcggcgagcgccgcgccgagugcggccucggcguccccaccacccgcggccccccccgcucccagcaccacuccggcgccuga

SEQ ID NO: 47550 - RNA, 1386 nt, Artificial Sequence
  derived and/or modified sequence opt2 from PGD__Homo_sapiens__NP_001291380
auggcccaggccgacaucgcccucaucggccucgccgucaugggccagaaccucauccucaacaugaacgaccacggcuucgucgucugcgccuucaaccgcaccgucuccaaggucgacgacuuccucgccaacgaggccaagggcaccaaggucgucggcgcccagucccucaaggagauggucuccaagcucaagaagccccgccgcaucauccuccucgucaaggccggccaggccgucgacgacuucaucgagaagcuccgccgcugccgcgaccucaaggccaagggcauccucuucgucggcuccggcgucuccggcggcgaggagggcgcccgcuacggccccucccucaugcccggcggcaacaaggaggccuggccccacaucaagaccaucuuccagggcaucgccgccaaggucggcaccggcgagcccugcugcgacugggucggcgacgagggcgccggccacuucgucaagaugguccacaacggcaucgaguacggcgacaugcagcucaucugcgaggccuaccaccucaugaaggacguccucggcauggcccaggacgagauggcccaggccuucgaggacuggaacaagaccgagcucgacuccuuccucaucgagaucaccgccaacauccucaaguuccaggacaccgacggcaagcaccuccuccccaagauccgcgacuccgccggccagaagggcaccggcaaguggaccgccaucuccgcccucgaguacggcguccccgucacccucaucggcgaggccgucuucgcccgcugccucuccucccucaaggacgagcgcauccaggccuccaagaagcucaagggcccccagaaguuccaguucgacggcgacaagaaguccuuccucgaggacauccgcaaggcccucuacgccuccaagaucaucuccuacgcccagggcuucaugcuccuccgccaggccgccaccgaguucggcuggacccucaacuacggcggcaucgcccucauguggcgcggcggcugcaucauccgcuccgucuuccucggcaagaucaaggacgccuucgaccgcaaccccgagcuccagaaccuccuccucgacgacuucuucaaguccgccgucgagaacugccaggacuccuggcgccgcgccgucuccaccggcguccaggccggcauccccaugcccugcuucaccaccgcccucuccuucuacgacggcuaccgccacgagaugcuccccgccucccucauccaggcccagcgcgacuacuucggcgcccacaccuacgagcuccucgccaagcccggccaguucauccacaccaacuggaccggccacggcggcaccgucuccuccuccuccuacaacgccuga

SEQ ID NO: 47551 - RNA, 450 nt, Artificial Sequence
  derived and/or modified sequence opt2 from PGF__Homo_sapiens__NP_001193941
augcccgucaugcgccucuuccccugcuuccuccagcuccucgccggccucgcccuccccgccguccccccccagcagugggcccucuccgccggcaacggcuccuccgaggucgaggucguccccuuccaggaggucuggggccgcuccuacugccgcgcccucgagcgccucgucgacgucgucuccgaguaccccuccgaggucgagcacauguucucccccuccugcgucucccuccuccgcugcaccggcugcugcggcgacgagaaccuccacugcguccccgucgagaccgccaacgucaccaugcagcuccucaagauccgcuccggcgaccgccccuccuacgucgagcucaccuucucccagcacguccgcugcgagugccgcccccuccgcgagaagaugaagcccgagcgcugcggcgacgccgucccccgccgcuga

SEQ ID NO: 47552 - RNA, 1134 nt, Artificial Sequence
  derived and/or modified sequence opt2 from PGGT1B__Homo_sapiens__NP_005014
auggccgccaccgaggacgagcgccucgccggcuccggcgagggcgagcgccucgacuuccuccgcgaccgccacguccgcuucuuccagcgcugccuccagguccuccccgagcgcuacuccucccucgagaccucccgccucaccaucgccuucuucgcccucuccggccucgacaugcucgacucccucgacgucgucaacaaggacgacaucaucgaguggaucuacucccuccagguccuccccaccgaggaccgcuccaaccucaaccgcugcggcuuccgcggcuccuccuaccucggcauccccuucaaccccuccaaggcccccggcaccgcccaccccuacgacuccggccacaucgccaugaccuacaccggccucuccugccucgucauccucggcgacgaccucucccgcgucaacaaggaggccugccucgccggccuccgcgcccuccagcucgaggacggcuccuucugcgccguccccgagggcuccgagaacgacaugcgcuucgucuacugcgccuccugcaucugcuacaugcucaacaacugguccggcauggacaugaagaaggccaucaccuacauccgccgcuccauguccuacgacaacggccucgcccagggcgccggccucgagucccacggcggcuccaccuucugcggcaucgccucccucugccucaugggcaagcucgaggaggucuucuccgagaaggagcucaaccgcaucaagcgcuggugcaucaugcgccagcagaacggcuaccacggccgccccaacaagcccgucgacaccugcuacuccuucugggucggcgccacccucaagcuccucaagaucuuccaguacaccaacuucgagaagaaccgcaacuacauccucuccacccaggaccgccucgucggcggcuucgccaaguggcccgacucccaccccgacgcccuccacgccuacuucggcaucugcggccucucccucauggaggaguccggcaucugcaagguccaccccgcccucaacgucuccacccgcaccuccgagcgccuccucgaccuccaccaguccuggaagaccaaggacuccaagcagugcuccgagaacguccacaucuccaccuga

SEQ ID NO: 47553 - RNA, 1254 nt, Artificial Sequence
  derived and/or modified sequence opt2 from PGK1__Homo_sapiens__NP_000282
augucccucuccaacaagcucacccucgacaagcucgacgucaagggcaagcgcgucgucaugcgcgucgacuucaacguccccaugaagaacaaccagaucaccaacaaccagcgcaucaaggccgccguccccuccaucaaguucugccucgacaacggcgccaaguccgucguccucaugucccaccucggccgccccgacggcguccccaugcccgacaaguacucccucgagcccgucgccgucgagcucaagucccuccucggcaaggacguccucuuccucaaggacugcgucggccccgaggucgagaaggccugcgccaaccccgccgccggcuccgucauccuccucgagaaccuccgcuuccacgucgaggaggagggcaagggcaaggacgccuccggcaacaaggucaaggccgagcccgccaagaucgaggccuuccgcgccucccucuccaagcucggcgacgucuacgucaacgacgccuucggcaccgcccaccgcgcccacuccuccauggucggcgucaaccucccccagaaggccggcggcuuccucaugaagaaggagcucaacuacuucgccaaggcccucgagucccccgagcgccccuuccucgccauccucggcggcgccaaggucgccgacaagauccagcucaucaacaacaugcucgacaaggucaacgagaugaucaucggcggcggcauggccuucaccuuccucaagguccucaacaacauggagaucggcaccucccucuucgacgaggagggcgccaagaucgucaaggaccucauguccaaggccgagaagaacggcgucaagaucacccuccccgucgacuucgucaccgccgacaaguucgacgagaacgccaagaccggccaggccaccgucgccuccggcauccccgccggcuggaugggccucgacugcggccccgaguccuccaagaaguacgccgaggccgucacccgcgccaagcagaucgucuggaacggccccgucggcgucuucgagugggaggccuucgcccgcggcaccaaggcccucauggacgaggucgucaaggccaccucccgcggcugcaucaccaucaucggcggcggcgacaccgccaccugcugcgccaaguggaacaccgaggacaaggucucccacgucuccaccggcggcggcgccucccucgagcuccucgagggcaagguccuccccggcgucgacgcccucuccaacaucuga

SEQ ID NO: 47554 - RNA, 1254 nt, Artificial Sequence
  derived and/or modified sequence opt2 from PGK2__Homo_sapiens__NP_620061
augucccucuccaagaagcucacccucgacaagcucgacguccgcggcaagcgcgucaucaugcgcgucgacuucaacguccccaugaagaagaaccagaucaccaacaaccagcgcaucaaggccuccauccccuccaucaaguacugccucgacaacggcgccaaggccgucguccucaugucccaccucggccgccccgacggcguccccaugcccgacaaguacucccucgcccccgucgccgucgagcucaagucccuccucggcaaggacguccucuuccucaaggacugcgucggcgccgaggucgagaaggccugcgccaaccccgcccccggcuccgucauccuccucgagaaccuccgcuuccacgucgaggaggagggcaagggccaggaccccuccggcaagaagaucaaggccgagcccgacaagaucgaggccuuccgcgccucccucuccaagcucggcgacgucuacgucaacgacgccuucggcaccgcccaccgcgcccacuccuccauggucggcgucaaccucccccacaaggccuccggcuuccucaugaagaaggagcucgacuacuucgccaaggcccucgagaaccccguccgccccuuccucgccauccucggcggcgccaaggucgccgacaagauccagcucaucaagaacaugcucgacaaggucaacgagaugaucaucggcggcggcauggccuacaccuuccucaagguccucaacaacauggagaucggcgccucccucuucgacgaggagggcgccaagaucgucaaggacaucauggccaaggcccagaagaacggcguccgcaucaccuuccccgucgacuucgucaccggcgacaaguucgacgagaacgcccaggucggcaaggccaccgucgccuccggcaucucccccggcuggaugggccucgacugcggccccgaguccaacaagaaccacgcccaggucgucgcccaggcccgccucaucgucuggaacggcccccucggcgucuucgagugggacgccuucgccaagggcaccaaggcccucauggacgagaucgucaaggccaccuccaagggcugcaucaccgucaucggcggcggcgacaccgccaccugcugcgccaaguggaacaccgaggacaaggucucccacgucuccaccggcggcggcgccucccucgagcuccucgagggcaagauccuccccggcgucgaggcccucuccaacauguga

SEQ ID NO: 47555 - RNA, 777 nt, Artificial Sequence
  derived and/or modified sequence opt2 from PGLS__Homo_sapiens__NP_036220
auggccgcccccgcccccggccucaucuccgucuucuccuccucccaggagcucggcgccgcccucgcccagcucgucgcccagcgcgccgccugcugccucgccggcgcccgcgcccgcuucgcccucggccucuccggcggcucccucgucuccaugcucgcccgcgagcuccccgccgccgucgcccccgccggccccgccucccucgcccgcuggacccucggcuucugcgacgagcgccucguccccuucgaccacgccgaguccaccuacggccucuaccgcacccaccuccucucccgccuccccauccccgagucccaggucaucaccaucaaccccgagcuccccgucgaggaggccgccgaggacuacgccaagaagcuccgccaggccuuccagggcgacuccauccccgucuucgaccuccucauccucggcgucggccccgacggccacaccugcucccucuuccccgaccacccccuccuccaggagcgcgagaagaucgucgcccccaucuccgacucccccaagccccccccccagcgcgucacccucacccuccccguccucaacgccgcccgcaccgucaucuucgucgccaccggcgagggcaaggccgccguccucaagcgcauccucgaggaccaggaggagaacccccuccccgccgcccucguccagccccacaccggcaagcucugcugguuccucgacgaggccgccgcccgccuccucaccguccccuucgagaagcacuccacccucuga

SEQ ID NO: 47556 - RNA, 591 nt, Artificial Sequence
  derived and/or modified sequence opt2 from PGLYRP1__Homo_sapiens__NP_005082
augucccgccgcuccaugcuccucgccugggcccuccccucccuccuccgccucggcgccgcccaggagaccgaggaccccgccugcugcucccccaucgucccccgcaacgaguggaaggcccucgccuccgagugcgcccagcaccucucccucccccuccgcuacgucgucgucucccacaccgccggcuccuccugcaacacccccgccuccugccagcagcaggcccgcaacguccagcacuaccacaugaagacccucggcuggugcgacgucggcuacaacuuccucaucggcgaggacggccucgucuacgagggccgcggcuggaacuucaccggcgcccacuccggccaccucuggaaccccauguccaucggcaucuccuucaugggcaacuacauggaccgcguccccaccccccaggccauccgcgccgcccagggccuccucgccugcggcgucgcccagggcgcccuccgcuccaacuacguccucaagggccaccgcgacguccagcgcacccucucccccggcaaccagcucuaccaccucauccagaacuggccccacuaccgcucccccuga

SEQ ID NO: 47557 - RNA, 1731 nt, Artificial Sequence
  derived and/or modified sequence opt2 from PGLYRP2__Homo_sapiens__NP_443122
auggcccagggcguccucuggauccuccucggccuccuccucugguccgaccccggcaccgccucccucccccuccucauggacuccgucauccaggcccucgccgagcucgagcagaagguccccgccgccaagacccgccacaccgccuccgccuggcucauguccgcccccaacuccggcccccacaaccgccucuaccacuuccuccucggcgccuggucccucaacgccaccgagcucgaccccugcccccucucccccgagcuccucggccucaccaaggaggucgcccgccacgacguccgcgagggcaaggaguacggcgucguccucgcccccgacggcuccaccgucgccgucgagccccuccucgccggccucgaggccggccuccagggccgccgcgucaucaaccucccccucgacuccauggccgcccccugggagaccggcgacaccuuccccgacgucgucgccaucgcccccgacguccgcgccaccuccucccccggccuccgcgacggcucccccgacgucaccaccgccgacaucggcgccaacacccccgacgccaccaagggcugccccgacguccaggccucccuccccgacgccaaggccaaguccccccccaccauggucgacucccuccucgccgucacccucgccggcaaccucggccucaccuuccuccgcggcucccagacccagucccaccccgaccucggcaccgagggcugcugggaccagcucuccgccccccgcaccuucacccuccucgaccccaaggccucccuccucaccauggccuuccucaacggcgcccucgacggcgucauccucggcgacuaccucucccgcacccccgagccccgccccucccucucccaccuccucucccaguacuacggcgccggcgucgcccgcgaccccggcuuccgcuccaacuuccgccgccagaacggcgccgcccucaccuccgccuccauccucgcccagcaggucuggggcacccucguccuccuccagcgccucgagcccguccaccuccagcuccagugcaugucccaggagcagcucgcccaggucgccgccaacgccaccaaggaguucaccgaggccuuccucggcugccccgccauccacccccgcugccgcuggggcgccgcccccuaccgcggccgccccaagcuccuccagcucccccucggcuuccucuacguccaccacaccuacguccccgccccccccugcaccgacuucacccgcugcgccgccaacaugcgcuccaugcagcgcuaccaccaggacacccagggcuggggcgacaucggcuacuccuucgucgucggcuccgacggcuacgucuacgagggccgcggcuggcacugggucggcgcccacacccucggccacaacucccgcggcuucggcgucgccaucgucggcaacuacaccgccgcccuccccaccgaggccgcccuccgcaccguccgcgacacccuccccuccugcgccguccgcgccggccuccuccgccccgacuacgcccuccucggccaccgccagcucguccgcaccgacugccccggcgacgcccucuucgaccuccuccgcaccuggccccacuucaccgccaccgucaagccccgccccgcccgcuccgucuccaagcgcucccgccgcgagccccccccccgcacccuccccgccaccgaccuccaguga

SEQ ID NO: 47558 - RNA, 1026 nt, Artificial Sequence
  derived and/or modified sequence opt2 from PGLYRP3__Homo_sapiens__XP_011507421
augggcacccuccccuggcuccucgccuucuucauccucggccuccaggccugggacacccccaccaucgucucccgcaaggaguggggcgcccgcccccucgccugccgcgcccuccucacccuccccgucgccuacaucaucaccgaccagcuccccggcaugcagugccagcagcaguccgucugcucccagaugcuccgcggccuccagucccacuccgucuacaccaucggcuggugcgacgucgccuacaacuuccucgucggcgacgacggccgcgucuacgagggcgucggcuggaacauccagggccuccacacccagggcuacaacaacaucucccucggcaucgccuucuucggcaacaagaucggcuccucccccucccccgccgcccucuccgccgccgagggccucaucuccuacgccauccagaagggccaccucuccccccgcuacauccagccccuccuccucaaggaggagaccugccucgacccccagcaccccgucaugccccgcaaggucugccccaacaucaucaagcgcuccgccugggaggcccgcgagacccacugccccaagaugaaccuccccgccaaguacgucaucaucauccacaccgccggcaccuccugcaccgucuccaccgacugccagaccgucguccgcaacauccaguccuuccacauggacacccgcaacuucugcgacaucggcuaccacuuccucgucggccaggacggcggcgucuacgagggcgucggcuggcacauccagggcucccacaccuacggcuucaacgacaucgcccucggcaucgccuucaucggcuacuucgucgagaagccccccaacgccgccgcccucgaggccgcccaggaccucauccagugcgccgucgucgagggcuaccucacccccaacuaccuccucaugggccacuccgacgucgucaacauccucucccccggccaggcccucuacaacaucaucuccaccuggccccacuucaagcacuga

SEQ ID NO: 47559 - RNA, 1122 nt, Artificial Sequence
  derived and/or modified sequence opt2 from PGLYRP4__Homo_sapiens__NP_065126
augcuccccuggcuccucgucuucuccgcccucggcauccaggccuggggcgacuccuccuggaacaagacccaggccaagcaggucuccgagggccuccaguaccucuucgagaacaucucccagcucaccgagaagggccuccccaccgacgucuccaccaccgucucccgcaaggccuggggcgccgaggccgucggcugcuccauccagcucaccacccccgucaacguccucgucauccaccacguccccggccucgagugccacgaccagaccgucugcucccagcgccuccgcgagcuccaggcccaccacguccacaacaacuccggcugcgacgucgccuacaacuuccucgucggcgacgacggccgcgucuacgagggcgucggcuggaacauccagggcguccacacccagggcuacaacaacaucucccucggcuucgccuucuucggcaccaagaagggccacucccccucccccgccgcccucuccgccauggagaaccucaucaccuacgccguccagaagggccaccucuccuccuccuacguccagccccuccucggcaagggcgagaacugccucgccccccgccagaagaccucccucaagaaggccugccccggcgucgucccccgcuccgucuggggcgcccgcgagacccacugcccccgcaugacccuccccgccaaguacggcaucaucauccacaccgccggccgcaccugcaacaucuccgacgagugccgccuccucguccgcgacauccaguccuucuacaucgaccgccucaaguccugcgacaucggcuacaacuuccucgucggccaggacggcgccaucuacgagggcgucggcuggaacguccagggcuccuccacccccggcuacgacgacaucgcccucggcaucaccuucaugggcaccuucaccggcaucccccccaacgccgccgcccucgaggccgcccaggaccucauccagugcgccauggucaagggcuaccucacccccaacuaccuccucgucggccacuccgacgucgcccgcacccucucccccggccaggcccucuacaacaucaucuccaccuggccccacuucaagcacuga

SEQ ID NO: 47560 - RNA, 1701 nt, Artificial Sequence
  derived and/or modified sequence opt2 from PGM3__Homo_sapiens__NP_001186848
auggaccucggcgccaucaccaaguacuccgcccuccacgccaagcccaacggccucauccuccaguacggcaccgccggcuuccgcaccaaggccgagcaccucgaccacgucauguuccgcaugggccuccucgccguccuccgcuccaagcagaccaaguccaccaucggcgucauggucaccgccucccacaaccccgaggaggacaacggcgucaagcucgucgacccccucggcgagaugcucgcccccuccugggaggagcacgccaccugccucgccaacgccgaggagcaggacaugcagcgcguccucaucgacaucuccgagaaggaggccgucaaccuccagcaggacgccuucgucgucaucggccgcgacacccgccccuccuccgagaagcucucccaguccgucaucgacggcgucaccguccucggcggccaguuccacgacuacggccuccucaccaccccccagcuccacuacauggucuacugccgcaacaccggcggccgcuacggcaaggccaccaucgagggcuacuaccagaagcucuccaaggccuucgucgagcucaccaagcaggccuccugcuccggcgacgaguaccgcucccucaaggucgacugcgccaacggcaucggcgcccucaagcuccgcgagauggagcacuacuucucccagggccucuccguccagcucuucaacgacggcuccaagggcaagcucaaccaccucugcggcgccgacuucgucaagucccaccagaagcccccccagggcauggagaucaaguccaacgagcgcugcugcuccuucgacggcgacgccgaccgcaucgucuacuacuaccacgacgccgacggccacuuccaccucaucgacggcgacaagaucgccacccucaucuccuccuuccucaaggagcuccucgucgagaucggcgagucccucaacaucggcgucguccagaccgccuacgccaacggcuccuccacccgcuaccucgaggaggucaugaagguccccgucuacugcaccaagaccggcgucaagcaccuccaccacaaggcccaggaguucgacaucggcgucuacuucgaggccaacggccacggcaccgcccucuucuccaccgccgucgagaugaagaucaagcaguccgccgagcagcucgaggacaagaagcgcaaggccgccaagaugcucgagaacaucaucgaccucuucaaccaggccgccggcgacgccaucuccgacaugcucgucaucgaggccauccucgcccucaagggccucaccguccagcagugggacgcccucuacaccgaccuccccaaccgccagcucaagguccaggucgccgaccgccgcgucaucuccaccaccgacgccgagcgccaggccgucaccccccccggccuccaggaggccaucaacgaccucgucaagaaguacaagcucucccgcgccuucguccgccccuccggcaccgaggacgucguccgcgucuacgccgaggccgacucccaggaguccgccgaccaccucgcccacgaggucucccucgccgucuuccagcucgccggcggcaucggcgagcgcccccagcccggcuacaaggccgccgagaccacccacaacaucaacaacgccuucggccccggcaccgccaacgagcacaccguccccuga

SEQ ID NO: 47561 - RNA, 630 nt, Artificial Sequence
  derived and/or modified sequence opt2 from PGPEP1__Homo_sapiens__NP_060182
auggagcagccccgcaaggccgucgucgucaccggcuucggccccuucggcgagcacaccgucaacgccuccuggaucgccguccaggagcucgagaagcucggccucggcgacuccgucgaccuccacgucuacgagauccccgucgaguaccagaccguccagcgccucauccccgcccucugggagaagcacuccccccagcucgucguccacgucggcgucuccggcauggccaccaccgucacccucgagaagugcggccacaacaagggcuacaagggccucgacaacugccgcuucugccccggcucccagugcugcgucgaggacggccccgaguccaucgacuccaucaucgacauggacgccgucugcaagcgcgucaccacccucggccucgacgucuccgucaccaucucccaggacgccggccgcuaccucugcgacuucaccuacuacaccucccucuaccagucccacggccgcuccgccuucguccacguccccccccucggcaagcccuacaacgccgaccagcucggccgcgcccuccgcgccaucaucgaggagaugcucgaccuccucgagcaguccgagggcaagaucaacuacugccacaagcacuga

SEQ ID NO: 47562 - RNA, 966 nt, Artificial Sequence
  derived and/or modified sequence opt2 from PGP__Homo_sapiens__NP_001035830
auggccgccgccgaggccggcggcgacgacgcccgcugcguccgccucuccgccgagcgcgcccaggcccuccucgccgacgucgacacccuccucuucgacugcgacggcguccucuggcgcggcgagaccgccguccccggcgcccccgaggcccuccgcgcccuccgcgcccgcggcaagcgccucggcuucaucaccaacaacuccuccaagacccgcgccgccuacgccgagaagcuccgccgccucggcuucggcggccccgccggccccggcgccucccucgaggucuucggcaccgccuacugcaccgcccucuaccuccgccagcgccucgccggcgcccccgcccccaaggccuacguccucggcucccccgcccucgccgccgagcucgaggccgucggcgucgccuccgucggcgucggccccgagccccuccagggcgagggccccggcgacuggcuccacgccccccucgagcccgacguccgcgccgucgucgucggcuucgacccccacuucuccuacaugaagcucaccaaggcccuccgcuaccuccagcagcccggcugccuccucgucggcaccaacauggacaaccgccucccccucgagaacggccgcuucaucgccggcaccggcugccucguccgcgccgucgagauggccgcccagcgccaggccgacaucaucggcaagcccucccgcuucaucuucgacugcgucucccaggaguacggcaucaaccccgagcgcaccgucauggucggcgaccgccucgacaccgacauccuccucggcgccaccugcggccucaagaccauccucacccucaccggcgucuccacccucggcgacgucaagaacaaccaggaguccgacugcgucuccaagaagaagaugguccccgacuucuacgucgacuccaucgccgaccuccuccccgcccuccagggcuga

SEQ ID NO: 47563 - RNA, 2802 nt, Artificial Sequence
  derived and/or modified sequence opt2 from PGR__Homo_sapiens__NP_000917
augaccgagcucaaggccaagggcccccgcgccccccacgucgccggcggcccccccucccccgaggucggcuccccccuccucugccgccccgccgccggccccuuccccggcucccagaccuccgacacccuccccgaggucuccgccauccccaucucccucgacggccuccucuucccccgccccugccagggccaggaccccuccgacgagaagacccaggaccagcagucccucuccgacgucgagggcgccuacucccgcgccgaggccacccgcggcgccggcggcuccuccuccuccccccccgagaaggacuccggccuccucgacuccguccucgacacccuccucgcccccuccggccccggccagucccagcccuccccccccgccugcgaggucaccuccuccuggugccucuucggccccgagcuccccgaggacccccccgccgcccccgccacccagcgcguccucuccccccucaugucccgcuccggcugcaaggucggcgacuccuccggcaccgccgccgcccacaagguccucccccgcggccucucccccgcccgccagcuccuccuccccgccuccgaguccccccacugguccggcgcccccgucaagcccuccccccaggccgccgccgucgaggucgaggaggaggacggcuccgaguccgaggaguccgccggcccccuccucaagggcaagccccgcgcccucggcggcgccgccgccggcggcggcgccgccgccgucccccccggcgccgccgccggcggcgucgcccucguccccaaggaggacucccgcuucuccgccccccgcgucgcccucgucgagcaggacgcccccauggcccccggccgcuccccccucgccaccaccgucauggacuucauccacguccccauccucccccucaaccacgcccuccucgccgcccgcacccgccagcuccucgaggacgaguccuacgacggcggcgccggcgccgccuccgccuucgcccccccccgcuccucccccugcgccuccuccacccccgucgccgucggcgacuuccccgacugcgccuacccccccgacgccgagcccaaggacgacgccuacccccucuacuccgacuuccagccccccgcccucaagaucaaggaggaggaggagggcgccgaggccuccgcccgcuccccccgcuccuaccucgucgccggcgccaaccccgccgccuuccccgacuucccccucggccccccccccccccuccccccccgcgccacccccucccgccccggcgaggccgccgucaccgccgcccccgccuccgccuccgucuccuccgccuccuccuccggcuccacccucgagugcauccucuacaaggccgagggcgcccccccccagcagggccccuucgcccccccccccugcaaggcccccggcgccuccggcugccuccucccccgcgacggccuccccuccaccuccgccuccgccgccgccgccggcgccgcccccgcccucuaccccgcccucggccucaacggccucccccagcucggcuaccaggccgccguccucaaggagggccucccccaggucuacccccccuaccucaacuaccuccgccccgacuccgaggccucccaguccccccaguacuccuucgagucccucccccagaagaucugccucaucugcggcgacgaggccuccggcugccacuacggcguccucaccugcggcuccugcaaggucuucuucaagcgcgccauggagggccagcacaacuaccucugcgccggccgcaacgacugcaucgucgacaagauccgccgcaagaacugccccgccugccgccuccgcaagugcugccaggccggcaugguccucggcggccgcaaguucaagaaguucaacaagguccgcgucguccgcgcccucgacgccgucgcccucccccagcccgucggcguccccaacgagucccaggcccucucccagcgcuucaccuucucccccggccaggacauccagcucauccccccccucaucaaccuccucauguccaucgagcccgacgucaucuacgccggccacgacaacaccaagcccgacaccuccuccucccuccucaccucccucaaccagcucggcgagcgccagcuccucuccgucgucaagugguccaagucccuccccggcuuccgcaaccuccacaucgacgaccagaucacccucauccaguacuccuggaugucccucauggucuucggccucggcuggcgcuccuacaagcacgucuccggccagaugcucuacuucgcccccgaccucauccucaacgagcagcgcaugaaggaguccuccuucuacucccucugccucaccauguggcagaucccccaggaguucgucaagcuccaggucucccaggaggaguuccucugcaugaagguccuccuccuccucaacaccaucccccucgagggccuccgcucccagacccaguucgaggagaugcgcuccuccuacauccgcgagcucaucaaggccaucggccuccgccagaagggcgucgucuccuccucccagcgcuucuaccagcucaccaagcuccucgacaaccuccacgaccucgucaagcagcuccaccucuacugccucaacaccuucauccagucccgcgcccucuccgucgaguuccccgagaugauguccgaggucaucgccgcccagcuccccaagauccucgccggcauggucaagccccuccucuuccacaagaaguga

SEQ ID NO: 47564 - RNA, 432 nt, Artificial Sequence
  derived and/or modified sequence opt2 from PGRMC1__Homo_sapiens__NP_001269550
auggccgccgaggacgucgucgccaccggcgccgaccccuccgaccucgaguccggcggccuccuccacgagaucuucaccuccccccucaaccuccuccuccucggccucugcaucuuccuccucuacaagaucguccgcggcgaccagcccgccgccuccggcgacuccgacgacgacgagccccccccccucccccgccucaagcgccgcgacuucacccccgccgagcuccgccgcuucgacggcguccaggacccccgcauccucauggccaucaacggcaaggucuucgacgucaccaagggccgcaaguucuacggccccgucaaguaccaccacgucggcaagcuccucaaggagggcgaggagcccaccgucuacuccgacgaggaggagcccaaggacgaguccgcccgcaagaacgacuga

SEQ ID NO: 47565 - RNA, 744 nt, Artificial Sequence
  derived and/or modified sequence opt2 from PGRMC2__Homo_sapiens__NP_006311
augggcggcgccggccgcggcgucggcgagggccgcggccgcggcggcggcggccgccgcuggcgcgccgucauggccgccggcgacggcgacgucaagcucggcacccucggcuccggcuccgaguccuccaacgacggcggcuccgagucccccggcgacgccggcgccgccgccgagggcggcggcugggccgccgccgcccucgcccuccucaccggcggcggcgagaugcuccucaacgucgcccucgucgcccucguccuccucggcgccuaccgccucuggguccgcuggggccgccgcggccucggcgccggcgccggcgccggcgaggagucccccgccaccucccucccccgcaugaagaagcgcgacuucucccucgagcagcuccgccaguacgacggcucccgcaacccccgcauccuccucgccgucaacggcaaggucuucgacgucaccaagggcuccaaguucuacggccccgccggccccuacggcaucuucgccggccgcgacgccucccgcggccucgccaccuucugccucgacaaggacgcccuccgcgacgaguacgacgaccucuccgaccucaacgccguccagauggaguccguccgcgagugggagaugcaguucaaggagaaguacgacuacgucggccgccuccucaagcccggcgaggagcccuccgaguacaccgacgaggaggacaccaaggaccacaacaagcaggacuga

SEQ ID NO: 47566 - RNA, 1743 nt, Artificial Sequence
  derived and/or modified sequence opt2 from PHACTR1__Homo_sapiens__NP_001229577
auggacuaccccaagauggacuacuuccucgacgucgaguccgcccaccgccuccucgacgucgaguccgcccagcgcuucuucuacucccagggcgcccaggcccgccgcgccacccuccuccucccccccacccucauggccgccuccuccgaggacgacaucgaccgccgccccauccgccgcguccgcuccaaguccgacacccccuaccucgccgaggcccgcaucuccuucaaccucggcgccgccgaggaggucgagcgccucgccgccaugcgcuccgacucccucguccccggcacccacaccccccccauccgccgccgcuccaaguucgccaaccucggccgcaucuucaagcccuggaaguggcgcaagaagaaguccgagaaguucaagcacaccuccgccgcccucgagcgcaagaucuccaugcgccagucccgcgaggagcucaucaagcgcggcguccucaaggagaucuacgacaaggacggcgagcucuccaucuccaacgaggaggacucccucgagaacggccagucccucuccuccucccagcucucccuccccgcccucuccgagauggagcccguccccaugccccgcgaccccugcuccuacgagguccuccagcccuccgacaucauggacggccccgaccccggcgcccccgucaagcuccccugccuccccgucaagcucucccccccccucccccccaagaaggucaugaucugcaugcccgucggcggccccgaccucucccucgucuccuacaccgcccagaaguccggccagcagggcgucgcccagcaccaccacaccguccuccccucccagauccagcaccagcuccaguacggcucccacggccagcaccuccccuccaccaccggcucccuccccaugcaccccuccggcugccgcaugaucgacgagcucaacaagacccucgccaugaccaugcagcgccucgaguccuccgagcagcgcguccccugcuccaccuccuaccacuccuccggccuccacuccggcgacggcgucaccaaggccggccccaugggccuccccgagauccgccagguccccaccgucgucaucgagugcgacgacaacaaggagaacgucccccacgaguccgacuacgaggacuccuccugccucuacacccgcgaggaggaggaggaggaggaggacgaggacgacgacuccucccucuacaccuccucccucgccaugaaggucugccgcaaggacucccucgccaucaagcucuccaaccgccccuccaagcgcgagcucgaggagaagaacauccucccccgccagaccgacgaggagcgccucgagcuccgccagcagaucggcaccaagcucacccgccgccucucccagcgccccaccgccgaggagcucgagcagcgcaacauccucaagccccgcaacgagcaggaggagcaggaggagaagcgcgagaucaagcgccgccucacccgcaagcucucccagcgccccaccgucgaggagcuccgcgagcgcaagauccucauccgcuucuccgacuacgucgaggucgccgacgcccaggacuacgaccgccgcgccgacaagcccuggacccgccucaccgccgccgacaaggccgccauccgcaaggagcucaacgaguucaaguccaccgagauggagguccacgagcucucccgccaccucacccgcuuccaccgccccuga

SEQ ID NO: 47567 - RNA, 1938 nt, Artificial Sequence
  derived and/or modified sequence opt2 from PHACTR2__Homo_sapiens__NP_001093634
augggccagaccuccgucuccacccucuccccccagcccggcuccgucgacggccucgacaaggccuccaucgccaacuccgacggccccaccgccggcucccagaccccccccuucaagcgcaagggcaagcucuccaccaucggcaagaucuucaagcccuggaaguggcgcaagaagaagaccuccgacaaguuccgcgagaccuccgccguccucgagcgcaagaucuccacccgccagucccgcgaggagcucauccgccgcggcguccucaaggagcuccccgaccaggacggcgacgucaccgucaacuucgagaacuccaacggccacaugauccccaucggcgaggaguccacccgcgaggagaacgucgucaaguccgaggagggcaacggcuccgucuccgagaagacccccccccucgaggagcaggccgaggacaagaaggagaacaccgagaaccacuccgagacccccgccgcccccgcccucccccccuccgccccccccaagccccgccccaagcccaagcccaagaagucccccgucccccccaagggcgccaccgccggcgccucccacaagggcgacgaggucccccccaucaagaagaacaccaaggcccccggcaagcaggcccccguccccccccccaagcccgccucccgcaacaccacccgcgaggccgccggcuccucccacuccaagaagaccaccggcuccaaggccuccgccucccccuccaccuccuccaccuccucccgccccaaggccuccaaggagaccgucuccuccaaggccggcaccgucggcaccaccaagggcaagcgcaagaccgacaagcagcccaucaccucccaccucuccuccgacaccaccaccuccggcaccuccgaccucaagggcgagcccgccgagacccgcgucgaguccuucaagcucgagcagaccguccccggcgccgaggagcagaacaccggcaaguucaaguccauggucccccccccccccgucgcccccgcccccuccccccucgcccccccccucccccucgaggaccagugcaucaccgccuccgacacccccgucguccucgucuccgucggcgccgaccuccccgucuccgcccucgaccccucccagcuccucugggccgaggagcccaccaaccgcaccacccucuacuccggcaccggccucuccgucaaccgcgagaacgccaagugcuucaccaccaaggaggagcucggcaagaccgucccccagcuccucacccccggccucaugggcgaguccuccgaguccuucuccgccuccgaggacgagggccaccgcgaguaccaggccaacgacuccgacuccgacggccccauccucuacaccgacgacgaggacgaggacgaggacgaggacggcuccggcgaguccgcccucgccuccaagauccgccgccgcgacacccucgccaucaagcucggcaaccgccccuccaagaaggagcucgaggacaagaacauccuccagcgcaccuccgaggaggagcgccaggagauccgccagcagaucggcaccaagcucguccgccgccucucccagcgccccaccaccgaggagcucgagcagcgcaacauccucaagcagaagaacgaggaggaggagcaggaggccaagauggagcucaagcgccgccucucccgcaagcucucccuccgccccaccgucgccgagcuccaggcccgccgcauccuccgcuucaacgaguacgucgaggucaccgacucccccgacuacgaccgccgcgccgacaagcccugggcccgccucacccccgccgacaaggccgccauccgcaaggagcucaacgaguucaaguccaccgagauggagguccacgaggagucccgccaguucacccgcuuccaccgccccuga

SEQ ID NO: 47568 - RNA, 1671 nt, Artificial Sequence
  derived and/or modified sequence opt2 from PHACTR3__Homo_sapiens__NP_001186434
augcgcggccgcggcggcggccgcgcccgcugccccgccccccuccgcucccuccucggcgccuucggcgcccgcgacgccgccgccgccgcccgcgaccccgcccaggacgagauggaccagaccccccccgcccgccccgaguaccucgucuccggcauccgcaccccccccguccgccgcaacuccaagcucgccacccucggccgcaucuucaagcccuggaaguggcgcaagaagaagaacgagaagcucaagcagaccaccuccgcccucgagaagaagauggccggccgccagggccgcgaggagcucaucaagaagggccuccucgagaugauggagcaggacgccgaguccaagaccugcaaccccgacggcggcccccgcuccguccaguccgagccccccacccccaaguccgagacccucaccuccgaggacgcccagcccggcuccccccucgccaccggcaccgaccaggucucccucgacaagccccucuccuccgccgcccaccucgacgacgccgccaagaugcccuccgccuccuccggcgaggaggccgacgccggcucccuccuccccaccaccaacgagcucucccaggcccucgccggcgccgacucccucgacucccccccccgcccccucgagcgcuccgucggccagcuccccucccccccccuccuccccacccccccccccaaggccuccuccaagaccaccaagaacgucaccggccaggccacccucuuccaggccuccuccaugaaguccgccgaccccucccuccgcggccagcucuccacccccaccggcuccccccaccucaccaccguccaccgcccccucccccccucccgcgucaucgaggagcuccaccgcgcccucgccaccaagcaccgccaggacuccuuccagggccgcgaguccaagggcucccccaagaagcgccucgacguccgccucucccgcaccuccuccgucgagcgcggcaaggagcgcgaggaggccugguccuucgacggcgcccucgagaacaagcgcaccgccgccaaggaguccgaggagaacaaggagaaccucaucaucaacuccgagcucaaggacgaccuccuccucuaccaggacgaggaggcccucaacgacuccaucaucuccggcacccucccccgcaagugcaagaaggagcuccucgccgucaagcuccgcaaccgccccuccaagcaggagcucgaggaccgcaacaucuucccccgccgcaccgacgaggagcgccaggagauccgccagcagaucgagaugaagcucuccaagcgccucucccagcgccccgccgucgaggagcucgagcgccgcaacauccucaagcagcgcaacgaccagaccgagcaggaggagcgccgcgagaucaagcagcgccucacccgcaagcucaaccagcgccccaccgucgacgagcuccgcgaccgcaagauccucauccgcuucuccgacuacgucgaggucgccaaggcccaggacuacgaccgccgcgccgacaagcccuggacccgccucuccgccgccgacaaggccgccauccgcaaggagcucaacgaguacaaguccaacgagauggagguccacgccuccuccaagcaccucacccgcuuccaccgccccuga

SEQ ID NO: 47569 - RNA, 900 nt, Artificial Sequence
  derived and/or modified sequence opt2 from PHB2__Homo_sapiens__NP_001138303
auggcccagaaccucaaggaccucgccggccgccuccccgccggcccccgcggcaugggcaccgcccucaagcuccuccucggcgccggcgccgucgccuacggcguccgcgaguccgucuucaccgucgagggcggccaccgcgccaucuucuucaaccgcaucggcggcguccagcaggacaccauccucgccgagggccuccacuuccgcauccccugguuccaguaccccaucaucuacgacauccgcgcccgcccccgcaagaucuccucccccaccggcuccaaggaccuccagauggucaacaucucccuccgcguccucucccgccccaacgcccaggagcuccccuccauguaccagcgccucggccucgacuacgaggagcgcguccuccccuccaucgucaacgagguccucaaguccgucgucgccaaguucaacgccucccagcucaucacccagcgcgcccaggucucccuccucauccgccgcgagcucaccgagcgcgccaaggacuucucccucauccucgacgacgucgccaucaccgagcucuccuucucccgcgaguacaccgccgccgucgaggccaagcaggucgcccagcaggaggcccagcgcgcccaguuccucgucgagaaggccaagcaggagcagcgccagaagaucguccaggccgagggcgaggccgaggccgccaagaugcucggcgaggcccucuccaagaaccccggcuacaucaagcuccgcaagauccgcgccgcccagaacaucuccaagaccaucgccaccucccagaaccgcaucuaccucaccgccgacaaccucguccucaaccuccaggacgaguccuucacccgcggcuccgacucccucaucaagggcaagaaguga

SEQ ID NO: 47570 - RNA, 468 nt, Artificial Sequence
  derived and/or modified sequence opt2 from PHB__Homo_sapiens__NP_001268426
auggccgccaaggucuucgaguccaucggcaaguucggccucgcccucgccgucgccggcggcgucgucaacuccgcccucuacaacgucgacgccggccaccgcgccgucaucuucgaccgcuuccgcggcguccaggacaucgucgucggcgagggcacccacuuccucauccccuggguccagaagcccaucaucuucgacugccgcucccgcccccgcaacguccccgucaucaccggcuccaaggaccuccagaacgucaacaucacccuccgcauccucuuccgccccgucgccucccagcucccccgcaucuucaccuccaucggcgaggacuacgacgagcgcguccuccccuccaucaccaccgagauccucaaguccgucgucgcccgcuucgacgccggcgagcucaucaccuaccuccccgccggccaguccguccuccuccagcucccccaguga

SEQ ID NO: 47571 - RNA, 3015 nt, Artificial Sequence
  derived and/or modified sequence opt2 from PHC1__Homo_sapiens__NP_004417
auggagaccgaguccgagcagaacuccaacuccaccaacggcuccuccuccuccggcggcuccucccgcccccagaucgcccagaugucccucuacgagcgccaggccguccaggcccuccaggcccuccagcgccagcccaacgccgcccaguacuuccaccaguucaugcuccagcagcagcucuccaacgcccagcuccacucccucgccgccguccagcaggccaccaucgccgccucccgccaggccuccucccccaacaccuccaccacccagcagcagaccaccaccacccaggccuccaucaaccucgccaccaccuccgccgcccagcucaucucccgcucccaguccgucuccucccccuccgccaccacccucacccaguccguccuccucggcaacaccaccucccccccccucaaccagucccaggcccagauguaccuccgcccccagcucggcaaccuccuccaggucaaccgcacccucggccgcaacgucccccucgccucccagcucauccucaugcccaacggcgccgucgccgccguccagcaggagguccccuccgcccagucccccggcguccacgccgacgccgaccagguccagaaccucgccguccgcaaccagcaggccuccgcccagggcccccagaugcagggcuccacccagaaggccaucccccccggcgccucccccgucuccucccucucccaggccuccucccaggcccucgccgucgcccaggccuccuccggcgccaccaaccagucccucaaccucucccaggccggcggcggcuccggcaacuccauccccggcuccaugggccccggcggcggcggccaggcccacggcggccucggccagcuccccuccuccggcaugggcggcggcuccugcccccgcaagggcaccggcgucguccagccccuccccgccgcccagaccgucaccgucucccagggcucccagaccgaggccgaguccgccgccgccaagaaggccgaggccgacggcuccggccagcagaacgucggcaugaaccucacccgcaccgccacccccgcccccucccagacccucaucuccuccgccaccuacacccagauccagccccacucccucauccagcagcagcagcagauccaccuccagcagaagcaggucgucauccagcagcagaucgccauccaccaccagcagcaguuccagcaccgccagucccagcuccuccacaccgccacccaccuccagcucgcccagcagcagcagcagcagcagcagcagcagcagcagcagcagcagccccaggccaccacccucaccgccccccagcccccccaggucccccccacccagcaggucccccccucccagucccagcagcaggcccagacccucgucguccagcccaugcuccaguccuccccccucucccucccccccgacgccgcccccaagccccccauccccauccaguccaagccccccgucgcccccaucaagcccccccagcucggcgccgccaagauguccgccgcccagcagccccccccccacauccccguccaggucgucggcacccgccagcccggcaccgcccaggcccaggcccucggccucgcccagcucgccgccgccguccccaccucccgcggcaugcccggcaccguccaguccggccaggcccaccucgccuccuccccccccuccucccaggcccccggcgcccuccaggagugcccccccacccucgcccccggcaugacccucgcccccguccagggcaccgcccacgucgucaagggcggcgccaccaccuccucccccgucgucgcccagguccccgccgccuucuacaugcaguccguccaccuccccggcaagccccagacccucgccgucaagcgcaaggccgacuccgaggaggagcgcgacgacgucuccacccucggcuccaugcuccccgccaaggccucccccgucgccgagucccccaaggucauggacgagaaguccucccucggcgagaaggccgaguccgucgccaacgucaacgccaacacccccuccuccgagcucgucgcccucacccccgcccccuccguccccccccccacccucgccauggucucccgccagaugggcgacuccaagcccccccaggccaucgucaagccccagauccucacccacaucaucgagggcuucgucauccaggagggcgccgagcccuuccccgucggcugcucccagcuccucaaggaguccgagaagccccuccagaccggccuccccaccggccucaccgagaaccaguccggcggcccccucggcgucgacucccccuccgccgagcucgacaagaaggccaaccuccucaagugcgaguacugcggcaaguacgcccccgccgagcaguuccgcggcuccaagcgcuucugcuccaugaccugcgccaagcgcuacaacgucuccugcucccaccaguuccgccucaagcgcaagaagaugaaggaguuccaggaggccaacuacgcccgcguccgccgccgcggcccccgccgcuccuccuccgacaucgcccgcgccaagauccagggcaagugccaccgcggccaggaggacuccucccgcggcuccgacaacuccuccuacgacgaggcccucucccccaccucccccggcccccucuccguccgcgccggccacggcgagcgcgaccucggcaaccccaacaccgccccccccacccccgagcuccacggcaucaaccccgucuuccucuccuccaaccccucccgcugguccgucgaggaggucuacgaguucaucgccucccuccagggcugccaggagaucgccgaggaguuccgcucccaggagaucgacggccaggcccuccuccuccucaaggaggagcaccucauguccgccaugaacaucaagcucggccccgcccucaagaucugcgccaagaucaacguccucaaggagaccuga

SEQ ID NO: 47572 - RNA, 861 nt, Artificial Sequence
  derived and/or modified sequence opt2 from PHC2__Homo_sapiens__XP_011539177
augaccuccggcaacggcaacuccgccuccuccaucgccggcaccgccccccagaacggcgagaacaagcccccccaggccaucgucaagccccagauccucacccacgucaucgagggcuucgucauccaggagggcgccgagcccuuccccgucggccgcuccucccuccucgucggcaaccucaagaagaaguacgcccagggcuuccuccccgagaagcucccccagcaggaccacaccaccaccaccgacuccgagauggaggagcccuaccuccaggaguccaaggaggagggcgccccccucaagcucaagugcgagcucugcggccgcgucgacuucgccuacaaguucaagcgcuccaagcgcuucugcuccauggccugcgccaagcgcuacaacgucggcugcaccaagcgcgucggccucuuccacuccgaccgcuccaagcuccagaaggccggcgccgccacccacaaccgccgccgcgccuccaaggccucccuccccccccucaccaaggacaccaagaagcagcccaccggcaccgucccccucuccgucaccgccgcccuccagcucacccacucccaggaggacuccucccgcugcuccgacaacuccuccuacgaggagccccucucccccaucuccgccuccuccuccaccucccgccgccgccagggccagcgcgaccucgagcuccccgacaugcacaugcgcgaccucgucggcaugggccaccacuuccuccccuccgagcccaccaaguggaacgucgaggacgucuacgaguucauccgcucccuccccgaguacccccaccgccaccagauccccgacucccucguccccuga

SEQ ID NO: 47573 - RNA, 2988 nt, Artificial Sequence
  derived and/or modified sequence opt2 from PHC3__Homo_sapiens__NP_079223
auggccgaggccgaguucaaggaccacuccaccgccauggacaccgagcccaaccccggcaccuccuccgucuccaccaccaccuccuccaccaccaccaccaccaucaccaccuccuccucccgcaugcagcagccccagaucuccgucuacuccggcuccgaccgccacgccguccaggucauccagcaggcccuccaccgcccccccuccuccgccgcccaguaccuccagcagauguacgccgcccagcagcagcaccucaugcuccacaccgccgcccuccagcagcagcaccucuccuccucccagcuccagucccucgccgccguccaggccucccucuccuccggccgccccuccaccucccccaccggcuccgucacccagcaguccuccaugucccagaccuccaucaaccucuccaccucccccacccccgcccagcucaucucccgcucccaggccuccuccuccaccuccggcuccaucacccagcagaccaugcuccucggcuccaccucccccacccucaccgccucccaggcccagauguaccuccgcgcccagaugcucaucuucacccccgccaccaccgucgccgccguccaguccgacauccccgucgucuccuccuccuccuccuccuccugccaguccgccgccacccagguccagaaccucacccuccgcucccagaagcucggcguccucuccuccucccagaacggcccccccaaguccaccucccagacccagucccucaccaucugccacaacaagaccaccgucaccuccuccaagaucucccagcgcgaccccucccccgaguccaacaagaagggcgagucccccucccucgagucccgcuccaccgccgucacccgcaccuccuccauccaccagcucaucgcccccgccuccuacucccccauccagccccacucccucaucaagcaccagcagaucccccuccacuccccccccuccaaggucucccaccaccagcucauccuccagcagcagcagcagcagauccagcccaucacccuccagaacuccacccaggaccccccccccucccagcacugcaucccccuccagaaccacggccucccccccgcccccuccaacgcccagucccagcacugcucccccauccagucccaccccuccccccucaccgucucccccaaccagucccaguccgcccagcaguccgucgucgucucccccccccccccccacucccccucccagucccccaccaucaucauccacccccaggcccucauccagccccacccccucgucuccuccgcccuccagcccggccccaaccuccagcaguccaccgccaaccagguccaggccaccgcccagcucaaccuccccucccaccucccccuccccgccucccccgucguccacaucggccccguccagcaguccgcccucgucucccccggccagcagaucgucucccccucccaccagcaguacuccucccuccaguccucccccauccccaucgccucccccccccagauguccaccuccccccccgcccagauccccccccucccccuccaguccaugcagucccuccagguccagcccgagauccucucccagggccagguccucguccagaacgcccucgucuccgaggaggagcuccccgccgccgaggcccucguccagcuccccuuccagacccucccccccccccagaccgucgccgucaaccuccagguccagccccccgcccccgucgacccccccgucgucuaccaggucgaggacgucugcgaggaggagaugcccgaggaguccgacgagugcguccgcauggaccgcaccccccccccccccacccucucccccgccgccaucaccgucggccgcggcgaggaccucaccuccgagcacccccuccucgagcaggucgagcuccccgccgucgccuccgucuccgccuccgucaucaagucccccuccgaccccucccacgucuccguccccccccccccccuccuccuccccgccgccaccacccgcuccaacuccaccuccaugcacuccuccauccccuccaucgagaacaagcccccccaggccaucgucaagccccagauccucacccacgucaucgagggcuucgucauccaggagggccucgagcccuuccccgucucccgcuccucccuccucaucgagcagcccgucaagaagcgcccccuccucgacaaccaggucaucaacuccgucugcguccagcccgagcuccagaacaacaccaagcacgccgacaacuccuccgacaccgagauggaggacaugaucgccgaggagacccucgaggagauggacuccgagcuccucaagugcgaguucugcggcaagaugggcuacgccaacgaguuccuccgcuccaagcgcuucugcaccauguccugcgccaagcgcuacaacgucuccugcuccaagaaguucgcccucucccgcuggaaccgcaagcccgacaaccagucccucggccaccgcggccgccgccccuccggccccgacggcgccgcccgcgagcacauccuccgccagcuccccaucaccuaccccuccgccgaggaggaccucgccucccacgaggacuccguccccuccgccaugaccacccgccuccgccgccaguccgagcgcgagcgcgagcgcgagcuccgcgacguccgcauccgcaagaugcccgagaacuccgaccuccuccccgucgcccagaccgagcccuccaucuggaccgucgacgacgucugggccuucauccacucccuccccggcugccaggacaucgccgacgaguuccgcgcccaggagaucgacggccaggcccuccuccuccucaaggaggaccaccucauguccgccaugaacaucaagcucggccccgcccucaagaucugcgcccgcaucaacucccucaaggaguccuga

SEQ ID NO: 47574 - RNA, 2250 nt, Artificial Sequence
  derived and/or modified sequence opt2 from PHEX__Homo_sapiens__NP_000435
auggaggccgagaccggcuccuccgucgagaccggcaagaaggccaaccgcggcacccgcaucgcccucgucgucuucgucggcggcacccucguccucggcaccauccucuuccucgucucccagggccuccucucccuccaggccaagcaggaguacugccucaagcccgagugcaucgaggccgccgccgccauccucuccaaggucaaccucuccgucgaccccugcgacaacuucuuccgcuucgccugcgacggcuggaucuccaacaaccccauccccgaggacaugcccuccuacggcgucuaccccuggcuccgccacaacgucgaccucaagcucaaggagcuccucgagaaguccaucucccgccgccgcgacaccgaggccauccagaaggccaagauccucuacuccuccugcaugaacgagaaggccaucgagaaggccgacgccaagccccuccuccacauccuccgccacucccccuuccgcuggcccguccucgaguccaacaucggccccgagggcgucugguccgagcgcaaguucucccuccuccagacccucgccaccuuccgcggccaguacuccaacuccgucuucauccgccucuacgucucccccgacgacaaggccuccaacgagcacauccucaagcucgaccaggccacccucucccucgccguccgcgaggacuaccucgacaacuccaccgaggccaaguccuaccgcgacgcccucuacaaguucauggucgacaccgccguccuccucggcgccaacuccucccgcgccgagcacgacaugaaguccguccuccgccucgagaucaagaucgccgagaucaugaucccccacgagaaccgcaccuccgaggccauguacaacaagaugaacaucuccgagcucuccgccaugaucccccaguucgacuggcucggcuacaucaagaaggucaucgacacccgccucuacccccaccucaaggacaucucccccuccgagaacgucgucguccgcgucccccaguacuucaaggaccucuuccgcauccucggcuccgagcgcaagaagaccaucgccaacuaccucgucuggcgcauggucuacucccgcauccccaaccucucccgccgcuuccaguaccgcuggcucgaguucucccgcgucauccagggcaccaccacccuccucccccagugggacaagugcgucaacuucaucgaguccgcccuccccuacgucgucggcaagauguucgucgacgucuacuuccaggaggacaagaaggagaugauggaggagcucgucgagggcguccgcugggccuucaucgacaugcucgagaaggagaacgaguggauggacgccggcaccaagcgcaaggccaaggagaaggcccgcgccguccucgccaaggucggcuaccccgaguucaucaugaacgacacccacgucaacgaggaccucaaggccaucaaguucuccgaggccgacuacuucggcaacguccuccagacccgcaaguaccucgcccaguccgacuucuucuggcuccgcaaggccguccccaagaccgagugguucaccaaccccaccaccgucaacgccuucuacuccgccuccaccaaccagauccgcuuccccgccggcgagcuccagaagcccuucuucuggggcaccgaguacccccgcucccucuccuacggcgccaucggcgucaucgucggccacgaguucacccacggcuucgacaacaacggccgcaaguacgacaagaacggcaaccucgaccccuggugguccaccgaguccgaggagaaguucaaggagaagaccaagugcaugaucaaccaguacuccaacuacuacuggaagaaggccggccucaacgucaagggcaagcgcacccucggcgagaacaucgccgacaacggcggccuccgcgaggccuuccgcgccuaccgcaaguggaucaacgaccgccgccagggccucgaggagccccuccuccccggcaucaccuucaccaacaaccagcucuucuuccucuccuacgcccacguccgcugcaacuccuaccgccccgaggccgcccgcgagcagguccagaucggcgcccacucccccccccaguuccgcgucaacggcgccaucuccaacuucgaggaguuccagaaggccuucaacugcccccccaacuccaccaugaaccgcggcauggacuccugccgccucugguga

SEQ ID NO: 47575 - RNA, 1497 nt, Artificial Sequence
  derived and/or modified sequence opt2 from PHF10__Homo_sapiens__NP_060758
auggccgccgccgccggccccggcgccgcccucuccccccgccccugcgacuccgaccccgccacccccggcgcccagucccccaaggacgacaacgaggacaacuccaacgacggcacccagcccuccaagcgccgccgcaugggcuccggcgacuccucccgcuccugcgagaccuccucccaggaccucggcuucuccuacuaccccgccgagaaccucaucgaguacaaguggccccccgacgagaccggcgaguacuacaugcuccaggagcaggucuccgaguaccucggcgucaccuccuucaagcgcaaguaccccgaccucgagcgccgcgaccucucccacaaggagaagcucuaccuccgcgagcucaacgucaucaccgagacccagugcacccucggccucaccgcccuccgcuccgacgaggucaucgaccucaugaucaaggaguaccccgccaagcacgccgaguacuccgucauccuccaggagaaggagcgccagcgcaucaccgaccacuacaaggaguacucccagaugcagcagcagaacacccagaaggucgaggccuccaagguccccgaguacaucaagaaggccgccaagaaggccgccgaguucaacuccaaccucaaccgcgagcgcauggaggagcgccgcgccuacuucgaccuccagacccacgucauccaggucccccagggcaaguacaagguccuccccaccgagcgcaccaaggucuccuccuaccccgucgcccucauccccggccaguuccaggaguacuacaagcgcuacucccccgacgagcuccgcuaccucccccucaacaccgcccucuacgagcccccccucgaccccgagcuccccgcccucgacuccgacggcgacuccgacgacggcgaggacggccgcggcgacgagaagcgcaagaacaagggcaccuccgacuccuccuccggcaacgucuccgagggcgaguccccccccgacucccaggaggacuccuuccagggccgccagaaguccaaggacaaggccgccaccccccgcaaggacggccccaagcgcuccguccucuccaaguccguccccggcuacaagcccaaggucauccccaacgccaucugcggcaucugccucaagggcaaggaguccaacaagaagggcaaggccgagucccucauccacugcucccagugcgagaacuccggccaccccuccugccucgacaugaccauggagcucgucuccaugaucaagaccuaccccuggcagugcauggagugcaagaccugcaucaucugcggccagccccaccacgaggaggagaugauguucugcgacaugugcgaccgcggcuaccacaccuucugcgucggccucggcgccauccccuccggccgcuggaucugcgacugcugccagcgcgccccccccaccccccgcaaggucggccgccgcggcaagaacuccaaggagggcuga

SEQ ID NO: 47576 - RNA, 996 nt, Artificial Sequence
  derived and/or modified sequence opt2 from PHF11__Homo_sapiens__NP_001035533
auggcccaggccucccccccccgccccgagcgcguccucggcgccuccucccccgaggcccgccccgcccaggaggcccuccuccuccccaccggcgucuuccaggucgccgagaagauggagaagcgcaccugcgcccucugccccaaggacgucgaguacaacguccucuacuucgcccaguccgagaacaucgccgcccacgagaacugccuccucuacuccuccggccucgucgagugcgaggaccaggacccccucaaccccgaccgcuccuucgacgucgaguccgucaagaaggagauccagcgcggccgcaagcucaagugcaaguucugccacaagcgcggcgccaccgucggcugcgaccucaagaacugcaacaagaacuaccacuucuucugcgccaagaaggacgacgccgucccccaguccgacggcguccgcggcaucuacaagcuccucugccagcagcacgcccaguuccccaucaucgcccaguccgccaaguucuccggcgucaagcgcaagcgcggccgcaagaagccccucuccggcaaccacguccagccccccgagaccaugaagugcaacaccuucauccgccaggucaaggaggagcacggccgccacaccgacgccaccgucaagguccccuuccucaagaagugcaaggaggccggccuccucaacuaccuccucgaggagauccucgacaagguccacuccauccccgagaagcucauggacgagaccaccuccgaguccgacuacgaggagaucggcuccgcccucuucgacugccgccucuucgaggacaccuucgucaacuuccaggccgccaucgagaagaagauccacgccucccagcagcgcuggcagcagcucaaggaggagaucgagcuccuccaggaccucaagcagacccucugcuccuuccaggagaaccgcgaccucauguccuccuccaccuccaucuccucccucuccuacuga

SEQ ID NO: 47577 - RNA, 3015 nt, Artificial Sequence
  derived and/or modified sequence opt2 from PHF12__Homo_sapiens__NP_001028733
augugggagaagauggagaccaagaccaucgucuacgaccucgacaccuccggcggccucauggagcagauccaggcccuccucgccccccccaagaccgacgaggccgagaagcgcucccgcaagcccgagaaggagccccgccgcuccggccgcgccaccaaccacgacuccugcgacuccugcaaggagggcggcgaccuccucugcugcgaccacugccccgccgccuuccaccuccagugcugcaaccccccccucuccgaggagaugcucccccccggcgaguggaugugccaccgcugcaccguccgccgcaagaagcgcgagcagaagaaggagcucggccacgucaacggccucgucgacaaguccggcaagcgcaccaccucccccuccuccgacaccgaccuccucgaccgcuccgccuccaagaccgagcucaaggccaucgcccacgcccgcauccucgagcgccgcgccucccgccccggcacccccaccuccuccgccuccaccgagacccccaccuccgagcagaacgacgucgacgaggacaucaucgacgucgacgaggagcccgucgccgccgagcccgacuacguccagccccagcuccgccgccccuucgagcuccucaucgccgccgccauggagcgcaaccccacccaguuccagcuccccaacgagcucaccugcaccaccgcccuccccggcuccuccaagcgccgccgcaaggaggagaccaccggcaagaacgucaagaagacccagcacgagcucgaccacaacggccucgucccccuccccgucaaggucugcuucaccugcaaccgcuccugccgcgucgccccccucauccagugcgacuacugcccccuccucuuccacauggacugccucgagcccccccucaccgccaugccccucggccgcuggaugugccccaaccacaucgagcacgucguccucaaccagaagaacaugacccucuccaaccgcugccaggucuucgaccgcuuccaggacaccgucucccagcacgucgucaaggucgacuuccucaaccgcauccacaagaagcacccccccaaccgccgcguccuccaguccgucaagcgccgcucccucaagguccccgacgccaucaagucccaguaccaguucccccccccccucaucgcccccgccgccauccgcgacggcgagcucaucugcaacggcauccccgaggagucccagaugcaccuccucaacuccgagcaccucgccacccaggccgagcagcaggaguggcucugcuccgucgucgcccuccagugcuccauccucaagcaccucuccgccaagcagaugcccucccacugggacuccgagcagaccgagaaggccgacaucaagcccgucaucgucaccgacuccuccgucaccaccucccuccagaccgccgacaagacccccacccccucccacuacccccucuccugccccuccggcaucuccacccagaacucccucuccugcucccccccccaccagucccccgcccucgaggacaucggcugcuccuccugcgccgagaaguccaagaagacccccugcggcaccgccaacggccccgucaacaccgaggucaaggccaacggcccccaccucuacuccucccccaccgacuccaccgacccccgccgccuccccggcgccaacaccccccuccccggccucucccaccgccagggcuggccccgcccccucaccccccccgccgccggcggccuccagaaccacaccgucggcaucaucgucaagaccgagaacgccaccggccccuccuccugcccccagcgcucccucguccccguccccucccucccccccuccauccccuccuccugcgccuccaucgagaacaccuccacccuccagcgcaagaccguccagucccagaucggccccccccucaccgacucccgcccccucggcuccccccccaacgccacccgcguccucacccccccccaggccgccggcgacggcauccucgccaccaccgccaaccagcgcuucuccucccccgcccccuccuccgacggcaaggucucccccggcacccucuccaucggcuccgcccucaccguccccuccuuccccgccaacuccaccgccauggucgaccucaccaacucccuccgcgccuucauggacgucaacggcgagaucgagaucaacaugcucgacgagaagcucaucaaguuccucgcccuccagcgcauccaccagcucuuccccucccgcguccagcccucccccggcuccgucggcacccaccagcucgccuccggcggccaccacaucgagguccagcgcaaggagguccaggcccgcgccgucuucuacccccuccucggccucggcggcgccgucaacaugugcuaccgcacccucuacaucggcaccggcgccgacauggacgucugccucaccaacuacggccacugcaacuacgucuccggcaagcacgccugcaucuucuacgacgagaacaccaagcacuacgagcuccucaacuacuccgagcacggcaccaccgucgacaacguccucuacuccugcgacuucuccgagaagaccccccccaccccccccuccuccaucgucgccaagguccaguccgucauccgccgccgccgccaccagaagcaggacgaggagcccuccgaggaggccgccaugauguccucccaggcccagggcccccagcgccgccccugcaacugcaaggccuccuccuccucccucaucggcggcuccggcgccggcugggagggcaccgcccuccuccaccacggcuccuacaucaagcucggcugccuccaguucgucuucuccaucaccgaguucgccaccaagcagcccaagggcgacgccucccuccuccaggacggcguccucgccgagaagcucucccucaagccccaccagggccccguccuccgcuccaacuccguccccuga

SEQ ID NO: 47578 - RNA, 624 nt, Artificial Sequence
  derived and/or modified sequence opt2 from PHF19__Homo_sapiens__NP_001009936
auggagaaccgcgcccucgaccccggcacccgcgacuccuacggcgccaccucccaccuccccaacaagggcgcccucgccaaggucaagaacaacuucaaggaccucauguccaagcucaccgagggccaguacguccucugccgcuggaccgacggccucuacuaccucggcaagaucaagcgcgucuccuccuccaagcaguccugccucgucaccuucgaggacaacuccaaguacuggguccucuggaaggacauccagcacgccggcguccccggcgaggagcccaagugcaacaucugccucggcaagaccuccggcccccucaacgagauccucaucugcggcaagugcggccucggcuaccaccagcagugccacauccccaucgccggcuccgccgaccagccccuccucacccccugguucugccgccgcugcaucuucgcccucgccguccgcgucucccuccccuccucccccguccccgccucccccgccuccuccuccggcgccgaccagcgccuccccucccagucccucuccuccaagcagaagggccacaccugggcccucgagaccgacuccgccuccgccaccguccucggccaggaccucuga

SEQ ID NO: 47579 - RNA, 1374 nt, Artificial Sequence
  derived and/or modified sequence opt2 from PHF1__Homo_sapiens__NP_002627
auggcccagcccccccgccucucccgcuccggcgccuccucccucugggaccccgccucccccgcccccaccuccggcccccgcccccgccucugggagggccaggacguccucgcccgcuggaccgacggccuccucuaccucggcaccaucaagaaggucgacuccgcccgcgaggucugccucguccaguucgaggacgacucccaguuccucguccucuggaaggacaucucccccgccgcccuccccggcgaggagcuccucugcugcgucugccgcuccgagaccgucguccccggcaaccgccucgucuccugcgagaagugccgccacgccuaccaccaggacugccacgucccccgcgcccccgcccccggcgagggcgagggcaccuccugggucugccgccagugcgucuucgccaucgccaccaagcgcggcggcgcccucaagaagggccccuacgcccgcgccaugcucggcaugaagcucucccuccccuacggccucaagggccucgacugggacgccggccaccucuccaaccgccagcaguccuacugcuacugcggcggccccggcgaguggaaccucaagaugcuccagugccgcuccugccuccagugguuccacgaggccugcacccagugccucuccaagccccuccucuacggcgaccgcuucuacgaguucgagugcugcgucugccgcggcggccccgagaagguccgccgccuccagcuccgcugggucgacgucgcccaccucguccucuaccaccucuccgucugcugcaagaagaaguacuucgacuucgaccgcgagauccuccccuucaccuccgagaacugggacucccuccuccucggcgagcucuccgacacccccaagggcgagcgcuccuccaagcuccucuccgcccucaacucccacaaggaccgcuucaucuccggccgcgagaucaagaagcgcaagugccucuucggccuccacgcccgcaugcccccccccgucgagccccccaccggcgacggcgcccucacccgcgccggccccuggggccgcggccucaccucccccggcgaggcccccgaggccggcgcccgcgcccccgaggaggaggccgagggcgaguccggcggcgccggcgccacccucuccuccgcccaguccgcccgcgcccccggcgccgagggcgccggcuccuccgccgagggcaccgccgccgcccccuccggcugccuccuccccuccacccuccuccccgccccccagggcccccucggcaccgucgacccccagaccggccaccccuggaacuucacccucgucuccccccagaccucccucaaggucccccccacccgcuga

SEQ ID NO: 47580 - RNA, 3039 nt, Artificial Sequence
  derived and/or modified sequence opt2 from PHF20__Homo_sapiens__NP_057520
augaccaagcacccccccaaccgccgcggcaucuccuucgaggucggcgcccagcucgaggcccgcgaccgccucaagaacugguaccccgcccacaucgaggacaucgacuacgaggagggcaagguccucauccacuucaagcgcuggaaccaccgcuacgacgagugguucugcugggacucccccuaccuccgcccccucgagaagauccagcuccgcaaggagggccuccacgaggaggacggcuccuccgaguuccagaucaacgagcagguccucgccugcugguccgacugccgcuucuaccccgccaaggucaccgccgucaacaaggacggcaccuacaccgucaaguucuacgacggcgucguccagaccgucaagcacauccacgucaaggccuucuccaaggaccagaacaucgucggcaacgcccgccccaaggagaccgaccacaagucccucuccuccucccccgacaagcgcgagaaguucaaggagcagcgcaaggccaccgucaacgucaagaaggacaaggaggacaagccccucaagaccgagaagcgccccaagcagcccgacaaggagggcaagcucaucugcuccgagaagggcaaggucuccgagaagucccuccccaagaacgagaaggaggacaaggagaacaucuccgagaacgaccgcgaguacuccggcgacgcccaggucgacaagaagcccgagaacgacaucgucaaguccccccaggagaaccuccgcgagcccaagcgcaagcgcggccgcccccccuccaucgcccccaccgccgucgacuccaacucccagacccuccagcccaucacccucgagcuccgccgccgcaagaucuccaagggcugcgaggucccccucaagcgcccccgccucgacaagaacuccucccaggagaaguccaagaacuacuccgagaacaccgacaaggaccucucccgccgccgcuccucccgccucuccaccaacggcacccacgagauccucgaccccgaccucgucgucuccgaccucgucgacaccgacccccuccaggacacccucuccuccaccaaggaguccgaggagggccagcucaaguccgcccucgaggccggccaggucuccuccgcccucaccugccacuccuucggcgacggcuccggcgccgccggccucgagcucaacugccccuccaugggcgagaacaccaugaagaccgagcccaccuccccccucgucgagcuccaggagaucuccaccgucgaggucaccaacaccuucaagaagaccgacgacuucggcuccuccaacgcccccgccgucgaccucgaccacaaguuccgcugcaaggucgucgacugccucaaguucuuccgcaaggccaagcuccuccacuaccacaugaaguacuuccacggcauggagaagucccucgagcccgaggagucccccggcaagcgccacguccagacccgcggccccuccgccuccgacaagcccucccaggagacccucacccgcaagcgcgucuccgccuccucccccaccaccaaggacaaggagaagaacaaggagaagaaguucaaggaguucguccgcgucaagcccaagaagaagaagaagaagaagaagaagaccaagcccgagugccccugcuccgaggagaucuccgacaccucccaggagcccuccccccccaaggccuucgccgucacccgcugcggcuccucccacaagcccggcguccacauguccccccagcuccacggccccgaguccggccaccacaagggcaaggucaaggcccucgaggaggacaaccucuccgaguccuccuccgaguccuuccucugguccgacgacgaguacggccaggacgucgacgucaccaccaaccccgacgaggagcucgacggcgacgaccgcuacgacuucgaggucguccgcugcaucugcgagguccaggaggagaacgacuucaugauccagugcgaggagugccagugcuggcagcacggcgucugcaugggccuccucgaggagaacguccccgagaaguacaccugcuacgucugccaggacccccccggccagcgccccggcuucaaguacugguacgacaaggaguggcucucccgcggccacaugcacggccucgccuuccucgaggagaacuacucccaccagaacgccaagaagaucgucgccacccaccagcuccucggcgacguccagcgcgucaucgagguccuccacggccuccagcucaagauguccauccuccagucccgcgagcaccccgaccucccccucuggugccagcccuggaagcagcacuccggcgagggccgcucccacuuccgcaacauccccgucaccgacacccgcuccaaggaggaggcccccuccuaccgcacccucaacggcgccgucgagaagccccgcccccucgcccucccccucccccgcuccgucgaggaguccuacaucaccuccgagcacugcuaccagaagccccgcgccuacuaccccgccgucgagcagaagcucgucgucgagacccgcggcuccgcccucgacgacgccgucaacccccuccacgagaacggcgacgacucccucuccccccgccucggcuggccccucgaccaggaccgcuccaagggcgacuccgaccccaagcccggcucccccaaggucaaggaguacgucuccaagaaggcccuccccgaggaggcccccgcccgcaagcuccucgaccgcggcggcgagggccuccucuccucccagcaccaguggcaguucaaccuccucacccacgucgagucccuccaggacgaggucacccaccgcauggacuccaucgagaaggagcucgacguccucgaguccuggcucgacuacaccggcgagcucgagccccccgagccccucgcccgccucccccagcucaagcacugcaucaagcagcuccucauggaccucggcaagguccagcagaucgcccucugcugcuccaccuga

SEQ ID NO: 47581 - RNA, 2043 nt, Artificial Sequence
  derived and/or modified sequence opt2 from PHF21A__Homo_sapiens__NP_001095272
auggagcuccagacccuccaggaggcccucaaggucgagauccagguccaccagaagcucgucgcccagaugaagcaggacccccagaacgccgaccucaagaagcagcuccacgagcuccaggccaagaucaccgcccucuccgagaagcagaagcgcgucgucgagcagcuccgcaagaaccucaucgucaagcaggagcagcccgacaaguuccagauccagccccucccccaguccgagaacaagcuccagaccgcccagcagcagccccuccagcagcuccagcagcagcagcaguaccaccaccaccacgcccagcaguccgccgccgccucccccaaccucaccgccucccagaagaccgucaccaccgccuccaugaucaccaccaagacccucccccucguccucaaggccgccaccgccaccaugcccgccuccgucgucggccagcgccccaccaucgccauggucaccgccaucaacucccagaaggccguccucuccaccgacguccagaacacccccgucaaccuccagaccuccuccaaggucaccggccccggcgccgaggccguccagaucgucgccaagaacaccgucacccucguccaggccacccccccccagcccaucaaggucccccaguucaucccccccccccgccucaccccccgccccaacuuccucccccagguccgccccaagcccgucgcccagaacaacauccccaucgcccccgcccccccccccaugcucgccgccccccagcucauccagcgccccgucaugcucaccaaguucacccccaccacccuccccaccucccagaacuccauccaccccguccgcgucgucaacggccagaccgccaccaucgccaagaccuuccccauggcccagcucaccuccaucgucaucgccacccccggcacccgccucgccggcccccagaccguccagcucuccaagcccucccucgagaagcagaccgucaagucccacaccgagaccgacgagaagcagaccgagucccgcaccaucaccccccccgccgcccccaagcccaagcgcgaggagaacccccagaagcucgccuucauggucucccucggccucgucacccacgaccaccucgaggagauccaguccaagcgccaggagcgcaagcgccgcaccaccgccaaccccgucuacuccggcgccgucuucgagcccgagcgcaagaaguccgccgucaccuaccucaacuccaccaugcaccccggcacccgcaagcgcggccgcccccccaaguacaacgccguccucggcuucggcgcccucacccccaccuccccccaguccucccaccccgacucccccgagaacgagaagaccgagaccaccuucaccuuccccgcccccguccagcccgucucccuccccucccccaccuccaccgacggcgacauccacgaggacuucugcuccgucugccgcaaguccggccagcuccucaugugcgacaccugcucccgcgucuaccaccucgacugccucgaccccccccucaagaccauccccaagggcauguggaucugcccccgcugccaggaccagaugcucaagaaggaggaggccauccccuggcccggcacccucgccaucguccacuccuacaucgccuacaaggccgccaaggaggaggagaagcagaagcuccucaagugguccuccgaccucaagcaggagcgcgagcagcucgagcagaaggucaagcagcucuccaacuccaucuccaagugcauggagaugaagaacaccauccucgcccgccagaaggagaugcacuccucccucgagaaggucaagcagcucauccgccucauccacggcaucgaccucuccaagcccgucgacuccgaggccaccgucggcgccaucuccaacggccccgacugcaccccccccgccaacgccgccaccuccacccccgcccccucccccuccucccaguccugcaccgccaacugcaaccagggcgaggagaccaaguga

SEQ ID NO: 47582 - RNA, 1200 nt, Artificial Sequence
  derived and/or modified sequence opt2 from PHF23__Homo_sapiens__NP_001271447
augcccggcgacugccgccgcgaccccccccccacccucaagcccgagacccagccccccgagaagcgccgccgcaccaucgaggacuucaacaaguucugcuccuucguccucgccuacgccggcuacaucccccccuccaaggaggaguccgacuggcccgccuccggcuccuccuccccccuccgcggcgaguccgccgccgacuccgacggcugggacuccgcccccuccgaccuccgcaccauccagaccuucgucaagaaggccaaguccuccaagcgccgcgccgcccaggccggccccacccagcccggccccccccgcuccaccuucucccgccuccaggcccccgacuccgccacccuccucgagaagaugaagcucaaggacucccucuucgaccucgacggccccaaggucgccuccccccucucccccaccucccucacccacaccucccgcccccccgccgcccucacccccgucccccucucccagggcgaccucucccaccccccccgcaagaaggaccgcaagaaccgcaagcucggccccggcgccggcgccggcuucggcguccuccgccgcccccgccccacccccggcgacggcgagaagcgcucccgcaucaagaaguccaagaagcgcaagcucaagaaggccgagcgcggcgaccgccuccccccccccggccccccccaggccccccccuccgacaccgacuccgaggaggaggaggaggaggaggaggaggaggaggaggaggagauggccaccgucgucggcggcgaggcccccguccccguccuccccaccccccccgaggccccccgcccccccgccaccguccaccccgagggcgucccccccgccgacuccgaguccaaggaggucggcuccaccgagaccucccaggacggcgacgccuccuccuccgagggcgagaugcgcgucauggacgaggacaucauggucgaguccggcgacgacuccugggaccucaucaccugcuacugccgcaagcccuucgccggccgccccaugaucgagugcucccucugcggcaccuggauccaccucuccugcgccaagaucaagaagaccaacguccccgacuucuucuacugccagaagugcaaggagcuccgccccgaggcccgccgccucggcggcccccccaaguccggcgagcccuga

SEQ ID NO: 47583 - RNA, 3291 nt, Artificial Sequence
  derived and/or modified sequence opt2 from PHF2__Homo_sapiens__NP_005383
auggccaccguccccgucuacugcgucugccgccuccccuacgacgucacccgcuucaugaucgagugcgacgccugcaaggacugguuccacggcuccugcgucggcgucgaggaggaggaggcccccgacaucgacaucuaccacugccccaacugcgagaagacccacggcaaguccacccucaagaagaagcgcaccuggcacaagcacggccccggccaggcccccgacgucaagcccguccagaacggcucccagcucuucaucaaggagcuccgcucccgcaccuuccccuccgccgaggacgucgucgcccgcguccccggcucccagcucacccucggcuacauggaggagcacggcuucaccgagcccauccucguccccaagaaggacggccucggccucgccguccccgcccccaccuucuacgucuccgacgucgagaacuacgucggccccgagcgcuccgucgacgucaccgacgucaccaagcagaaggacugcaagaugaagcucaaggaguucgucgacuacuacuacuccaccaaccgcaagcgcguccucaacgucaccaaccucgaguucuccgacacccgcauguccuccuucgucgagccccccgacaucgucaagaagcucuccugggucgagaacuacuggcccgacgacgcccuccucgccaagcccaaggucaccaaguacugccucaucugcgucaaggacuccuacaccgacuuccacaucgacuccggcggcgccuccgccugguaccacguccucaagggcgagaagaccuucuaccucauccgccccgccuccgccaacaucucccucuacgagcgcuggcgcuccgccuccaaccacuccgagauguucuucgccgaccaggucgacaagugcuacaagugcaucgucaagcagggccagacccucuucauccccuccggcuggaucuacgccacccucacccccgucgacugccucgccuucgccggccacuuccuccacucccucuccgucgagaugcagaugcgcgccuacgaggucgagcgccgccucaagcucggcucccucacccaguuccccaacuucgagaccgccugcugguacaugggcaagcaccuccucgaggccuucaagggcucccacaaguccggcaagcagcuccccccccaccucguccagggcgccaagauccucaacggcgccuuccgcuccuggaccaagaagcaggcccucgccgagcacgaggacgagcuccccgagcacuucaagcccucccagcucaucaaggaccucgccaaggagauccgccucuccgagaacgccuccaaggccguccgccccgaggucaacaccgucgccuccuccgacgaggucugcgacggcgaccgcgagaaggaggagccccccucccccaucgaggccacccccccccagucccuccucgagaaggucuccaagaagaagacccccaagaccgucaagaugcccaagcccuccaagauccccaagccccccaagccccccaagcccccccgcccccccaagacccucaagcucaaggacggcggcaagaagaagggcaagaagucccgcgaguccgccucccccaccauccccaaccucgaccuccucgaggcccacaccaaggaggcccucaccaagauggagccccccaagaagggcaaggccaccaaguccguccucuccguccccaacaaggacgucguccacaugcagaacgacgucgagcgccucgagauccgcgagcagaccaaguccaaguccgaggccaaguggaaguacaagaacuccaagcccgacucccuccucaagauggaggaggagcagaagcucgagaaguccccccucgccggcaacaaggacaacaaguucuccuucuccuucuccaacaagaagcuccucggcuccaaggcccuccgcccccccaccucccccggcgucuucggcgcccuccagaacuucaaggaggacaagcccaagcccguccgcgacgaguacgaguacgucuccgacgacggcgagcucaagaucgacgaguuccccauccgccgcaagaagaacgcccccaagcgcgaccucuccuuccuccucgacaagaaggccguccuccccacccccgucaccaagcccaagcucgacuccgccgccuacaaguccgacgacuccuccgacgagggcucccuccacaucgacaccgacaccaagcccggccgcaacgcccgcgucaagaaggaguccggcuccuccgccgccggcauccucgaccuccuccaggccuccgaggaggucggcgcccucgaguacaaccccuccucccagccccccgccucccccuccacccaggaggccauccagggcaugcucuccauggccaaccuccaggccuccgacuccugccuccagaccaccuggggcgccggccaggccaagggcuccucccucgccgcccacggcgcccgcaagaacggcggcggcuccggcaaguccgccggcaagcgccuccucaagcgcgccgccaagaacuccgucgaccucgacgacuacgaggaggagcaggaccaccucgacgccugcuucaaggacuccgacuacgucuaccccucccucgaguccgacgaggacaaccccaucuucaagucccgcuccaagaagcgcaagggcuccgacgacgcccccuacucccccaccgcccgcgucggccccuccgucccccgccaggaccgccccguccgcgagggcacccgcgucgccuccaucgagaccggccucgccgccgccgccgccaagcucucccagcaggaggagcagaaguccaagaagaagaaguccgccaagcgcaagcucacccccaacaccaccucccccuccaccuccaccuccaucuccgccggcaccaccuccaccuccaccacccccgccuccaccacccccgccuccaccacccccgccuccaccuccaccgccuccucccaggccucccaggagggcuccucccccgagcccccccccgagucccacuccuccucccucgccgaccacgaguacaccgccgccggcaccuucaccggcgcccaggccggccgcaccucccagcccauggcccccggcgucuuccucacccagcgccgccccuccgccuccucccccaacaacaacaccgccgccaagggcaagcgcaccaagaagggcauggccaccgccaagcagcgccucggcaagauccucaagauccaccgcaacggcaagcuccuccucuga

SEQ ID NO: 47584 - RNA, 2211 nt, Artificial Sequence
  derived and/or modified sequence opt2 from PHF3__Homo_sapiens__NP_001277189
auggacaucgucgacaccuucaaccaccucauccccaccgagcaccucgacgacgcccucuuccucggcuccaaccucgagaacgaggucugcgaggacuucuccgccucccagaacguccucgaggacucccucaagaacaugcucuccgacaaggaccccaugcucggcuccgccuccaaccaguucugccuccccguccucgacuccaacgaccccaacuuccagaugcccugcuccaccgucgucggccucgacgacaucauggacgagggcgucgucaaggaguccggcaacgacaccaucgacgaggaggagcucauccuccccaaccgcaaccuccgcgacaaggucgaggagaacuccguccgcuccccccgcaaguccccccgccucauggcccaggagcagguccgcucccuccgccaguccaccaucgccaagcgcuccaacgccgccccccucuccaacaccaagaaggccuccggcaagaccgucuccaccgccaaggccggcgucaagcagcccgagcgcucccaggucaaggaggaggucugcaugucccucaagcccgaguaccacaaggagaaccgccgcugcucccgcaacuccggccagaucgaggucguccccgaggucuccgucuccuccucccacuccuccgucuccuccugccucgagaugaaggacgaggacggccucgacuccaagcacaagugcaacaaccccggcgagaucgacguccccucccacgagcucaacugcucccuccucuccgagaccugcgucaccaucggcgagaagaagaacgaggcccucauggagugcaaggccaagcccgucggcuccccccucuucaaguucuccgacaaggaggagcacgagcagaacgacuccaucuccggcaagaccggcgagaccgucgucgaggagaugaucgccacccgcaaggucgagcaggacuccaaggagaccgucaagcucucccacgaggacgaccacauccucgaggacgccggcuccuccgacaucuccuccgacgccgccugcaccaaccccaacaagaccgagaacucccucgucggccuccccuccugcgucgacgaggucaccgagugcaaccucgagcucaaggacaccaugggcaucgccgacaagaccgagaacacccucgagcgcaacaagaucgagccccucggcuacugcgaggacgccgaguccaaccgccagcucgaguccaccgaguucaacaaguccaaccucgaggucgucgacaccuccaccuucggccccgaguccaacauccucgagaacgccaucugcgacguccccgaccagaacuccaagcagcucaacgccaucgaguccaccaagaucgagucccacgagaccgccaaccuccaggacgaccgcaacucccaguccuccuccgucuccuaccucgaguccaaguccgucaaguccaagcacaccaagcccgucauccacuccaagcagaacaugaccaccgacgcccccaagaagaucgucgccgccaaguacgaggucauccacuccaagaccaaggucaacgucaaguccgucaagcgcaacaccgacguccccgagucccagcagaacuuccaccgccccgucaagguccgcaagaagcagaucgacaaggagcccaagauccaguccugcaacuccggcgucaaguccgucaagaaccaggcccacuccguccucaagaagacccuccaggaccagacccucguccagaucuucaagccccucacccacucccucuccgacaagucccacgcccaccccggcugccucaaggagccccaccaccccgcccagaccggccacgucucccacuccucccagaagcagugccacaagccccagcagcaggcccccgccaugaagaccaacucccacgucaaggaggagcucgagcaccccggcgucgagcacuucaaggaggaggacaagcucaagcucaagaagcccgagaagaaccuccagccccgccagcgccgcuccuccaaguccuucucccucgacgagcccccccucuucauccccgacaacaucgccaccauccgccgcgagggcuccgaccacuccuccuccuucgaguccaaguacauguggacccccuccaagcagugcggcuucugcaagaagccccacggcaaccgcugcgucugcaugugcgucuga

SEQ ID NO: 47585 - RNA, 333 nt, Artificial Sequence
  derived and/or modified sequence opt2 from PHF5A__Homo_sapiens__NP_116147
auggccaagcaccaccccgaccucaucuucugccgcaagcaggccggcgucgccaucggccgccucugcgagaagugcgacggcaagugcgucaucugcgacuccuacguccgccccugcacccucguccgcaucugcgacgagugcaacuacggcuccuaccagggccgcugcgucaucugcggcggccccggcgucuccgacgccuacuacugcaaggagugcaccauccaggagaaggaccgcgacggcugccccaagaucgucaaccucggcuccuccaagaccgaccucuucuacgagcgcaagaaguacggcuucaagaagcgcuga

SEQ ID NO: 47586 - RNA, 939 nt, Artificial Sequence
  derived and/or modified sequence opt2 from PHF6__Homo_sapiens__NP_115711
auguccuccuccgucgagcagaagaagggccccacccgccagcgcaagugcggcuucugcaaguccaaccgcgacaaggagugcggccagcuccucaucuccgagaaccagaaggucgccgcccaccacaagugcaugcucuucuccuccgcccucgucuccucccacuccgacaacgagucccucggcggcuucuccaucgaggacguccagaaggagaucaagcgcggcaccaagcucaugugcucccucugccacugccccggcgccaccaucggcugcgacgucaagaccugccaccgcaccuaccacuaccacugcgcccuccacgacaaggcccagauccgcgagaagcccucccagggcaucuacauggucuacugccgcaagcacaagaagaccgcccacaacuccgaggccgccgaccucgaggaguccuucaacgagcacgagcucgagcccuccucccccaaguccaagaagaagucccgcaagggccgcccccgcaagaccaacuucaagggccucuccgaggacacccgcuccaccuccucccacggcaccgacgagauggaguccuccuccuaccgcgaccgcuccccccaccgcuccucccccuccgacacccgccccaagugcggcuucugccacgucggcgaggaggagaacgaggcccgcggcaagcuccacaucuucaacgccaagaaggccgccgcccacuacaagugcaugcucuucuccuccggcaccguccagcucaccaccaccucccgcgccgaguucggcgacuucgacaucaagaccguccuccaggagaucaagcgcggcaagcgcauggucugcuccuucuacaucugcuacgccacccuccaccucaucugcugcuucaaguuccgcguccaccccaaguucauccaguccuccgagaaccucaaguga

SEQ ID NO: 47587 - RNA, 3183 nt, Artificial Sequence
  derived and/or modified sequence opt2 from PHF8__Homo_sapiens__NP_001171825
augaaccgcucccgcgccaucguccagcgcggccgcguccuccccccccccgccccccucgacaccaccaaccucgccggccgccgcacccuccagggccgcgccaagauggccuccguccccgucuacugccucugccgccuccccuacgacgucacccgcuucaugaucgagugcgacaugugccaggacugguuccacggcuccugcgucggcgucgaggaggagaaggccgccgacaucgaccucuaccacugccccaacugcgagguccuccacggccccuccaucaugaagaagcgccgcggcuccuccaagggccacgacacccacaagggcaagcccgucaagaccggcucccccaccuucguccgcgagcuccgcucccgcaccuucgacuccuccgacgaggucauccucaagcccaccggcaaccagcucaccgucgaguuccucgaggagaacuccuucuccguccccauccucguccucaagaaggacggccucggcaugacccuccccucccccuccuucaccguccgcgacgucgagcacuacgucggcuccgacaaggagaucgacgucaucgacgucacccgccaggccgacugcaagaugaagcucggcgacuucgucaaguacuacuacuccggcaagcgcgagaagguccucaacgucaucucccucgaguucuccgacacccgccucuccaaccucgucgagacccccaagaucguccgcaagcucuccugggucgagaaccucuggcccgaggagugcgucuucgagcgccccaacguccagaaguacugccucauguccguccgcgacuccuacaccgacuuccacaucgacuucggcggcaccuccgucugguaccacguccucaagggcgagaagaucuucuaccucauccgccccaccaacgccaaccucacccucuucgagugcugguccuccuccuccaaccagaacgagauguucuucggcgaccaggucgacaagugcuacaagugcuccgucaagcagggccagacccucuucauccccaccggcuggauccacgccguccucacccccgucgacugccucgccuucggcggcaacuuccuccacucccucaacaucgagaugcagcucaaggccuacgagaucgagaagcgccucuccaccgccgaccucuuccgcuuccccaacuucgagaccaucugcugguacgucggcaagcacauccucgacaucuuccgcggccuccgcgagaaccgccgccaccccgccuccuaccucguccacggcggcaaggcccucaaccucgccuuccgcgccuggacccgcaaggaggcccuccccgaccacgaggacgagauccccgagaccguccgcaccguccagcucaucaaggaccucgcccgcgagauccgccucgucgaggacaucuuccagcagaacgucggcaagaccuccaacaucuucggccuccagcgcaucuuccccgccggcuccaucccccucacccgccccgcccacuccaccuccgucuccaugucccgccucucccuccccuccaagaacggcuccaagaagaagggccucaagcccaaggagcucuucaagaaggccgagcgcaagggcaaggaguccuccgcccucggccccgccggccagcucuccuacaaccucauggacaccuacucccaccaggcccucaagaccggcuccuuccagaaggccaaguucaacaucaccggcgccugccucaacgacuccgacgacgacucccccgaccucgaccucgacggcaacgaguccccccucgcccuccucauguccaacggcuccaccaagcgcgucaagucccucuccaagucccgccgcaccaagaucgccaagaaggucgacaaggcccgccucauggccgagcaggucauggaggacgaguucgaccucgacuccgacgacgagcuccagaucgacgagcgccucggcaaggagaaggccacccucaucauccgccccaaguucccccgcaagcucccccgcgccaagcccugcuccgaccccaaccgcguccgcgagcccggcgaggucgaguucgacaucgaggaggacuacaccaccgacgaggacauggucgagggcgucgagggcaagcucggcaacggcuccggcgccggcggcauccucgaccuccucaaggccucccgccaggucggcggccccgacuacgccgcccucaccgaggcccccgccucccccuccacccaggaggccauccagggcaugcucugcauggccaaccuccaguccuccuccuccucccccgccaccuccucccuccaggccugguggaccggcggccaggaccgcuccuccggcuccuccuccuccggccucggcaccgucuccaacucccccgccucccagcgcacccccggcaagcgccccaucaagcgccccgccuacuggcgcaccgaguccgaggaggaggaggagaacgccucccucgacgagcaggacucccucggcgccugcuucaaggacgccgaguacaucuaccccucccucgaguccgacgacgacgaccccgcccucaagucccgccccaagaagaagaagaacuccgacgacgcccccuggucccccaaggcccgcgucacccccacccuccccaagcaggaccgccccguccgcgagggcacccgcgucgccuccaucgagaccggccucgccgccgccgccgccaagcucgcccagcaggagcuccagaaggcccagaagaagaaguacaucaagaagaagccccuccucaaggaggucgagcagccccgcccccaggacuccaaccucucccucaccguccccgcccccaccgucgccgccaccccccagcucgucaccuccuccuccccccuccccccccccgagcccaagcaggaggcccucuccggcucccucgccgaccacgaguacaccgcccgccccaacgccuucggcauggcccaggccaaccgcuccaccacccccauggcccccggcgucuuccucacccagcgccgccccuccgucggcucccaguccaaccaggccggccagggcaagcgccccaagaagggccucgccaccgccaagcagcgccucggccgcauccucaagauccaccgcaacggcaagcuccuccucuga

SEQ ID NO: 47588 - RNA, 1308 nt, Artificial Sequence
  derived and/or modified sequence opt2 from PHGDH__Homo_sapiens__XP_011539533
augcucugguucaagcgcuccuccccccucuccaccgcccaccacgaccucacccaccagcgccagaucccccaggccaccgccuccaugaaggacggcaagugggagcgcaagaaguucaugggcaccgagcucaacggcaagacccucggcauccucggccucggccgcaucggccgcgaggucgccacccgcaugcaguccuucggcaugaagaccaucggcuacgaccccaucaucucccccgaggucuccgccuccuucggcguccagcagcucccccucgaggagaucuggccccucugcgacuucaucaccguccacaccccccuccuccccuccaccaccggccuccucaacgacaacaccuucgcccagugcaagaagggcguccgcgucgucaacugcgcccgcggcggcaucgucgacgagggcgcccuccuccgcgcccuccaguccggccagugcgccggcgccgcccucgacgucuucaccgaggagcccccccgcgaccgcgcccucgucgaccacgagaacgucaucuccugcccccaccucggcgccuccaccaaggaggcccagucccgcugcggcgaggagaucgccguccaguucgucgacauggucaagggcaagucccucaccggcgucgucaacgcccaggcccucaccuccgccuucuccccccacaccaagcccuggaucggccucgccgaggcccucggcacccucaugcgcgccugggccggcucccccaagggcaccauccaggucaucacccagggcaccucccucaagaacgccggcaacugccucucccccgccgucaucgucggccuccucaaggaggccuccaagcaggccgacgucaaccucgucaacgccaagcuccucgucaaggaggccggccucaacgucaccaccucccacucccccgccgcccccggcgagcagggcuucggcgagugccuccucgccgucgcccucgccggcgcccccuaccaggccgucggccucguccagggcaccacccccguccuccagggccucaacggcgccgucuuccgccccgaggucccccuccgccgcgaccucccccuccuccucuuccgcacccagaccuccgaccccgccaugcuccccaccaugaucggccuccucgccgaggccggcguccgccuccucuccuaccagaccucccucgucuccgacggcgagaccuggcacgucaugggcaucuccucccuccuccccucccucgaggccuggaagcagcacgucaccgaggccuuccaguuccacuucuga

SEQ ID NO: 47589 - RNA, 5466 nt, Artificial Sequence
  derived and/or modified sequence opt2 from PHIP__Homo_sapiens__NP_060404
auguccugcgagcgcaagggccucuccgagcuccgcuccgagcucuacuuccucaucgcccgcuuccucgaggacggccccugccagcaggccgcccagguccucauccgcgaggucgccgagaaggagcuccucccccgccgcaccgacuggaccggcaaggagcacccccgcaccuaccagaaccucgucaaguacuaccgccaccucgcccccgaccaccuccuccagaucugccaccgccucggcccccuccucgagcaggagaucccccaguccguccccggcguccagacccuccucggcgccggccgccagucccuccuccgcaccaacaaguccugcaagcacgucgucuggaagggcuccgcccucgccgcccuccacugcggccgcccccccgagucccccgucaacuacggcuccccccccuccaucgccgacacccucuucucccgcaagcucaacggcaaguaccgccucgagcgccucguccccaccgccgucuaccagcacaugaagaugcacaagcgcauccucggccaccucuccuccgucuacugcgucaccuucgaccgcaccggccgccgcaucuucaccggcuccgacgacugccucgucaagaucugggccaccgacgacggccgccuccucgccacccuccgcggccacgccgccgagaucuccgacauggccgucaacuacgagaacaccaugaucgccgccggcuccugcgacaagaugauccgcgucuggugccuccgcaccugcgccccccucgccguccuccagggccacuccgccuccaucaccucccuccaguucuccccccucugcuccggcuccaagcgcuaccucuccuccaccggcgccgacggcaccaucugcuucuggcucugggacgccggcacccucaagaucaacccccgccccgccaaguucaccgagcgcccccgccccggcguccagaugaucugcuccuccuucuccgccggcggcauguuccucgccaccggcuccaccgaccacaucauccgcgucuacuucuucggcuccggccagcccgagaagaucuccgagcucgaguuccacaccgacaaggucgacuccauccaguucuccaacaccuccaaccgcuucgucuccggcucccgcgacggcaccgcccgcaucuggcaguucaagcgccgcgaguggaaguccauccuccucgacauggccacccgccccgccggccagaaccuccagggcaucgaggacaagaucaccaagaugaaggucaccauggucgccugggaccgccacgacaacaccgucaucaccgccgucaacaacaugacccucaaggucuggaacuccuacaccggccagcucauccacguccucaugggccacgaggacgaggucuucguccucgagccccaccccuucgacccccgcguccucuucuccgccggccacgacggcaacgucaucgucugggaccucgcccgcggcgucaagauccgcuccuacuucaacaugaucgagggccagggccacggcgccgucuucgacugcaagugcucccccgacggccagcacuucgccugcaccgacucccacggccaccuccucaucuucggcuucggcuccuccuccaaguacgacaagaucgccgaccagauguucuuccacuccgacuaccgcccccucauccgcgacgccaacaacuucguccucgacgagcagacccagcaggccccccaccucaugcccccccccuuccucgucgacgucgacggcaacccccaccccucccgcuaccagcgccucguccccggccgcgagaacugccgcgaggagcagcucaucccccagaugggcgucaccuccuccggccucaaccagguccucucccagcaggccaaccaggagaucuccccccucgacuccaugauccagcgccuccagcaggagcaggaccuccgccgcuccggcgaggccggcaucuccaacaccucccgccucucccgcggcuccaucuccuccaccuccgagguccacuccccccccaacgucggccuccgccgcuccggccagaucgagggcguccgccagaugcacuccaacgccccccgcuccgagaucgccaccgagcgcgaccucgucgccuggucccgccgcgucgucguccccgagcucuccgccggcgucgccucccgccaggaggaguggcgcaccgccaagggcgaggaggagaucaagaccuaccgcuccgaggagaagcgcaagcaccucaccguccccaaggagaacaagauccccaccgucuccaagaaccacgcccacgagcacuuccucgaccucggcgaguccaagaagcagcagaccaaccagcacaacuaccgcacccgcuccgcccucgaggagaccccccgccccuccgaggagaucgagaacggcuccuccuccuccgacgagggcgaggucgucgccgucuccggcggcaccuccgaggaggaggagcgcgccuggcacuccgacggcuccuccuccgacuacuccuccgacuacuccgacuggaccgccgacgccggcaucaaccuccagccccccaagaagguccccaagaacaagaccaagaaggccgaguccuccuccgacgaggaggaggaguccgagaagcagaagcagaagcagaucaagaaggagaagaagaaggucaacgaggagaaggacggccccaucucccccaagaagaagaagcccaaggagcgcaagcagaagcgccucgccgucggcgagcucaccgagaacggccucacccucgaggaguggcuccccuccaccuggaucaccgacaccaucccccgccgcugccccuucgucccccagaugggcgacgaggucuacuacuuccgccagggccacgaggccuacgucgagauggcccgcaagaacaagaucuacuccaucaaccccaagaagcagcccuggcacaagauggagcuccgcgagcaggagcucaugaagaucgucggcaucaaguacgaggucggccuccccacccucugcugccucaagcucgccuuccucgaccccgacaccggcaagcucaccggcggcuccuucaccaugaaguaccacgacaugcccgacgucaucgacuuccucguccuccgccagcaguucgacgacgccaaguaccgccgcuggaacaucggcgaccgcuuccgcuccgucaucgacgacgccuggugguucggcaccaucgagucccaggagccccuccagcucgaguaccccgacucccucuuccagugcuacaacgucugcugggacaacggcgacaccgagaagaugucccccugggacauggagcucauccccaacaacgccgucuuccccgaggagcucggcaccuccgucccccucaccgacggcgagugccgcucccucaucuacaagccccucgacggcgaguggggcaccaacccccgcgacgaggagugcgagcgcaucgucgccggcaucaaccagcucaugacccucgacaucgccuccgccuucgucgcccccgucgaccuccaggccuaccccauguacugcaccgucgucgccuaccccaccgaccucuccaccaucaagcagcgccucgagaaccgcuucuaccgccgcgucuccucccucaugugggagguccgcuacaucgagcacaacacccgcaccuucaacgagcccggcucccccaucgucaaguccgccaaguucgucaccgaccuccuccuccacuucaucaaggaccagaccugcuacaacaucaucccccucuacaacuccaugaagaagaagguccucuccgacuccgaggacgaggagaaggacgccgacguccccggcaccuccacccgcaagcgcaaggaccaccagccccgccgccgccuccgcaaccgcgcccaguccuacgacauccaggccuggaagaagcagugcgaggagcuccucaaccucaucuuccagugcgaggacuccgagcccuuccgccagcccgucgaccuccucgaguaccccgacuaccgcgacaucaucgacacccccauggacuucgccaccguccgcgagacccucgaggccggcaacuacgagucccccauggagcucugcaaggacguccgccucaucuucuccaacuccaaggccuacacccccuccaagcgcucccgcaucuacuccaugucccuccgccucuccgccuucuucgaggagcacaucuccuccguccucuccgacuacaaguccgcccuccgcuuccacaagcgcaacaccaucaccaagcgccgcaagaagcgcaaccgcuccuccuccgucuccuccuccgccgccuccucccccgagcgcaagaagcgcauccucaagccccagcucaaguccgaguccuccaccuccgccuucuccacccccacccgcuccauccccccccgccacaacgccgcccagaucaacggcaagaccgaguccuccuccgucguccgcacccgcuccaaccgcgucgucgucgaccccgucgucaccgagcagcccuccaccuccuccgccgccaagaccuucaucaccaaggccaacgccuccgccauccccggcaagaccauccucgagaacuccgucaagcacuccaaggcccucaacacccucuccucccccggccaguccuccuucucccacggcacccgcaacaacuccgccaaggagaacauggagaaggagaagcccgucaagcgcaagaugaaguccuccguccuccccaaggccuccacccucuccaaguccuccgccgucaucgagcagggcgacugcaagaacaacgcccucguccccggcaccauccaggucaacggccacggcggccagcccuccaagcucgucaagcgcggccccggccgcaagcccaaggucgaggucaacaccaacuccggcgagaucauccacaagaagcgcggccgcaagcccaagaagcuccaguacgccaagcccgaggaccucgagcagaacaacguccaccccauccgcgacgagguccuccccuccuccaccugcaacuuccucuccgagaccaacaacgucaaggaggaccuccuccagaagaagaaccgcggcggccgcaagcccaagcgcaagaugaagacccagaagcucgacgccgaccuccucguccccgccuccgucaagguccuccgccgcuccaaccgcaagaagaucgacgaccccaucgacgaggaggaggaguucgaggagcucaagggcuccgagccccacaugcgcacccgcaaccagggccgccgcaccgccuucuacaacgaggacgacuccgaggaggagcagcgccagcuccucuucgaggacaccucccucaccuucggcaccuccucccgcggccgcguccgcaagcucaccgagaaggccaaggccaaccucaucggcugguga

SEQ ID NO: 47590 - RNA, 3633 nt, Artificial Sequence
  derived and/or modified sequence opt2 from PHKA1__Homo_sapiens__NP_001116142
augcgcucccgcuccaacuccggcguccgccucgacggcuacgcccgccucguccagcagaccauccucugccaccagaaccccgucaccggccuccuccccgccuccuacgaccagaaggacgccuggguccgcgacaacgucuacuccauccucgccgucuggggccucggccucgccuaccgcaagaacgccgaccgcgacgaggacaaggccaaggccuacgagcucgagcaguccgucgucaagcucaugcgcggccuccuccacugcaugauccgccaggucgacaaggucgaguccuucaaguacucccaguccaccaaggacucccuccacgccaaguacaacaccaagaccugcgccaccgucgucggcgacgaccaguggggccaccuccagcucgacgccaccuccgucuaccuccucuuccucgcccagaugaccgccuccggccuccacaucauccacucccucgacgaggucaacuucauccagaaccucgucuucuacaucgaggccgccuacaagaccgccgacuucggcaucugggagcgcggcgacaagaccaaccagggcaucuccgagcucaacgccuccuccgucggcauggccaaggccgcccucgaggcccucgacgagcucgaccucuucggcgucaagggcggcccccaguccgucauccacguccucgccgacgagguccagcacugccaguccauccucaacucccuccucccccgcgccuccaccuccaaggaggucgacgccucccuccucuccgucgucuccuuccccgccuucgccgucgaggacucccagcucgucgagcucaccaagcaggagaucaucaccaagcuccagggccgcuacggcugcugccgcuuccuccgcgacggcuacaagacccccaaggaggaccccaaccgccucuacuacgagcccgccgagcucaagcucuucgagaacaucgagugcgaguggccccucuucuggaccuacuucauccucgacggcgucuucuccggcaacgccgagcagguccaggaguacaaggaggcccucgaggccguccucaucaagggcaagaacggcgucccccuccuccccgagcucuacuccgucccccccgaccgcgucgacgaggaguaccagaacccccacaccgucgaccgcguccccaugggcaagcucccccacauguggggccagucccucuacauccucggcucccucauggccgagggcuuccucgcccccggcgagaucgacccccucaaccgccgcuucuccaccguccccaagcccgacgucgucguccaggucuccauccucgccgagaccgaggagaucaagaccauccucaaggacaagggcaucuacgucgagaccaucgccgaggucuaccccauccgcguccagcccgcccgcauccucucccacaucuacuccucccucggcugcaacaaccgcaugaagcucuccggccgccccuaccgccacaugggcguccucggcaccuccaagcucuacgacauccgcaagaccaucuucaccuucaccccccaguucaucgaccagcagcaguucuaccucgcccucgacaacaagaugaucgucgagaugcuccgcaccgaccucuccuaccucugcucccgcuggcgcaugaccggccagcccaccaucaccuuccccaucucccacuccaugcucgacgaggacggcaccucccucaacuccuccauccucgccgcccuccgcaagaugcaggacggcuacuucggcggcgcccgcguccagaccggcaagcucuccgaguuccucaccaccuccugcugcacccaccucuccuucauggaccccggccccgagggcaagcucuacuccgaggacuacgacgacaacuacgacuaccucgaguccggcaacuggaugaacgacuacgacuccaccucccacgcccgcugcggcgacgaggucgcccgcuaccucgaccaccuccucgcccacaccgccccccaccccaagcucgcccccaccucccagaagggcggccucgaccgcuuccaggccgccguccagaccaccugcgaccucaugucccucgucaccaaggccaaggagcuccacguccagaacguccacauguaccuccccaccaagcucuuccaggccucccgccccuccuucaaccuccucgacuccccccacccccgccaggagaaccagguccccuccguccgcgucgagauccaccucccccgcgaccaguccggcgaggucgacuucaaggcccucguccuccagcucaaggagaccuccucccuccaggagcaggccgacauccucuacaugcucuacaccaugaagggccccgacuggaacaccgagcucuacaacgagcgcuccgccaccguccgcgagcuccucaccgagcucuacggcaaggucggcgagauccgccacuggggccucauccgcuacaucuccggcauccuccgcaagaaggucgaggcccucgacgaggccugcaccgaccuccucucccaccagaagcaccucaccgucggccucccccccgagccccgcgagaagaccaucuccgccccccuccccuacgaggcccucacccagcucaucgacgaggccuccgagggcgacauguccaucuccauccucacccaggagaucauggucuaccucgccauguacaugcgcacccagcccggccucuucgccgagauguuccgccuccgcaucggccucaucauccaggucauggccaccgagcucgcccacucccuccgcugcuccgccgaggaggccaccgagggccucaugaaccucucccccuccgccaugaagaaccuccuccaccacauccucuccggcaaggaguucggcgucgagcgcuccguccgccccaccgacuccaacgucucccccgccaucuccauccacgagaucggcgccgucggcgccaccaagaccgagcgcaccggcaucaugcagcucaaguccgagaucaagcagucccccggcaccuccaugacccccuccuccggcuccuuccccuccgccuacgaccagcaguccuccaaggacucccgccagggccaguggcagcgccgccgccgccucgacggcgcccucaaccgcguccccgucggcuucuaccagaaggucuggaagguccuccagaagugccacggccucuccgucgagggcuucguccuccccuccuccaccacccgcgagaugacccccggcgagaucaaguucuccguccacgucgaguccguccucaaccgcgucccccagcccgaguaccgccagcuccucgucgaggccauccucguccucaccaugcucgccgacaucgagauccacuccaucggcuccaucaucgccgucgagaagaucguccacaucgccaacgaccucuuccuccaggagcagaagacccucggcgccgacgacaccaugcucgccaaggaccccgccuccggcaucugcacccuccucuacgacuccgcccccuccggccgcuucggcaccaugaccuaccucuccaaggccgccgccaccuacguccaggaguuccucccccacuccaucugcgccaugcaguga

SEQ ID NO: 47591 - RNA, 3708 nt, Artificial Sequence
  derived and/or modified sequence opt2 from PHKA2__Homo_sapiens__NP_000283
augcgcucccgcuccaacuccggcguccgccucgacggcuacgcccgccucguccagcagaccauccucugcuaccagaaccccgucaccggccuccucuccgccucccacgagcagaaggacgccuggguccgcgacaacaucuacuccauccucgccgucuggggccucggcauggccuaccgcaagaacgccgaccgcgacgaggacaaggccaaggccuacgagcucgagcagaacgucgucaagcucaugcgcggccuccuccagugcaugaugcgccaggucgccaaggucgagaaguucaagcacacccaguccaccaaggacucccuccacgccaaguacaacaccgccaccugcggcaccgucgucggcgacgaccaguggggccaccuccaggucgacgccaccucccucuuccuccucuuccucgcccagaugaccgccuccggccuccgcaucaucuucacccucgacgaggucgccuucauccagaaccucgucuucuacaucgaggccgccuacaaggucgccgacuacggcaugugggagcgcggcgacaagaccaaccagggcauccccgagcucaacgccuccuccgucggcauggccaaggccgcccucgaggccaucgacgagcucgaccucuucggcgcccacggcggccgcaaguccgucauccacguccuccccgacgaggucgagcacugccaguccauccucuucuccaugcucccccgcgccuccaccuccaaggagaucgacgccggccuccucuccaucaucuccuuccccgccuucgccgucgaggacgucaaccucgucaacgucaccaagaacgagaucaucuccaagcuccagggccgcuacggcugcugccgcuuccuccgcgacggcuacaagaccccccgcgaggaccccaaccgccuccacuacgaccccgccgagcucaagcucuucgagaacaucgagugcgaguggcccgucuucuggaccuacuucaucaucgacggcgucuucuccggcgacgccguccagguccaggaguaccgcgaggcccucgagggcauccucauccgcggcaagaacggcauccgccucguccccgagcucuacgccgucccccccaacaaggucgacgaggaguacaagaacccccacaccgucgaccgcguccccaugggcaaggucccccaccucuggggccagucccucuacauccucuccucccuccucgccgagggcuuccucgccgccggcgagaucgacccccucaaccgccgcuucuccaccuccgucaagcccgacgucgucguccaggucaccguccucgccgagaacaaccacaucaaggaccuccuccgcaagcacggcgucaacguccaguccaucgccgacauccaccccauccagguccagcccggccgcauccucucccacaucuacgccaagcucggccgcaacaagaacaugaaccucuccggccgccccuaccgccacaucggcguccucggcaccuccaagcucuacgucauccgcaaccagaucuucaccuucaccccccaguucaccgaccagcaccacuucuaccucgcccucgacaacgagaugaucgucgagaugcuccgcaucgagcucgccuaccucugcaccugcuggcgcaugaccggccgccccacccucaccuuccccaucucccgcaccaugcucaccaacgacggcuccgacauccacuccgccguccucuccaccauccgcaagcucgaggacggcuacuucggcggcgcccgcgucaagcucggcaaccucuccgaguuccucaccaccuccuucuacaccuaccucaccuuccucgaccccgacugcgacgagaagcucuucgacaacgccuccgagggcaccuucucccccgacuccgacuccgaccucgucggcuaccucgaggacaccugcaaccaggagucccaggacgagcucgaccacuacaucaaccaccuccuccaguccaccucccuccgcuccuaccuccccccccucugcaagaacaccgaggaccgccacgucuucuccgccauccacuccacccgcgacauccucuccgucauggccaaggccaagggccucgagguccccuucguccccaugacccuccccaccaagguccucuccgcccaccgcaagucccucaaccucgucgacuccccccagccccuccucgagaagguccccgaguccgacuuccaguggccccgcgacgaccacggcgacgucgacugcgagaagcucgucgagcagcucaaggacugcuccaaccuccaggaccaggccgacauccucuacauccucuacgucaucaagggccccuccugggacaccaaccucuccggccagcacggcgucaccguccagaaccuccucggcgagcucuacggcaaggccggccucaaccaggaguggggccucauccgcuacaucuccggccuccuccgcaagaaggucgagguccucgccgaggccugcaccgaccuccucucccaccagaagcagcucaccgucggccucccccccgagccccgcgagaagaucaucuccgccccccucccccccgaggagcucaccaagcucaucuacgaggccuccggccaggacaucuccaucgccguccucacccaggagaucgucgucuaccucgccauguacguccgcgcccagcccucccucuucgucgagaugcuccgccuccgcaucggccucaucauccaggucauggccaccgagcucgcccgcucccucaacugcuccggcgaggaggccuccgagucccucaugaaccucucccccuucgacaugaagaaccuccuccaccacauccucuccggcaaggaguucggcgucgagcgcuccguccgccccauccacuccuccaccuccucccccaccaucuccauccacgaggucggccacaccggcgucaccaagaccgagcgcuccggcaucaaccgccuccgcuccgagaugaagcagaugacccgccgcuucuccgccgacgagcaguucuucuccgucggccaggccgccuccuccuccgcccacuccuccaaguccgcccgcuccuccacccccuccucccccaccggcaccuccuccuccgacuccggcggccaccacaucggcuggggcgagcgccagggccaguggcuccgccgccgccgccucgacggcgccaucaaccgcguccccgucggcuucuaccagcgcgucuggaagauccuccagaagugccacggccucuccaucgacggcuacguccuccccuccuccaccacccgcgagaugaccccccacgagaucaaguucgccguccacgucgaguccguccucaaccgcgucccccagcccgaguaccgccagcuccucgucgaggccaucaugguccucacccuccucuccgacaccgagaugaccuccaucggcggcaucauccacgucgaccagaucguccagauggccucccagcucuuccuccaggaccaggucuccaucggcgccauggacacccucgagaaggaccaggccaccggcaucugccacuucuucuacgacuccgcccccuccggcgccuacggcaccaugaccuaccucacccgcgccgucgccuccuaccuccaggagcuccuccccaacuccggcugccagaugcaguga

SEQ ID NO: 47592 - RNA, 3282 nt, Artificial Sequence
  derived and/or modified sequence opt2 from PHKB__Homo_sapiens__NP_000284
auggccggcgccgccggccucaccgccgaggucuccuggaagguccucgagcgccgcgcccgcaccaagcgcuccggcuccgucuacgagccccucaaguccaucaaccucccccgccccgacaacgagacccucugggacaagcucgaccacuacuaccgcaucgucaaguccacccuccuccucuaccagucccccaccaccggccucuuccccaccaagaccugcggcggcgaccagaaggccaagauccaggacucccucuacugcgccgccggcgccugggcccucgcccucgccuaccgccgcaucgacgacgacaagggccgcacccacgagcucgagcacuccgccaucaagugcaugcgcggcauccucuacugcuacaugcgccaggccgacaagguccagcaguucaagcaggacccccgccccaccaccugccuccacuccgucuucaacguccacaccggcgacgagcuccucuccuacgaggaguacggccaccuccagaucaacgccgucucccucuaccuccucuaccucgucgagaugaucuccuccggccuccagaucaucuacaacaccgacgaggucuccuucauccagaaccucgucuucugcgucgagcgcgucuaccgcguccccgacuucggcgucugggagcgcggcuccaaguacaacaacggcuccaccgagcuccacuccuccuccgucggccucgccaaggccgcccucgaggccaucaacggcuucaaccucuucggcaaccagggcugcuccugguccgucaucuucgucgaccucgacgcccacaaccgcaaccgccagacccucugcucccuccucccccgcgagucccgcucccacaacaccgacgccgcccuccuccccugcaucuccuaccccgccuucgcccucgacgacgagguccucuucucccagacccucgacaaggucguccgcaagcucaagggcaaguacggcuucaagcgcuuccuccgcgacggcuaccgcaccucccucgaggaccccaaccgcugcuacuacaagcccgccgagaucaagcucuucgacggcaucgagugcgaguuccccaucuucuuccucuacaugaugaucgacggcgucuuccgcggcaaccccaagcagguccaggaguaccaggaccuccucacccccguccuccaccacaccaccgagggcuaccccgucguccccaaguacuacuacguccccgccgacuucgucgaguacgagaagaacaaccccggcucccagaagcgcuuccccuccaacugcggccgcgacggcaagcucuuccucuggggccaggcccucuacaucaucgccaagcuccucgccgacgagcucaucucccccaaggacaucgaccccguccagcgcuacgucccccucaaggaccagcgcaacgucuccaugcgcuucuccaaccagggcccccucgagaacgaccucgucguccacgucgcccucaucgccgagucccagcgccuccaggucuuccucaacaccuacggcauccagacccagaccccccagcaggucgagcccauccagaucuggccccagcaggagcucgucaaggccuaccuccagcucggcaucaacgagaagcucggccucuccggccgccccgaccgccccaucggcugccucggcaccuccaagaucuaccgcauccucggcaagaccgucgucugcuaccccaucaucuucgaccucuccgacuucuacaugucccaggacgucuuccuccucaucgacgacaucaagaacgcccuccaguucaucaagcaguacuggaagaugcacggccgcccccucuuccucguccucauccgcgaggacaacauccgcggcucccgcuucaaccccauccucgacaugcucgccgcccucaagaagggcaucaucggcggcgucaagguccacgucgaccgccuccagacccucaucuccggcgccgucgucgagcagcucgacuuccuccgcaucuccgacaccgaggagcuccccgaguucaaguccuucgaggagcucgagccccccaagcacuccaaggucaagcgccaguccuccacccccuccgcccccgagcucggccagcagcccgacgucaacaucuccgaguggaaggacaagcccacccacgagauccuccagaagcucaacgacugcuccugccucgccucccaggccauccuccucggcauccuccucaagcgcgagggccccaacuucaucaccaaggagggcaccgucuccgaccacaucgagcgcgucuaccgccgcgccggcucccagaagcucuggcucgccguccgcuacggcgccgccuucacccagaaguucuccuccuccaucgccccccacaucaccaccuuccucguccacggcaagcaggucacccucggcgccuucggccacgaggaggaggucaucuccaacccccucuccccccgcgucauccagaacaucaucuacuacaagugcaacacccacgacgagcgcgaggccgucauccagcaggagcucgucauccacaucggcuggaucaucuccaacaaccccgagcucuucuccggcaugcucaagauccgcaucggcuggaucauccacgccauggaguacgagcuccagauccgcggcggcgacaagcccgcccucgaccucuaccagcucucccccuccgaggucaagcagcuccuccucgacauccuccagccccagcagaacggccgcugcuggcucaaccgccgccagaucgacggcucccucaaccgcacccccaccggcuucuacgaccgcgucuggcagauccucgagcgcacccccaacggcaucaucgucgccggcaagcaccucccccagcagcccacccucuccgacaugaccauguacgagaugaacuucucccuccucgucgaggacacccucggcaacaucgaccagccccaguaccgccagaucgucgucgagcuccucauggucgucuccaucguccucgagcgcaaccccgagcucgaguuccaggacaaggucgaccucgaccgccucgucaaggaggccuucaacgaguuccagaaggaccagucccgccucaaggagaucgagaagcaggacgacaugaccuccuucuacaacacccccccccucggcaagcgcggcaccugcuccuaccucaccaaggccgucaugaaccuccuccucgagggcgaggucaagcccaacaacgacgaccccugccucaucuccuga

SEQ ID NO: 47593 - RNA, 1260 nt, Artificial Sequence
  derived and/or modified sequence opt2 from PHKG1__Homo_sapiens__NP_001245388
augacccgcgacgaggcccuccccgacucccacuccgcccaggacuucuacgagaacuacgagcccaaggagauccucggccgcggcgucuccuccgucguccgccgcugcauccacaagcccaccucccaggaguacgccgucaaggucaucgacgucaccggcggcggcuccuucucccccgaggagguccgcgagcuccgcgaggccacccucaaggaggucgacauccuccgcaaggucuccggccaccccaacaucauccagcucaaggacaccuacgagaccaacaccuucuucuuccucgucuucgaccucugggaggacaccgacaccauggagauggagcagaaguggugccucggcugggacucccccaaguccaccaacuuccgcgcccagggccgcgcccgcaugaagcgcggcgagcucuucgacuaccucaccgagaaggucacccucuccgagaaggagacccgcaagaucaugcgcgcccuccucgaggucaucugcacccuccacaagcucaacaucguccaccgcgaccucaagcccgagaacauccuccucgacgacaacaugaacaucaagcucaccgacuucggcuucuccugccagcucgagcccggcgagcgccuccgcgaggucugcggcacccccuccuaccucgcccccgagaucaucgagugcuccaugaacgaggaccaccccggcuacggcaaggaggucgacaugugguccaccggcgucaucauguacacccuccucgccggcuccccccccuucuggcaccgcaagcagaugcucaugcuccgcaugaucauguccggcaacuaccaguucggcucccccgagugggacgacuacuccgacaccgucaaggaccucgucucccgcuuccucgucguccagccccagaaccgcuacaccgccgaggaggcccucgcccaccccuucuuccagcaguaccucgucgaggagguccgccacuucuccccccgcggcaaguucaaggucaucgcccucaccguccucgccuccguccgcaucuacuaccaguaccgccgcgucaagcccgucacccgcgagaucgucauccgcgaccccuacgcccuccgcccccuccgccgccucaucgacgccuacgccuuccgcaucuacggccacugggucaagaagggccagcagcagaaccgcgccgcccucuucgagaacacccccaaggccguccuccucucccucgccgaggaggacuacuga

SEQ ID NO: 47594 - RNA, 1221 nt, Artificial Sequence
  derived and/or modified sequence opt2 from PHKG2__Homo_sapiens__NP_000285
augacccucgacgucggccccgaggacgagcuccccgacugggccgccgccaaggaguucuaccagaaguacgaccccaaggacgucaucggccgcggcgucuccuccgucguccgccgcugcguccaccgcgccaccggccacgaguucgccgucaagaucauggaggucaccgccgagcgccucucccccgagcagcucgaggagguccgcgaggccacccgccgcgagacccacauccuccgccaggucgccggccacccccacaucaucacccucaucgacuccuacgaguccuccuccuucauguuccucgucuucgaccucaugcgcaagggcgagcucuucgacuaccucaccgagaaggucgcccucuccgagaaggagacccgcuccaucaugcgcucccuccucgaggccgucuccuuccuccacgccaacaacaucguccaccgcgaccucaagcccgagaacauccuccucgacgacaacaugcagauccgccucuccgacuucggcuucuccugccaccucgagcccggcgagaagcuccgcgagcucugcggcacccccggcuaccucgcccccgagauccucaagugcuccauggacgagacccaccccggcuacggcaaggaggucgaccucugggccugcggcgucauccucuucacccuccucgccggcuccccccccuucuggcaccgccgccagauccucaugcuccgcaugaucauggagggccaguaccaguucuccucccccgagugggacgaccgcuccuccaccgucaaggaccucaucucccgccuccuccaggucgaccccgaggcccgccucaccgccgagcaggcccuccagcaccccuucuucgagcgcugcgagggcucccagcccuggaaccucaccccccgccagcgcuuccgcgucgccgucuggaccguccucgccgccggccgcgucgcccucuccacccaccgcguccgcccccucaccaagaacgcccuccuccgcgaccccuacgcccuccgcuccguccgccaccucaucgacaacugcgccuuccgccucuacggccacugggucaagaagggcgagcagcagaaccgcgccgcccucuuccagcaccgcccccccggccccuuccccaucaugggccccgaggaggagggcgacuccgccgccaucaccgaggacgaggccguccucguccucggcuga

SEQ ID NO: 47595 - RNA, 1206 nt, Artificial Sequence
  derived and/or modified sequence opt2 from PHLDA1__Homo_sapiens__NP_031376
augcgccgcgcccccgccgccgagcgccuccucgagcucggcuuccccccccgcugcggccgccaggagccccccuucccccucggcgucacccgcggcuggggccgcuggcccauccagaagcgccgcgagggcgcccgccccguccccuucuccgagcgcucccaggaggacggccgcggccccgccgcccgcuccuccggcacccucuggcgcauccgcacccgccucucccucugccgcgaccccgagcccccccccccccucugccuccuccgcgucucccuccucugcgcccuccgcgccggcggccgcggcucccgcuggggcgaggacggcgcccgccuccuccuccucccccccgcccgcgccgccggcaacggcgaggccgagcccuccggcggccccuccuacgccggccgcaugcucgaguccuccggcugcaaggcccucaaggagggcguccucgagaagcgcuccgacggccuccuccagcucuggaagaagaagugcugcauccucaccgaggagggccuccuccucaucccccccaagcagcuccagcaccagcagcagcagcagcagcagcagcagcagcagcagcagcagcagcccggccagggccccgccgagcccucccagcccuccggccccgccgucgccucccucgagccccccgucaagcucaaggagcuccacuucuccaacaugaagaccgucgacugcgucgagcgcaagggcaaguacauguacuucaccgucgucauggccgagggcaaggagaucgacuuccgcugcccccaggaccagggcuggaacgccgagaucacccuccagaugguccaguacaagaaccgccaggccauccucgccgucaaguccacccgccagaagcagcagcaccucguccagcagcagccccccucccagccccagccccagccccagcuccagccccagccccagccccagccccagccccagccccagccccagucccagccccagccccagccccagcccaagccccagccccagcagcuccaccccuacccccacccccacccccacccccacucccacccccacucccacccccacccccacccccacccccacccccaccagaucccccacccccacccccagccccacucccagccccacggccaccgccuccuccgcuccaccuccaacuccgccuga

SEQ ID NO: 47596 - RNA, 459 nt, Artificial Sequence
  derived and/or modified sequence opt2 from PHLDA2__Homo_sapiens__NP_003302
augaagucccccgacgagguccuccgcgagggcgagcucgagaagcgcuccgacucccucuuccagcucuggaagaagaagcgcggcguccucaccuccgaccgccucucccucuuccccgccuccccccgcgcccgccccaaggagcuccgcuuccacuccauccucaaggucgacugcgucgagcgcaccggcaaguacgucuacuucaccaucgucaccaccgaccacaaggagaucgacuuccgcugcgccggcgaguccugcuggaacgccgccaucgcccucgcccucaucgacuuccagaaccgccgcgcccuccaggacuuccgcucccgccaggagcgcaccgcccccgccgcccccgccgaggacgccgucgccgccgccgccgccgcccccuccgagcccuccgagcccucccgccccuccccccagcccaagccccgcacccccuga

SEQ ID NO: 47597 - RNA, 384 nt, Artificial Sequence
  derived and/or modified sequence opt2 from PHLDA3__Homo_sapiens__NP_036528
augaccgccgccgccaccgccaccguccucaaggagggcguccucgagaagcgcuccggcggccuccuccagcucuggaagcgcaagcgcugcguccucaccgagcgcggccuccagcucuucgaggccaagggcaccggcggccgccccaaggagcucuccuucgcccgcaucaaggccgucgagugcgucgaguccaccggccgccacaucuacuucacccucgucaccgagggcggcggcgagaucgacuuccgcugcccccucgaggaccccggcuggaacgcccagaucacccucggccucgucaaguucaagaaccagcaggccauccagaccguccgcgcccgccagucccucggcaccggcacccucgucuccuga

SEQ ID NO: 47598 - RNA, 3960 nt, Artificial Sequence
  derived and/or modified sequence opt2 from PHLDB1__Homo_sapiens__NP_001138231
auggacgcccucaaccgcaaccagaucggccccggcugccagacccagaccaugguccagaagggcccccucgaccucaucgagaccggcaagggccucaagguccagaccgacaagccccaccucgucucccucggcuccggccgccucuccaccgccaucacccuccucccccucgaggagggccgcaccgucaucggcuccgccgcccgcgacaucucccuccagggccccggccucgcccccgagcacugcuacaucgagaaccuccgcggcacccucacccucuaccccugcggcaacgccugcaccaucgacggccuccccguccgccagcccacccgccucacccagggcugcaugcucugccucggccaguccaccuuccuccgcuucaaccaccccgccgaggccaaguggaugaaguccaugauccccgccggcggccgcgcccccggcccccccuacucccccguccccgccgaguccgagucccucgucaacggcaaccacaccccccagaccgccacccgcggccccuccgccugcgccucccacuccucccucgucuccuccaucgagaaggaccuccaggagaucauggacucccucguccucgaggagcccggcgccgccggcaagaagcccgccgccaccuccccccucucccccauggccaacggcggccgcuaccuccucuccccccccaccucccccggcgccauguccgucggcuccuccuacgagaacaccucccccgccuucuccccccucuccucccccgccuccuccggcuccugcgccucccacucccccuccggccaggagcccggccccuccguccccccccucguccccgcccgcuccuccuccuaccaccucgcccuccagcccccccagucccgccccuccggcgcccgcuccgaguccccccgccucucccgcaagggcggccacgagcgcccccccucccccggccuccgcggccuccucaccgacucccccgccgccaccguccucgccgaggcccgccgcgccaccgaguccccccgccucggcggccagcuccccgucgucgccaucucccucuccgaguaccccgccuccggcgcccucucccagcccaccuccauccccggcucccccaaguuccagccccccguccccgccccccgcaacaagaucggcacccuccaggaccgcccccccucccccuuccgcgagccccccggcuccgagcgcguccucaccaccucccccucccgccagcucgucggccgcaccuucuccgacggccucgccacccgcacccuccagccccccgaguccccccgccucggccgccgcggccucgacuccaugcgcgagcuccccccccucucccccucccucucccgccgcgcccucuccccccuccccacccgcaccacccccgaccccaagcucaaccgcgaggucgccgaguccccccgcccccgccgcugggccgcccacggcgccucccccgaggacuucucccucacccucggcgcccgcggccgccgcacccgcucccccucccccacccucggcgagucccucgccccccacaagggcuccuucuccggccgccucucccccgccuacucccucggcucccucaccggcgccucccccugccagucccccugcguccagcgcaagcucuccuccggcgaccuccgcguccccgucacccgcgagcgcaagaacuccaucaccgagaucuccgacaacgaggacgaccuccucgaguaccaccgccgccagcgccaggagcgccuccgcgagcaggagauggagcgccucgagcgccagcgccucgagaccauccucaaccucugcgccgaguacucccgcgccgacggcggccccgaggccggcgagcuccccuccaucggcgaggccaccgccgcccucgcccucgccggccgccgccccucccgcggccucgccggcgccuccggccgcuccuccgaggagcccggcgucgccacccagcgccucugggaguccauggagcgcuccgacgaggagaaccucaaggaggagugcuccuccaccgaguccacccagcaggagcacgaggacgcccccuccaccaagcuccagggcgagguccucgcccucgaggaggagcgcgcccagguccucggccacgucgagcagcucaagguccgcgucaaggagcucgagcagcagcuccaggaguccgcccgcgaggccgagauggagcgcgcccuccuccagggcgagcgcgaggccgagcgcgcccuccuccagaaggagcagaaggccgucgaccagcuccaggagaagcucgucgcccucgagaccggcauccagaaggagcgcgacaaggaggccgaggcccucgagaccgagaccaagcucuucgaggaccucgaguuccagcagcucgagcgcgagucccgcgucgaggaggagcgcgagcucgccggccagggccuccuccgcuccaaggccgagcuccuccgcuccaucgccaagcgcaaggagcgccucgccauccucgacucccaggccggccagauccgcgcccaggccguccaggaguccgagcgccucgcccgcgacaagaacgccucccuccagcuccuccagaaggagaaggagaagcucaccguccucgagcgccgcuaccacucccucaccggcggccgccccuuccccaagaccaccuccacccucaaggaggucuaccgcuccaagauggacggcgaggccaccuccccccucccccgcacccgcuccggcccccuccccuccuccuccggcuccuccuccuccuccucccagcucuccgucgccacccucggccgcucccccucccccaaguccgcccuccucacccagaacggcaccggcucccucccccgcaaccucgccgccacccuccaggacaucgagaccaagcgccagcucgcccuccagcagaagggccagcaggucaucgaggagcagcgccgccgccucgccgagcucaagcagaaggccgccgccgaggcccagugccagugggacgcccuccacggcgccgcccccuuccccgccggccccuccggcuuccccccccucaugcaccacuccauccuccaccaccuccccgccggccgcgagcgcggcgaggagggcgagcacgccuacgacacccucucccucgaguccuccgacuccauggagaccuccaucuccaccggcggcaacuccgccugcucccccgacaacauguccuccgccuccggccucgacaugggcaagaucgaggagauggagaagaugcucaaggaggcccacgccgagaagaaccgccucauggagucccgcgagcgcgagauggagcuccgccgccaggcccucgaggaggagcgccgccgccgcgagcaggucgagcgccgccuccaguccgaguccgcccgccgccagcagcucgucgagaaggaggucaagaugcgcgagaagcaguucucccaggcccgcccccucacccgcuaccuccccauccgcaaggaggacuucgaccucaagacccacaucgaguccuccggccacggcgucgacaccugccuccacgucguccucuccuccaaggucugccgcggcuaccucgucaagaugggcggcaagaucaaguccuggaagaagcgcugguucgucuucgaccgccucaagcgcacccucuccuacuacgucgacaagcacgagaccaagcucaagggcgucaucuacuuccaggccaucgaggaggucuacuacgaccaccuccgcuccgccgccaagucccccaaccccgcccucaccuucugcgucaagacccacgaccgccucuacuacauggucgcccccuccgccgaggccaugcgcaucuggauggacgucaucgucaccggcgccgagggcuacacccaguucaugaacuga

SEQ ID NO: 47599 - RNA, 5154 nt, Artificial Sequence
  derived and/or modified sequence opt2 from PHLPP1__Homo_sapiens__NP_919431
auggagcccgccgccgccgccaccguccagcgccuccccgagcucggccgcgaggaccgcgccuccgcccccgccgccgccgccgccgccgccgccgccgccgccgccgccgccgccgcccucgccgccgccgccggcggcggccgcucccccgagcccgcccucacccccgccgcccccuccggcggcaacggcuccggcuccggcgcccgcgaggaggcccccggcgaggccccccccggcccccuccccggccgcgccggcggcgccggccgccgccgccgccgcggcgccccccagcccaucgccggcggcgccgcccccguccccggcgccggcggcggcgccaacucccuccuccuccgccgcggccgccucaagcgcaaccucuccgccgccgccgccgccgccuccuccuccuccuccuccuccgccgccgccgccucccacucccccggcgccgccggccuccccgccuccugcuccgccuccgccucccucugcacccgcucccucgaccgcaagacccuccuccucaagcaccgccagacccuccagcuccagcccuccgaccgcgacuggguccgccaccagcuccagcgcggcugcguccacgucuucgaccgccacauggccuccaccuaccuccgccccguccucugcacccucgacaccaccgccggcgaggucgccgcccgccuccuccagcucggccacaagggcggcggcgucgucaagguccucggccagggccccggcgccgccgccgcccgcgagcccgccgagcccccccccgaggccggcccccgccucgccccccccgagccccgcgacuccgaggucccccccgcccgcuccgcccccggcgccuucggcggccccccccgcgccccccccgccgaccucccccuccccgucggcggccccggcggcuggucccgccgcgccucccccgcccccuccgacuccucccccggcgagcccuucgucggcggccccgucuccuccccccgcgccccccgccccgucgucuccgacaccgaguccuucucccucucccccuccgccgaguccgucuccgaccgccucgaccccuacuccuccggcggcggcuccuccuccuccuccgaggagcucgaggccgacgccgccuccgcccccaccggcguccccggccagccccgccgccccggccaccccgcccagccccucccccucccccagaccgccuccuccccccagccccagcagaaggccccccgcgccaucgacucccccggcggcgccguccgcgagggcuccugcgaggagaaggccgccgccgccgucgcccccggcggccuccaguccacccccggccgcuccggcgucaccgccgagaaggcccccccccccccccccccccccacccucuacguccagcuccacggcgagaccacccgccgccucgaggccgaggagaagccccuccagauccagaacgacuaccucuuccagcucggcuucggcgagcucuggcgcguccaggaggagggcauggacuccgagaucggcugccucauccgcuucuacgccggcaagccccacuccaccggcuccuccgagcgcauccagcucuccggcauguacaacguccgcaagggcaagaugcagcuccccgucaaccgcuggacccgccgccaggucauccucugcggcaccugccucaucgucuccuccgucaaggacucccucaccggcaagaugcacguccucccccucaucggcggcaaggucgaggaggucaagaagcaccagcacugccucgccuucuccuccuccggcccccagucccagaccuacuacaucugcuucgacaccuucaccgaguaccuccgcuggcuccgccaggucuccaaggucgccucccagcgcaucuccuccgucgaccucuccugcugcucccucgagcaccuccccgccaaccucuucuacucccaggaccucacccaccucaaccucaagcagaacuuccuccgccagaaccccucccuccccgccgcccgcggccucaacgagcuccagcgcuucaccaagcucaagucccucaaccucuccaacaaccaccucggcgacuucccccucgccgucugcuccauccccacccucgccgagcucaacgucuccugcaacgcccuccgcuccguccccgccgccgucggcgucaugcacaaccuccagaccuuccuccucgacggcaacuuccuccagucccuccccgccgagcucgagaacaugaagcagcucuccuaccucggccucuccuucaacgaguucaccgacauccccgagguccucgagaagcucaccgccgucgacaagcucugcauguccggcaacugcgucgagacccuccgccuccaggcccuccgcaagaugccccacaucaagcacgucgaccuccgccucaacgucauccgcaagcucaucgccgacgaggucgacuuccuccagcacgucacccagcucgaccuccgcgacaacaagcucggcgaccucgacgccaugaucuucaacaacaucgagguccuccacugcgagcgcaaccagcucgucacccucgacaucugcggcuacuuccucaaggcccucuacgccuccuccaacgagcucguccagcucgacgucuaccccguccccaacuaccucuccuacauggacgucucccgcaaccgccucgagaacguccccgagugggucugcgagucccgcaagcucgagguccucgacaucggccacaaccagaucugcgagcuccccgcccgccucuucugcaacuccucccuccgcaagcuccucgccggccacaaccagcucgcccgccuccccgagcgccucgagcgcaccuccgucgagguccucgacguccagcacaaccagcuccucgagcucccccccaaccuccucaugaaggccgacucccuccgcuuccucaacgccuccgccaacaagcucgagucccucccccccgccacccucuccgaggagaccaacuccauccuccaggagcucuaccucaccaacaacucccucaccgacaagugcgucccccuccucaccggccacccccaccucaagauccuccacauggccuacaaccgccuccaguccuuccccgccuccaagauggccaagcucgaggagcucgaggagaucgaccucuccggcaacaagcucaaggccauccccaccaccaucaugaacugccgccgcaugcacaccgucaucgcccacuccaacugcaucgaggucuuccccgaggucaugcagcuccccgagaucaagugcgucgaccucuccugcaacgagcucuccgaggucacccuccccgagaaccucccccccaagcuccaggagcucgaccucaccggcaacccccgccucguccucgaccacaagacccucgagcuccucaacaacauccgcugcuucaagaucgaccagcccuccaccggcgacgccuccggcgcccccgccgucuggucccacggcuacaccgaggccuccggcgucaagaacaagcucugcgucgccgcccucuccgucaacaacuucugcgacaaccgcgaggcccucuacggcgucuucgacggcgaccgcaacgucgagguccccuaccuccuccagugcaccauguccgacauccucgccgaggagcuccagaagaccaagaacgaggaggaguacauggucaacaccuucaucgucaugcagcgcaagcucggcaccgccggccagaagcucggcggcgccgccguccucugccacaucaagcacgaccccgucgaccccggcggcuccuucacccucaccuccgccaacgucggcaagugccagaccguccucugccgcaacggcaagccccucccccucucccgcuccuacaucauguccugcgaggaggagcucaagcgcaucaagcagcacaaggccaucaucaccgaggacggcaaggucaacggcgucaccgaguccacccgcauccucggcuacaccuuccuccaccccuccgucgucccccgcccccacguccaguccguccuccucaccccccaggacgaguucuucauccucggcuccaagggccucugggacucccucuccgucgaggaggccgucgaggccguccgcaacguccccgacgcccucgccgccgccaagaagcucugcacccucgcccaguccuacggcugccacgacuccaucuccgccgucgucguccagcucuccgucaccgaggacuccuucugcugcugcgagcucuccgccggcggcgccguccccccccccucccccggcaucuucccccccuccgucaacauggucaucaaggaccgccccuccgacggccucggcguccccuccuccuccuccggcauggccuccgagaucuccuccgagcucuccaccuccgagauguccuccgaggucggcuccaccgccuccgacgagcccccccccggcgcccucuccgagaacucccccgccuaccccuccgagcagcgcugcaugcuccaccccaucugccucuccaacuccuuccagcgccagcucuccuccgccaccuucuccuccgccuucuccgacaacggccucgacuccgacgacgaggagcccaucgagggcgucuucaccaacggcucccgcgucgaggucgaggucgacauccacugcucccgcgccaaggagaaggagaagcagcagcaccuccuccagguccccgccgaggccuccgacgagggcaucgucaucuccgccaacgaggacgagcccggccucccccgcaaggccgacuucuccgccgucggcaccaucggccgccgccgcgccaacggcuccgucgccccccaggagcgcucccacaacgucaucgaggucgccaccgacgccccccuccgcaagcccggcggcuacuucgccgcccccgcccagcccgaccccgacgaccaguucaucaucccccccgagcucgaggaggaggucaaggagaucaugaagcaccaccaggagcagcagcagcagcagcagccccccccccccccccagcuccagccccagcucccccgccacuaccagcucgaccagcuccccgacuacuacgacaccccccucuga

SEQ ID NO: 47600 - RNA, 3771 nt, Artificial Sequence
  derived and/or modified sequence opt2 from PHLPP2__Homo_sapiens__NP_001275932
augaagcgcaacggcucccgcaacugccucaaccgccgcucccgcuucggcucccgcgagcgcgacuggcuccgcgaggacgucaagcgcggcugcgucuaccucuacggcgccgacaccaccaccgccaccaccaccaccaccaccuccuccuccuccuccuccuccuccuccuccuccgaccuccaccucguccucugcaccgucgagacccccgccuccgagaucugcgccggcgagggccgcgagucccucuaccuccagcuccacggcgaccucguccgccgccucgagcccaccgagcgcccccuccagaucgucuacgacuaccucucccgccucggcuucgacgaccccguccgcauccaggaggaggccaccaaccccgaccucggcugcaugauccgcuucuacggcgagaagcccugccacauggaccgccucgaccgcauccuccucuccggcaucuacaacguccgcaagggcaagacccagcuccacaagugggccgagcgccucgucguccucugcggcaccugccucaucgucuccuccgucaaggacugccagaccggcaagaugcacauccucccccucgucggcggcaagaucgaggaggucaagcgccgccaguacucccucgccuucuccuccgccggcgcccaggcccagaccuaccacgucuccuucgagacccucgccgaguaccagcgcuggcagcgccaggccuccaaggucgucucccagcgcaucuccaccgucgaccucuccugcuacucccucgaggagguccccgagcaccucuucuacucccaggacaucaccuaccucaaccuccgccacaacuucaugcagcucgagcgccccggcggccucgacacccucuacaaguucucccagcucaagggccucaaccucucccacaacaagcucggccucuuccccauccuccucugcgagaucuccacccucaccgagcucaaccucuccugcaacggcuuccacgaccuccccucccagaucggcaaccuccucaaccuccagacccucugccucgacggcaacuuccucaccacccuccccgaggagcucggcaaccuccagcagcucuccucccucggcaucuccuucaacaacuucucccagauccccgaggucuacgagaagcucaccaugcucgaccgcgucgucauggccggcaacugccucgagguccucaaccucggcguccucaaccgcaugaaccacaucaagcacgucgaccuccgcaugaaccaccucaagaccauggucaucgagaaccucgagggcaacaagcacaucacccacgucgaccuccgcgacaaccgccucaccgaccucgaccucuccucccucugcucccucgagcagcuccacugcggccgcaaccagcuccgcgagcucacccucuccggcuucucccuccgcacccucuacgccuccuccaaccgccucaccgccgucaacgucuaccccguccccucccuccucaccuuccucgaccucucccgcaaccuccucgagugcguccccgacugggccugcgaggccaagaagaucgagguccucgacgucuccuacaaccuccucaccgagguccccguccgcauccucuccucccucucccuccgcaagcucaugcucggccacaaccacguccagaaccuccccacccucgucgagcacaucccccucgagguccucgaccuccagcacaacgcccucacccgccuccccgacacccucuucuccaaggcccucaacaagcucaacaagcucgagcagcucgaggagcucaaccucuccggcaacaagcucaagaccauccccaccaccaucgccaacugcaagcgccuccacacccucgucgcccacuccaacaacaucuccaucuuccccgagauccuccagcucccccagauccaguucgucgaccucuccugcaacgaccucaccgagauccucauccccgaggcccuccccgccacccuccaggaccucgaccucaccggcaacaccaaccucguccucgagcacaagacccucgacaucuucucccacaucaccacccucaagaucgaccagaagccccuccccaccaccgacuccaccgucaccuccaccuucuggucccacggccucgccgagauggccggccagcgcaacaagcucugcgucuccgcccucgccauggacuccuucgccgagggcgucggcgccgucuacggcauguucgacggcgaccgcaacgaggagcucccccgccuccuccagugcaccauggccgacguccuccucgaggagguccagcaguccaccaacgacaccgucuucauggccaacaccuuccucgucucccaccgcaagcucggcauggccggccagaagcucggcuccuccgcccuccucugcuacauccgccccgacaccgccgaccccgccuccuccuucucccucaccgucgccaacgucggcaccugccaggccguccucugccgcggcggcaagcccgucccccucuccaaggucuucucccucgagcaggaccccgaggaggcccagcgcgucaaggaccagaaggccaucaucaccgaggacaacaaggucaacggcgucaccugcugcacccgcaugcucggcugcaccuaccucuaccccuggauccuccccaagccccacaucuccuccaccccccucaccauccaggacgagcuccucauccucggcaacaaggcccucugggagcaccucuccuacaccgaggccgucaacgccguccgccacguccaggacccccucgccgccgccaagaagcucugcacccucgcccaguccuacggcugccaggacaacgucggcgccauggucgucuaccucaacaucggcgaggagggcugcaccugcgagaugaacggccucacccuccccggccccgucggcuucgccuccaccaccaccaucaaggacgcccccaagcccgccacccccuccuccuccuccggcaucgccuccgaguucuccuccgagauguccaccuccgaggucuccuccgaggucggcuccaccgccuccgacgagcacaacgccggcggccucgacaccgcccuccucccccgccccgagcgccgcugcucccuccaccccacccccaccuccggccucuuccagcgccagcccuccuccgccaccuucuccuccaaccaguccgacaacggccucgacuccgacgacgaccagcccgucgagggcgucaucaccaacggcuccaaggucgaggucgaggucgacauccacugcugccgcggccgcgaccucgagaacucccccccccucaucgaguccucccccacccucugcuccgaggagcacgcccgcggcuccugcuucggcauccgccgccagaacuccgucaacuccggcaugcuccuccccauguccaaggaccgcauggagcuccagaagucccccuccaccuccugccucuacggcaagaagcucuccaacggcuccaucgucccccucgaggacucccucaaccucaucgaggucgccaccgagguccccaagcgcaagaccggcuacuucgccgcccccacccagauggagcccgaggaccaguucgucgucccccacgaccucgaggaggaggucaaggagcagaugaagcagcaccaggacucccgccucgagcccgagccccacgaggaggaccgcaccgagccccccgaggaguucgacaccgcccucuga

SEQ ID NO: 47601 - RNA, 855 nt, Artificial Sequence
  derived and/or modified sequence opt2 from PHOX2A__Homo_sapiens__NP_005160
auggacuacuccuaccucaacuccuacgacuccugcgucgccgccauggaggccuccgccuacggcgacuucggcgccugcucccagcccggcggcuuccaguacuccccccuccgccccgccuuccccgccgccggcccccccugccccgcccucggcuccuccaacugcgcccucggcgcccuccgcgaccaccagcccgcccccuacuccgccguccccuacaaguucuuccccgagcccuccggccuccacgagaagcgcaagcagcgccgcauccgcaccaccuucaccuccgcccagcucaaggagcucgagcgcgucuucgccgagacccacuaccccgacaucuacacccgcgaggagcucgcccucaagaucgaccucaccgaggcccgcguccaggucugguuccagaaccgccgcgccaaguuccgcaagcaggagcgcgccgccuccgccaagggcgccgccggcgccgccggcgccaagaagggcgaggcccgcugcuccuccgaggacgacgacuccaaggaguccaccugcucccccacccccgacuccaccgccucccucccccccccccccgcccccggccucgccuccccccgccucucccccuccccccuccccgucgcccucggcuccggccccggccccggccccggcccccagccccucaagggcgcccucugggccggcgucgccggcggcggcggcggcggccccggcgccggcgccgccgagcuccucaaggccuggcagcccgccgaguccggccccggccccuucuccggcguccucuccuccuuccaccgcaagcccggccccgcccucaagaccaaccucuucuga

SEQ ID NO: 47602 - RNA, 945 nt, Artificial Sequence
  derived and/or modified sequence opt2 from PHOX2B__Homo_sapiens__NP_003915
auguacaagauggaguacuccuaccucaacuccuccgccuacgaguccugcauggccggcauggacaccuccucccucgccuccgccuacgccgacuucuccuccugcucccaggccuccggcuuccaguacaaccccauccgcaccaccuucggcgccaccuccggcugccccucccucacccccggcuccugcucccucggcacccuccgcgaccaccaguccucccccuacgccgccguccccuacaagcucuucaccgaccacggcggccucaacgagaagcgcaagcagcgccgcauccgcaccaccuucaccuccgcccagcucaaggagcucgagcgcgucuucgccgagacccacuaccccgacaucuacacccgcgaggagcucgcccucaagaucgaccucaccgaggcccgcguccaggucugguuccagaaccgccgcgccaaguuccgcaagcaggagcgcgccgccgccgccgccgccgccgccgccaagaacggcuccuccggcaagaaguccgacuccucccgcgacgacgaguccaaggaggccaaguccaccgaccccgacuccaccggcggccccggccccaaccccaaccccacccccuccugcggcgccaacggcggcggcggcggcggccccucccccgccggcgcccccggcgccgccggccccggcggccccggcggcgagcccggcaagggcggcgccgccgccgccgccgccgccgccgccgccgccgccgccgccgccgccgccgccgccgccggcggccucgccgccgccggcggccccggccagggcugggcccccggccccggccccaucaccuccauccccgacucccucggcggccccuucgccuccguccucuccucccuccagcgccccaacggcgccaaggccgcccucgucaaguccuccauguucuga

SEQ ID NO: 47603 - RNA, 375 nt, Artificial Sequence
  derived and/or modified sequence opt2 from PHPT1__Homo_sapiens__NP_001129333
auggccgucgccgaccucgcccucauccccgacgucgacaucgacuccgacggcgucuucaaguacguccucauccgcguccacuccgccccccgcuccggcgcccccgccgccgaguccaaggagaucguccgcggcuacaagugggccgaguaccacgccgacaucuacgacaaggucuccggcgacaugcagaagcagggcugcgacugcgagugccucggcggcggccgcaucucccaccagucccaggacaagaagauccacgucuacggcuacuccaugaugcgccccaccugcgucccccucggcgccuccggcccccgcauccaccaccagggccucugguccugccccgcccgccacuucaacuga

SEQ ID NO: 47604 - RNA, 4950 nt, Artificial Sequence
  derived and/or modified sequence opt2 from PHRF1__Homo_sapiens__NP_001273510
auggacgacgacucccucgacgagcucgucgcccgcucccccggccccgacggccacccccaggucggccccgccgaccccgccggcgacuucgaggaguccuccgucggcuccuccggcgacuccggcgacgacuccgacuccgagcacggcgacggcaccgacggcgaggacgagggcgccuccgaggaggaggaccucgaggaccgcuccggcuccgaggacuccgaggacgacggcgagacccuccucgaggucgccggcacccagggcaagcucgaggccgccggcuccuucaacuccgacgacgacgccgaguccugccccaucugccucaacgccuuccgcgaccaggccgucggcacccccgagaacugcgcccacuacuucugccucgacugcaucgucgagugguccaagaacgccaacuccugccccgucgaccgcacccucuucaagugcaucugcauccgcgcccaguucggcggcaagauccuccgcaagauccccgucgagaacaccaaggccuccgaggaggaggaggaccccaccuucugcgaggucugcggccgcuccgaccgcgaggaccgccuccuccucugcgacggcugcgacgccggcuaccacauggagugccucgaccccccccuccaggagguccccgucgacgagugguucugccccgagugcgccgcccccggcgucguccucgccgccgacgccggccccgucuccgaggaggaggucucccuccuccucgccgacgucguccccaccaccucccgccuccgcccccgcgccggccgcacccgcgccaucgcccgcacccgccaguccgagcgcguccgcgccaccgucaaccgcaaccgcaucuccaccgcccgccgcguccagcacacccccggccgccucggcuccucccuccucgacgaggccaucgaggccgucgccaccggccucuccaccgccgucuaccagcgcccccucaccccccgcacccccgcccgccgcaagcgcaagacccgccgccgcaagaagguccccggccgcaagaagacccccuccggccccuccgccaaguccaaguccuccgccacccgcuccaagaagcgccagcaccgcgucaagaagcgccgcggcaagaaggucaaguccgaggccaccacccgcucccgcaucgcccgcacccucggccuccgccgccccguccacuccuccugcauccccuccguccucaagcccgucgagcccucccucggccuccuccgcgccgacaucggcgccgccucccucucccucuucggcgaccccuacgagcucgaccccuucgacuccuccgaggagcucuccgccaacccccucuccccccucuccgccaagcgccgcgcccucucccgcuccgcccuccagucccaccagcccgucgcccgccccgucuccgucggccucucccgccgccgccuccccgccgccguccccgagcccgaccucgaggaggagcccguccccgaccuccucggcuccauccucuccggccagucccuccucaugcucggcuccuccgacgucaucauccaccgcgacggcucccucuccgccaagcgcgccgcccccgucuccuuccagcgcaacuccggcucccucucccgcggcgaggagggcuucaagggcugccuccagccccgcgcccuccccuccggcucccccgcccagggccccuccggcaaccgcccccaguccaccggccucuccugccagggccgcucccgcacccccgcccgcaccgccggcgcccccguccgccucgaccuccccgccgcccccggcgccguccaggcccgcaaccucuccaacggcuccguccccggcuuccgccagucccacucccccugguucaacggcaccaacaagcacacccucccccucgccuccgccgccuccaagaucuccucccgcgacuccaagccccccugccgcuccgucguccccggccccccccucaagcccgccccccgccgcaccgacaucuccgagcucccccgcauccccaagauccgccgcgacgacggcggcggccgccgcgacgccgcccccgcccacggccaguccaucgagauccccuccgccugcaucucccgccucaccggccgcgagggcaccggccagcccggccgcggcacccgcgccgaguccgaggccuccucccgcgucccccgcgagcccggcguccacaccggcuccucccgcccccccgcccccuccucccacggcucccucgccccccucggccccucccgcggcaagggcgucggcuccaccuucgaguccuuccgcaucaacauccccggcaacauggcccacuccucccagcucuccucccccggcuucugcaacaccuuccgccccgucgacgacaaggagcagcgcaaggagaaccccuccccccucuucuccaucaagaagaccaagcagcuccgcuccgaggucuacgaccccuccgaccccaccggcuccgacuccuccgcccccggcuccucccccgagcgcuccggccccggccuccuccccuccgagaucacccgcaccaucuccaucaacucccccaaggcccagaccguccaggccguccgcugcgucaccuccuacaccgucgaguccaucuucggcaccgagcccgagcccccccucggccccuccuccgccauguccaagcuccgcggcgccgucgccgccgagggcgccuccgacaccgagcgcgaggagcccaccgagucccagggccucgccgcccgccuccgccgccccuccccccccgagcccugggacgaggaggacggcgccuccugcuccaccuucuucggcuccgaggagcgcaccgucaccugcgucaccgucgucgagcccgaggccccccccucccccgacguccuccaggccgccacccaccgcgucgucgagcuccgcccccccucccgcucccgcuccaccuccuccucccgcucccgcaagaaggccaagcgcaagcgcgucucccgcgagcacggccgcacccgcuccggcacccgcuccgagucccgcgaccgcuccucccgcuccgccucccccuccgucggcgaggagcgcccccgccgccagcgcuccaaggccaagucccgccgcuccuccuccgaccgcuccuccucccgcgagcgcgccaagcgcaagaaggccaaggacaagucccgcgagcaccgccgcggccccuggggccacucccgccgcaccucccgcucccgcuccggcucccccggcuccuccuccuacgagcacuacgagucccgcaagaagaagaagcgccgcuccgccucccgcccccgcggccgcgagugcucccccaccuccucccucgagcgccucugccgccacaagcaccagcgcgagcgcucccacgagcgccccgaccgcaaggaguccgucgccuggccccgcgaccgccgcaagcgccgcucccgcucccccuccuccgagcaccgcgcccgcgagcaccgccgcccccgcucccgcgagaaguggccccagacccgcucccacucccccgagcgcaagggcgccguccgcgaggccucccccgccccccucgcccagggcgagcccggccgcgaggaccuccccacccgccuccccgcccucggcgaggcccacgucucccccgaggucgccaccgccgacaaggccccccuccaggccccccccguccucgaggucgccgccgagugcgagcccgacgaccucgaccucgacuacggcgacuccgucgaggccggccacgucuucgacgacuucuccuccgacgccgucuucauccagcucgacgacauguccuccccccccucccccgaguccaccgacuccucccccgagcgcgacuucccccucaagcccgcccucccccccgccucccucgccgucgccgccauccagcgcgaggucucccucaugcacgacgaggaccccucccagccccccccccuccccgagggcacccaggagccccaccuccuccgccccgacgccgccgagaaggccgaggcccccuccucccccgacgucgcccccgccggcaaggaggacucccccuccgccuccggccgcguccaggaggccgcccgccccgaggaggucgucucccagaccccccuccuccgcucccgcgcccucgucaagcgcgucaccuggaaccuccaggaguccgaguccuccgcccccgccgaggaccgcgccccccgcgccccccuccaccgcccccagaagccccgcgagggcgccugggacauggaggacgucgcccccaccggcguccgccaggucuucuccgagcuccccuuccccucccacguccuccccgagcccggcuuccccgacaccgaccccucccaggucuacucccccggccucccccccgcccccgcccagcccuccuccaucccccccugcgcccucgucucccagcccaccguccaguucauccuccagggcucccucccccucgucggcugcggcgccgcccagacccucgcccccguccccgccgcccucacccccgccuccgagcccgccucccaggccaccgccgccuccaacuccgaggagaagacccccgccccccgccucgccgccgagaagaccaagaaggaggaguacaugaagaagcuccacaugcaggagcgcgccgucgaggaggucaagcucgccaucaagcccuucuaccagaagcgcgaggucaccaaggaggaguacaaggacauccuccgcaaggccguccagaagaucugccacuccaaguccggcgagaucaaccccgucaaggucgccaaccucgucaaggccuacgucgacaaguaccgccacaugcgccgccacaagaagcccgaggccggcgaggagccccccacccagggcgccgagggcuga

SEQ ID NO: 47605 - RNA, 2289 nt, Artificial Sequence
  derived and/or modified sequence opt2 from PHTF1__Homo_sapiens__XP_011538833
auggccuccaacgagcgcgacgccaucuccugguaccagaagaagaucggcgccuacgaccagcagaucugggagaaguccaucgagcagacccagaucaagggccucaagaacaagcccaagaagaugggccacaucaagcccgaccucaucgacgucgaccucauccgcggcuccaccuucgccaaggccaagcccgagauccccuggaccucccucacccgcaagggccucguccgcgucgucuucuucccccucuucuccaacugguggauccaggucaccucccuccgcaucuucgucuggcuccuccuccucuacuucaugcaggucaucgccaucguccucuaccucaugaugcccaucgucaacaucuccgagguccucggcccccucugccucaugcuccucaugggcaccguccacugccagaucgucuccacccagaucacccgccccuccggcaacaacggcaaccgccgccgccgcaagcuccgcaagaccgucaacggcgacggcucccgcgagaacggcaacaacuccuccgacaagguccgcggcaucgagacccucgaguccguccccaucaucggcggcuucugggagaccaucuucggcaaccgcaucaagcgcgucaagcucaucuccaacaagggcaccgagaccgacaacgaccccuccugcguccaccccaucaucaagcgccgccagugccgccccgagauccgcauguggcagacccgcgagaaggccaaguucuccgacggcgagaagugccgccgcgaggccuuccgccgccucggcaacggcgucuccgacgaccucuccuccgaggaggacggcgaggcccgcacccagaugauccuccuccgccgcuccgucgagggcgccuccuccgacaacggcugcgaggucaagaaccgcaaguccauccucucccgccaccucaacucccaggucaagaagaccaccacccgcuggugccacaucguccgcgacuccgacucccucgccgaguccgaguucgaguccgccgccuucucccagggcucccgcuccggcgucuccggcggcucccgcucccucaacaugucccgccgcgacuccgaguccacccgccacgacuccgagaccgaggacaugcucugggacgaccuccuccacggccccgagugccgcuccuccgucaccuccgacuccgagggcgcccacgucaacacccuccacuccggcaccaagcgcgaccccaaggaggacgucuuccagcagaaccaccucuucuggcuccagaacuccucccccuccuccgaccgcgucuccgccaucaucugggagggcaacgagugcaagaagauggacauguccguccucgagaucuccggcaucaucaugucccgcgucaacgccuaccagcagggcgucggcuaccagaugcucggcaacgucgucaccaucggccucgccuucuuccccuuccuccaccgccucuuccgcgagaagucccucgaccagcucaaguccaucuccgccgaggagauccucacccucuucugcggcgccccccccgucacccccaucaucguccucuccaucaucaacuucuucgagcgccucugccucaccuggauguucuucuucaugaugugcgucgccgagcgcaccuacaagcagcgcuuccucuucgccaagcucuucucccacaucaccuccgcccgcaaggcccgcaaguacgagaucccccacuuccgccucaagaaggucgagaacaucaagaucuggcucucccuccgcuccuaccucaagcgccgcggcccccagcgcuccgucgacgucgucgucuccuccgucuuccuccucacccucuccaucgccuucaucugcugcgcccagguccuccagggccacaagaccuuccucaacgacgccuacaacugggaguuccucaucugggagaccgcccuccuccucuuccuccuccgccucgccucccucggcuccgagaccaacaagaaguacuccaacgucuccauccuccucaccgagcagaucaaccucuaccucaagauggagaagaagcccaacaagaaggagcagcucacccucgucaacaacguccucaagcucuccaccaagcuccucaaggagcucgacacccccuuccgccucuacggccucaccaugaacccccucaucuacaacaucacccgcgucgucauccucuccgccgucuccggcgucaucuccgaccuccucggcuucaacauccgccucuggaagaucaaguccuga

SEQ ID NO: 47606 - RNA, 2244 nt, Artificial Sequence
  derived and/or modified sequence opt2 from PHTF2__Homo_sapiens__NP_001120830
auggccuccaaggucaccgacgccaucgucugguaccagaagaagaucggcgccuacgaccagcagaucugggagaaguccgucgagcagcgcgagaucaagggccuccgcaacaagcccaagaagaccgcccacgucaagcccgaccucaucgacgucgaccucguccgcggcuccgccuucgccaaggccaagcccgagucccccuggaccucccucacccgcaagggcaucguccgcgucgucuucuuccccuucuucuuccgcugguggcuccaggucaccuccaaggucaucuucuucuggcuccucguccucuaccuccuccaggucgccgccaucguccucuucugcuccaccuccuccccccacuccaucccccucaccgaggucaucggccccaucuggcucaugcuccuccucggcaccguccacugccagaucgucuccacccgcacccccaagcccccccucuccaccggcggcaagcgccgccgcaagcuccgcaaggccgcccaccucgagguccaccgcgagggcgacggcuccuccaccaccgacaacacccaggagggcgccguccagaaccacggcaccuccaccucccacuccgucggcaccgucuuccgcgaccucuggcacgccgccuucuuccucuccggcuccaagaaggccaagaacuccaucgacaaguccaccgagaccgacaacggcuacgucucccucgacggcaagaagaccgucaaguccggcgaggacggcauccagaaccacgagccccagugcgagaccauccgccccgaggagaccgccuggaacaccggcacccuccgcaacggccccuccaaggacacccagcgcaccaucaccaacgucuccgacgaggucuccuccgaggagggccccgagaccggcuacucccuccgccgccacgucgaccgcaccuccgagggcguccuccgcaaccgcaagucccaccacuacaagaagcacuaccccaacgaggacgcccccaaguccggcaccuccugcuccucccgcugcuccuccucccgccaggacuccgaguccgcccgccccgaguccgagaccgaggacguccucugggaggaccuccuccacugcgccgagugccacuccuccugcaccuccgagaccgacgucgagaaccaccagaucaaccccugcgucaagaaggaguaccgcgacgaccccuuccaccagucccaccuccccuggcuccacuccucccaccccggccucgagaagaucuccgccaucgucugggagggcaacgacugcaagaaggccgacauguccguccucgagaucuccggcaugaucaugaaccgcgucaacucccacauccccggcaucggcuaccagaucuucggcaacgccgucucccucauccucggccucacccccuucgucuuccgccucucccaggccaccgaccucgagcagcucaccgcccacuccgccuccgagcucuacgucaucgccuucggcuccaacgaggacgucaucguccucuccauggucaucaucuccuucgucguccgcgucucccucgucuggaucuucuucuuccuccucugcgucgccgagcgcaccuacaagcagcgccuccucuucgccaagcucuucggccaccucaccuccgcccgccgcgcccgcaaguccgaggucccccacuuccgccucaagaagguccagaacaucaagauguggcucucccuccgcuccuaccucaagcgccgcggcccccagcgcuccgucgacgucaucgucuccuccgccuuccuccucaccaucuccgucgucuucaucugcugcgcccagcuccuccacguccacgagaucuuccucgacugccacuacaacugggagcucgucaucuggugcaucucccucacccucuuccuccuccgcuucgucacccucggcuccgagaccuccaagaaguacuccaacaccuccauccuccucaccgagcagaucaaccucuaccucaagauggagaagaagcccaacaagaaggaggagcucacccucgucaacaacguccucaagcucgccaccaagcuccucaaggagcucgacucccccuuccgccucuacggccucaccaugaacccccuccucuacaacaucacccaggucgucauccucuccgccgucuccggcgucaucuccgaccuccucggcuucaaccucaagcucuggaagaucaaguccuga

SEQ ID NO: 47607 - RNA, 717 nt, Artificial Sequence
  derived and/or modified sequence opt2 from PHYH__Homo_sapiens__NP_001032626
augcgcgacgucaccaucuccaaguccgaguacgcccccuccgagaagaugaucaccaagguccaggacuuccaggaggacaaggagcucuuccgcuacugcacccuccccgagauccucaaguacgucgagugcuucaccggccccaacaucauggccaugcacaccaugcucaucaacaagccccccgacuccggcaagaagaccucccgccacccccuccaccaggaccuccacuacuuccccuuccgccccuccgaccucaucgucugcgccuggaccgccauggagcacaucucccgcaacaacggcugccucgucguccuccccggcacccacaagggcucccucaagccccacgacuaccccaagugggagggcggcgucaacaagauguuccacggcauccaggacuacgaggagaacaaggcccgcguccaccucgucauggagaagggcgacaccgucuucuuccacccccuccucauccacggcuccggccagaacaagacccagggcuuccgcaaggccaucuccugccacuucgccuccgccgacugccacuacaucgacgucaagggcaccucccaggagaacaucgagaaggaggucgucggcaucgcccacaaguucuucggcgccgagaacuccgucaaccucaaggacaucuggauguuccgcgcccgccucgucaagggcgagcgcaccaaccucuga

SEQ ID NO: 47608 - RNA, 993 nt, Artificial Sequence
  derived and/or modified sequence opt2 from PHYHIP__Homo_sapiens__NP_001092805
auggagcuccucuccaccccccacuccaucgagaucaacaacaucaccugcgacuccuuccgcaucuccugggccauggaggacuccgaccucgagcgcgucacccacuacuucaucgaccucaacaagaaggagaacaagaacuccaacaaguucaagcaccgcgacguccccaccaagcucgucgccaaggccgucccccuccccaugaccguccgcggccacugguuccucuccccccgcaccgaguacuccgucgccguccagaccgccgucaagcaguccgacggcgaguaccucgucuccggcugguccgagaccgucgaguucugcaccggcgacuacgccaaggagcaccucgcccagcuccaggagaaggccgagcagaucgccggccgcaugcuccgcuucuccgucuucuaccgcaaccaccacaaggaguacuuccagcacgcccgcacccacugcggcaacaugcuccagcccuaccucaaggacaacuccggcucccacggcucccccaccuccggcaugcuccacggcgucuucuucuccugcaacaccgaguucaacaccggccagcccccccaggacucccccuacggccgcuggcgcuuccagauccccgcccagcgccucuucaaccccuccaccaaccucuacuucgccgacuucuacugcauguacaccgccuaccacuacgccauccucguccucgcccccaagggcucccucggcgaccgcuucugccgcgaccgccucccccuccucgacaucgccugcaacaaguuccucaccugcuccgucgaggacggcgagcucgucuuccgccacgcccaggaccucauccucgagaucaucuacaccgagcccgucgaccucucccucggcacccucggcgagaucuccggccaccagcucaugucccucuccaccgccgacgccaagaaggaccccuccugcaagaccugcaacaucuccgucggccgcuga

SEQ ID NO: 47609 - RNA, 1353 nt, Artificial Sequence
  derived and/or modified sequence opt2 from PHYKPL__Homo_sapiens__NP_699204
auggccgccgaccagcgccccaaggccgacacccucgcccuccgccagcgccucaucuccuccuccugccgccucuucuuccccgaggaccccgucaagaucguccgcgcccagggccaguacauguacgacgagcagggcgccgaguacaucgacugcaucuccaacgucgcccacgucggccacugccacccccucgucguccaggccgcccacgagcagaaccagguccucaacaccaacucccgcuaccuccacgacaacaucgucgacuacgcccagcgccucuccgagacccuccccgagcagcucugcgucuucuacuuccucaacuccggcuccgaggccaacgaccucgcccuccgccucgcccgccacuacaccggccaccaggacgucgucguccucgaccacgccuaccacggccaccucuccucccucaucgacaucucccccuacaaguuccgcaaccucgacggccagaaggaguggguccacgucgccccccuccccgacaccuaccgcggccccuaccgcgaggaccaccccaaccccgccauggccuacgccaacgaggucaagcgcgucgucuccuccgcccaggagaagggccgcaagaucgccgccuucuucgccgagucccuccccuccgucggcggccagaucaucccccccgccggcuacuucucccaggucgccgagcacauccgcaaggccggcggcgucuucgucgccgacgagauccaggucggcuucggccgcgucggcaagcacuucugggccuuccagcuccagggcaaggacuucguccccgacaucgucaccaugggcaaguccaucggcaacggccaccccgucgccugcgucgccgccacccagcccgucgcccgcgccuucgaggccaccggcgucgaguacuucaacaccuucggcggcucccccgucuccugcgccgucggccucgccguccucaacguccucgagaaggagcagcuccaggaccacgccaccuccgucggcuccuuccucaugcagcuccucggccagcagaagaucaagcaccccaucgucggcgacguccgcggcgucggccucuucaucggcgucgaccucaucaaggacgaggccacccgcacccccgccaccgaggaggccgccuaccucgucucccgccucaaggagaacuacguccuccucuccaccgacggccccggccgcaacauccucaaguucaagccccccaugugcuucucccucgacaacgcccgccaggucgucgccaagcucgacgccauccucaccgacauggaggagaagguccgcuccugcgagacccuccgccuccagcccuga

SEQ ID NO: 47610 - RNA, 777 nt, Artificial Sequence
  derived and/or modified sequence opt2 from PI15__Homo_sapiens__NP_056970
augaucgccaucuccgccgucuccuccgcccuccucuucucccuccucugcgaggccuccaccgucguccuccucaacuccaccgacuccuccccccccaccaacaacuucaccgacaucgaggccgcccucaaggcccagcucgacuccgccgacauccccaaggcccgccgcaagcgcuacaucucccagaacgacaugaucgccauccucgacuaccacaaccagguccgcggcaaggucuucccccccgccgccaacauggaguacauggucugggacgagaaccucgccaaguccgccgaggccugggccgccaccugcaucugggaccacggccccuccuaccuccuccgcuuccucggccagaaccucuccguccgcaccggccgcuaccgcuccauccuccagcucgucaagcccugguacgacgaggucaaggacuacgccuuccccuacccccaggacugcaacccccgcugccccaugcgcugcuucggccccaugugcacccacuacacccagauggucugggccaccuccaaccgcaucggcugcgccauccacaccugccagaacaugaacgucuggggcuccgucuggcgccgcgccgucuaccucgucugcaacuacgcccccaagggcaacuggaucggcgaggcccccuacaaggucggcguccccugcuccuccugcccccccuccuacggcggcuccugcaccgacaaccucugcuuccccggcgucaccuccaacuaccucuacugguucaaguga

SEQ ID NO: 47611 - RNA, 1392 nt, Artificial Sequence
  derived and/or modified sequence opt2 from PI16__Homo_sapiens__NP_001186088
augcacggcuccugcuccuuccucaugcuccuccucccccuccuccuccuccucgucgccaccaccggccccgucggcgcccucaccgacgaggagaagcgccucauggucgagcuccacaaccucuaccgcgcccaggucucccccaccgccuccgacaugcuccacaugcgcugggacgaggagcucgccgccuucgccaaggccuacgcccgccagugcgucuggggccacaacaaggagcgcggccgccgcggcgagaaccucuucgccaucaccgacgagggcauggacgucccccucgccauggaggaguggcaccacgagcgcgagcacuacaaccucuccgccgccaccugcucccccggccagaugugcggccacuacacccaggucgucugggccaagaccgagcgcaucggcugcggcucccacuucugcgagaagcuccagggcgucgaggagaccaacaucgagcuccucgucugcaacuacgagccccccggcaacgucaagggcaagcgccccuaccaggagggcacccccugcucccagugccccuccggcuaccacugcaagaacucccucugcgagcccaucggcucccccgaggacgcccaggaccuccccuaccucgucaccgaggcccccuccuuccgcgccaccgaggccuccgacucccgcaagaugggcacccccuccucccucgccaccggcauccccgccuuccucgucaccgaggucuccggcucccucgccaccaaggcccuccccgccgucgagacccaggcccccaccucccucgccaccaaggacccccccuccauggccaccgaggccccccccugcgucaccaccgagguccccuccauccucgccgcccacucccuccccucccucgacgaggagcccgucaccuuccccaaguccacccacguccccauccccaaguccgccgacaaggucaccgacaagaccaagguccccucccgcucccccgagaacucccucgaccccaagaugucccucaccggcgcccgcgagcuccucccccacgcccaggaggaggccgaggccgaggccgagcucccccccuccuccgagguccucgccuccgucuuccccgcccaggacaagcccggcgagcuccaggccacccucgaccacaccggccacaccuccuccaagucccuccccaacuuccccaacaccuccgccaccgccaacgccaccggcggccgcgcccucgcccuccaguccucccuccccggcgccgagggccccgacaagcccuccgucgucuccggccucaacuccggccccggccacgucuggggcccccuccucggccuccuccuccuccccccccucguccucgccggcaucuucuga

SEQ ID NO: 47612 - RNA, 354 nt, Artificial Sequence
  derived and/or modified sequence opt2 from PI3__Homo_sapiens__NP_002629
augcgcgccuccuccuuccucaucgucgucgucuuccucaucgccggcacccucguccucgaggccgccgucaccggcguccccgucaagggccaggacaccgucaagggccgcguccccuucaacggccaggaccccgucaagggccaggucuccgucaagggccaggacaaggucaaggcccaggagcccgucaagggccccgucuccaccaagcccggcuccugccccaucauccucauccgcugcgccaugcucaacccccccaaccgcugccucaaggacaccgacugccccggcaucaagaagugcugcgagggcuccugcggcauggccugcuucgucccccaguga

SEQ ID NO: 47613 - RNA, 1440 nt, Artificial Sequence
  derived and/or modified sequence opt2 from PI4K2A__Homo_sapiens__NP_060895
auggacgagaccuccccccucgucucccccgagcgcgcccagccccccgacuacaccuuccccuccggcuccggcgcccacuucccccagguccccggcggcgccguccgcgucgccgccgccgccggcuccggccccuccccccccggcucccccggccacgaccgcgagcgccagccccuccucgaccgcgcccgcggcgccgccgcccagggccagacccagaccgucgccgcccaggcccaggcccucgccgcccaggccgccgccgccgcccacgccgcccaggcccaccgcgagcgcaacgaguuccccgaggaccccgaguucgaggccgucguccgccaggccgagcucgccaucgagcgcugcaucuuccccgagcgcaucuaccagggcuccuccggcuccuacuucgucaaggacccccagggccgcaucaucgccgucuucaagcccaagaacgaggagcccuacggccaccucaaccccaaguggaccaaguggcuccagaagcucugcugccccugcugcuucggccgcgacugccucguccucaaccagggcuaccucuccgaggccggcgccucccucgucgaccagaagcucgagcucaacaucgucccccgcaccaaggucgucuaccucgccuccgagaccuucaacuacuccgccaucgaccgcgucaagucccgcggcaagcgccucgcccucgagaagguccccaaggucggccagcgcuucaaccgcaucggccucccccccaaggucggcuccuuccagcucuucgucgagggcuacaaggacgccgacuacuggcuccgccgcuucgaggccgagccccuccccgagaacaccaaccgccagcuccuccuccaguucgagcgccucgucguccucgacuacaucauccgcaacaccgaccgcggcaacgacaacuggcucaucaaguacgacugccccauggacuccuccuccucccgcgacaccgacugggucgucgucaaggagcccgucaucaaggucgccgccaucgacaacggccucgccuucccccucaagcaccccgacuccuggcgcgccuaccccuucuacugggccuggcucccccaggccaagguccccuucucccaggagaucaaggaccucauccuccccaagaucuccgaccccaacuucgucaaggaccucgaggaggaccucuacgagcucuucaagaaggaccccggcuucgaccgcggccaguuccacaagcagaucgccgucaugcgcggccagauccucaaccucacccaggcccucaaggacaacaaguccccccuccaccucguccagaugccccccgucaucgucgagaccgcccgcucccaccagcgcuccuccuccgaguccuacacccaguccuuccagucccgcaagcccuucuucuccuggugguga

SEQ ID NO: 47614 - RNA, 1446 nt, Artificial Sequence
  derived and/or modified sequence opt2 from PI4K2B__Homo_sapiens__NP_060793
auggaggaccccuccgagcccgaccgccucgccuccgccgacggcggcucccccgaggaggaggaggacggcgagcgcgagccccuccucccccgcaucgccugggcccacccccgccgcggcgcccccggcuccgccguccgccuccucgacgccgccggcgaggagggcgaggccggcgacgaggagcucccccucccccccggcgacgucggcgucucccgcuccuccuccgccgagcucgaccgcucccgccccgccgucuccgucaccaucggcaccuccgagaugaacgccuuccucgacgaccccgaguucgccgacaucaugcuccgcgccgagcaggccaucgaggucggcaucuuccccgagcgcaucucccagggcuccuccggcuccuacuucgucaaggaccccaagcgcaagaucaucggcgucuucaagcccaaguccgaggagcccuacggccagcucaaccccaaguggaccaaguacguccacaaggucugcugccccugcugcuucggccgcggcugccucauccccaaccagggcuaccucuccgaggccggcgccuaccucgucgacaacaagcuccaccucuccaucguccccaagaccaaggucgucuggcucgucuccgagaccuucaacuacaacgccaucgaccgcgccaagucccgcggcaagaaguacgcccucgagaagguccccaaggucggccgcaaguuccaccgcaucggccucccccccaagaucggcuccuuccagcucuucgucgagggcuacaaggaggccgaguacuggcuccgcaaguucgaggccgacccccuccccgagaacauccgcaagcaguuccagucccaguucgagcgccucgucauccucgacuacaucauccgcaacaccgaccgcggcaacgacaacuggcucguccgcuacgagaagcagaagugcgagaaggagaucgaccacaaggaguccaaguggaucgacgacgaggaguuccucaucaagaucgccgccaucgacaacggccucgccuuccccuucaagcaccccgacgaguggcgcgccuaccccuuccacugggccuggcucccccaggccaagguccccuucuccgaggagauccgcaaccucauccuccccuacaucuccgacaugaacuucguccaggaccucugcgaggaccucuacgagcucuucaagaccgacaagggcuucgacaaggccaccuucgagucccagauguccgucaugcgcggccagauccucaaccucacccaggcccuccgcgacggcaagucccccuuccagcucguccagauccccugcgucaucgucgagcgcucccagggcggcucccagggccgcaucguccaccucuccaacuccuucacccagaccgucaacugccgcaagcccuucuucuccuccugguga

SEQ ID NO: 47615 - RNA, 6309 nt, Artificial Sequence
  derived and/or modified sequence opt2 from PI4KA__Homo_sapiens__NP_477352
auggccgccgcccccgcccgcggcggcggcggcggcggcggcggcggcggcggcugcuccggcuccggcuccuccgccucccgcggcuucuacuucaacaccguccucucccucgcccgcucccucgccguccagcgccccgccucccucgagaagguccagaagcuccucugcaugugccccgucgacuuccacggcaucuuccagcucgacgagcgccgccgcgacgccgucaucgcccucggcaucuuccucaucgaguccgaccuccagcacaaggacugcgucguccccuaccuccuccgccuccucaagggccuccccaaggucuacugggucgaggaguccaccgcccgcaagggccgcggcgcccuccccgucgccgaguccuucuccuucugccucgucacccuccucuccgacgucgccuaccgcgaccccucccuccgcgacgagauccucgagguccuccuccagguccuccacguccuccucggcaugugccaggcccucgagauccaggacaaggaguaccucugcaaguacgccauccccugccucaucggcaucucccgcgccuucggccgcuacuccaacauggaggagucccuccucuccaagcucuuccccaagauccccccccacucccuccgcguccucgaggagcucgagggcguccgccgccgcuccuucaacgacuuccgcuccauccuccccuccaaccuccucaccgucugccaggagggcacccucaagcgcaagaccuccuccgucuccuccaucucccaggucucccccgagcgcggcaugcccccccccuccucccccggcggcuccgccuuccacuacuucgaggccuccugccuccccgacggcaccgcccucgagcccgaguacuacuucuccaccaucuccuccuccuucuccgucuccccccucuucaacggcgucaccuacaaggaguucaacaucccccucgagaugcuccgcgagcuccucaaccucgucaagaagaucgucgaggaggccguccucaagucccucgacgccaucgucgccuccgucauggaggccaaccccuccgccgaccucuacuacaccuccuucuccgacccccucuaccucaccauguucaagaugcuccgcgacacccucuacuacaugaaggaccuccccaccuccuucgucaaggagauccacgacuucguccucgagcaguucaacaccucccagggcgagcuccagaagauccuccacgacgccgaccgcauccacaacgagcucuccccccucaagcuccgcugccaggccaacgccgccugcgucgaccucauggucugggccgucaaggacgagcagggcgccgagaaccucugcaucaagcucuccgagaagcuccaguccaagaccuccuccaaggucaucaucgcccaccucccccuccucaucugcugccuccagggccucggccgccucugcgagcgcuuccccgucgucguccacuccgucacccccucccuccgcgacuuccucgucauccccucccccguccucgucaagcucuacaaguaccacucccaguaccacaccgucgccggcaacgacaucaagaucuccgucaccaacgagcacuccgaguccacccucaacgucauguccggcaagaagucccagcccuccauguacgagcagcuccgcgacaucgccaucgacaacaucugccgcugccucaaggccggccucaccgucgaccccgucaucgucgaggccuuccucgccucccucuccaaccgccucuacaucucccaggaguccgacaaggacgcccaccucauccccgaccacaccauccgcgcccucggccacaucgccgucgcccuccgcgacacccccaaggucauggagcccauccuccagauccuccagcagaaguucugccagccccccuccccccucgacguccucaucaucgaccagcucggcugccucgucaucaccggcaaccaguacaucuaccaggaggucuggaaccucuuccagcagaucuccgucaaggccuccuccgucgucuacuccgccaccaaggacuacaaggaccacggcuaccgccacugcucccucgccgucaucaacgcccucgccaacaucgccgccaacauccaggacgagcaccucgucgacgagcuccucaugaaccuccucgagcucuucguccagcucggccucgagggcaagcgcgccuccgagcgcgccuccgagaagggccccgcccucaaggccuccuccuccgccggcaaccucggcguccucauccccgucaucgccguccucacccgccgccucccccccaucaaggaggccaagccccgccuccagaagcucuuccgcgacuucuggcucuacuccguccucaugggcuucgccgucgagggcuccggccucuggcccgaggagugguacgagggcgucugcgagaucgccaccaaguccccccuccucaccuuccccuccaaggagccccuccgcuccguccuccaguacaacuccgccaugaagaacgacaccgucacccccgccgagcucuccgagcuccgcuccaccaucaucaaccuccucgaccccccccccgaggucuccgcccucaucaacaagcucgacuucgccauguccaccuaccuccucuccgucuaccgccucgaguacaugcgcguccuccgcuccaccgaccccgaccgcuuccaggucauguucugcuacuucgaggacaaggccauccagaaggacaaguccggcaugaugcagugcgucaucgccgucgccgacaaggucuucgacgccuuccucaacaugauggccgacaaggccaagaccaaggagaacgaggaggagcucgagcgccacgcccaguuccuccucgucaacuucaaccacauccacaagcgcauccgccgcgucgccgacaaguaccucuccggccucgucgacaaguucccccaccuccucugguccggcaccguccucaagaccaugcucgacauccuccagacccucucccucucccucuccgccgacauccacaaggaccagcccuacuacgacauccccgacgcccccuaccgcaucaccguccccgacaccuacgaggcccgcgaguccaucgucaaggacuucgccgcccgcugcggcaugauccuccaggaggccaugaagugggcccccaccgucaccaagucccaccuccaggaguaccucaacaagcaccagaacugggucuccggccucucccagcacaccggccucgccauggccaccgaguccauccuccacuucgccggcuacaacaagcagaacaccacccucggcgccacccagcucuccgagcgccccgccugcgucaagaaggacuacuccaacuucauggccucccucaaccuccgcaaccgcuacgccggcgaggucuacggcaugauccgcuucuccggcaccaccggccagauguccgaccucaacaagaugaugguccaggaccuccacuccgcccucgaccgcucccacccccagcacuacacccaggccauguucaagcucaccgccaugcucaucuccuccaaggacugcgacccccagcuccuccaccaccucugcuggggcccccuccgcauguucaacgagcacggcauggagaccgcccucgccugcugggaguggcuccucgccggcaaggacggcgucgagguccccuucaugcgcgagauggccggcgccuggcacaugaccgucgagcagaaguucggccucuucuccgccgagaucaaggaggccgacccccucgccgccuccgaggccucccagcccaagcccugcccccccgaggucaccccccacuacaucuggaucgacuuccucguccagcgcuucgagaucgccaaguacugcuccuccgaccaggucgagaucuucuccucccuccuccagcgcuccaugucccucaacaucggcggcgccaagggcuccaugaaccgccacgucgccgccaucggcccccgcuucaagcuccucacccucggccucucccuccuccacgccgacgucguccccaacgccaccauccgcaacguccuccgcgagaagaucuacuccaccgccuucgacuacuucuccugcccccccaaguuccccacccagggcgagaagcgccuccgcgaggacaucuccaucaugaucaaguucuggaccgccauguucuccgacaagaaguaccucaccgccucccagcucgucccccccgacaaccaggacacccgcuccaaccucgacaucaccgucggcucccgccagcaggccacccagggcuggaucaacaccuacccccucuccuccggcauguccaccaucuccaagaaguccggcauguccaagaagaccaaccgcggcucccagcuccacaaguacuacaugaagcgccgcacccuccuccucucccuccucgccaccgagaucgagcgccucaucaccugguacaacccccucuccgcccccgagcucgagcucgaccaggccggcgagaacuccgucgccaacuggcgcuccaaguacaucucccucuccgagaagcaguggaaggacaacgucaaccucgccugguccaucucccccuaccucgccguccagcuccccgcccgcuucaagaacaccgaggccaucggcaacgaggucacccgccucguccgccucgaccccggcgccgucuccgacguccccgaggccaucaaguuccucgucaccuggcacaccaucgacgccgacgcccccgagcucucccacguccucugcugggcccccaccgacccccccaccggccucuccuacuucuccuccauguaccccccccacccccucaccgcccaguacggcgucaagguccuccgcuccuucccccccgacgccauccucuucuacaucccccagaucguccaggcccuccgcuacgacaagaugggcuacguccgcgaguacauccucugggccgccuccaagucccagcuccucgcccaccaguucaucuggaacaugaagaccaacaucuaccucgacgaggagggccaccagaaggaccccgacaucggcgaccuccucgaccagcucgucgaggagaucaccggcucccucuccggccccgccaaggacuucuaccagcgcgaguucgacuucuucaacaagaucaccaacgucuccgccaucaucaagcccuaccccaagggcgacgagcgcaagaaggccugccucuccgcccucuccgaggucaagguccagcccggcugcuaccuccccuccaaccccgaggccaucguccucgacaucgacuacaaguccggcacccccaugcaguccgccgccaaggcccccuaccucgccaaguucaaggucaagcgcugcggcgucuccgagcucgagaaggagggccuccgcugccgcuccgacuccgaggacgagugcuccacccaggaggccgacggccagaagaucuccuggcaggccgccaucuucaaggucggcgacgacugccgccaggacaugcucgcccuccagaucaucgaccucuucaagaacaucuuccagcucgucggccucgaccucuucgucuuccccuaccgcgucgucgccaccgcccccggcugcggcgucaucgagugcauccccgacugcaccucccgcgaccagcucggccgccagaccgacuucggcauguacgacuacuucacccgccaguacggcgacgaguccacccucgccuuccagcaggcccgcuacaacuucauccgcuccauggccgccuacucccuccuccucuuccuccuccagaucaaggaccgccacaacggcaacaucaugcucgacaagaagggccacaucauccacaucgacuucggcuucauguucgaguccucccccggcggcaaccucggcugggagcccgacaucaagcucaccgacgagauggucaugaucaugggcggcaagauggaggccacccccuucaagugguucauggagaugugcguccgcggcuaccucgccguccgccccuacauggacgccgucgucucccucgucacccucaugcucgacaccggccuccccugcuuccgcggccagaccaucaagcuccucaagcaccgcuucucccccaacaugaccgagcgcgaggccgccaacuucaucaugaaggucauccaguccugcuuccucuccaaccgcucccgcaccuacgacaugauccaguacuaccagaacgacauccccuacuga

SEQ ID NO: 47616 - RNA, 2406 nt, Artificial Sequence
  derived and/or modified sequence opt2 from PI4KB__Homo_sapiens__NP_001185703
augggcgacaccgucgucgagcccgccccccucaagcccaccuccgagcccaccuccggcccccccggcaacaacggcggcucccuccucuccgucaucaccgagggcgucggcgagcucuccgucaucgaccccgaggucgcccagaaggccugccaggagguccucgagaaggucaagcuccuccacggcggcgucgccgucuccucccgcggcaccccccucgagcucgucaacggcgacggcgucgacuccgagauccgcugccucgacgacccccccgcccagauccgcgaggaggaggacgagaugggcgccgccgucgccuccggcaccgccaagggcgcccgccgccgccgccagaacaacuccgccaagcaguccuggcuccuccgccucuucgaguccaagcucuucgacaucuccauggccaucuccuaccucuacaacuccaaggagcccggcguccaggccuacaucggcaaccgccucuucugcuuccgcaacgaggacgucgacuucuaccucccccagcuccucaacauguacauccacauggacgaggacgucggcgacgccaucaagcccuacaucguccaccgcugccgccaguccaucaacuucucccuccagugcgcccuccuccucggcgccuacuccuccgacaugcacaucuccacccagcgccacucccgcggcaccaagcuccgcaagcucauccucuccgacgagcucaagcccgcccaccgcaagcgcgagcuccccucccucucccccgcccccgacaccggccucucccccuccaagcgcacccaccagcgcuccaaguccgacgccaccgccuccaucucccucuccuccaaccucaagcgcaccgccuccaaccccaaggucgagaacgaggacgagcccguccgccucgcccccgagcgcgaguucaucaagucccucauggccaucggcaagcgccucgccacccuccccaccaaggagcagaagacccagcgccucaucuccgagcucucccuccucaaccacaagcuccccgcccgcgucuggcuccccaccgccggcuucgaccaccacgucguccgcgucccccacacccaggccgucguccucaacuccaaggacaaggcccccuaccucaucuacgucgagguccucgagugcgagaacuucgacaccaccuccguccccgcccgcauccccgagaaccgcauccgcuccacccgcuccgucgagaaccuccccgagugcggcaucacccacgagcagcgcgccggcuccuucuccaccguccccaacuacgacaacgacgacgaggccugguccgucgacgacaucggcgagcuccaggucgagcuccccgagguccacaccaacuccugcgacaacaucucccaguucuccgucgacuccaucaccucccaggaguccaaggagcccgucuucaucgccgccggcgacauccgccgccgccucuccgagcagcucgcccacacccccaccgccuucaagcgcgaccccgaggaccccuccgccgucgcccucaaggagcccuggcaggagaagguccgccgcauccgcgagggcucccccuacggccaccuccccaacuggcgccuccucuccgucaucgucaagugcggcgacgaccuccgccaggagcuccucgccuuccagguccucaagcagcuccaguccaucugggagcaggagcgcgucccccucuggaucaagcccuacaagauccucgucaucuccgccgacuccggcaugaucgagcccgucgucaacgccgucuccauccaccaggucaagaagcagucccagcucucccuccucgacuacuuccuccaggagcacggcuccuacaccaccgaggccuuccucuccgcccagcgcaacuucguccaguccugcgccggcuacugccucgucugcuaccuccuccaggucaaggaccgccacaacggcaacauccuccucgacgccgagggccacaucauccacaucgacuucggcuucauccucuccuccuccccccgcaaccucggcuucgagaccuccgccuucaagcucaccaccgaguucgucgacgucaugggcggccucgacggcgacauguucaacuacuacaagaugcucaugcuccagggccucaucgccgcccgcaagcacauggacaaggucguccagaucgucgagaucaugcagcagggcucccagcuccccugcuuccacggcuccuccaccauccgcaaccucaaggagcgcuuccacauguccaugaccgaggagcagcuccagcuccucgucgagcagauggucgacggcuccaugcgcuccaucaccaccaagcucuacgacggcuuccaguaccucaccaacggcaucauguga

SEQ ID NO: 47617 - RNA, 1956 nt, Artificial Sequence
  derived and/or modified sequence opt2 from PIAS1__Homo_sapiens__NP_057250
auggccgacuccgccgagcucaagcagauggucaugucccuccgcgucuccgagcuccagguccuccucggcuacgccggccgcaacaagcacggccgcaagcacgagcuccucaccaaggcccuccaccuccucaaggccggcugcucccccgccguccagaugaagaucaaggagcucuaccgccgccgcuucccccagaagaucaugacccccgccgaccucuccauccccaacguccacuccucccccaugcccgccacccucucccccuccaccaucccccagcucaccuacgacggccaccccgccuccuccccccuccuccccgucucccuccucggccccaagcacgagcucgagcucccccaccucaccuccgcccuccaccccguccaccccgacaucaagcuccagaagcuccccuucuacgaccuccucgacgagcucaucaagcccaccucccucgccuccgacaacucccagcgcuuccgcgagaccugcuucgccuucgcccucaccccccagcagguccagcagaucuccuccuccauggacaucuccggcaccaagugcgacuucaccguccagguccagcuccgcuucugccucuccgagaccuccugcccccaggaggaccacuucccccccaaccucugcgucaaggucaacaccaagcccugcucccuccccggcuaccucccccccaccaagaacggcgucgagcccaagcgccccucccgccccaucaacaucaccucccucguccgccucuccaccaccguccccaacaccaucgucgucuccuggaccgccgagaucggccgcaacuacuccauggccgucuaccucgucaagcagcucuccuccaccguccuccuccagcgccuccgcgccaagggcauccgcaaccccgaccacucccgcgcccucaucaaggagaagcucaccgccgaccccgacuccgagaucgccaccaccucccuccgcgucucccuccucugcccccucggcaagaugcgccucaccauccccugccgcgcccucaccugcucccaccuccagugcuucgacgccacccucuacauccagaugaacgagaagaagcccaccugggucugccccgucugcgacaagaaggcccccuacgagcaccucaucaucgacggccucuucauggagauccucaaguacugcaccgacugcgacgagauccaguucaaggaggacggcaccugggcccccaugcgcuccaagaaggagguccaggaggucuccgccuccuacaacggcgucgacggcugccucuccuccacccucgagcaccaggucgccucccaccaccaguccuccaacaagaacaagaaggucgaggucaucgaccucaccaucgacuccuccuccgacgaggaggaggaggagcccuccgccaagcgcaccugccccucccucucccccaccuccccccucaacaacaagggcauccucucccucccccaccaggccucccccgucucccgcacccccucccuccccgccgucgacaccuccuacaucaacaccucccucauccaggacuaccgccaccccuuccacaugacccccaugcccuacgaccuccagggccucgacuucuuccccuuccucuccggcgacaaccagcacuacaacaccucccuccucgccgccgccgccgccgccgucuccgacgaccaggaccuccuccacuccucccgcuucuuccccuacaccuccucccagauguuccucgaccagcucuccgccggcggcuccaccucccuccccaccaccaacggcuccuccuccggcuccaacuccucccucgucuccuccaacucccuccgcgagucccacucccacaccgucaccaaccgcuccuccaccgacaccgccuccaucuucggcaucauccccgacaucaucucccucgacuga

SEQ ID NO: 47618 - RNA, 1866 nt, Artificial Sequence
  derived and/or modified sequence opt2 from PIAS2__Homo_sapiens__NP_004662
auggccgacuucgaggagcuccgcaacauggucuccuccuuccgcgucuccgagcuccagguccuccucggcuucgccggccgcaacaaguccggccgcaagcacgaccuccucaugcgcgcccuccaccuccucaaguccggcugcucccccgccguccagaucaagauccgcgagcucuaccgccgccgcuacccccgcacccucgagggccucuccgaccucuccaccaucaaguccuccgucuucucccucgacggcggcuccucccccgucgagcccgaccucgccgucgccggcauccacucccuccccuccaccuccgucaccccccacucccccuccucccccgucggcuccguccuccuccaggacaccaagcccaccuucgagaugcagcagcccuccccccccaucccccccguccaccccgacguccagcucaagaaccuccccuucuacgacguccucgacguccucaucaagcccaccucccucguccaguccuccauccagcgcuuccaggagaaguucuucaucuucgcccucaccccccagcagguccgcgagaucugcaucucccgcgacuuccuccccggcggccgccgcgacuacaccguccagguccagcuccgccucugccucgccgagaccuccugcccccaggaggacaacuaccccaacucccucugcaucaaggucaacggcaagcucuucccccuccccggcuacgcccccccccccaagaacggcaucgagcagaagcgccccggccgcccccucaacaucaccucccucguccgccucuccuccgccguccccaaccagaucuccaucuccugggccuccgagaucggcaagaacuacuccauguccgucuaccucguccgccagcucaccuccgccaugcuccuccagcgccucaagaugaagggcauccgcaaccccgaccacucccgcgcccucaucaaggagaagcucaccgccgaccccgacuccgagaucgccaccaccucccuccgcgucucccucaugugcccccucggcaagaugcgccucaccauccccugccgcgccgucaccugcacccaccuccagugcuucgacgccgcccucuaccuccagaugaacgagaagaagcccaccuggaucugccccgucugcgacaagaaggccgccuacgagucccucauccucgacggccucuucauggagauccucaacgacugcuccgacgucgacgagaucaaguuccaggaggacggcuccuggugccccaugcgccccaagaaggaggccaugaaggucuccucccagcccugcaccaagaucgaguccuccuccguccucuccaagcccugcuccgucaccgucgccuccgaggccuccaagaagaaggucgacgucaucgaccucaccaucgaguccuccuccgacgaggaggaggacccccccgccaagcgcaagugcaucuucauguccgagacccaguccucccccaccaagggcguccucauguaccagcccuccuccguccgcguccccuccgucaccuccgucgaccccgccgccaucccccccucccucaccgacuacuccguccccuuccaccacacccccaucuccuccauguccuccgaccuccccggccucgacuuccucucccucauccccgucgacccccaguacugcccccccauguuccucgacucccucaccuccccccucaccgccuccuccaccuccgucaccaccaccuccucccacgaguccuccacccacgucuccuccuccuccucccgcuccgagaccggcgucaucaccuccuccggcuccaacauccccgacaucaucucccucgacuga

SEQ ID NO: 47619 - RNA, 1533 nt, Artificial Sequence
  derived and/or modified sequence opt2 from PIAS4__Homo_sapiens__NP_056981
auggccgccgagcucgucgaggccaagaacauggucauguccuuccgcgucuccgaccuccagaugcuccucggcuucgucggccgcuccaaguccggccucaagcacgagcucgucacccgcgcccuccagcucguccaguucgacugcucccccgagcucuucaagaagaucaaggagcucuacgagacccgcuacgccaagaagaacuccgagcccgccccccagccccaccgcccccucgacccccucaccaugcacuccaccuacgaccgcgccggcgccgucccccgcaccccccucgccggccccaacaucgacuaccccguccucuacggcaaguaccucaacggccucggccgccuccccgccaagacccucaagcccgagguccgccucgucaagcuccccuucuucaacaugcucgacgagcuccucaagcccaccgagcucgucccccagaacaacgagaagcuccaggagucccccugcaucuucgcccucaccccccgccaggucgagcucauccgcaacucccgcgagcuccagcccggcgucaaggccguccaggucguccuccgcaucugcuacuccgacaccuccugcccccaggaggaccaguacccccccaacaucgccgucaaggucaaccacuccuacugcuccguccccggcuacuaccccuccaacaagcccggcgucgagcccaagcgccccugccgccccaucaaccucacccaccucauguaccucuccuccgccaccaaccgcaucaccgucaccuggggcaacuacggcaaguccuacuccgucgcccucuaccucguccgccagcucaccuccuccgagcuccuccagcgccucaagaccaucggcgucaagcaccccgagcucugcaaggcccucgucaaggagaagcuccgccucgaccccgacuccgagaucgccaccaccggcguccgcgucucccucaucugcccccucgucaagaugcgccucuccguccccugccgcgccgagaccugcgcccaccuccagugcuucgacgccgucuucuaccuccagaugaacgagaagaagcccaccuggaugugccccgucugcgacaagcccgcccccuacgaccagcucaucaucgacggccuccucuccaagauccucuccgagugcgaggacgccgacgagaucgaguaccucgucgacggcuccuggugccccauccgcgccgagaaggagcgcuccugcuccccccagggcgccauccucguccucggccccuccgacgccaacggccuccuccccgcccccuccgucaacggcuccggcgcccucggcuccaccggcggcggcggccccgucggcuccauggagaacggcaagcccggcgccgacgucgucgaccucacccucgacuccuccuccuccuccgaggacgaggaggaggaggaggaggaggaggaggacgaggacgaggagggcccccgccccaagcgccgcugccccuuccagaagggccucguccccgccugcuga

SEQ ID NO: 47620 - RNA, 2274 nt, Artificial Sequence
  derived and/or modified sequence opt2 from PIBF1__Homo_sapiens__NP_006337
augucccgcaagaucuccaaggaguccaagaaggucaacaucuccuccucccucgaguccgaggacaucucccucgagaccaccguccccaccgacgacaucuccuccuccgaggagcgcgagggcaagguccgcaucacccgccagcucaucgagcgcaaggagcuccuccacaacauccagcuccucaagaucgagcucucccagaagaccaugaugaucgacaaccucaaggucgacuaccucaccaagaucgaggagcucgaggagaagcucaacgacgcccuccaccagaagcagcuccucacccuccgccucgacaaccagcucgccuuccagcagaaggacgccuccaaguaccaggagcucaugaagcaggagauggagaccauccuccuccgccagaagcagcucgaggagaccaaccuccagcuccgcgagaaggccggcgacguccgccgcaaccuccgcgacuucgagcucaccgaggagcaguacaucaagcucaaggccuuccccgaggaccagcucuccauccccgaguacgucuccguccgcuucuacgagcucgucaacccccuccgcaaggagaucugcgagcuccaggucaagaagaacauccucgccgaggagcucuccaccaacaagaaccagcucaagcagcucaccgagaccuacgaggaggaccgcaagaacuacuccgagguccagauccgcugccagcgccucgcccucgagcucgccgacaccaagcagcucauccagcagggcgacuaccgccaggagaacuacgacaaggucaaguccgagcgcgacgcccucgagcaggaggucaucgagcuccgccgcaagcacgagauccucgaggccucccacaugauccagaccaaggagcgcuccgagcucuccaaggaggucgucacccucgagcagaccgucacccuccuccagaaggacaaggaguaccucaaccgccagaacauggagcucuccguccgcugcgcccacgaggaggaccgccucgagcgccuccaggcccagcucgaggaguccaagaaggcccgcgaggagauguacgagaaguacgucgccucccgcgaccacuacaagaccgaguacgagaacaagcuccacgacgagcucgagcagauccgccucaagaccaaccaggagaucgaccagcuccgcaacgccucccgcgagauguacgagcgcgagaaccgcaaccuccgcgaggcccgcgacaacgccgucgccgagaaggagcgcgccgucauggccgagaaggacgcccucgagaagcacgaccagcuccucgaccgcuaccgcgagcuccagcucuccaccgaguccaaggucaccgaguuccuccaccaguccaagcucaaguccuucgaguccgagcgcguccagcuccuccaggaggagaccgcccgcaaccucacccagugccagcucgagugcgagaaguaccagaagaagcucgagguccucaccaaggaguucuacucccuccaggccuccuccgagaagcgcaucaccgagcuccaggcccagaacuccgagcaccaggcccgccucgacaucuacgagaagcucgagaaggagcucgacgagaucaucaugcagaccgccgagaucgagaacgaggacgaggccgagcgcguccucuucuccuacggcuacggcgccaacguccccaccaccgccaagcgccgccucaagcaguccguccaccucgcccgccgcguccuccagcucgagaagcagaacucccucauccucaaggaccucgagcaccgcaaggaccaggucacccagcucucccaggagcucgaccgcgccaacucccuccucaaccagacccagcagcccuaccgcuaccucaucgaguccguccgccagcgcgacuccaagaucgacucccucaccgaguccaucgcccagcucgagaaggacgucuccaaccucaacaaggagaaguccgcccuccuccagaccaagaaccagauggcccucgaccucgagcagcuccucaaccaccgcgaggagcucgccgccaugaagcagauccucgucaagaugcacuccaagcacuccgagaacucccuccuccucaccaagaccgagcccaagcacgucaccgagaaccagaaguccaagacccucaacguccccaaggagcacgaggacaacaucuucacccccaagcccacccucuucaccaagaaggaggcccccgagugguccaagaagcagaagaugaagaccuga

SEQ ID NO: 47621 - RNA, 1833 nt, Artificial Sequence
  derived and/or modified sequence opt2 from PICALM__Homo_sapiens__NP_001008660
auguccggccagucccucaccgaccgcaucaccgccgcccagcacuccgucaccggcuccgccgucuccaagaccgucugcaaggccaccacccacgagaucaugggccccaagaagaagcaccucgacuaccucauccagugcaccaacgagaugaacgucaacaucccccagcucgccgacucccucuucgagcgcaccaccaacuccuccugggucgucgucuucaagucccucaucaccacccaccaccucauggucuacggcaacgagcgcuucauccaguaccucgccucccgcaacacccucuucaaccucuccaacuuccucgacaaguccggccuccagggcuacgacauguccaccuucauccgccgcuacucccgcuaccucaacgagaaggccgucuccuaccgccaggucgccuucgacuucaccaaggucaagcgcggcgccgacggcgucaugcgcaccaugaacaccgagaagcuccucaagaccguccccaucauccagaaccagauggacgcccuccucgacuucaacgucaacuccaacgagcucaccaacggcgucaucaacgccgccuucaugcuccucuucaaggacgccauccgccucuucgccgccuacaacgagggcaucaucaaccuccucgagaaguacuucgacaugaagaagaaccagugcaaggagggccucgacaucuacaagaaguuccucacccgcaugacccgcaucuccgaguuccucaaggucgccgagcaggucggcaucgaccgcggcgacauccccgaccucucccaggcccccuccucccuccucgacgcccucgagcagcaccucgccucccucgagggcaagaagaucaaggacuccaccgccgccucccgcgccaccacccucuccaacgccgucuccucccucgccuccaccggccucucccucaccaaggucgacgagcgcgagaagcaggccgcccucgaggaggagcaggcccgccucaaggcccucaaggagcagcgccucaaggagcucgccaagaagccccacaccucccucaccaccgccgccucccccgucuccaccuccgccggcggcaucaugaccgcccccgccaucgacaucuucuccacccccuccuccuccaacuccaccuccaagcuccccaacgaccuccucgaccuccagcagcccaccuuccaccccuccguccaccccauguccaccgccucccaggucgccuccaccuggggcggcuucacccccucccccgucgcccagccccaccccuccgccggccucaacgucgacuucgaguccgucuucggcaacaaguccaccaacgucaucgucgacuccggcggcuucgacgagcucggcggccuccucaagcccaccgucgccucccagaaccagaaccuccccgucgccaagcucccccccuccaagcucgucuccgacgaccucgacuccucccucgccaaccucgucggcaaccucggcaucggcaacggcaccaccaagaacgacgucaacuggucccagcccggcgagaagaagcucaccggcggcuccaacuggcagcccaaggucgcccccaccaccgccuggaacgccgccaccaugaacggcaugcacuucccccaguacgccccccccgucauggccuaccccgccaccacccccaccggcaugaucggcuacggcauccccccccagaugggcuccguccccgucaugacccagcccacccucaucuacucccagcccgucaugcgcccccccaaccccuucggccccgucuccggcgcccagauccaguucauguga

SEQ ID NO: 47622 - RNA, 1248 nt, Artificial Sequence
  derived and/or modified sequence opt2 from PICK1__Homo_sapiens__NP_001034673
auguucgccgaccucgacuacgacaucgaggaggacaagcucggcauccccaccguccccggcaaggucacccuccagaaggacgcccagaaccucaucggcaucuccaucggcggcggcgcccaguacugccccugccucuacaucguccaggucuucgacaacacccccgccgcccucgacggcaccgucgccgccggcgacgagaucaccggcgucaacggccgcuccaucaagggcaagaccaaggucgaggucgccaagaugauccaggaggucaagggcgaggucaccauccacuacaacaagcuccaggccgaccccaagcagggcaugucccucgacaucguccucaagaaggucaagcaccgccucgucgagaacauguccuccggcaccgccgacgcccucggccucucccgcgccauccucugcaacgacggccucgucaagcgccucgaggagcucgagcgcaccgccgagcucuacaagggcaugaccgagcacaccaagaaccuccuccgcgccuucuacgagcucucccagacccaccgcgccuucggcgacgucuucuccgucaucggcguccgcgagccccagcccgccgccuccgaggccuucgucaaguucgccgacgcccaccgcuccaucgagaaguucggcauccgccuccucaagaccaucaagcccaugcucaccgaccucaacaccuaccucaacaaggccauccccgacacccgccucaccaucaagaaguaccucgacgucaaguucgaguaccucuccuacugccucaaggucaaggagauggacgacgaggaguacuccugcaucgcccucggcgagccccucuaccgcgucuccaccggcaacuacgaguaccgccucauccuccgcugccgccaggaggcccgcgcccgcuucucccagaugcgcaaggacguccucgagaagauggagcuccucgaccagaagcacguccaggacaucgucuuccagcuccagcgccucgucuccaccauguccaaguacuacaacgacugcuacgccguccuccgcgacgccgacgucuuccccaucgaggucgaccucgcccacaccacccucgccuacggccucaaccaggaggaguucaccgacggcgaggaggaggaggaggaggaggacaccgccgccggcgagcccucccgcgacacccgcggcgccgccggcccccucgacaagggcggcuccuggugcgacuccuga

SEQ ID NO: 47623 - RNA, 654 nt, Artificial Sequence
  derived and/or modified sequence opt2 from PID1__Homo_sapiens__NP_001094288
auguggcagcccgccaccgagcgccuccagcacuuccagaccaugcucaaguccaagcucaacguccucacccucaagaaggagccccuccccgccgucaucuuccacgagcccgaggccaucgagcucugcaccaccaccccccucaugaagacccgcacccacuccggcugcaaggucaccuaccucggcaaggucuccaccaccggcaugcaguuccucuccggcugcaccgagaagcccgucaucgagcucuggaagaagcacacccucgcccgcgaggacgucuuccccgccaacgcccuccucgagauccgccccuuccaggucuggcuccaccaccucgaccacaagggcgaggccaccguccacauggacaccuuccaggucgcccgcaucgccuacugcaccgccgaccacaacgucucccccaacaucuucgccugggucuaccgcgagaucaacgacgaccucuccuaccagauggacugccacgccgucgagugcgaguccaagcucgaggccaagaagcucgcccacgccaugauggaggccuuccgcaagaccuuccacuccaugaaguccgacggccgcauccacuccaacuccuccuccgaggaggucucccaggagcucgaguccgacgacggcuga

SEQ ID NO: 47624 - RNA, 2763 nt, Artificial Sequence
  derived and/or modified sequence opt2 from PIDD1__Homo_sapiens__XP_011518511
augcagcucccccgcgcccuccccggccaggccugccuccgcgccggcaccugccucgccuccaaggaccgccgcugggccauggccgccaccgucgagggccccgagcucgaggccgccgccgccgccggcgacgccuccgaggacuccgacgccggcucccgcgcccuccccuuccucggcggcaaccgccucucccucgaccucuaccccggcggcugccagcagcuccuccaccucugcguccagcagccccuccagcuccuccaggucgaguuccuccgccucuccacccacgaggacccccagcuccucgaggccacccucgcccagcucccccagucccucuccugccuccgcucccucguccucaagggcggccagcgccgcgacacccucggcgccugccuccgcggcgcccucaccaaccuccccgccggccucuccggccucgcccaccucgcccaccucgaccucuccuucaacucccucgagacccuccccgccugcguccuccagaugcgcggccucggcgcccuccuccucucccacaacugccucuccgagcuccccgaggcccucggcgcccuccccgcccucaccuuccucaccgucacccacaaccgccuccagacccucccccccgcccucggcgcccucuccacccuccagcgccucgaccucucccagaaccuccucgacacccucccccccgagaucggcggccucggcucccuccucgagcucaaccucgccuccaaccgccuccagucccuccccgccucccucgccggccuccgcucccuccgccuccucguccuccacuccaaccuccucgccuccguccccgccgaccucgcccgccucccccuccucacccgccucgaccuccgcgacaaccagcuccgcgaccucccccccgagcuccucgacgcccccuucguccgccuccagggcaacccccucggcgaggccucccccgacgcccccuccucccccgucgccgcccucauccccgagaugccccgccucuuccucaccuccgaccucgacuccuuccccgucaccccccagggcugcuccgucacccucgccugcggcguccgccuccaguuccccgccggcgccaccgccacccccaucaccauccgcuaccgccuccuccuccccgagcccggccucgucccccucggcccccacgacgcccuccucucccacguccucgagcuccagccccacggcgucgccuuccagcaggacgucggccucuggcuccucuucacccccccccaggcccgccgcugccgcgaggucgucguccgcacccgcaacgacaacuccuggggcgaccucgagaccuaccucgaggaggaggccccccagcgccucugggcccacugccaggucccccacuucuccugguuccucgucgucucccgccccgucuccaacgccugccucgucccccccgagggcacccuccucugcuccuccggccaccccggcgucaaggucaucuucccccccggcgccaccgaggagccccgccgcgucuccaugcaggucguccgcauggccggccgcgagcuccaggcccuccucggcgagcccgaggccgccgucuccccccuccucugccucucccaguccggcccccccuccuuccuccagcccgucaccguccagcucccccuccccuccggcaucaccggccucucccucgaccgcucccgccuccaccuccucuacugggccccccccgccgccaccugggacgacaucaccgcccaggucguccucgagcucacccaccucuacgcccgcuuccaggucacccacuucuccugguacuggcucugguacaccaccaagaacugcgucggcggccucgcccgcaaggccugggagcgccuccgccuccaccgcgucaaccucaucgcccuccagcgccgccgcgaccccgagcagguccuccuccagugccucccccgcaacaaggucgacgccacccuccgccgccuccucgagcgcuaccgcggccccgagcccuccgacaccgucgagauguucgagggcgaggaguucuucgccgccuucgagcgcggcaucgacgucgacgccgaccgccccgacugcgucgagggccgcaucugcuucgucuucuacucccaccucaagaacgucaaggaggucuccuucuaccgcggcgccguccccguccgcguccccgaggaggccgaggccgcccgccagcgcaagggcgccgacgcccucuggauggccacccuccccaucaagcucccccgccuccgcggcuccgagggcccccgccgcggcgccggccucucccucgccccccucaaccucggcgacgccgagaccggcuuccucacccaguccaaccuccucuccgucgccggccgccucggccucgacuggcccgccgucgcccuccaccucggcgucuccuaccgcgagguccagcgcauccgccacgaguuccgcgacgaccucgacgagcagauccgccacaugcucuucuccugggccgagcgccaggccggccagcccggcgccgucggccuccucguccaggcccucgagcaguccgaccgccaggacgucgccgaggagguccgcgccguccucgagcucggccgccgcaaguaccaggacuccauccgccgcaugggccucgcccccaaggaccccgcccuccccggcuccuccgccccccagccccccgagcccgcccaggccuga

SEQ ID NO: 47625 - RNA, 7566 nt, Artificial Sequence
  derived and/or modified sequence opt2 from PIEZO1__Homo_sapiens__NP_001136336
auggagccccacguccucggcgccguccucuacuggcuccuccuccccugcgcccuccucgccgccugccuccuccgcuucuccggccucucccucgucuaccuccucuuccuccuccuccuccccugguuccccggccccacccgcugcggccuccagggccacaccggccgccuccuccgcgcccuccucggccucucccuccucuuccucgucgcccaccucgcccuccagaucugccuccacaucgucccccgccucgaccagcuccucggccccuccugcucccgcugggagacccucucccgccacaucggcgucacccgccucgaccucaaggacauccccaacgccauccgccucgucgcccccgaccucggcauccucgucgucuccuccgucugccucggcaucugcggccgccucgcccgcaacacccgccaguccccccacccccgcgagcucgacgacgacgagcgcgacgucgacgccucccccaccgccggccuccaggaggccgccacccucgcccccacccgccgcucccgccucgccgcccgcuuccgcgucaccgcccacuggcuccucgucgccgccggccgcguccucgccgucacccuccucgcccucgccggcaucgcccaccccuccgcccucuccuccgucuaccuccuccucuuccucgcccucugcaccuggugggccugccacuuccccaucuccacccgcggcuucucccgccucugcgucgccgucggcugcuucggcgccggccaccucaucugccucuacugcuaccagaugccccucgcccaggcccuccucccccccgccggcaucugggcccgcguccucggccucaaggacuucgucggccccaccaacugcuccuccccccacgcccucguccucaacaccggccucgacuggcccgucuacgccucccccggcguccuccuccuccucugcuacgccaccgccucccuccgcaagcuccgcgccuaccgccccuccggccagcgcaaggaggccgccaagggcuacgaggcccgcgagcucgagcucgccgagcucgaccaguggccccaggagcgcgaguccgaccagcacgucguccccaccgcccccgacaccgaggccgacaacugcaucguccacgagcucaccggccaguccuccguccuccgccgccccguccgccccaagcgcgccgagccccgcgaggccuccccccuccacucccucggccaccucaucauggaccaguccuacgucugcgcccucaucgccaugauggucugguccaucaccuaccacuccuggcucaccuucguccuccuccucugggccugccucaucuggaccguccgcucccgccaccagcucgccaugcucugcucccccugcauccuccucuacggcaugacccucugcugccuccgcuacgucugggccauggaccuccgccccgagcuccccaccacccucggccccgucucccuccgccagcucggccucgagcacacccgcuaccccugccucgaccucggcgccaugcuccucuacacccucaccuucuggcuccuccuccgccaguucgucaaggagaagcuccucaagugggccgagucccccgccgcccucaccgaggucaccgucgccgacaccgagcccacccgcacccagacccuccuccagucccucggcgagcucgucaagggcgucuacgccaaguacuggaucuacgucugcgccggcauguucaucgucgucuccuucgccggccgccucgucgucuacaagaucgucuacauguuccucuuccuccucugccucacccucuuccaggucuacuacucccucuggcgcaagcuccucaaggccuucugguggcucgucgucgccuacaccaugcucguccucaucgccgucuacaccuuccaguuccaggacuuccccgccuacuggcgcaaccucaccggcuucaccgacgagcagcucggcgaccucggccucgagcaguucuccgucuccgagcucuucuccuccauccucguccccggcuucuuccuccucgccugcauccuccagcuccacuacuuccaccgccccuucaugcagcucaccgacauggagcacgucucccuccccggcacccgccucccccgcugggcccaccgccaggacgccgucuccggcaccccccuccuccgcgaggagcagcaggagcaccagcagcagcagcaggaggaggaggaggaggaggaggacucccgcgacgagggccucggcgucgccaccccccaccaggccacccagguccccgagggcgccgccaaguggggccucgucgccgagcgccuccucgagcucgccgccggcuucuccgacguccucucccgcguccaggucuuccuccgccgccuccucgagcuccacgucuucaagcucgucgcccucuacaccgucugggucgcccucaaggaggucuccgucaugaaccuccuccucgucguccucugggccuucgcccuccccuacccccgcuuccgccccauggccuccugccucuccaccgucuggaccugcgucaucaucgucugcaagaugcucuaccagcucaaggucgucaacccccaggaguacuccuccaacugcaccgagcccuuccccaacuccaccaaccuccuccccaccgagaucucccagucccuccucuaccgcggccccgucgaccccgccaacugguucggcguccgcaagggcuuccccaaccucggcuacauccagaaccaccuccagguccuccuccuccucgucuucgaggccaucgucuaccgccgccaggagcacuaccgccgccagcaccagcucgccccccuccccgcccaggccgucuucgccuccggcacccgccagcagcucgaccaggaccuccucggcugccucaaguacuucaucaacuucuucuucuacaaguucggccucgagaucugcuuccucauggccgucaacgucaucggccagcgcaugaacuuccucgucacccuccacggcugcuggcucgucgccauccucacccgccgccaccgccaggccaucgcccgccucuggcccaacuacugccucuuccucgcccucuuccuccucuaccaguaccuccucugccucggcaugccccccgcccucugcaucgacuaccccuggcgcuggucccgcgccguccccaugaacuccgcccucaucaaguggcucuaccuccccgacuucuuccgcgcccccaacuccaccaaccucaucuccgacuuccuccuccuccucugcgccucccagcaguggcaggucuucuccgccgagcgcaccgaggaguggcagcgcauggccggcgucaacaccgaccgccucgagccccuccgcggcgagcccaaccccguccccaacuucauccacugccgcuccuaccucgacaugcucaaggucgccgucuuccgcuaccucuucuggcucguccucgucgucgucuucgucaccggcgccacccgcaucuccaucuucggccucggcuaccuccucgccugcuucuaccuccuccucuucggcaccgcccuccuccagcgcgacacccgcgcccgccucguccucugggacugccucauccucuacaacgucaccgucaucaucuccaagaacaugcucucccuccucgccugcgucuucgucgagcagaugcagaccggcuucugcugggucauccagcucuucucccucgucugcaccgucaagggcuacuacgaccccaaggagaugauggaccgcgaccaggacugccuccuccccgucgaggaggccggcaucaucugggacuccgucugcuucuucuuccuccuccuccagcgccgcgucuuccucucccacuacuaccuccacguccgcgccgaccuccaggccaccgcccuccucgccucccgcggcuucgcccucuacaacgccgccaaccucaaguccaucgacuuccaccgccgcaucgaggagaagucccucgcccagcucaagcgccagauggagcgcauccgcgccaagcaggagaagcaccgccagggccgcgucgaccgcucccgcccccaggacacccucggccccaaggaccccggccucgagcccggccccgacucccccggcggcuccucccccccccgccgccagugguggcgccccuggcucgaccacgccaccgucauccacuccggcgacuacuuccucuucgaguccgacuccgaggaggaggaggaggccguccccgaggacccccgccccuccgcccaguccgccuuccagcucgccuaccaggccugggucaccaacgcccaggccguccuccgccgccgccagcaggagcaggagcaggcccgccaggagcaggccggccagcuccccaccggcggcggccccucccaggaggucgagcccgccgagggccccgaggaggccgccgccggccgcucccacgucguccagcgcguccucuccaccgcccaguuccucuggaugcucggccaggcccucgucgacgagcucacccgcuggcuccaggaguucacccgccaccacggcaccauguccgacguccuccgcgccgagcgcuaccuccucacccaggagcuccuccagggcggcgagguccaccgcggcguccucgaccagcucuacaccucccaggccgaggccacccuccccggccccaccgaggcccccaacgcccccuccaccgucuccuccggccucggcgccgaggagccccucuccuccaugaccgacgacaugggcuccccccucuccaccggcuaccacacccgcuccggcuccgaggaggccgucaccgaccccggcgagcgcgaggccggcgccucccucuaccagggccucaugcgcaccgccuccgagcuccuccucgaccgccgccuccgcauccccgagcucgaggaggccgagcucuucgccgagggccagggccgcgcccuccgccuccuccgcgccgucuaccagugcgucgccgcccacuccgagcuccucugcuacuucaucaucauccucaaccacauggucaccgccuccgccggcucccucguccuccccguccucgucuuccucugggccaugcucuccaucccccgccccuccaagcgcuucuggaugaccgccaucgucuucaccgagaucgccgucgucgucaaguaccucuuccaguucggcuucuuccccuggaacucccacgucguccuccgccgcuacgagaacaagcccuacuuccccccccgcauccucggccucgagaagaccgacggcuacaucaaguacgaccucguccagcucauggcccucuucuuccaccgcucccagcuccucugcuacggccucugggaccacgaggaggacucccccuccaaggagcacgacaaguccggcgaggaggagcagggcgccgaggagggccccggcguccccgccgccaccaccgaggaccacauccaggucgaggcccgcgucggccccaccgacggcacccccgagccccaggucgagcuccgcccccgcgacacccgccgcaucucccuccgcuuccgccgccgcaagaaggagggccccgcccgcaagggcgccgccgccaucgaggccgaggaccgcgaggaggaggagggcgaggaggagaaggaggcccccaccggccgcgagaagcgccccucccgcuccggcggccgcguccgcgccgccggccgccgccuccagggcuucugccucucccucgcccagggcaccuaccgcccccuccgccgcuucuuccacgacauccuccacaccaaguaccgcgccgccaccgacgucuacgcccucauguuccucgccgacgucgucgacuucaucaucaucaucuucggcuucugggccuucggcaagcacuccgccgccaccgacaucaccuccucccucuccgacgaccagguccccgaggccuuccucgucaugcuccucauccaguucuccaccauggucgucgaccgcgcccucuaccuccgcaagaccguccucggcaagcucgccuuccaggucgcccucguccucgccauccaccucuggauguucuucauccuccccgccgucaccgagcgcauguucaaccagaacgucgucgcccagcucugguacuucgucaagugcaucuacuucgcccucuccgccuaccagauccgcugcggcuaccccacccgcauccucggcaacuuccucaccaagaaguacaaccaccucaaccucuuccucuuccagggcuuccgccucguccccuuccucgucgagcuccgcgccgucauggacugggucuggaccgacaccacccucucccucuccuccuggaugugcgucgaggacaucuacgccaacaucuucaucaucaagugcucccgcgagaccgagaagaaguacccccagcccaagggccagaagaagaagaagaucgucaaguacggcaugggcggccucaucauccucuuccucaucgccaucaucugguucccccuccucuucaugucccucguccgcuccgucgucggcgucgucaaccagcccaucgacgucaccgucacccucaagcucggcggcuacgagccccucuucaccauguccgcccagcagcccuccaucauccccuucaccgcccaggccuacgaggagcucucccgccaguucgacccccagccccucgccaugcaguucaucucccaguacucccccgaggacaucgucaccgcccagaucgagggcuccuccggcgcccucuggcgcaucuccccccccucccgcgcccagaugaagcgcgagcucuacaacggcaccgccgacaucacccuccgcuucaccuggaacuuccagcgcgaccucgccaagggcggcaccgucgaguacgccaacgagaagcacaugcucgcccucgcccccaacuccaccgcccgccgccagcucgccucccuccucgagggcaccuccgaccaguccgucgucauccccaaccucuuccccaaguacauccgcgcccccaacggccccgaggccaaccccgucaagcagcuccagcccaacgaggaggccgacuaccucggcguccgcauccagcuccgccgcgagcagggcgccggcgccaccggcuuccucgaguggugggucaucgagcuccaggagugccgcaccgacugcaaccuccuccccauggucaucuucuccgacaaggucuccccccccucccucggcuuccucgccggcuacggcaucaugggccucuacgucuccaucguccucgucaucggcaaguucguccgcggcuucuucuccgagaucucccacuccaucauguucgaggagcuccccugcgucgaccgcauccucaagcucugccaggacaucuuccucguccgcgagacccgcgagcucgagcucgaggaggagcucuacgccaagcucaucuuccucuaccgcucccccgagaccaugaucaaguggacccgcgagaaggaguga

SEQ ID NO: 47626 - RNA, 8259 nt, Artificial Sequence
  derived and/or modified sequence opt2 from PIEZO2__Homo_sapiens__NP_071351
auggccuccgaggucgucugcggccucaucuuccgccuccuccuccccaucugccucgccgucgccugcgccuuccgcuacaacggccucuccuucgucuaccucaucuaccuccuccucaucccccucuucuccgagcccaccaagaccaccaugcagggccacaccggccgccuccucaagucccucugcuucaucucccucuccuuccuccuccuccacaucaucuuccacaucacccucgucucccucgaggcccagcaccgcaucgcccccggcuacaacugcuccaccugggagaagaccuuccgccagaucggcuucgagucccucaagggcgccgacgccggcaacggcauccgcgucuucguccccgacaucggcauguucaucgccucccucaccaucuggcuccucugccgcaacaucguccagaagcccgucaccgacgaggccgcccaguccaaccccgaguucgagaacgaggagcucgccgagggcgagaagaucgacuccgaggaggcccucaucuacgaggaggacuucaacggcggcgacggcgucgagggcgagcucgaggaguccaccaagcucaagauguuccgccgccucgccuccgucgccuccaagcucaaggaguucaucggcaacaugaucaccaccgccggcaaggucgucgucaccauccuccucggcuccuccggcaugaugcuccccucccucaccuccuccgucuacuucuucgucuuccucggccucugcaccuggugguccuggugccgcaccuucgacccccuccucuucuccugccucugcguccuccucgccaucuucaccgccggccaccucaucggccucuaccucuaccaguuccaguucuuccaggaggccgucccccccaacgacuacuacgcccgccucuucggcaucaaguccgucauccagaccgacugcuccuccaccuggaagaucaucgucaaccccgaccucuccugguaccaccacgccaaccccauccuccuccucgucauguacuacacccucgccacccucauccgcaucuggcuccaggagccccucguccaggacgagggcaccaaggaggaggacaaggcccucgccugcucccccauccagaucaccgccggccgccgccgcucccucugguacgccacccacuaccccaccgacgagcgcaagcuccucuccaugacccaggacgacuacaagcccuccgacggccuccucgucaccgucaacggcaaccccgucgacuaccacaccauccaccccucccuccccauggagaacggccccggcaaggccgaccucuacuccaccccccaguaccgcugggagcccuccgacgaguccuccgagaagcgcgaggaggaggaggaggagaaggaggaguucgaggaggagcgcucccgcgaggagaagcgcuccaucaagguccacgccauggucuccgucuuccaguucaucaugaagcaguccuacaucugcgcccucaucgccaugauggccugguccaucaccuaccacuccuggcucaccuucguccuccucaucugguccugcacccucuggaugauccgcaaccgccgcaaguacgccaugaucuccucccccuucauggucgucuacggcaaccuccuccucauccuccaguacaucugguccuucgagcuccccgagaucaagaagguccccggcuuccucgagaagaaggagcccggcgagcucgccuccaagauccucuucaccaucaccuucuggcuccuccuccgccagcaccucaccgagcagaaggcccuccaggagaaggaggcccuccucuccgaggucaagaucggcucccaggagaacgaggagaaggacgaggagcuccaggacauccaggucgagggcgagcccaaggaggaggaggaggaggaggccaaggaggagaagcaggagcgcaagaaggucgagcaggaggaggccgaggaggaggacgagcaggacaucaugaagguccucggcaaccucgucgucgccauguucaucaaguacuggaucuacgucugcggcggcauguucuucuucgucuccuucgagggcaagaucgucauguacaagaucaucuacaugguccucuuccucuucugcgucgcccucuaccagguccacuacgagugguggcgcaagauccucaaguacuucuggauguccgucgucaucuacaccaugcucguccucaucuucaucuacaccuaccaguucgagaacuuccccggccucuggcagaacaugaccggccucaagaaggagaagcucgaggaccucggccucaagcaguucaccgucgccgagcucuucacccgcaucuucauccccaccuccuuccuccucgucugcauccuccaccuccacuacuuccacgaccgcuuccucgagcucaccgaccucaaguccauccccuccaaggaggacaacaccaucuaccgccucgcccaccccgagggcucccuccccgaccucaccaugaugcaccucaccgccucccucgagaagcccgagguccgcaagcucgccgagcccggcgaggagaagcucgagggcuacuccgagaaggcccagaagggcgaccucggcaaggacuccgaggaguccgaggaggacggcgaggaggaggaggaguccgaggaggaggaggagaccuccgaccuccgcaacaaguggcaccucgucaucgaccgccucaccguccucuuccucaaguuccucgaguacuuccacaagcuccaggucuucaugugguggauccucgagcuccacaucaucaagaucgucuccuccuacaucaucugggucuccgucaaggaggucucccucuucaacuacgucuuccucaucuccugggccuucgcccuccccuacgccaagcuccgccgccucgccuccuccgucugcaccgucuggaccugcgucaucaucgucugcaagaugcucuaccagcuccagaccaucaagcccgagaacuucuccgucaacugcucccuccccaacgagaaccagaccaacauccccuucaacgagcucaacaagucccuccucuacuccgcccccaucgaccccaccgagugggucggccuccgcaaguccuccccccuccucgucuaccuccgcaacaaccuccucaugcucgccauccucgccuucgaggucaccaucuaccgccaccaggaguacuaccgcggccgcaacaaccucaccgcccccgucucccgcaccaucuuccacgacaucacccgccuccaccucgacgacggccucaucaacugcgccaaguacuucaucaacuacuucuucuacaaguucggccucgagaccugcuuccucauguccgucaacgucaucggccagcgcauggacuucuacgccaugauccacgccugcuggcucaucgccguccucuaccgccgccgccgcaaggccaucgccgagaucuggcccaaguacugcugcuuccucgccugcaucaucaccuuccaguacuucaucugcaucggcaucccccccgcccccugccgcgacuaccccuggcgcuucaagggcgccuccuucaacgacaacaucaucaaguggcucuacuuccccgacuucaucguccgccccaaccccgucuuccucgucuacgacuucaugcuccuccucugcgccucccuccagcgccagaucuucgaggacgagaacaaggccgccguccgcaucauggccggcgacaacgucgagaucugcaugaaccucgacgccgccuccuucucccagcacaaccccguccccgacuucauccacugccgcuccuaccucgacauguccaaggucaucaucuucuccuaccucuucugguucguccucaccaucaucuucaucaccggcaccacccgcaucuccaucuucugcaugggcuaccucgucgccugcuucuacuuccuccucuucggcggcgaccuccuccucaagcccaucaaguccauccuccgcuacugggacuggcucaucgccuacaacgucuucgucaucaccaugaagaacauccucuccaucggcgccugcggcuacaucggcacccucguccacaacuccugcuggcucauccaggccuucucccucgccugcaccgucaagggcuaccagaugcccgccgccaacucccccugcacccuccccuccggcgaggccggcaucaucugggacuccaucugcuucgccuuccuccuccuccagcgccgcgucuucauguccuacuacuuccuccacgucgucgccgacaucaaggccucccagauccucgccucccgcggcgccgagcucuuccaggccaccaucgucaaggccgucaaggcccgcaucgaggaggagaagaaguccauggaccagcucaagcgccagauggaccgcaucaaggcccgccagcagaaguacaagaagggcaaggagcgcaugcucucccucacccaggagcccggcgagggccaggacaugcagaagcucuccgaggaggacgacgagcgcgaggccgacaagcagaaggccaagggcaagaagaagcagugguggcgccccugggucgaccacgccuccaugguccgcuccggcgacuacuaccucuucgagaccgacuccgaggaggaggaggaggaggagcucaagaaggaggacgaggagcccccccgccgcuccgccuuccaguucgucuaccaggccuggaucaccgaccccaagaccgcccuccgccagcgccacaaggagaagaagcgcuccgcccgcgaggagcgcaagcgccgccgcaagggcuccaaggagggccccgucgagugggaggaccgcgaggacgagcccaucaagaagaaguccgacggccccgacaacaucaucaagcgcaucuucaacauccucaaguucaccuggguccucuuccucgccaccgucgacuccuucaccaccuggcucaacuccaucucccgcgagcacaucgacaucuccaccguccuccgcaucgagcgcugcaugcucacccgcgagaucaagaagggcaacguccccacccgcgaguccauccacauguacuaccagaaccacaucaugaaccucucccgcgaguccggccucgacaccaucgacgagcaccccggcgccgccuccggcgcccagaccgcccaccgcauggacucccucgacucccacgacuccaucuccuccgagcccacccagugcaccaugcucuacucccgccagggcaccaccgagaccaucgaggaggucgaggccgagcaggaggaggaggccggcuccaccgcccccgagccccgcgaggccaaggaguacgaggccaccggcuacgacgucggcgccaugggcgccgaggaggccucccucacccccgaggaggagcucacccaguucuccacccucgacggcgacgucgaggccccccccuccuacuccaaggccgucuccuucgagcaccucuccuucggcucccaggacgacuccgccggcaagaaccgcauggccgucucccccgacgacucccgcaccgacaagcucggcuccuccauccuccccccccucacccacgagcucaccgccuccgagcuccuccucaagaagauguuccacgacgacgagcucgaggaguccgagaaguucuacgucggccagccccgcuuccuccuccucuucuacgccauguacaacacccucgucgcccgcuccgagauggucugcuacuucgucaucauccucaaccacauggucuccgccuccaugaucacccuccuccuccccauccucaucuuccucugggccaugcucuccgucccccgccccucccgccgcuucuggaugauggccaucgucuacaccgaggucgccaucgucgucaaguacuucuuccaguucggcuucuuccccuggaacaagaacgucgaggucaacaaggacaagcccuaccacccccccaacaucaucggcgucgagaagaaggagggcuacguccucuacgaccucauccagcuccucgcccucuucuuccaccgcuccauccucaagugccacggccucugggacgaggacgacaugaccgaguccggcauggcccgcgaggaguccgacgacgagcucucccucggccacggccgccgcgacuccuccgacucccucaaguccaucaaccucgccgccuccgucgaguccguccacgucaccuuccccgagcagcagaccgccguccgccgcaagcgcuccggcuccuccuccgagcccucccagcgcuccuccuucuccuccaaccgcucccagcgcggcuccaccuccacccgcaacuccucccagaagggcuccuccguccucuccaucaagcagaagggcaagcgcgagcucuacauggagaagcuccaggagcaccucaucaaggccaaggccuucaccaucaagaagacccucgagaucuacguccccaucaagcaguucuucuacaaccucauccaccccgaguacuccgccgucaccgacgucuacguccucauguuccucgccgacaccgucgacuucaucaucaucgucuucggcuucugggccuucggcaagcacuccgccgccgccgacaucaccuccucccucuccgaggaccagguccccggccccuuccucgucaugguccucauccaguucggcaccauggucgucgaccgcgcccucuaccuccgcaagaccguccucggcaaggucaucuuccaggucauccucgucuucggcauccacuucuggauguucuucauccuccccggcgucaccgagcgcaaguucucccagaaccucgucgcccagcucugguacuucgucaagugcgucuacuucggccucuccgccuaccagauccgcugcggcuaccccacccgcguccucggcaacuuccucaccaaguccuacaacuacgucaaccucuuccucuuccagggcuuccgccucguccccuuccucaccgagcuccgcgccgucauggacugggucuggaccgacaccacccucucccucuccuccuggaucugcgucgaggacaucuacgcccacaucuucauccucaagugcuggcgcgaguccgagaagcgcuacccccagccccgcggccagaagaagaagaaggucgucaaguacggcaugggcggcaugaucaucguccuccucaucugcaucgucugguucccccuccucuucaugucccucaucaaguccgucgccggcgucaucaaccagccccucgacgucuccgucaccaucacccucggcggcuaccagcccaucuucaccauguccgcccagcagucccagcucaaggucauggaccagcaguccuucaacaaguucauccaggccuucucccgcgacaccggcgccaugcaguuccucgagaacuacgagaaggaggacaucaccgucgccgagcucgagggcaacuccaacucccucuggaccaucuccccccccuccaagcagaagaugauccacgagcuccucgaccccaacuccuccuucuccgucgucuucuccugguccauccagcgcaaccucucccucggcgccaaguccgagaucgccaccgacaagcucuccuucccccucaagaacaucacccgcaagaacaucgccaagaugaucgccggcaacuccaccgaguccuccaagacccccgucaccaucgagaagaucuaccccuacuacgucaaggcccccuccgacuccaacuccaagcccaucaagcagcuccucuccgagaacaacuucauggacaucaccaucauccucucccgcgacaacaccaccaaguacaacuccgagugguggguccucaaccucaccggcaaccgcaucuacaaccccaacucccaggcccucgagcucgucgucuucaacgacaaggucuccccccccucccucggcuuccucgccggcuacggcaucaugggccucuacgccuccgucguccucgucaucggcaaguucguccgcgaguucuucuccggcaucucccacuccaucauguucgaggagcuccccaacgucgaccgcauccucaagcucugcaccgacaucuuccucguccgcgagaccggcgagcucgagcucgaggaggaccucuacgccaagcucaucuuccucuaccgcucccccgagaccaugaucaaguggacccgcgagaagaccaacuga

SEQ ID NO: 47627 - RNA, 2124 nt, Artificial Sequence
  derived and/or modified sequence opt2 from PIF1__Homo_sapiens__NP_001273426
augcucuccggcaucgaggccgccgccggcgaguacgaggacuccgagcuccgcugccgcgucgccgucgaggagcucucccccggcggccagccccgccgccgccaggcccuccgcaccgccgagcucucccucggccgcaacgagcgccgcgagcucaugcuccgccuccaggcccccggccccgccggccgcccccgcugcuucccccuccgcgccgcccgccucuucacccgcuucgccgaggccggccgcuccacccuccgccuccccgcccacgacacccccggcgccggcgccguccagcuccuccucuccgacugcccccccgaccgccuccgccgcuuccuccgcacccuccgccucaagcucgccgccgcccccggccccggccccgccuccgcccgcgcccagcuccucggcccccgcccccgcgacuucgucaccaucucccccguccagcccgaggagcgccgccuccgcgccgccacccgcguccccgacaccacccucgucaagcgccccgucgagccccaggccggcgccgagcccuccaccgaggccccccgcuggccccuccccgucaagcgccucucccuccccuccaccaagccccagcucuccgaggagcaggccgccguccuccgcgccguccucaagggccaguccaucuucuucaccggcuccgccggcaccggcaaguccuaccuccucaagcgcauccucggcucccucccccccaccggcaccgucgccaccgccuccaccggcgucgccgccugccacaucggcggcaccacccuccacgccuucgccggcaucggcuccggccaggccccccucgcccagugcgucgcccucgcccagcgccccggcguccgccagggcuggcucaacugccagcgccucgucaucgacgagaucuccauggucgaggccgaccucuucgacaagcucgaggccgucgcccgcgccguccgccagcagaacaagcccuucggcggcauccagcucaucaucugcggcgacuuccuccagcucccccccgucaccaagggcucccagcccccccgcuucugcuuccaguccaaguccuggaagcgcugcguccccgucacccucgagcucaccaaggucuggcgccaggccgaccagaccuucaucucccuccuccaggccguccgccucggccgcugcuccgacgaggucacccgccagcuccaggccaccgccucccacaaggucggccgcgacggcaucgucgccacccgccucugcacccaccaggacgacgucgcccucaccaacgagcgccgccuccaggagcuccccggcaagguccaccgcuucgaggccauggacuccaaccccgagcucgccuccacccucgacgcccagugccccgucucccagcuccuccagcucaagcucggcgcccaggucaugcucgucaagaaccucuccgucucccgcggccucgucaacggcgcccgcggcgucgucgucggcuucgaggccgagggccgcggccucccccagguccgcuuccucugcggcgucaccgaggucauccacgccgaccgcuggaccguccaggccaccggcggccagcuccucucccgccagcagcucccccuccagcucgccugggccauguccauccacaagucccagggcaugacccucgacugcgucgagaucucccucggccgcgucuucgccuccggccaggccuacgucgcccucucccgcgcccgcucccuccagggccuccgcguccucgacuucgaccccauggccguccgcugcgacccccgcguccuccacuucuacgccacccuccgccgcggccgcucccucucccucgccgccgagggccgcggcaacgaggaccgcugcuccggcuccuccauccgcgcccucggcggcgacugguggggccuccgccucggcgccgccuccaagcagcgcaccgagcuccgcugcgucuccaccgcccgccccucccucgcccagccccgcaccaacacccuccagucccucaccaaggagcacaagcuccagaacguccaccccuacuucaagcuccucuuccagggcaucaacuccgucuggggccacuga

SEQ ID NO: 47628 - RNA, 477 nt, Artificial Sequence
  derived and/or modified sequence opt2 from PIFO__Homo_sapiens__NP_001287760
augugcuucucccgcgccgacgccgccgacaacuaccccuucggcaccugccagcagcgcaagcucuucccccacuuccacccccccaaccucaucggcaacaaguucgucccccuccgcggcuccccccaccgcggccccggcugcuacuucuccgacgagaugaccccccacgccggccgcuaccagaaggucuccccccagcaggagaagcacaagcagaacuucgcccccuucaacguccucgucccccgcuucaagaacuaccccaaggacaccuacuaccccucccccggcgccuacaaccccgagaagaagcccccccccaagaucgccuggcccaugaaguucggcucccccgacugggcccagguccccugccuccagaagcgcacccucaaggccgagcucuccaccgacaaggacuuccgcaagcaccgcaaccgcgucgccuaccucucccucuacuacaacuga

SEQ ID NO: 47629 - RNA, 1455 nt, Artificial Sequence
  derived and/or modified sequence opt2 from PIGA__Homo_sapiens__NP_002632
auggccugccgcggcggcgccggcaacggccaccgcgccuccgccacccucucccgcgucucccccggcucccucuacaccugccgcacccgcacccacaacaucugcauggucuccgacuucuucuaccccaacaugggcggcgucgagucccacaucuaccagcucucccagugccucaucgagcgcggccacaaggucaucaucgucacccacgccuacggcaaccgcaagggcauccgcuaccucaccuccggccucaaggucuacuaccucccccucaaggucauguacaaccaguccaccgccaccacccucuuccacucccucccccuccuccgcuacaucuucguccgcgagcgcgucaccaucauccacucccacuccuccuucuccgccauggcccacgacgcccucuuccacgccaagaccaugggccuccagaccgucuucaccgaccacucccucuucggcuucgccgacgucuccuccguccucaccaacaagcuccucaccgucucccucugcgacaccaaccacaucaucugcgucuccuacaccuccaaggagaacaccguccuccgcgccgcccucaaccccgagaucgucuccgucauccccaacgccgucgaccccaccgacuucacccccgaccccuuccgccgccacgacuccaucaccaucgucgucgucucccgccucgucuaccgcaagggcaucgaccuccucuccggcaucauccccgagcucugccagaaguaccccgaccucaacuucaucaucggcggcgagggccccaagcgcaucauccucgaggagguccgcgagcgcuaccagcuccacgaccgcguccgccuccucggcgcccucgagcacaaggacguccgcaacguccucguccagggccacaucuuccucaacaccucccucaccgaggccuucugcauggccaucgucgaggccgccuccugcggccuccaggucgucuccacccgcgucggcggcauccccgagguccuccccgagaaccucaucauccucugcgagcccuccgucaagucccucugcgagggccucgagaaggccaucuuccagcucaaguccggcacccuccccgcccccgagaacauccacaacaucgucaagaccuucuacaccuggcgcaacgucgccgagcgcaccgagaaggucuacgaccgcgucuccgucgaggccguccuccccauggacaagcgccucgaccgccucaucucccacugcggccccgucaccggcuacaucuucgcccuccucgccgucuucaacuuccucuuccucaucuuccuccgcuggaugacccccgacuccaucaucgacgucgccaucgacgccaccggcccccgcggcgccuggaccaacaacuacucccacuccaagcgcggcggcgagaacaacgagaucuccgagacccgcuga

SEQ ID NO: 47630 - RNA, 660 nt, Artificial Sequence
  derived and/or modified sequence opt2 from PIGF__Homo_sapiens__NP_002634
augaaggacaacgacaucaagcgccuccucuacacccaccuccucugcaucuucuccaucauccucuccgucuucauccccucccucuuccucgagaacuucuccauccucgagacccaccucaccuggcucugcaucugcuccggcuucgucaccgccgucaaccucguccucuaccucgucgucaagcccaacaccuccuccaagcgcuccucccucucccacaaggucaccggcuuccucaagugcugcaucuacuuccucauguccugcuucuccuuccacgucaucuucguccucuacggcgccccccucaucgagcucgcccucgagaccuuccucuucgccgucauccucuccaccuucaccaccguccccugccucugccuccucggccccaaccucaaggccuggcuccgcgucuucucccgcaacggcgucaccuccaucugggagaacucccuccagaucaccaccaucuccuccuucgucggcgccuggcucggcgcccuccccaucccccucgacugggagcgccccuggcaggucuggcccaucuccugcacccucggcgccaccuucggcuacgucgccggccucgucaucuccccccucuggaucuacuggaaccgcaagcagcucaccuacaagaacaacuga

SEQ ID NO: 47631 - RNA, 2952 nt, Artificial Sequence
  derived and/or modified sequence opt2 from PIGG__Homo_sapiens__NP_001120650
augcgccucggcuccggcaccuucgccaccugcugcgucgccaucgagguccucggcaucgccgucuuccuccgcggcuucuuccccgcccccguccgcuccuccgcccgcgccgagcacggcgccgagccccccgcccccgagcccuccgccggcgccuccuccaacuggaccacccucccccccccccucuucuccaaggucgucaucguccucaucgacgcccuccgcgacgacuucgucuucggcuccaagggcgucaaguucaugcccuacaccaccuaccucgucgagaagggcgccucccacuccuucgucgccgaggccaagccccccaccgucaccaugccccgcaucaaggcccucaugaccggcucccuccccggcuucgucgacgucauccgcaaccucaacucccccgcccuccucgaggacuccgucauccgccaggccaaggccgccggcaagcgcaucgucuucuacggcgacgagaccugggucaagcucuuccccaagcacuucgucgaguacgacggcaccaccuccuucuucgucuccgacuacaccgaggucgacaacaacgucacccgccaccucgacaagguccucaagcgcggcgacugggacauccucauccuccacuaccucggccucgaccacaucggccacaucuccggccccaacuccccccucaucggccagaagcucuccgagauggacuccguccucaugaagauccacaccucccuccaguccaaggagcgcgagaccccccuccccaaccuccucguccucugcggcgaccacggcauguccgagaccggcucccacggcgccuccuccaccgaggaggucaacaccccccucauccucaucuccuccgccuucgagcgcaagcccggcgacauccgccaccccaagcacguccagcagaccgacgucgccgccacccucgccaucgcccucggccuccccauccccaaggacuccgucggcucccuccucuuccccgucgucgagggccgccccaugcgcgagcagcuccgcuuccuccaccucaacaccguccagcucuccaagcuccuccaggagaacguccccuccuacgagaaggaccccggcuucgagcaguucaagauguccgagcgccuccacggcaacuggauccgccucuaccucgaggagaagcacuccgagguccucuucaaccucggcuccaagguccuccgccaguaccucgacgcccucaagacccucucccucucccucuccgcccaggucgcccaguacgacaucuacuccaugauggucggcaccgucgucguccucgagguccucacccuccuccuccucuccgucccccaggcccuccgccgcaaggccgagcucgaggucccccucuccucccccggcuucucccuccucuucuaccucgucauccucguccucuccgccguccacgucaucgucugcaccuccgccgaguccuccugcuacuucugcggccucuccuggcucgccgccggcggcgucaugguccucgccuccgcccuccucugcgucaucgucuccguccucaccaacguccucgucggcggcaacaccccccgcaagaaccccaugcaccccuccucccgcugguccgagcucgaccuccucauccuccucggcaccgccggccacguccucucccucggcgccuccuccuucgucgaggaggagcaccagaccugguacuuccucgucaacacccucugccucgcccucucccaggagaccuaccgcaacuacuuccucggcgacgacggcgagccccccugcggccucugcgucgagcagggccacgacggcgccaccgccgccuggcaggacggccccggcugcgacguccucgagcgcgacaagggccacggcucccccuccaccuccgagguccuccgcggccgcgagaaguggaugguccucgccucccccuggcucauccucgccugcugccgccuccuccgcucccucaaccagaccggcguccagugggcccaccgccccgaccucggccacuggcucaccuccuccgaccacaaggccgagcucuccguccucgccgcccucucccuccucgucgucuucguccucguccagcgcggcugcucccccgucuccaaggccgcccucgcccucggccuccucggcgucuacugcuaccgcgccgccaucggcuccguccgcuuccccuggcgccccgacuccaaggacaucuccaagggcaucaucgaggcccgcuucgucuacgucuucguccucggcauccucuucaccggcaccaaggaccuccucaagucccaggucaucgccgccgacuucaagcucaagaccgucggccucugggagaucuacuccggccucguccuccucgccgcccuccucuuccgcccccacaaccuccccguccucgccuucucccuccucauccagacccucaugaccaaguucaucuggaagccccuccgccacgacgccgccgagaucaccgucaugcacuacugguucggccaggccuucuucuacuuccagggcaacuccaacaacaucgccaccgucgacaucuccgccggcuucgucggccucgacaccuacgucgagauccccgccguccuccucaccgccuucggcaccuacgccggccccguccucugggccucccaccucguccacuuccucuccuccgagacccgcuccggcuccgcccucucccacgccugcuucugcuacgcccucaucugcuccauccccgucuucaccuacaucguccucgucaccucccuccgcuaccaccucuucaucugguccgucuucucccccaagcuccucuacgagggcaugcaccuccucaucaccgccgccgucugcgucuucuucaccgccauggaccagacccgccucacccaguccuga

SEQ ID NO: 47632 - RNA, 759 nt, Artificial Sequence
  derived and/or modified sequence opt2 from PIGL__Homo_sapiens__NP_004269
auggaggccauguggcuccucugcgucgcccucgccguccucgccuggggcuuccucugggucugggacuccuccgagcgcaugaagucccgcgagcagggcggccgccucggcgccgagucccgcacccuccucgucaucgcccaccccgacgacgaggccauguucuucgcccccaccguccucggccucgcccgccuccgccacugggucuaccuccucugcuucuccgccggcaacuacuacaaccagggcgagacccgcaagaaggagcuccuccaguccugcgacguccucggcaucccccucuccuccgucaugaucaucgacaaccgcgacuuccccgacgaccccggcaugcagugggacaccgagcacgucgcccgcguccuccuccagcacaucgaggucaacggcaucaaccucgucgucaccuucgacgccggcggcgucuccggccacuccaaccacaucgcccucuacgccgccguccgcgcccuccacuccgagggcaagcuccccaagggcugcuccguccucacccuccaguccgucaacguccuccgcaaguacaucucccuccucgaccucccccucucccuccuccacacccaggacguccucuucguccucaacuccaaggaggucgcccaggccaagaaggccauguccugccaccgcucccagcuccucugguuccgccgccucuacaucaucuucucccgcuacaugcgcaucaacucccucuccuuccucuga

SEQ ID NO: 47633 - RNA, 1272 nt, Artificial Sequence
  derived and/or modified sequence opt2 from PIGM__Homo_sapiens__NP_660150
augggcuccaccaagcacuggggcgaguggcuccucaaccucaaggucgcccccgccggcgucuucggcgucgccuuccucgcccgcgucgcccucgucuucuacggcgucuuccaggaccgcacccuccacguccgcuacaccgacaucgacuaccaggucuucaccgacgccgcccgcuucgucaccgagggccgcucccccuaccuccgcgccaccuaccgcuacaccccccuccucggcuggcuccucacccccaacaucuaccucuccgagcucuucggcaaguuccucuucaucuccugcgaccuccucaccgccuuccuccucuaccgccuccuccuccucaagggccucggccgccgccaggccugcggcuacugcgucuucuggcuccucaacccccuccccauggccgucuccucccgcggcaacgccgacuccaucgucgccucccucguccucaugguccucuaccucaucaagaagcgccucgucgccugcgccgccgucuucuacggcuucgccguccacaugaagaucuaccccgucaccuacauccuccccaucacccuccaccuccuccccgaccgcgacaacgacaagucccuccgccaguuccgcuacaccuuccaggccugccucuacgagcuccucaagcgccucugcaaccgcgccguccuccucuucgucgccgucgccggccucaccuucuucgcccucuccuucggcuucuacuacgaguacggcugggaguuccucgagcacaccuacuucuaccaccucacccgccgcgacauccgccacaacuucucccccuacuucuacaugcucuaccucaccgccgaguccaagugguccuucucccucggcaucgccgccuuccucccccagcucauccuccucuccgccgucuccuucgccuacuaccgcgaccucgucuucugcugcuuccuccacaccuccaucuucgucaccuucaacaaggucugcaccucccaguacuuccucugguaccucugccuccucccccucgucaugccccucguccgcaugcccuggaagcgcgccgucguccuccucaugcucugguucaucggccaggccauguggcucgcccccgccuacguccucgaguuccagggcaagaacaccuuccucuucaucuggcucgccggccucuucuuccuccucaucaacugcuccauccucauccagaucaucucccacuacaaggaggagccccucaccgagcgcaucaaguacgacuga

SEQ ID NO: 47634 - RNA, 2796 nt, Artificial Sequence
  derived and/or modified sequence opt2 from PIGN__Homo_sapiens__NP_789744
augcuccucuucuucacccucggccuccucauccacuucgucuucuucgccuccaucuucgacaucuacuucaccuccccccucguccacggcaugaccccccaguucaccccccuccccccccccgcccgccgccucguccucuucgucgccgacggccuccgcgccgacgcccucuacgagcucgacgagaacggcaacucccgcgcccccuucauccgcaacaucaucaugcacgagggcuccuggggcaucucccacacccgcguccccaccgagucccgccccggccacgucgcccucaucgccggcuucuacgaggacgucuccgccgucgccaagggcuggaaggagaaccccgucgaguucgacucccucuucaacgaguccaaguacaccugguccuggggcucccccgacauccuccccauguucgccaagggcgccuccggcgaccacgucuacaccuacuccuacgacgccaagcgcgaggacuucggcgcccaggacgccaccaagcucgacaccugggucuucgacaacgucaaggacuucuuccaccacgcccgcaacaaccagucccucuucuccaagaucaacgaggagaagaucgucuucuuccuccaccuccucggcaucgacaccaacggccacgcccaccgccccuccucccgcgacuacaagcacaacaucaagaaggucgacgacggcgucaaggagaucgucuccauguucaaccacuucuacggcaacgacggcaagaccaccuucaucuucaccuccgaccacggcaugaccgacuggggcucccacggcgccggccaccccuccgagacccucaccccccucgucaccuggggcgccggcaucaaguacccccagcgcgucuccgcccagcaguucgacgacgccuuccucaaggaguggcgccucgagaacuggaagcgccucgacgucaaccaggccgacaucgccccccucaugaccucccucaucggcguccccuucccccucaacuccgucggcauccuccccgucgacuaccucaacaacaccgaccucuucaaggccgaguccauguucaccaacgccguccagauccucgagcaguucaaggucaagaugacccagaagaaggaggucacccuccccuuccucuucacccccuucaagcuccucuccgacuccaagcaguucaacauccuccgcaaggcccgcuccuacaucaagcaccgcaaguucgacgaggucgucucccucugcaaggagcucauccaccucgcccucaagggccucuccuacuaccacaccuacgaccgcuucuuccucggcgucaacgucgucaucggcuucgucggcuggaucuccuacgccucccuccucaucaucaagucccacuccaaccucaucaagggcgucuccaaggaggucaagaagcccucccaccuccuccccugcuccuucgucgccaucggcauccucgucgccuucuuccuccucauccaggccugccccuggaccuacuacgucuacggccuccucccccuccccaucugguacgccguccuccgcgaguuccaggucauccaggaccucgucgucuccguccucaccuacccccucucccacuucgucggcuaccuccucgccuucacccucggcaucgagguccucguccucuccuucuucuaccgcuacaugcucaccgccggccucaccgccuucgccgccuggcccuuccucacccgccucuggacccgcgccaagaugaccucccucuccuggaccuucuucucccuccuccucgccgucuucccccucaugcccgucgucggccgcaagcccgacaucucccucgucaugggcgccggccuccucguccuccuccucucccucugcgucgucaccucccucaugaagcgcaaggacuccuucaucaaggaggagcuccucguccaccuccuccagguccucuccaccguccucuccauguacgucgucuacuccacccaguccucccuccuccgcaagcagggccucccccucaugaaccagaucaucuccugggccacccucgccuccucccucgucgucccccuccucuccucccccguccucuuccagcgccucuucuccauccuccucucccucauguccaccuaccuccuccucuccaccggcuacgaggcccucuucccccucguccucuccugccucauguucgucuggaucaacaucgagcaggagacccuccagcaguccggcgucugcugcaagcagaagcucaccuccauccaguucuccuacaacaccgacaucacccaguuccgccagcucuaccucgacgacauccgccgcgccuucuuccucgucuucuuccucgucaccgccuucuucggcaccggcaacaucgccuccaucaacuccuucgaccucgccuccgucuacugcuuccucaccgucuucucccccuucaugaugggcgcccucaugauguggaagauccucauccccuucguccucgucaugugcgccuucgaggccguccagcucaccacccagcucuccuccaagucccucuuccucaucguccucgucaucuccgacaucauggcccuccacuucuucuuccucgucaaggacuacggcuccuggcucgacaucggcaccuccaucucccacuacgucaucgucauguccaugaccaucuuccucgucuuccucaacggccucgcccagcuccucaccaccaagaagcuccgccucugcggcaagcccaagucccacuucauguga

SEQ ID NO: 47635 - RNA, 2019 nt, Artificial Sequence
  derived and/or modified sequence opt2 from PIGO__Homo_sapiens__NP_001188413
augcagaaggccuccguccuccucuuccucgccugggucugcuuccucuucuacgccggcaucgcccucuucaccuccggcuuccuccucacccgccucgagcucaccaaccacuccuccugccaggagccccccggccccggcucccuccccuggggcucccagggcaagcccggcgccugcuggauggccucccgcuucucccgcgucguccucguccucaucgacgcccuccgcuucgacuucgcccagccccagcacucccacgucccccgcgagccccccgucucccuccccuuccucggcaagcucuccucccuccagcgcauccucgagauccagccccaccacgcccgccucuaccgcucccaggucgacccccccaccaccaccaugcagcgccucaaggcccucaccaccggcucccuccccaccuucaucgacgccggcuccaacuucgccucccacgccaucgucgaggacaaccucaucaagcagcucaccuccgccggccgccgcgucgucuucaugggcgacgacaccuggaaggaccucuuccccggcgccuucuccaaggccuucuucuuccccuccuucaacguccgcgaccucgacaccgucgacaacggcauccucgagcaccucuaccccaccauggacuccggcgagugggacguccucaucgcccacuuccucggcgucgaccacugcggccacaagcacggcccccaccaccccgagauggccaagaagcucucccagauggaccaggucauccagggccucgucgagcgccucgagaacgacacccuccucgucgucgccggcgaccacggcaugaccaccaacggcgaccacggcggcgacuccgagcucgaggucuccgccgcccucuuccucuacucccccaccgccgucuuccccuccaccccccccgaggagcccgaggucaucccccaggucucccucguccccacccucgcccuccuccucggccuccccauccccuucggcaacaucggcgaggucauggccgagcucuucuccggcggcgaggacucccagccccacuccuccgcccucgcccaggccuccgcccuccaccucaacgcccagcaggucucccgcuuccuccacaccuacuccgccgccacccaggaccuccaggccaaggagcuccaccagcuccagaaccucuucuccaaggccuccgccgacuaccaguggcuccuccagucccccaagggcgccgaggccacccuccccaccgucaucgccgagcuccagcaguuccuccgcggcgcccgcgccaugugcaucgaguccugggcccgcuucucccucuccuuccuccuccuccaccuccucgccgccggcauccccgucaccacccccggccccuucaccguccccuggcaggccgucuccgccugggcccucauggccacccagaccuucuacuccaccggccaccagcccgucuuccccgccauccacuggcacgccgccuucgucggcuuccccgagggccacggcuccugcaccuggcuccccgcccuccucgucggcgccaacaccuucgccucccaccuccucuucgccgucggcugcccccuccuccuccucuggcccuuccucugcgagucccagggccuccgcaagcgccagcagccccccggcaacgaggccgacgcccgcguccgccccgaggaggaggaggagccccucauggagaugcgccuccgcgacgccccccagcacuucuacgccgcccuccuccagcucggccucaaguaccucuucauccucggcauccagauccucgccugcgcccucgccgccuccauccuccgccgccaccucauggucuggaaggucuucgcccccaaguucaucuucgaggccgucggcuucaucgucuccuccgucggccuccuccucggcaucgcccucgucaugcgcgucgacggcgccgucuccuccugguuccgccagcucuuccucgcccagcagcgcuga

SEQ ID NO: 47636 - RNA, 477 nt, Artificial Sequence
  derived and/or modified sequence opt2 from PIGP__Homo_sapiens__NP_710148
auggucccccgcuccaccucccucacccucaucgucuuccucuuccaccgccucuccaaggcccccggcaagauggucgagaacucccccuccccccuccccgagcgcgccaucuacggcuucguccucuuccucuccucccaguucggcuucauccucuaccucgucugggccuucauccccgaguccuggcucaacucccucggccucaccuacuggccccagaaguacugggccgucgcccuccccgucuaccuccucaucgccaucgucaucggcuacguccuccucuucggcaucaacaugauguccaccuccccccucgacuccauccacaccaucaccgacaacuacgccaagaaccagcagcagaagaaguaccaggaggaggccauccccgcccuccgcgacaucuccaucuccgaggucaaccagauguucuuccucgccgccaaggagcucuacaccaagaacuga

SEQ ID NO: 47637 - RNA, 1746 nt, Artificial Sequence
  derived and/or modified sequence opt2 from PIGQ__Homo_sapiens__NP_004195
augguccucaaggccuucuuccccaccugcugcgucuccaccgacuccggccuccucgucggccgcuggguccccgagcaguccuccgccgucguccucgccguccuccacuuccccuucauccccauccaggucaagcagcuccucgcccagguccgccaggccucccaggucggcgucgccguccucggcaccuggugccacugccgccaggagcccgaggagucccucggccgcuuccucgagucccucggcgccgucuucccccacgagcccuggcuccgccucugccgcgagcgcggcggcaccuucugguccugcgaggccacccaccgccaggcccccaccgcccccggcgcccccggcgaggaccaggucaugcucaucuucuacgaccagcgccagguccuccucucccagcuccaccuccccaccguccuccccgaccgccaggccggcgccaccaccgccuccaccggcggccucgccgccgucuucgacaccgucgcccgcuccgagguccucuuccgcuccgaccgcuucgacgagggccccguccgccucucccacuggcaguccgagggcgucgaggccuccauccucgccgagcucgcccgccgcgccuccggccccaucugccuccuccucgccucccuccucucccucgucuccgccgucuccgccugccgcgucuucaagcucuggccccucuccuuccucggcuccaagcucuccaccugcgagcagcuccgccaccgccucgagcaccucacccucaucuucuccacccgcaaggccgagaaccccgcccagcucaugcgcaaggccaacaccgucgccuccguccuccucgacgucgcccucggccucaugcuccucuccuggcuccacggccgcucccgcaucggccaccucgccgacgcccucguccccgucgccgaccacgucgccgaggagcuccagcaccuccuccaguggcucaugggcgcccccgccggccucaagaugaaccgcgcccucgaccagguccucggccgcuucuuccucuaccacauccaccucuggaucuccuacauccaccucaugucccccuucgucgagcacauccucuggcacgucggccucuccgccugccucggccucaccgucgcccucucccuccucuccgacaucaucgcccuccucaccuuccacaucuacugcuucuacgucuacggcgcccgccucuacugccucaagauccacggccucuccucccucuggcgccucuuccgcggcaagaaguggaacguccuccgccagcgcgucgacuccugcuccuacgaccucgaccagcucuucaucggcacccuccucuucaccauccuccucuuccuccuccccaccaccgcccucuacuaccucgucuucacccuccuccgccuccucgucgucgccguccagggccucauccaccuccucgucgaccucaucaacucccucccccucuacucccucggccuccgccucugccgccccuaccgccucgccgccggcgucaaguuccgcguccuccgccacgaggccggccgcccccuccgccuccucaugcagaucaacccccuccccuacucccgcgucguccacaccuaccgccuccccuccugcggcugccaccccaagcacuccuggggcgcccucugccgcaagcucuuccucggcgagcucaucuaccccuggcgccagcgcggcgacaagcaggacuga

SEQ ID NO: 47638 - RNA, 2295 nt, Artificial Sequence
  derived and/or modified sequence opt2 from PIGR__Homo_sapiens__XP_011507931
augcuccucuucguccucaccugccuccucgccgucuuccccgccaucuccaccaagucccccaucuucggccccgaggaggucaacuccgucgagggcaacuccgucuccaucaccugcuacuacccccccaccuccgucaaccgccacacccgcaaguacuggugccgccagggcgcccgcggcggcugcaucacccucaucuccuccgagggcuacgucuccuccaaguacgccggccgcgccaaccucaccaacuuccccgagaacggcaccuucgucgucaacaucgcccagcucucccaggacgacuccggccgcuacaagugcggccucggcaucaacucccgcggccucuccuucgacgucucccucgaggucucccagggccccggccuccucaacgacaccaaggucuacaccgucgaccucggccgcaccgucaccaucaacugccccuucaagaccgagaacgcccagaagcgcaagucccucuacaagcagaucggccucuaccccguccucgucaucgacuccuccggcuacgucaaccccaacuacaccggccgcauccgccucgacauccagggcaccggccagcuccucuucuccgucgucaucaaccagcuccgccucuccgacgccggccaguaccucugccaggccggcgacgacuccaacuccaacaagaagaacgccgaccuccagguccucaagcccgagcccgagcucgucuacgaggaccuccgcggcuccgucaccuuccacugcgcccucggccccgaggucgccaacgucgccaaguuccucugccgccaguccuccggcgagaacugcgacgucgucgucaacacccucggcaagcgcgcccccgccuucgagggccgcauccuccucaacccccaggacaaggacggcuccuucuccgucgucaucaccggccuccgcaaggaggacgccggccgcuaccucugcggcgcccacuccgacggccagcuccaggagggcucccccauccaggccuggcagcucuucgucaacgaggaguccaccaucccccgcucccccaccgucgucaagggcgucgccggcggcuccgucgccguccucugccccuacaaccgcaaggaguccaaguccaucaaguacuggugccucugggagggcgcccagaacggccgcugcccccuccucgucgacuccgagggcugggucaaggcccaguacgagggccgccucucccuccucgaggagcccggcaacggcaccuucaccgucauccucaaccagcucaccucccgcgacgccggcuucuacuggugccucaccaacggcgacacccucuggcgcaccaccgucgagaucaagaucaucgagggcgagcccaaccucaagguccccggcaacgucaccgccguccucggcgagacccucaagguccccugccacuuccccugcaaguucuccuccuacgagaaguacuggugcaaguggaacaacaccggcugccaggcccuccccucccaggacgagggccccuccaaggccuucgucaacugcgacgagaacucccgccucgucucccucacccucaaccucgucacccgcgccgacgagggcugguacuggugcggcgucaagcagggccacuucuacggcgagaccgccgccgucuacgucgccgucgaggagcgcaaggccgccggcucccgcgacgucucccucgccaaggccgacgccgcccccgacgagaagguccucgacuccggcuuccgcgagaucgagaacaaggccauccaggacccccgccucuucgccgaggagaaggccgucgccgacacccgcgaccaggccgacggcucccgcgccuccgucgacuccggcuccuccgaggagcagggcggcuccucccgcgcccucgucuccacccucgucccccucggccucguccucgccgucggcgccgucgccgucggcgucgcccgcgcccgccaccgcaagaacgucgaccgcgucuccauccgcuccuaccgcaccgacaucuccauguccgacuucgagaacucccgcgaguucggcgccaacgacaacaugggcgccuccuccaucacccaggagaccucccucggcggcaaggaggaguucgucgccaccaccgaguccaccaccgagaccaaggagcccaagaaggccaagcgcuccuccaaggaggaggccgagauggccuacaaggacuuccuccuccaguccuccaccgucgccgccgaggcccaggacggcccccaggaggccuga

SEQ ID NO: 47639 - RNA, 1569 nt, Artificial Sequence
  derived and/or modified sequence opt2 from PIGT__Homo_sapiens__NP_001171657
auggccgccgccaugccccucgcccuccucguccuccuccuccucggccccggcggcuggugccucgccgagcccccccgcgacucccuccgcgaggagcucgucaucaccccccuccccuccggcgacgucgccgccaccuuccaguuccgcacccgcugggacuccgagcuccagcgcgagggcgucucccacuaccgccucuuccccaaggcccucggccagcucaucuccaaguacucccuccgcgagcuccaccucuccuucacccagggcuucuggcgcacccgcuacuggggcccccccuuccuccaggcccccuccgacaccgaccacuacuuccuccgcuacgccguccucccccgcgaggucgucugcaccgagaaccucacccccuggaagaagcuccuccccugcuccuccaaggccggccucuccguccuccucaaggccgaccgccucuuccacaccuccuaccacucccaggccguccacauccgccccgucugccgcaacgcccgcugcaccuccaucuccugggagcuccgccagacccucuccgucgucuucgacgccuucaucaccggccagggcaagaaggacuggucccucuuccgcauguucucccgcacccucaccgagcccugcccccucgccuccgagucccgcgucuacgucgacaucaccaccuacaaccaggacaacgagacccucgagguccaccccccccccaccaccaccuaccaggacgucauccucggcacccgcaagaccuacgccaucuacgaccuccucgacaccgccaugaucaacaacucccgcaaccucaacauccagcucaaguggaagcgcccccccgagaacgaggccccccccguccccuuccuccacgcccagcgcuacgucuccggcuacggccuccagaagggcgagcucuccacccuccucuacaacacccaccccuaccgcgccuuccccguccuccuccucgacaccguccccugguaccuccgccucuacguccacacccucaccaucaccuccaagggcaaggagaacaagcccuccuacauccacuaccagcccgcccaggaccgccuccagccccaccuccucgagaugcucauccagcuccccgccaacuccgucaccaaggucuccauccaguucgagcgcgcccuccucaaguggaccgaguacacccccgaccccaaccacggcuucuacgucucccccuccguccucuccgcccucguccccuccauggucgccgccaagcccgucgacugggaggaguccccccucuucaacucccucuuccccgucuccgacggcuccaacuacuucguccgccucuacaccgagccccuccucgucaaccuccccacccccgacuucuccaugcccuacaacgucaucugccucaccugcaccgucgucgccgucugcuacggcuccuucuacaaccuccucacccgcaccuuccacaucgaggagccccgcaccggcggccucgccaagcgccucgccaaccucauccgccgcgcccgcggcguccccccccucuga

SEQ ID NO: 47640 - RNA, 1308 nt, Artificial Sequence
  derived and/or modified sequence opt2 from PIGU__Homo_sapiens__NP_536724
auggccgccccccucguccucguccucgucgucgccgucaccguccgcgccgcccucuuccgcuccucccucgccgaguucaucuccgagcgcgucgaggucgucuccccccucuccuccuggaagcgcgucgucgagggccucucccuccucgaccucggcgucucccccuacuccggcgccgucuuccacgagaccccccucaucaucuaccucuuccacuuccucaucgacuacgccgagcucgucuucaugaucaccgacgcccucaccgccaucgcccucuacuucgccauccaggacuucaacaaggucgucuucaagaagcagaagcuccuccucgagcucgaccaguacgcccccgacgucgccgagcucauccgcacccccauggagaugcgcuacaucccccucaaggucgcccucuucuaccuccucaaccccuacaccauccucuccugcgucgccaaguccaccugcgccaucaacaacacccucaucgccuucuucauccucaccaccaucaagggcuccgccuuccucuccgccaucuuccucgcccucgccaccuaccagucccucuacccccucacccucuucguccccggccuccucuaccuccuccagcgccaguacauccccgucaagaugaaguccaaggccuucuggaucuucuccugggaguacgccaugauguacgucggcucccucgucgucaucaucugccucuccuucuuccuccucuccuccugggacuucauccccgccgucuacggcuucauccucuccguccccgaccucacccccaacaucggccucuucugguacuucuucgccgagauguucgagcacuucucccucuucuucgucugcgucuuccagaucaacgucuucuucuacaccaucccccucgccaucaagcucaaggagcaccccaucuucuucauguucauccagaucgccgucaucgccaucuucaaguccuaccccaccgucggcgacgucgcccucuacauggccuucuuccccgucuggaaccaccucuaccgcuuccuccgcaacaucuucguccucaccugcaucaucaucgucugcucccuccucuuccccguccucuggcaccucuggaucuacgccggcuccgccaacuccaacuucuucuacgccaucacccucaccuucaacgucggccagauccuccucaucuccgacuacuucuacgccuuccuccgccgcgaguacuaccucacccacggccucuaccucaccgccaaggacggcaccgaggccaugcucguccucaaguga

SEQ ID NO: 47641 - RNA, 1515 nt, Artificial Sequence
  derived and/or modified sequence opt2 from PIGW__Homo_sapiens__NP_848612
auguccgagaagcagaugaaggaggccuucgucuccaaccucaacggcaccaccguccucgagaucacccagggccucugcuuccccgccuucugcauccucugccgcggcuuccucaucaucuucucccaguaccucugcuccuucucccccaccuggaagacccgcuuccucaccgacuucgucguccucaucguccccauggucgccacccucaccaucugggccuccuucauccuccucgagcuccucggcgucaucaucuucggcgccggccuccucuaccagaucuaccgccgccgcaccugcuacgcccgccuccccuuccucaagauccucgagaaguuccucaacaucucccucgaguccgaguacaaccccgccaucuccugcuuccgcgucaucaccuccgccuucaccgccaucgccauccucgccgucgacuucccccucuucccccgccgcuucgccaagaccgagcucuacggcaccggcgccauggacuucggcgucggcggcuucgucuucggcuccgccauggucugccucgagguccgccgccgcaaguacauggagggcuccaagcuccacuacuucaccaacucccucuacuccgucuggccccucgucuuccucggcaucggccgccucgccaucaucaaguccaucggcuaccaggagcaccucaccgaguacggcguccacuggaacuucuucuucaccaucaucgucgucaagcucaucaccccccuccuccucaucaucuucccccucaacaaguccuggaucaucgcccucggcaucaccguccucuaccagcucgcccucgacuucaccucccucaagcgccucauccucuacggcaccgacggcuccggcacccgcgucggccuccucaacgccaaccgcgagggcaucaucuccacccucggcuacgucgccauccacauggccggcguccagaccggccucuacaugcacaagaaccgcucccacaucaaggaccucaucaaggucgccugcuuccuccuccucgccgccaucucccucuucaucucccucuacgucguccaggucaacgucgaggccgucucccgccgcauggccaaccucgccuucugcaucuggaucgucgccuccucccucauccuccucuccucccuccuccucggcgacaucauccucuccuucgccaaguuccucaucaagggcgcccucguccccugcuccuggaagcucauccagucccccgucaccaacaagaagcacuccgagucccucguccccgaggccgagcgcauggagcccucccucugccucaucaccgcccucaaccgcaagcagcucaucuucuuccuccucuccaacaucaccaccggccucaucaaccucauggucgacacccuccacuccuccacccucugggcccucuucgucgucaaccucuacauguucuccaacugccucaucgucuacguccucuaccuccaggacaagaccguccaguucugguga

SEQ ID NO: 47642 - RNA, 216 nt, Artificial Sequence
  derived and/or modified sequence opt2 from PIGY__Homo_sapiens__NP_001036081
auguuccucucccuccccacccucaccguccucaucccccucgucucccucgccggccucuucuacuccgccuccgucgaggagaacuucccccagggcugcaccuccaccgccucccucugcuucuacucccuccuccuccccaucaccauccccgucuacgucuucuuccaccucuggaccuggaugggcaucaagcucuuccgccacaacuga

SEQ ID NO: 47643 - RNA, 873 nt, Artificial Sequence
  derived and/or modified sequence opt2 from PIH1D1__Homo_sapiens__NP_060386
auggccaaccccaagcuccucggcaugggccucuccgaggccgaggccaucggcgccgacuccgcccgcuucgaggagcuccuccuccaggccuccaaggagcuccagcaggcccagaccacccgccccgaguccacccagauccagccccagcccggcuucugcaucaagaccaacuccuccgagggcaaggucuucaucaacaucugccacucccccuccauccccccccccgccgacgucaccgaggaggagcuccuccagaugcucgaggaggaccaggccggcuuccgcauccccaugucccucggcgagccccacgccgagcucgacgccaagggccagggcugcaccgccuacgacgucgccgucaacuccgacuucuaccgccgcaugcagaacuccgacuuccuccgcgagcucgucaucaccaucgcccgcgagggccucgaggacaaguacaaccuccagcucaaccccgaguggcgcaugaugaagaaccgccccuucaugggcuccaucucccagcagaacauccgcuccgagcagcgcccccgcauccaggagcucggcgaccucuacacccccgcccccggccgcgccgaguccggccccgagaagccccaccucaaccucuggcucgaggcccccgaccuccuccucgccgaggucgaccuccccaagcucgacggcgcccucggccucucccucgagaucggcgagaaccgccucgucaugggcggcccccagcagcucuaccaccucgacgccuacaucccccuccagaucaacucccacgaguccaaggccgccuuccaccgcaagcgcaagcagcucauggucgccaugccccuccuccccguccccuccuga

SEQ ID NO: 47644 - RNA, 2418 nt, Artificial Sequence
  derived and/or modified sequence opt2 from PIK3AP1__Homo_sapiens__NP_689522
auggccgccuccggcgucccccgcggcugcgacauccucaucgucuacucccccgacgccgaggaguggugccaguaccuccagacccucuuccucuccucccgccagguccgcucccagaagauccucacccaccgccucggccccgaggccuccuucuccgccgaggaccucucccucuuccucuccacccgcugcgucgucguccuccucuccgccgagcucguccagcacuuccacaagcccgcccuccucccccuccuccagcgcgccuuccaccccccccaccgcgucguccgccuccucugcggcguccgcgacuccgaggaguuccucgacuucuuccccgacugggcccacuggcaggagcucaccugcgacgacgagcccgagaccuacgucgccgccgucaagaaggccaucuccgaggacuccggcugcgacuccgucaccgacaccgagcccgaggacgagaaggucgucuccuacuccaagcagcagaaccuccccaccgucaccucccccggcaaccucauggucguccagcccgaccgcauccgcugcggcgccgagaccaccgucuacgucaucguccgcugcaagcucgacgaccgcgucgccaccgaggccgaguucucccccgaggacucccccuccguccgcauggaggccaaggucgagaacgaguacaccaucuccgucaaggcccccaaccucuccuccggcaacgucucccucaagaucuacuccggcgaccucgucgucugcgagaccgucaucuccuacuacaccgacauggaggagaucggcaaccuccucuccaacgccgccaaccccgucgaguucaugugccaggccuucaagaucguccccuacaacaccgagacccucgacaagcuccucaccgagucccucaagaacaacauccccgccuccggccuccaccucuucggcaucaaccagcucgaggaggaggacaugaugaccaaccagcgcgacgaggagcuccccacccuccuccacuucgccgccaaguacggccucaagaaccucaccgcccuccuccucaccugccccggcgcccuccaggccuacuccgucgccaacaagcacggccacuaccccaacaccaucgccgagaagcacggcuuccgcgaccuccgccaguucaucgacgaguacgucgagaccgucgacaugcucaagucccacaucaaggaggagcucaugcacggcgaggaggccgacgccgucuacgaguccauggcccaccucuccaccgaccuccucaugaagugcucccucaaccccggcugcgacgaggaccucuacgaguccauggccgccuucguccccgccgccaccgaggaccucuacgucgagaugcuccaggccuccaccuccaaccccauccccggcgacggcuucucccgcgccaccaaggacuccaugauccgcaaguuccucgagggcaacuccaugggcaugaccaaccucgagcgcgaccagugccaccucggccaggaggaggacgucuaccacaccgucgacgacgacgaggccuucuccgucgaccucgccucccgcccccccguccccgucccccgccccgagaccaccgcccccggcgcccaccagcuccccgacaacgagcccuacaucuucaaggucuucgccgagaagucccaggagcgccccggcaacuucuacgucuccuccgaguccauccgcaagggcccccccguccgccccuggcgcgaccgcccccaguccuccaucuacgaccccuucgccggcaugaagacccccggccagcgccagcucaucacccuccaggagcaggucaagcucggcaucgucaacgucgacgaggccguccuccacuucaaggaguggcagcucaaccagaagaagcgcuccgaguccuuccgcuuccagcaggagaaccucaagcgccuccgcgacuccaucacccgccgccagcgcgagaagcagaaguccggcaagcagaccgaccucgagaucaccguccccauccgccacucccagcaccuccccgccaaggucgaguucggcgucuacgaguccggcccccgcaaguccgucauccccccccgcaccgagcuccgccgcggcgacuggaagaccgacuccaccuccuccaccgccuccuccaccuccaaccgcuccuccacccgcucccuccucuccgucuccuccggcauggagggcgacaacgaggacaacgagguccccgaggucacccgcucccgcucccccggccccccccaggucgacggcacccccaccaugucccucgagcgccccccccgcguccccccccgcgccgccucccagcgcccccccacccgcgagaccuuccacccccccccccccguccccccccgcggccgcuga

SEQ ID NO: 47645 - RNA, 5061 nt, Artificial Sequence
  derived and/or modified sequence opt2 from PIK3C2A__Homo_sapiens__NP_002636
auggcccagaucuccuccaacuccggcuucaaggagugccccuccucccaccccgagcccacccgcgccaaggacgucgacaaggaggaggcccuccagauggaggccgaggcccucgccaagcuccagaaggaccgccaggucaccgacaaccagcgcggcuucgagcucuccuccuccacccgcaagaaggcccaggucuacaacaagcaggacuacgaccucauggucuuccccgaguccgacucccagaagcgcgcccucgacaucgacgucgagaagcucacccaggccgagcucgagaagcuccuccucgacgacuccuucgagaccaagaagacccccguccuccccgucacccccauccucucccccuccuucuccgcccagcucuacuuccgccccaccauccagcgcggccaguggccccccggccuccccggccccuccaccuacgcccuccccuccaucuaccccuccaccuacuccaagcaggccgccuuccagaacggcuucaacccccgcaugcccaccuuccccuccaccgagcccaucuaccucucccuccccggccagucccccuacuucuccuacccccucacccccgccacccccuuccacccccagggcucccuccccaucuaccgccccgucgucuccaccgacauggccaagcucuucgacaagaucgccuccaccuccgaguuccucaagaacggcaaggcccgcaccgaccucgagaucaccgacuccaaggucuccaaccuccaggucucccccaaguccgaggacaucuccaaguucgacuggcucgaccucgacccccucuccaagcccaaggucgacaacgucgagguccucgaccacgaggaggagaagaacgucuccucccuccucgccaaggaccccugggacgccguccuccucgaggagcgcuccaccgccaacugccaccucgagcgcaaggucaacggcaagucccucuccgucgccaccgucacccgcucccagucccucaacauccgcaccacccagcucgccaaggcccagggccacaucucccagaaggaccccaacggcaccuccucccuccccaccggcuccucccuccuccaggaggucgagguccagaacgaggagauggccgccuucugccgcuccaucaccaagcucaagaccaaguuccccuacaccaaccaccgcaccaaccccggcuaccuccucucccccgucaccgcccagcgcaacaucugcggcgagaacgccuccgucaaggucuccaucgacaucgagggcuuccagcuccccgucaccuucaccugcgacgucuccuccaccgucgagaucaucaucaugcaggcccucugcuggguccacgacgaccucaaccaggucgacgucggcuccuacguccucaaggucugcggccaggaggagguccuccagaacaaccacugccucggcucccacgagcacauccagaacugccgcaagugggacaccgagauccgccuccagcuccucaccuucuccgccaugugccagaaccucgcccgcaccgccgaggacgacgagacccccgucgaccucaacaagcaccucuaccagaucgagaagcccugcaaggaggccaugacccgccaccccgucgaggagcuccucgacuccuaccacaaccaggucgagcucgcccuccagaucgagaaccagcaccgcgccgucgaccaggucaucaaggccguccgcaagaucugcuccgcccucgacggcgucgagacccucgccaucaccgaguccgucaagaagcucaagcgcgccgucaaccucccccgcuccaagaccgccgacgucaccucccucuucggcggcgaggacaccucccgcuccuccacccgcggcucccucaaccccgagaaccccguccaggucuccaucaaccagcucaccgccgccaucuacgaccuccuccgccuccacgccaacuccggccgcucccccaccgacugcgcccaguccuccaaguccgucaaggaggccuggaccaccaccgagcagcuccaguucaccaucuucgccgcccacggcaucuccuccaacugggucuccaacuacgagaaguacuaccucaucugcucccucucccacaacggcaaggaccucuucaagcccauccaguccaagaaggucggcaccuacaagaacuucuucuaccucaucaagugggacgagcucaucaucuuccccauccagaucucccagcucccccucgaguccguccuccaccucacccucuucggcauccucaaccaguccuccggcuccucccccgacuccaacaagcagcgcaagggccccgaggcccucggcaaggucucccucccccucuucgacuucaagcgcuuccucaccugcggcaccaagcuccucuaccucuggaccuccucccacaccaacuccguccccggcaccgucaccaagaagggcuacgucauggagcgcaucguccuccaggucgacuuccccucccccgccuucgacaucaucuacaccaccccccaggucgaccgcuccaucauccagcagcacaaccucgagacccucgagaacgacaucaagggcaagcuccucgacauccuccacaaggacuccucccucggccucuccaaggaggacaaggccuuccucugggagaagcgcuacuacugcuucaagcaccccaacugccuccccaagauccucgccuccgcccccaacuggaagugggucaaccucgccaagaccuacucccuccuccaccaguggcccgcccucuacccccucaucgcccucgagcuccucgacuccaaguucgccgaccaggagguccgcucccucgccgucaccuggaucgaggccaucuccgacgacgagcucaccgaccuccucccccaguucguccaggcccucaaguacgagaucuaccucaacuccucccucguccaguuccuccucucccgcgcccucggcaacauccagaucgcccacaaccucuacuggcuccucaaggacgcccuccacgacguccaguucuccacccgcuacgagcacguccucggcgcccuccucuccgucggcggcaagcgccuccgcgaggagcuccucaagcagaccaagcucguccagcuccucggcggcgucgccgagaagguccgccaggccuccggcuccgcccgccaggucguccuccagcgcuccauggagcgcguccaguccuucuuccagaagaacaagugccgccucccccucaagcccucccucgucgccaaggagcucaacaucaaguccugcuccuucuucuccuccaacgccgucccccucaaggucaccauggucaacgccgaccccaugggcgaggagaucaacgucauguucaaggucggcgaggaccuccgccaggacaugcucgcccuccagaugaucaagaucauggacaagaucuggcucaaggagggccucgaccuccgcauggucaucuucaagugccucuccaccggccgcgaccgcggcauggucgagcucguccccgccuccgacacccuccgcaagauccaggucgaguacggcgucaccggcuccuucaaggacaagccccucgccgaguggcuccgcaaguacaaccccuccgaggaggaguacgagaaggccuccgagaacuucaucuacuccugcgccggcugcugcgucgccaccuacguccucggcaucugcgaccgccacaacgacaacaucaugcuccgcuccaccggccacauguuccacaucgacuucggcaaguuccucggccacgcccagauguucggcuccuucaagcgcgaccgcgcccccuucguccucaccuccgacauggccuacgucaucaacggcggcgagaagcccaccauccgcuuccagcucuucgucgaccucugcugccaggccuacaaccucauccgcaagcagaccaaccucuuccucaaccuccucucccucaugauccccuccggccuccccgagcucaccuccauccaggaccucaaguacguccgcgacgcccuccagccccagaccaccgacgccgaggccaccaucuucuucacccgccucaucgaguccucccucggcuccaucgccaccaaguucaacuucuucauccacaaccucgcccagcuccgcuucuccggccuccccuccaacgacgagcccauccucuccuucucccccaagaccuacuccuuccgccaggacggccgcaucaaggaggucuccgucuucaccuaccacaagaaguacaaccccgacaagcacuacaucuacgucguccgcauccuccgcgagggccagaucgagcccuccuucgucuuccgcaccuucgacgaguuccaggagcuccacaacaagcucuccaucaucuucccccucuggaagcuccccggcuuccccaaccgcaugguccucggccgcacccacaucaaggacgucgccgccaagcgcaagaucgagcucaacuccuaccuccagucccucaugaacgccuccaccgacgucgccgagugcgaccucgucugcaccuucuuccacccccuccuccgcgacgagaaggccgagggcaucgcccgcuccgccgacgccggcuccuucucccccacccccggccagaucggcggcgccgucaagcucuccaucuccuaccgcaacggcacccucuucaucauggucaugcacaucaaggaccucgucaccgaggacggcgccgaccccaaccccuacgucaagaccuaccuccuccccgacaaccacaagaccuccaagcgcaagaccaagaucucccgcaagacccgcaaccccaccuucaacgagaugcucgucuacuccggcuacuccaaggagacccuccgccagcgcgagcuccagcucuccguccucuccgccgagucccuccgcgagaacuucuuccucggcggcgucacccucccccucaaggacuucaaccucuccaaggagaccgucaagugguaccagcucaccgccgccaccuaccucuga

SEQ ID NO: 47646 - RNA, 4905 nt, Artificial Sequence
  derived and/or modified sequence opt2 from PIK3C2B__Homo_sapiens__NP_002637
auguccuccacccagggcaacggcgagcacuggaagucccucgaguccgucggcaucucccgcaaggagcucgccauggccgaggcccuccagauggaguacgacgcccucucccgccuccgccacgacaaggaggagaaccgcgccaagcagaacgccgaccccucccucaucuccugggacgagcccggcgucgacuucuacuccaagcccgccggccgccgcaccgaccucaagcuccuccgcggccucuccggcuccgaccccacccucaacuacaacucccucuccccccaggagggcccccccaaccacuccaccucccagggcccccagcccggcuccgaccccuggcccaagggcucccucuccggcgacuaccucuacaucuucgacggcuccgacggcggcgucuccuccucccccggccccggcgacaucgagggcuccugcaagaagcucuccccccccccccuccccccccgcgccuccaucugggacacccccccccuccccccccgcaagggcucccccuccuccuccaagaucucccagcccuccgacaucaacaccuucucccucgucgagcagcuccccggcaagcuccucgagcaccgcauccucgaggaggaggagguccucggcggcggcggccagggccgccuccucggcuccgucgacuacgacggcaucaacgacgccaucacccgccucaaccucaaguccaccuacgacgccgagaugcuccgcgacgccacccgcggcuggaaggagggccgcggcccccucgacuucuccaaggacaccuccggcaagcccgucgcccgcuccaagaccaugcccccccagguccccccccgcaccuacgccucccgcuacggcaaccgcaagaacgccacccccggcaagaaccgccgcaucuccgccgcccccgucggcucccgcccccacaccgucgccaacggccacgagcucuucgaggucuccgaggagcgcgacgaggaggucgccgccuucugccacaugcucgacauccuccgcuccggcuccgacauccaggacuacuuccucaccggcuacgucugguccgccgucacccccucccccgagcaccucggcgacgaggucaaccucaaggucaccguccucugcgaccgccuccaggaggcccucaccuucaccugcaacugcuccuccaccgucgaccuccucaucuaccagacccucugcuacacccacgacgaccuccgcaacgucgacgucggcgacuucguccucaagcccugcggccucgaggaguuccuccagaacaagcacgcccucggcucccacgaguacauccaguacugccgcaaguucgacaucgacauccgccuccagcucauggagcagaaggucguccgcuccgaccucgcccgcaccgucaacgacgaccagucccccuccacccucaacuaccucguccaccuccaggagcgccccgucaagcagaccaucucccgccaggcccucucccuccucuucgacaccuaccacaacgaggucgacgccuuccuccucgccgacggcgacuucccccucaaggccgaccgcgucguccaguccgucaaggccaucugcaacgcccucgccgccgucgagacccccgagaucaccuccgcccucaaccagcucccccccugccccucccgcaugcagcccaagauccagaaggaccccuccguccucgccguccgcgagaaccgcgagaaggucgucgaggcccucaccgccgccauccucgaccucgucgagcucuacugcaacaccuucaacgccgacuuccagaccgccguccccggcucccgcaagcacgaccucguccaggaggccugccacuucgcccgcucccucgccuucaccgucuacgccacccaccgcauccccaucaucugggccaccuccuacgaggacuucuaccucuccugcucccucucccacggcggcaaggagcucugcuccccccuccagacccgccgcgcccacuucuccaaguaccucuuccaccucaucgucugggaccagcagaucugcuuccccguccaggucaaccgccucccccgcgagacccuccucugcgccacccucuacgcccuccccauccccccccccggcuccuccuccgaggccaacaagcagcgccgcguccccgaggcccucggcugggucaccaccccccucuucaacuuccgccagguccucaccugcggccgcaagcuccucggccucuggcccgccacccaggagaaccccuccgcccgcugguccgcccccaacuuccaccagcccgacuccgucauccuccagaucgacuuccccaccuccgccuucgacaucaaguucaccuccccccccggcgacaaguucuccccccgcuacgaguucggcucccuccgcgaggaggaccagcgcaagcucaaggacaucaugcagaaggagucccucuacuggcucaccgacgccgacaagaagcgccucugggagaagcgcuacuacugccacuccgaggucuccucccucccccucguccucgccuccgcccccuccugggagugggccugccuccccgacaucuacguccuccucaagcaguggacccacaugaaccaccaggacgcccucggccuccuccacgccaccuuccccgaccaggagguccgccgcauggccguccaguggaucggcucccucuccgacgccgagcuccucgacuaccucccccagcucguccaggcccucaaguacgagugcuaccucgacuccccccucguccgcuuccuccucaagcgcgccgucuccgaccuccgcgucacccacuacuucuucuggcuccucaaggacggccucaaggacucccaguucuccauccgcuaccaguaccuccucgccgcccuccucugcugcugcggcaagggccuccgcgaggaguucaaccgccagugcuggcucgucaacgcccucgccaagcucgcccagcagguccgcgaggccgcccccuccgcccgccagggcauccuccgcaccggccucgaggaggucaagcaguucuucgcccucaacggcuccugccgccucccccucucccccucccuccucgucaagggcaucgucccccgcgacugcuccuacuucaacuccaacgccgucccccucaagcucuccuuccagaacgucgacccccucggcgagaacauccgcgucaucuucaagugcggcgacgaccuccgccaggacaugcucacccuccagaugauccgcaucauguccaagaucuggguccaggagggccucgacaugcgcauggucaucuuccgcugcuucuccaccggccgcggccgcggcauggucgagaugauccccaacgccgagacccuccgcaagauccaggucgagcacggcgucaccggcuccuucaaggaccgcccccucgccgacuggcuccagaagcacaaccccggcgaggacgaguacgagaaggccgucgagaacuucaucuacuccugcgccggcugcugcgucgccaccuacguccucggcaucugcgaccgccacaacgacaacaucaugcucaagaccaccggccacauguuccacaucgacuucggccgcuuccucggccacgcccagauguucggcaacaucaagcgcgaccgcgcccccuucgucuucaccuccgacauggccuacgucaucaacggcggcgacaagcccuccucccgcuuccacgacuucgucgaccucugcugccaggccuacaaccucauccgcaagcacacccaccucuuccucaaccuccucggccucaugcucuccugcggcauccccgagcucuccgaccucgaggaccucaaguacgucuacgacgcccuccgcccccaggacaccgaggccaacgccaccaccuacuucacccgccucaucgaguccucccucggcuccgucgccaccaagcucaacuucuucauccacaaccucgcccagaugaaguucaccggcuccgacgaccgccucacccucuccuucgccucccgcacccacacccucaaguccuccggccgcaucuccgacgucuuccucugccgccacgagaagaucuuccaccccaacaagggcuacaucuacgucgucaaggucaugcgcgagaacacccacgaggccaccuacauccagcgcaccuucgaggaguuccaggagcuccacaacaagcuccgccuccucuuccccuccucccaccuccccuccuuccccucccgcuucgucaucggccgcucccgcggcgaggccgucgccgagcgccgccgcgaggagcucaacggcuacaucuggcaccucauccacgccccccccgaggucgccgagugcgaccucgucuacaccuucuuccacccccucccccgcgacgagaaggccaugggcaccucccccgcccccaaguccuccgacggcaccugggcccgccccgucggcaaggucggcggcgaggucaagcucuccaucuccuacaagaacaacaagcucuucaucauggucaugcacauccgcggccuccagcuccuccaggacggcaacgaccccgaccccuacgucaagaucuaccuccuccccgacccccagaagaccaccaagcgcaagaccaaggucgcccgcaagaccugcaaccccaccuacaacgagaugcucgucuacgacggcauccccaagggcgaccuccagcagcgcgagcuccagcucuccguccucuccgagcagggcuucugggagaacguccuccucggcgaggucaacauccgccuccgcgagcucgaccucgcccaggagaagaccggcugguucgcccucggcucccgcucccacggcacccucuga

SEQ ID NO: 47647 - RNA, 4461 nt, Artificial Sequence
  derived and/or modified sequence opt2 from PIK3C2G__Homo_sapiens__NP_001275701
auggccuacuccuggcagaccgaccccaaccccaacgagucccacgagaagcaguacgagcaccaggaguuccucuucgucaaccagccccacuccuccucccaggucucccucggcuucgaccagaucgucgacgagaucuccggcaagaucccccacuacgaguccgagaucgacgagaacaccuucuucguccccaccgcccccaagugggacuccaccggccacucccucaacgaggcccaccagaucucccucaacgaguucaccuccaagucccgcgagcucuccuggcaccaggucuccaaggcccccgccaucggcuucucccccuccguccuccccaagccccagaacaccaacaaggagugcuccuggggcucccccaucggcaagcaccacggcgccgacgacucccgcuucuccauccucgcccccuccuucaccucccucgacaagaucaaccucgagaaggagcucgagaacgagaaccacaacuaccacaucggcuucgaguccuccaucccccccaccaacuccuccuucuccuccgacuucaugcccaaggaggagaacaagcgcuccggccacgucaacaucgucgagcccucccucaugcuccucaagggcucccuccagcccggcaugugggaguccaccuggcagaagaacaucgaguccaucggcugcuccauccagcucgucgaggucccccaguccuccaacaccucccucgccuccuucugcaacaaggucaagaagauccgcgagcgcuaccacgccgccgacgucaacuucaacuccggcaagaucugguccaccaccaccgccuuccccuaccagcucuucuccaagaccaaguucaacauccacaucuucaucgacaacuccacccagccccuccacuucaugcccugcgccaacuaccucgucaaggaccucaucgccgagauccuccacuucugcaccaacgaccagcuccuccccaaggaccacauccucuccgucugcggcuccgaggaguuccuccagaacgaccacugccucggcucccacaagauguuccagaaggacaaguccgucauccagcuccaccuccagaagucccgcgaggcccccggcaagcucucccgcaagcacgaggaggaccacucccaguucuaccucaaccagcuccucgaguucaugcacaucuggaaggucucccgccagugccuccucacccucauccgcaaguacgacuuccaccucaaguaccuccucaagacccaggagaacgucuacaacaucaucgaggaggucaagaagaucugcuccguccucggcugcgucgagaccaagcagaucaccgacgccgucaacgagcucucccucauccuccagcgcaagggcgagaacuucuaccaguccuccgagaccuccgccaagggccucaucgagaaggucaccaccgagcucuccaccuccaucuaccagcucaucaacgucuacugcaacuccuucuacgccgacuuccagcccgucaacgucccccgcugcaccuccuaccucaaccccggccuccccucccaccucuccuucaccgucuacgccgcccacaacauccccgagaccuggguccacuccuacaaggccuucuccuucaccugcuggcucaccuacgccggcaagaagcucugccagguccgcaacuaccgcaacauccccgacaagaagcucuucuucuuccucgucaacuggaacgagaccaucaacuucccccucgagaucaagucccucccccgcgaguccaugcucaccgucaagcucuucggcaucgccugcgccaccaacaacgccaaccuccucgccuggaccugccucccccucuuccccaaggagaaguccauccucggcuccaugcucuucuccaugacccuccaguccgagccccccgucgagaugaucacccccggcgucugggacgucucccagcccucccccgucacccuccagaucgacuuccccgccaccggcugggaguacaugaagcccgacuccgaggagaaccgcuccaaccucgaggagccccucaaggagugcaucaagcacaucgcccgccucucccagaagcagaccccccuccuccucuccgaggagaagaagcgcuaccucugguucuaccgcuucuacugcaacaacgagaacugcucccucccccucguccucggcuccgcccccggcugggacgagcgcaccgucuccgagaugcacaccauccuccgccgcuggaccuucucccagccccucgaggcccucggccuccucaccuccuccuuccccgaccaggagauccgcaaggucgccguccagcagcucgacaaccuccucaacgacgagcuccucgaguaccucccccagcucguccaggccgucaaguucgaguggaaccucgaguccccccucguccagcuccuccuccaccgcucccuccaguccauccaggucgcccaccgccucuacuggcuccucaagaacgccgagaacgaggccuacuucaaguccugguaccagaagcuccucgccgcccuccaguucugcgccggcaaggcccucaacgacgaguucuccaaggagcagaagcucaucaagauccucggcgacaucggcgagcgcgucaaguccgccuccgaccaccagcgccaggagguccucaagaaggagaucggccgccucgaggaguucuuccaggacgucaacaccugccaccucccccucaaccccgcccucugcaucaagggcaucgaccacgacgccugcuccuacuucaccuccaacgcccucccccucaagaucaccuucaucaacgccaaccccaugggcaagaacaucuccaucaucuucaaggccggcgacgaccuccgccaggacaugcucguccuccagcucauccaggucauggacaacaucuggcuccaggagggccucgacaugcagaugaucaucuaccgcugccucuccaccggcaaggaccagggccucguccagaugguccccgacgccgucacccucgccaagauccaccgccacuccggccucaucggcccccucaaggagaacaccaucaagaagugguucucccagcacaaccaccucaaggccgacuacgagaaggcccuccgcaacuucuucuacuccugcgccggcuggugcgucgucaccuucauccucggcgucugcgaccgccacaacgacaacaucaugcucaccaaguccggccacauguuccacaucgacuucggcaaguuccucggccacgcccagaccuucggcggcaucaagcgcgaccgcgcccccuucaucuucaccuccgagauggaguacuucaucaccgagggcggcaagaacccccagcacuuccaggacuucgucgagcucugcugccgcgccuacaacaucauccgcaagcacucccagcuccuccucaaccuccucgagaugaugcucuacgccggccuccccgagcucuccggcauccaggaccucaaguacgucuacaacaaccuccgcccccaggacaccgaccucgaggccaccucccacuucaccaagaagaucaaggagucccucgagugcuuccccgucaagcucaacaaccucauccacacccucgcccagauguccgccaucucccccgccaaguccaccucccagaccuucccccaggaguccugccuccucuccaccacccgcuccaucgagcgcgccaccauccucggcuucuccaagaaguccuccaaccucuaccucauccaggucacccacuccaacaacgagaccucccucaccgagaaguccuucgagcaguucuccaagcuccacucccagcuccagaagcaguucgccucccucacccuccccgaguucccccacugguggcaccuccccuucaccaacuccgaccaccgccgcuuccgcgaccucaaccacuacauggagcagauccucaacgucucccacgaggucaccaacuccgacugcguccucuccuucuuccucuccgaggccguccagcagaccgucgaggaguccucccccgucuaccucggcgagaaguuccccgacaagaagcccaagguccagcucgucaucuccuacgaggacgucaagcucaccauccucgucaagcacaugaagaacauccaccuccccgacggcuccgcccccuccgcccacgucgaguucuaccuccuccccuaccccuccgagguccgccgccgcaagaccaaguccguccccaagugcaccgaccccaccuacaacgagaucgucgucuacgacgaggucaccgagcuccagggccacguccucaugcucaucgucaaguccaagaccgucuucgucggcgccaucaacauccgccucugcuccgucccccucgacaaggagaagugguacccccucggcaacuccaucaucuga

SEQ ID NO: 47648 - RNA, 2664 nt, Artificial Sequence
  derived and/or modified sequence opt2 from PIK3C3__Homo_sapiens__NP_002638
augggcgaggccgagaaguuccacuacaucuacuccugcgaccucgacaucaacguccagcucaagaucggcucccucgagggcaagcgcgagcagaaguccuacaaggccguccucgaggaccccaugcucaaguucuccggccucuaccaggagaccugcuccgaccucuacgucaccugccaggucuucgccgagggcaagccccucgcccuccccguccgcaccuccuacaaggccuucuccacccgcuggaacuggaacgaguggcucaagcuccccgucaaguaccccgaccucccccgcaacgcccaggucgcccucaccaucugggacgucuacggccccggcaaggccguccccgucggcggcaccaccgucucccucuucggcaaguacggcauguuccgccagggcaugcacgaccucaaggucuggcccaacgucgaggccgacggcuccgagcccaccaagacccccggccgcaccuccuccacccucuccgaggaccagaugucccgccucgccaagcucaccaaggcccaccgccagggccacauggucaaggucgacuggcucgaccgccucaccuuccgcgagaucgagaugaucaacgaguccgagaagcgcuccuccaacuucauguaccucauggucgaguuccgcugcgucaagugcgacgacaaggaguacggcaucgucuacuacgagaaggacggcgacgaguccucccccauccucaccuccuucgagcucgucaagguccccgacccccagauguccauggagaaccucgucgaguccaagcaccacaagcucgcccgcucccuccgcuccggccccuccgaccacgaccucaagcccaacgccgccacccgcgaccagcucaacaucaucgucuccuacccccccaccaagcagcucaccuacgaggagcaggaccucgucuggaaguuccgcuacuaccucaccaaccaggagaaggcccucaccaaguuccucaagugcgucaacugggaccucccccaggaggccaagcaggcccucgagcuccucggcaaguggaagcccauggacgucgaggacucccucgagcuccucuccucccacuacaccaaccccaccguccgccgcuacgccgucgcccgccuccgccaggccgacgacgaggaccuccucauguaccuccuccagcucguccaggcccucaaguacgagaacuucgacgacaucaagaacggccucgagcccaccaagaaggacucccaguccuccgucuccgagaacgucuccaacuccggcaucaacuccgccgagaucgacuccucccagaucaucaccuccccccuccccuccgucuccucccccccccccgccuccaagaccaaggagguccccgacggcgagaaccucgagcaggaccucugcaccuuccucaucucccgcgccugcaagaacuccacccucgccaacuaccucuacugguacgucaucgucgagugcgaggaccaggacacccagcagcgcgaccccaagacccacgagauguaccucaacgucaugcgccgcuucucccaggcccuccucaagggcgacaaguccguccgcgucaugcgcucccuccucgccgcccagcagaccuucgucgaccgccucguccaccucaugaaggccguccagcgcgaguccggcaaccgcaagaagaagaacgagcgccuccaggcccuccucggcgacaacgagaagaugaaccucuccgacgucgagcucaucccccucccccucgagccccaggucaagauccgcggcaucauccccgagaccgccacccucuucaaguccgcccucaugcccgcccagcucuucuucaagaccgaggacggcggcaaguaccccgucaucuucaagcacggcgacgaccuccgccaggaccagcucauccuccagaucaucucccucauggacaagcuccuccgcaaggagaaccucgaccucaagcucacccccuacaagguccucgccaccuccaccaagcacggcuucaugcaguucauccaguccguccccgucgccgagguccucgacaccgagggcuccauccagaacuucuuccgcaaguacgcccccuccgagaacggccccaacggcaucuccgccgaggucauggacaccuacgucaaguccugcgccggcuacugcgucaucaccuacauccucggcgucggcgaccgccaccucgacaaccuccuccucaccaagaccggcaagcucuuccacaucgacuucggcuacauccucggccgcgaccccaagccccuccccccccccaugaagcucaacaaggagauggucgagggcaugggcggcacccaguccgagcaguaccaggaguuccgcaagcagugcuacaccgccuuccuccaccuccgccgcuacuccaaccucauccucaaccucuucucccucauggucgacgccaacauccccgacaucgcccucgagcccgacaagaccgucaagaagguccaggacaaguuccgccucgaccucuccgacgaggaggccguccacuacaugcagucccucaucgacgaguccguccacgcccucuucgccgccgucgucgagcagauccacaaguucgcccaguacuggcgcaaguga

SEQ ID NO: 47649 - RNA, 3207 nt, Artificial Sequence
  derived and/or modified sequence opt2 from PIK3CA__Homo_sapiens__NP_006209
augcccccccgccccuccuccggcgagcucuggggcauccaccucaugcccccccgcauccucgucgagugccuccuccccaacggcaugaucgucacccucgagugccuccgcgaggccacccucaucaccaucaagcacgagcucuucaaggaggcccgcaaguacccccuccaccagcuccuccaggacgaguccuccuacaucuucgucuccgucacccaggaggccgagcgcgaggaguucuucgacgagacccgccgccucugcgaccuccgccucuuccagcccuuccucaaggucaucgagcccgucggcaaccgcgaggagaagauccucaaccgcgagaucggcuucgccaucggcaugcccgucugcgaguucgacauggucaaggaccccgagguccaggacuuccgccgcaacauccucaacgucugcaaggaggccgucgaccuccgcgaccucaacuccccccacucccgcgccauguacgucuacccccccaacgucgaguccucccccgagcuccccaagcacaucuacaacaagcucgacaagggccagaucaucgucgucaucugggucaucgucucccccaacaacgacaagcagaaguacacccucaagaucaaccacgacugcguccccgagcaggucaucgccgaggccauccgcaagaagacccgcuccaugcuccucuccuccgagcagcucaagcucugcguccucgaguaccagggcaaguacauccucaaggucugcggcugcgacgaguacuuccucgagaaguacccccucucccaguacaaguacauccgcuccugcaucaugcucggccgcaugcccaaccucaugcucauggccaaggagucccucuacucccagcuccccauggacugcuucaccaugcccuccuacucccgccgcaucuccaccgccacccccuacaugaacggcgagaccuccaccaagucccucugggucaucaacuccgcccuccgcaucaagauccucugcgccaccuacgucaacgucaacauccgcgacaucgacaagaucuacguccgcaccggcaucuaccacggcggcgagccccucugcgacaacgucaacacccagcgcguccccugcuccaacccccgcuggaacgaguggcucaacuacgacaucuacauccccgaccucccccgcgccgcccgccucugccucuccaucugcuccgucaagggccgcaagggcgccaaggaggagcacugcccccucgccuggggcaacaucaaccucuucgacuacaccgacacccucgucuccggcaagauggcccucaaccucuggcccgucccccacggccucgaggaccuccucaaccccaucggcgucaccggcuccaaccccaacaaggagacccccugccucgagcucgaguucgacugguucuccuccgucgucaaguuccccgacauguccgucaucgaggagcacgccaacugguccgucucccgcgaggccggcuucuccuacucccacgccggccucuccaaccgccucgcccgcgacaacgagcuccgcgagaacgacaaggagcagcucaaggccaucuccacccgcgacccccucuccgagaucaccgagcaggagaaggacuuccucuggucccaccgccacuacugcgucaccauccccgagauccuccccaagcuccuccucuccgucaaguggaacucccgcgacgaggucgcccagauguacugccucgucaaggacuggccccccaucaagcccgagcaggccauggagcuccucgacugcaacuaccccgaccccaugguccgcggcuucgccguccgcugccucgagaaguaccucaccgacgacaagcucucccaguaccucauccagcucguccagguccucaaguacgagcaguaccucgacaaccuccucguccgcuuccuccucaagaaggcccucaccaaccagcgcaucggccacuucuucuucuggcaccucaaguccgagaugcacaacaagaccgucucccagcgcuucggccuccuccucgaguccuacugccgcgccugcggcauguaccucaagcaccucaaccgccaggucgaggccauggagaagcucaucaaccucaccgacauccucaagcaggagaagaaggacgagacccagaagguccagaugaaguuccucgucgagcagaugcgccgccccgacuucauggacgcccuccagggcuuccucuccccccucaaccccgcccaccagcucggcaaccuccgccucgaggagugccgcaucauguccuccgccaagcgcccccucuggcucaacugggagaaccccgacaucauguccgagcuccucuuccagaacaacgagaucaucuucaagaacggcgacgaccuccgccaggacaugcucacccuccagaucauccgcaucauggagaacaucuggcagaaccagggccucgaccuccgcaugcuccccuacggcugccucuccaucggcgacugcgucggccucaucgaggucguccgcaacucccacaccaucaugcagauccagugcaagggcggccucaagggcgcccuccaguucaacucccacacccuccaccaguggcucaaggacaagaacaagggcgagaucuacgacgccgccaucgaccucuucacccgcuccugcgccggcuacugcgucgccaccuucauccucggcaucggcgaccgccacaacuccaacaucauggucaaggacgacggccagcucuuccacaucgacuucggccacuuccucgaccacaagaagaagaaguucggcuacaagcgcgagcgcguccccuucguccucacccaggacuuccucaucgucaucuccaagggcgcccaggagugcaccaagacccgcgaguucgagcgcuuccaggagaugugcuacaaggccuaccucgccauccgccagcacgccaaccucuucaucaaccucuucuccaugaugcucggcuccggcaugcccgagcuccaguccuucgacgacaucgccuacauccgcaagacccucgcccucgacaagaccgagcaggaggcccucgaguacuucaugaagcagaugaacgacgcccaccacggcggcuggaccaccaagauggacuggaucuuccacaccaucaagcagcacgcccucaacuga

SEQ ID NO: 47650 - RNA, 3213 nt, Artificial Sequence
  derived and/or modified sequence opt2 from PIK3CB__Homo_sapiens__NP_006210
augugcuucuccuucaucaugccccccgccauggccgacauccucgacaucugggccgucgacucccagaucgccuccgacggcuccauccccgucgacuuccuccuccccaccggcaucuacauccagcucgaggucccccgcgaggccaccaucuccuacaucaagcagaugcucuggaagcagguccacaacuaccccauguucaaccuccucauggacaucgacuccuacauguucgccugcgucaaccagaccgccgucuacgaggagcucgaggacgagacccgccgccucugcgacguccgccccuuccuccccguccucaagcucgucacccgcuccugcgaccccggcgagaagcucgacuccaagaucggcguccucaucggcaagggccuccacgaguucgacucccucaaggaccccgaggucaacgaguuccgccgcaagaugcgcaaguucuccgaggagaagauccucucccucgucggccucuccuggauggacuggcucaagcagaccuacccccccgagcacgagcccuccauccccgagaaccucgaggacaagcucuacggcggcaagcucaucgucgccguccacuucgagaacugccaggacgucuucuccuuccaggucucccccaacaugaaccccaucaaggucaacgagcucgccauccagaagcgccucaccauccacggcaaggaggacgaggucucccccuacgacuacguccuccaggucuccggccgcgucgaguacgucuucggcgaccacccccucauccaguuccaguacauccgcaacugcgucaugaaccgcgcccucccccacuucauccucgucgagugcugcaagaucaagaagauguacgagcaggagaugaucgccaucgaggccgccaucaaccgcaacuccuccaaccucccccucccccucccccccaagaagacccgcaucaucucccacgucugggagaacaacaaccccuuccagaucguccucgucaagggcaacaagcucaacaccgaggagaccgucaagguccacguccgcgccggccucuuccacggcaccgagcuccucugcaagaccaucgucuccuccgaggucuccggcaagaacgaccacaucuggaacgagccccucgaguucgacaucaacaucugcgaccucccccgcauggcccgccucugcuucgccgucuacgccguccucgacaaggucaagaccaagaaguccaccaagaccaucaaccccuccaaguaccagaccauccgcaaggccggcaagguccacuaccccgucgccugggucaacaccauggucuucgacuucaagggccagcuccgcaccggcgacaucauccuccacuccugguccuccuuccccgacgagcucgaggagaugcucaaccccaugggcaccguccagaccaaccccuacaccgagaacgccaccgcccuccacgucaaguuccccgagaacaagaagcagcccuacuacuacccccccuucgacaagaucaucgagaaggccgccgagaucgccuccuccgacuccgccaacgucuccucccgcggcggcaagaaguuccuccccguccucaaggagauccucgaccgcgacccccucucccagcucugcgagaacgagauggaccucaucuggacccuccgccaggacugccgcgagaucuucccccagucccuccccaagcuccuccucuccaucaaguggaacaagcucgaggacgucgcccagcuccaggcccuccuccagaucuggcccaagcuccccccccgcgaggcccucgagcuccucgacuucaacuaccccgaccaguacguccgcgaguacgccgucggcugccuccgccagauguccgacgaggagcucucccaguaccuccuccagcucguccagguccucaaguacgagcccuuccucgacugcgcccucucccgcuuccuccucgagcgcgcccucggcaaccgccgcaucggccaguuccucuucuggcaccuccgcuccgagguccacauccccgccgucuccguccaguucggcgucauccucgaggccuacugccgcggcuccgucggccacaugaagguccucuccaagcaggucgaggcccucaacaagcucaagacccucaacucccucaucaagcucaacgccgucaagcucaaccgcgccaagggcaaggaggccaugcacaccugccucaagcaguccgccuaccgcgaggcccucuccgaccuccaguccccccucaaccccugcgucauccucuccgagcucuacgucgagaagugcaaguacauggacuccaagaugaagccccucuggcucgucuacaacaacaaggucuucggcgaggacuccgucggcgucaucuucaagaacggcgacgaccuccgccaggacaugcucacccuccagaugcuccgccucauggaccuccucuggaaggaggccggccucgaccuccgcaugcuccccuacggcugccucgccaccggcgaccgcuccggccucaucgaggucgucuccaccuccgagaccaucgccgacauccagcucaacuccuccaacgucgccgccgccgccgccuucaacaaggacgcccuccucaacuggcucaaggaguacaacuccggcgacgaccucgaccgcgccaucgaggaguucacccucuccugcgccggcuacugcgucgccuccuacguccucggcaucggcgaccgccacuccgacaacaucauggucaagaagaccggccagcucuuccacaucgacuucggccacauccucggcaacuucaaguccaaguucggcaucaagcgcgagcgcguccccuucauccucaccuacgacuucauccacgucauccagcagggcaagaccggcaacaccgagaaguucggccgcuuccgccagugcugcgaggacgccuaccucauccuccgccgccacggcaaccucuucaucacccucuucgcccucaugcucaccgccggccuccccgagcucaccuccgucaaggacauccaguaccucaaggacucccucgcccucggcaaguccgaggaggaggcccucaagcaguucaagcagaaguucgacgaggcccuccgcgaguccuggaccaccaaggucaacuggauggcccacaccguccgcaaggacuaccgcuccuga

SEQ ID NO: 47651 - RNA, 2487 nt, Artificial Sequence
  derived and/or modified sequence opt2 from PIK3CD__Homo_sapiens__XP_011539885
auggccugcgcccuccgcaagaaggccaccgucuuccgccagccccucgucgagcagcccgaggacuacacccuccaggucaacggccgccacgaguaccucuacggcuccuacccccucugccaguuccaguacaucugcuccugccuccacuccggccucaccccccaccucaccaugguccacuccuccuccauccucgccaugcgcgacgagcaguccaaccccgccccccagguccagaagccccgcgccaagcccccccccauccccgccaagaagcccuccuccgucucccucuggucccucgagcagcccuuccgcaucgagcucauccagggcuccaaggucaacgccgacgagcgcaugaagcucgucguccaggccggccucuuccacggcaacgagaugcucugcaagaccgucuccuccuccgaggucuccgucugcuccgagcccgucuggaagcagcgccucgaguucgacaucaacaucugcgaccucccccgcauggcccgccucugcuucgcccucuacgccgucaucgagaaggccaagaaggcccgcuccaccaagaagaaguccaagaaggccgacugccccaucgccugggccaaccucaugcucuucgacuacaaggaccagcucaagaccggcgagcgcugccucuacauguggcccuccguccccgacgagaagggcgagcuccucaaccccaccggcaccguccgcuccaaccccaacaccgacuccgccgccgcccuccucaucugccuccccgaggucgccccccaccccgucuacuaccccgcccucgagaagauccucgagcucggccgccacuccgagugcguccacgucaccgaggaggagcagcuccagcuccgcgagauccucgagcgccgcggcuccggcgagcucuacgagcacgagaaggaccucgucuggaagcuccgccacgagguccaggagcacuuccccgaggcccucgcccgccuccuccucgucaccaaguggaacaagcacgaggacgucgcccagaugcucuaccuccucugcuccuggcccgagcuccccguccucuccgcccucgagcuccucgacuucuccuuccccgacugccacgucggcuccuucgccaucaagucccuccgcaagcucaccgacgacgagcucuuccaguaccuccuccagcucguccagguccucaaguacgaguccuaccucgacugcgagcucaccaaguuccuccucgaccgcgcccucgccaaccgcaagaucggccacuuccucuucuggcaccuccgcuccgagaugcacguccccuccgucgcccuccgcuucggccucauccucgaggccuacugccgcggcuccacccaccacaugaagguccucaugaagcagggcgaggcccucuccaagcucaaggcccucaacgacuucgucaagcucuccucccagaagacccccaagccccagaccaaggagcucaugcaccucugcaugcgccaggaggccuaccucgaggcccucucccaccuccaguccccccucgaccccuccacccuccucgccgaggucugcgucgagcagugcaccuucauggacuccaagaugaagccccucuggaucauguacuccaacgaggaggccggcuccggcggcuccgucggcaucaucuucaagaacggcgacgaccuccgccaggacaugcucacccuccagaugauccagcucauggacguccucuggaagcaggagggccucgaccuccgcaugacccccuacggcugccuccccaccggcgaccgcaccggccucaucgaggucguccuccgcuccgacaccaucgccaacauccagcucaacaaguccaacauggccgccaccgccgccuucaacaaggacgcccuccucaacuggcucaaguccaagaaccccggcgaggcccucgaccgcgccaucgaggaguucacccucuccugcgccggcuacugcgucgccaccuacguccucggcaucggcgaccgccacuccgacaacaucaugauccgcgaguccggccagcucuuccacaucgacuucggccacuuccucggcaacuucaagaccaaguucggcaucaaccgcgagcgcguccccuucauccucaccuacgacuucguccacgucauccagcagggcaagaccaacaacuccgagaaguucgagcgcuuccgcggcuacugcgagcgcgccuacaccauccuccgccgccacggccuccucuuccuccaccucuucgcccucaugcgcgccgccggccuccccgagcucuccugcuccaaggacauccaguaccucaaggacucccucgcccucggcaagaccgaggaggaggcccucaagcacuuccgcgucaaguucaacgaggcccuccgcgaguccuggaagaccaaggucaacuggcucgcccacaacgucuccaaggacaaccgccaguga

SEQ ID NO: 47652 - RNA, 3309 nt, Artificial Sequence
  derived and/or modified sequence opt2 from PIK3CG__Homo_sapiens__NP_001269355
auggagcucgagaacuacaagcagcccgucguccuccgcgaggacaacugccgccgccgccgccgcaugaagccccgcuccgccgccgccucccucuccuccauggagcucauccccaucgaguucguccuccccaccucccagcgcaagugcaagucccccgagaccgcccuccuccacgucgccggccacggcaacgucgagcagaugaaggcccaggucuggcuccgcgcccucgagaccuccgucgccgccgacuucuaccaccgccucggcccccaccacuuccuccuccucuaccagaagaagggccagugguacgagaucuacgacaaguaccaggucguccagacccucgacugccuccgcuacuggaaggccacccaccgcucccccggccagauccaccucguccagcgccacccccccuccgaggagucccaggccuuccagcgccagcucaccgcccucaucggcuacgacgucaccgacgucuccaacguccacgacgacgagcucgaguucacccgccgcggccucgucaccccccgcauggccgaggucgccucccgcgaccccaagcucuacgccaugcaccccugggucaccuccaagccccuccccgaguaccucuggaagaagaucgccaacaacugcaucuucaucgucauccaccgcuccaccaccucccagaccaucaaggucucccccgacgacacccccggcgccauccuccaguccuucuucaccaagauggccaagaagaagucccucauggacauccccgagucccaguccgagcaggacuucguccuccgcgucugcggccgcgacgaguaccucgucggcgagacccccaucaagaacuuccaguggguccgccacugccucaagaacggcgaggagauccacgucguccucgacaccccccccgaccccgcccucgacgagguccgcaaggaggaguggccccucgucgacgacugcaccggcgucaccggcuaccacgagcagcucaccauccacggcaaggaccacgaguccgucuucaccgucucccucugggacugcgaccgcaaguuccgcgucaagauccgcggcaucgacauccccguccucccccgcaacaccgaccucaccgucuucgucgaggccaacauccagcacggccagcagguccucugccagcgccgcaccucccccaagcccuucaccgaggagguccucuggaacgucuggcucgaguucuccaucaagaucaaggaccuccccaagggcgcccuccucaaccuccagaucuacugcggcaaggcccccgcccucuccuccaaggccuccgccgagucccccuccuccgaguccaagggcaagguccagcuccucuacuacgucaaccuccuccucaucgaccaccgcuuccuccuccgccgcggcgaguacguccuccacauguggcagaucuccggcaagggcgaggaccagggcuccuucaacgccgacaagcucaccuccgccaccaaccccgacaaggagaacuccauguccaucuccauccuccucgacaacuacugccaccccaucgcccuccccaagcaccagcccacccccgaccccgagggcgaccgcguccgcgccgagaugcccaaccagcuccgcaagcagcucgaggccaucaucgccaccgacccccucaacccccucaccgccgaggacaaggagcuccucuggcacuuccgcuacgagucccucaagcaccccaaggccuaccccaagcucuucuccuccgucaaguggggccagcaggagaucgucgccaagaccuaccagcuccucgcccgccgcgaggucugggaccaguccgcccucgacgucggccucaccaugcagcuccucgacugcaacuucuccgacgagaacguccgcgccaucgccguccagaagcucgagucccucgaggacgacgacguccuccacuaccuccuccagcucguccaggccgucaaguucgagcccuaccacgacuccgcccucgcccgcuuccuccucaagcgcggccuccgcaacaagcgcaucggccacuuccucuucugguuccuccgcuccgagaucgcccagucccgccacuaccagcagcgcuucgccgucauccucgaggccuaccuccgcggcugcggcaccgccaugcuccacgacuucacccagcagguccaggucaucgagaugcuccagaaggucacccucgacaucaagucccucuccgccgagaaguacgacgucuccucccaggucaucucccagcucaagcagaagcucgagaaccuccagaacucccagcuccccgaguccuuccgcguccccuacgaccccggccucaaggccggcgcccucgccaucgagaagugcaaggucauggccuccaagaagaagccccucuggcucgaguucaagugcgccgaccccaccgcccucuccaacgagaccaucggcaucaucuucaagcacggcgacgaccuccgccaggacaugcucauccuccagauccuccgcaucauggaguccaucugggagaccgagucccucgaccucugccuccuccccuacggcugcaucuccaccggcgacaagaucggcaugaucgagaucgucaaggacgccaccaccaucgccaagauccagcaguccaccgucggcaacaccggcgccuucaaggacgagguccucaaccacuggcucaaggagaagucccccaccgaggagaaguuccaggccgccgucgagcgcuucgucuacuccugcgccggcuacugcgucgccaccuucguccucggcaucggcgaccgccacaacgacaacaucaugaucaccgagaccggcaaccucuuccacaucgacuucggccacauccucggcaacuacaaguccuuccucggcaucaacaaggagcgcguccccuucguccucacccccgacuuccucuucgucaugggcaccuccggcaagaagaccuccccccacuuccagaaguuccaggacaucugcgucaaggccuaccucgcccuccgccaccacaccaaccuccucaucauccucuucuccaugaugcucaugaccggcaugccccagcucaccuccaaggaggacaucgaguacauccgcgacgcccucaccgucggcaagaacgaggaggacgccaagaaguacuuccucgaccagaucgaggucugccgcgacaagggcuggaccguccaguucaacugguuccuccaccucguccucggcaucaagcagggcgagaagcacuccgccuga

SEQ ID NO: 47653 - RNA, 522 nt, Artificial Sequence
  derived and/or modified sequence opt2 from PIK3IP1__Homo_sapiens__NP_001129383
augcuccucgccuggguccaggccuuccucgucuccaacaugcuccucgccgaggccuacggcuccggcggcugcuucugggacaacggccaccucuaccgcgaggaccagaccucccccgcccccggccuccgcugccucaacuggcucgacgcccaguccggccucgccuccgcccccgucuccggcgccggcaaccacuccuacugccgcaaccccgacgaggacccccgcggccccuggugcuacgucuccggcgaggccggcguccccgagaagcgccccugcgaggaccuccgcugccccgagaccaccucccaggcccuccccgccuucaccaccgagauccaggaggccuccgagggccccggcgccgacgagguccaggucuucgcccccgccaacgcccuccccgcccgcuccgaggccgccgccguccagcccgucaucggcaucucccagcgcguccgcaugaacuccaaggagaagaaggaccucggcacccucggcggccgcaucuga

SEQ ID NO: 47654 - RNA, 1086 nt, Artificial Sequence
  derived and/or modified sequence opt2 from PIK3R1__Homo_sapiens__NP_001229395
augcacggcgacuacacccucacccuccgcaagggcggcaacaacaagcucaucaagaucuuccaccgcgacggcaaguacggcuucuccgacccccucaccuucuccuccgucgucgagcucaucaaccacuaccgcaacgagucccucgcccaguacaaccccaagcucgacgucaagcuccucuaccccgucuccaaguaccagcaggaccaggucgucaaggaggacaacaucgaggccgucggcaagaagcuccacgaguacaacacccaguuccaggagaagucccgcgaguacgaccgccucuacgaggaguacacccgcaccucccaggagauccagaugaagcgcaccgccaucgaggccuucaacgagaccaucaagaucuucgaggagcagugccagacccaggagcgcuacuccaaggaguacaucgagaaguucaagcgcgagggcaacgagaaggagauccagcgcaucaugcacaacuacgacaagcucaagucccgcaucuccgagaucaucgacucccgccgccgccucgaggaggaccucaagaagcaggccgccgaguaccgcgagaucgacaagcgcaugaacuccaucaagcccgaccucauccagcuccgcaagacccgcgaccaguaccucauguggcucacccagaagggcguccgccagaagaagcucaacgaguggcucggcaacgagaacaccgaggaccaguacucccucgucgaggacgacgaggaccucccccaccacgacgagaagaccuggaacgucggcuccuccaaccgcaacaaggccgagaaccuccuccgcggcaagcgcgacggcaccuuccucguccgcgaguccuccaagcagggcugcuacgccugcuccgucgucgucgacggcgaggucaagcacugcgucaucaacaagaccgccaccggcuacggcuucgccgagcccuacaaccucuacuccucccucaaggagcucguccuccacuaccagcacaccucccucguccagcacaacgacucccucaacgucacccucgccuaccccgucuacgcccagcagcgccgcuga

SEQ ID NO: 47655 - RNA, 2187 nt, Artificial Sequence
  derived and/or modified sequence opt2 from PIK3R2__Homo_sapiens__NP_005018
auggccggccccgagggcuuccaguaccgcgcccucuaccccuuccgccgcgagcgccccgaggaccucgagcuccuccccggcgacguccucgucgucucccgcgccgcccuccaggcccucggcgucgccgagggcggcgagcgcugcccccaguccgucggcuggaugcccggccucaacgagcgcacccgccagcgcggcgacuuccccggcaccuacgucgaguuccucggccccgucgcccucgcccgccccggcccccgcccccgcggcccccgcccccuccccgcccgcccccgcgacggcgcccccgagcccggccucacccuccccgaccuccccgagcaguucuccccccccgacgucgcccccccccuccucgucaagcucgucgaggccaucgagcgcaccggccucgacuccgagucccacuaccgccccgagcuccccgccccccgcaccgacuggucccucuccgacgucgaccagugggacaccgccgcccucgccgacggcaucaaguccuuccuccucgcccuccccgccccccucgucacccccgaggccuccgccgaggcccgccgcgcccuccgcgaggccgccggccccgucggccccgcccucgagccccccacccucccccuccaccgcgcccucacccuccgcuuccuccuccagcaccucggccgcgucgcccgccgcgcccccgcccucggccccgccguccgcgcccucggcgccaccuucggcccccuccuccuccgcgccccccccccccccuccucccccccccccggcggcgcccccgacggcuccgagcccucccccgacuuccccgcccuccucgucgagaagcuccuccaggagcaccucgaggagcaggaggucgccccccccgcccucccccccaagccccccaaggccaagcccgcccccaccguccucgccaacggcggcuccccccccucccuccaggacgccgagugguacuggggcgacaucucccgcgaggaggucaacgagaagcuccgcgacacccccgacggcaccuuccucguccgcgacgccuccuccaagauccagggcgaguacacccucacccuccgcaagggcggcaacaacaagcucaucaaggucuuccaccgcgacggccacuacggcuucuccgagccccucaccuucugcuccgucgucgaccucaucaaccacuaccgccacgagucccucgcccaguacaacgccaagcucgacacccgccuccucuaccccgucuccaaguaccagcaggaccagaucgucaaggaggacuccgucgaggccgucggcgcccagcucaaggucuaccaccagcaguaccaggacaagucccgcgaguacgaccagcucuacgaggaguacacccgcaccucccaggagcuccagaugaagcgcaccgccaucgaggccuucaacgagaccaucaagaucuucgaggagcagggccagacccaggagaagugcuccaaggaguaccucgagcgcuuccgccgcgagggcaacgagaaggagaugcagcgcauccuccucaacuccgagcgccucaagucccgcaucgccgagauccacgagucccgcaccaagcucgagcagcagcuccgcgcccaggccuccgacaaccgcgagaucgacaagcgcaugaacucccucaagcccgaccucaugcagcuccgcaagauccgcgaccaguaccucgucuggcucacccagaagggcgcccgccagaagaagaucaacgaguggcucggcaucaagaacgagaccgaggaccaguacgcccucauggaggacgaggacgaccucccccaccacgaggagcgcaccugguacgucggcaagaucaaccgcacccaggccgaggagaugcucuccggcaagcgcgacggcaccuuccucauccgcgaguccucccagcgcggcugcuacgccugcuccgucgucgucgacggcgacaccaagcacugcgucaucuaccgcaccgccaccggcuucggcuucgccgagcccuacaaccucuacggcucccucaaggagcucguccuccacuaccagcacgccucccucguccagcacaacgacgcccucaccgucacccucgcccaccccguccgcgcccccggccccggccccccccccgccgcccgcuga

SEQ ID NO: 47656 - RNA, 1524 nt, Artificial Sequence
  derived and/or modified sequence opt2 from PIK3R3__Homo_sapiens__NP_001290356
augggccccucccgccucguccgcggcccccgcccccagggcaugcgcucccccuaccgccgccccggcaugggcuggccccgcccccgcuucccccgcauguucaagugcucccgccgccgcuaccagcagggccuccgcggccgcaccgccuccuccgccgccaucaaccccgccacccgcgccaugggcaucaacaacacccacaccgacaccaccaucgucuggaucuuccccccccaggcccucccccccaagccccccaagcccaugaccuccgccguccccaacggcaugaaggacuccuccgucucccuccaggacgccgagugguacuggggcgacaucucccgcgaggaggucaacgacaagcuccgcgacaugcccgacggcaccuuccucguccgcgacgccuccaccaagaugcagggcgacuacacccucacccuccgcaagggcggcaacaacaagcucaucaagaucuaccaccgcgacggcaaguacggcuucuccgacccccucaccuucaacuccgucgucgagcucaucaaccacuaccaccacgagucccucgcccaguacaaccccaagcucgacgucaagcucauguaccccgucucccgcuaccagcaggaccagcucgucaaggaggacaacaucgacgccgucggcaagaagcuccaggaguaccacucccaguaccaggagaaguccaaggaguacgaccgccucuacgaggaguacacccgcaccucccaggagauccagaugaagcgcaccgccaucgaggccuucaacgagaccaucaagaucuucgaggagcagugccacacccaggagcagcacuccaaggaguacaucgagcgcuuccgccgcgagggcaacgagaaggagaucgagcgcaucaugaugaacuacgacaagcucaagucccgccucggcgagauccacgacuccaagaugcgccucgagcaggaccucaagaaccaggcccucgacaaccgcgagaucgacaagaagaugaacuccaucaagcccgaccucauccagcuccgcaagauccgcgaccagcaccucgucuggcucaaccacaagggcguccgccagaagcgccucaacgucuggcucggcaucaagaacgaggacgccgacgagaacuacuucaucaacgaggaggacgagaaccucccccacuacgacgagaagaccugguucgucgaggacaucaaccgcguccaggccgaggaccuccucuacggcaagcccgacggcgccuuccucauccgcgaguccuccaagaagggcugcuacgccugcuccgucgucgccgacggcgaggucaagcacugcgucaucuacuccaccgcccgcggcuacggcuucgccgagcccuacaaccucuacuccucccucaaggagcucguccuccacuaccagcagaccucccucguccagcacaacgacucccucaacguccgccucgccuaccccguccacgcccagaugcccucccucugccgcuga

SEQ ID NO: 47657 - RNA, 4077 nt, Artificial Sequence
  derived and/or modified sequence opt2 from PIK3R4__Homo_sapiens__NP_055417
augggcaaccagcucgccggcaucgcccccucccagauccucuccgucgaguccuacuucuccgacauccacgacuucgaguacgacaagucccucggcuccacccgcuucuucaaggucgcccgcgccaagcaccgcgagggccucgucgucgucaaggucuucgccauccaggaccccacccucccccucaccuccuacaagcaggagcucgaggagcucaagauccgccucaacuccgcccagaacugccuccccuuccagaaggccuccgagaaggccuccgagaaggccgccaugcucuuccgccaguacguccgcgacaaccucuacgaccgcaucuccacccgccccuuccucaacaacaucgagaagcgcuggaucgccuuccagauccucaccgccgucgaccaggcccacaaguccggcguccgccacggcgacaucaagaccgagaacgucauggucaccuccuggaacuggguccuccucaccgacuucgccuccuucaagcccaccuaccuccccgaggacaaccccgccgacuucaacuacuucuucgacaccucccgccgccgcaccugcuacaucgcccccgagcgcuucgucgacggcggcauguucgccaccgagcucgaguacaugcgcgaccccuccaccccccucgucgaccucaacuccaaccagcgcacccgcggcgagcucaagcgcgccauggacaucuucuccgccggcugcgucaucgccgagcucuucaccgagggcgucccccucuucgaccucucccagcuccucgccuaccgcaacggccacuucuuccccgagcagguccucaacaagaucgaggaccacuccauccgcgagcucgucacccagaugauccaccgcgagcccgacaagcgccucgaggccgaggacuaccucaagcagcagcgcggcaacgccuuccccgagaucuucuacaccuuccuccagcccuacauggcccaguucgccaaggagaccuuccucuccgccgacgagcgcauccucgucauccgcaaggaccucggcaacaucauccacaaccucugcggccacgaccuccccgagaaggccgagggcgagcccaaggagaacggccucgucauccucgucuccgucaucaccuccugccuccagacccucaaguacugcgacuccaagcucgccgcccucgagcucauccuccaccucgccccccgccucuccgucgagauccuccucgaccgcaucacccccuaccuccuccacuucuccaacgacuccgucccccgcguccgcgccgaggcccuccgcacccucaccaagguccucgcccucgucaaggaggucccccgcaacgacaucaacaucuaccccgaguacauccuccccggcaucgcccaccucgcccaggacgacgccaccaucguccgccucgccuacgccgagaacaucgcccuccucgccgagaccgcccuccgcuuccucgagcucguccagcucaagaaccucaacauggagaacgaccccaacaacgaggagaucgacgaggucacccaccccaacggcaacuacgacaccgagcuccaggcccuccacgagaugguccagcagaaggucgucacccuccucuccgaccccgagaacaucgucaagcagacccucauggagaacggcaucacccgccucugcgucuucuucggccgccagaaggccaacgacguccuccucucccacaugaucaccuuccucaacgacaagaacgacuggcaccuccgcggcgccuucuucgacuccaucgucggcgucgccgccuacgucggcuggcaguccuccuccauccucaagccccuccuccagcagggccucuccgacgccgaggaguucgucaucgucaaggcccucuacgcccucaccugcaugugccagcucggccuccuccagaagccccacgucuacgaguucgccuccgacaucgcccccuuccucugccaccccaaccucuggauccgcuacggcgccgucggcuucaucaccgucgucgcccgccagaucuccaccgccgacgucuacugcaagcucaugcccuaccucgaccccuacaucacccagcccaucauccagaucgagcgcaagcucguccuccucuccguccucaaggagcccgucucccgcuccaucuucgacuacgcccuccgcuccaaggacaucaccucccucuuccgccaccuccacaugcgccagaagaagcgcaacggcucccuccccgacugccccccccccgaggaccccgccaucgcccagcuccucaagaagcuccucucccagggcaugaccgaggaggaggaggacaagcuccucgcccucaaggacuucaugaugaaguccaacaaggccaaggccaacaucgucgaccagucccaccuccacgacuccucccagaagggcgucaucgaccucgccgcccucggcaucaccggccgccaggucgaccucgucaagaccaagcaggagcccgacgacaagcgcgcccgcaagcacgucaagcaggacuccaacgucaacgaggaguggaaguccauguucggcucccucgacccccccaacaugccccaggcccuccccaagggcuccgaccaggaggucauccagaccggcaagcccccccgcuccgaguccuccgccggcaucugcgucccccucuccaccuccucccagguccccgaggucaccaccguccagaacaagaagcccgucauccccguccucuccuccaccauccuccccuccaccuaccagauccgcaucaccaccugcaagaccgagcuccagcagcucauccagcagaagcgcgagcagugcaacgccgagcgcaucgccaagcagaugauggagaacgccgagugggaguccaagccccccccccccggcuggcgccccaagggccuccucgucgcccaccuccacgagcacaaguccgccgucaaccgcauccgcgucuccgacgagcacucccucuucgccaccugcuccaacgacggcaccgucaagaucuggaacucccagaagauggagggcaagaccaccaccacccgcuccauccucaccuacucccgcaucggcggccgcgucaagacccucaccuucugccagggcucccacuaccucgccaucgccuccgacaacggcgccguccagcuccucggcaucgaggccuccaagcuccccaagucccccaagauccacccccuccagucccgcauccucgaccagaaggaggacggcugcgucgucgacaugcaccacuucaacuccggcgcccaguccguccucgccuacgccaccgucaacggcucccucgucggcugggaccuccgcuccuccuccaacgccuggacccucaagcacgaccucaaguccggccucaucaccuccuucgccgucgacauccaccagugcuggcucugcaucggcaccuccuccggcaccauggccugcugggacaugcgcuuccagcuccccaucuccucccacugccaccccucccgcgcccgcauccgccgccucuccaugcacccccucuaccaguccugggucaucgccgccguccagggcaacaacgaggucuccaugugggacauggagaccggcgaccgccgcuucacccucugggccuccuccgcccccccccucuccgagcuccagcccuccccccacuccguccacggcaucuacugcucccccgccgacggcaaccccauccuccucaccgccggcuccgacaugaagauccgcuucugggaccucgccuaccccgagcgcuccuacgucgucgccggcuccaccuccucccccuccgucuccuacuaccgcaagaucaucgagggcaccgaggucguccaggagauccagaacaagcagaaggucggccccuccgacgacaccccccgccgcggccccgagucccuccccgucggccaccacgacaucaucaccgacgucgccaccuuccagaccacccagggcuucaucgucaccgccucccgcgacggcaucgucaaggucuggaaguga

SEQ ID NO: 47658 - RNA, 2643 nt, Artificial Sequence
  derived and/or modified sequence opt2 from PIK3R5__Homo_sapiens__NP_055123
augcagcccggcgccaccaccugcaccgaggaccgcauccagcacgcccucgagcgcugccuccacggccucucccucucccgccgcuccaccuccugguccgccggccucugccucaacugcuggucccuccaggagcucgucucccgcgaccccggccacuuccucauccuccucgagcagauccuccagaagacccgcgagguccaggagaagggcaccuacgaccuccucaccccccucgcccuccucuucuacuccaccguccucugcaccccccacuucccccccgacuccgaccuccuccucaaggccgccuccaccuaccaccgcuuccucaccuggcccguccccuacugcuccaucugccaggagcuccucaccuucaucgacgccgagcucaaggcccccggcaucuccuaccagcgccucguccgcgccgagcagggccuccccauccgcucccaccgcuccuccaccgucaccguccuccuccucaaccccgucgagguccaggccgaguuccucgccgucgccaacaagcucuccacccccggccacuccccccacuccgccuacaccacccuccuccuccacgccuuccaggccaccuucggcgcccacugcgacguccccggccuccacugccgccuccaggccaagacccucgccgagcucgaggacaucuucaccgagaccgccgaggcccaggagcucgccuccggcaucggcgacgccgccgaggcccgccgcuggcuccgcaccaagcuccaggccgucggcgagaaggccggcuuccccggcguccucgacaccgccaagcccggcaagcuccacaccauccccauccccgucgcccgcugcuacaccuacuccuggucccaggacuccuucgacauccuccaggagauccuccucaaggagcaggagcuccuccagcccggcauccucggcgacgacgaggaggaggaggaggaggaggaggaggucgaggaggaccucgagaccgacggccacugcgccgagcgcgacucccuccucuccaccuccucccucgccucccacgacuccacccucucccucgccuccucccaggccuccggccccgcccucucccgccaccuccucaccuccuucgucuccggccucuccgacggcauggacuccggcuacgucgaggacuccgaggaguccuccuccgaguggcccuggcgccgcggcucccaggagcgccgcggccaccgccgccccggccagaaguucauccgcaucuacaagcucuucaaguccaccucccagcucguccuccgccgcgacucccgcucccucgagggcuccuccgacaccgcccucccccuccgccgcgccggcucccucugcuccccccucgacgagcccgucuccccccccucccgcgcccagcgcucccgcucccucccccagcccaagcucggcacccagcuccccuccuggcuccucgcccccgccucccgcccccagcgccgccgccccuuccucuccggcgacgaggaccccaaggccuccacccuccgcgucgucgucuucggcuccgaccgcaucuccggcaaggucgcccgcgccuacuccaaccuccgccgccucgagaacaaccgcccccuccucacccgcuucuucaagcuccaguucuucuacguccccgucaagcgcucccacggcaccucccccggcgccugcccccccccccgcucccagacccccuccccccccaccgacuccccccgccacgccucccccggcgagcucggcaccacccccugggaggaguccaccaacgacaucucccacuaccucggcaugcucgaccccugguacgagcgcaacguccucggccucaugcaccucccccccgagguccucugccagcagucccucaaggccgaggcccaggcccucgagggcucccccacccagcuccccauccucgccgacaugcuccucuacuacugccgcuucgccgcccgccccguccuccuccaggucuaccagaccgagcucaccuucaucaccggcgagaagaccaccgagaucuucauccacucccucgagcucggccacuccgccgccacccgcgccaucaaggccuccggccccggcuccaagcgccucggcaucgacggcgaccgcgaggccgucccccucacccuccagaucaucuacuccaagggcgccaucuccggccgcucccgcugguccaaccucgagaaggucugcaccuccgucaaccucaacaaggccugccgcaagcaggaggagcucgacuccuccauggaggcccucacccucaaccucaccgaggucgucaagcgccagaacuccaaguccaagaagggcuucaaccagaucuccaccucccagaucaaggucgacaagguccagaucaucggcuccaacuccugccccuucgccgucugccucgaccaggacgagcgcaagauccuccaguccgucguccgcugcgaggucucccccugcuacaagcccgagaaguccgaccucuccucccccccccagaccccccccgaccuccccgcccaggccgcccccgaccucugcucccuccucugccuccccaucaugaccuucuccggcgcccuccccuga

SEQ ID NO: 47659 - RNA, 1647 nt, Artificial Sequence
  derived and/or modified sequence opt2 from PIKFYVE__Homo_sapiens__NP_001171471
auggccaccgacgacaagaccucccccacccucgacuccgccaacgaccucccccgcucccccaccucccccucccaccucacccacuucaagccccucacccccgaccaggacgagccccccuucaaguccgccuacuccuccuucgucaaccucuuccgcuucaacaaggagcgcgccgagggcggccagggcgagcagcagccccucuccggcuccuggaccuccccccagcuccccucccgcacccaguccguccgcucccccacccccuacaagaagcagcucaacgaggagcuccagcgccgcuccuccgcccucgacacccgccgcaaggccgagcccaccuucggcggccacgacccccgcaccgccguccagcuccgcucccucuccaccguccucaagcgccucaaggagaucauggagggcaagucccaggacuccgaccucaagcaguacuggaugcccgacucccagugcaaggagugcuacgacugcuccgagaaguucaccaccuuccgccgccgccaccacugccgccucugcggccagaucuucugcucccgcugcugcaaccaggagauccccggcaaguucaugggcuacaccggcgaccuccgcgccugcaccuacugccgcaagaucgcccucuccuacgcccacuccaccgacuccaacuccaucggcgaggaccucaacgcccucuccgacuccgccugcuccgucuccguccucgaccccuccgagccccgcacccccgucggcucccgcaaggccucccgcaacaucuuccucgaggacgaccucgccuggcagucccucauccaccccgacuccuccaacaccccccucuccacccgccucgucuccguccaggaggacgccggcaagucccccgcccgcaaccgcuccgccuccaucaccaaccucucccucgaccgcuccggcucccccaugguccccuccuacgagaccuccgucuccccccaggccaaccgcaccuacguccgcaccgagaccaccgaggacgagcgcaagauccuccucgacuccguccagcucaaggaccucuggaagaagaucugccaccacuccuccggcauggaguuccaggaccaccgcuacuggcuccgcacccaccccaacugcaucgucggcaaggagcucgucaacuggcucauccgcaacggccacaucgccacccgcgcccaggccaucgccaucggccaggccauggucgacggccgcuggcucgacugcgucucccaccacgaccagcucuuccgcgacgaguacgcccucuaccgcccccuccaguccaccgaguucuccgagacccccucccccgacuccgacuccgucaacuccgucgagggccacuccgagcccuccugguucaaggacaucaaguucgacgacuccgacaccgagcagaucgccgaggagggcgacgacaaccucgccaacuccgccucccccuccaagcgcaccuccgucuccuccuuccaguccaccgucgacuccgacuccgccgccuccaucucccucaacgucgagcucgacaacgucaacuuccacaucaagaagcccuccaaguacccccacguccccccccaccccgccgaccagaagggccgccgcuga

SEQ ID NO: 47660 - RNA, 912 nt, Artificial Sequence
  derived and/or modified sequence opt2 from PILRA__Homo_sapiens__NP_038467
augggccgcccccuccuccucccccuccucccccuccuccucccccccgccuuccuccagcccuccggcuccaccggcuccggccccuccuaccucuacggcgucacccagcccaagcaccucuccgccuccaugggcggcuccgucgagauccccuucuccuucuacuaccccugggagcucgccaccgcccccgacguccgcaucuccuggcgccgcggccacuuccaccgccaguccuucuacuccacccgcccccccuccauccacaaggacuacgucaaccgccucuuccucaacuggaccgagggccagaaguccggcuuccuccgcaucuccaaccuccagaagcaggaccaguccgucuacuucugccgcgucgagcucgacacccgcuccuccggccgccagcaguggcaguccaucgagggcaccaagcucuccaucacccaggccgucaccaccaccacccagcgccccuccuccaugaccaccaccuggcgccucuccuccaccaccaccaccaccggccuccgcgucacccagggcaagcgccgcuccgacuccuggcacaucucccucgagaccgccgucggcgucgccgucgccgucaccguccucggcaucaugauccucggccucaucugccuccuccgcuggcgccgccgcaagggccagcagcgcaccaaggccaccacccccgcccgcgagcccuuccagaacaccgaggagcccuacgagaacauccgcaacgagggccagaacaccgaccccaagcucaaccccaaggacgacggcaucgucuacgccucccucgcccucuccuccuccaccuccccccgcgccccccccucccaccgcccccucaaguccccccagaacgagacccucuacuccguccucaaggccuga

SEQ ID NO: 47661 - RNA, 1215 nt, Artificial Sequence
  derived and/or modified sequence opt2 from PIM1__Homo_sapiens__NP_001230115
augccccacgagccccacgagccccucaccccccccuucuccgcccuccccgaccccgccggcgcccccucccgccgccagucccgccagcgcccccagcucuccuccgacucccccuccgccuuccgcgccucccgcucccacucccgcaacgccacccgcucccacucccacucccacuccccccgccacucccuccgccacucccccggcuccggcuccugcggcuccuccuccggccaccgccccugcgccgacauccucgaggucggcaugcuccucuccaagaucaacucccucgcccaccuccgcgccgcccccugcaacgaccuccacgccaccaagcucgcccccggcaaggagaaggagccccucgagucccaguaccaggucggcccccuccucggcuccggcggcuucggcuccgucuacuccggcauccgcgucuccgacaaccuccccgucgccaucaagcacgucgagaaggaccgcaucuccgacuggggcgagcuccccaacggcacccgcguccccauggaggucguccuccucaagaaggucuccuccggcuucuccggcgucauccgccuccucgacugguucgagcgccccgacuccuucguccucauccucgagcgccccgagcccguccaggaccucuucgacuucaucaccgagcgcggcgcccuccaggaggagcucgcccgcuccuucuucuggcagguccucgaggccguccgccacugccacaacugcggcguccuccaccgcgacaucaaggacgagaacauccucaucgaccucaaccgcggcgagcucaagcucaucgacuucggcuccggcgcccuccucaaggacaccgucuacaccgacuucgacggcacccgcgucuacuccccccccgaguggauccgcuaccaccgcuaccacggccgcuccgccgccgucuggucccucggcauccuccucuacgacauggucugcggcgacauccccuucgagcacgacgaggagaucauccgcggccaggucuucuuccgccagcgcgucuccuccgagugccagcaccucauccgcuggugccucgcccuccgccccuccgaccgccccaccuucgaggagauccagaaccaccccuggaugcaggacguccuccucccccaggagaccgccgagauccaccuccacucccucucccccggccccuccaaguga

SEQ ID NO: 47662 - RNA, 936 nt, Artificial Sequence
  derived and/or modified sequence opt2 from PIM2__Homo_sapiens__NP_006866
augcucaccaagccccuccagggcccccccgccccccccggcacccccacccccccccccggcggcaaggaccgcgaggccuucgaggccgaguaccgccucggcccccuccucggcaagggcggcuucggcaccgucuucgccggccaccgccucaccgaccgccuccaggucgccaucaaggucaucccccgcaaccgcguccucggcugguccccccucuccgacuccgucaccugcccccucgaggucgcccuccucuggaaggucggcgccggcggcggccaccccggcgucauccgccuccucgacugguucgagacccaggagggcuucaugcucguccucgagcgcccccuccccgcccaggaccucuucgacuacaucaccgagaagggcccccucggcgagggccccucccgcugcuucuucggccaggucgucgccgccauccagcacugccacucccgcggcgucguccaccgcgacaucaaggacgagaacauccucaucgaccuccgccgcggcugcgccaagcucaucgacuucggcuccggcgcccuccuccacgacgagcccuacaccgacuucgacggcacccgcgucuacuccccccccgaguggaucucccgccaccaguaccacgcccuccccgccaccgucuggucccucggcauccuccucuacgacauggucugcggcgacauccccuucgagcgcgaccaggagauccucgaggccgagcuccacuuccccgcccacgucucccccgacugcugcgcccucauccgccgcugccucgcccccaagcccuccucccgccccucccucgaggagauccuccucgaccccuggaugcagacccccgccgaggacgucccccucaaccccuccaagggcggccccgccccccucgccuggucccuccuccccuga

SEQ ID NO: 47663 - RNA, 981 nt, Artificial Sequence
  derived and/or modified sequence opt2 from PIM3__Homo_sapiens__NP_001001852
augcuccucuccaaguucggcucccucgcccaccucugcggccccggcggcgucgaccaccuccccgucaagauccuccagcccgccaaggccgacaaggaguccuucgagaaggccuaccaggucggcgccguccucggcuccggcggcuucggcaccgucuacgccggcucccgcaucgccgacggccuccccgucgccgucaagcacgucgucaaggagcgcgucaccgaguggggcucccucggcggcgccaccgucccccucgaggucguccuccuccgcaaggucggcgccgccggcggcgcccgcggcgucauccgccuccucgacugguucgagcgccccgacggcuuccuccucguccucgagcgccccgagcccgcccaggaccucuucgacuucaucaccgagcgcggcgcccucgacgagccccucgcccgccgcuucuucgcccagguccucgccgccguccgccacugccacuccugcggcgucguccaccgcgacaucaaggacgagaaccuccucgucgaccuccgcuccggcgagcucaagcucaucgacuucggcuccggcgcccuccucaaggacaccgucuacaccgacuucgacggcacccgcgucuacuccccccccgaguggauccgcuaccaccgcuaccacggccgcuccgccaccgucuggucccucggcguccuccucuacgacauggucugcggcgacauccccuucgagcaggacgaggagauccuccgcggccgccuccucuuccgccgccgcgucucccccgagugccagcagcucauccgcuggugccucucccuccgccccuccgagcgccccucccucgaccagaucgccgcccaccccuggaugcucggcgccgacggcggcguccccgaguccugcgaccuccgccucugcacccucgaccccgacgacgucgccuccaccaccuccuccuccgagucccucuga

SEQ ID NO: 47664 - RNA, 492 nt, Artificial Sequence
  derived and/or modified sequence opt2 from PIN1__Homo_sapiens__NP_006212
auggccgacgaggagaagcucccccccggcugggagaagcgcaugucccgcuccuccggccgcgucuacuacuucaaccacaucaccaacgccucccagugggagcgccccuccggcaacuccuccuccggcggcaagaacggccagggcgagcccgcccgcguccgcugcucccaccuccucgucaagcacucccagucccgccgccccuccuccuggcgccaggagaagaucacccgcaccaaggaggaggcccucgagcucaucaacggcuacauccagaagaucaaguccggcgaggaggacuucgagucccucgccucccaguucuccgacugcuccuccgccaaggcccgcggcgaccucggcgccuucucccgcggccagaugcagaagcccuucgaggacgccuccuucgcccuccgcaccggcgagauguccggccccgucuucaccgacuccggcauccacaucauccuccgcaccgaguga

SEQ ID NO: 47665 - RNA, 402 nt, Artificial Sequence
  derived and/or modified sequence opt2 from PIN4__Homo_sapiens__NP_001164218
augcccauggccggccuccucaagggccucguccgccagcucgagcgcuucuccguccagcagcaggccuccaagaugccccccaagggcaaguccggcuccggcaaggccggcaagggcggcgccgccuccggcuccgacuccgccgacaagaaggcccagggccccaagggcggcggcaacgccgucaagguccgccacauccucugcgagaagcacggcaagaucauggaggccauggagaagcucaaguccggcaugcgcuucaacgaggucgccgcccaguacuccgaggacaaggcccgccagggcauccccucccuccagcagcacgccggccaccaccgcgaccuccgcuccacccucaucucccucgucuccuaccuccagaccacccccuga

SEQ ID NO: 47666 - RNA, 525 nt, Artificial Sequence
  derived and/or modified sequence opt2 from PINX1__Homo_sapiens__NP_001271285
auguccaugcucgccgagcgccgccgcaagcagaagugggccgucgacccccagaacaccgccugguccaacgacgacuccaaguucggccagcgcaugcucgagaagaugggcugguccaagggcaagggccucggcgcccaggagcagggcgccaccgaccacaucaagguccaggucaagaacaaccaccucggccucggcgccaccaucaacaacgaggacaacuggaucgcccaccaggacgacuucaaccagcuccucgccgagcucaacaccugccacggccaggagaccaccgacuccuccgacaagaaggagaagaaguccuucucccucgaggagaaguccaagaucuccaagaaccgcguccacuacaugaaguucaccaagggccgcugccagucccuccacucccgcggcgagcgcaaccacgacaaccagcgccuccaccaccccggcguccucugccaggccgacggcuccaccgaggagcaggcccccggcuccuccucccgcgucuga

SEQ ID NO: 47667 - RNA, 1221 nt, Artificial Sequence
  derived and/or modified sequence opt2 from PIP4K2A__Homo_sapiens__NP_005019
auggccacccccggcaaccucggcuccuccguccucgccuccaagaccaagaccaagaagaagcacuucgucgcccagaaggucaagcucuuccgcgccuccgacccccuccucuccguccucauguggggcgucaaccacuccaucaacgagcucucccacguccagauccccgucaugcucaugcccgacgacuucaaggccuacuccaagaucaaggucgacaaccaccucuucaacaaggagaacaugcccucccacuucaaguucaaggaguacugccccauggucuuccgcaaccuccgcgagcgcuucggcaucgacgaccaggacuuccagaacucccucacccgcuccgccccccuccccaacgacucccaggcccgcuccggcgcccgcuuccacaccuccuacgacaagcgcuacaucaucaagaccaucaccuccgaggacgucgccgagaugcacaacauccucaagaaguaccaccaguacaucgucgagugccacggcaucacccuccucccccaguuccucggcauguaccgccucaacgucgacggcgucgagaucuacgucaucgucacccgcaacgucuucucccaccgccucuccgucuaccgcaaguacgaccucaagggcuccaccgucgcccgcgaggccuccgacaaggagaaggccaaggagcuccccacccucaaggacaacgacuucaucaacgagggccagaagaucuacaucgacgacaacaacaagaaggucuuccucgagaagcucaagaaggacgucgaguuccucgcccagcucaagcucauggacuacucccuccucgucggcauccacgacgucgagcgcgccgagcaggaggaggucgagugcgaggagaacgacggcgaggaggagggcgaguccgacggcacccaccccgucggcaccccccccgacucccccggcaacacccucaacuccucccccccccucgcccccggcgaguucgaccccaacaucgacgucuacggcaucaagugccacgagaacuccccccgcaaggaggucuacuucauggccaucaucgacauccucacccacuacgacgccaagaagaaggccgcccacgccgccaagaccgucaagcacggcgccggcgccgagaucuccaccgucaaccccgagcaguacuccaagcgcuuccucgacuucaucggccacauccucaccuga

SEQ ID NO: 47668 - RNA, 1251 nt, Artificial Sequence
  derived and/or modified sequence opt2 from PIP4K2B__Homo_sapiens__NP_003550
auguccuccaacugcaccuccaccaccgccgucgccgucgccccccucuccgccuccaagaccaagaccaagaagaagcacuucgucugccagaaggucaagcucuuccgcgccuccgagcccauccucuccguccucauguggggcgucaaccacaccaucaacgagcucuccaacguccccguccccgucaugcucaugcccgacgacuucaaggccuacuccaagaucaaggucgacaaccaccucuucaacaaggagaaccuccccucccgcuucaaguucaaggaguacugccccauggucuuccgcaaccuccgcgagcgcuucggcaucgacgaccaggacuaccagaacuccgucacccgcuccgcccccaucaacuccgacucccagggccgcugcggcacccgcuuccucaccaccuacgaccgccgcuucgucaucaagaccgucuccuccgaggacgucgccgagaugcacaacauccucaagaaguaccaccaguucaucgucgagugccacggcaacacccuccucccccaguuccucggcauguaccgccucaccgucgacggcgucgagaccuacauggucgucacccgcaacgucuucucccaccgccucaccguccaccgcaaguacgaccucaagggcuccaccgucgcccgcgaggccuccgacaaggagaaggccaaggaccuccccaccuucaaggacaacgacuuccucaacgagggccagaagcuccacgucggcgaggaguccaagaagaacuuccucgagaagcucaagcgcgacgucgaguuccucgcccagcucaagaucauggacuacucccuccucgucggcauccacgacgucgaccgcgccgagcaggaggagauggaggucgaggagcgcgccgaggacgaggagugcgagaacgacggcgucggcggcaaccuccucugcuccuacggcaccccccccgacucccccggcaaccuccucuccuucccccgcuucuucggccccggcgaguucgaccccuccgucgacgucuacgccaugaagucccacgaguccucccccaagaaggaggucuacuucauggccaucaucgacauccucacccccuacgacaccaagaagaaggccgcccacgccgccaagaccgucaagcacggcgccggcgccgagaucuccaccgucaaccccgagcaguacuccaagcgcuucaacgaguucauguccaacauccucaccuga

SEQ ID NO: 47669 - RNA, 1212 nt, Artificial Sequence
  derived and/or modified sequence opt2 from PIP4K2C__Homo_sapiens__NP_001139731
auggccuccuccuccgucccccccgccaccgucuccgccgccaccgccggccccggccccggcuucggcuucgccuccaagaccaagaagaagcacuucguccagcagaaggucaaggucuuccgcgccgccgacccccucgucggcgucuuccucuggggcgucgcccacuccaucaacgagcucucccagguccccccccccgucaugcuccuccccgacgacuucaaggccuccuccaagaucaaggaguacugcccccaggucuuccgcaaccuccgcgaccgcuucggcaucgacgaccaggacuaccucgucucccucacccgcaacccccccuccgaguccgagggcuccgacggccgcuuccucaucuccuacgaccgcacccucgucaucaaggaggucuccuccgaggacaucgccgacaugcacuccaaccucuccaacuaccaccaguacaucgucaagugccacggcaacacccuccucccccaguuccucggcauguaccgcgucuccgucgacaacgaggacuccuacaugcucgucaugcgcaacauguucucccaccgccuccccguccaccgcaaguacgaccucaagggcucccucgucucccgcgaggccuccgacaaggagaaggucaaggagcuccccacccucaaggacauggacuuccucaacaagaaccagaaggucuacaucggcgaggaggagaagaagaucuuccucgagaagcucaagcgcgacgucgaguuccucguccagcucaagaucauggacuacucccuccuccucggcauccacgacaucauccgcggcuccgagcccgaggaggaggcccccguccgcgaggacgaguccgaggucgacggcgacugcucccucaccggcccccccgcccucgucggcuccuacggcaccucccccgagggcaucggcggcuacauccacucccaccgcccccucggccccggcgaguucgaguccuucaucgacgucuacgccauccgcuccgccgagggcgccccccagaaggaggucuacuucaugggccucaucgacauccucacccaguacgacgccaagaagaaggccgcccacgccgccaagaccgucaagcacggcgccggcgccgagaucuccaccguccaccccgagcaguacgccaagcgcuuccucgacuucaucaccaacaucuucgccuga

SEQ ID NO: 47670 - RNA, 1569 nt, Artificial Sequence
  derived and/or modified sequence opt2 from PIP5K1A__Homo_sapiens__NP_001129108
auggccuccgccuccuccggccccuccuccuccgucggcuucuccuccuucgaccccgccguccccuccugcacccucuccuccgccgccuccggcaucaagcgccccauggccuccgagguccccuacgccuccggcaugcccaucaagaagaucggccaccgcuccgucgacuccuccggcgagaccaccuacaagaagaccaccuccuccgcccucaagggcgccauccagcucggcaucacccacaccgucggcucccucuccaccaagcccgagcgcgacguccucaugcaggacuucuacgucgucgaguccaucuucuuccccuccgagggcuccaaccucacccccgcccaccacuacaacgacuuccgcuucaagaccuacgcccccgucgccuuccgcuacuuccgcgagcucuucggcauccgccccgacgacuaccucuacucccucugcuccgagccccucaucgagcucugcuccuccggcgccuccggcucccucuucuacgucuccuccgacgacgaguucaucaucaagaccguccagcacaaggaggccgaguuccuccagaagcuccuccccggcuacuacaugaaccucaaccagaacccccgcacccuccuccccaaguucuacggccucuacugcguccaggccggcggcaagaacauccgcaucgucgucaugaacaaccuccucccccgcuccgucaagaugcacaucaaguacgaccucaagggcuccaccuacaagcgccgcgccucccagaaggagcgcgagaagccccuccccaccuucaaggaccucgacuuccuccaggacauccccgacggccucuuccucgacgccgacauguacaacgcccucugcaagacccuccagcgcgacugccucguccuccaguccuucaagaucauggacuacucccuccucauguccauccacaacaucgaccacgcccagcgcgagccccucuccuccgagacccaguacuccgucgacacccgccgccccgccccccagaaggcccucuacuccaccgccauggaguccauccagggcgaggcccgccgcggcggcaccauggagaccgacgaccaguucgucaagaagcucgagcacuccuggaaggcccucguccacgacggcgacaccgucuccguccaccgccccggcuucuacgccgagcgcuuccagcgcuucaugugcaacaccgucuucaagaagaucccccucaagcccucccccuccaagaaguuccgcuccggcuccuccuucucccgccgcgccggcuccuccggcaacuccugcaucaccuaccagcccuccgucuccggcgagcacaaggcccaggucaccaccaaggccgaggucgagcccggcguccaccucggccgccccgacguccucccccagacccccccccucgaggagaucuccgagggcucccccauccccgaccccuccuucuccccccucgucggcgagacccuccagaugcucaccaccuccaccacccucgagaagcucgaggucgccgaguccgaguucacccacuga

SEQ ID NO: 47671 - RNA, 1509 nt, Artificial Sequence
  derived and/or modified sequence opt2 from PIP5K1B__Homo_sapiens__XP_006717364
auguccuccgccgccgagaacggcgaggccgcccccggcaagcagaacgaggagaagaccuacaagaagaccgccuccuccgccaucaagggcgccauccagcucggcaucggcuacaccgucggcaaccucaccuccaagcccgagcgcgacguccucaugcaggacuucuacgucgucgaguccgucuuccuccccuccgagggcuccaaccucacccccgcccaccacuaccccgacuuccgcuucaagaccuacgccccccucgccuuccgcuacuuccgcgagcucuucggcaucaagcccgacgacuaccucuacuccaucugcuccgagccccucaucgagcucuccaaccccggcgccuccggcucccucuucuucgucaccuccgacgacgaguucaucaucaagaccguccagcacaaggaggccgaguuccuccagaagcuccuccccggcuacuacaugaaccucaaccagaacccccgcacccuccuccccaaguucuacggccucuacugcaugcaguccggcggcaucaacauccgcaucgucgucaugaacaacguccucccccgcuccaugcgcaugcacuucaccuacgaccucaagggcuccaccuacaagcgccgcgccucccgcaaggagcgcgagaaguccaaccccaccuucaaggaccucgacuuccuccaggacaugcacgagggccucuacuucgacaccgagaccuacaacgcccucaugaagacccuccagcgcgacugccgcguccucgaguccuucaagaucauggacuacucccuccuccucggcauccacuuccucgaccacucccucaaggagaaggaggaggagaccccccagaacguccccgacgccaagcgcaccggcaugcagaagguccucuacuccaccgccauggaguccauccagggccccggcaaguccggcgacggcaucaucaccgagaaccccgacaccaugggcggcauccccgccaagucccaccgcggcgagaagcuccuccucuucaugggcaucaucgacauccuccaguccuaccgccucaugaagaagcucgagcacuccuggaaggcccucgucuacgacggcgacaccgucuccguccaccgccccuccuucuacgccgaccgcuuccucaaguucaugaacucccgcgucuucaagaagauccaggcccucaaggccucccccuccaagaagcgcugcaacuccaucgccgcccucaaggccaccucccaggagaucgucuccuccaucucccaggaguggaaggacgagaagcgcgaccuccucaccgagggccaguccuucuccucccucgacgaggaggcccucggcucccgccaccgccccgaccucguccccuccacccccucccucuucgaggccgccucccucgccaccaccaucuccuccuccucccucuacgucaacgagcacuacccccacgaccgccccacccucuacuccaacuccaaguga

SEQ ID NO: 47672 - RNA, 1923 nt, Artificial Sequence
  derived and/or modified sequence opt2 from PIP5K1C__Homo_sapiens__NP_001182662
auggagcucgagguccccgacgaggccgaguccgccgaggccggcgccguccccuccgaggccgccugggccgccgaguccggcgccgccgccggccucgcccagaagaaggccgcccccaccgagguccucuccaugaccgcccagcccggccccggccacggcaagaagcucggccaccgcggcgucgacgccuccggcgagaccaccuacaagaagaccaccuccuccacccucaagggcgccauccagcucggcaucggcuacaccgucggccaccucuccuccaagcccgagcgcgacguccucaugcaggacuucuacgucgucgaguccaucuucuuccccuccgagggcuccaaccucacccccgcccaccacuuccaggacuuccgcuucaagaccuacgcccccgucgccuuccgcuacuuccgcgagcucuucggcauccgccccgacgacuaccucuacucccucugcaacgagccccucaucgagcucuccaaccccggcgccuccggcucccucuucuacgucaccuccgacgacgaguucaucaucaagaccgucaugcacaaggaggccgaguuccuccagaagcuccuccccggcuacuacaugaaccucaaccagaacccccgcacccuccuccccaaguucuacggccucuacugcguccaguccggcggcaagaacauccgcgucgucgucaugaacaacauccucccccgcgucgucaagaugcaccucaaguucgaccucaagggcuccaccuacaagcgccgcgccuccaagaaggagaaggagaaguccuuccccaccuacaaggaccucgacuucaugcaggacaugcccgagggccuccuccucgacgccgacaccuucuccgcccucgucaagacccuccagcgcgacugccucguccucgaguccuucaagaucauggacuacucccuccuccucggcguccacaacaucgaccagcacgagcgcgagcgccaggcccagggcgcccaguccaccuccgacgagaagcgccccgucggccagaaggcccucuacuccaccgccauggaguccauccagggcggcgccgcccgcggcgaggccaucgaguccgacgacaccaugggcggcauccccgccgucaacggccgcggcgagcgccuccuccuccacaucggcaucaucgacauccuccaguccuaccgcuucaucaagaagcucgagcacaccuggaaggcccucguccacgacggcgacaccgucuccguccaccgccccuccuucuacgccgagcgcuucuucaaguucauguccaacaccgucuuccgcaagaacuccucccucaaguccucccccuccaagaagggccgcggcggcgcccuccucgccgucaagccccucggccccaccgccgccuucuccgccucccagauccccuccgagcgcgaggaggcccaguacgaccuccgcggcgcccgcuccuaccccacccucgaggacgagggccgccccgaccuccuccccugcaccccccccuccuucgaggaggccaccaccgccuccaucgccaccacccucuccuccaccucccucuccauccccgagcgcucccccuccgagaccuccgagcagccccgcuaccgccgccgcacccaguccuccggccaggacggccgcccccaggaggagccccccgccgaggaggaccuccagcagaucaccguccaggucgagcccgccugcuccgucgagaucgucguccccaaggaggaggacgccggcgucgaggccucccccgccggcgccuccgccgccgucgaggucgagaccgccucccaggccuccgacgaggagggcgcccccgccucccaggccuccgacgaggaggacgcccccgccaccgacaucuacuucuga

SEQ ID NO: 47673 - RNA, 1185 nt, Artificial Sequence
  derived and/or modified sequence opt2 from PIP5KL1__Homo_sapiens__NP_001128691
auggccgcccccucccccggcccccgcgagguccucgcccccucccccgaggccggcugccgcgccgucaccuccucccgccgcggccuccucuggcgccuccgcgacaagcagucccgccucggccucuucgagaucucccccggccacgagcuccacggcaugaccugcaugaugcaggccggccucugggccgccacccaggucuccauggaccacccccccaccggcccccccucccgcgacgacuucuccgagguccucacccagguccacgagggcuucgagcucggcacccucgccggccccgccuucgccuggcuccgccgcucccucggccucgccgaggaggacuaccaggccgcccucggccccggcggccccuaccuccaguuccucuccaccuccaaguccaaggccuccuucuuccucucccacgaccagcgcuucuuccucaagacccagggccgccgcgagguccaggcccuccucgcccaccucccccgcuacguccagcaccuccagcgccacccccacucccuccucgcccgccuccucggcguccacucccuccgcgucgaccgcggcaagaagaccuacuucaucgucaugcaguccgucuucuaccccgccggccgcaucuccgagcgcuacgacaucaagggcugcgaggucucccgcugggucgaccccgcccccgagggcuccccccucguccucguccucaaggaccucaacuuccagggcaagaccaucaaccucggcccccagcgcuccugguuccuccgccagauggagcucgacaccaccuuccuccgcgagcucaacguccucgacuacucccuccucaucgccuuccagcgccuccacgaggacgagcgcggccccggcuccucccucaucuuccgcaccgcccgcuccguccagggcgcccagucccccgaggagucccgcgcccagaaccgccgccuccuccccgacgcccccaacgcccuccacauccucgacggccccgagcagcgcuacuuccucggcgucgucgaccucgccaccgucuacggccuccgcaagcgccucgagcaccucuggaagacccuccgcuaccccggccgcaccuucuccaccgucucccccgcccgcuacgcccgccgccucugccagugggucgaggcccacaccgaguga

SEQ ID NO: 47674 - RNA, 441 nt, Artificial Sequence
  derived and/or modified sequence opt2 from PIP__Homo_sapiens__NP_002643
augcgccuccuccagcuccucuuccgcgccucccccgccacccuccuccucguccucugccuccagcucggcgccaacaaggcccaggacaacacccgcaagaucaucaucaagaacuucgacauccccaaguccguccgccccaacgacgaggucaccgccguccucgccguccagaccgagcucaaggagugcauggucgucaagaccuaccucaucuccuccaucccccuccagggcgccuucaacuacaaguacaccgccugccucugcgacgacaaccccaagaccuucuacugggacuucuacaccaaccgcaccguccagaucgccgccgucgucgacgucauccgcgagcucggcaucugccccgacgacgccgccgucauccccaucaagaacaaccgcuucuacaccaucgagauccucaaggucgaguga

SEQ ID NO: 47675 - RNA, 1173 nt, Artificial Sequence
  derived and/or modified sequence opt2 from PIPOX__Homo_sapiens__NP_057602
auggccgcccagaaggaccucugggacgccaucgucaucggcgccggcauccagggcugcuucaccgccuaccaccucgccaagcaccgcaagcgcauccuccuccucgagcaguucuuccucccccacucccgcggcuccucccacggccagucccgcaucauccgcaaggccuaccucgaggacuucuacacccgcaugaugcacgagugcuaccagaucugggcccagcucgagcacgaggccggcacccagcuccaccgccagaccggccuccuccuccucggcaugaaggagaaccaggagcucaagaccauccaggccaaccucucccgccagcgcgucgagcaccagugccucuccuccgaggagcucaagcagcgcuuccccaacauccgccucccccgcggcgaggucggccuccucgacaacuccggcggcgucaucuacgccuacaaggcccuccgcgcccuccaggacgccauccgccagcucggcggcaucguccgcgacggcgagaaggucgucgagaucaaccccggccuccucgucaccgucaagaccaccucccgcuccuaccaggccaagucccucgucaucaccgccggccccuggaccaaccagcuccuccgcccccucggcaucgagaugccccuccagacccuccgcaucaacgucugcuacuggcgcgagaugguccccggcuccuacggcgucucccaggccuuccccugcuuccucuggcucggccucugcccccaccacaucuacggccuccccaccggcgaguaccccggccucaugaaggucuccuaccaccacggcaaccacgccgaccccgaggagcgcgacugccccaccgcccgcaccgacaucggcgacguccagauccucuccuccuucguccgcgaccaccuccccgaccucaagcccgagcccgccgucaucgaguccugcauguacaccaacacccccgacgagcaguucauccucgaccgccaccccaaguacgacaacaucgucaucggcgccggcuucuccggccacggcuucaagcucgcccccgucgucggcaagauccucuacgagcucuccaugaagcucacccccuccuacgaccucgcccccuuccgcaucucccgcuuccccucccucggcaaggcccaccucuga

SEQ ID NO: 47676 - RNA, 873 nt, Artificial Sequence
  derived and/or modified sequence opt2 from PIR__Homo_sapiens__NP_003653
augggcuccuccaagaaggucacccucuccguccucucccgcgagcaguccgagggcgucggcgcccgcguccgccgcuccaucggccgccccgagcucaagaaccucgaccccuuccuccucuucgacgaguucaagggcggccgccccggcggcuuccccgaccacccccaccgcggcuucgagaccgucuccuaccuccucgagggcggcuccauggcccacgaggacuucugcggccacaccggcaagaugaaccccggcgaccuccaguggaugaccgccggccgcggcauccuccacgccgagaugcccugcuccgaggagcccgcccacggccuccagcucugggucaaccuccgcuccuccgagaagauggucgagccccaguaccaggagcucaaguccgaggagauccccaagcccuccaaggacggcgucaccgucgccgucaucuccggcgaggcccucggcaucaaguccaaggucuacacccgcacccccacccucuaccucgacuucaagcucgaccccggcgccaagcacucccagcccauccccaagggcuggaccuccuucaucuacaccaucuccggcgacgucuacaucggccccgacgacgcccagcagaagaucgagccccaccacaccgccguccucggcgagggcgacuccguccaggucgagaacaaggaccccaagcgcucccacuucguccucaucgccggcgagccccuccgcgagcccgucauccagcacggccccuucgucaugaacaccaacgaggagaucucccaggccauccucgacuuccgcaacgccaagaacggcuucgagcgcgccaagaccuggaaguccaagaucggcaacuga

SEQ ID NO: 47677 - RNA, 1230 nt, Artificial Sequence
  derived and/or modified sequence opt2 from PISD__Homo_sapiens__XP_005261512
auggccaccuccgucggccaccgcugccucggccuccuccacggcgucgcccccuggcgcuccucccuccaccccugcgagaucaccgcccucucccagucccuccagccccuccgcaagcuccccuuccgcgccuuccgcaccgacgcccgcaagauccacaccgcccccgcccgcaccauguuccuccuccgcccccuccccauccuccucgucaccggcggcggcuacgccggcuaccgccaguacgagaaguaccgcgagcgcgagcucgagaagcucggccucgagaucccccccaagcucgccggccacugggaggucgcccucuacaaguccguccccacccgccuccucucccgcgccuggggccgccucaaccaggucgagcucccccacuggcuccgccgccccgucuacucccucuacaucuggaccuucggcgucaacaugaaggaggccgccgucgaggaccuccaccacuaccgcaaccucuccgaguucuuccgccgcaagcucaagccccaggcccgccccgucugcggccuccacuccgucaucucccccuccgacggccgcauccucaacuucggccaggucaagaacugcgaggucgagcaggucaagggcgucaccuacucccucgaguccuuccucggcccccgcaugugcaccgaggaccuccccuucccccccgccgccuccugcgacuccuucaagaaccagcucgucacccgcgagggcaacgagcucuaccacugcgucaucuaccucgcccccggcgacuaccacugcuuccacucccccaccgacuggaccgucucccaccgccgccacuuccccggcucccucauguccgucaaccccggcauggcccgcuggaucaaggagcucuucugccacaacgagcgcgucguccucaccggcgacuggaagcacggcuucuucucccucaccgccgucggcgccaccaacgucggcuccauccgcaucuacuucgaccgcgaccuccacaccaacuccccccgccacuccaagggcuccuacaacgacuucuccuucgucacccacaccaaccgcgagggcguccccaugcgcaagggcgagcaccucggcgaguucaaccucggcuccaccaucguccucaucuucgaggcccccaaggacuucaacuuccagcucaagaccggccagaagauccgcuucggcgaggcccucggcucccucuga

SEQ ID NO: 47678 - RNA, 813 nt, Artificial Sequence
  derived and/or modified sequence opt2 from PITPNA__Homo_sapiens__NP_006215
augguccuccucaaggaguaccgcgucauccuccccgucuccgucgacgaguaccaggucggccagcucuacuccgucgccgaggccuccaagaacgagaccggcggcggcgagggcgucgagguccucgucaacgagcccuacgagaaggacggcgagaagggccaguacacccacaagaucuaccaccuccaguccaagguccccaccuucguccgcaugcucgcccccgagggcgcccucaacauccacgagaaggccuggaacgccuaccccuacugccgcaccgucaucaccaacgaguacaugaaggaggacuuccucaucaagaucgagaccuggcacaagcccgaccucggcacccaggagaacguccacaagcucgagcccgaggccuggaagcacgucgaggccgucuacaucgacaucgccgaccgcucccagguccucuccaaggacuacaaggccgaggaggaccccgccaaguucaaguccaucaagaccggccgcggcccccucggccccaacuggaagcaggagcucgucaaccagaaggacugccccuacaugugcgccuacaagcucgucaccgucaaguucaagugguggggccuccagaacaaggucgagaacuucauccacaagcaggagcgccgccucuucaccaacuuccaccgccagcucuucugcuggcucgacaagugggucgaccucaccauggacgacauccgccgcauggaggaggagaccaagcgccagcucgacgagaugcgccagaaggaccccgucaagggcaugaccgccgacgacuga

SEQ ID NO: 47679 - RNA, 3732 nt, Artificial Sequence
  derived and/or modified sequence opt2 from PITPNM1__Homo_sapiens__NP_001124320
augcucaucaaggaguaccacauccuccuccccaugucccucgacgaguaccaggucgcccagcucuacaugauccagaagaagucccgcgaggaguccuccggcgagggcuccggcgucgagauccucgccaaccgccccuacaccgacggccccggcggcuccggccaguacacccacaaggucuaccacgucggcucccacauccccggcugguuccgcgcccuccuccccaaggccgcccuccaggucgaggaggaguccuggaacgccuaccccuacacccgcacccgcuacaccugccccuucgucgagaaguucuccaucgagaucgagaccuacuaccuccccgacggcggccagcagcccaacgucuucaaccucuccggcgccgagcgccgccagcgcauccucgacaccaucgacaucguccgcgacgccgucgcccccggcgaguacaaggccgaggaggacccccgccucuaccacuccgucaagaccggccgcggcccccucuccgacgacugggcccgcaccgccgcccagaccggcccccucaugugcgccuacaagcucugcaaggucgaguuccgcuacuggggcaugcaggccaagaucgagcaguucauccacgacgucggccuccgccgcgucaugcuccgcgcccaccgccaggccuggugcuggcaggacgaguggaccgagcucuccauggccgacauccgcgcccucgaggaggagaccgcccgcaugcucgcccagcgcauggccaagugcaacaccggcuccgagggcuccgaggcccagccccccggcaagcccuccaccgaggcccgcuccgccgccuccaacaccggcacccccgacggccccgaggccccccccggccccgacgccucccccgacgccuccuucggcaagcagugguccuccuccucccgcuccuccuacuccucccagcacggcggcgccgucuccccccagucccucuccgaguggcgcaugcagaacaucgcccgcgacuccgagaacuccuccgaggaggaguucuucgacgcccacgagggcuucuccgacuccgaggaggucuuccccaaggagaugaccaaguggaacuccaacgacuucaucgacgccuucgccucccccgucgaggccgagggcacccccgagcccggcgccgaggccgccaagggcaucgaggacggcgcccaggccccccgcgacuccgagggccucgacggcgccggcgagcucggcgccgaggccugcgccguccacgcccucuuccucauccuccacuccggcaacauccucgacuccggccccggcgacgccaacuccaagcaggccgacguccagacccucuccuccgccuucgaggccgucacccgcauccacuuccccgaggcccucggccacgucgcccuccgccucguccccugcccccccaucugcgccgccgccuacgcccucgucuccaaccucucccccuacucccacgacggcgacucccucucccgcucccaggaccacaucccccucgccgcccucccccuccucgccaccuccuccucccgcuaccagggcgccgucgccaccgucaucgcccgcaccaaccaggccuacuccgccuuccuccgcucccccgagggcgccggcuucugcggccaggucgcccucaucggcgacggcgucggcggcauccucggcuucgacgcccucugccacuccgccaacgccggcaccggcucccgcggcuccucccgccgcggcuccaugaacaacgagcuccucucccccgaguucggccccguccgcgacccccucgccgacggcgucgagggccucggccgcggcucccccgagcccuccgcccuccccccccagcgcauccccuccgacauggccucccccgagcccgagggcucccagaacucccuccaggccgcccccgccaccaccuccuccugggagccccgccgcgccuccaccgccuucugcccccccgccgccuccuccgaggcccccgacggccccuccuccaccgcccgccucgacuucaaggucuccggcuucuuccucuucggcuccccccucggccucguccucgcccuccgcaagaccgucaugcccgcccucgaggcccagaugcgccccgccugcgagcagaucuacaaccucuuccacgccgccgaccccugcgccucccgccucgagccccuccucgcccccaaguuccaggccaucgccccccucaccgucccccgcuaccagaaguucccccucggcgacggcuccucccuccuccucgccgacacccuccagacccacuccucccucuuccucgaggagcucgagaugcucguccccuccacccccaccuccaccuccggcgccuucuggaagggcuccgagcucgccaccgacccccccgcccagcccgccgcccccuccaccaccuccgaggucgucaagauccucgagcgcugguggggcaccaagcgcaucgacuacucccucuacugccccgaggcccucaccgccuuccccaccgucacccucccccaccucuuccacgccuccuacugggaguccgccgacgucgucgccuucauccuccgccaggucaucgagaaggagcgcccccagcucgccgagugcgaggagcccuccaucuacucccccgccuucccccgcgagaaguggcagcgcaagcgcacccaggucaagauccgcaacgucaccuccaaccaccgcgccuccgacaccgucgucugcgagggccgcccccagguccucuccggccgcuucauguacggcccccucgacgucgucacccucaccggcgagaaggucgacgucuacaucaugacccagccccucuccggcaaguggauccacuucggcaccgaggucaccaacuccuccggccgccucaccuuccccgucccccccgagcgcgcccucggcaucggcgucuaccccguccgcauggucguccgcggcgaccacaccuacgccgagugcugccucaccgucgucgcccgcggcaccgaggccgucgucuucuccaucgacggcuccuucaccgccuccgucuccaucaugggcuccgaccccaagguccgcgccggcgccgucgacgucguccgccacuggcaggacuccggcuaccucaucgucuacgucaccggccgccccgacaugcagaagcaccgcgucgucgccuggcucucccagcacaacuucccccacggcgucgucuccuucugcgacggccucacccacgacccccuccgccagaaggccauguuccuccagucccucguccaggaggucgagcucaacaucgucgccggcuacggcucccccaaggacgucgccgucuacgccgcccucggccucucccccucccagaccuacaucgucggccgcgccguccgcaagcuccaggcccagugccaguuccucuccgacggcuacgucgcccaccucggccagcucgaggccggcucccacucccacgccuccuccggccccccccgcgccgcccucggcaaguccuccuacggcgucgccgcccccgucgacuuccuccgcaagcagucccagcuccuccgcucccgcggccccucccaggccgagcgcgagggccccggcaccccccccaccacccucgcccgcggcaaggcccgcuccaucucccucaagcucgacuccgaggaguga

SEQ ID NO: 47680 - RNA, 2817 nt, Artificial Sequence
  derived and/or modified sequence opt2 from PITPNM3__Homo_sapiens__NP_001159438
auggccaaggccggccgcgccggcggccccccccccggcggcggcgcccccuggcaccuccgcaacguccucuccgacuccgucgaguccuccgacgacgaguucuucgacgcccgcggcgagggcaccgcccccugcaccuccuccauccuccaggagaagcagcgcgagcucuaccgcgucucccuccgccgccagcgcuuccccgcccagggcuccaucgagauccacgaggacuccgaggagggcugcccccagcgcuccugcaagacccacguccuccuccucguccuccacggcggcaacauccucgacaccggcgccggcgaccccuccugcaaggccgccgacauccacaccuucuccuccguccucgagaaggucacccgcgcccacuuccccgccgcccucggccacauccucaucaaguucguccccugccccgccaucugcuccgaggccuucucccucgucucccaccucaaccccuacucccacgacgagggcugccucuccuccucccaggaccacgucccccucgccgcccucccccuccucgccaucuccuccccccaguaccaggacgccgucgccaccgucaucgagcgcgccaaccaggucuaccgcgaguuccucaaguccuccgacggcaucggcuucuccggccaggucugccucaucggcgacugcgucggcggccuccucgccuucgacgccaucugcuacuccgccggccccuccggcgacucccccgccuccuccucccgcaagggcuccaucuccuccacccaggacacccccgucgccgucgaggaggacugcucccucgccuccuccaagcgccucuccaaguccaacaucgacaucuccuccggccucgaggacgaggagcccaagcgcccccucccccgcaagcaguccgacuccuccaccuacgacugcgaggccaucacccagcaccacgccuuccucuccuccauccacuccuccguccucaaggacgaguccgagacccccgccgccggcggcccccagcuccccgaggucucccucggccgcuucgacuucgacgucuccgacuucuuccucuucggcuccccccucggccucguccucgccaugcgccgcaccguccuccccggccucgacggcuuccagguccgccccgccugcucccaggucuacuccuucuuccacugcgccgaccccuccgccucccgccucgagccccuccucgagcccaaguuccaccucgucccccccgucuccgucccccgcuaccagcgcuucccccucggcgacggccagucccuccuccucgccgacgcccuccacacccacuccccccucuuccucgagggcuccucccgcgacucccccccccuccucgacgcccccgccucccccccccaggccucccgcuuccagcgccccggccgccgcauguccgagggcuccucccacuccgaguccuccgaguccuccgacuccauggcccccgucggcgccucccgcaucaccgccaagugguggggcuccaagcgcaucgacuacgcccucuacugccccgacguccucaccgccuuccccaccgucgcccucccccaccucuuccacgccuccuacugggaguccaccgacgucgucgccuucauccuccgccaggucaugcgcuacgaguccgucaacaucaaggaguccgcccgccucgaccccgccgcccucucccccgccaacccccgcgagaaguggcuccgcaagcgcacccaggucaagcuccgcaacgucaccgccaaccaccgcgccaacgacgucaucgccgccgaggacggcccccagguccucgucggccgcuucauguacggcccccucgacauggucgcccucaccggcgagaaggucgacauccucgucauggccgagcccuccuccggccgcuggguccaccucgacaccgagaucaccaacuccuccggccgcaucaccuacaacgucccccgcccccgccgccucggcgucggcgucuaccccgucaagauggucguccgcggcgaccagaccugcgccauguccuaccucaccguccucccccgcggcauggagugcgucgucuucuccaucgacggcuccuucgccgccuccgucuccaucaugggcuccgaccccaagguccgccccggcgccgucgacgucguccgccacuggcaggaccucggcuacaugauccucuacaucaccggccgccccgacaugcagaagcagcgcgucgucuccuggcucucccagcacaacuucccccagggcaugaucuucuucuccgacggccucguccacgacccccuccgccagaaggccaucuuccuccgcaaccucaugcaggagugcuucaucaagaucuccgccgccuacggcuccaccaaggacaucuccgucuacuccguccucggccuccccgccucccagaucuucaucgucggccgccccaccaagaaguaccagacccagugccaguuccucuccgagggcuacgccgcccaccucgccgcccucgaggccucccaccgcucccgccccaagaagaacaacucccgcaugauccuccgcaagggcuccuucggccuccacgcccagcccgaguuccuccgcaagcgcaaccaccuccgccgcaccauguccguccagcagcccgacccccccgccgccaaccccaagcccgagcgcgcccagucccagcccgaguccgacaaggaccacgagcgcccccuccccgcccucuccugggcccgcggcccccccaaguucgaguccguccccuga

SEQ ID NO: 47681 - RNA, 3117 nt, Artificial Sequence
  derived and/or modified sequence opt2 from PITRM1__Homo_sapiens__NP_001229236
auguggcgcugcggcggccgccagggccucugcguccuccgccgccucuccggcggccacgcccaccaccgcgccuggcgcuggaacuccaaccgcgccugcgagcgcgcccuccaguacaagcucggcgacaagauccacggcuucaccgucaaccaggucaccuccguccccgagcucuuccucaccgccgucaagcucacccacgacgacaccggcgcccgcuaccuccaccucgcccgcgaggacaccaacaaccucuucuccguccaguuccgcaccacccccauggacuccaccggcgucccccacauccucgagcacaccguccucugcggcucccagaaguaccccugccgcgaccccuucuucaagaugcucaaccgcucccucuccaccuucaugaacgccuucaccgccuccgacuacacccucuaccccuucuccacccagaaccccaaggacuuccagaaccuccucuccgucuaccucgacgccaccuucuuccccugccuccgcgagcucgacuucuggcaggagggcuggcgccucgagcacgagaaccccuccgacccccagaccccccucgucuucaagggcgucgucuucaacgagaugaagggcgccuucaccgacaacgagcgcaucuucucccagcaccuccagaaccgccuccuccccgaccacaccuacuccgucgucuccggcggcgacccccucugcauccccgagcucaccugggagcagcucaagcaguuccacgccacccacuaccaccccuccaacgcccgcuucuucaccuacggcaacuucccccucgagcagcaccucaagcagauccacgaggaggcccucuccaaguuccagaagaucgagcccuccaccgucguccccgcccagacccccugggacaagccccgcgaguuccagaucaccugcggccccgacuccuucgccaccgaccccuccaagcagaccaccaucuccgucuccuuccuccuccccgacaucaccgacaccuucgaggccuucacccucucccuccucuccucccuccucaccuccggccccaacucccccuucuacaaggcccucaucgaguccggccucggcaccgacuucucccccgacgucggcuacaacggcuacacccgcgaggccuacuucuccgucggccuccagggcaucgccgagaaggacaucgagaccguccgcucccucaucgaccgcaccaucgacgaggucgucgagaagggcuucgaggacgaccgcaucgaggcccuccuccacaagaucgagauccagaugaagcaccaguccaccuccuucggccucaugcucaccuccuacaucgccuccugcuggaaccacgacggcgaccccgucgagcuccucaagcucggcaaccagcucgccaaguuccgccagugccuccaggagaaccccaaguuccuccaggagaaggucaagcaguacuucaagaacaaccagcacaagcucacccucuccaugcgccccgacgacaaguaccacgagaagcaggcccaggucgaggccaccaagcucaagcagaaggucgaggcccucucccccggcgaccgccagcagaucuacgagaagggccucgagcuccgcucccagcaguccaagccccaggacgccuccugccuccccgcccucaaggucuccgacaucgagcccaccauccccgucaccgagcucgacgucguccucaccgccggcgacauccccguccaguacugcgcccagcccaccaacggcauggucuacuuccgcgccuucuccucccucaacacccuccccgaggagcuccgccccuacgucccccucuucugcuccguccucaccaagcucggcugcggccuccucgacuaccgcgagcaggcccagcagaucgagcucaagaccggcggcauguccgccuccccccacguccuccccgacgacucccacauggacaccuacgagcaggucggcguccucuucuccucccucugccucgaccgcaaccuccccgacaugaugcagcucugguccgagaucuucaacaaccccugcuucgaggaggaggagcacuucaagguccucgucaagaugaccgcccaggagcucgccaacggcauccccgacuccggccaccucuacgccuccauccgcgccggccgcacccucacccccgccggcgaccuccaggagaccuucuccggcauggaccagguccgccucaugaagcgcaucgccgagaugaccgacaucaagcccauccuccgcaagcucccccgcaucaagaagcaccuccucaacggcgacaacaugcgcugcuccgucaacgccaccccccagcagaugccccagaccgagaaggccgucgaggacuuccuccgcuccaucggccgcuccaagaaggagcgccgccccguccgcccccacaccgucgagaagcccguccccuccuccuccggcggcgacgcccacgucccccacggcucccaggucauccgcaagcucgucauggagcccaccuucaagcccuggcagaugaagacccacuuccucaugcccuuccccgucaacuacgucggcgagugcauccgcaccguccccuacaccgaccccgaccacgccucccucaagauccucgcccgccucaugaccgccaaguuccuccacaccgagauccgcgagaagggcggcgccuacggcggcggcgccaagcucucccacaacggcaucuucacccucuacuccuaccgcgaccccaacaccaucgagacccuccaguccuucggcaaggccgucgacugggccaaguccggcaaguucacccagcaggacaucgacgaggccaagcucuccgucuucuccaccgucgacgcccccgucgcccccuccgacaagggcauggaccacuuccucuacggccucuccgacgagaugaagcaggcccaccgcgagcagcucuucgccgucucccacgacaagcuccucgccgucuccgaccgcuaccucggcaccggcaaguccacccacggccucgccauccucggccccgagaaccccaagaucgccaaggaccccuccuggaucauccaguga

SEQ ID NO: 47682 - RNA, 945 nt, Artificial Sequence
  derived and/or modified sequence opt2 from PITX1__Homo_sapiens__NP_002644
auggacgccuucaagggcggcaugucccucgagcgccuccccgagggccuccgccccccccccccccccccccacgacaugggccccgccuuccaccucgcccgccccgccgacccccgcgagccccucgagaacuccgccuccgaguccuccgacaccgagcuccccgagaaggagcgcggcggcgagcccaagggccccgaggacuccggcgccggcggcaccggcugcggcggcgccgacgaccccgccaagaagaagaagcagcgccgccagcgcacccacuucaccucccagcagcuccaggagcucgaggccaccuuccagcgcaaccgcuaccccgacauguccaugcgcgaggagaucgccgucuggaccaaccucaccgagccccgcguccgcgucugguucaagaaccgccgcgccaaguggcgcaagcgcgagcgcaaccagcagcucgaccucugcaagggcggcuacgucccccaguucuccggccucguccagcccuacgaggacgucuacgccgccggcuacuccuacaacaacugggccgccaagucccucgcccccgccccccucuccaccaaguccuucaccuucuucaacuccauguccccccucuccucccaguccauguucuccgcccccuccuccaucuccuccaugaccaugcccuccuccaugggccccggcgccguccccggcaugcccaacuccggccucaacaacaucaacaaccucaccggcuccucccucaacuccgccaugucccccggcgccugccccuacggcacccccgccucccccuacuccgucuaccgcgacaccugcaacuccucccucgccucccuccgccucaaguccaagcagcacuccuccuucggcuacggcggccuccagggccccgccuccggccucaacgccugccaguacaacuccuga

SEQ ID NO: 47683 - RNA, 975 nt, Artificial Sequence
  derived and/or modified sequence opt2 from PITX2__Homo_sapiens__NP_000316
augaacugcaugaagggcccccuccaccucgagcaccgcgccgccggcaccaagcucuccgccgucuccuccuccuccugccaccacccccagccccucgccauggccuccguccucgcccccggccagccccgcucccucgacuccuccaagcaccgccucgagguccacaccaucuccgacaccuccucccccgaggccgccgagaaggacaagucccagcagggcaagaacgaggacgucggcgccgaggaccccuccaagaagaagcgccagcgccgccagcgcacccacuucaccucccagcagcuccaggagcucgaggccaccuuccagcgcaaccgcuaccccgacauguccacccgcgaggagaucgccgucuggaccaaccucaccgaggcccgcguccgcgucugguucaagaaccgccgcgccaaguggcgcaagcgcgagcgcaaccagcaggccgagcucugcaagaacggcuucggcccccaguucaacggccucaugcagcccuacgacgacauguaccccggcuacuccuacaacaacugggccgccaagggccucaccuccgccucccucuccaccaaguccuuccccuucuucaacuccaugaacgucaacccccucuccucccaguccauguucuccccccccaacuccaucuccuccauguccauguccuccuccaugguccccuccgccgucaccggcguccccggcuccucccucaacucccucaacaaccucaacaaccucuccucccccucccucaacuccgccguccccacccccgccugccccuacgccccccccaccccccccuacgucuaccgcgacaccugcaacuccucccucgccucccuccgccucaaggccaagcagcacuccuccuucggcuacgccuccguccagaaccccgccuccaaccucuccgccugccaguacgccgucgaccgccccgucuga

SEQ ID NO: 47684 - RNA, 909 nt, Artificial Sequence
  derived and/or modified sequence opt2 from PITX3__Homo_sapiens__NP_005020
auggaguucggccuccucuccgaggccgaggcccgcucccccgcccucucccucuccgacgccggcaccccccacccccagcuccccgagcacggcugcaagggccaggagcacuccgacuccgagaaggccuccgccucccuccccggcggcucccccgaggacggcucccucaagaagaagcagcgccgccagcgcacccacuucaccucccagcagcuccaggagcucgaggccaccuuccagcgcaaccgcuaccccgacauguccacccgcgaggagaucgccgucuggaccaaccucaccgaggcccgcguccgcgucugguucaagaaccgccgcgccaaguggcgcaagcgcgagcgcucccagcaggccgagcucugcaagggcuccuucgccgccccccucggcggccucgucccccccuacgaggaggucuaccccggcuacuccuacggcaacuggccccccaaggcccucgcccccccccucgccgccaagaccuuccccuucgccuucaacuccgucaacgucggcccccucgccucccagcccgucuucuccccccccuccuccaucgccgccuccaugguccccuccgccgccgccgcccccggcaccguccccggccccggcgcccuccagggccucggcggcggcccccccggccucgcccccgccgccgucuccuccggcgccgucuccugccccuacgccuccgccgccgccgccgccgccgccgccgccuccucccccuacgucuaccgcgaccccugcaacuccucccucgccucccuccgccucaaggccaagcagcacgccuccuucuccuaccccgccguccacggccccccccccgccgccaaccucucccccugccaguacgccgucgagcgccccgucuga

SEQ ID NO: 47685 - RNA, 2490 nt, Artificial Sequence
  derived and/or modified sequence opt2 from PIWIL1__Homo_sapiens__NP_001177900
augaccggccgcgcccgcgcccgcgcccgcggccgcgcccgcggccaggagaccgcccagcucgucggcuccaccgccucccagcagcccggcuacauccagccccgcccccagcccccccccgccgagggcgagcucuucggccgcggccgccagcgcggcaccgccggcggcaccgccaagucccagggccuccagaucuccgccggcuuccaggagcucucccucgccgagcgcggcggccgccgccgcgacuuccacgaccucggcgucaacacccgccagaaccucgaccacgucaaggaguccaagaccggcuccuccggcaucaucguccgccucuccaccaaccacuuccgccucaccucccgcccccagugggcccucuaccaguaccacaucgacuacaacccccucauggaggcccgccgccuccgcuccgcccuccucuuccagcacgaggaccucaucggcaagugccacgccuucgacggcaccauccucuuccuccccaagcgccuccagcagaaggucaccgaggucuucuccaagacccgcaacggcgaggacguccgcaucaccaucacccucaccaacgagcucccccccaccucccccaccugccuccaguucuacaacaucaucuuccgccgccuccucaagaucaugaaccuccagcagaucggccgcaacuacuacaaccccaacgaccccaucgacauccccucccaccgccucgucaucuggcccggcuucaccaccuccauccuccaguacgagaacuccaucaugcucugcaccgacgucucccacaagguccuccgcuccgagaccguccucgacuucauguucaacuucuaccaccagaccgaggagcacaaguuccaggagcaggucuccaaggagcucaucggccucgucguccucaccaaguacaacaacaagaccuaccgcgucgacgacaucgacugggaccagaaccccaaguccaccuucaagaaggccgacggcuccgaggucuccuuccucgaguacuaccgcaagcaguacaaccaggagaucaccgaccucaagcagcccguccucgucucccagcccaagcgccgccgcggccccggcggcacccuccccggccccgccaugcucauccccgagcucugcuaccucaccggccucaccgacaagaugcgcaacgacuucaacgucaugaaggaccucgccguccacacccgccucacccccgagcagcgccagcgcgaggucggccgccucaucgacuacauccacaagaacgacaacguccagcgcgagcuccgcgacuggggccucuccuucgacuccaaccuccucuccuucuccggccgcauccuccagaccgagaagauccaccagggcggcaagaccuucgacuacaacccccaguucgccgacugguccaaggagacccgcggcgccccccucaucuccgucaagccccucgacaacuggcuccucaucuacacccgccgcaacuacgaggccgccaacucccucauccagaaccucuucaaggucacccccgccaugggcaugcagaugcgcaaggccaucaugaucgaggucgacgaccgcaccgaggccuaccuccgcguccuccagcagaaggucaccgccgacacccagaucgucgucugccuccucuccuccaaccgcaaggacaaguacgacgccaucaagaaguaccucugcaccgacugccccacccccucccagugcgucgucgcccgcacccucggcaagcagcagaccgucauggccaucgccaccaagaucgcccuccagaugaacugcaagaugggcggcgagcucuggcgcgucgacaucccccucaagcucgucaugaucgucggcaucgacugcuaccacgacaugaccgccggccgccgcuccaucgccggcuucgucgccuccaucaacgagggcaugacccgcugguucucccgcugcaucuuccaggaccgcggccaggagcucgucgacggccucaaggucugccuccaggccgcccuccgcgccuggaacuccugcaacgaguacaugcccucccgcaucaucgucuaccgcgacggcgucggcgacggccagcucaagacccucgucaacuacgaggucccccaguuccucgacugccucaaguccaucggccgcggcuacaacccccgccucaccgucaucgucgucaagaagcgcgucaacacccgcuucuucgcccaguccggcggccgccuccagaacccccuccccggcaccgucaucgacgucgaggucacccgccccgagugguacgacuucuucaucgucucccaggccguccgcuccggcuccgucucccccacccacuacaacgucaucuacgacaacuccggccucaagcccgaccacauccagcgccucaccuacaagcucugccacaucuacuacaacuggcccgucuccgccuccaccugcuga

SEQ ID NO: 47686 - RNA, 2922 nt, Artificial Sequence
  derived and/or modified sequence opt2 from PIWIL2__Homo_sapiens__NP_001129193
auggaccccuuccgccccuccuuccgcggccagucccccauccaccccucccagugccaggccguccgcaugcccggcugcuggccccaggccuccaagccccucgaccccgcccucggccgcggcgcccccgccggccgcggccacgucuucggcaagcccgaggagcccuccacccagcgcggccccgcccagcgcgaguccgucggccucgucuccauguuccgcggccucggcaucgagaccgucuccaagaccccccucaagcgcgagaugcuccccuccggccgcggcauccucggccgcggccucuccgccaaccucguccgcaaggaccgcgaggagcucucccccaccuucugggaccccaagguccucgccgccggcgacuccaagauggccgagaccuccgucggcuggucccgcacccucggccgcggcuccuccgacgccucccuccucccccucggccgcgccgccggcggcaucucccgcgaggucgacaagccccccugcaccuucuccacccccucccgcggccccccccagcucuccuccccccccgcccucccccaguccccccuccacucccccgaccgcccccucguccucaccgucgagcacaaggagaaggagcucaucgucaagcagggcuccaagggcaccccccagucccucggccucaaccucgucaagauccagugccacaacgaggccgucuaccaguaccacgucaccuucucccccaacgucgagugcaaguccaugcgcuucggcaugcucaaggaccaccaggccgucaccggcaacgucaccgccuucgacggcuccauccucuaccuccccgucaagcuccagcagguccucgagcucaagucccagcgcaagaccgacuccgccgagaucuccaucaagauccagaugaccaagauccucgagcccugcuccgaccucugcauccccuucuacaacgucgucuuccgccgcgucaugaagcuccucgacaugaagcucgucggccgcaacuucuacgaccccaccuccgccaugguccuccagcagcaccgccuccagaucuggcccggcuacgccgccuccauccgccgcaccgacggcggccucuuccuccucgccgacgucucccacaaggucauccgcaacgacugcguccucgacgucaugcacgccaucuaccagcagaacaaggagcacuuccaggacgagugcaccaagcuccucgucggcaacaucgucaucacccgcuacaacaaccgcaccuaccgcaucgacgacgucgacuggaacaagacccccaaggacuccuucaccauguccgacggcaaggagaucaccuuccucgaguacuacuccaagaacuacggcaucaccgucaaggaggaggaccagccccuccucauccaccgccccuccgagcgccaggacaaccacggcaugcuccucaagggcgagauccuccuccuccccgagcucuccuucaugaccggcauccccgagaagaugaagaaggacuuccgcgccaugaaggaccucgcccagcagaucaaccucucccccaagcagcaccacuccgcccucgagugccuccuccagcgcaucgccaagaacgaggccgccaccaacgagcucaugcgcuggggccuccgccuccagaaggacguccacaagaucgagggccgcguccuccccauggagcgcaucaaccucaagaacaccuccuucaucaccucccaggagcucaacugggucaaggaggucacccgcgaccccuccauccucaccauccccaugcacuucugggcccucuucuaccccaagcgcgccauggaccaggcccgcgagcucgucaacaugcucgagaagaucgccggccccaucggcaugcgcauguccccccccgccugggucgagcucaaggacgaccgcaucgagaccuacguccgcaccauccaguccacccucggcgccgagggcaagauccagauggucgucugcaucaucaugggcccccgcgacgaccucuacggcgccaucaagaagcucugcugcguccagucccccguccccucccaggucgucaacguccgcaccaucggccagcccacccgccuccgcuccgucgcccagaagauccuccuccagaucaacugcaagcucggcggcgagcucuggggcgucgacaucccccucaagcagcucauggucaucggcauggacgucuaccacgaccccucccgcggcaugcgcuccgucgucggcuucgucgccuccaucaaccucacccucaccaagugguacucccgcgucgucuuccagaugccccaccaggagaucgucgacucccucaagcucugccucgucggcucccucaagaaguucuacgaggucaaccacugccuccccgagaagaucgucgucuaccgcgacggcgucuccgacggccagcucaagaccgucgccaacuacgagaucccccagcuccagaagugcuucgaggccuucgagaacuaccagcccaagauggucgucuucgucguccagaagaagaucuccaccaaccucuaccucgccgccccccagaacuucgucacccccacccccggcaccgucgucgaccacaccaucaccuccugcgagugggucgacuucuaccuccucgcccaccacguccgccagggcugcggcauccccacccacuacgucugcguccucaacaccgccaaccucucccccgaccacaugcagcgccucaccuucaagcucugccacauguacuggaacuggcccggcaccauccgcguccccgcccccugcaaguacgcccacaagcucgccuuccucuccggccacauccuccaccacgagcccgccauccagcucugcgagaaccucuucuuccucuga

SEQ ID NO: 47687 - RNA, 2649 nt, Artificial Sequence
  derived and/or modified sequence opt2 from PIWIL3__Homo_sapiens__NP_001008496
augcccggccgcgcccgcacccgcgcccgcggccgcgcccgccgccgcgaguccuaccagcaggaggcccccggcggcccccgcgcccccggcuccgccaccacccaggagcccccccagcuccaguccaccccccgcccccuccaggaggagguccccgucguccgcccccuccagccccgcgccgcccgcggcggcgccggcggcggcgcccagucccagggcgucaaggagcccggccccgaggccggccuccacaccgccccccuccaggagcgccgcaucggcggcgucuuccaggaccucgucgucaacacccgccaggacaugaagcacgucaaggacuccaagaccggcuccgagggcaccgucguccagcuccucgccaaccacuuccgcgucaucucccgcccccagugggucgccuacaaguacaacgucgacuacaagcccgacaucgaggacggcaaccuccgcaccauccuccucgaccagcaccgccgcaaguucggcgagcgccacaucuucgacggcaacucccuccuccucucccgcccccucaaggagcgccgcgucgaguggcucuccaccaccaaggacaagaacaucgucaagaucaccgucgaguucuccaaggagcucacccccaccucccccgacugccuccgcuacuacaacauccucuuccgccgcaccuucaagcuccucgacuucgagcaggucggccgcaacuacuacaccaagaagaaggccauccagcucuaccgccacggcaccucccucgagaucuggcucggcuacgucaccuccguccuccaguacgagaacuccaucacccucugcgccgacgucucccacaagcuccuccgcaucgagaccgccuacgacuucaucaagcgcaccuccgcccaggcccagaccggcaacauccgcgaggaggucaccaacaagcucaucggcuccaucguccucaccaaguacaacaacaagaccuaccgcgucgacgacaucgacuggaagcagaaccccgaggacaccuucaacaaguccgacggcuccaagaucaccuacaucgacuacuaccgccagcagcacaaggagaucgucaccgucaagaagcagccccuccucgucucccagggccgcuggaagaagggccucaccggcacccagcgcgagcccauccuccucaucccccagcucugccacaugaccggccucaccgacgagaucugcaaggacuacuccaucgucaaggagcucgccaagcacacccgccucuccccccgccgccgccaccacacccucaaggaguucaucaacacccuccaggacaacaagaagguccgcgagcuccuccagcucugggaccucaaguucgacaccaacuuccucuccguccccggccgcguccucaagaacgccaacaucguccagggccgccgcauggucaaggccaacucccagggcgacuggucccgcgagauccgcgagcucccccuccucaacgccaugccccuccacuccuggcucauccucuacucccgcuccucccaccgcgaggccaugucccucaagggccaccuccaguccgucaccgcccccaugggcaucaccaugaagcccgccgagaugaucgaggucgacggcgacgccaacuccuacaucgacacccuccgcaaguacacccgccccacccuccagaugggcauguccugccuccucgucuucaaggucaucugcauccuccccaacgacgacaagcgccgcuacgacuccaucaagcgcuaccucugcaccaagugccccauccccucccagugcgucgucaagaagacccucgagaagguccaggcccgcaccaucgucaccaagaucgcccagcagaugaacugcaagaugggcggcgcccucuggaaggucgagaccgacguccagcgcaccauguucgucggcaucgacugcuuccacgacaucgucaaccgccagaaguccaucgccggcuucgucgccuccaccaacgccgagcucaccaagugguacucccagugcgucauccagaagaccggcgaggagcucgucaaggagcucgagaucugccucaaggccgcccucgacgucuggugcaagaacgaguccuccaugccccacuccgucaucgucuaccgcgacggcgucggcgacggccagcuccaggcccuccucgaccacgaggccaagaagauguccaccuaccucaagaccaucucccccaacaacuucacccucgccuucaucgucgucaagaagcgcaucaacacccgcuucuuccucaagcacggcuccaacuuccagaaccccccccccggcaccgucaucgacgucgagcucacccgcaacgagugguacgacuucuucaucgucucccaguccguccaggacggcaccgucacccccacccacuacaacgucaucuacgacaccaucggccucucccccgacaccguccagcgccucaccuacugccucugccacauguacuacaaccuccccggcaucauccgcguccccgcccccugccacuacgcccacaagcucgccuaccucgucggccaguccauccaccaggagcccaaccgcucccucuccacccgccucuucuaccucuga

SEQ ID NO: 47688 - RNA, 2559 nt, Artificial Sequence
  derived and/or modified sequence opt2 from PIWIL4__Homo_sapiens__NP_689644
auguccggccgcgcccgcgucaaggcccgcggcaucgcccgcucccccuccgccaccgaggucggccgcauccaggccuccccccucccccgcuccgucgaccucuccaacaacgaggccuccuccuccaacggcuuccucggcaccucccgcaucuccaccaacgacaaguacggcaucuccuccggcgacgccggcuccaccuucauggagcgcggcgucaagaacaagcaggacuucauggaccucuccaucugcacccgcgagaagcucgcccacguccgcaacugcaagaccggcuccuccggcauccccgucaagcucgucaccaaccucuucaaccucgacuucccccaggacuggcagcucuaccaguaccacgucaccuacauccccgaccucgccucccgccgccuccgcaucgcccuccucuacucccacuccgagcucuccaacaaggccaaggccuucgacggcgccauccucuuccucucccagaagcucgaggagaaggucaccgagcucuccuccgagacccagcgcggcgagaccaucaagaugaccaucacccucaagcgcgagcuccccuccuccucccccgucugcauccaggucuucaacaucaucuuccgcaagauccucaagaagcucuccauguaccagaucggccgcaacuucuacaaccccuccgagcccauggagaucccccagcacaagcucucccucuggcccggcuucgccaucuccgucuccuacuucgagcgcaagcuccucuucuccgccgacgucuccuacaagguccuccgcaacgagaccguccucgaguucaugaccgcccucugccagcgcaccggccucuccugcuucacccagaccugcgagaagcagcucaucggccucaucguccucacccgcuacaacaaccgcaccuacuccaucgacgacaucgacugguccgucaagcccacccacaccuuccagaagcgcgacggcaccgagaucaccuacgucgacuacuacaagcagcaguacgacaucaccgucuccgaccucaaccagcccaugcucgucucccuccucaagaagaagcgcaacgacaacuccgaggcccagcucgcccaccucauccccgagcucugcuuccucaccggccucaccgaccaggccaccuccgacuuccagcucaugaaggccgucgccgagaagacccgccucucccccuccggccgccagcagcgccucgcccgccucgucgacaacauccagcgcaacaccaacgcccgcuucgagcucgagaccuggggccuccacuucggcucccagaucucccucaccggccgcaucguccccuccgagaagauccucaugcaggaccacaucugccagcccgucuccgccgccgacugguccaaggacauccgcaccugcaagauccucaacgcccagucccucaacaccuggcucauccucugcuccgaccgcaccgaguacgucgccgaguccuuccucaacugccuccgccgcgucgccggcuccaugggcuucaacgucgacuaccccaagaucaucaagguccaggagaaccccgccgccuucguccgcgccauccagcaguacgucgaccccgacguccagcucgucaugugcauccuccccuccaaccagaagaccuacuacgacuccaucaagaaguaccucuccuccgacugccccguccccucccagugcguccucgcccgcacccucaacaagcagggcaugaugauguccaucgccaccaagaucgccaugcagaugaccugcaagcucggcggcgagcucugggccgucgagaucccccucaagucccucauggucgucggcaucgacgucugcaaggacgcccucuccaaggacgucauggucgucggcugcgucgccuccgucaacccccgcaucacccgcugguucucccgcugcauccuccagcgcaccaugaccgacgucgccgacugccucaaggucuucaugaccggcgcccucaacaagugguacaaguacaaccacgaccuccccgcccgcaucaucgucuaccgcgccggcgucggcgacggccagcucaagacccucaucgaguacgaggucccccagcuccucuccuccgucgccgaguccuccuccaacaccuccucccgccucuccgucaucgucguccgcaagaagugcaugccccgcuucuucaccgagaugaaccgcaccguccagaaccccccccucggcaccgucgucgacuccgaggccacccgcaacgagugguacgacuucuaccucaucucccaggucgccugccgcggcaccgucucccccaccuacuacaacgucaucuacgacgacaacggccucaagcccgaccacaugcagcgccucaccuucaagcucugccaccucuacuacaacuggcccggcaucgucuccguccccgcccccugccaguacgcccacaagcucaccuuccucgucgcccaguccauccacaaggagcccucccucgagcucgccaaccaccucuucuaccucuga

SEQ ID NO: 47689 - RNA, 1368 nt, Artificial Sequence
  derived and/or modified sequence opt2 from PJA1__Homo_sapiens__NP_071763
augggccaggaguccuccaagcccgucuggcccaaccccaccggcggcuaccaguccaacaccggccgccgcuacggccgccgccacgccuacgucuccuuccgcccccccaccucccagcgcgagcgcaucgccucccagcgcaagaccaacuccgagguccccaugcaccgcuccgcccccucccagaccaccaagcgcucccgcucccccuucuccaccacccgccgcuccugggacgacuccgaguccuccggcaccaaccucaacaucgacaacgaggacuacuccuccaccucccgcuggcgcgacaccgccaacgacaacgagggccacuccgacggccucgcccgccgcggccgcggcgaguccuccuccggcuaccccgagcccaaguaccccgaggacaagcgcgaggcccgcuccgaccaggucaagcccgagaaggucccccgccgccgccgcaccauggccgaccccgacuucuggacccacuccgacgacuacuacaaguacugcgacgaggacuccgacuccgacaaggaguggaucgccgcccuccgccgcaaguaccgcucccgcgagcagacccucuccuccuccggcgaguccugggagacccuccccggcaaggaggagcgcgagcccccccaggccaaggucuccgccuccaccggcaccucccccggccccggcgccuccgccuccgccggcgccggcgccggcgccuccgccggcuccaacggcuccaacuaccucgaggagguccgcgagcccucccuccaggaggagcaggccucccucgaggagggcgagauccccuggcuccaguaccacgagaacgacuccuccuccgagggcgacaacgacuccggccacgagcucaugcagcccggcgucuucaugcucgacggcaacaacaaccucgaggacgacuccuccgucuccgaggaccucgaggucgacuggucccucuucgacggcuucgccgacggccucggcgucgccgaggccaucuccuacgucgacccccaguuccucaccuacauggcccucgaggagcgccucgcccaggccauggagaccgcccucgcccaccucgagucccucgccgucgacgucgaggucgccaacccccccgccuccaaggaguccaucgacgcccuccccgagauccucgucaccgaggaccacggcgccgucggccaggagaugugcugccccaucugcugcuccgaguacgucaagggcgaggucgccaccgagcuccccugccaccacuacuuccacaagcccugcgucuccaucuggcuccagaaguccggcaccugccccgucugccgcugcauguucccccccccccucuga

SEQ ID NO: 47690 - RNA, 2127 nt, Artificial Sequence
  derived and/or modified sequence opt2 from PJA2__Homo_sapiens__NP_055634
augucccaguacaccgagaaggagcccgccgccauggaccaggaguccggcaaggccgucuggcccaagcccgccggcggcuaccagaccaucaccggccgccgcuacggccgccgccacgccuacgucuccuucaagcccugcaugacccgccacgagcgcucccucggccgcgccggcgacgacuacgagguccucgagcucgacgacguccccaaggagaacuccuccggcuccuccccccucgaccaggucgacuccucccuccccuccgagcccaucuucgagaaguccgagaccgagauccccaccugcggcuccgcccucaaccagaccaccgaguccucccaguccuucgucgccguccaccacuccgaggagggccgcgacacccucggcuccuccaccaaccuccacaaccacuccgagggcgaguacauccccggcgccugcuccgccuccuccguccagaacggcaucgcccucguccacaccgacuccuacgaccccgacggcaagcacggcgaggacaacgaccaccuccagcucuccgccgaggucgucgagggcucccgcuaccaggagucccucggcaacaccgucuucgagcucgagaaccgcgaggccgaggccuacaccggccucuccccccccguccccuccuucaacugcgagguccgcgacgaguucgaggagcucgacuccgucccccucgucaaguccuccgccggcgacaccgaguucguccaccagaacucccaggagauccagcgcuccucccaggacgagauggucuccaccaagcagcagaacaacaccucccaggagcgccagaccgagcacucccccgaggacgccgccugcggccccggccacaucugcuccgagcagaacaccaacgaccgcgagaagaaccacggcuccucccccgagcaggucguccgccccaagguccgcaagcucaucuccuccucccaggucgaccaggagaccggcuucaaccgccacgaggccaagcagcgcuccguccagcgcuggcgcgaggcccucgaggucgaggaguccggcuccgacgaccuccucaucaagugcgaggaguacgacggcgagcacgacugcauguuccucgacccccccuacucccgcgucaucacccagcgcgagaccgagaacaaccagaugaccuccgaguccggcgccaccgccggccgccaggaggucgacaacaccuucuggaacggcugcggcgacuacuaccagcucuacgacaaggacgaggacuccuccgagugcuccgacggcgagugguccgccucccucccccaccgcuucuccggcaccgagaaggaccaguccuccuccgacgaguccugggagacccuccccggcaaggacgagaacgagcccgagcuccaguccgacuccuccggccccgaggaggagaaccaggagcucucccuccaggagggcgagcagaccucccucgaggagggcgagauccccuggcuccaguacaacgaggucaacgaguccuccuccgacgagggcaacgagcccgccaacgaguucgcccagcccgccuucaugcucgacggcaacaacaaccucgaggacgacuccuccgucuccgaggaccucgacgucgacuggucccucuucgacggcuucgccgacggccucggcgucgccgaggccaucuccuacgucgacccccaguuccucaccuacauggcccucgaggagcgccucgcccaggccauggagaccgcccucgcccaccucgagucccucgccgucgacgucgaggucgccaacccccccgccuccaaggaguccaucgacggccuccccgagacccucguccucgaggaccacaccgccaucggccaggagcagugcugccccaucugcugcuccgaguacaucaaggacgacaucgccaccgagcuccccugccaccacuucuuccacaagcccugcgucuccaucuggcuccagaaguccggcaccugccccgucugccgccgccacuucccccccgccgucaucgaggccuccgccgcccccuccuccgagcccgaccccgacgccccccccuccaacgacuccaucgccgaggcccccuga

SEQ ID NO: 47691 - RNA, 12909 nt, Artificial Sequence
  derived and/or modified sequence opt2 from PKD1__Homo_sapiens__NP_000287
augccccccgccgcccccgcccgccucgcccucgcccucggccucggccucuggcucggcgcccucgccggcggccccggccgcggcugcggccccugcgagccccccugccucugcggccccgcccccggcgccgccugccgcgucaacugcuccggccgcggccuccgcacccucggccccgcccuccgcauccccgccgacgccaccgcccucgacgucucccacaaccuccuccgcgcccucgacgucggccuccucgccaaccucuccgcccucgccgagcucgacaucuccaacaacaagaucuccacccucgaggagggcaucuucgccaaccucuucaaccucuccgagaucaaccucuccggcaaccccuucgagugcgacugcggccucgccuggcucccccgcugggccgaggagcagcagguccgcgucguccagcccgaggccgccaccugcgccggccccggcucccucgccggccagccccuccucggcaucccccuccucgacuccggcugcggcgaggaguacgucgccugccuccccgacaacuccuccggcaccgucgccgccgucuccuucuccgccgcccacgagggccuccuccagcccgaggccugcuccgccuucugcuucuccaccggccagggccucgccgcccucuccgagcagggcuggugccucugcggcgccgcccagcccuccuccgccuccuucgccugccucucccucugcuccggccccccccccccccccgcccccaccugccgcggccccacccuccuccagcacgucuuccccgccucccccggcgccacccucgucggcccccacggcccccucgccuccggccagcucgccgccuuccacaucgccgccccccuccccgucaccgccacccgcugggacuucggcgacggcuccgccgaggucgacgccgccggccccgccgccucccaccgcuacguccuccccggccgcuaccacgucaccgccguccucgcccucggcgccggcuccgcccuccucggcaccgacguccaggucgaggccgcccccgccgcccucgagcucgucugccccuccuccguccaguccgacgagucccucgaccucuccauccagaaccgcggcggcuccggccucgaggccgccuacuccaucgucgcccucggcgaggagcccgcccgcgccguccacccccucugccccuccgacaccgagaucuuccccggcaacggccacugcuaccgccucgucgucgagaaggccgccuggcuccaggcccaggagcagugccaggccugggccggcgccgcccucgccauggucgacucccccgccguccagcgcuuccucgucucccgcgucacccgcucccucgacgucuggaucggcuucuccaccguccagggcgucgaggucggccccgccccccagggcgaggccuucucccucgaguccugccagaacuggcuccccggcgagccccaccccgccaccgccgagcacugcguccgccucggccccaccggcuggugcaacaccgaccucugcuccgccccccacuccuacgucugcgagcuccagcccggcggccccguccaggacgccgagaaccuccucgucggcgcccccuccggcgaccuccagggcccccucaccccccucgcccagcaggacggccucuccgccccccacgagcccgucgaggucauggucuuccccggccuccgccucucccgcgaggccuuccucaccaccgccgaguucggcacccaggagcuccgccgccccgcccagcuccgccuccaggucuaccgccuccucuccaccgccggcacccccgagaacggcuccgagcccgagucccgcucccccgacaaccgcacccagcucgcccccgccugcaugcccggcggccgcuggugccccggcgccaacaucugccucccccucgacgccuccugccacccccaggccugcgccaacggcugcaccuccggccccggccuccccggcgcccccuacgcccucuggcgcgaguuccucuucuccguccccgccggcccccccgcccaguacuccgucacccuccacggccaggacguccucaugcuccccggcgaccucgucggccuccagcacgacgccggccccggcgcccuccuccacugcucccccgcccccggccaccccggcccccaggcccccuaccucuccgccaacgccuccuccuggcucccccaccuccccgcccagcucgagggcaccugggccugccccgccugcgcccuccgccuccucgccgccaccgagcagcucaccguccuccucggccuccgccccaaccccggccuccgccuccccggccgcuacgagguccgcgccgaggucggcaacggcgucucccgccacaaccucuccugcuccuucgacgucgucucccccgucgccggccuccgcgucaucuaccccgccccccgcgacggccgccucuacguccccaccaacggcuccgcccucguccuccaggucgacuccggcgccaacgccaccgccaccgcccgcuggcccggcggcuccgucuccgcccgcuucgagaacgucugccccgcccucgucgccaccuucguccccggcugccccugggagaccaacgacacccucuucuccgucgucgcccuccccuggcucuccgagggcgagcacgucgucgacgucgucgucgagaacuccgccucccgcgccaaccucucccuccgcgucaccgccgaggagcccaucugcggccuccgcgccacccccucccccgaggcccgcguccuccagggcguccucguccgcuacucccccgucgucgaggccggcuccgacauggucuuccgcuggaccaucaacgacaagcagucccucaccuuccagaacgucgucuucaacgucaucuaccaguccgccgccgucuucaagcucucccucaccgccuccaaccacgucuccaacgucaccgucaacuacaacgucaccgucgagcgcaugaaccgcaugcagggccuccaggucuccaccguccccgccguccucucccccaacgccacccucgcccucaccgccggcguccucgucgacuccgccgucgaggucgccuuccucuggaccuucggcgacggcgagcaggcccuccaccaguuccagccccccuacaacgaguccuuccccguccccgaccccuccgucgcccagguccucgucgagcacaacgucaugcacaccuacgccgcccccggcgaguaccuccucaccguccucgccuccaacgccuucgagaaccucacccagcagguccccgucuccguccgcgccucccuccccuccgucgccgucggcgucuccgacggcguccucgucgccggccgccccgucaccuucuacccccacccccuccccucccccggcggcguccucuacaccugggacuucggcgacggcucccccguccucacccagucccagcccgccgccaaccacaccuacgccucccgcggcaccuaccacguccgccucgaggucaacaacaccgucuccggcgccgccgcccaggccgacguccgcgucuucgaggagcuccgcggccucuccgucgacaugucccucgccgucgagcagggcgcccccgucgucgucuccgccgccguccagaccggcgacaacaucaccuggaccuucgacaugggcgacggcaccguccucuccggccccgaggccaccgucgagcacgucuaccuccgcgcccagaacugcaccgucaccgucggcgccgccucccccgccggccaccucgcccgcucccuccacguccucgucuucguccucgagguccuccgcgucgagcccgccgccugcauccccacccagcccgacgcccgccucaccgccuacgucaccggcaaccccgcccacuaccucuucgacuggaccuucggcgacggcuccuccaacaccaccguccgcggcugccccaccgucacccacaacuucacccgcuccggcaccuucccccucgcccucguccucuccucccgcgucaaccgcgcccacuacuucaccuccaucugcgucgagcccgaggucggcaacgucacccuccagcccgagcgccaguucguccagcucggcgacgaggccuggcucgucgccugcgccuggccccccuuccccuaccgcuacaccugggacuucggcaccgaggaggccgcccccacccgcgcccgcggccccgaggucaccuucaucuaccgcgaccccggcuccuaccucgucaccgucaccgccuccaacaacaucuccgccgccaacgacuccgcccucgucgagguccaggagcccguccucgucaccuccaucaaggucaacggcucccucggccucgagcuccagcagcccuaccucuucuccgccgucggccgcggccgccccgccuccuaccucugggaccucggcgacggcggcuggcucgagggccccgaggucacccacgccuacaacuccaccggcgacuucaccguccgcgucgccggcuggaacgaggucucccgcuccgaggccuggcucaacgucaccgucaagcgccgcguccgcggccucgucgucaacgccucccgcaccgucgucccccucaacggcuccgucuccuucuccaccucccucgaggccggcuccgacguccgcuacuccuggguccucugcgaccgcugcacccccauccccggcggccccaccaucuccuacaccuuccgcuccgucggcaccuucaacaucaucgucaccgccgagaacgaggucggcuccgcccaggacuccaucuucgucuacguccuccagcucaucgagggccuccaggucgucggcggcggccgcuacuuccccaccaaccacaccguccagcuccaggccgucguccgcgacggcaccaacgucuccuacuccuggaccgccuggcgcgaccgcggccccgcccucgccggcuccggcaagggcuucucccucaccguccucgaggccggcaccuaccacguccagcuccgcgccaccaacaugcucggcuccgccugggccgacugcaccauggacuucgucgagcccgucggcuggcucauggucgccgccucccccaaccccgccgccgucaacaccuccgucacccucuccgccgagcucgccggcggcuccggcgucgucuacaccuggucccucgaggagggccucuccugggagaccuccgagcccuucaccacccacuccuuccccacccccggccuccaccucgucaccaugaccgccggcaacccccucggcuccgccaacgccaccgucgaggucgacguccagguccccgucuccggccucuccauccgcgccuccgagcccggcggcuccuucgucgccgccggcuccuccguccccuucuggggccagcucgccaccggcaccaacgucuccuggugcugggccguccccggcggcuccuccaagcgcggcccccacgucaccauggucuuccccgacgccggcaccuucuccauccgccucaacgccuccaacgccgucuccugggucuccgccaccuacaaccucaccgccgaggagcccaucgucggccucguccucugggccuccuccaaggucgucgcccccggccagcucguccacuuccagauccuccucgccgccggcuccgccgucaccuuccgccuccaggucggcggcgccaaccccgagguccuccccggcccccgcuucucccacuccuucccccgcgucggcgaccacgucgucuccguccgcggcaagaaccacgucuccugggcccaggcccagguccgcaucgucguccucgaggccgucuccggccuccagguccccaacugcugcgagcccggcaucgccaccggcaccgagcgcaacuucaccgcccgcguccagcgcggcucccgcgucgccuacgccugguacuucucccuccagaagguccagggcgacucccucgucauccucuccggccgcgacgucaccuacacccccgucgccgccggccuccucgagauccagguccgcgccuucaacgcccucggcuccgagaaccgcacccucguccucgagguccaggacgccguccaguacgucgcccuccaguccggccccugcuucaccaaccgcuccgcccaguucgaggccgccaccucccccuccccccgccgcgucgccuaccacugggacuucggcgacggcucccccggccaggacaccgacgagccccgcgccgagcacuccuaccuccgccccggcgacuaccgcguccaggucaacgccuccaaccucgucuccuucuucgucgcccaggccaccgucaccguccagguccucgccugccgcgagcccgaggucgacgucguccucccccuccagguccucaugcgccgcucccagcgcaacuaccucgaggcccacgucgaccuccgcgacugcgucaccuaccagaccgaguaccgcugggaggucuaccgcaccgccuccugccagcgccccggccgccccgcccgcgucgcccuccccggcgucgacgucucccgcccccgccucguccucccccgccucgcccuccccgucggccacuacugcuucgucuucgucgucuccuucggcgacaccccccucacccaguccauccaggccaacgucaccgucgcccccgagcgccucguccccaucaucgagggcggcuccuaccgcgucugguccgacacccgcgaccucguccucgacggcuccgaguccuacgaccccaaccucgaggacggcgaccagaccccccucuccuuccacugggccugcgucgccuccacccagcgcgaggccggcggcugcgcccucaacuucggcccccgcggcuccuccaccgucaccaucccccgcgagcgccucgccgccggcgucgaguacaccuucucccucaccgucuggaaggccggccgcaaggaggaggccaccaaccagaccguccucauccgcuccggccgcguccccaucgucucccucgagugcgucuccugcaaggcccaggccgucuacgaggucucccgcuccuccuacgucuaccucgagggccgcugccucaacugcuccuccggcuccaagcgcggccgcugggccgcccgcaccuucuccaacaagacccucguccucgacgagaccaccaccuccaccggcuccgccggcaugcgccucguccuccgccgcggcguccuccgcgacggcgagggcuacaccuucacccucaccguccucggccgcuccggcgaggaggagggcugcgccuccauccgccucucccccaaccgccccccccucggcggcuccugccgccucuucccccucggcgccguccacgcccucaccaccaagguccacuucgagugcaccggcuggcacgacgccgaggacgccggcgccccccucgucuacgcccuccuccuccgccgcugccgccagggccacugcgaggaguucugcgucuacaagggcucccucuccuccuacggcgccguccucccccccggcuuccgcccccacuucgaggucggccucgccgucgucguccaggaccagcucggcgccgccgucgucgcccucaaccgcucccucgccaucacccuccccgagcccaacggcuccgccaccggccucaccgucuggcuccacggccucaccgccuccguccuccccggccuccuccgccaggccgacccccagcacgucaucgaguacucccucgcccucgucaccguccucaacgaguacgagcgcgcccucgacgucgccgccgagcccaagcacgagcgccagcaccgcgcccagauccgcaagaacaucaccgagacccucgucucccuccgcguccacaccgucgacgacauccagcagaucgccgccgcccucgcccagugcaugggccccucccgcgagcucgucugccgcuccugccucaagcagacccuccacaagcucgaggccaugaugcucauccuccaggccgagaccaccgccggcaccgucacccccaccgccaucggcgacuccauccucaacaucaccggcgaccucauccaccucgccuccuccgacguccgcgccccccagcccuccgagcucggcgccgagucccccucccgcauggucgccucccaggccuacaaccucaccuccgcccucaugcgcauccucaugcgcucccgcguccucaacgaggagccccucacccucgccggcgaggagaucgucgcccagggcaagcgcuccgacccccgcucccuccucugcuacggcggcgcccccggccccggcugccacuucuccauccccgaggccuucuccggcgcccucgccaaccucuccgacgucguccagcucaucuuccucgucgacuccaaccccuuccccuucggcuacaucuccaacuacaccgucuccaccaaggucgccuccauggccuuccagacccaggccggcgcccagauccccaucgagcgccucgccuccgagcgcgccaucaccgucaagguccccaacaacuccgacugggccgcccgcggccaccgcuccuccgccaacuccgccaacuccgucgucguccagccccaggccuccgucggcgccgucgucacccucgacuccuccaaccccgccgccggccuccaccuccagcucaacuacacccuccucgacggccacuaccucuccgaggagcccgagcccuaccucgccgucuaccuccacuccgagccccgccccaacgagcacaacugcuccgccucccgccgcauccgccccgagucccuccagggcgccgaccaccgccccuacaccuucuucaucucccccggcucccgcgaccccgccggcuccuaccaccucaaccucuccucccacuuccgcugguccgcccuccaggucuccgucggccucuacaccucccucugccaguacuucuccgaggaggacauggucuggcgcaccgagggccuccucccccucgaggagaccuccccccgccaggccgucugccucacccgccaccucaccgccuucggcgccucccucuucgucccccccucccacguccgcuucgucuuccccgagcccaccgccgacgucaacuacaucgucaugcucaccugcgccgucugccucgucaccuacauggucauggccgccauccuccacaagcucgaccagcucgacgccucccgcggccgcgccauccccuucugcggccagcgcggccgcuucaaguacgagauccucgucaagaccggcuggggccgcggcuccggcaccaccgcccacgucggcaucaugcucuacggcgucgacucccgcuccggccaccgccaccucgacggcgaccgcgccuuccaccgcaacucccucgacaucuuccgcaucgccaccccccacucccucggcuccgucuggaagauccgcgucuggcacgacaacaagggccucucccccgccugguuccuccagcacgucaucguccgcgaccuccagaccgcccgcuccgccuucuuccucgucaacgacuggcucuccgucgagaccgaggccaacggcggccucgucgagaaggagguccucgccgccuccgacgccgcccuccuccgcuuccgccgccuccucgucgccgagcuccagcgcggcuucuucgacaagcacaucuggcucuccaucugggaccgccccccccgcucccgcuucacccgcauccagcgcgccaccugcugcguccuccucaucugccucuuccucggcgccaacgccgucugguacggcgccgucggcgacuccgccuacuccaccggccacgucucccgccucuccccccucuccgucgacaccgucgccgucggccucgucuccuccgucgucgucuaccccgucuaccucgccauccucuuccucuuccgcaugucccgcuccaaggucgccggcucccccucccccacccccgccggccagcagguccucgacaucgacuccugccucgacuccuccguccucgacuccuccuuccucaccuucuccggccuccacgccgaggccuucgucggccagaugaaguccgaccucuuccucgacgacuccaagucccucgucugcuggcccuccggcgagggcacccucuccuggcccgaccuccucuccgaccccuccaucgucggcuccaaccuccgccagcucgcccgcggccaggccggccacggccucggccccgaggaggacggcuucucccucgccucccccuacucccccgccaaguccuucuccgccuccgacgaggaccucauccagcagguccucgccgagggcgucuccucccccgcccccacccaggacacccacauggagaccgaccuccucuccucccucuccuccacccccggcgagaagaccgagacccucgcccuccagcgccucggcgagcucggcccccccucccccggccucaacugggagcagccccaggccgcccgccucucccgcaccggccucgucgagggccuccgcaagcgccuccuccccgccuggugcgccucccucgcccacggccucucccuccuccucgucgccgucgccgucgccgucuccggcugggucggcgccuccuucccccccggcgucuccgucgccuggcuccucuccuccuccgccuccuuccucgccuccuuccucggcugggagccccucaagguccuccucgaggcccucuacuucucccucgucgccaagcgccuccaccccgacgaggacgacacccucgucgagucccccgccgucacccccgucuccgcccgcgucccccgcguccgccccccccacggcuucgcccucuuccucgccaaggaggaggcccgcaaggucaagcgccuccacggcaugcuccgcucccuccucgucuacaugcucuuccuccucgucacccuccucgccuccuacggcgacgccuccugccacggccacgccuaccgccuccaguccgccaucaagcaggagcuccacucccgcgccuuccucgccaucacccgcuccgaggagcucuggcccuggauggcccacguccuccuccccuacguccacggcaaccaguccucccccgagcucggccccccccgccuccgccagguccgccuccaggaggcccucuaccccgacccccccggcccccgcguccacaccugcuccgccgccggcggcuucuccaccuccgacuacgacgucggcugggaguccccccacaacggcuccggcaccugggccuacuccgcccccgaccuccucggcgccugguccuggggcuccugcgccgucuacgacuccggcggcuacguccaggagcucggccucucccucgaggagucccgcgaccgccuccgcuuccuccagcuccacaacuggcucgacaaccgcucccgcgccgucuuccucgagcucacccgcuacucccccgccgucggccuccacgccgccgucacccuccgccucgaguuccccgccgccggccgcgcccucgccgcccucuccguccgccccuucgcccuccgccgccucuccgccggccucucccucccccuccucaccuccgucugccuccuccucuucgccguccacuucgccgucgccgaggcccgcaccuggcaccgcgagggccgcuggcgcguccuccgccucggcgccugggcccgcuggcuccucgucgcccucaccgccgccaccgcccucguccgccucgcccagcucggcgccgccgaccgccaguggacccgcuucguccgcggccgcccccgccgcuucaccuccuucgaccaggucgcccagcucuccuccgccgcccgcggccucgccgccucccuccucuuccuccuccucgucaaggccgcccagcagcuccgcuucguccgccagugguccgucuucggcaagacccucugccgcgcccuccccgagcuccucggcgucacccucggccucgucguccucggcgucgccuacgcccagcucgccauccuccucgucuccuccugcgucgacucccucugguccgucgcccaggcccuccucguccucugccccggcaccggccucuccacccucugccccgccgaguccuggcaccucuccccccuccucugcgucggccucugggcccuccgccucuggggcgcccuccgccucggcgccgucauccuccgcuggcgcuaccacgcccuccgcggcgagcucuaccgccccgccugggagccccaggacuacgagauggucgagcucuuccuccgccgccuccgccucuggaugggccucuccaaggucaaggaguuccgccacaagguccgcuucgagggcauggagccccuccccucccgcuccucccgcggcuccaaggucucccccgacguccccccccccuccgccggcuccgacgccucccaccccuccaccuccuccucccagcucgacggccucuccgucucccucggccgccucggcacccgcugcgagcccgagcccucccgccuccaggccgucuucgaggcccuccucacccaguucgaccgccucaaccaggccaccgaggacgucuaccagcucgagcagcagcuccacucccuccagggccgccgcuccucccgcgcccccgccggcuccucccgcggccccucccccggccuccgccccgcccuccccucccgccucgcccgcgccucccgcggcgucgaccucgccaccggccccucccgcaccccccuccgcgccaagaacaagguccaccccuccuccaccuga

SEQ ID NO: 47692 - RNA, 8550 nt, Artificial Sequence
  derived and/or modified sequence opt2 from PKD1L1__Homo_sapiens__NP_612152
auggccgaggaggccgcccagaacaucuccgacgaccaggagcgcugccuccaggccgccugcugccucuccuucggcggcgagcucuccgucuccaccgacaaguccuggggccuccaccucugcuccugcuccccccccggcggcggccucugggucgaggucuacgccaaccacguccuccucauguccgacggcaagugcggcugccccuggugcgcccucaacggcaaggccgaggaccgcgagucccagucccccuccuccuccgccucccgccagaagaacaucuggaagaccaccuccgaggccgcccucuccgucgucaacgagaagacccaggccgucgucaacgagaagacccaggccccccucgacugcgacaacuccgccgaccgcaucccccacaagcccuucaucaucaucgcccgcgccugguccuccggcggcccccgcuuccaccaccgccgccucugcgccaccggcaccgccgacuccaccuucuccgcccuccuccagcuccagggcaccaccuccgccgccgcccccugcucccucaagauggaggccuccugcugcguccuccgccuccucugcugcgccgaggacgucgccaccggccuccuccccggcaccgucaccauggagacccccaccaaggucgcccgccccacccagaccuccucccagcgcgucccccucuggcccaucucccacuuccccaccuccccccgcuccucccacggccucccccccggcaucccccgcacccccuccuucaccgccucccaguccggcuccgagauccucuacccccccacccagcacccccccgucgccauccucgcccgcaacuccgacaacuucaugaaccccguccucaacugcucccucgaggucgaggcccgcgccccccccaaccucggcuuccgcguccacauggccuccggcgaggcccucugccucaugauggacuucggcgacuccuccggcgucgagaugcgccuccacaacauguccgaggccauggccgucaccgccuaccaccaguacuccaagggcaucuucuuccaccuccuccacuuccagcucgacauguccaccuacaaggaggccgagacccagaacaccacccucaacgucuaccucugccaguccgagaacuccugccucgaggacuccgaccccuccaaccucggcuacgagcucaucuccgccuucgucaccaagggcgucuacaugcucaaggccgucaucuacaacgaguuccacggcaccgaggucgagcucggccccuacuacgucgagaucggccacgaggccgucuccgccuucaugaacuccuccuccguccacgaggacgagguccucgucuucgccgacucccaggucaaccagaaguccaccgucgucauccaccacuuccccuccauccccuccuacaacgucuccuucaucucccagacccaggucggcgacucccaggccuggcacuccaugaccgucugguacaagaugcaguccgucuccgucuacaccaacggcaccgucuucgccaccgacaccgacaucaccuucaccgccgucaccaaggagaccaucccccucgaguucgagugguacuucggcgaggacccccccguccgcaccaccucccgcuccaucaagaagcgccucuccaucccccagugguaccgcgucauggucaaggccuccaaccgcauguccuccgucgucuccgagccccacgucauccgcguccagaagaagaucgucgccaaccgccucaccucccccuccuccgcccucgucaacgccuccgucgccuucgagugcuggaucaacuucggcaccgacgucgccuaccucugggacuucggcgacggcaccgucucccucggcuccuccuccuccucccacgucuacucccgcgagggcgaguucaccgucgagguccucgccuucaacaacgucuccgccuccacccuccgccagcagcucuucaucgucugcgagcccugccagcccccccucgucaagaacaugggccccggcaagguccagaucuggcgcucccagcccguccgccucggcgucaccuucgaggccgccgucuucugcgacaucucccagggccucuccuacaccuggaaccucauggacuccgagggccuccccgucucccuccccgccgccgucgacacccaccgccagacccucauccuccccucccacacccucgaguacggcaacuacaccgcccucgccaagguccagaucgagggcuccgucgucuacuccaacuacugcgucggccucgagguccgcgcccaggcccccgucuccgucaucuccgagggcacccaccucuucuucucccgcaccaccuccucccccaucguccuccgcggcacccaguccuucgaccccgacgaccccggcgccacccuccgcuaccacugggagugcgccaccgccggcucccccgcccaccccugcuucgacuccuccaccgcccaccagcucgacgccgccgcccccaccgucuccuucgaggcccaguggcucuccgacuccuacgaccaguuccucgucaugcuccgcgucuccuccggcggccgcaacuccuccgagacccgcgucuuccucucccccuaccccgacuccgccuuccgcuucguccacaucuccugggucuccuucaaggacaccuucgucaacuggaacgacgagcucucccuccaggccaugugcgaggacugcuccgagauccccaaccucuccuacuccugggaccucuuccucgucaacgccaccgagaagaaccgcaucgagguccccuucugccgcgucgucggccuccucggcucccucggccucggcgccaucuccgaguccucccagcucaaccuccuccccaccgagcccggcaccgccgaccccgacgccaccaccacccccuucucccgcgagcccucccccgucacccucggccagcccgccaccuccgccccccgcggcacccccaccgagcccaugaccggcgucuacuggaucccccccgccggcgacuccgccguccucggcgaggcccccgaggagggcucccucgaccucgagcccggcccccaguccaagggcucccucaugaccggccgcuccgagcgcucccagcccacccacucccccgacccccaccucuccgacuucgaggccuacuacuccgacauccaggaggccauccccuccggcggccgccagcccgccaaggacaccuccuuccccggcuccggccccucccucuccgccgaggagucccccggcgacggcgacaaccucgucgaccccucccucuccgccggccgcgccgagcccguccucaugaucgacuggcccaaggcccuccucggccgcgccgucuuccagggcuacuccuccuccggcaucaccgagcagaccgucaccaucaagcccuacucccucuccuccggcgagaccuacguccuccaggucuccgucgccuccaagcacggccuccucggcaaggcccagcucuaccucaccgucaaccccgccccccgcgacauggccugccagguccagccccaccacggccucgaggcccacaccgucuucuccgucuucugcauguccggcaagcccgacuuccacuacgaguucuccuaccagaucggcaacaccuccaagcacacccucuaccacggccgcgacacccaguacuacuucguccuccccgccggcgagcaccucgacaacuacaaggucauggucuccaccgagaucaccgacggcaagggcuccaagguccagcccugcaccgucgucgucaccguccucccccgcuaccacggcaacgacugccucggcgaggaccucuacaacuccucccucaagaaccucuccacccuccagcucaugggcuccuacaccgagauccgcaacuacaucaccgucaucacccgcauccucucccgccucuccaaggaggacaagaccgccuccugcaaccaguggucccgcauccaggacgcccucaucuccuccgucugccgccucgccuucgucgaccaggaggagaugaucggcuccguccucaugcuccgcgaccucgucuccuucuccaacaagcucggcuucauguccgccguccucauccucaaguacacccgcgcccuccucgcccagggccaguucuccggccccuucgucaucgacaagggcguccgccucgagcucaucggccucaucucccgcgucugggaggucuccgagcaggagaacuccaaggaggaggucuaccgccacgaggagggcaucaccgucaucuccgaccuccuccucggcugccucucccucaaccacgucuccaccggccagauggaguuccgcacccuccuccacuacaaccuccaguccuccguccagucccucggcuccguccagguccaccuccccggcgaccucgccggccacucccccgccggcgccgagacccagucccccugcuacaucucccagcucauccucuucaagaagaaccccuaccccggcucccaggcccccggccagaucggcggcgucgucggccucaaccucuacaccugcuccucccgccgccccaucaaccgccaguggcuccgcaagcccgucauggucgaguucggcgaggaggacggccucgacaaccgccgcaacaagaccaccuucguccuccuccgcgacaaggucaaccuccaccaguucaccgagcucuccgagaacccccaggagucccuccagaucgagaucgaguucuccaagcccgucacccgcgccuuccccgucaugcuccucguccgcuucuccgagaagcccacccccuccgacuuccucgucaagcagaucuacuucugggacgaguccaucguccagaucuacauccccgccgccucccagaaggacgccuccgucggcuaccucucccuccucgacgccgacuacgaccgcaagccccccaaccgcuaccucgccaaggccgucaacuacaccguccacuuccaguggauccgcugccucuucugggacaagcgcgaguggaaguccgagcgcuucuccccccagcccggcaccucccccgagaaggucaacugcuccuaccaccgccucgccgccuucgcccuccuccgccgcaagcucaaggccuccuucgaggucuccgacaucuccaagcuccagucccaccccgagaaccuccuccccuccaucuucaucaugggcuccgucauccucuacggcuuccucgucgccaagucccgccaggucgaccaccacgagaagaagaaggccggcuacaucuuccuccaggaggccucccuccccggccaccagcucuacgccgucgucaucgacaccggcuuccgcgcccccgcccgccucaccuccaaggucuacaucguccucugcggcgacaacggccucuccgagaccaaggagcucuccugccccgagaagccccucuucgagcgcaacucccgccacaccuucauccucuccgcccccgcccagcucggccuccuccgcaagauccgccucuggcacgacucccgcggccccucccccggcugguucaucucccacgucauggucaaggagcuccacaccggccagggcugguucuuccccgcccagugcuggcucuccgccggccgccacgacggccgcgucgagcgcgagcucaccugccuccagggcggccucggcuuccgcaagcucuucuacugcaaguucaccgaguaccucgaggacuuccacgucuggcucuccgucuacucccgccccuccuccucccgcuaccuccacaccccccgccucaccgucuccuucucccuccucugcgucuacgccugccucaccgcccucgucgccgccggcggccaggagcagccccaccucgacgucucccccacccucggcuccuuccgcgucggccuccucugcacccuccucgccucccccggcgcccagcuccucucccuccucuuccgccucuccaaggaggcccccggcuccgcccgcgucgagccccacuccccccuccgcggcggcgcccagaccgaggccccccacggccccaacuccuggggccgcauccccgacgcccaggagccccgcaagcagcccgccuccgccauccucuccggcuccggccgcgcccagcgcaaggccgccuccgacaacggcaccgccugccccgcccccaagcuccagguccacggcgccgaccacucccgcaccucccucaugggcaagucccacugcugccccccccacacccaggcccccuccuccggccucgagggccucaugccccaguggucccgcgcccuccagcccuggugguccuccgccgucugggccaucugcggcaccgccucccucgccugcucccucggcaccggcuuccucgccuaccgcuucggccaggagcagugcguccaguggcuccaccuccucucccucuccgucgucugcugcaucuucaucacccagccccucauggucugccucauggcccucggcuucgccuggaagcgccgcgccgacaaccacuucuucaccgagucccucugcgaggccacccgcgaccucgacuccgagcucgccgagcgcuccuggacccgccuccccuucuccuccuccugcuccauccccgacugcgccggcgaggucgagaagguccucgccgcccgccagcaggcccgccaccuccgcugggcccacccccccuccaaggcccagcuccgcggcacccgccagcgcaugcgccgcgagucccgcacccgcgccgcccuccgcgacaucuccauggacauccucaugcuccuccuccuccucugcgucaucuacggccgcuucucccaggacgaguacucccucaaccaggccauccgcaaggaguucacccgcaacgcccgcaacugccucggcggccuccgcaacaucgccgacuggugggacuggucccucaccacccuccucgacggccucuaccccggcggcacccccuccgcccgcguccccggcgcccagcccggcgcccucggcggcaagugcuaccucaucggcuccuccgucauccgccagcucaaggucuucccccgccaccucugcaagcccccccgccccuucuccgcccucaucgaggacuccauccccaccugcucccccgaggucggcggccccgagaaccccuaccucaucgaccccgagaaccagaacgucacccucaacggccccggcggcugcggcacccgcgaggacugcguccucucccucggccgcacccgcaccgaggcccacaccgcccucucccgccuccgcgccuccauguggaucgaccgcuccacccgcgccgucuccguccacuucacccucuacaacccccccacccagcucuucaccuccgucucccuccgcgucgagauccuccccaccggcucccucguccccuccucccucgucgaguccuucuccaucuuccgcuccgacuccgcccuccaguaccaccucaugcucccccagcucgucuuccucgcccucucccucauccaccucugcguccagcucuaccgcaugauggacaagggcguccucuccuacuggcgcaagccccgcaacuggcucgagcucuccgucgucggcgucucccucaccuacuacgccgucuccggccaccucgucacccucgccggcgacgucaccaaccaguuccaccgcggccucugccgcgccuucauggaccucacccucauggccuccuggaaccagcgcgcccgcuggcuccgcggcauccuccucuuccucuucacccucaagugcgucuaccuccccggcauccagaacaccauggccuccugcuccuccaugaugcgccacucccuccccuccaucuucgucgccggccucgucggcgcccucaugcucgccgcccucucccaccuccaccgcuuccuccucuccauguggguccucccccccggcaccuucaccgacgccuuccccggccuccucuuccacuucccccgccgcucccagaaggacugccuccucggccucuccaaguccgaccagcgcgccauggccugcuacuucggcauccuccucaucgucuccgccacccucugcuucggcaugcuccgcggcuuccucaugacccucccccagaagcgcaaguccuuccaguccaaguccuucguccgccucaaggacgucaccgccuacaugugggagaagguccucaccuuccuccgccucgagacccccaagcucgaggaggccgagauggucgagaaccacaacuacuaccucgacgaguucgccaaccuccucgacgagcuccucaugaagaucaacggccucuccgacucccuccagcucccccuccucgagaagaccuccaacaacaccggcgaggcccgcaccgaggaguccccccucgucgacaucuccuccuaccaggccgccgagcccgccgacaucaaggacuucuga

SEQ ID NO: 47693 - RNA, 2976 nt, Artificial Sequence
  derived and/or modified sequence opt2 from PKD1L2__Homo_sapiens__NP_001070248
auguccgccgucggccucguccuccucguccucgcccuccgccuccgcgccaccaccgucaagcccgaggagggcuccuucugcuccaacucccaggucgccuuccgcgacgccugcuacgaguucgucccccucggccgcaccuuccgcgacgcccaguccuggugcgagggccagggcggccaccucgucuucauccaggacgagggcacccagugguuccuccagaagcacaucucccaggaccgcgagugguggaucggccucaccuggaaccucgcccgcaacggcaccaccgagggccccggcaccuggcucgacaccuccaacgucaccuacuccaacuggcacggcggccaggccgccgccgcccccgacaccugcggccacaucggccgcggccccuccuccgagugggucaccuccgacugcgcccagaccuucgccuucaugugcgaguuccgcgucggccagucccucgccugcgagggccucaacgccaccguccacugcggccucggccaggucauccagguccaggacgccgucuacggccgccagaacccccacuucugcacccaggacgccggccgccccuccgaccucgagcagggcugcuccugggccaacgucaaggaggaggucgccggccagugccaggagcuccaguccugccaggucgccgccgacgagaccuacuucggcaaccucugccccacccagggcuccuaccucuggguccaguaccagugccgcgaggcccuccagcucauggucuccuccgaguccuucaucuucgacaacgucaccaucucccucaccuggcuccucucccccuacaucggcaaccucuccugcaucaucuccaccggcgacucccacaccuucgaccccuacaacccccccuccgucuccuccaacgucacccaccaguucaccucccccggcgaguucaccgucuucgccgagugcaccaccuccgaguggcacgucaccgcccagcgccaggucaccguccgcgacaagauggagacccucuccgucaccgccugcuccggccucucccaguccggcgccggcccccucugccaggccgucuucggcgacccccucuggauccaggucgagcucgacggcggcaccggcgucaccuacaccguccuccucggcgacaucacccucgccgaguccaccacccagaagggcucccuccccuacaaccucauccucgaccgcgagacccagaagcucaugggccccggccgccaccgccucgagauccaggccaccggcaacaccaccaccuccaccaucucccgcaacaucaccguccaccucgucgagcuccucuccggccuccaggccuccugggccuccgaccaccucgagcucggccaggaccuccucaucaccaucucccucgcccagggcacccccgaggagcucaccuucgaggucgccggccucaacgccaccuucucccacgagcaggucuccuucggcgagcccuucggcaucugccgccucgccguccccgucgagggcaccuuccucgucaccaugcucguccgcaacgccuucuccaaccucucccucgagaucggcaacaucaccaucaccgcccccuccggccuccaggagcccuccggcaugaacgccgagggcaaguccaaggacaagggcgacauggaggucuacauccagcccggccccuacgucgaccccuucaccaccgucacccucggcuggcccgacaacgacaaggagcuccgcuuccagugguccugcggcuccugcugggcccucugguccuccugcgucgagcgccagcuccuccgcaccgaccagcgcgagcucgucguccccgccuccugccuccccccccccgacuccgccgucacccuccgccucgccguccuccgcggccaggagcucgagaaccgcgccgagcagugccucuacgucuccgcccccugggagcuccgcccccgcgucuccugcgagcgcaacugccgccccgucaacgccuccaaggacauccuccuccgcgucaccaugggcgaggacucccccgucgccauguucuccugguaccucgacaacacccccaccgagcaggccgagccccuccucgacgccugccgccuccgcggcuucuggccccgcucccucacccuccuccaguccaacaccuccacccuccuccucaacuccuccuuccuccagucccgcggcgaggucauccgcauccgcgccaccgcccucacccgccacgccuacggcgaggacaccuacgucaucuccaccguccccccccgcgagguccccgccugcaccaucgcccccgaggagggcaccguccucaccuccuucgccaucuucugcaacgccuccaccgcccucggcccccucgaguucugcuucugccucgaguccggcuccugccuccacugcggccccgagcccgcccuccccuccgucuaccucccccucggcgaggagaacaacgacuucguccucaccgucgucaucuccgccaccaaccgcgccggcgacacccagcagacccaggccauggccaaggucgcccucggcgacaccugcgucgaggacgucgccuuccaggccgccgucuccgagaagauccccaccgcccuccagggcgagggcggccccgagcagcuccuccagcucgccaaggccgucuccuccaugcucaaccaggagcacgagucccagggcuccggccagucccucuccaucgacguccgccagaagguccgcgagcacguccucggcucccucuccgccgucaccaccggccucgaggacguccagcgcguccaggagcucgccgagguccuccgcgaggucaccugccgcuccaaggagcucacccccuccgcccagggcuccugcaugggcgacuccugggagggcgccccccccgccgcccacgucucccacgcccgcuga

SEQ ID NO: 47694 - RNA, 5199 nt, Artificial Sequence
  derived and/or modified sequence opt2 from PKD1L3__Homo_sapiens__NP_853514
auguucuucaagggcggcuccuggcucuggcucuacauccgcaccuccaucauccucggcuccgagcucaacucccccgccccccacggccagaacaacugcuaccagcucaaccgcuuccagugcuccuucgaggaggcccagcacuacugccacguccagcgcggcuuccucgcccacaucuggaacaaggagguccaggaccucauccgcgacuaccucgaggagggcaagaagugguggaucggccagaacgucaugccccucaagaagcaccaggacaacaaguaccccgccgacgucgccgccaacggcccccccaagccccucuccugcaccuaccucucccgcaacuucauccgcaucuccuccaagggcgacaagugccuccucaaguacuacuucaucugccagaccggcgacuuccucgacggcgacgcccacuacgagcgcaacggcaacaacucccaccucuaccagcgccacaagaagaccaagcgcggcgucgccaucgcccgcgacaagaugccccccggccccggccaccuccccaccaccugccacuacccccuccccgcccaccucuccaagacccucugccaccccaucucccaguuccccuccguccucuccuccaucaccucccaggucaccuccgccgccuccgagcccuccucccagccccuccccgucaucacccagcucaccaugcccgucuccgucacccacgccggccagucccucgccgagaccaccuccucccccaaggaggagggccaccccaacaccuucaccuccuaccuccaggucucccuccagaaggccuccggccaggucaucgacgagaucgccggcaacuucucccgcgccguccacggccuccaggcccucaacaagcuccaggaggccugcgaguuccuccagaagcucaccgcccucaccccccgcuucuccaagcccgcccaggucaaccucaucaacucccucaucuaccucuccgaggagcuccuccgcauccccuuccagaacaacaacucccucggcuucaaggucccccccaccgucugccccuuccacucccucaacaacgucaccaaggccggcgagggcuccuggcucgaguccaagcgccacaccgagcccgucgaggacauccucgagaugucccucgucgaguucggcaacaucggcgaggccuuccucgagcagaaccagucccccgaguccuccgucacccucaccuccgccaacgccacccuccuccucucccgccagaacaucuccacccucccccucuccuccuacacccucggccaccccgcccccguccgccucggcuuccccuccgcccucgcccucaaggagcuccucaacaagcaccccggcgucaacguccagaucaccggccucgccuucaaccccuucaaggaccucgacaaccgcaacaucgucggcuccaucggcuccguccuccucuccgccaaccgcaagcuccuccagguccacgaccucauggaggacaucgagaucaugcucuggcgcaacgucucccucgagacccaccccaccucccucaacauguccacccaccagcucaccaucaccgucaacgucaccucccucgagaagucccucaucgucuccaucgaccccgacuccccccuccucaugacccucuaccucggcuuccaguaccagcccaacugcacccacuuccaccucaacaucacccuccccaaggacaaggucuggcagaaggacgaggaguacaccuggguccucaaccccgagcaccuccagcacggcaucggcaccuacuacaucaccgccguccucuccgagcgccaggagggcgcccagcagacccccucccucgucuccgucaucaccgccgucacccagugcuacuacugggagauccacaaccagaccugguccuccgccggcugccaggucggcccccaguccaccauccuccgcacccagugccucugcaaccaccucaccuucuucgccuccgacuucuucgucgucccccgcaccgucaacgucgaggacaccaucaagcucuuccuccgcgucaccaacaaccccgucggcgucucccuccucgccucccuccucggcuucuacgucaucaccgucgucugggcccgcaagaaggaccaggccgacaugcagaaggucaaggucaccguccucgccgacaacgaccccuccgcccaguuccacuaccucauccaggucuacaccggcuaccgccgcuccgccgccaccaccgccaaggucgucaucacccucuacggcuccgagggccgcuccgagccccaccaccucugcgacccccagaagaccgucuucgagcgcggcggccucgacgucuuccuccucaccaccuggaccucccucggcaaccuccacucccuccgccucuggcacgacaacuccggcgucucccccuccugguacgucucccaggucaucgucugcgacauggccgucaagcgcaaguggcacuuccucugcaacugcuggcucgccgucgaccucggcgacugcgagcucgaccgcgucuucauccccgucuccaagcgcgagcucuucuccuuccgccaccucuucuccuccaugaucgucgagaaguucacccaggacuaccucuggcucuccaucgccacccgccaccccuggaaccaguucacccgcguccagcgccucuccugcugcaugacccuccuccucugcaacauggucaucaacgucauguucuggaagaucaacuccaccaccgccaagcgcgacgagcagaugcgccccuucgccgucgccugguccgagcuccucgucuccauccacaccgccgucauccucuuccccaucaaccucgucaucggccgccucuucccccucaucgagccccaggagacccucccccucuucccccccauccaggccuccugccucuccgacgccuccgucgagccccucuccgccaccauggucgucgaggagcucaaggagaccguccgcuuccuccuccgccgcaacaccuaccuccucuccaagugcgagcagccccccugguccuccugggacaucaccaagcucgucaagcuccucuccucccucgucuccucccaccucgagggccagggcugccaccagcagggcgagcgccacugggcccgcgucguccccgagaaccaccaccacuucugcugcuaccuccaccgcguccuccagcgccucaagucccaccucggcacccucggccucacccagggccaccaguccugcgacuuccucgacgccgccucccagcuccagaagcuccaggagcuccucgagacccacauccuccccaccgagcaggagcccucccgcgaggucaccuccuucgccauccucuccuccgaggagggcaagaagcccaucuccaacggccucuccaaguggcucaccuccgucugcuggcuccuccucggcuucaccucccucgccuccgccuucuucaccgcccucuacucccucgagcucuccaaggaccaggccaccuccuggaugaucuccaucauccucuccguccuccagaacaucuucaucucccagcccgucaaggucgucuucuucaccuuccucuacucccucaugaugucccgcaugccccgccucaacaaggagaacgagcagcagaccaagcgcauccucgcccuccucgccaagugcuccuccuccguccccggcucccgcgacaagaacaaccccgucuacgucgcccccgccaucaacucccccaccaagcaccccgagcgcacccucaagaagaagaagcucuucaagcucaccggcgacauccucguccagauccucuuccucacccuccucaugaccgccaucuacuccgccaagaacuccaaccgcuucuaccuccaccaggccaucuggaagaccuucucccaccaguucuccgagaucaagcuccuccaggacuucuaccccugggccaaccacauccuccuccccucccucuacggcgacuaccgcggcaagaacgccguccucgagcccucccacugcaagugcggcguccagcucaucuuccagaucccccgcaccaagaccuacgagaaggucgacgagggccagcucgccuucugcgacaacggccacaccugcggccgccccaagucccucuuccccggccuccaccuccgccgcuucuccuacaucugcuccccccgccccaugguccucauccccaccgacgagcuccacgagcgccucaccuccaagaacgagaacggcuucuccuacaucaugcgcggcgccuucuucaccucccuccgccucgaguccuucaccucccuccagauguccaagaagggcugcgucugguccaucaucucccaggucaucuacuaccuccucgucugcuacuacgccuucauccagggcugccagcucaagcagcagaaguggcgcuucuucaccggcaagcgcaacauccucgacaccuccaucauccucaucuccuucauccuccucggccucgacaugaaguccaucucccuccacaagaagaacauggcccgcuaccgcgacgaccaggaccgcuucaucuccuucuacgaggccgucaaggucaacuccgccgccacccaccucgucggcuuccccguccuccucgccaccguccagcucuggaaccuccuccgccacuccccccgccuccgcgucaucucccgcacccucucccgcgccugggacgaggucgucggcuuccuccucaucauccucauccuccucaccggcuacgccaucgccuucaaccuccucuucggcugcuccaucuccgacuaccgcaccuucuucuccuccgccgucaccgucgucggccuccucaugggcaucucccaccaggaggaggucuucgcccucgaccccguccucggcaccuuccucauccucaccuccgucauccucaugguccucgucgucaucaaccucuucgucuccgccauccucauggccuucggcaaggagcgcaagucccucaagaaggaggccgcccucaucgacacccuccuccagaagcucuccaaccuccucggcaucuccuggccccagaagaccuccuccgagcaggccgccaccaccgccgucggcuccgacaccgagguccucgacgagcuccccuga

SEQ ID NO: 47695 - RNA, 2907 nt, Artificial Sequence
  derived and/or modified sequence opt2 from PKD2__Homo_sapiens__NP_000288
auggucaacuccucccgcguccagccccagcagcccggcgacgccaagcgcccccccgccccccgcgcccccgaccccggccgccucauggccggcugcgccgccgucggcgccucccucgccgcccccggcggccucugcgagcagcgcggccucgagaucgagaugcagcgcauccgccaggccgccgcccgcgacccccccgccggcgccgccgccucccccucccccccccucuccuccugcucccgccaggccuggucccgcgacaaccccggcuucgaggccgaggaggaggaggaggaggucgagggcgaggagggcggcauggucgucgagauggacgucgaguggcgccccggcucccgccgcuccgccgccuccuccgccgucuccuccgucggcgcccgcucccgcggccucggcggcuaccacggcgccggccaccccuccggccgccgccgccgccgcgaggaccagggcccccccugccccucccccgucggcggcggcgacccccuccaccgccaccucccccucgagggccagcccccccgcgucgccugggccgagcgccucguccgcggccuccgcggccucuggggcacccgccucauggaggaguccuccaccaaccgcgagaaguaccucaaguccguccuccgcgagcucgucaccuaccuccucuuccucaucguccucugcauccucaccuacggcaugauguccuccaacgucuacuacuacacccgcaugaugucccagcucuuccucgacacccccgucuccaagaccgagaagaccaacuucaagacccucuccuccauggaggacuucuggaaguucaccgagggcucccuccucgacggccucuacuggaagaugcagcccuccaaccagaccgaggccgacaaccgcuccuucaucuucuacgagaaccuccuccucggcgucccccgcauccgccagcuccgcguccgcaacggcuccugcuccaucccccaggaccuccgcgacgagaucaaggagugcuacgacgucuacuccgucuccuccgaggaccgcgcccccuucggcccccgcaacggcaccgccuggaucuacaccuccgagaaggaccucaacggcuccucccacuggggcaucaucgccaccuacuccggcgccggcuacuaccucgaccucucccgcacccgcgaggagaccgccgcccaggucgccucccucaagaagaacgucuggcucgaccgcggcacccgcgccaccuucaucgacuucuccgucuacaacgccaacaucaaccucuucugcgucguccgccuccucgucgaguuccccgccaccggcggcgucauccccuccuggcaguuccagccccucaagcucauccgcuacgucaccaccuucgacuucuuccucgccgccugcgagaucaucuucugcuucuucaucuucuacuacgucgucgaggagauccucgagauccgcauccacaagcuccacuacuuccgcuccuucuggaacugccucgacgucgucaucgucguccucuccgucgucgccaucggcaucaacaucuaccgcaccuccaacgucgagguccuccuccaguuccucgaggaccagaacaccuuccccaacuucgagcaccucgccuacuggcagauccaguucaacaacaucgccgccgucaccgucuucuucgucuggaucaagcucuucaaguucaucaacuucaaccgcaccaugucccagcucuccaccaccaugucccgcugcgccaaggaccucuucggcuucgccaucauguucuucaucaucuuccucgccuacgcccagcucgccuaccucgucuucggcacccaggucgacgacuucuccaccuuccaggagugcaucuucacccaguuccgcaucauccucggcgacaucaacuucgccgagaucgaggaggccaaccgcguccucggccccaucuacuucaccaccuucgucuucuucauguucuucauccuccucaacauguuccucgccaucaucaacgacaccuacuccgaggucaaguccgaccucgcccagcagaaggccgagauggagcucuccgaccucauccgcaagggcuaccacaaggcccucgucaagcucaagcucaagaagaacaccgucgacgacaucuccgagucccuccgccagggcggcggcaagcucaacuucgacgagcuccgccaggaccucaagggcaagggccacaccgacgccgagaucgaggccaucuucaccaaguacgaccaggacggcgaccaggagcucaccgagcacgagcaccagcagaugcgcgacgaccucgagaaggagcgcgaggaccucgaccucgaccacuccucccucccccgccccauguccucccgcuccuucccccgcucccucgacgacuccgaggaggacgacgacgaggacuccggccacuccucccgccgccgcggcuccaucuccuccggcgucuccuacgaggaguuccagguccucguccgccgcgucgaccgcauggagcacuccaucggcuccaucgucuccaagaucgacgccgucaucgucaagcucgagaucauggagcgcgccaagcucaagcgccgcgagguccucggccgccuccucgacggcgucgccgaggacgagcgccucggccgcgacuccgagauccaccgcgagcagauggagcgccucguccgcgaggagcucgagcgcugggaguccgacgacgccgccucccagaucucccacggccucggcacccccgucggccucaacggccagccccgcccccgcuccucccgccccuccuccucccaguccaccgagggcauggagggcgccggcggcaacggcuccuccaacguccacgucuga

SEQ ID NO: 47696 - RNA, 2277 nt, Artificial Sequence
  derived and/or modified sequence opt2 from PKD2L1__Homo_sapiens__NP_001240766
augaacccccgccgccgccacaccggcccccgcugccccgccgccgccuccaucuccgucaaggccuccgaggccucccuccccugcccccucggccucuggggcaccacccucaccgagaacaccgccgagaaccgcgagcucuacaucaagaccacccuccgcgagcuccucgucuacaucgucuuccucgucgacaucugccuccucaccuacggcaugaccuccuccuccgccuacuacuacaccaaggucauguccgagcucuuccuccacacccccuccgacaccggcgucuccuuccaggccaucuccuccauggccgacuucugggacuucgcccagggcccccuccucgacucccucuacuggaccaagugguacaacaaccagucccucggccacggcucccacuccuucaucuacuacgagaacaugcuccucggcgucccccgccuccgccagcucaagguccgcaacgacuccugcgucguccacgaggacuuccgcgaggacauccucuccugcuacgacgucuacucccccgacaaggaggagcagcuccccuucggccccuucaacggcaccgccuggaccuaccacucccaggacgagcucggcggcuucucccacuggggccgccucaccuccuacuccggcggcggcuacuaccucgaccuccccggcucccgccagggcuccgccgaggcccuccgcgcccuccaggagggccucuggcucgaccgcggcacccgcgucgucuucaucgacuucuccgucuacaacgccaacaucaaccucuucugcguccuccgccucgucgucgaguuccccgccaccggcggcgccauccccuccuggcagauccgcaccgucaagcucauccgcuacgucuccaacugggacuucuucaucgucggcugcgaggucaucuucugcgucuucaucuucuacuacgucgucgaggagauccucgagcuccacauccaccgccuccgcuaccucuccuccaucuggaacauccucgaccucgucgucauccuccucuccaucgucgccgucggcuuccacaucuuccgcacccucgaggucaaccgccucaugggcaagcuccuccagcagcccaacaccuacgccgacuucgaguuccucgccuucuggcagacccaguacaacaacaugaacgccgucaaccucuucuucgccuggaucaagaucuucaaguacaucuccuucaacaagaccaugacccagcucuccuccacccucgcccgcugcgccaaggacauccucggcuucgccgucauguucuucaucgucuucuucgccuacgcccagcucggcuaccuccucuucggcacccaggucgagaacuucuccaccuucaucaagugcaucuucacccaguuccgcaucauccucggcgacuucgacuacaacgccaucgacaacgccaaccgcauccucggccccgccuacuucgucaccuacgucuucuucgucuucuucguccuccucaacauguuccucgccaucaucaacgacaccuacuccgaggucaaggaggagcucgccggccagaaggacgagcuccagcucuccgaccuccucaagcagggcuacaacaagacccuccuccgccuccgccuccgcaaggagcgcgucuccgacguccagaagguccuccagggcggcgagcaggagauccaguucgaggacuucaccaacacccuccgcgagcucggccacgccgagcacgagaucaccgagcucaccgccaccuucaccaaguucgaccgcgacggcaaccgcauccucgacgagaaggagcaggagaagaugcgccaggaccucgaggaggagcgcgucgcccucaacaccgagaucgagaagcucggccgcuccaucgucuccuccccccagggcaaguccggccccgaggccgcccgcgccggcggcugggucuccggcgaggaguucuacaugcucacccgccgcguccuccagcucgagaccguccucgagggcgucgucucccagaucgacgccgucggcuccaagcucaagaugcucgagcgcaagggcuggcucgcccccucccccggcgucaaggagcaggccaucuggaagcacccccagcccgcccccgccgucacccccgaccccuggggcguccagggcggccaggaguccgagguccccuacaagcgcgaggaggaggcccucgaggagcgccgccucucccgcggcgagauccccacccuccagcgcuccuga

SEQ ID NO: 47697 - RNA, 1482 nt, Artificial Sequence
  derived and/or modified sequence opt2 from PKDCC__Homo_sapiens__NP_612379
augcgccgccgccgcgccgccgucgccgccggcuucugcgccuccuuccuccucggcuccguccucaacguccucuucgcccccggcuccgagcccccccgccccggccagucccccgagcccucccccgcccccggccccggccgccgcggcggccgcggcgagcucgcccgccagauccgcgcccgcuacgaggagguccagcgcuacucccgcggcggccccggccccggcgccggccgccccgagcgccgccgccucauggaccucgcccccggcggccccggccucccccgcccccgcccccccugggcccgcccccucuccgacggcgcccccggcuggccccccgcccccggccccggcucccccggccccggcccccgccucggcugcgccgcccuccgcaacgucuccggcgcccaguacaugggcuccggcuacaccaaggccgucuaccgcguccgccuccccggcggcgccgccgucgcccucaaggccgucgacuucuccggccacgaccucggcuccugcguccgcgaguucggcguccgccgcggcugcuaccgccucgccgcccacaagcuccucaaggagaugguccuccucgagcgccuccgccaccccaacguccuccagcucuacggcuacugcuaccaggacuccgaggacauccccgacacccucaccaccaucaccgagcucggcgcccccgucgagaugauccagcuccuccagaccuccugggaggaccgcuuccgcaucugccucucccucggccgccuccuccaccaccucgcccacuccccccucggcuccgucacccuccucgacuuccgcccccgccaguucguccucgucgacggcgagcucaaggucaccgaccucgacgacgcccgcgucgaggagacccccugcgccggcuccaccgacugcauccucgaguuccccgcccgcaacuucacccuccccugcuccgcccagggcuggugcgagggcaugaacgagaagcgcaaccucuacaacgccuaccgcuucuucuucaccuaccuccucccccacuccgccccccccucccuccgcccccuccucgacuccaucgucaacgccaccggcgagcucgccuggggcgucgacgagacccucgcccagcucgagaagguccuccaccucuaccgcuccggccaguaccuccagaacuccaccgccuccuccuccaccgaguaccagugcauccccgacuccaccaucccccaggaggacuaccgcugcuggcccuccuaccaccacggcuccugccuccucuccgucuucaaccucgccgaggccgucgacgucugcgagucccacgcccagugccgcgccuucgucgucaccaaccagaccaccuggaccggccgccagcucgucuucuucaagaccggcuggucccaggucguccccgaccccaacaagaccaccuacgucaaggccuccggcuga

SEQ ID NO: 47698 - RNA, 6762 nt, Artificial Sequence
  derived and/or modified sequence opt2 from PKDREJ__Homo_sapiens__NP_006062
augcgccccggccccgcccuccuccuccucggcgucggccucucccucuccgucggccgccucccccucccccccgucccccgcggcgcccaggccgccgucuccggcgcccccggcggccuccuccgcggcgcccccggccucggcguccgcggcggccgcgcccuccucucccuccgccccuccgccguccgcgccggcggcgccguccucuccggccgcggcucccucugcuucccccacggcggcaccggccgccgcugguacugccucgaccuccgcguccuccucuccgcccagcgccuccccuggcccgccgcccccgcccucgcccucgucgaccuccagcucuccgcccgcggcggccgccucucccucaccugguccguccgccucccccgcucccccggccgccucgccugggccuuccgccuccgccuccucggccccggcgccgcccgccccgccucccccgccgcccgcgucuccccccgcuccgccgcccccggcccccgcccccagcagggcuucgucgcccgcaccgagugccccaccgacggccccgcccgcgucaugcuccaggccgucaacuccuccucccaccgcgccgucgaguccuccgucuccugccagaucaacgccugcgucauccagcgcguccgcaucaacaccgaccagaagggcgcccccguccgccucuccaugcaggccgaggccaccaucaacgccuccguccagcucgacugccccgccgcccgcgccaucgcccaguacuggcaggucuucuccguccccgccgucggccaggcccccgacuggacccagccccucgaccucccccagcucgagauccgcaacuccccccucuucauccacauccccaacaacucccuccaguggggcgucuacgucuucaacuucaccgucuccaucaccaccggcaaccccaagaugcccgaggucaaggacuccgacgccgucuacgucuggaucguccgcuccucccuccaggccgucaugcucggcgacgccaacaucaccgccaacuucaccgagcagcucauccucgacggcuccaccuccuccgaccccgacgccgacuccccccuccagggccuccaguucuucugguacugcaccaccgacccccgcaacuacggcggcgaccgcaucauccucggcuccaaggaggucugccaccccgagcaggccaaccucaaguggcccugggccuccggccccguccucacccuccuccccgagacccucaagggcgaccacgucuacuucuuccgcauggucauccgcaaggacucccgcaccgccuucuccgacaagcgcguccacguccuccagggccccaaggccaucgcccacaucaccugcaucgagaacugcgagcgcaacuucaucgucuccgaccgcuucucccucuuccucaacugcaccaacugcgccucccgcgacuucuacaagugguccauccucuccuccuccggcggcgagaugcucuucgacuggaugggcgagaccgucaccggccgcaacggcgccuaccucuccaucaaggccuucgccuuccgccacuuccucgaggccgaguucuccaucucccucuaccucgccugcugguccggcgucaccuccgucuuccgccacuccuucaucaucaaccacggcccccagaucggcgagugcaagaucaaccccgccaagggcaucgcccucaucaccaaguucgucguccagugcuccaacuuccgcgacaagcacgucccccucaccuacaagaucaucgucuccgaccuccacuccgucggcgagaucuccuccgucaaggagaacacccucggcaccauccucuaccucggcccccaguccaccgucccccccuccuuccuccccgucggcaugcucgccucccaguacggccucaagaucuacgcccaggucuacgacucccucggcgccuucucccaggucacccuccacgccaccgcccaggcccccaccgacaagaacuccuccaagaccguccucaaccagcuccucuccuucaccgucggccccuccucccuccucuccacccucauccagaagaaggacuuccuccccgccggcuaccuccucuacaucgucgccuccguccucaacaacaugaagaccgagcucccccuccgcgacgaccgcgucaaccuccgcaagcaccucaucgaccaguccuuccuccuccccgucuccacccucgucgagaucggccaggucgucaugaccaucaccaagcucacccagaagcccuccgaguucaccugggacgcccagaagcgcgccaccaugcgcgucuggcaggccaaccaggcccuccaggaguaccagcagaaggacaagcgcuuccgcuccgagcagaucgagaucgucuccaccggcauccucaugucccucuccaacauccucaagaugaccuccccccaccaggucgucaaggaccccuucuacgucaucgagucccucuccgacaccauccucgccaacaagguccccggcaacaagaccaccuccaugcgcacccccaacuucaacauguacgucaagaaggucgagaaguggggcaucaaccagcucuuccgcaacgagaagcacugccgcaacugcuucuaccccacccucaacgucuccuccguccccggccucuccgccaacggccccaucuccaccauguucugcgacuucaccaacgaccucuuccccuggcucaacgaccaggagaacaccuccgucgaggucuccggcuuccgcaugaccggcgucgccgacaacggcuccguccucgagaucacccccgacgucgccgaggucuaccucguccgcaagaaccucaccuucgccgccuucaaccucaccgucggccccaacuccgaggucgacggcucccucaagaagaccaccggcggcuucuccuuccaggucgacuccaccguccuccgcgagguccucguccacaucgucaccgaggucaugguccucuucaccguccucgucuacaccggcucccagaucacccccaccgcccucgucgccaccuuccucgucccccacgacaucccccccuucgccucccaguccgcccucuucgaccccgccugcaccgucaagaaggcccgcgucgucugccuccccgucucccuccuccagcucaucgcccagcacucccacuccccccacugcaccgucuccaucguccuccaggccccccgcuucgucaugaagcucaacgacaagcucguccgcaucuccaucuucuccguccagugccucgacauguacggcauccaguccgaguggcgcgagggcuacugcauccucggcgagaagaccuccugguacgagguccacugcaucugcaagaacgucguccgcgcccgccgccagcucggcaccaucggccucaccggcauccaccuccacacccacuacgucauggccaaggucaucgucauccccaaccccgucgaccuccgccucaacaucaucaagucccuccaccagaaccccgucacccucuucaccguccucuucaucauccuccucuacgucggccucgccuucugggcccucuaccgcgacgagauggaccagcaccuccgcggccacgucaucguccuccccgacaacgaccccuacgacaaccucugcuaccucgucaccaucuucaccggcucccgcuggggcuccggcacccgcgccaacgucuucguccagcuccgcggcaccgucuccaccuccgacguccacugccucucccacccccacuucaccacccucuaccgcggcuccaucaacaccuuccuccucaccaccaaguccgaccucggcgacauccacuccauccgcgucuggcacaacaacgagggccgcucccccuccugguaccucucccgcaucaaggucgagaaccucuucucccgccacaucuggcucuucaucugccagaaguggcucuccgucgacaccacccucgaccgcaccuuccacgucacccaccccgacgagcgccucacccgcaaggacuucuucuucaucgacgucuccuccaaccuccgcaagaaccacaugugguucuccaucuucgccuccgucgucgccaagaccuucaaccgccuccagcgccucuccugcugccucgccaugcuccucuccucccuccucugcaacaucauguucuucaaccucaaccgccaggagcagaccgagucccgcgagcgcaaguacaugcgcuccaugaugaucggcaucgaguccguccucaucaccauccccguccagcuccucaucaccuuccucuucaccugcucccagcgcaagccccaggccgaccucaaggaggucuccccccagaagcacccccucauguccgaggccuccgagcacugggaggaguaccuccgcaaguggcacgccuacgagaccgccaagguccacccccgcgaggucgccaagcccgccuccaagggcaagccccgccuccccaaggccucccccaaggccaccuccaagcccaagcaccgccaccgcaaggcccagaucaagacccccgagacccucggccccaacaccaacuccaacaacaacaucgaggacgaccaggacguccacuccgagcagcaccccucccagaaggaccuccagcagcucaagaagaagccccgcaucguccuccccugguggugcgucuacgucgccugguuccucgucuucgccaccuccuccaucuccuccuucuucaucgucuucuacggccucaccuacggcuacgacaaguccaucgaguggcucuucgccuccuucugcuccuucugccaguccguccuccucguccagcccuccaagaucauccuccucuccggcuuccgcaccaacaagcccaaguacugcaagaaccucuccugguccaccaaguacaaguacaccgagauccgccucgacggcaugcgcaugcaccccgaggagaugcagcgcauccacgaccagaucguccgcauccgcggcacccgcauguaccagccccucaccgaggacgagauccgcaucuucaagcgcaagaagcgcaucaagcgccgcgcccuccucuuccucuccuacauccucacccacuucaucuuccucgcccuccuccucauccucaucguccuccuccgccacaccgacugcuucuacuacaaccaguucauccgcgaccgcuucuccauggaccucgccaccgucaccaagcucgaggacaucuaccgcuggcucaacuccguccuccucccccuccuccacaacgaccucaaccccaccuuccuccccgaguccuccuccaagauccucggccucccccucaugcgccagguccgcgccaaguccuccgagaagaugugccuccccgccgagaaguucguccagaacuccauccgccgcgagauccacugccaccccaaguacggcaucgaccccgaggacaccaagaacuacuccggcuucuggaacgaggucgacaagcaggccaucgacgaguccaccaacggcuucaccuacaagccccagggcacccaguggcucuacuacuccuacggccuccuccacaccuacggcuccggcggcuacgcccucuacuucuuccccgagcagcagcgcuucaacuccacccuccgccucaaggagcuccaggaguccaacuggcucgacgagaagaccugggccgucguccucgagcucaccaccuucaaccccgacaucaaccucuucugcuccaucuccgucaucuucgaggucucccagcucggcgucgucaacaccuccaucucccuccacuccuucucccucgccgacuucgaccgcaaggccuccgccgagaucuaccucuacgucgccauccucaucuucuuccucgccuacgucgucgacgagggcugcaucaucaugcaggagcgcgccuccuacguccgcuccgucuacaaccuccucaacuucgcccucaagugcaucuucaccguccucaucguccucuuccuccgcaagcacuuccucgccaccggcaucauccgcuucuaccucuccaaccccgaggacuucauccccuuccacgccgucucccaggucgaccacaucaugcgcaucauccucggcuuccuccucuuccucaccauccucaagacccuccgcuacucccgcuucuucuacgacguccgccucgcccagcgcgccauccaggccgcccuccccggcaucugccacauggccuucgucgucuccgucuacuucuucgucuacauggccuucggcuaccucgucuucggccagcacgaguggaacuacuccaaccucauccacuccacccagaccgucuucuccuacugcgucuccgccuuccagaacaccgaguucuccaacaaccgcauccucggcguccucuuccucuccuccuucaugcucgucaugaucugcguccucaucaaccucuuccaggccgucauccucuccgccuacgaggagaugaagcagcccgucuacgaggagcccuccgacgaggucgaggccaugaccuaccucugccgcaagcuccgcaccauguucuccuuccucaccucccaguccaaggccaaggacgagcccgaguucuucaucgacaugcucuacggccagcccgagaagaacucccaccgcuaccucggccucaagacccgcaacaucaacggcaagaagauggucuaccucgucgucuga

SEQ ID NO: 47699 - RNA, 10191 nt, Artificial Sequence
  derived and/or modified sequence opt2 from PKHD1__Homo_sapiens__NP_733842
augaccgccuggcucaucucccucauguccaucgagguccuccuccucgccguccgccaccucucccuccacaucgagcccgaggagggcucccucgccggcggcaccuggaucaccgucaucuucgacggccucgagcucggcguccucuaccccaacaacggcucccagcucgagauccaccucgucaacgucaacauggucguccccgcccuccgcuccguccccugcgacgucuuccccgucuuccucgaccuccccgucgucaccugccgcacccgcuccguccucuccgaggcccacgagggccucuacuuccucgaggccuacuucggcggccagcucgucuccucccccaaccccggcccccgcgacuccugcaccuucaaguucuccaaggcccagacccccaucguccaccaggucuacccccccuccggcguccccggcaagcucauccacgucuacggcuggaucaucaccggccgccucgagaccuucgacuucgacgccgaguacaucgacucccccgucauccucgaggcccagggcgacaagugggucacccccugcucccucaucaaccgccagaugggcuccugcuaccccauccaggaggaccacggccucggcacccuccagugccacgucgagggcgacuacaucggcucccagaacgucuccuucuccgucuucaacaagggcaaguccaugguccacaagaaggccuggcucaucuccgccaagcaggaccucuuccucuaccagacccacuccgagauccucuccgucuuccccgagaccggcucccucggcggccgcaccaacaucaccaucaccggcgacuucuucgacaacuccgcccaggucaccaucgccggcauccccugcgacauccgccacgucuccccccgcaagaucgagugcaccacccgcgcccccggcaaggacguccgccucaccaccccccagcccggcaaccgcggccuccucuucgaggucggcgacgccgucgagggccucgagcucaccgaggccacccccggcuaccgcuggcagaucguccccaacgccuccucccccuucggcuucuggucccaggagggccagcccuuccgcgcccgccucuccggcuucuucgucgcccccgagaccaacaacuacaccuucuggauccaggccgacucccaggccucccuccacuucuccugguccgaggagccccgcaccaaggucaaggucgccuccaucuccgucggcaccgccgacugguucgacuccugggagcagaaccgcgacgagggcaccuggcagcagaagacccccaagcucgagcuccucggcggcgccauguacuaccucgaggccgagcaccacggcaucgcccccucccgcggcaugcgcaucggcguccagauccacaacaccuggcucaaccccgacgucgucaccaccuaccuccgcgagaagcaccagauccgcguccgcgcccagcgccuccccgagguccagguccucaacgucuccggccgcggcaacuucuuccucaccugggacaacgucuccucccagcccauccccgccaacgccaccgcccaccucauccagaccaccaucgaggagcuccucgccgucaagugcaagcucgagccccucugguccaacauccuccuccgccucggcuucgagcgcggccccgaggucuccaacuccgacggcgaccucaccuccggcaccgagcccuucugcggccgcuucucccuccgccagccccgccaccucguccucaccccccccgccgcccagaagggcuaccgccucgaccaguacacccaccucugccucgccuacaagggccacaugaacaagauccucaagaugaucgucuccuucaccaucggcuuccagaacauggucaagaacaccaccugcgacuggucccucacccgcaccucccccgaguccuggcaguucgacugcaccgaccucugggagaccugcguccgcugcuucggcgaccuccagcccccccccgccaacucccccguccucguccaccagaucaaccuccucccccucgcccaggagaccggccucuucuacgucgacgagaucaucaucgccgacaccaacgucaccgucucccaggccgacuccggcaccgcccgccccggcggcaaccucgucgaguccgucuccgucgucggcuccccccccgucuacuccgucaccuccuggcucgccggcugcggcaccgagcucccccucaucaccgcccgcuccguccccaccgagggcaccgaggagggcuccggccucguccucgucaccacccagcgccgccagcgcaccucccccccccucggcggccacuuccgcauccagcuccccaacaccgucaucuccgacguccccguccagaucuccgcccaccaccuccaccagcuccuccagaacaacgccgacgacuucaccucccgcuaccucaacgccuccgacuucaccgucaaggaggaccucuacaccugcuacgagcacgucuggacccucuccugguccacccagaucggcgaccuccccaacuucauccgcgucuccgacgagaaccucaccggcgucaaccccgccgccgccacccgcgucgucuacgacggcggcgucuuccucggccccaucuucggcgacaugcucgccaccgccaaccagcacacccaggucgucguccgcgucaacgacguccccgcccacugccccggcuccugcuccuuccaguaccuccagggcuccacccccugcguccacuccgucugguacuccaucgacggcgacaucaaccucaugaucuacaucaccggcaccggcuucuccggcgacucccaguuccuccaggucaccgucaacaagaccuccugcaaggucaucuucuccaaccagaccaacgucgucugccagaccgaccuccuccccgucggcaugcaccgcauccucaugcucguccgccccuccggccucgccaucuccgccaccggcgaggaccucuuccucaacgucaagccccgccucgacauggucgagcccucccgcgccgccgacaucggcggccucugggccaccauccgcggcuccucccucgagggcgucucccucauccucuucggcuccuacuccugcgccaucaacgucgccaccuccaacuccucccgcauccagugcaagguccccccccgcggcaaggacggccgcaucgucaacgucaccgucauccgcggcgacuacuccgccguccucccccgcgccuucaccuacgucuccucccucaaccccgucaucgucacccucucccgcaacaucuccaacaucgccggcggcgagacccucgucaucggcgucgcccgccucaugaacuacaccgaccucgacgucgagguccacguccaggacgcccucgcccccguccacacccaguccgccuggggccucgaggucgcccuccccccccuccccgccggccuccaccgcaucuccgucuccaucaacggcgucuccauccacucccagggcgucgaccuccacauccaguaccucaccgaggucuucuccaucgagcccugcugcggcucccuccucggcggcaccauccucuccaucuccggcaucggcuucucccgcgaccccgcccucgucuggguccucgucggcaaccgcuccugcgacaucgucaaccucaccgaggccuccaucuggugcgagacccuccccgccccccagauccccgacgccggcgcccccaccguccccgccgccgucgaggucugggccggcaaccgcuucuucgcccgcggccccucccccucccucgucggcaagggcuucaccuucauguacgaggccgccgccacccccgucgucaccgccaugcagggcgagaucaccaacuccucccucucccuccacgucggcggcuccaaccucuccaacuccgucauccuccucggcaaccucaacugcgacgucgagacccaguccuuccagggcaacgucucccucuccggcugcuccaucccccuccacucccucgaggccggcaucuacccccuccagguccgccagaagcagaugggcuucgccaacauguccgucguccuccagcaguucgccgucaugccccgcaucauggccaucuuccccucccagggcuccgccugcggcggcaccauccucaccguccgcggccuccuccucaacucccgccgccgcuccguccgcgucgaccucuccggccccuucaccugcgucauccucucccucggcgaccacaccauccucugccaggucucccucgagggcgacccccuccccggcgccuccuucucccucaacgucaccguccucgucaacggccucaccuccgagugccagggcaacugcacccucuucauccgcgaggaggccucccccgucauggacgcccucuccaccaacaccuccggcucccucaccaccguccucauccgcggccagcgccucgccaccaccgccgacgagcccauggucuucgucgacgaccagcuccccugcaacgucaccuucuucaacgccucccacgucgucugccagacccgcgaccucgcccccggcccccacuaccucuccgucuucuacacccgcaacggcuacgccugcuccggcaacgucucccgccacuucuacaucaugccccaggucuuccacuacuuccccaagaacuucucccuccacggcggcucccuccucaccaucgagggcaccggccuccgcggccagaacaccaccuccgucuacaucgaccagcagaccugccucaccgucaacaucggcgccgagcucauccgcugcaucguccccaccggcaacggcuccgucgcccucgagaucgaggucgacggccucugguaccacaucggcgucaucggcuacaacaaggccuucacccccgagcucaucuccaucucccaguccgacgacauccucaccuucgccgucgcccagaucuccggcgccgccaacaucgacaucuucaucggcaugucccccugcgucggcgucuccggcaaccacaccguccuccagugcgucguccccucccuccccgccggcgaguaccacguccgcggcuacgacugcauccgcggcugggccuccuccgcccucgucuucaccucccgcgucaucaucaccgccgucaccgagaacuucggcugccucggcggccgccucguccacgucuucggcgccggcuucucccccggcaacgucuccgccgccgucugcggcgcccccugccgcguccucgccaacgccaccgucuccgccuucuccugccucguccucccccucgacgucucccucgccuuccucugcggccucaagcgcgaggaggacuccugcgaggccgcccgccacaccuacguccagugcgaccucaccgucgccauggccaccgagcagcuccucgaguccuggcccuaccucuacaucugcgaggaguccucccagugccucuucguccccgaccacugggccgaguccauguuccccuccuucuccggccucuucaucucccccaagcucgagcgcgacgagguccucaucuacaacuccuccugcaacaucaccauggagaccgaggccgagauggagugcgagacccccaaccagcccaucaccgucaagaucaccgagauccgcaagcgcuggggccagaacacccagggcaacuucucccuccaguucugccgccgcuggucccgcacccacuccugguuccccgagcgccucccccaggacggcgacaacgucaccgucgagaacggccagcuccuccuccucgacaccaacaccuccauccucaaccuccuccacaucaagggcggcaagcucaucuucauggcccccggccccaucgagcuccgcgcccacgccauccucgucuccgacggcggcgagcuccgcaucggcuccgaggacaagcccuuccagggccgcgcccagaucacccucuacggcuccuccuacuccacccccuucuuccccuacggcgucaaguuccucgccguccgcaacggcacccucucccuccacggcucccuccccgaggucaucgucaccugccuccgcgccaccgcccacgcccucgacaccguccucgcccucgaggacgccgucgacuggaaccccggcgacgaggucgucaucaucuccggcaccggcgucaagggcgccaagcccauggaggagaucgucaccgucgagaccguccaggacaccgaccucuaccucaaguccccccuccgcuacucccacaacuucaccgagaacugggucgccggcgagcaccacauccucaaggccaccgucgcccuccucucccgcuccaucaccauccagggcaaccucaccaacgagcgcgagaagcuccucgucuccugccaggaggccaacgcccccgagggcaaccuccagcacugccucuacuccauguccgagaagaugcucggcucccgcgacaugggcgcccgcgucaucguccaguccuuccccgaggagcccucccagguccagcucaagggcguccaguuccagguccucggccaggccuuccacaagcaccucuccucccucacccucgucggcgccaugcgcgaguccuucauccagggcugcaccguccgcaacuccuucucccgcggccucuccaugugcggcacccucggccucaaggucgacuccaacgucuucuacaacauccucggccacgcccuccucgucggcaccugcaccgagaugcgcuacaucuccugggaggccauccacggccgcaaggacgacugguccggccacggcaacaucauccgcaacaacgucaucauccaggucuccggcgccgagggccucuccaaccccgagaugcucacccccuccggcaucuacaucugcucccccaccaacgucaucgagggcaaccgcgucugcggcgccggcuacggcuacuucuuccaccucaugaccaaccagaccucccaggccccccuccucuccuucacccagaacaucgcccacuccugcacccgcuacggccucuucgucuaccccaaguuccagccccccugggacaacgucaccggcaccacccucuuccaguccuucaccgucugggaguccgccggcggcgcccagaucuuccgcuccuccaaccuccgccucaagaacuucaaggucuacuccugccgcgacuucggcaucgacguccucgaguccgacgccaacaccuccgucaccgacucccuccuccucggccacuucgcccacaagggcucccucugcauguccuccggcaucaagacccccaagcgcugggagcucauggucuccaacaccaccuucgucaacuucgaccucaucaacugcgucgccauccgcaccugcuccgacugcucccagggccagggcggcuucaccgucaagaccucccagcucaaguucaccaacuccuccaaccucgucgccuuccccuucccccacgccgccauccucgaggaccucgacggcucccucuccggcaagaaccgcucccacauccucgccuccauggagacccucuccgccuccugccucgucaacuccuccuucggccgcgucguccacggcuccgccugcggcggcggcguccucuuccaccgcauguccaucggccucgccaacacccccgaggucuccuacgaccucaccaugaccgacucccgcaacaagaccaccaccgucaacuacguccgcgacacccucuccaacccccgcggcuggauggcccuccuccucgaccaggagaccuacucccuccaguccgagaaccucuggaucaaccgcucccuccaguacuccgccaccuucgacaacuucgcccccggcaacuaccuccuccucguccacaccgaccucccccccuaccccgacauccuccuccgcugcggcucccgcgucggccucuccuuccccuuccuccccucccccggccagaaccagggcugcgacugguucuucaacucccagcuccgccagcucaccuaccucgucuccggcgagggccagguccaggucauccuccgcgucaaggagggcaugccccccaccaucuccgccuccaccuccgcccccgaguccgcccucaaguggucccuccccgagaccuggcagggcgucgaggagggcuggggcggcuacaacaacaccauccccggccccggcgacgacguccucauccuccccaaccgcaccguccucgucgacaccgaccuccccuucuucaagggccucuacgucaugggcacccucgacuuccccgucgaccgcuccaacguccucuccgucgccugcauggucaucgccggcggcgagcucaaggucggcacccucgagaacccccucgagaaggagcagaagcuccucauccuccuccgcgccuccgagggcgucuucugcgaccgcaugaacggcauccacaucgaccccggcaccaucggcgucuacggcaagguccaccucuacuccgccuaccccaagaacuccuggacccaccucggcgccgacaucgccuccggcaacgagcgcaucaucgucgaggacgccgucgacuggcgcccccacgacaagaucguccucuccuccuccuccuacgagccccacgaggccgagguccucaccgucaaggaggucaagggccaccacguccgcaucuacgagcgccucaagcaccgccacaucggcuccguccacgucaccgaggacggccgccacauccgccucgccgccgaggucggccuccucacccgcaacauccagauccagcccgacgucuccugccgcggccgccucuucgucggcuccuuccgcaaguccucccgcgaggaguucuccggcguccuccagcuccucaacgucgagauccagaacuucggcuccccccucuacuccuccgucgaguucuccaacgucuccgccggcuccuggaucaucuccuccacccuccaccaguccugcggcggcggcauccacgccgccgccucccacggcguccuccucaacgacaacaucgucuucggcaccgccggccacggcaucgaccucgagggccaggccuacaccgucaccaacaaccucgucguccucaugacccagcccgccugguccaccaucugggucgccggcaucaaggucaaccaggucaaggacaucaaccuccacggcaacgucgucgccggcuccgagcgccucggcuuccacauccgcggccacaagugcuccuccugcgagcuccucugguccgacaacgucgcccacuccucccuccacggccuccaccucuacaaggaguccggccucgacaacugcacccgcaucuccggcuuccucgccuucaagaacuucgacuacggcgccaugcuccacgucgagaacuccgucgagaucgagaacaucacccucgucgacaacaccaucggccuccucgccgucgucuacgucuucuccgccccccagaacuccgucaagaagguccagaucguccuccgcaacuccgucaucgucgccaccuccuccuccuucgacugcauccaggacaaggucaagccccacuccgccaaccucaccuccaccgaccgcgcccccuccaacccccgcggcggccgcaucggcauccucuggcccgucuucaccuccgagcccaaccaguggccccaggagcccuggcacaagguccgcaacgaccacuccaucuccggcaucaugaagcuccaggacgucaccuucuccuccuucgucaaguccugcuacuccgacgaccucgacgucugcauccuccccaacgccgagaacuccggcaucaugcaccccaucaccgccgagcgcacccgcaugcucaagaucaaggacaagaacaaguucuacuuccccucccuccagccccgcaaggaccucggcaaggucgucugccccgagcucgacugcgccuccccccgcaaguaccucuucaaggaccucgacggccgcgcccucggccuccccccccccgucuccgucuuccccaagaccgaggccgaguggaccgccuccuucuucaacgccgucaccaccgagcaggcccucaagaucuccgaguga

SEQ ID NO: 47700 - RNA, 231 nt, Artificial Sequence
  derived and/or modified sequence opt2 from PKIA__Homo_sapiens__NP_006814
augaccgacgucgagaccaccuacgccgacuucaucgccuccggccgcaccggccgccgcaacgccauccacgacauccucgucuccuccgccuccggcaacuccaacgagcucgcccucaagcucgccggccucgacaucaacaagaccgagggcgaggaggacgcccagcgcuccuccaccgagcaguccggcgaggcccagggcgaggccgccaaguccgaguccuga

SEQ ID NO: 47701 - RNA, 258 nt, Artificial Sequence
  derived and/or modified sequence opt2 from PKIB__Homo_sapiens__NP_001257323
augucccaccaggacgucgccaugcgcaccgacuccuccaagaugaccgacgucgaguccggcgucgccaacuucgccuccuccgcccgcgccggccgccgcaacgcccuccccgacauccaguccuccgccgccaccgacggcaccuccgaccucccccucaagcucgaggcccucuccgucaaggaggacgccaaggagaaggacgagaagaccacccaggaccagcucgagaagccccagaacgaggagaaguga

SEQ ID NO: 47702 - RNA, 1725 nt, Artificial Sequence
  derived and/or modified sequence opt2 from PKLR__Homo_sapiens__NP_000289
auguccauccaggagaacaucuccucccuccagcuccgcuccugggucuccaagucccagcgcgaccucgccaaguccauccucaucggcgcccccggcggccccgccggcuaccuccgccgcgccuccgucgcccagcucacccaggagcucggcaccgccuucuuccagcagcagcagcuccccgccgccauggccgacaccuuccucgagcaccucugccuccucgacaucgacuccgagcccgucgccgcccgcuccaccuccaucaucgccaccaucggccccgccucccgcuccgucgagcgccucaaggagaugaucaaggccggcaugaacaucgcccgccucaacuucucccacggcucccacgaguaccacgccgaguccaucgccaacguccgcgaggccgucgaguccuucgccggcuccccccucuccuaccgccccgucgccaucgcccucgacaccaagggccccgagauccgcaccggcauccuccagggcggccccgaguccgaggucgagcucgucaagggcucccagguccucgucaccgucgaccccgccuuccgcacccgcggcaacgccaacaccgucugggucgacuaccccaacaucguccgcgucguccccgucggcggccgcaucuacaucgacgacggccucaucucccucgucguccagaagaucggccccgagggccucgucacccaggucgagaacggcggcguccucggcucccgcaagggcgucaaccuccccggcgcccaggucgaccuccccggccucuccgagcaggacguccgcgaccuccgcuucggcgucgagcacggcgucgacaucgucuucgccuccuucguccgcaaggccuccgacgucgccgccguccgcgccgcccucggccccgagggccacggcaucaagaucaucuccaagaucgagaaccacgagggcgucaagcgcuucgacgagauccucgaggucuccgacggcaucauggucgcccgcggcgaccucggcaucgagauccccgccgagaaggucuuccucgcccagaagaugaugaucggccgcugcaaccucgccggcaagcccgucgucugcgccacccagaugcucgaguccaugaucaccaagccccgccccacccgcgccgagaccuccgacgucgccaacgccguccucgacggcgccgacugcaucaugcucuccggcgagaccgccaagggcaacuuccccgucgaggccgucaagaugcagcacgccaucgcccgcgaggccgaggccgccgucuaccaccgccagcucuucgaggagcuccgccgcgccgccccccucucccgcgaccccaccgaggucaccgccaucggcgccgucgaggccgccuucaagugcugcgccgccgccaucaucguccucaccaccaccggccgcuccgcccagcuccucucccgcuaccgcccccgcgccgccgucaucgccgucacccgcuccgcccaggccgcccgccagguccaccucugccgcggcgucuucccccuccucuaccgcgagccccccgaggccaucugggccgacgacgucgaccgccgcguccaguucggcaucgaguccggcaagcuccgcggcuuccuccgcgucggcgaccucgucaucgucgucaccggcuggcgccccggcuccggcuacaccaacaucaugcgcguccucuccaucuccuga

SEQ ID NO: 47703 - RNA, 1818 nt, Artificial Sequence
  derived and/or modified sequence opt2 from PKM__Homo_sapiens__NP_001193725
augcagugguccuccgagcgcggcgagcgccuccucacccccggcgccugcuccuccgagguccccuccgccguccccucccgcuccggcggcucccccggccacaccgucuucuccuccgagcgcucccuccucguccgcccccgcucccaccccgagcccaagggcgagcacuacgucaccggcucccccacccccgagaaccagcgcaccuccgccgccauguccaagccccacuccgaggccggcaccgccuucauccagacccagcagcuccacgccgccauggccgacaccuuccucgagcacaugugccgccucgacaucgacuccccccccaucaccgcccgcaacaccggcaucaucugcaccaucggccccgccucccgcuccgucgagacccucaaggagaugaucaaguccggcaugaacgucgcccgccucaacuucucccacggcacccacgaguaccacgccgagaccaucaagaacguccgcaccgccaccgaguccuucgccuccgaccccauccucuaccgccccgucgccgucgcccucgacaccaagggccccgagauccgcaccggccucaucaagggcuccggcaccgccgaggucgagcucaagaagggcgccacccucaagaucacccucgacaacgccuacauggagaagugcgacgagaacauccucuggcucgacuacaagaacaucugcaaggucgucgaggucggcuccaagaucuacgucgacgacggccucaucucccuccaggucaagcagaagggcgccgacuuccucgucaccgaggucgagaacggcggcucccucggcuccaagaagggcgucaaccuccccggcgccgccgucgaccuccccgccgucuccgagaaggacauccaggaccucaaguucggcgucgagcaggacgucgacauggucuucgccuccuucauccgcaaggccuccgacguccacgagguccgcaagguccucggcgagaagggcaagaacaucaagaucaucuccaagaucgagaaccacgagggcguccgccgcuucgacgagauccucgaggccuccgacggcaucauggucgcccgcggcgaccucggcaucgagauccccgccgagaaggucuuccucgcccagaagaugaugaucggccgcugcaaccgcgccggcaagcccgucaucugcgccacccagaugcucgaguccaugaucaagaagccccgccccacccgcgccgagggcuccgacgucgccaacgccguccucgacggcgccgacugcaucaugcucuccggcgagaccgccaagggcgacuacccccucgaggccguccgcaugcagcaccucaucgcccgcgaggccgaggccgccauguuccaccgcaagcucuucgaggagcucguccgcgccuccucccacuccaccgaccucauggaggccauggccaugggcuccgucgaggccuccuacaagugccucgccgccgcccucaucguccucaccgaguccggccgcuccgcccaccaggucgcccgcuaccgcccccgcgcccccaucaucgccgucacccgcaacccccagaccgcccgccaggcccaccucuaccgcggcaucuuccccguccucugcaaggaccccguccaggaggccugggccgaggacgucgaccuccgcgucaacuucgccaugaacgucggcaaggcccgcggcuucuucaagaagggcgacgucgucaucguccucaccggcuggcgccccggcuccggcuucaccaacaccaugcgcgucguccccguccccuga

SEQ ID NO: 47704 - RNA, 1293 nt, Artificial Sequence
  derived and/or modified sequence opt2 from PKMYT1__Homo_sapiens__NP_001245379
augcucgagcgcuggcaccagcuccagccccgccgcgucuccuuccgcggcgaggccuccgagacccuccagucccccggcuacgaccccucccgccccgaguccuucuuccagcaguccuuccagcgccucucccgccucggccacggcuccuacggcgaggucuucaagguccgcuccaaggaggacggccgccucuacgccgucaagcgcuccaugucccccuuccgcggccccaaggaccgcgcccgcaagcucgccgaggucggcucccacgagaaggucggccagcaccccugcugcguccgccucgagcaggccugggaggagggcggcauccucuaccuccagaccgagcucugcggccccucccuccagcagcacugcgaggccuggggcgccucccuccccgaggcccaggucuggggcuaccuccgcgacacccuccucgcccucgcccaccuccacucccagggccucguccaccucgacgucaagcccgccaacaucuuccucggcccccgcggccgcugcaagcucggcgacuucggccuccucgucgagcucggcaccgccggcgccggcgagguccaggagggcgacccccgcuacauggcccccgagcuccuccagggcuccuacggcaccgccgccgacgucuucucccucggccucaccauccucgaggucgccugcaacauggagcucccccacggcggcgagggcuggcagcagcuccgccagggcuaccucccccccgaguucaccgccggccucuccuccgagcuccgcuccguccucgucaugaugcucgagcccgaccccaagcuccgcgccaccgccgaggcccuccucgcccuccccguccuccgccagccccgcgccuggggcguccucuggugcauggccgccgaggcccucucccgcggcugggcccucuggcaggcccuccucgcccuccucugcuggcucuggcacggccucgcccaccccgccuccuggcuccagccccucggcccccccgccaccccccccggcuccccccccugcucccuccuccucgacuccucccucuccuccaacugggacgacgacucccucggccccucccucucccccgaggccguccucgcccgcaccgucggcuccaccuccaccccccgcucccgcugcaccccccgcgacgcccucgaccucuccgacaucaacuccgagcccccccgcggcuccuuccccuccuucgagccccgcaaccuccucucccucuucgaggacacccucgaccccaccuga

SEQ ID NO: 47705 - RNA, 2829 nt, Artificial Sequence
  derived and/or modified sequence opt2 from PKN1__Homo_sapiens__NP_002732
auggccuccgacgccguccaguccgagccccgcuccuggucccuccucgagcagcucggccucgccggcgccgaccucgccgcccccggcguccagcagcagcucgagcucgagcgcgagcgccuccgccgcgagauccgcaaggagcucaagcucaaggagggcgccgagaaccuccgccgcgccaccaccgaccucggccgcucccucggccccgucgagcuccuccuccgcggcuccucccgccgccucgaccuccuccaccagcagcuccaggagcuccacgcccacgucguccuccccgaccccgccgccacccacgacggcccccagucccccggcgccggcggccccaccugcuccgccaccaaccucucccgcgucgccggccucgagaagcagcucgccaucgagcucaaggucaagcagggcgccgagaacaugauccagaccuacuccaacggcuccaccaaggaccgcaagcuccuccucaccgcccagcagaugcuccaggacuccaagaccaagaucgacaucauccgcaugcagcuccgccgcgcccuccaggccggccagcucgagaaccaggccgcccccgacgacacccagggcucccccgaccucggcgccgucgagcuccgcaucgaggagcuccgccaccacuuccgcgucgagcacgccgucgccgagggcgccaagaacguccuccgccuccucuccgccgccaaggcccccgaccgcaaggccgucuccgaggcccaggagaagcucaccgaguccaaccagaagcucggccuccuccgcgaggcccucgagcgccgccucggcgagcuccccgccgaccaccccaagggccgccuccuccgcgaggagcucgccgccgccuccuccgccgccuucuccacccgccucgccggccccuuccccgccacccacuacuccacccucugcaagcccgccccccucaccggcacccucgagguccgcgucgucggcugccgcgaccuccccgagaccauccccuggaaccccacccccuccaugggcggccccggcacccccgacucccgcccccccuuccucucccgccccgcccgcggccucuacucccgcuccggcucccucuccggccgcuccucccucaaggccgaggccgagaacaccuccgaggucuccaccguccucaagcucgacaacaccgucgucggccagaccuccuggaagcccugcggccccaacgccugggaccaguccuucacccucgagcucgagcgcgcccgcgagcucgagcucgccgucuucuggcgcgaccagcgcggccucugcgcccucaaguuccucaagcucgaggacuuccucgacaacgagcgccacgagguccagcucgacauggagccccagggcugccucgucgccgaggucaccuuccgcaaccccgucaucgagcgcaucccccgccuccgccgccagaagaagaucuucuccaagcagcagggcaaggccuuccagcgcgcccgccagaugaacaucgacgucgccaccuggguccgccuccuccgccgccucauccccaacgccaccggcaccggcaccuucucccccggcgccucccccggcuccgaggcccgcaccaccggcgacaucuccgucgagaagcucaaccucggcaccgacuccgacuccuccccccagaaguccucccgcgacccccccuccucccccuccucccucuccucccccauccaggaguccaccgcccccgagcuccccuccgagacccaggagacccccggccccgcccucugcuccccccuccgcaaguccccccucacccucgaggacuucaaguuccucgccguccucggccgcggccacuucggcaagguccuccucuccgaguuccgccccuccggcgagcucuucgccaucaaggcccucaagaagggcgacaucgucgcccgcgacgaggucgagucccucaugugcgagaagcgcauccucgccgccgucaccuccgccggccaccccuuccucgucaaccucuucggcugcuuccagacccccgagcacgucugcuucgucauggaguacuccgccggcggcgaccucaugcuccacauccacuccgacgucuucuccgagccccgcgccaucuucuacuccgccugcgucguccucggccuccaguuccuccacgagcacaagaucgucuaccgcgaccucaagcucgacaaccuccuccucgacaccgagggcuacgucaagaucgccgacuucggccucugcaaggagggcaugggcuacggcgaccgcaccuccaccuucugcggcacccccgaguuccucgcccccgagguccucaccgacaccuccuacacccgcgccgucgacugguggggccucggcguccuccucuacgagaugcucgucggcgagucccccuuccccggcgacgacgaggaggaggucuucgacuccaucgucaacgacgagguccgcuacccccgcuuccucuccgccgaggccaucggcaucaugcgccgccuccuccgccgcaaccccgagcgccgccucggcuccuccgagcgcgacgccgaggacgucaagaagcagcccuucuuccgcacccucggcugggaggcccuccucgcccgccgccuccccccccccuucguccccacccucuccggccgcaccgacgucuccaacuucgacgaggaguucaccggcgaggcccccacccucucccccccccgcgacgcccgcccccucaccgccgccgagcaggccgccuuccucgacuucgacuucgucgccggcggcugcuga

SEQ ID NO: 47706 - RNA, 3036 nt, Artificial Sequence
  derived and/or modified sequence opt2 from PKN2__Homo_sapiens__XP_011540071
auggccuccaaccccgagcgcggcgagauccuccucaccgagcuccagaacugcggccacuccggcggccucgccugcuucaucuacugggaguuccagggcugggagaagguccagaacgagaaguccggcgacucccgcucccuccccuucuccgagaacgucuccgccguccagaagcucgacuucuccgacaccaugguccagcagaagcucgacgacaucaaggaccgcaucaagcgcgagauccgcaaggagcucaagaucaaggagggcgccgagaaccuccgcaaggucaccaccgacaagaagucccucgccuacgucgacaacauccucaagaaguccaacaagaagcucgaggagcuccaccacaagcuccaggagcucaacgcccacaucgucgucuccgaccccgaggacaucaccgacugcccccgcacccccgacacccccaacaacgacccccgcugcuccaccuccaacaaccgccucaaggcccuccagaagcagcucgacaucgagcucaaggucaagcagggcgccgagaacaugauccagauguacuccaacggcuccuccaaggaccgcaagcuccacggcaccgcccagcagcuccuccaggacuccaagaccaagaucgaggucauccgcaugcagauccuccaggccguccagaccaacgagcucgccuucgacaacgccaagcccgucaucuccccccucgagcuccgcauggaggagcuccgccaccacuuccgcaucgaguucgccgucgccgagggcgccaagaacgucaugaagcuccucggcuccggcaaggucaccgaccgcaaggcccucuccgaggcccaggcccgcuucaacgaguccucccagaagcucgaccuccucaaguacucccucgagcagcgccucaacgagguccccaagaaccaccccaagucccgcaucaucaucgaggagcucucccucgucgccgccucccccacccucuccccccgccaguccaugaucuccacccagaaccaguacuccacccucuccaagcccgccgcccucaccggcacccucgagguccgccucaugggcugccaggacauccucgagaacguccccggccgcuccaaggccaccuccgucgcccuccccggcuggucccccuccgagacccgcuccuccuucaugucccgcaccuccaaguccaaguccggcuccucccgcaaccuccucaagaccgacgaccucuccaacgacgucugcgccguccucaagcucgacaacaccgucgucggccagaccuccuggaagcccaucuccaaccaguccugggaccagaaguucacccucgagcucgaccgcucccgcgagcucgagaucuccgucuacuggcgcgacuggcgcucccucugcgccgucaaguuccuccgccucgaggacuuccucgacaaccagcgccacggcaugugccucuaccucgagccccagggcacccucuucgccgaggucaccuucuucaaccccgucaucgagcgccgccccaagcuccagcgccagaagaagaucuucuccaagcagcagggcaagaccuuccuccgcgccccccagaugaacaucaacaucgccaccuggggccgccucguccgccgcgccauccccaccgucaaccacuccggcaccuucuccccccaggcccccguccccaccaccguccccgucgucgacguccgcaucccccagcucgccccccccgccuccgacuccaccgucaccaagcucgacuucgaccucgagcccgagcccccccccgcccccccccgcgccuccucccucggcgagaucgacgaguccuccgagcuccgcguccucgacauccccggccaggacuccgagaccgucuucgacauccagaacgaccgcaacuccauccuccccaagucccaguccgaguacaagcccgacaccccccaguccggccucgaguacuccggcauccaggagcucgaggaccgccgcucccagcagcgcuuccaguucaaccuccaggacuuccgcugcugcgccguccucggccgcggccacuucggcaagguccuccucgccgaguacaagaacaccaacgagauguucgccaucaaggcccucaagaagggcgacaucgucgcccgcgacgaggucgacucccucaugugcgagaagcgcaucuucgagaccgucaacuccguccgccaccccuuccucgucaaccucuucgccugcuuccagaccaaggagcacgucugcuucgucauggaguacgccgccggcggcgaccucaugaugcacauccacaccgacgucuucuccgagccccgcgccgucuucuacgccgccugcgucguccucggccuccaguaccuccacgagcacaagaucgucuaccgcgaccucaagcucgacaaccuccuccucgacaccgagggcuucgucaagaucgccgacuucggccucugcaaggagggcaugggcuacggcgaccgcaccuccaccuucugcggcacccccgaguuccucgcccccgagguccucaccgagaccuccuacacccgcgccgucgacugguggggccucggcguccucaucuacgagaugcucgucggcgagucccccuuccccggcgacgacgaggaggaggucuucgacuccaucgucaacgacgagguccgcuacccccgcuuccucuccaccgaggccaucuccaucaugcgccgccuccuccgccgcaaccccgagcgccgccucggcgccuccgagaaggacgccgaggacgucaagaagcaccccuucuuccgccucaucgacugguccgcccucauggacaagaaggucaagccccccuucauccccaccauccgcggccgcgaggacgucuccaacuucgacgacgaguucaccuccgaggcccccauccucacccccccccgcgagccccgcauccucuccgaggaggagcaggagauguuccgcgacuucgacuacaucgccgacuggugcuga

SEQ ID NO: 47707 - RNA, 2670 nt, Artificial Sequence
  derived and/or modified sequence opt2 from PKN3__Homo_sapiens__NP_037487
auggaggagggcgccccccgccagcccggccccucccaguggccccccgaggacgagaaggaggucauccgccgcgccauccagaaggagcucaagaucaaggagggcgucgagaaccuccgccgcgucgccaccgaccgccgccaccucggccacguccagcagcuccuccgcuccuccaaccgccgccucgagcagcuccacggcgagcuccgcgagcuccacgcccgcauccuccuccccggccccggccccggccccgccgagcccgucgccuccggcccccgccccugggccgagcagcuccgcgcccgccaccucgaggcccuccgccgccagcuccacgucgagcucaaggucaagcagggcgccgagaacaugacccacaccugcgccuccggcacccccaaggagcgcaagcuccucgccgccgcccagcagaugcuccgcgacucccagcucaaggucgcccuccuccgcaugaagaucuccucccucgaggccuccggcucccccgagcccggccccgagcuccucgccgaggagcuccagcaccgccuccacgucgaggccgccgucgccgagggcgccaagaacgucgucaagcuccucuccucccgccgcacccaggaccgcaaggcccucgccgaggcccaggcccagcuccaggaguccucccagaagcucgaccuccuccgccucgcccucgagcagcuccucgagcagcucccccccgcccacccccuccgcucccgcgucacccgcgagcuccgcgccgccguccccggcuacccccagcccuccggcacccccgucaagcccaccgcccucaccggcacccuccagguccgccuccucggcugcgagcagcuccucaccgccguccccggccgcucccccgccgccgcccucgccuccucccccuccgagggcuggcuccgcaccaaggccaagcaccagcgcggccgcggcgagcucgccuccgagguccucgccguccucaaggucgacaaccgcgucgucggccagaccggcuggggccaggucgccgagcaguccugggaccagaccuucgucaucccccucgagcgcgcccgcgagcucgagaucggcguccacuggcgcgacuggcgccagcucugcggcgucgccuuccuccgccucgaggacuuccucgacaacgccugccaccagcucucccucucccucgucccccagggccuccucuucgcccaggucaccuucugcgaccccgucaucgagcgccgcccccgccuccagcgccaggagcgcaucuucuccaagcgccgcggccaggacuuccuccgcgccucccagaugaaccucggcauggccgccuggggccgccucgucaugaaccuccucccccccugcuccucccccuccaccaucuccccccccaagggcugcccccgcacccccaccacccuccgcgaggccuccgaccccgccacccccuccaacuuccuccccaagaagaccccccucggcgaggagaugacccccccccccaagcccccccgccucuaccucccccaggagcccaccuccgaggagaccccccgcaccaagcgcccccacauggagccccgcacccgccgcggccccuccccccccgccucccccacccgcaagcccccccgccuccaggacuuccgcugccucgccguccucggccgcggccacuucggcaagguccuccucguccaguucaagggcaccggcaaguacuacgccaucaaggcccucaagaagcaggagguccucucccgcgacgagaucgagucccucuacugcgagaagcgcauccucgaggccgucggcugcaccggccaccccuuccuccucucccuccucgccugcuuccagaccuccucccacgccugcuucgucaccgaguucguccccggcggcgaccucaugaugcagauccacgaggacgucuuccccgagccccaggcccgcuucuacgucgccugcgucguccucggccuccaguuccuccacgagaagaagaucaucuaccgcgaccucaagcucgacaaccuccuccucgacgcccagggcuuccucaagaucgccgacuucggccucugcaaggagggcaucggcuucggcgaccgcaccuccaccuucugcggcacccccgaguuccucgcccccgagguccucacccaggaggccuacacccgcgccgucgacugguggggccucggcguccuccucuacgagaugcucgucggcgagugccccuuccccggcgacaccgaggaggaggucuucgacugcaucgucaacauggacgcccccuaccccggcuuccucuccguccagggccucgaguucauccagaagcuccuccagaagugccccgagaagcgccucggcgccggcgagcaggacgccgaggagaucaagguccagcccuucuuccgcaccaccaacuggcaggcccuccucgcccgcaccauccagccccccuucguccccacccucugcggccccgccgaccuccgcuacuucgagggcgaguucaccggccucccccccgcccucaccccccccgccccccacucccuccucaccgcccgccagcaggccgccuuccgcgacuucgacuucgucuccgagcgcuuccucgagcccuga

SEQ ID NO: 47708 - RNA, 960 nt, Artificial Sequence
  derived and/or modified sequence opt2 from PKNOX1__Homo_sapiens__NP_001273187
auggucaaggccauccagguccuccgcauccaccuccucgagcucgagaaggucaacgagcucugcaaggacuucugcucccgcuacaucgccugccucaagaccaagaugaacuccgagacccuccucuccggcgagcccggcucccccuacucccccguccagucccagcagauccaguccgccaucaccggcaccaucuccccccagggcaucgucguccccgccuccgcccuccagcagggcaacgucgccauggccaccgucgccggcggcaccgucuaccagcccgucaccgucgucaccccccagggccaggucgucacccagacccucucccccggcaccauccgcauccagaacucccagcuccagcuccagcucaaccaggaccucuccauccuccaccaggacgacggcuccuccaagaacaagcgcggcguccuccccaagcacgccaccaacgucaugcgcuccuggcucuuccagcacaucggccaccccuaccccaccgaggacgagaagaagcagaucgccgcccagaccaaccucacccuccuccaggucaacaacugguucaucaacgcccgccgccgcauccuccagcccaugcucgacuccuccugcuccgagacccccaagaccaagaagaagaccgcccagaaccgccccguccagcgcuucuggcccgacuccaucgccuccggcgucgcccagcccccccccuccgagcucaccauguccgagggcgccgucgucaccaucaccacccccgucaacaugaacgucgacucccuccagucccucuccuccgacggcgccacccucgccguccagcaggucaugauggccggccaguccgaggacgaguccgucgacuccaccgaggaggacgccggcgcccucgcccccgcccacaucuccggccucguccucgagaacuccgacucccuccaguga

SEQ ID NO: 47709 - RNA, 1332 nt, Artificial Sequence
  derived and/or modified sequence opt2 from PKNOX2__Homo_sapiens__XP_005271700
augaccgccaccgcccagccccccuccaaggcccaggccguccacaucuccgcccccuccgccgccgccuccacccccguccccuccgcccccaucgacccccaggcccagcucgaggccgacaagcgcgccgucuaccgccacccccucuucccccuccucacccuccucuucgagaagugcgagcaggccacccagggcuccgagugcaucaccuccgccuccuucgacgucgacaucgagaacuucguccaccagcaggagcaggagcacaagcccuucuucuccgacgaccccgagcucgacaaccucauggucaaggccauccagguccuccgcauccaccuccucgagcucgagaaggucaacgagcucugcaaggacuucugcaaccgcuacaucaccugccucaagaccaagaugcacuccgacaaccuccuccgcaacgaccucggcggccccuacucccccaaccagcccuccaucaaccuccacucccaggaccuccuccagaacucccccaacuccauguccggcgucuccaacaacccccagggcaucgucguccccgccuccgcccuccagcagggcaacaucgccaugaccaccgucaacucccaggucgucuccggcggcgcccucuaccagcccgucaccauggucaccucccagggccaggucgucacccaggccaucccccagggcgccauccagauccagaacacccaggucaaccucgaccucaccucccuccucgacaacgaggacaagaaguccaagaacaagcgcggcguccuccccaagcacgccaccaacaucaugcgcuccuggcucuuccagcaccucaugcaccccuaccccaccgaggacgagaagcgccagaucgccgcccagaccaaccucacccuccuccaggucaacaacugguucaucaacgcccgccgccgcauccuccagcccaugcucgacgccuccaaccccgaccccgcccccaaggccaagaagaucaagucccagcaccgccccacccagcgcuucuggcccaacuccaucgccgccggcguccuccagcagcagggcggcgcccccggcaccaaccccgacggcuccaucaaccucgacaaccuccagucccucuccuccgacuccgccaccauggccaugcagcaggccaugauggccgcccacgacgacucccucgacggcaccgaggaggaggacgaggacgagauggaggaggaggaggaggaggagcucgaggaggaggucgacgagcuccagaccaccaacgucuccgaccucggccucgagcacuccgacucccucgaguga

SEQ ID NO: 47710 - RNA, 2244 nt, Artificial Sequence
  derived and/or modified sequence opt2 from PKP1__Homo_sapiens__NP_000290
augaaccacuccccccucaagaccgcccucgccuacgagugcuuccaggaccaggacaacuccacccucgcccuccccuccgaccagaagaugaagaccggcaccuccggccgccagcgcguccaggagcaggucaugaugaccgucaagcgccagaaguccaaguccucccaguccuccacccucucccacuccaaccgcggcuccauguacgacggccucgccgacaacuacaacuacggcaccaccucccgcuccuccuacuacuccaaguuccaggccggcaacggcuccuggggcuaccccaucuacaacggcacccucaagcgcgagcccgacaaccgccgcuucuccuccuacucccagauggagaacuggucccgccacuacccccgcggcuccugcaacaccaccggcgccggcuccgacaucugcuucaugcagaagaucaaggccucccgcuccgagcccgaccucuacugcgacccccgcggcacccuccgcaagggcacccucggcuccaagggccagaagaccacccagaaccgcuacuccuucuacuccaccugcuccggccagaaggccaucaagaagugccccguccgcccccccuccugcgccuccaagcaggaccccgucuacaucccccccaucuccugcaacaaggaccucuccuucggccacucccgcgccuccuccaagaucugcuccgaggacaucgagugcuccggccucaccauccccaaggccguccaguaccucuccucccaggacgagaaguaccaggccaucggcgccuacuacauccagcacaccugcuuccaggacgaguccgccaagcagcaggucuaccagcucggcggcaucugcaagcucgucgaccuccuccgcucccccaaccagaacguccagcaggccgccgccggcgcccuccgcaaccucgucuuccgcuccaccaccaacaagcucgagacccgccgccagaacggcauccgcgaggccgucucccuccuccgccgcaccggcaacgccgagauccagaagcagcucaccggccuccucuggaaccucuccuccaccgacgagcucaaggaggagcucaucgccgacgcccuccccguccucgccgaccgcgucaucauccccuucuccggcuggugcgacggcaacuccaacaugucccgcgaggucgucgaccccgaggucuucuucaacgccaccggcugccuccgcaagcgccucggcaugcgcgagcuccucgcccucgucccccagcgcgccaccuccucccgcgucaaccucuccuccgccgacgccggccgccagaccaugcgcaacuacuccggccucaucgacucccucauggccuacguccagaacugcgucgccgccucccgcugcgacgacaaguccgucgagaacugcaugugcguccuccacaaccucuccuaccgccucgacgccgagguccccacccgcuaccgccagcucgaguacaacgcccgcaacgccuacaccgagaaguccuccaccggcugcuucuccaacaaguccgacaagaugaugaacaacaacuacgacugcccccuccccgaggaggagaccaaccccaagggcuccggcuggcucuaccacuccgacgccauccgcaccuaccucaaccucaugggcaaguccaagaaggacgccacccucgaggccugcgccggcgcccuccagaaccucaccgccuccaagggccucauguccuccggcaugucccagcucaucggccucaaggagaagggccucccccagaucgcccgccuccuccaguccggcaacuccgacgucguccgcuccggcgccucccuccucuccaacaugucccgccacccccuccuccaccgcgucaugggcaaccaggucuuccccgaggucacccgccuccucaccucccacaccggcaacaccuccaacuccgaggacauccucuccuccgccugcuacaccguccgcaaccucauggccucccagccccagcucgccaagcaguacuucuccuccuccaugcucaacaacaucaucaaccucugccgcuccuccgccucccccaaggccgccgaggccgcccgccuccuccucuccgacaugugguccuccaaggagcuccagggcguccuccgccagcagggcuucgaccgcaacaugcucggcacccucgccggcgccaacucccuccgcaacuucaccucccgcuucuga

SEQ ID NO: 47711 - RNA, 2514 nt, Artificial Sequence
  derived and/or modified sequence opt2 from PKP2__Homo_sapiens__NP_001005242
auggccgcccccggcgcccccgccgaguacggcuacauccgcaccguccucggccagcagauccucggccagcucgacuccuccucccucgcccuccccuccgaggccaagcucaagcucgccggcuccuccggccgcggcggccagaccgucaagucccuccgcauccaggagcagguccagcagacccucgcccgcaagggccgcuccuccgucggcaacggcaaccuccaccgcaccuccuccguccccgaguacgucuacaaccuccaccucgucgagaacgacuucgucggcggccgcucccccguccccaagaccuacgacaugcucaaggccggcaccaccgccaccuacgagggccgcuggggccgcggcaccgcccaguacuccucccagaaguccgucgaggagcgcucccuccgccacccccuccgccgccucgagaucucccccgacuccucccccgagcgcgcccacuacacccacuccgacuaccaguacucccagcgcucccaggccggccacacccuccaccaccaggagucccgccgcgccgcccuccucguccccccccgcuacgcccgcuccgagaucgucggcgucucccgcgccggcaccaccucccgccagcgccacuucgacaccuaccaccgccaguaccagcacggcuccgucuccgacaccgucuucgacuccauccccgccaaccccgcccuccucaccuacccccgccccggcaccucccgcuccaugggcaaccuccucgagaaggagaacuaccucaccgccggccucaccgucggccagguccgcccccucgucccccuccagcccgucacccagaaccgcgccucccgcuccuccuggcaccaguccuccuuccacuccacccgcacccuccgcgaggccggccccuccgucgccgucgacuccuccggccgccgcgcccaccucaccgucggccaggccgccgccggcggcuccggcaaccuccucaccgagcgcuccaccuucaccgacucccagcucggcaacgccgacauggagaugacccucgagcgcgccgucuccaugcucgaggccgaccacaugcuccccucccgcaucuccgccgccgccaccuucauccagcacgagugcuuccagaaguccgaggcccgcaagcgcgucaaccagcuccgcggcauccucaagcuccuccagcuccucaagguccagaacgaggacguccagcgcgccgucugcggcgcccuccgcaaccucgucuucgaggacaacgacaacaagcucgaggucgccgagcucaacggcgucccccgccuccuccagguccucaagcagacccgcgaccucgagaccaagaagcagaucaccggccuccucuggaaccucuccuccaacgacaagcucaagaaccucaugaucaccgaggcccuccucacccucaccgagaacaucaucauccccuucuccggcuggcccgagggcgacuaccccaaggccaacggccuccucgacuucgacaucuucuacaacgucaccggcugccuccgcaacauguccuccgccggcgccgacggccgcaaggccaugcgccgcugcgacggccucaucgacucccucguccacuacguccgcggcaccaucgccgacuaccagcccgacgacaaggccaccgagaacugcgucugcauccuccacaaccucuccuaccagcucgaggccgagcuccccgagaaguacucccagaacaucuacauccagaaccgcaacauccagaccgacaacaacaaguccaucggcugcuucggcucccgcucccgcaaggucaaggagcaguaccaggacguccccaugcccgaggagaaguccaaccccaagggcgucgaguggcucuggcacuccaucgucauccgcauguaccucucccucaucgccaaguccguccgcaacuacacccaggaggccucccucggcgcccuccagaaccucaccgccggcuccggccccaugcccaccuccgucgcccagaccgucguccagaaggaguccggccuccagcacacccgcaagaugcuccacgucggcgaccccuccgucaagaagaccgccaucucccuccuccgcaaccucucccgcaaccucucccuccagaacgagaucgccaaggagacccuccccgaccucgucuccaucauccccgacaccguccccuccaccgaccuccucaucgagaccaccgccuccgccugcuacacccucaacaacaucauccagaacuccuaccagaacgcccgcgaccuccucaacaccggcggcauccagaagaucauggccaucuccgccggcgacgccuacgccuccaacaaggccuccaaggccgccuccguccuccucuacucccucugggcccacaccgagcuccaccacgccuacaagaaggcccaguucaagaagaccgacuucgucaacucccgcaccgccaaggccuaccacucccucaaggacuga

SEQ ID NO: 47712 - RNA, 2394 nt, Artificial Sequence
  derived and/or modified sequence opt2 from PKP3__Homo_sapiens__NP_009114
augcaggacggcaacuuccuccucuccgcccuccagcccgaggccggcgucugcucccucgcccuccccuccgaccuccagcucgaccgccgcggcgccgagggccccgaggccgagcgccuccgcgccgcccgcguccaggagcagguccgcgcccgccuccuccagcucggccagcagccccgccacaacggcgccgccgagcccgagcccgaggccgagaccgcccgcggcaccucccgcggccaguaccacacccuccaggccggcuucuccucccgcucccagggccucuccggcgacaagaccuccggcuuccgccccaucgccaagcccgccuacucccccgccuccugguccucccgcuccgccgucgaccucuccugcucccgccgccucuccuccgcccacaacggcggcuccgccuucggcgccgccggcuacggcggcgcccagcccaccccccccaugcccacccgccccgucuccuuccacgagcgcggcggcgucggcucccgcgccgacuacgacacccucucccuccgcucccuccgccucggccccggcggccucgacgaccgcuacucccucgucuccgagcagcucgagcccgccgccaccuccaccuaccgcgccuucgccuacgagcgccaggccuccuccuccuccucccgcgccggcggccucgacuggcccgaggccaccgaggucucccccucccgcaccauccgcgcccccgccguccgcacccuccagcgcuuccaguccucccaccgcucccgcggcgucggcggcgccguccccggcgccguccucgagcccgucgcccgcgcccccuccguccgcucccucucccucucccucgccgacuccggccaccuccccgacguccacggcuucaacuccuacggcucccaccgcacccuccagcgccucuccuccggcuucgacgacaucgaccuccccuccgccgucaaguaccucauggccuccgaccccaaccuccagguccucggcgccgccuacauccagcacaagugcuacuccgacgccgccgccaagaagcaggcccgcucccuccaggccgucccccgccucgucaagcucuucaaccacgccaaccaggagguccagcgccacgccaccggcgccaugcgcaaccucaucuacgacaacgccgacaacaagcucgcccucgucgaggagaacggcaucuucgagcuccuccgcacccuccgcgagcaggacgacgagcuccgcaagaacgucaccggcauccucuggaaccucuccuccuccgaccaccucaaggaccgccucgcccgcgacacccucgagcagcucaccgaccucguccucuccccccucuccggcgccggcggccccccccucauccagcagaacgccuccgaggccgagaucuucuacaacgccaccggcuuccuccgcaaccucuccuccgccucccaggccacccgccagaagaugcgcgagugccacggccucgucgacgcccucgucaccuccaucaaccacgcccucgacgccggcaagugcgaggacaaguccgucgagaacgccgucugcguccuccgcaaccucuccuaccgccucuacgacgagaugccccccuccgcccuccagcgccucgagggccgcggccgccgcgaccucgccggcgccccccccggcgaggucgucggcugcuucaccccccagucccgccgccuccgcgagcucccccucgccgccgacgcccucaccuucgccgaggucuccaaggaccccaagggccucgaguggcucugguccccccagaucgucggccucuacaaccgccuccuccagcgcugcgagcucaaccgccacaccaccgaggccgccgccggcgcccuccagaacaucaccgccggcgaccgccgcugggccggcguccucucccgccucgcccucgagcaggagcgcauccucaacccccuccucgaccgcguccgcaccgccgaccaccaccagcuccgcucccucaccggccucauccgcaaccucucccgcaacgcccgcaacaaggacgagauguccaccaaggucgucucccaccucaucgagaagcuccccggcuccgucggcgagaaguccccccccgccgagguccucgucaacaucaucgccguccucaacaaccucgucgucgccucccccaucgccgcccgcgaccuccucuacuucgacggccuccgcaagcucaucuucaucaagaagaagcgcgacucccccgacuccgagaaguccucccgcgccgccuccucccuccucgccaaccucuggcaguacaacaagcuccaccgcgacuuccgcgccaagggcuaccgcaaggaggacuuccucggccccuga

SEQ ID NO: 47713 - RNA, 3450 nt, Artificial Sequence
  derived and/or modified sequence opt2 from PKP4__Homo_sapiens__NP_001005476
augcccgcccccgagcaggccucccucgucgaggagggccagccccagacccgccaggaggccgccuccaccggccccggcauggagcccgagaccaccgccaccaccauccucgccuccgucaaggagcaggagcuccaguuccagcgccucacccgcgagcucgaggucgagcgccagaucgucgccucccagcucgagcgcugccgccucggcgccgagucccccuccaucgccuccaccuccuccaccgagaaguccuuccccuggcgcuccaccgacguccccaacaccggcgucuccaagccccgcgucuccgacgccguccagcccaacaacuaccucauccgcaccgagcccgagcagggcacccucuacucccccgagcagaccucccuccacgaguccgagggcucccucggcaacucccgcuccuccacccagaugaacuccuacuccgacuccggcuaccaggaggccggcuccuuccacaacucccagaacgucuccaaggccgacaaccgccagcagcacuccuucaucggcuccaccaacaaccacgucguccgcaacucccgcgccgagggccagacccucguccagcccuccgucgccaaccgcgccaugcgccgcgucuccuccguccccucccgcgcccagucccccuccuacgucaucuccaccggcgucucccccucccgcggcucccuccgcaccucccucggcuccggcuucggcucccccuccgucaccgacccccgcccccucaaccccuccgccuacuccuccaccacccuccccgccgcccgcgccgccucccccuacucccagcgccccgccucccccaccgccauccgccgcaucggcuccgucaccucccgccagaccuccaaccccaacggccccaccccccaguaccagaccaccgcccgcgucggcuccccccucacccucaccgacgcccagacccgcgucgccucccccucccagggccaggucggcuccuccucccccaagcgcuccggcaugaccgccgucccccagcaccucggccccucccuccagcgcaccguccacgacauggagcaguucggccagcagcaguacgacaucuacgagcgcaugguccccccccgccccgacucccucaccggccuccgcuccuccuacgccucccagcacucccagcucggccaggaccuccgcuccgccgucucccccgaccuccacaucacccccaucuacgagggccgcaccuacuacucccccgucuaccgcucccccaaccacggcaccgucgagcuccagggcucccagaccgcccucuaccgcaccggcuccgucggcaucggcaaccuccagcgcaccuccucccagcgcuccacccucaccuaccagcgcaacaacuacgcccucaacaccaccgccaccuacgccgagcccuaccgccccauccaguaccgcguccaggagugcaacuacaaccgccuccagcacgccguccccgccgacgacggcaccacccgcucccccuccaucgacuccauccagaaggacccccgcgaguucgccuggcgcgaccccgagcuccccgaggucauccacaugcuccagcaccaguuccccuccguccaggccaacgccgccgccuaccuccagcaccucugcuucggcgacaacaaggucaagauggaggucugccgccucggcggcaucaagcaccucgucgaccuccucgaccaccgcguccucgagguccagaagaacgccugcggcgcccuccgcaaccucgucuucggcaaguccaccgacgagaacaagaucgccaugaagaacgucggcggcauccccgcccuccuccgccuccuccgcaaguccaucgacgccgagguccgcgagcucgucaccggcguccucuggaaccucuccuccugcgacgccgucaagaugaccaucauccgcgacgcccucuccacccucaccaacaccgucaucgucccccacuccggcuggaacaacuccuccuucgacgacgaccacaagaucaaguuccagaccucccucguccuccgcaacaccaccggcugccuccgcaaccucuccuccgccggcgaggaggcccgcaagcagaugcgcuccugcgagggccucgucgacucccuccucuacgucauccacaccugcgucaacaccuccgacuacgacuccaagaccgucgagaacugcgucugcacccuccgcaaccucuccuaccgccucgagcucgaggucccccaggcccgccuccucggccucaacgagcucgacgaccuccucggcaaggagucccccuccaaggacuccgagcccuccugcuggggcaagaagaagaagaagaagaagcgcaccccccaggaggaccagugggacggcgucggccccauccccggccucuccaagucccccaagggcgucgagaugcucuggcaccccuccgucgucaagcccuaccucacccuccucgccgaguccuccaaccccgccacccucgagggcuccgccggcucccuccagaaccucuccgccggcaacuggaaguucgccgccuacauccgcgccgccguccgcaaggagaagggccuccccauccucgucgagcuccuccgcauggacaacgaccgcgucgucuccuccgucgccaccgcccuccgcaacauggcccucgacguccgcaacaaggagcucaucggcaaguacgccaugcgcgaccucgucaaccgccuccccggcggcaacggccccuccguccucuccgacgagaccauggccgccaucugcugcgcccuccacgaggucaccuccaagaacauggagaacgccaaggcccucgccgacuccggcggcaucgagaagcucgucaacaucaccaagggccgcggcgaccgcuccucccucaaggucgucaaggccgccgcccagguccucaacacccucuggcaguaccgcgaccuccgcuccaucuacaagaaggacggcuggaaccagaaccacuucaucacccccgucuccacccucgagcgcgaccgcuucaagucccaccccucccucuccaccaccaaccagcagaugucccccaucauccaguccggcuccuccaagcccucccccaucuacaucuccuccuacuccucccccgcccgcgagcagaaccgccgccuccagcaccagcagcucuacuacucccaggacgacuccaaccgcaagaacuucgacgccuaccgccucuaccuccaguccccccacuccuacgaggaccccuacuucgacgaccgcguccacuuccccgccuccaccgacuacuccacccaguacggccucaaguccaccaccaacuacgucgacuucuacuccaccaagcgccccuccuaccgcgccgagcaguaccccggcucccccgacuccugggucuga

SEQ ID NO: 47714 - RNA, 1323 nt, Artificial Sequence
  derived and/or modified sequence opt2 from PLA1A__Homo_sapiens__NP_001193889
augccccccggccccugggaguccugcuucugggucggcggccucauccucuggcucuccgucggcuccuccggcgacgccccccccaccccccagcccaagugcgccgacuuccaguccgccaaccucuucgagggcaccgaccucaagguccaguuccuccucuucguccccuccaaccccuccugcggccagcucgucgagggcuccuccgaccuccagaacuccggcuucaacgccacccucggcaccaagcucaucauccacggcuuccgcguccucggcaccaagcccuccuggaucgacaccuucauccgcacccuccuccgcgccaccaacgccaacgucaucgccgucgacuggaucuacggcuccaccggcgucuacuucuccgccgucaagaacguccucggcgucuccgaguccuccauccacaucaucggcgucucccucggcgcccacgucggcggcauggucggccagcucuucggcggccagcucggccagaucaccggccucgaccccgccggccccgaguacacccgcgccuccgucgaggagcgccucgacgccggcgacgcccucuucgucgaggccauccacaccgacaccgacaaccucggcauccgcauccccgucggccacgucgacuacuucgucaacggcggccaggaccagcccggcugccccaccuucuucuacgccggcuacuccuaccucaucugcgaccacaugcgcgccguccaccucuacaucuccgcccucgagaacuccugcccccucauggccuuccccugcgccuccuacaaggccuuccucgccggccgcugccucgacugcuucaaccccuuccuccucuccugcccccgcaucggccucgucgagcagggcggcgucaagaucgagccccuccccaaggaggucaaggucuaccuccucaccaccuccuccgcccccuacugcaugcaccacucccucgucgaguuccaccucaaggagcuccgcaacaaggacaccaacaucgaggucaccuuccucuccuccaacaucaccuccuccuccaagaucaccauccccaagcagcagcgcuacggcaagggcaucaucgcccacgccaccccccagugccagaucaaccaggucaaguucaaguuccaguccuccaaccgcgucuggaagaaggaccgcaccaccaucaucggcaaguucugcaccgcccuccuccccgucaacgaccgcgagaagauggucugccuccccgagcccgucaaccuccaggccuccgucaccgucuccugcgaccucaagaucgccugcgucuga

SEQ ID NO: 47715 - RNA, 498 nt, Artificial Sequence
  derived and/or modified sequence opt2 from PLA2G10__Homo_sapiens__NP_003552
augggcccccuccccgucugccuccccaucaugcuccuccuccuccuccccucccuccuccuccuccuccuccuccccggccccggcuccggcgaggccucccgcauccuccgcguccaccgccgcggcauccucgagcucgccggcaccgucggcugcgucggcccccgcacccccaucgccuacaugaaguacggcugcuucugcggccucggcggccacggccagccccgcgacgccaucgacuggugcugccacggccacgacugcugcuacacccgcgccgaggaggccggcugcucccccaagaccgagcgcuacuccuggcagugcgucaaccaguccguccucugcggccccgccgagaacaagugccaggagcuccucugcaagugcgaccaggagaucgccaacugccucgcccagaccgaguacaaccucaaguaccucuucuacccccaguuccucugcgagcccgacucccccaagugcgacuga

SEQ ID NO: 47716 - RNA, 570 nt, Artificial Sequence
  derived and/or modified sequence opt2 from PLA2G12A__Homo_sapiens__NP_110448
auggcccuccucucccgccccgcccucacccuccuccuccuccucauggccgccgucguccgcugccaggagcaggcccagaccaccgacuggcgcgccacccucaagaccauccgcaacggcguccacaagaucgacaccuaccucaacgccgcccucgaccuccucggcggcgaggacggccucugccaguacaagugcuccgacggcuccaagcccuucccccgcuacggcuacaagcccuccccccccaacggcugcggcuccccccucuucggcguccaccucaacaucggcauccccucccucaccaagugcugcaaccagcacgaccgcugcuacgagaccugcggcaaguccaagaacgacugcgacgaggaguuccaguacugccucuccaagaucugccgcgacguccagaagacccucggccucacccagcacguccaggccugcgagaccaccgucgagcuccucuucgacuccgucauccaccucggcugcaagcccuaccucgacucccagcgcgccgccugccgcugccacuacgaggagaagaccgaccucuga

SEQ ID NO: 47717 - RNA, 588 nt, Artificial Sequence
  derived and/or modified sequence opt2 from PLA2G12B__Homo_sapiens__NP_115951
augaagcucgccuccggcuuccucguccucuggcucucccucggcggcggccucgcccaguccgacaccucccccgacaccgaggaguccuacuccgacuggggccuccgccaccuccgcggcuccuucgaguccgucaacuccuacuucgacuccuuccucgagcuccucggcggcaagaacggcgucugccaguaccgcugccgcuacggcaaggcccccaugccccgccccggcuacaagccccaggagcccaacggcugcggcuccuacuuccucggccucaagguccccgaguccauggaccucggcauccccgccaugaccaagugcugcaaccagcucgacgucugcuacgacaccugcggcgccaacaaguaccgcugcgacgccaaguuccgcuggugccuccacuccaucugcuccgaccucaagcgcucccucggcuucgucuccaaggucgaggccgccugcgacucccucgucgacaccgucuucaacaccgucuggacccucggcugccgccccuucaugaacucccagcgcgccgccugcaucugcgccgaggaggagaaggaggagcucuga

SEQ ID NO: 47718 - RNA, 1239 nt, Artificial Sequence
  derived and/or modified sequence opt2 from PLA2G15__Homo_sapiens__NP_036452
augggccuccaccuccgccccuaccgcgucggccuccuccccgacggccuccucuuccuccuccuccuccucaugcuccucgccgaccccgcccuccccgccggccgccacccccccgucguccucguccccggcgaccucggcaaccagcucgaggccaagcucgacaagcccaccgucguccacuaccucugcuccaagaagaccgaguccuacuucaccaucuggcucaaccucgagcuccuccuccccgucaucaucgacugcuggaucgacaacauccgccucgucuacaacaagaccucccgcgccacccaguuccccgacggcgucgacguccgcguccccggcuucggcaagaccuucucccucgaguuccucgaccccuccaaguccuccgucggcuccuacuuccacaccauggucgagucccucgucggcuggggcuacacccgcggcgaggacguccgcggcgcccccuacgacuggcgccgcgcccccaacgagaacggccccuacuuccucgcccuccgcgagaugaucgaggagauguaccagcucuacggcggccccgucguccucgucgcccacuccaugggcaacauguacacccucuacuuccuccagcgccagccccaggccuggaaggacaaguacauccgcgccuucgucucccucggcgcccccuggggcggcgucgccaagacccuccgcguccucgccuccggcgacaacaaccgcauccccgucaucggcccccucaagauccgcgagcagcagcgcuccgccgucuccaccuccuggcuccuccccuacaacuacaccuggucccccgagaaggucuucguccagacccccaccaucaacuacacccuccgcgacuaccgcaaguucuuccaggacaucggcuucgaggacggcuggcucaugcgccaggacaccgagggccucgucgaggccaccaugccccccggcguccagcuccacugccucuacggcaccggcguccccacccccgacuccuucuacuacgaguccuuccccgaccgcgaccccaagaucugcuucggcgacggcgacggcaccgucaaccucaaguccgcccuccagugccaggccuggcagucccgccaggagcaccagguccuccuccaggagcuccccggcuccgagcacaucgagaugcucgccaacgccaccacccucgccuaccucaagcgcguccuccucggccccuga

SEQ ID NO: 47719 - RNA, 489 nt, Artificial Sequence
  derived and/or modified sequence opt2 from PLA2G16__Homo_sapiens__NP_009000
augcgcgcccccauccccgagcccaagcccggcgaccucaucgagaucuuccgccccuucuaccgccacugggccaucuacgucggcgacggcuacgucguccaccucgccccccccuccgaggucgccggcgccggcgccgccuccgucauguccgcccucaccgacaaggccaucgucaagaaggagcuccucuacgacgucgccggcuccgacaaguaccaggucaacaacaagcacgacgacaaguacuccccccuccccugcuccaagaucauccagcgcgccgaggagcucgucggccaggagguccucuacaagcucaccuccgagaacugcgagcacuucgucaacgagcuccgcuacggcgucgcccgcuccgaccagguccgcgacgucaucaucgccgccuccgucgccggcaugggccucgccgccaugucccucaucggcgucauguucucccgcaacaagcgccagaagcaguga

SEQ ID NO: 47720 - RNA, 447 nt, Artificial Sequence
  derived and/or modified sequence opt2 from PLA2G1B__Homo_sapiens__NP_000919
augaagcuccucguccucgccguccuccucaccgucgccgccgccgacuccggcaucuccccccgcgccgucuggcaguuccgcaagaugaucaagugcgucauccccggcuccgaccccuuccucgaguacaacaacuacggcugcuacugcggccucggcggcuccggcacccccgucgacgagcucgacaagugcugccagacccacgacaacugcuacgaccaggccaagaagcucgacuccugcaaguuccuccucgacaaccccuacacccacaccuacuccuacuccugcuccggcuccgccaucaccugcuccuccaagaacaaggagugcgaggccuucaucugcaacugcgaccgcaacgccgccaucugcuucuccaaggcccccuacaacaaggcccacaagaaccucgacaccaagaaguacugccaguccuga

SEQ ID NO: 47721 - RNA, 1530 nt, Artificial Sequence
  derived and/or modified sequence opt2 from PLA2G3__Homo_sapiens__NP_056530
augggcguccaggccggccucuucggcaugcucggcuuccucggcgucgcccucggcggcucccccgcccuccgcugguaccgcaccuccugccaccucaccaaggccguccccggcaacccccucggcuaccucuccuuccucgccaaggacgcccagggccucgcccucauccacgcccgcugggacgcccaccgccgccuccaguccugcuccugggaggacgagcccgagcucaccgccgccuacggcgcccucugcgcccacgagaccgccuggggcuccuucauccacacccccggccccgagcuccagcgcgcccucgccacccuccagucccagugggaggccugccgcgcccucgaggagucccccgccggcgcccgcaagaagcgcgccgccggccaguccggcguccccggcggcggccaccagcgcgagaagcgcggcuggaccaugcccggcacccucuggugcggcgucggcgacuccgccggcaacuccuccgagcucggcgucuuccagggccccgaccucugcugccgcgagcacgaccgcugcccccagaacaucuccccccuccaguacaacuacggcauccgcaacuaccgcuuccacaccaucucccacugcgacugcgacacccgcuuccagcagugccuccagaaccagcacgacuccaucuccgacaucgucggcgucgccuucuucaacguccucgagauccccugcuucguccucgaggagcaggaggccugcgucgccugguacugguggggcggcugccgcauguacggcaccgucccccucgcccgccuccagccccgcaccuucuacaacgccuccugguccucccgcgccaccucccccacccccuccucccgcucccccgccccccccaagccccgccagaagcagcaccuccgcaagggccccccccaccagaagggcuccaagcgccccuccaaggccaacaccaccgcccuccaggaccccauggucuccccccgccucgacgucgcccccaccggccuccagggcccccagggcggccucaagccccagggcgcccgcugggucugccgcuccuuccgccgccaccucgaccagugcgagcaccagaucggcccccgcgagaucgaguuccagcuccucaacuccgcccaggagccccucuuccacugcaacugcacccgccgccucgcccgcuuccuccgccuccacuccccccccgaggucaccaacaugcucugggagcuccucggcaccaccugcuucaagcucgcccccccccucgacugcgucgagggcaagaacugcucccgcgacccccgcgccauccgcgucuccgcccgccaccuccgccgccuccagcagcgccgccaccagcuccaggacaagggcaccgacgagcgccagcccuggcccuccgagccccuccgcggccccauguccuucuacaaccagugccuccagcucacccaggccgcccgccgccccgaccgccagcagaaguccuggucccaguga

SEQ ID NO: 47722 - RNA, 2250 nt, Artificial Sequence
  derived and/or modified sequence opt2 from PLA2G4A__Homo_sapiens__NP_077734
auguccuucaucgaccccuaccagcacaucaucgucgagcaccaguacucccacaaguucaccgucgucguccuccgcgccaccaaggucaccaagggcgccuucggcgacaugcucgacacccccgaccccuacgucgagcucuucaucuccaccacccccgacucccgcaagcgcacccgccacuucaacaacgacaucaaccccgucuggaacgagaccuucgaguucauccucgaccccaaccaggagaacguccucgagaucacccucauggacgccaacuacgucauggacgagacccucggcaccgccaccuucaccgucuccuccaugaaggucggcgagaagaaggagguccccuucaucuucaaccaggucaccgagaugguccucgagaugucccucgaggucugcuccugccccgaccuccgcuucuccauggcccucugcgaccaggagaagaccuuccgccagcagcgcaaggagcacauccgcgaguccaugaagaagcuccucggccccaagaacuccgagggccuccacuccgcccgcgacguccccgucgucgccauccucggcuccggcggcggcuuccgcgccauggucggcuucuccggcgucaugaaggcccucuacgaguccggcauccucgacugcgccaccuacgucgccggccucuccggcuccaccugguacauguccacccucuacucccaccccgacuuccccgagaagggccccgaggagaucaacgaggagcucaugaagaacgucucccacaacccccuccuccuccucaccccccagaaggucaagcgcuacgucgagucccucuggaagaagaaguccuccggccagcccgucaccuucaccgacaucuucggcaugcucaucggcgagacccucauccacaaccgcaugaacaccacccucuccucccucaaggagaaggucaacaccgcccagugcccccucccccucuucaccugccuccacgucaagcccgacgucuccgagcucauguucgccgacugggucgaguucucccccuacgagaucggcauggccaaguacggcaccuucauggcccccgaccucuucggcuccaaguucuucaugggcaccgucgucaagaaguacgaggagaacccccuccacuuccucaugggcgucuggggcuccgccuucuccauccucuucaaccgcguccucggcgucuccggcucccagucccgcggcuccaccauggaggaggagcucgagaacaucaccaccaagcacaucgucuccaacgacuccuccgacuccgacgacgagucccacgagcccaagggcaccgagaacgaggacgccggcuccgacuaccaguccgacaaccaggccuccuggauccaccgcaugaucauggcccucgucuccgacuccgcccucuucaacacccgcgagggccgcgccggcaagguccacaacuucaugcucggccucaaccucaacaccuccuacccccucuccccccucuccgacuucgccacccaggacuccuucgacgacgacgagcucgacgccgccgucgccgaccccgacgaguucgagcgcaucuacgagccccucgacgucaaguccaagaagauccacgucgucgacuccggccucaccuucaaccuccccuacccccucauccuccgcccccagcgcggcgucgaccucaucaucuccuucgacuucuccgcccgccccuccgacuccuccccccccuucaaggagcuccuccucgccgagaagugggccaagaugaacaagcuccccuuccccaagaucgaccccuacgucuucgaccgcgagggccucaaggagugcuacgucuucaagcccaagaaccccgacauggagaaggacugccccaccaucauccacuucguccucgccaacaucaacuuccgcaaguacaaggcccccggcgucccccgcgagaccgaggaggagaaggagaucgccgacuucgacaucuucgacgaccccgagucccccuucuccaccuucaacuuccaguaccccaaccaggccuucaagcgccuccacgaccucaugcacuucaacacccucaacaacaucgacgucaucaaggaggccauggucgaguccaucgaguaccgccgccagaaccccucccgcugcuccgucucccucuccaacgucgaggcccgccgcuucuucaacaaggaguuccucuccaagcccaaggccuga

SEQ ID NO: 47723 - RNA, 2346 nt, Artificial Sequence
  derived and/or modified sequence opt2 from PLA2G4B__Homo_sapiens__NP_001108105
auggccgucgccgaggucucccgcaccugccuccucaccguccgcguccuccaggcccaccgccuccccuccaaggaccucgucacccccuccgacugcuacgucacccucuggcuccccaccgccugcucccaccgccuccagacccgcaccgucaagaacuccuccucccccgucuggaaccaguccuuccacuuccgcauccaccgccagcucaagaacgucauggagcucaaggucuucgaccaggaccucgucaccggcgacgaccccguccucuccguccucuucgacgccggcacccuccgcgccggcgaguuccgccgcgaguccuucucccucuccccccagggcgagggccgccucgaggucgaguuccgccuccagucccucgccgaccgcggcgaguggcucgucuccaacggcguccucgucgcccgcgagcucuccugccuccacguccagcucgaggagaccggcgaccagaaguccuccgagcaccgcguccagcucgucguccccggcuccugcgagggcccccaggaggccuccgucggcaccggcaccuuccgcuuccacugccccgccugcugggagcaggagcucuccauccgccuccaggacgcccccgaggagcagcucaaggccccccucuccgcccuccccuccggccaggucguccgccucgucuuccccaccucccaggagccccucaugcgcgucgagcucaagaaggaggccggccuccgcgagcucgccguccgccucggcuucggccccugcgccgaggagcaggccuuccucucccgccgcaagcaggucgucgccgccgcccuccgccaggcccuccagcucgacggcgaccuccaggaggacgagauccccgucgucgccaucauggccaccggcggcggcauccgcgccaugaccucccucuacggccagcucgccggccucaaggagcucggccuccucgacugcgucuccuacaucaccggcgccuccggcuccaccugggcccucgccaaccucuacgaggaccccgaguggucccagaaggaccucgccggccccaccgagcuccucaagacccaggucaccaagaacaagcucggcguccucgcccccucccagcuccagcgcuaccgccaggagcucgccgagcgcgcccgccucggcuaccccuccugcuucaccaaccucugggcccucaucaacgaggcccuccuccacgacgagccccacgaccacaagcucuccgaccagcgcgaggcccucucccacggccagaacccccuccccaucuacugcgcccucaacaccaagggccagucccucaccaccuucgaguucggcgaguggugcgaguucucccccuacgaggucggcuuccccaaguacggcgccuucauccccuccgagcucuucggcuccgaguucuucaugggccagcucaugaagcgccuccccgagucccgcaucugcuuccucgagggcaucugguccaaccucuacgccgccaaccuccaggacucccucuacugggccuccgagcccucccaguucugggaccgcuggguccgcaaccaggccaaccucgacaaggagcaggucccccuccucaagaucgaggagccccccuccaccgccggccgcaucgccgaguucuucaccgaccuccucaccuggcgcccccucgcccaggccacccacaacuuccuccgcggccuccacuuccacaaggacuacuuccagcacccccacuucuccaccuggaaggccaccacccucgacggccuccccaaccagcucacccccuccgagccccaccucugccuccucgacgucggcuaccucaucaacaccuccugccucccccuccuccagcccacccgcgacgucgaccucauccucucccucgacuacaaccuccacggcgccuuccagcagcuccagcuccucggccgcuucugccaggagcagggcauccccuucccccccaucucccccucccccgaggagcagcuccagccccgcgagugccacaccuucuccgaccccaccugccccggcgcccccgccguccuccacuucccccucgucuccgacuccuuccgcgaguacuccgcccccggcguccgccgcacccccgaggaggccgccgccggcgaggucaaccucuccuccuccgacucccccuaccacuacaccaaggucaccuacucccaggaggacgucgacaagcuccuccaccucacccacuacaacgucugcaacaaccaggagcagcuccucgaggcccuccgccaggccguccagcgccgccgccagcgccgcccccacuga

SEQ ID NO: 47724 - RNA, 1656 nt, Artificial Sequence
  derived and/or modified sequence opt2 from PLA2G4C__Homo_sapiens__NP_001152794
augcgcacccgcccccgcccccgccuccgccgcaccgagaacuuccucaccgccguccaccacggcaagaaggaggagaaggccgccgucgagcgccgccgccuccacguccucaaggcccucaagaagcuccgcaucgaggccgacgaggcccccgucgucgccguccucggcuccggcggcggccuccgcgcccacaucgccugccucggcguccucuccgagaugaaggagcagggccuccucgacgccgucaccuaccucgccggcgucuccggcuccaccugggccaucuccucccucuacaccaacgacggcgacauggaggcccucgaggccgaccucaagcaccgcuucacccgccaggagugggaccucgccaagucccuccagaagaccauccaggccgcccgcuccgagaacuacucccucaccgacuucugggccuacauggucaucuccaagcagacccgcgagcuccccgagucccaccucuccaacaugaagaagcccgucgaggagggcacccuccccuaccccaucuucgccgccaucgacaacgaccuccagcccuccuggcaggaggcccgcgcccccgagaccugguucgaguucaccccccaccacgccggcuucuccgcccucggcgccuucgucuccaucacccacuucggcuccaaguucaagaagggccgccucguccgcacccaccccgagcgcgaccucaccuuccuccgcggccucuggggcuccgcccucggcaacaccgaggucauccgcgaguacaucuucgaccagcuccgcaaccucacccucaagggccucuggcgccgcgccgucgccaacgccaaguccaucggccaccucaucuucgcccgccuccuccgccuccaggaguccucccagggcgagcaccccccccccgaggacgagggcggcgagcccgagcacaccuggcucaccgagaugcucgagaacuggacccgcaccucccucgagaagcaggagcagccccacgaggaccccgagcgcaagggcucccucuccaaccucauggacuucgucaagaagaccggcaucugcgccuccaagugggaguggggcaccacccacaacuuccucuacaagcacggcggcauccgcgacaagaucauguccucccgcaagcaccuccaccucgucgacgccggccucgccaucaacacccccuucccccucguccucccccccacccgcgagguccaccucauccucuccuucgacuucuccgccggcgaccccuucgagaccauccgcgccaccaccgacuacugccgccgccacaagauccccuucccccaggucgaggaggccgagcucgaccucugguccaaggcccccgccuccugcuacauccucaagggcgagaccggccccgucgucaugcacuucccccucuucaacaucgacgccugcggcggcgacaucgaggccugguccgacaccuacgacaccuucaagcucgccgacaccuacacccucgacgucgucguccuccuccucgcccucgccaagaagaacguccgcgagaacaagaagaagauccuccgcgagcucaugaacgucgccggccucuacuaccccaaggacuccgcccgcuccugcugccucgccuga

SEQ ID NO: 47725 - RNA, 2457 nt, Artificial Sequence
  derived and/or modified sequence opt2 from PLA2G4D__Homo_sapiens__NP_828848
auggagucccucucccccggcggcccccccggccaccccuaccagggcgaggccuccaccugcuggcagcucaccguccgcguccucgaggcccgcaaccuccgcugggccgaccuccucuccgaggccgaccccuacgucauccuccagcucuccaccgcccccggcaugaaguucaagaccaagacccucaccgacaccucccaccccgucuggaacgaggccuuccgcuuccucauccagucccaggucaagaacguccucgagcucuccaucuacgacgaggacuccgucaccgaggacgacaucugcuucaagguccucuacgacaucuccgagguccuccccggcaagcuccuccgcaagaccuucucccaguccccccagggcgaggaggagcucgacgucgaguuccucauggaggagaccuccgaccgccccgagaaccucaucaccaacaaggucaucgucgcccgcgagcucuccugccucgacguccaccucgacuccaccggcuccaccgccgucgucgccgaccaggacaagcucgagcucgagcucguccucaagggcuccuacgaggacacccagaccuccuuccucggcaccgccuccgccuuccgcuuccacuacauggccgcccucgagaccgagcucuccggccgccuccgcuccucccgcuccaacggcuggaacggcgacaacuccgccggcuaccucaccgucccccuccgcccccucaccaucggcaaggaggucaccauggacguccccgcccccaacgcccccggcguccgccuccagcucaaggccgagggcugccccgaggagcucgccguccaccucggcuucaaccucugcgccgaggagcaggccuuccucucccgccgcaagcaggucgucgccaaggcccucaagcaggcccuccagcucgaccgcgaccuccaggaggacgagguccccgucgucggcaucauggccaccggcggcggcgcccgcgccaugaccucccucuacggccaccuccucgcccuccagaagcucggccuccucgacugcgucaccuacuucuccggcaucuccggcuccaccuggaccauggcccaccucuacggcgaccccgaguggucccagcgcgaccucgagggccccauccgcuacgcccgcgagcaccucgccaaguccaagcucgaggucuucucccccgagcgccucgccuccuaccgccgcgagcucgagcuccgcgccgagcagggccaccccaccaccuucgucgaccucugggcccucguccucgaguccaugcuccacggccaggucauggaccagaagcucuccggccagcgcgccgcccucgagcgcggccagaacccccucccccucuaccucucccucaacgucaaggagaacaaccucgagacccucgacuucaaggagugggucgaguucucccccuacgaggucggcuuccucaaguacggcgccuucgucccccccgagcucuucggcuccgaguucuucaugggccgccucaugcgccgcauccccgagccccgcaucugcuuccucgaggccaucugguccaacaucuucucccucaaccuccucgacgccugguacgaccucaccuccuccggcgaguccuggaagcagcacaucaaggacaagacccgcucccucgagaaggagccccucaccaccuccggcaccuccucccgccucgaggccuccuggcuccagcccggcaccgcccucgcccaggccuucaagggcuuccucaccggccgcccccuccaccagcgcucccccaacuuccuccagggccuccagcuccaccaggacuacugcucccacaaggacuucuccaccugggccgacuaccagcucgacuccaugcccucccagcucacccccaaggagccccgccucugccucgucgacgccgccuacuucaucaacaccuccucccccuccauguuccgccccggccgccgccucgaccucauccucuccuucgacuacucccucuccgcccccuucgaggcccuccagcagaccgagcucuacugccgcgcccgcggccuccccuucccccgcgucgagcccuccccccaggaccagcaccagccccgcgagugccaccucuucuccgaccccgccugccccgaggcccccauccuccuccacuucccccucgucaacgccuccuucaaggaccacuccgcccccggcguccagcgcucccccgccgagcuccagggcggccaggucgaccucaccggcgccaccugccccuacacccucuccaacaugaccuacaaggaggaggacuucgagcgccuccuccgccucuccgacuacaacguccagaccucccagggcgccauccuccaggcccuccgcaccgcccucaagcaccgcacccucgaggcccgccccccccgcgcccagaccuga

SEQ ID NO: 47726 - RNA, 510 nt, Artificial Sequence
  derived and/or modified sequence opt2 from PLA2G5__Homo_sapiens__XP_011539888
auggagguccgcaccaagcgcccccgcaucggcaccgacaccaaccgccccuucgucgaggaggagauccagauggccauccgcacccccgagaugaagggccuccucccccucgccugguuccucgccugcuccguccccgccguccagggcggccuccucgaccucaaguccaugaucgagaaggucaccggcaagaacgcccucaccaacuacggcuucuacggcugcuacugcggcuggggcggccgcggcacccccaaggacggcaccgacuggugcugcugggcccacgaccacugcuacggccgccucgaggagaagggcugcaacauccgcacccaguccuacaaguaccgcuucgccuggggcgucgucaccugcgagcccggccccuucugccacgucaaccucugcgccugcgaccgcaagcucgucuacugccucaagcgcaaccuccgcuccuacaacccccaguaccaguacuuccccaacauccucugcuccuga

SEQ ID NO: 47727 - RNA, 2259 nt, Artificial Sequence
  derived and/or modified sequence opt2 from PLA2G6__Homo_sapiens__NP_001186491
augcaguucuucggccgccucgucaacaccuucuccggcgucaccaaccucuucuccaaccccuuccgcgucaaggaggucgccgucgccgacuacaccuccuccgaccgcguccgcgaggagggccagcucauccucuuccagaacacccccaaccgcaccugggacugcguccucgucaacccccgcaacucccaguccggcuuccgccucuuccagcucgagcucgaggccgacgcccucgucaacuuccaccaguacuccucccagcuccuccccuucuacgaguccuccccccagguccuccacaccgagguccuccagcaccucaccgaccucauccgcaaccaccccuccugguccgucgcccaccucgccgucgagcucggcauccgcgagugcuuccaccacucccgcaucaucuccugcgccaacugcgccgagaacgaggagggcugcaccccccuccaccucgccugccgcaagggcgacggcgagauccucgucgagcucguccaguacugccacacccagauggacgucaccgacuacaagggcgagaccgucuuccacuacgccguccagggcgacaacucccagguccuccagcuccucggccgcaacgccgucgccggccucaaccaggucaacaaccagggccucaccccccuccaccucgccugccagcucggcaagcaggagaugguccgcguccuccuccucugcaacgcccgcugcaacaucaugggccccaacggcuaccccauccacuccgccaugaaguucucccagaagggcugcgccgagaugaucaucuccauggacuccucccagauccacuccaaggacccccgcuacggcgccuccccccuccacugggccaagaacgccgagauggcccgcaugcuccucaagcgcggcugcaacgucaacuccaccuccuccgccggcaacaccgcccuccacgucgccgucaugcgcaaccgcuucgacugcgccaucguccuccucacccacggcgccaacgccgacgcccgcggcgagcacggcaacaccccccuccaccucgccauguccaaggacaacgucgagaugaucaaggcccucaucgucuucggcgccgaggucgacacccccaacgacuucggcgagacccccaccuuccucgccuccaagaucggccgccagcuccaggaccucaugcacaucucccgcgcccgcaagcccgccuucauccucggcuccaugcgcgacgagaagcgcacccacgaccaccuccucugccucgacggcggcggcgucaagggccucaucaucauccagcuccucaucgccaucgagaaggccuccggcgucgccaccaaggaccucuucgacugggucgccggcaccuccaccggcggcauccucgcccucgccauccuccacuccaaguccauggccuacaugcgcggcauguacuuccgcaugaaggacgaggucuuccgcggcucccgccccuacgaguccggcccccucgaggaguuccucaagcgcgaguucggcgagcacaccaagaugaccgacguccgcaagcccaaggucaugcucaccggcacccucuccgaccgccagcccgccgagcuccaccucuuccgcaacuacgacgcccccgagaccguccgcgagccccgcuucaaccagaacgucaaccuccgcccccccgcccagcccuccgaccagcucgucuggcgcgccgcccgcuccuccggcgccgcccccaccuacuuccgccccaacggccgcuuccucgacggcggccuccucgccaacaaccccacccucgacgccaugaccgagauccacgaguacaaccaggaccucauccgcaagggccaggccaacaaggucaagaagcucuccaucgucgucucccucggcaccggccgcuccccccagguccccgucaccugcgucgacgucuuccgccccuccaaccccugggagcucgccaagaccgucuucggcgccaaggagcucggcaagauggucgucgacugcugcaccgaccccgacggccgcgccgucgaccgcgcccgcgccuggugcgagauggucggcauccaguacuuccgccucaacccccagcucggcaccgacaucaugcucgacgaggucuccgacaccguccucgucaacgcccucugggagaccgaggucuacaucuacgagcaccgcgaggaguuccagaagcucauccagcuccuccucucccccuga

SEQ ID NO: 47728 - RNA, 1326 nt, Artificial Sequence
  derived and/or modified sequence opt2 from PLA2G7__Homo_sapiens__NP_005075
auggucccccccaagcuccacguccucuucugccucugcggcugccucgccgucgucuaccccuucgacuggcaguacaucaaccccgucgcccacaugaaguccuccgccugggucaacaagauccagguccucauggccgccgccuccuucggccagaccaagaucccccgcggcaacggccccuacuccgucggcugcaccgaccucauguucgaccacaccaacaagggcaccuuccuccgccucuacuaccccucccaggacaacgaccgccucgacacccucuggauccccaacaaggaguacuucuggggccucuccaaguuccucggcacccacuggcucaugggcaacauccuccgccuccucuucggcuccaugaccacccccgccaacuggaacuccccccuccgccccggcgagaaguacccccucgucgucuucucccacggccucggcgccuuccgcacccucuacuccgccaucggcaucgaccucgccucccacggcuucaucgucgccgccgucgagcaccgcgaccgcuccgccuccgccaccuacuacuucaaggaccaguccgccgccgagaucggcgacaaguccuggcucuaccuccgcacccucaagcaggaggaggagacccacauccgcaacgagcagguccgccagcgcgccaaggagugcucccaggcccucucccucauccucgacaucgaccacggcaagcccgucaagaacgcccucgaccucaaguucgacauggagcagcucaaggacuccaucgaccgcgagaagaucgccgucaucggccacuccuucggcggcgccaccgucauccagacccucuccgaggaccagcgcuuccgcugcggcaucgcccucgacgccuggauguucccccucggcgacgaggucuacucccgcaucccccagccccucuucuucaucaacuccgaguacuuccaguaccccgccaacaucaucaagaugaagaagugcuacucccccgacaaggagcgcaagaugaucaccauccgcggcuccguccaccagaacuucgccgacuucaccuucgccaccggcaagaucaucggccacaugcucaagcucaagggcgacaucgacuccaacgucgccaucgaccucuccaacaaggccucccucgccuuccuccagaagcaccucggccuccacaaggacuucgaccagugggacugccucaucgagggcgacgacgagaaccucauccccggcaccaacaucaacaccaccaaccagcacaucaugcuccagaacuccuccggcaucgagaaguacaacuga

SEQ ID NO: 47729 - RNA, 3975 nt, Artificial Sequence
  derived and/or modified sequence opt2 from PLA2R1__Homo_sapiens__NP_001007268
augcuccucucccccucccuccuccuccuccuccuccucggcgccccccgcggcugcgccgagggcgucgccgccgcccucacccccgagcgccuccucgaguggcaggacaagggcaucuucgucauccaguccgagucccucaagaagugcauccaggccggcaaguccguccucacccucgagaacugcaagcaggccaacaagcacaugcucuggaagugggucuccaaccacggccucuucaacaucggcggcuccggcugccucggccucaacuucuccgcccccgagcagccccucucccucuacgagugcgacuccacccucgucucccuccgcuggcgcugcaaccgcaagaugaucaccggcccccuccaguacuccguccaggucgcccacgacaacaccgucgucgccucccgcaaguacauccacaaguggaucuccuacggcuccggcggcggcgacaucugcgaguaccuccacaaggaccuccacaccaucaagggcaacacccacggcaugcccugcauguuccccuuccaguacaaccaccaguggcaccacgagugcacccgcgagggccgcgaggacgaccuccucuggugcgccaccaccucccgcuacgagcgcgacgagaaguggggcuucugccccgaccccaccuccgccgaggucggcugcgacaccaucugggagaaggaccucaacucccacaucugcuaccaguucaaccuccucuccucccucuccugguccgaggcccacuccuccugccagaugcagggcggcacccuccucuccaucaccgacgagaccgaggagaacuucauccgcgagcacauguccuccaagaccgucgaggucuggaugggccucaaccagcucgacgagcacgccggcuggcagugguccgacggcaccccccucaacuaccucaacuggucccccgaggucaacuucgagcccuucgucgaggaccacugcggcaccuucuccuccuucaugcccuccgccuggcgcucccgcgacugcgaguccacccuccccuacaucugcaagaaguaccucaaccacaucgaccacgagaucgucgagaaggacgccuggaaguacuacgccacccacugcgagcccggcuggaaccccuacaaccgcaacugcuacaagcuccagaaggaggagaagaccuggcacgaggcccuccgcuccugccaggccgacaacuccgcccucaucgacaucaccucccucgccgaggucgaguuccucgucacccuccucggcgacgagaacgccuccgagaccuggaucggccucuccuccaacaagauccccgucuccuucgagugguccaacgacuccuccgucaucuucaccaacuggcacacccucgagccccacaucuuccccaaccgcucccagcucugcgucuccgccgagcaguccgagggccacuggaaggucaagaacugcgaggagcgccucuucuacaucugcaagaaggccggccacguccucuccgacgccgaguccggcugccaggagggcugggagcgccacggcggcuucugcuacaagaucgacaccguccuccgcuccuucgaccaggccuccuccggcuacuacugcccccccgcccucgucaccaucaccaaccgcuucgagcaggccuucaucaccucccucaucuccuccgucgucaagaugaaggacuccuacuucuggaucgcccuccaggaccagaacgacaccggcgaguacaccuggaagcccgucggccagaagcccgagcccguccaguacacccacuggaacacccaccagccccgcuacuccggcggcugcgucgccaugcgcggccgccacccccucggccgcugggaggucaagcacugccgccacuucaaggccaugucccucugcaagcagcccgucgagaaccaggagaaggccgaguacgaggagcgcuggcccuuccaccccugcuaccucgacugggaguccgagcccggccucgccuccugcuucaaggucuuccacuccgagaagguccucaugaagcgcaccuggcgcgaggccgaggccuucugcgaggaguucggcgcccaccucgccuccuucgcccacaucgaggaggagaacuucgucaacgagcuccuccacuccaaguucaacuggaccgaggagcgccaguucuggaucggcuucaacaagcgcaacccccucaacgccggcuccugggagugguccgaccgcacccccgucgucuccuccuuccucgacaacaccuacuucggcgaggacgcccgcaacugcgccgucuacaaggccaacaagacccuccucccccuccacugcggcuccaagcgcgaguggaucugcaagaucccccgcgacgucaagcccaagauccccuucugguaccaguacgacguccccuggcucuucuaccaggacgccgaguaccucuuccacaccuucgccuccgaguggcucaacuucgaguucgucugcuccuggcuccacuccgaccuccucaccauccacuccgcccacgagcaggaguucauccacuccaagaucaaggcccucuccaaguacggcgccuccugguggaucggccuccaggaggagcgcgccaacgacgaguuccgcuggcgcgacggcacccccgucaucuaccagaacugggacaccggccgcgagcgcaccgucaacaaccagucccagcgcugcggcuucaucuccuccaucaccggccucuggggcuccgaggagugcuccgucuccaugcccuccaucugcaagcgcaagaaggucuggcucaucgagaagaagaaggacacccccaagcagcacggcaccugccccaagggcuggcucuacuucaacuacaagugccuccuccucaacauccccaaggaccccuccuccuggaagaacuggacccacgcccagcacuucugcgccgaggagggcggcacccucgucgccaucgaguccgaggucgagcaggccuucaucaccaugaaccucuucggccagaccaccuccgucuggaucggccuccagaacgacgacuacgagaccuggcucaacggcaagcccgucgucuacuccaacuggucccccuucgacaucaucaacauccccucccacaacaccaccgagguccagaagcacaucccccucugcgcccuccucuccuccaaccccaacuuccacuucaccggcaagugguacuucgaggacugcggcaaggagggcuacggcuucgucugcgagaagaugcaggacaccuccggccacggcgucaacaccuccgacauguaccccaugcccaacacccucgaguacggcaaccgcaccuacaagaucaucaacgccaacaugaccugguacgccgccaucaagaccugccucaugcacaaggcccagcucgucuccaucaccgaccaguaccaccaguccuuccucaccgucguccucaaccgccucggcuacgcccacuggaucggccucuucaccaccgacaacggccucaacuucgacugguccgacggcaccaaguccuccuucaccuucuggaaggacgaggaguccucccuccucggcgacugcgucuucgccgacuccaacggccgcuggcacuccaccgccugcgaguccuuccuccagggcgccaucugccacgucccccccgagacccgccaguccgagcaccccgagcucugcuccgagaccuccauccccuggaucaaguucaaguccaacugcuacuccuucuccaccguccucgacuccauguccuucgaggccgcccacgaguucugcaagaaggagggcuccaaccuccucaccaucaaggacgaggccgagaacgccuuccuccucgaggagcucuucgccuucggcuccuccguccagauggucuggcucaacgcccaguucgacggcaacuccaaguga

SEQ ID NO: 47730 - RNA, 2388 nt, Artificial Sequence
  derived and/or modified sequence opt2 from PLAA__Homo_sapiens__NP_001026859
augaccuccggcgccacccgcuaccgccucuccugcucccuccgcggccacgagcucgacguccgcggccucgucugcugcgccuacccccccggcgccuucgucuccgucucccgcgaccgcaccacccgccucugggcccccgacucccccaaccgcuccuucaccgagaugcacugcauguccggccacuccaacuucgucuccugcgucugcaucauccccuccuccgacaucuacccccacggccucaucgccaccggcggcaacgaccacaacaucugcaucuucucccucgacucccccaugccccucuacauccucaagggccacaagaacaccgucugcucccucuccuccggcaaguucggcacccuccucuccggcuccugggacaccaccgccaaggucuggcucaacgacaagugcaugaugacccuccagggccacaccgccgccgucugggccgucaagauccuccccgagcagggccucaugcucaccggcuccgccgacaagaccgucaagcucuggaaggccggccgcugcgagcgcaccuucuccggccacgaggacugcguccgcggccucgccauccucuccgagaccgaguuccucuccugcgccaacgacgccuccauccgccgcuggcagaucaccggcgagugccucgaggucuacuacggccacaccaacuacaucuacuccaucuccgucuuccccaacugccgcgacuucgucaccaccgccgaggaccgcucccuccgcaucuggaagcacggcgagugcgcccagaccauccgccuccccgcccaguccaucuggugcugcugcguccucgacaacggcgacaucgucgucggcgccuccgacggcaucauccgcgucuucaccgaguccgaggaccgcaccgccuccgccgaggagaucaaggccuucgagaaggagcucucccacgccaccaucgacuccaagaccggcgaccucggcgacaucaacgccgagcagcuccccggccgcgagcaccucaacgagcccggcacccgcgagggccagacccgccucauccgcgacggcgagaaggucgaggccuaccagugguccgucuccgagggccgcuggaucaagaucggcgacgucgucggcuccuccggcgccaaccagcagaccuccggcaagguccucuacgagggcaaggaguucgacuacgucuucuccaucgacgucaacgagggcggccccuccuacaagcuccccuacaacaccuccgacgaccccuggcucaccgccuacaacuuccuccagaagaacgaccucaaccccauguuccucgaccaggucgccaaguucaucaucgacaacaccaagggccagaugcucggccucggcaaccccuccuucuccgaccccuucaccggcggcggccgcuacguccccggcuccuccggcuccuccaacacccuccccaccgccgaccccuucaccggcgccggccgcuacguccccggcuccgccuccaugggcaccaccauggccggcgucgaccccuucaccggcaacuccgccuaccgcuccgccgccuccaagaccaugaacaucuacuuccccaagaaggaggccgucaccuucgaccaggccaaccccacccagauccucggcaagcucaaggagcucaacggcaccgcccccgaggagaagaagcucaccgaggacgaccucauccuccucgagaagauccucucccucaucugcaacuccuccuccgagaagcccaccguccagcagcuccagauccucuggaaggccaucaacugccccgaggacaucgucuuccccgcccucgacauccuccgccucuccaucaagcaccccuccgucaacgagaacuucugcaacgagaaggagggcgcccaguucuccucccaccucaucaaccuccucaaccccaagggcaagcccgccaaccagcuccucgcccuccgcaccuucugcaacugcuucgucggccaggccggccagaagcucaugaugucccagcgcgagucccucaugucccacgccaucgagcucaaguccggcuccaacaagaacauccacaucgcccucgccacccucgcccucaacuacuccgucugcuuccacaaggaccacaacaucgagggcaaggcccagugccucucccucaucuccaccauccucgaggucguccaggaccucgaggccaccuuccgccuccucgucgcccucggcacccucaucuccgacgacuccaacgccguccagcucgccaagucccucggcgucgacucccagaucaagaaguacuccuccgucuccgagcccgccaaggucuccgagugcugccgcuucauccucaaccuccucuga

SEQ ID NO: 47731 - RNA, 639 nt, Artificial Sequence
  derived and/or modified sequence opt2 from PLAC1__Homo_sapiens__NP_068568
augaaggucuucaaguucaucggccucaugauccuccucaccuccgccuucuccgccggcuccggccagucccccaugaccguccucugcuccaucgacugguucauggucaccguccaccccuucaugcucaacaacgacgucugcguccacuuccacgagcuccaccucggccucggcugcccccccaaccacguccagccccacgccuaccaguucaccuaccgcgucaccgagugcggcauccgcgccaaggccgucucccaggacauggucaucuacuccaccgagauccacuacuccuccaagggcacccccuccaaguucgucauccccgucuccugcgccgccccccagaagucccccuggcucaccaagcccugcuccaugcgcgucgccuccaagucccgcgccaccgcccagaaggacgagaagugcuacgaggucuucucccucucccaguccucccagcgccccaacugcgacugcccccccugcgucuucuccgaggaggagcacacccagguccccugccaccaggccggcgcccaggaggcccagccccuccagcccucccacuuccucgacaucuccgaggacuggucccuccacaccgacgacaugaucggcuccauguga

SEQ ID NO: 47732 - RNA, 348 nt, Artificial Sequence
  derived and/or modified sequence opt2 from PLAC8__Homo_sapiens__NP_001124187
augcaggcccaggcccccgucgucgucgucacccagcccggcgucggccccggccccgccccccagaacuccaacuggcagaccggcaugugcgacugcuucuccgacugcggcgucugccucugcggcaccuucugcuuccccugccucggcugccaggucgccgccgacaugaacgagugcugccucugcggcaccuccgucgccaugcgcacccucuaccgcacccgcuacggcauccccggcuccaucugcgacgacuacauggccacccucugcugcccccacugcacccucugccagaucaagcgcgacaucaaccgccgccgcgccaugcgcaccuucuga

SEQ ID NO: 47733 - RNA, 1503 nt, Artificial Sequence
  derived and/or modified sequence opt2 from PLAG1__Homo_sapiens__NP_001108106
auggccaccgucauccccggcgaccucuccgagguccgcgacacccagaagguccccuccggcaagcgcaagcgcggcgagaccaagccccgcaagaacuuccccugccagcucugcgacaaggccuucaacuccgucgagaagcucaagguccacuccuacucccacaccggcgagcgccccuacaagugcauccagcaggacugcaccaaggccuucgucuccaaguacaagcuccagcgccacauggccacccacucccccgagaagacccacaagugcaacuacugcgagaagauguuccaccgcaaggaccaccucaagaaccaccuccacacccacgaccccaacaaggagaccuucaagugcgaggagugcggcaagaacuacaacaccaagcucggcuucaagcgccaccucgcccuccacgccgccaccuccggcgaccucaccugcaaggucugccuccagaccuucgaguccaccggcguccuccucgagcaccucaagucccacgccggcaaguccuccggcggcgucaaggagaagaagcaccagugcgagcacugcgaccgccgcuucuacacccgcaaggacguccgccgccacauggucguccacaccggccgcaaggacuuccucugccaguacugcgcccagcgcuucggccgcaaggaccaccucacccgccacaugaagaagucccacaaccaggagcuccucaaggucaagaccgagcccgucgacuuccucgaccccuucaccugcaacgucuccguccccaucaaggacgagcuccuccccgucaugucccuccccuccuccgagcuccucuccaagcccuucaccaacacccuccagcucaaccucuacaacacccccuuccaguccaugcaguccuccggcuccgcccaccagaugaucaccacccucccccucggcaugaccugccccaucgacauggacaccguccaccccucccaccaccucuccuucaaguaccccuucuccuccaccuccuacgccaucuccauccccgagaaggagcagccccucaagggcgagaucgaguccuaccucauggagcuccagggcggcguccccuccuccucccaggacucccaggccuccuccuccuccaagcucggccucgacccccagaucggcucccucgacgacggcgccggcgaccucucccucuccaaguccuccaucuccaucuccgacccccucaacacccccgcccucgacuucucccagcucuucaacuucaucccccucaacggcccccccuacaacccccucuccgucggcucccucggcauguccuacucccaggaggaggcccacuccuccgucucccagcuccccccccagacccaggaccuccaggaccccgccaacaccaucggccucggcucccuccacucccucuccgccgccuucaccuccucccucuccaccuccaccacccucccccgcuuccaccaggccuuccaguga

SEQ ID NO: 47734 - RNA, 1236 nt, Artificial Sequence
  derived and/or modified sequence opt2 from PLAGL1__Homo_sapiens__NP_001275966
auggccacccacuccccccagaagucccaccagugcgcccacugcgagaagaccuucaaccgcaaggaccaccucaagaaccaccuccagacccacgaccccaacaagauggccuucggcugcgaggagugcggcaagaaguacaacaccaugcucggcuacaagcgccaccucgcccuccacgccgccuccuccggcgaccucaccugcggcgucugcgcccucgagcucggcuccaccgagguccuccucgaccaccucaaggcccacgccgaggagaagccccccuccggcaccaaggagaagaagcaccagugcgaccacugcgagcgcugcuucuacacccgcaaggacguccgccgccaccucgucguccacaccggcugcaaggacuuccucugccaguucugcgcccagcgcuucggccgcaaggaccaccucacccgccacaccaagaagacccacucccaggagcucaugaaggagucccuccagaccggcgaccuccucuccaccuuccacaccaucucccccuccuuccagcucaaggccgccgcccucccccccuucccccucggcgccuccgcccagaacggccucgccuccucccuccccgccgagguccacucccucacccucuccccccccgagcaggccgcccagcccaugcagccccuccccgagucccucgccucccuccaccccuccgucucccccggcucccccccccccccccuccccaaccacaaguacaacaccaccuccaccuccuacuccccccucgccucccucccccucaaggccgacaccaagggcuucugcaacaucucccucuucgaggaccucccccuccaggagccccaguccccccagaagcucaaccccggcuucgaccucgccaagggcaacgccggcaaggucaaccuccccaaggagcuccccgccgacgccgucaaccucaccauccccgccucccucgaccucuccccccuccucggcuucuggcagcuccccccccccgccacccagaacaccuucggcaacuccacccucgcccucggccccggcgagucccucccccaccgccucuccugccucggccagcagcagcaggagcccccccucgccaugggcaccgucucccucggccagcucccccucccccccaucccccacgucuucuccgccggcaccggcuccgccauccucccccacuuccaccacgccuuccgcuga

SEQ ID NO: 47735 - RNA, 1491 nt, Artificial Sequence
  derived and/or modified sequence opt2 from PLAGL2__Homo_sapiens__NP_002648
augaccaccuucuucaccuccgucccccccuggauccaggacgccaagcaggaggaggaggucggcuggaagcucgucccccgcccccgcggccgcgaggccgagucccaggucaagugccagugcgagaucuccggcacccccuucuccaacggcgagaagcuccgcccccacucccucccccagcccgagcagcgccccuacuccugcccccagcuccacugcggcaaggccuucgccuccaaguacaagcucuaccgccacauggccacccacuccgcccagaagccccaccagugcauguacugcgacaagauguuccaccgcaaggaccaccuccgcaaccaccuccagacccacgaccccaacaaggaggcccuccacugcuccgagugcggcaagaacuacaacaccaagcucggcuaccgccgccaccucgccaugcacgccgccuccuccggcgaccucuccugcaaggucugccuccagaccuucgaguccacccaggcccuccucgagcaccucaaggcccacucccgccgcgucgccggcggcgccaaggagaagaagcaccccugcgaccacugcgaccgccgcuucuacacccgcaaggacguccgccgccaccucgucguccacaccggccgcaaggacuuccucugccaguacugcgcccagcgcuucggccgcaaggaccaccucacccgccacgucaagaagucccacucccaggagcuccucaagaucaagaccgagcccgucgacaugcucggccuccucuccugcuccuccaccgucuccgucaaggaggagcucucccccguccucugcauggccucccgcgacgucaugggcaccaaggccuuccccggcaugcuccccaugggcauguacggcgcccacauccccaccaugcccuccaccggcgucccccacucccucguccacaacacccuccccaugggcauguccuacccccucgaguccucccccaucuccucccccgcccagcucccccccaaguaccagcucggcuccaccuccuaccuccccgacaagcuccccaaggucgaggucgacuccuuccucgccgagcuccccggcucccucucccucuccuccgccgagccccagcccgccuccccccagcccgccgccgccgccgcccuccucgacgaggcccuccucgccaagucccccgccaaccucuccgaggcccucugcgccgccaacgucgacuucucccaccuccucggcuuccucccccucaaccucccccccugcaacccccccggcgccaccggcggccucgucaugggcuacucccaggccgaggcccagccccuccucaccacccuccaggcccagccccaggacucccccggcgccggcggcccccucaacuucggcccccuccacucccucccccccgucuucaccuccggccucuccuccaccacccucccccgcuuccaccaggccuuccaguga

SEQ ID NO: 47736 - RNA, 1689 nt, Artificial Sequence
  derived and/or modified sequence opt2 from PLAT__Homo_sapiens__NP_000921
auggacgccaugaagcgcggccucugcugcguccuccuccucugcggcgccgucuucgucucccccucccaggagauccacgcccgcuuccgccgcggcgcccgcuccuaccaggucaucugccgcgacgagaagacccagaugaucuaccagcagcaccaguccuggcuccgccccguccuccgcuccaaccgcgucgaguacugcuggugcaacuccggccgcgcccagugccacuccguccccgucaaguccugcuccgagccccgcugcuucaacggcggcaccugccagcaggcccucuacuucuccgacuucgucugccagugccccgagggcuucgccggcaagugcugcgagaucgacacccgcgccaccugcuacgaggaccagggcaucuccuaccgcggcaccugguccaccgccgaguccggcgccgagugcaccaacuggaacuccuccgcccucgcccagaagcccuacuccggccgccgccccgacgccauccgccucggccucggcaaccacaacuacugccgcaaccccgaccgcgacuccaagcccuggugcuacgucuucaaggccggcaaguacuccuccgaguucugcuccacccccgccugcuccgagggcaacuccgacugcuacuucggcaacggcuccgccuaccgcggcacccacucccucaccgaguccggcgccuccugccuccccuggaacuccaugauccucaucggcaaggucuacaccgcccagaaccccuccgcccaggcccucggccucggcaagcacaacuacugccgcaaccccgacggcgacgccaagcccuggugccacguccucaagaaccgccgccucaccugggaguacugcgacguccccuccugcuccaccugcggccuccgccaguacucccagccccaguuccgcaucaagggcggccucuucgccgacaucgccucccaccccuggcaggccgccaucuucgccaagcaccgccgcucccccggcgagcgcuuccucugcggcggcauccucaucuccuccugcuggauccucuccgccgcccacugcuuccaggagcgcuuccccccccaccaccucaccgucauccucggccgcaccuaccgcgucguccccggcgaggaggagcagaaguucgaggucgagaaguacaucguccacaaggaguucgacgacgacaccuacgacaacgacaucgcccuccuccagcucaaguccgacuccucccgcugcgcccaggaguccuccgucguccgcaccgucugccucccccccgccgaccuccagcuccccgacuggaccgagugcgagcucuccggcuacggcaagcacgaggcccucucccccuucuacuccgagcgccucaaggaggcccacguccgccucuaccccuccucccgcugcaccucccagcaccuccucaaccgcaccgucaccgacaacaugcucugcgccggcgacacccgcuccggcggcccccaggccaaccuccacgacgccugccagggcgacuccggcggcccccucgucugccucaacgacggccgcaugacccucgucggcaucaucuccuggggccucggcugcggccagaaggacguccccggcgucuacaccaaggucaccaacuaccucgacuggauccgcgacaacaugcgccccuga

SEQ ID NO: 47737 - RNA, 1245 nt, Artificial Sequence
  derived and/or modified sequence opt2 from PLAU__Homo_sapiens__NP_001138503
auggucuuccaccuccgcacccgcuacgagcaggccaacugcgacugccucaacggcggcaccugcgucuccaacaaguacuucuccaacauccacuggugcaacugccccaagaaguucggcggccagcacugcgagaucgacaaguccaagaccugcuacgagggcaacggccacuucuaccgcggcaaggccuccaccgacaccaugggccgccccugccuccccuggaacuccgccaccguccuccagcagaccuaccacgcccaccgcuccgacgcccuccagcucggccucggcaagcacaacuacugccgcaaccccgacaaccgccgccgccccuggugcuacguccaggucggccucaagccccucguccaggagugcaugguccacgacugcgccgacggcaagaagcccuccuccccccccgaggagcucaaguuccagugcggccagaagacccuccgcccccgcuucaagaucaucggcggcgaguucaccaccaucgagaaccagcccugguucgccgccaucuaccgccgccaccgcggcggcuccgucaccuacgucugcggcggcucccucaucucccccugcugggucaucuccgccacccacugcuucaucgacuaccccaagaaggaggacuacaucgucuaccucggccgcucccgccucaacuccaacacccagggcgagaugaaguucgaggucgagaaccucauccuccacaaggacuacuccgccgacacccucgcccaccacaacgacaucgcccuccucaagauccgcuccaaggagggccgcugcgcccagcccucccgcaccauccagaccaucugccuccccuccauguacaacgacccccaguucggcaccuccugcgagaucaccggcuucggcaaggagaacuccaccgacuaccucuaccccgagcagcucaagaugaccgucgucaagcucaucucccaccgcgagugccagcagccccacuacuacggcuccgaggucaccaccaagaugcucugcgccgccgacccccaguggaagaccgacuccugccagggcgacuccggcggcccccucgucugcucccuccagggccgcaugacccucaccggcaucgucuccuggggccgcggcugcgcccucaaggacaagcccggcgucuacacccgcgucucccacuuccuccccuggauccgcucccacaccaaggaggagaacggccucgcccucuga

SEQ ID NO: 47738 - RNA, 846 nt, Artificial Sequence
  derived and/or modified sequence opt2 from PLAUR__Homo_sapiens__NP_001005376
augggccaccccccccuccucccccuccuccuccuccuccacaccugcguccccgccuccuggggccuccgcugcaugcagugcaagaccaacggcgacugccgcgucgaggagugcgcccucggccaggaccucugccgcaccaccaucguccgccucugggaggagggcgaggagcucgagcucgucgagaaguccugcacccacuccgagaagaccaaccgcacccucuccuaccgcaccggccucaagaucaccucccucaccgaggucgucugcggccucgaccucugcaaccagggcaacuccggccgcgccgucaccuacucccgcucccgcuaccucgagugcaucuccugcggcuccuccgacauguccugcgagcgcggccgccaccagucccuccagugccgcucccccgaggagcagugccucgacgucgucacccacuggauccaggagggcgaggagggccgccccaaggacgaccgccaccuccgcggcugcggcuaccuccccggcugccccggcuccaacggcuuccacaacaacgacaccuuccacuuccucaagugcugcaacaccaccaagugcaacgagggccccauccucgagcucgagaaccucccccagaacggccgccagugcuacuccugcaagggcaacuccacccacggcugcuccuccgaggagaccuuccucaucgacugccgcggccccaugaaccagugccucgucgccaccggcacccacgagcgcucccucuggggcuccuggcuccccugcaaguccaccaccgcccuccgcccccccugcugcgaggaggcccaggccacccacgucuga

SEQ ID NO: 47739 - RNA, 4344 nt, Artificial Sequence
  derived and/or modified sequence opt2 from PLB1__Homo_sapiens__NP_001164056
augggccuccgccccggcaucuuccuccucgagcuccuccuccuccucggccagggcaccccccagauccacaccuccccccgcaaguccacccucgagggccagcucuggcccgagacccucaagaacucccccuuccccugcaaccccaacaagcucggcgucaacaugcccuccaaguccguccacucccucaagcccuccgacaucaaguucgucgccgccaucggcaaccucgagaucccccccgaccccggcaccggcgaccucgagaagcaggacuggaccgagcgcccccagcaggucugcaugggcgucaugaccguccucuccgacaucauccgcuacuucucccccuccguccccaugcccgucugccacaccggcaagcgcgucaucccccacgacggcgccgaggaccucuggauccaggcccaggagcucguccgcaacaugaaggagaaccuccagcucgacuuccaguucgacuggaagcucaucaacgucuucuucuccaacgccucccagugcuaccucugccccuccgcccagcaggcccccucccucuccaccguccuccucucccagaacggccucgccgccggcggcgucgacgagcucaugggcguccucgacuaccuccagcaggaggucccccgcgccuucgucaaccucgucgaccucuccgaggucgccgaggucucccgccaguaccacggcaccuggcucucccccgcccccgagcccugcaacugcuccgaggagaccacccgccucgccaaggucgucaugcagugguccuaccaggaggccuggaacucccuccucgccuccucccgcuacuccgagcaggaguccuucaccgucgucuuccagcccuucuucuacgagaccacccccucccuccacuccgaggacccccgccuccaggacuccaccacccucgccuggcaccucuggaaccgcaugauggagcccgccggcgagaaggacgagccccucuccgucaagcacggccgccccaugaagugccccucccaggagucccccuaccucuucuccuaccgcaacuccaacuaccucacccgccuccagaagccccaggacaagcucgagguccgcgagggcgccgagauccgcugccccgacaaggaccccuccgacaccguccccaccuccguccaccgccucaagcccgccgacaucaacgucaucggcgcccucggcgacucccucaccgccggcaacggcgccggcuccacccccggcaacguccucgacguccucacccaguaccgcggccucuccugguccgucggcggcgacgagaacaucggcaccgucaccacccucgccaacauccuccgcgaguucaaccccucccucaagggcuucuccgucggcaccggcaaggagaccucccccaacgccuuccucaaccaggccgucgccggcggccgcgccgaggaccuccccguccaggcccgccgccucgucgaccucaugaagaacgacacccgcauccacuuccaggaggacuggaagaucaucacccucuucaucggcggcaacgaccucugcgacuucugcaacgaccucgucccccgcgccuucgucaaccucgucaccguccucgagaucgucaaccuccgcgagcucuaccaggagaagaaggucuacugcccccgcaugauccuccgcucccucugccccugcguccucaaguucgacgacaacuccaccgagcucgccacccucaucgaguucaacaagaaguuccaggagaagacccaccagcucaucgaguccggccgcuacgacacccgcgaggacuucaccgucgucguccagcccuucuucgagaacgucgacaugcccaagaccuccgagggccuccccgacaacuccuucuucgcccccgacugcuuccacuucuccuccaagucccacucccgcgccgccuccgcccucuggaacaacaugcucgagcccgucggccagaagaccacccgccacaaguucgagaacaagaucaacaucaccugccccaaccagguccagcccuuccuccgcaccuacaagaacuccaugcagggccacggcaccuggcuccccugccgcgaccgcgcccccuccgcccuccaccccaccuccguccacgcccuccgccccgccgacauccaggucgucgccgcccucggcgacucccucaccgccggcaacggcaucggcuccaagcccgacgaccuccccgacgucaccacccaguaccgcggccucuccuacuccgccggcggcgacggcucccucgagaacgucaccacccuccccaacauccuccgcgaguucaaccgcaaccucaccggcuacgccgucggcaccggcgacgccaacgacaccaacgccuuccucaaccaggccguccccggcgccaaggccgaggaccucaugucccagguccagacccucaugcagaagaugaaggacgaccaccgcgucaacuuccacgaggacuggaaggucaucaccguccucaucggcggcuccgaccucugcgacuacugcaccgacuccaaccucuacuccgccgccaacuucguccaccaccuccgcaacgcccucgacguccuccaccgcgaggucccccgcguccucgucaaccucgucgacuuccucaaccccaccaucaugcgccaggucuuccucggcaaccccgacaagugccccguccagcaggccuccguccucugcaacugcguccucacccuccgcgagaacucccaggagcucgcccgccucgaggccuucucccgcgccuaccgcuccuccaugcgcgagcucgucggcuccggccgcuacgacacccaggaggacuucuccgucguccuccagcccuucuuccagaacauccagcuccccguccucgccgacggccuccccgacaccuccuucuucgcccccgacugcauccaccccaaccagaaguuccacucccagcucgcccgcgcccucuggaccaacaugcucgagccccucggcuccaagaccgagacccucgaccuccgcgccgagaugcccaucaccugccccacccagaacgagcccuuccuccgcaccccccgcaacuccaacuacaccuaccccaucaagcccgccaucgagaacuggggcuccgacuuccucugcaccgaguggaaggccuccaacuccguccccaccuccguccaccagcuccgccccgccgacaucaaggucgucgccgcccucggcgacucccucaccaccgccgucggcgcccgccccaacaacuccuccgaccuccccaccuccuggcgcggccucuccugguccaucggcggcgacggcaaccucgagacccacaccacccuccccaacauccucaagaaguucaaccccuaccuccucggcuucuccaccuccaccugggagggcaccgccggccucaacgucgccgccgagggcgcccgcgcccgcgacaugcccgcccaggccugggaccucgucgagcgcaugaagaacucccccgacaucaaccucgagaaggacuggaagcucgucacccucuucaucggcgucaacgaccucugccacuacugcgagaaccccgaggcccaccucgccaccgaguacguccagcacauccagcaggcccucgacauccucuccgaggagcucccccgcgccuucgucaacgucgucgaggucauggagcucgccucccucuaccagggccagggcggcaagugcgccaugcucgccgcccagaacaacugcaccugccuccgccacucccaguccucccucgagaagcaggagcucaagaaggucaacuggaaccuccagcacggcaucuccuccuucuccuacuggcaccaguacacccagcgcgaggacuucgccgucgucguccagcccuucuuccagaacacccucaccccccucaacgagcgcggcgacaccgaccucaccuucuucuccgaggacugcuuccacuucuccgaccgcggccacgccgagauggccaucgcccucuggaacaacaugcucgagcccgucggccgcaagaccaccuccaacaacuucacccacucccgcgccaagcucaagugccccucccccgagucccccuaccucuacacccuccgcaacucccgccuccuccccgaccaggccgaggaggcccccgagguccucuacugggccguccccgucgccgccggcgucggccucgucgucggcaucaucggcaccgucgucuggcgcugccgccgcggcggccgccgcgaggacccccccaugucccuccgcaccgucgcccucuga

SEQ ID NO: 47740 - RNA, 1662 nt, Artificial Sequence
  derived and/or modified sequence opt2 from PLBD1__Homo_sapiens__NP_079105
augacccgcggcggccccggcggccgccccggccucccccagccccccccccuccuccuccuccuccuccuccucccccuccuccucgucaccgccgagccccccaagcccgccggcgucuacuacgccaccgccuacuggaugcccgccgagaagaccguccaggucaagaacgucauggacaagaacggcgacgccuacggcuucuacaacaacuccgucaagaccaccggcuggggcauccucgagauccgcgccggcuacggcucccagacccucuccaacgagaucaucauguucgucgccggcuuccucgagggcuaccucaccgccccccacaugaacgaccacuacaccaaccucuacccccagcucaucaccaagcccuccaucauggacaagguccaggacuucauggagaagcaggacaaguggacccgcaagaacaucaaggaguacaagaccgacuccuucuggcgccacaccggcuacgucauggcccagaucgacggccucuacgucggcgccaagaagcgcgccauccucgagggcaccaagcccaugacccucuuccagauccaguuccucaacuccgucggcgaccuccucgaccucauccccucccucucccccaccaagaacggcucccucaaggucuucaagcgcugggacaugggccacugcuccgcccucaucaagguccuccccggcuucgagaacauccucuucgcccacuccuccugguacaccuacgccgccaugcuccgcaucuacaagcacugggacuucaacgucaucgacaaggacaccuccuccucccgccucuccuucuccuccuaccccggcuuccucgagucccucgacgacuucuacauccucuccuccggccucauccuccuccagaccaccaacuccgucuucaacaagacccuccucaagcaggucauccccgagacccuccucuccuggcagcgcguccgcgucgccaacaugauggccgacuccggcaagcgcugggccgacaucuucuccaaguacaacuccggcaccuacaacaaccaguacaugguccucgaccucaagaaggucaagcucaaccacucccucgacaagggcacccucuacaucgucgagcagauccccaccuacgucgaguacuccgagcagaccgacguccuccgcaagggcuacuggcccuccuacaacguccccuuccacgagaagaucuacaacugguccggcuacccccuccucguccagaagcucggccucgacuacuccuacgaccucgccccccgcgccaagaucuuccgccgcgaccagggcaaggucaccgacaccgccuccaugaaguacaucaugcgcuacaacaacuacaagaaggaccccuacucccgcggcgaccccugcaacaccaucugcugccgcgaggaccucaacucccccaaccccucccccggcggcugcuacgacaccaaggucgccgacaucuaccucgccucccaguacaccuccuacgccaucuccggccccaccguccagggcggccuccccgucuuccgcugggaccgcuucaacaagacccuccaccagggcaugcccgaggucuacaacuucgacuucaucaccaugaagcccauccucaagcucgacaucaaguga

SEQ ID NO: 47741 - RNA, 3651 nt, Artificial Sequence
  derived and/or modified sequence opt2 from PLCB1__Homo_sapiens__NP_056007
auggccggcgcccagcccggcguccacgcccuccagcucaagcccgucugcgucuccgacucccucaagaagggcaccaaguucgucaagugggacgacgacuccaccaucgucacccccaucauccuccgcaccgacccccagggcuucuucuucuacuggaccgaccagaacaaggagaccgagcuccucgaccucucccucgucaaggacgcccgcugcggccgccacgccaaggcccccaaggaccccaagcuccgcgagcuccucgacgucggcaacaucggccgccucgagcagcgcaugaucaccgucgucuacggccccgaccucgucaacaucucccaccucaaccucgucgccuuccaggaggaggucgccaaggaguggaccaacgaggucuucucccucgccaccaaccuccucgcccagaacaugucccgcgacgccuuccucgagaaggccuacaccaagcucaagcuccaggucacccccgagggccgcaucccccucaagaacaucuaccgccucuucuccgccgaccgcaagcgcgucgagaccgcccucgaggccugcucccuccccuccucccgcaacgacuccaucccccaggaggacuucacccccgaggucuaccgcgucuuccucaacaaccucugcccccgccccgagaucgacaacaucuucuccgaguucggcgccaaguccaagcccuaccucaccgucgaccagaugauggacuucaucaaccucaagcagcgcgacccccgccucaacgagauccucuaccccccccucaagcaggagcagguccagguccucaucgagaaguacgagcccaacaacucccucgcccgcaagggccagaucuccgucgacggcuucaugcgcuaccucuccggcgaggagaacggcgucgucucccccgagaagcucgaccucaacgaggacaugucccagccccucucccacuacuucaucaacuccucccacaacaccuaccucaccgccggccagcucgccggcaacuccuccgucgagauguaccgccagguccuccucuccggcugccgcugcgucgagcucgacugcuggaagggccgcaccgccgaggaggagcccgucaucacccacggcuucaccaugaccaccgagaucuccuucaaggaggucaucgaggccaucgccgagugcgccuucaagaccucccccuuccccauccuccucuccuucgagaaccacgucgacucccccaagcagcaggccaagauggccgaguacugccgccucaucuucggcgacgcccuccucauggagccccucgagaaguacccccucgaguccggcgucccccuccccucccccauggaccucauguacaagauccucgucaagaacaagaagaagucccacaaguccuccgagggcuccggcaagaagaagcucuccgagcaggccuccaacaccuacuccgacuccuccuccauguucgagcccuccucccccggcgccggcgaggccgacaccgaguccgacgacgacgacgacgacgacgacugcaagaaguccuccauggacgagggcaccgccggcuccgaggccauggccaccgaggagauguccaaccucgucaacuacauccagcccgucaaguucgaguccuucgagaucuccaagaagcgcaacaaguccuucgagauguccuccuucgucgagaccaagggccucgagcagcucaccaagucccccgucgaguucgucgaguacaacaagaugcagcucucccgcaucuaccccaagggcacccgcgucgacuccuccaacuacaugccccagcucuucuggaacgccggcugccagauggucgcccucaacuuccagaccauggaccucgccaugcagaucaacaugggcauguacgaguacaacggcaaguccggcuaccgccucaagcccgaguucaugcgccgccccgacaagcacuucgaccccuucaccgagggcaucgucgacggcaucgucgccaacacccucuccgucaagaucaucuccggccaguuccucuccgacaagaaggucggcaccuacgucgaggucgacauguucggccuccccgucgacacccgccgcaaggccuucaagaccaagaccucccagggcaacgccgucaaccccgucugggaggaggagcccaucgucuucaagaaggucguccuccccacccucgccugccuccgcaucgccgucuacgaggagggcggcaaguucaucggccaccgcauccuccccguccaggccauccgccccggcuaccacuacaucugccuccgcaacgagcgcaaccagccccucacccuccccgccgucuucgucuacaucgaggucaaggacuacguccccgacaccuacgccgacgucaucgaggcccucuccaaccccauccgcuacgucaaccucauggagcagcgcgccaagcagcucgccgcccucacccucgaggacgaggaggaggucaagaaggaggccgaccccggcgagacccccuccgaggcccccuccgaggcccgcaccacccccgccgagaacggcgucaaccacaccaccacccucacccccaagccccccucccaggcccuccacucccagcccgcccccggcuccgucaaggcccccgccaagaccgaggaccucauccaguccguccucaccgaggucgaggcccagaccaucgaggagcucaagcagcagaaguccuucgucaagcuccagaagaagcacuacaaggagaugaaggaccucgucaagcgccaccacaagaagaccaccgaccucaucaaggagcacaccaccaaguacaacgagauccagaacgacuaccuccgccgccgcgccgcccucgagaaguccgccaagaaggacuccaagaagaaguccgagcccuccucccccgaccacggcuccuccaccaucgagcaggaccucgccgcccucgacgccgagaugacccagaagcucaucgaccucaaggacaagcagcagcagcagcuccucaaccuccgccaggagcaguacuacuccgagaaguaccagaagcgcgagcacaucaagcuccucauccagaagcucaccgacgucgccgaggagugccagaacaaccagcucaagaagcucaaggagaucugcgagaaggagaagaaggagcucaagaagaagauggacaagaagcgccaggagaagaucaccgaggccaaguccaaggacaagucccagauggaggaggagaagaccgagaugauccgcuccuacauccaggaggucguccaguacaucaagcgccucgaggaggcccaguccaagcgccaggagaagcucgucgagaagcacaaggagauccgccagcagauccucgacgagaagcccaagcuccaggucgagcucgagcaggaguaccaggacaaguucaagcgccucccccucgagauccucgaguucguccaggaggccaugaagggcaagaucuccgaggacuccaaccacggcuccgccccccucucccucuccuccgaccccggcaaggucaaccacaagacccccuccuccgaggagcucggcggcgacauccccggcaaggaguucgacaccccccucuga

SEQ ID NO: 47742 - RNA, 3546 nt, Artificial Sequence
  derived and/or modified sequence opt2 from PLCB2__Homo_sapiens__NP_001271226
augucccuccucaaccccguccuccucccccccaaggucaaggccuaccucucccagggcgagcgcuucaucaagugggacgacgagaccaccgucgccucccccgucauccuccgcgucgaccccaagggcuacuaccucuacuggaccuaccaguccaaggagauggaguuccucgacaucaccuccauccgcgacacccgcuucggcaaguucgccaagaugcccaagucccagaagcuccgcgacgucuucaacauggacuuccccgacaacuccuuccuccucaagacccucaccgucgucuccggccccgacauggucgaccucaccuuccacaacuucgucuccuacaaggagaacgucggcaaggccugggccgaggacguccucgcccucgucaagcacccccucaccgccaacgccucccgcuccaccuuccucgacaagauccucgucaagcucaagaugcagcucaacuccgagggcaagauccccgucaagaacuucuuccagauguuccccgccgaccgcaagcgcgucgaggccgcccucuccgccugccaccuccccaagggcaagaacgacgccaucaaccccgaggacuuccccgagcccgucuacaaguccuuccucaugucccucugcccccgccccgagaucgacgagaucuucaccuccuaccacgccaaggccaagcccuacaugaccaaggagcaccucaccaaguucaucaaccagaagcagcgcgacucccgccucaacucccuccucuucccccccgcccgccccgaccagguccagggccucaucgacaaguacgagcccuccggcaucaacgcccagcgcggccagcucucccccgagggcauggucugguuccucugcggccccgagaacuccguccucgcccaggacaagcuccuccuccaccacgacaugacccagccccucaaccacuacuucaucaacuccucccacaacaccuaccucaccgccggccaguucuccggccucuccuccgccgagauguaccgccagguccuccucuccggcugccgcugcgucgagcucgacugcuggaagggcaagccccccgacgaggagcccaucaucacccacggcuucaccaugaccaccgacaucuucuucaaggaggccaucgaggccaucgccgaguccgccuucaagaccucccccuaccccaucauccucuccuucgagaaccacgucgacuccccccgccagcaggccaagauggccgaguacugccgcaccaucuucggcgacaugcuccucaccgagccccucgagaaguucccccucaagcccggcgucccccuccccucccccgaggaccuccgcggcaagauccucaucaagaacaagaagaaccaguucuccggccccaccuccuccuccaaggacaccggcggcgaggccgagggcuccuccccccccuccgcccccgccgucugggccggcgaggagggcaccgagcucgaggaggaggaggucgaggaggaggaggaggaggaguccggcaaccucgacgaggaggagaucaagaagaugcaguccgacgagggcaccgccggccucgaggucaccgccuacgaggagauguccucccucgucaacuacauccagcccaccaaguucgucuccuucgaguucuccgcccagaagaaccgcuccuacgucaucuccuccuucaccgagcucaaggccuacgaccuccucuccaaggccuccguccaguucgucgacuacaacaagcgccagaugucccgcaucuaccccaagggcacccgcauggacuccuccaacuacaugccccagauguucuggaacgccggcugccagauggucgcccucaacuuccagaccauggaccuccccaugcagcagaacauggccgucuucgaguucaacggccaguccggcuaccuccucaagcacgaguucaugcgccgccccgacaagcaguucaaccccuucuccgucgaccgcaucgacgucgucgucgccaccacccucuccaucaccgucaucuccggccaguuccucuccgagcgcuccguccgcaccuacgucgaggucgagcucuucggccuccccggcgaccccaagcgccgcuaccgcaccaagcucucccccuccaccaacuccaucaaccccgucuggaaggaggagcccuucgucuucgagaagauccucaugcccgagcucgccucccuccgcgucgccgucauggaggagggcaacaaguuccucggccaccgcaucauccccaucaacgcccucaacuccggcuaccaccaccucugccuccacuccgaguccaacaugccccucaccaugcccgcccucuucaucuuccucgagaugaaggacuacauccccggcgccugggccgaccucaccgucgcccucgccaaccccaucaaguucuucuccgcccacgacaccaaguccgucaagcucaaggaggccaugggcggccuccccgagaagcccuucccccucgccucccccgucgccucccaggucaacggcgcccucgcccccaccuccaacggcucccccgccgcccgcgccggcgcccgcgaggaggccaugaaggaggccgccgagccccgcaccgccucccucgaggagcuccgcgagcucaagggcgucgucaagcuccagcgccgccacgagaaggagcuccgcgagcucgagcgccgcggcgcccgccgcugggaggagcuccuccagcgcggcgccgcccagcucgccgagcucggcccccccggcgucggcggcgucggcgccugcaagcucggccccggcaagggcucccgcaagaagcgcucccucccccgcgaggaguccgccggcgccgcccccggcgagggccccgagggcgucgacggccgcguccgcgagcucaaggaccgccucgagcucgagcuccuccgccagggcgaggagcaguacgagugcguccucaagcgcaaggagcagcacgucgccgagcagaucuccaagaugauggagcucgcccgcgagaagcaggccgccgagcucaaggcccucaaggagaccuccgagaacgacaccaaggagaugaagaagaagcucgagaccaagcgccucgagcgcauccagggcaugaccaaggucaccaccgacaagauggcccaggagcgccucaagcgcgagaucaacaacucccacauccaggaggucguccaggucaucaagcagaugaccgagaaccucgagcgccaccaggagaagcucgaggagaagcaggccgccugccucgagcagauccgcgagauggagaagcaguuccagaaggaggcccucgccgaguacgaggcccgcaugaagggccucgaggccgaggucaaggaguccguccgcgccugccuccgcaccugcuuccccuccgaggccaaggacaagcccgagcgcgccugcgagugcccccccgagcucugcgagcaggacccccucaucgccaaggccgacgcccaggagucccgccucuga

SEQ ID NO: 47743 - RNA, 3504 nt, Artificial Sequence
  derived and/or modified sequence opt2 from PLCB3__Homo_sapiens__NP_001171812
auggccggcgcccagcccggcguccacgcccuccagcucgagccccccaccgucgucgagacccuccgccgcggcuccaaguucaucaagugggacgaggagaagcucaugaccgucgucuccggccccgaccccgucaacaccgucuuccucaacuucauggccguccaggacgacaccgccaaggucugguccgaggagcucuucaagcucgccaugaacauccucgcccagaacgccucccgcaacaccuuccuccgcaaggccuacaccaagcucaagcuccaggucaaccaggacggccgcauccccgucaagaacauccucaagauguucuccgccgacaagaagcgcgucgagaccgcccucgaguccugcggccucaaguucaaccgcuccgaguccauccgccccgacgaguucucccucgagaucuucgagcgcuuccucaacaagcucugccuccgccccgacaucgacaagauccuccucgagaucggcgccaagggcaagcccuaccucacccucgagcagcucauggacuucaucaaccagaagcagcgcgacccccgccucaacgagguccucuaccccccccuccgccccucccaggcccgccuccucaucgagaaguacgagcccaaccagcaguuccucgagcgcgaccagauguccauggagggcuucucccgcuaccucggcggcgaggagaacggcauccucccccucgaggcccucgaccucuccaccgacaugacccagccccucuccgccuacuucaucaacuccucccacaacaccuaccucaccgccggccagcucgccggcaccuccuccgucgagauguaccgccaggcccuccucuggggcugccgcugcgucgagcucgacgucuggaagggccgcccccccgaggaggagcccuucaucacccacggcuucaccaugaccaccgaggucccccuccgcgacguccucgaggccaucgccgagaccgccuucaagaccucccccuaccccgucauccucuccuucgagaaccacgucgacuccgccaagcagcaggccaagauggccgaguacugccgcuccaucuucggcgacgcccuccucaucgagccccucgacaaguacccccucgcccccggcgucccccuccccuccccccaggaccucaugggccgcauccucgucaagaacaagaagcgccaccgccccuccgccggcggccccgacuccgccggccgcaagcgcccccucgagcaguccaacuccgcccucuccgaguccuccgccgccaccgagcccuccuccccccagcucggcucccccuccuccgacuccugccccggccucuccaacggcgaggaggucggccucgagaagcccucccucgagccccagaagucccucggcgacgagggccucaaccgcggccccuacguccucggccccgccgaccgcgaggacgaggaggaggacgaggaggaggaggagcagaccgaccccaagaagcccaccaccgacgagggcaccgccuccuccgaggucaacgccaccgaggagauguccacccucgucaacuacaucgagcccgucaaguucaaguccuucgaggccgcccgcaagcgcaacaagugcuucgagauguccuccuucgucgagaccaaggccauggagcagcucaccaagucccccauggaguucgucgaguacaacaagcagcagcucucccgcaucuaccccaagggcacccgcgucgacuccuccaacuacaugccccagcucuucuggaacgucggcugccagcucgucgcccucaacuuccagacccucgacgucgccaugcagcucaacgccggcgucuucgaguacaacggccgcuccggcuaccuccucaagcccgaguucaugcgccgccccgacaaguccuucgaccccuucaccgaggucaucgucgacggcaucgucgccaacgcccuccgcgucaaggucaucuccggccaguuccucuccgaccgcaaggucggcaucuacgucgaggucgacauguucggccuccccgucgacacccgccgcaaguaccgcacccgcaccucccagggcaacuccuucaaccccgucugggacgaggagcccuucgacuuccccaaggucguccuccccacccucgccucccuccgcaucgccgccuucgaggagggcggcaaguucgucggccaccgcauccuccccgucuccgccauccgcuccggcuaccacuacgucugccuccgcaacgaggccaaccagccccucugccuccccgcccuccucaucuacaccgaggccuccgacuacauccccgacgaccaccaggacuacgccgaggcccucaucaaccccaucaagcacgucucccucauggaccagcgcgcccgccagcucgccgcccucaucggcgaguccgaggcccaggccggccaggagaccugccaggacacccagucccagcagcucggcucccagcccuccuccaaccccacccccuccccccucgacgccuccccccgccgcccccccggccccaccaccucccccgccuccaccucccucuccucccccggccagcgcgacgaccucaucgccuccauccucuccgaggucgcccccaccccccucgacgagcuccgcggccacaaggcccucgucaagcuccgcucccgccaggagcgcgaccuccgcgagcuccgcaagaagcaccagcgcaaggccgucacccucacccgccgccuccucgacggccucgcccaggcccaggccgagggccgcugccgccuccgccccggcgcccucggcggcgccgccgacgucgaggacaccaaggagggcgaggacgaggccaagcgcuaccaggaguuccagaaccgccagguccagucccuccucgagcuccgcgaggcccaggucgacgccgaggcccagcgccgccucgagcaccuccgccaggcccuccagcgccuccgcgaggucguccucgacgccaacaccacccaguucaagcgccucaaggagaugaacgagcgcgagaagaaggagcuccagaagauccucgaccgcaagcgccacaacuccaucuccgaggccaagaugcgcgacaagcacaagaaggaggccgagcucaccgagaucaaccgccgccacaucaccgaguccgucaacuccauccgccgccucgaggaggcccagaagcagcgccacgaccgccucgucgccggccagcagcagguccuccagcagcucgccgaggaggagcccaagcuccucgcccagcucgcccaggagugccaggagcagcgcgcccgccucccccaggagauccgccgcucccuccucggcgagaugcccgagggccucggcgacggcccccucgucgccugcgccuccaacggccacgcccccggcuccuccggccaccucuccggcgccgacuccgagucccaggaggagaacacccagcucuga

SEQ ID NO: 47744 - RNA, 3585 nt, Artificial Sequence
  derived and/or modified sequence opt2 from PLCB4__Homo_sapiens__NP_000924
auggccaagcccuacgaguucaacuggcagaaggagguccccuccuuccuccaggagggcgccgucuucgaccgcuacgaggaggaguccuucgucuucgagcccaacugccucuucaaggucgacgaguucggcuucuuccucaccuggcgcuccgagggcaaggagggccagguccucgagugcucccucaucaacuccauccgcuccggcgccauccccaaggaccccaagauccucgccgcccucgaggccgucggcaaguccgagaacgaccucgagggccgcaucgucugcgucugcuccggcaccgaccucgucaacaucuccuucaccuacauggucgccgagaaccccgaggucaccaagcagugggucgagggccuccgcuccaucauccacaacuuccgcgccaacaacgucucccccaugaccugccucaagaagcacuggaugaagcucgccuucaugaccaacaccaacggcaagauccccguccgcuccaucacccgcaccuucgccuccggcaagaccgagaaggucaucuuccaggcccucaaggagcucggccuccccuccggcaagaacgacgagaucgagcccaccgccuucuccuacgagaaguucuacgagcucacccagaagaucugcccccgcaccgacaucgaggaccucuucaagaagaucaacggcgacaagaccgacuaccucaccgucgaccagcucgucuccuuccucaacgagcaccagcgcgacccccgccucaacgagauccucuuccccuucuacgacgccaagcgcgccaugcagaucaucgagauguacgagcccgacgaggaccucaagaagaagggccucaucuccuccgacggcuucugccgcuaccucauguccgacgagaacgcccccgucuuccucgaccgccucgagcucuaccaggagauggaccacccccucgcccacuacuucaucuccuccucccacaacaccuaccucaccggccgccaguucggcggcaaguccuccgucgagauguaccgccagguccuccucgccggcugccgcugcgucgagcucgacugcugggacggcaagggcgaggaccaggagcccaucaucacccacggcaaggccaugugcaccgacauccucuucaaggacgucauccaggccaucaaggagaccgccuucgucaccuccgaguaccccgucauccucuccuucgagaaccacugcuccaaguaccagcaguacaagauguccaaguacugcgaggaccucuucggcgaccuccuccucaagcaggcccucgagucccacccccucgagcccggccgcgcccuccccucccccaacgaccucaagcgcaagauccucaucaagaacaagcgccucaagcccgaggucgagaagaagcagcucgaggcccuccgcuccaugauggaggccggcgaguccgccucccccgccaacauccucgaggacgacaacgaggaggagaucgaguccgccgaccaggaggaggaggcccaccccgaguucaaguucggcaacgagcucuccgccgacgaccucggccacaaggaggccgucgccaacuccgucaagaagggccucgucaccgucgaggacgagcaggccuggauggccuccuacaaguacgucggcgccaccaccaacauccaccccuaccucuccaccaugaucaacuacgcccagcccgucaaguuccagggcuuccacgucgccgaggagcgcaacauccacuacaacauguccuccuucaacgaguccgucggccucggcuaccucaagacccacgccaucgaguucgucaacuacaacaagcgccagaugucccgcaucuaccccaagggcggccgcgucgacuccuccaacuacaugccccagaucuucuggaacgccggcugccagauggucucccucaacuaccagacccccgaccucgccaugcagcucaaccagggcaaguucgaguacaacggcuccugcggcuaccuccucaagcccgacuucaugcgccgccccgaccgcaccuucgaccccuucuccgagacccccgucgacggcgucaucgccgccaccugcuccguccaggucaucuccggccaguuccucuccgacaagaagaucggcaccuacgucgaggucgacauguacggccuccccaccgacaccauccgcaaggaguuccgcacccgcauggucaugaacaacggccucaaccccgucuacaacgaggaguccuucgucuuccgcaaggucauccuccccgaccucgccguccuccgcaucgccgucuacgacgacaacaacaagcucaucggccagcgcauccucccccucgacggccuccaggccggcuaccgccacaucucccuccgcaacgagggcaacaagccccucucccuccccaccaucuucugcaacaucguccucaagaccuacguccccgacggcuucggcgacaucgucgacgcccucuccgaccccaagaaguuccucuccaucaccgagaagcgcgccgaccagaugcgcgccaugggcaucgagaccuccgacaucgccgacguccccuccgacaccuccaagaacgacaagaagggcaaggccaacaccgccaaggccaacgucaccccccaguccuccuccgagcuccgccccaccaccaccgccgcccucgccuccggcgucgaggccaagaagggcaucgagcucaucccccagguccgcaucgaggaccucaagcagaugaaggccuaccucaagcaccucaagaagcagcagaaggagcucaacucccucaagaagaagcacgccaaggagcacuccaccaugcagaagcuccacugcacccaggucgacaagaucgucgcccaguacgacaaggagaaguccacccacgagaagauccucgagaaggccaugaagaagaagggcggcuccaacugccucgagaugaagaaggagaccgagaucaagauccagacccucaccuccgaccacaaguccaaggucaaggagaucgucgcccagcacaccaaggagugguccgagaugaucaacacccacuccgccgaggagcaggagauccgcgaccuccaccucucccagcagugcgagcuccucaagaagcuccucaucaacgcccacgagcagcagacccagcagcucaagcucucccacgaccgcgaguccaaggagaugcgcgcccaccaggccaagaucuccauggagaacuccaaggccaucucccaggacaaguccaucaagaacaaggccgagcgcgagcgccgcguccgcgagcucaacuccuccaacaccaagaaguuccucgaggagcgcaagcgccucgccaugaagcaguccaaggagauggaccagcucaagaagguccagcucgagcaccucgaguuccucgagaagcagaacgagcagcuccucaaguccugccacgccgucucccagacccagggcgagggcgacgccgccgacggcgagaucggcucccgcgacggcccccagaccuccaacuccuccaugaagcuccagaacgccaacuga

SEQ ID NO: 47745 - RNA, 2334 nt, Artificial Sequence
  derived and/or modified sequence opt2 from PLCD1__Homo_sapiens__NP_001124436
augcagugccucggcauccgcucccgcucccgcucccgcgagcucuaccuccaggagcgcucccucaaggucgccgcccucaacggccgccgccucggccuccaggacgacgaggaccuccaggcccuccucaagggcucccagcuccucaaggucaaguccuccuccuggcgccgcgagcgcuucuacaagcuccaggaggacugcaagaccaucuggcaggagucccgcaaggucaugcgcacccccgagucccagcucuucuccaucgaggacauccaggagguccgcaugggccaccgcaccgagggccucgagaaguucgcccgcgacguccccgaggaccgcugcuucuccaucgucuucaaggaccagcgcaacacccucgaccucaucgcccccucccccgccgacgcccagcacuggguccucggccuccacaagaucauccaccacuccggcuccauggaccagcgccagaagcuccagcacuggauccacuccugccuccgcaaggccgacaagaacaaggacaacaagauguccuucaaggagcuccagaacuuccucaaggagcucaacauccaggucgacgacuccuacgcccgcaagaucuuccgcgagugcgaccacucccagaccgacucccucgaggacgaggagaucgaggccuucuacaagaugcucacccagcgcgucgagaucgaccgcaccuucgccgaggccgccggcuccggcgagacccucuccgucgaccagcucgucaccuuccuccagcaccagcagcgcgaggaggccgccggccccgcccucgcccucucccucaucgagcgcuacgagcccuccgagaccgccaaggcccagcgccagaugaccaaggacggcuuccucauguaccuccucuccgccgacggcuccgccuucucccucgcccaccgccgcgucuaccaggacaugggccagccccucucccacuaccucgucuccuccucccacaacaccuaccuccucgaggaccagcucgccggccccuccuccaccgaggccuacauccgcgcccucugcaagggcugccgcugccucgagcucgacugcugggacggccccaaccaggagcccaucaucuaccacggcuacaccuucaccuccaagauccucuucugcgacguccuccgcgccauccgcgacuacgccuucaaggccucccccuaccccgucauccucucccucgagaaccacugcacccucgagcagcagcgcgucauggcccgccaccuccacgccauccucggccccaugcuccucaaccgcccccucgacggcgucaccaacucccuccccucccccgagcagcucaagggcaagauccuccucaagggcaagaagcucggcggccuccucccccccggcggcgagggcggccccgaggccaccgucgucuccgacgaggacgaggccgccgagauggaggacgaggccguccgcucccgcguccagcacaagcccaaggaggacaagcuccgccucgcccaggagcucuccgacauggucaucuacugcaaguccguccacuucggcggcuucuccucccccggcacccccggccaggccuucuacgagauggccuccuucuccgagaaccgcgcccuccgccuccuccaggaguccggcaacggcuucguccgccacaacgucggccaccucucccgcaucuaccccgccggcuggcgcaccgacuccuccaacuacucccccgucgagauguggaacggcggcugccagaucgucgcccucaacuuccagacccccggccccgagauggacgucuaccagggccgcuuccaggacaacggcgccugcggcuacguccucaagcccgccuuccuccgcgaccccaacggcaccuucaacccccgcgcccucgcccagggccccuggugggcccgcaagcgccucaacauccgcgucaucuccggccagcagcuccccaaggucaacaagaacaagaacuccaucgucgaccccaaggucaccgucgagauccacggcgucucccgcgacgucgccucccgccagaccgccgucaucaccaacaacggcuucaaccccuggugggacaccgaguucgccuucgaggucgucguccccgaccucgcccucauccgcuuccucgucgaggacuacgacgccuccuccaagaacgacuucaucggccaguccaccaucccccucaacucccucaagcagggcuaccgccacguccaccucauguccaagaacggcgaccagcaccccuccgccacccucuucgucaagaucucccuccaggacuga

SEQ ID NO: 47746 - RNA, 2370 nt, Artificial Sequence
  derived and/or modified sequence opt2 from PLCD3__Homo_sapiens__NP_588614
augcucugcggccgcuggcgccgcugccgccgcccccccgaggagccccccgucgccgcccaggucgccgcccaggucgccgcccccgucgcccuccccuccccccccacccccuccgacggcggcaccaagcgccccggccuccgcgcccucaagaagaugggccucaccgaggacgaggacguccgcgccaugcuccgcggcucccgccuccgcaagauccgcucccgcaccuggcacaaggagcgccucuaccgccuccaggaggacggccucuccgucugguuccagcgccgcaucccccgcgcccccucccagcacaucuucuucguccagcacaucgaggccguccgcgagggccaccaguccgagggccuccgccgcuucggcggcgccuucgcccccgcccgcugccucaccaucgccuucaagggccgccgcaagaaccucgaccucgccgcccccaccgccgaggaggcccagcgcuggguccgcggccucaccaagcuccgcgcccgccucgacgccaugucccagcgcgagcgccucgaccacuggauccacuccuaccuccaccgcgccgacuccaaccaggacuccaagauguccuucaaggagaucaagucccuccuccgcauggucaacgucgacaugaacgacauguacgccuaccuccucuucaaggagugcgaccacuccaacaacgaccgccucgagggcgccgagaucgaggaguuccuccgccgccuccucaagcgccccgagcucgaggagaucuuccaccaguacuccggcgaggaccgcguccucuccgcccccgagcuccucgaguuccucgaggaccagggcgaggagggcgccacccucgcccgcgcccagcagcucauccagaccuacgagcucaacgagaccgccaagcagcacgagcucaugacccucgacggcuucaugauguaccuccucucccccgagggcgccgcccucgacaacacccacaccugcgucuuccaggacaugaaccagccccucgcccacuacuucaucuccuccucccacaacaccuaccucaccgacucccagaucggcggccccuccuccaccgaggccuacguccgcgccuucgcccagggcugccgcugcgucgagcucgacugcugggagggccccggcggcgagcccgucaucuaccacggccacacccucaccuccaagauccucuuccgcgacgucguccaggccguccgcgaccacgccuucacccucucccccuaccccgucauccucucccucgagaaccacugcggccucgagcagcaggccgccauggcccgccaccucugcaccauccucggcgacaugcucgucacccaggcccucgacucccccaaccccgaggagcuccccucccccgagcagcucaagggccgcguccucgucaagggcaagaagcuccccgccgcccgcuccgaggacggccgcgcccucuccgaccgcgaggaggaggaggaggacgacgaggaggaggaggaggaggucgaggccgccgcccagcgccgccucgccaagcagaucucccccgagcucuccgcccucgccgucuacugccacgccacccgccuccgcacccuccaccccgcccccaacgccccccagcccugccaggucuccucccucuccgagcgcaaggccaagaagcucauccgcgaggccggcaacuccuucguccgccacaacgcccgccagcucacccgcgucuacccccucggccuccgcaugaacuccgccaacuacuccccccaggagauguggaacuccggcugccagcucgucgcccucaacuuccagacccccggcuacgagauggaccucaacgccggccgcuuccucgucaacggccagugcggcuacguccucaagcccgccugccuccgccagcccgacuccaccuucgaccccgaguaccccggccccccccgcaccacccucuccauccagguccucaccgcccagcagcuccccaagcucaacgccgagaagccccacuccaucgucgacccccucguccgcaucgagauccacggcguccccgccgacugcgcccgccaggagaccgacuacguccucaacaacggcuucaacccccgcuggggccagacccuccaguuccagcuccgcgcccccgagcucgcccucguccgcuucgucgucgaggacuacgacgccaccucccccaacgacuucgucggccaguucacccucccccucuccucccucaagcagggcuaccgccacauccaccuccucuccaaggacggcgccucccucucccccgccacccucuucauccagauccgcauccagcgcuccuga

SEQ ID NO: 47747 - RNA, 2289 nt, Artificial Sequence
  derived and/or modified sequence opt2 from PLCD4__Homo_sapiens__NP_116115
auggccucccuccuccaggaccagcucaccaccgaccaggaccuccuccucaugcaggagggcaugcccaugcgcaagguccgcuccaaguccuggaagaagcuccgcuacuuccgccuccagaacgacggcaugaccgucuggcacgcccgccaggcccgcggcuccgccaagcccuccuucuccaucuccgacgucgagaccauccgcaacggccacgacuccgagcuccuccgcucccucgccgaggagcucccccucgagcagggcuucaccaucgucuuccacggccgccgcuccaaccucgaccucauggccaacuccgucgaggaggcccagaucuggaugcgcggccuccagcuccucgucgaccucgucaccuccauggaccaccaggagcgccucgaccaguggcucuccgacugguuccagcgcggcgacaagaaccaggacggcaagauguccuuccaggagguccagcgccuccuccaccucaugaacgucgagauggaccaggaguacgccuucucccucuuccaggccgccgacaccucccaguccggcacccucgagggcgaggaguucguccaguucuacaaggcccucaccaagcgcgccgagguccaggagcucuucgaguccuucuccgccgacggccagaagcucacccuccucgaguuccucgacuuccuccaggaggagcagaaggagcgcgacugcaccuccgagcucgcccucgagcucaucgaccgcuacgagcccuccgacuccggcaagcuccgccacguccucuccauggacggcuuccucuccuaccucugcuccaaggacggcgacaucuucaaccccgccugccuccccaucuaccaggacaugacccagccccucaaccacuacuucaucugcuccucccacaacaccuaccucgucggcgaccagcucugcggccaguccuccgucgagggcuacauccgcgcccucaagcgcggcugccgcugcgucgaggucgacgucugggacggccccuccggcgagcccgucgucuaccacggccacacccucaccucccgcauccucuucaaggacgucgucgccaccgucgcccaguacgccuuccagaccuccgacuaccccgucauccucucccucgagacccacugcuccugggagcagcagcagaccauggcccgccaccucaccgagauccucggcgagcagcuccucuccaccacccucgacggcguccuccccacccagcuccccucccccgaggagcuccgccgcaagauccucgucaagggcaagaagcucacccucgaggaggaccucgaguacgaggaggaggaggccgagcccgagcucgaggaguccgagcucgcccucgagucccaguucgagaccgagcccgagccccaggagcagaaccuccagaacaaggacaagaagaagaaguccaagcccauccucugccccgcccucuccucccucgucaucuaccucaaguccgucuccuuccgcuccuucacccacuccaaggagcacuaccacuucuacgagaucuccuccuucuccgagaccaaggccaagcgccucaucaaggaggccggcaacgaguucguccagcacaacaccuggcagcucucccgcgucuaccccuccggccuccgcaccgacuccuccaacuacaacccccaggagcucuggaacgccggcugccagauggucgccaugaacaugcagaccgccggccucgagauggacaucugcgacggccacuuccgccagaacggcggcugcggcuacguccucaagcccgacuuccuccgcgacauccaguccuccuuccaccccgagaagcccaucucccccuucaaggcccagacccuccucauccaggucaucuccggccagcagcuccccaaggucgacaagaccaaggagggcuccaucgucgacccccucgucaagguccagaucuucggcguccgccucgacaccgcccgccaggagaccaacuacgucgagaacaacggcuucaaccccuacuggggccagacccucugcuuccgcguccucguccccgagcucgccaugcuccgcuucgucgucauggacuacgacuggaagucccgcaacgacuucaucggccaguacacccuccccuggaccugcaugcagcagggcuaccgccacauccaccuccucuccaaggacggcaucucccuccgccccgccuccaucuucgucuacaucugcauccaggagggccucgagggcgacgaguccuga

SEQ ID NO: 47748 - RNA, 5985 nt, Artificial Sequence
  derived and/or modified sequence opt2 from PLCE1__Homo_sapiens__NP_001159451
auggucuccgagggcuccgccgccggccgcgacuucgccggcauggaggagguccgccagcuccacguccgcuucugcaagggcaucaagaucuggcaccaggccugguuccucugcucccuccucggccgcgagccccaggagcgcgaggccggcugccagcucuggcucugcacccucuccgccguccucaaggucggcuggcucuucccccucuccgagguccccaacuucacccuccucaaggacggcugcggcugcuggcgccucaaggaggaccagaucuacaacgccguccgccgcgaggagaccgagaacaccgucggcucccuccuccacuuccucaccaagcuccccgccuccgagaccgcccacggccgcaucuccgucggccccugccucaagcagugcguccgcgacaccgucugcgaguaccgcgccacccuccagcgcaccuccaucucccaguacaucaccggcucccuccucgaggccaccaccucccucggcgcccgcuccggccuccucuccaccuucggcggcuccaccggccgcaugaugcucaaggagcgccagcccggccccuccgucgccaacuccaacgcccuccccuccuccuccgccggcaucuccaaggagcucaucgaccuccagccccucauccaguuccccgaggaggucgccuccauccucauggagcaggagcagaccaucuaccgccgcguccuccccgucgacuaccucugcuuccucacccgcgaccucggcacccccgagugccaguccucccuccccugccucaaggccuccaucuccgccuccauccucaccacccagaacggcgagcacaacgcccucgaggaccucgucaugcgcuucaacgaggucuccuccugggucaccuggcucauccucaccgccggcuccauggaggagaagcgcgaggucuucuccuaccucguccacgucgccaagugcugcuggaacaugggcaacuacaacgccgucauggaguuccucgccggccuccgcucccgcaagguccucaagauguggcaguucauggaccaguccgacaucgagaccaugcgcucccucaaggacgccauggcccagcacgaguccuccugcgaguaccgcaaggucgucacccgcgcccuccacauccccggcugcaaggucguccccuucugcggcgucuuccucaaggagcucugcgagguccucgacggcgccuccggccucaugaagcucugcccccgcuacaacucccaggaggagacccucgaguucgucgccgacuacuccggccaggacaacuuccuccagcgcgucggccagaacggccucaagaacuccgagaaggaguccaccgucaacuccaucuuccaggucauccgcuccugcaaccgcucccucgagaccgacgaggaggacucccccuccgagggcaacuccucccgcaaguccucccucaaggacaagucccgcuggcaguucaucaucggcgaccuccucgacuccgacaacgacaucuucgagcaguccaaggaguacgacucccacggcuccgaggacucccagaaggccuucgaccacggcaccgagcucauccccugguacguccucuccauccaggccgacguccaccaguuccuccuccagggcgccaccgucauccacuacgaccaggacacccaccucuccgcccgcugcuuccuccagcuccagcccgacaacuccacccucaccugggucaagcccaccaccgccucccccgccuccuccaaggccaagcucggcguccucaacaacaccgccgagcccggcaaguucccccuccucggcaacgccggccucuccucccucaccgagggcguccucgaccucuucgccgucaaggccgucuacaugggccaccccggcaucgacauccacaccgucugcguccagaacaagcucggcuccauguuccucuccgagaccggcgucacccuccucuacggccuccagaccaccgacaaccgccuccuccacuucgucgcccccaagcacaccgccaagaugcucuucuccggccuccucgagcucacccgcgccguccgcaagaugcgcaaguuccccgaccagcgccagcaguggcuccgcaagcaguacgucucccucuaccaggaggacggccgcuacgagggccccacccucgcccacgccgucgagcucuucggcggccgccgcugguccgcccgcaaccccucccccggcaccuccgccaagaacgccgagaagcccaacaugcagcgcaacaacacccucggcaucuccaccaccaagaagaagaagaagauccucaugcgcggcgaguccggcgaggucaccgacgacgagauggccacccgcaaggccaagaugcacaaggagugccgcucccgcuccggcuccgacccccaggacaucaacgagcaggaggaguccgaggucaacgccaucgccaacccccccaacccccuccccucccgccgcgcccacucccucaccaccgccggcucccccaaccucgccgccggcaccuccucccccauccgccccgucuccucccccguccucuccuccuccaacaagucccccuccuccgccugguccuccuccuccuggcacggccgcaucaagggcggcaugaagggcuuccaguccuucauggucuccgacuccaacauguccuucgucgaguucgucgagcucuucaaguccuucuccguccgcucccgcaaggaccucaaggaccucuucgacgucuacgccguccccugcaaccgcuccggcuccgaguccgccccccucuacaccaaccucaccaucgacgagaacaccuccgaccuccagcccgaccucgaccuccucacccgcaacgucuccgaccucggccucuucaucaaguccaagcagcagcucuccgacaaccagcgccagaucuccgacgccaucgccgccgccuccaucgucaccaacggcaccggcaucgaguccaccucccucggcaucuucggcgucggcauccuccagcucaacgacuuccucgucaacugccagggcgagcacugcaccuacgacgagauccucuccaucauccagaaguucgagcccuccaucuccaugugccaccagggccucauguccuucgagggcuucgcccgcuuccucauggacaaggagaacuucgccuccaagaacgacgagucccaggagaacaucaaggagcuccagcucccccucuccuacuacuacaucgaguccucccacaacaccuaccucaccggccaccagcucaagggcgaguccuccgucgagcucuacucccagguccuccuccagggcugccgcuccgucgagcucgacugcugggacggcgacgacggcaugcccaucaucuaccacggccacacccucaccaccaagauccccuucaaggaggucgucgaggccaucgaccgcuccgccuucaucaacuccgaccuccccaucaucaucuccaucgagaaccacugcucccucccccagcagcgcaagauggccgagaucuucaagaccgucuucggcgagaagcucgucaccaaguuccucuucgagaccgacuucuccgacgaccccaugcuccccucccccgaccagcuccgcaagaagguccuccucaagaacaagaagcucaaggcccaccagacccccgucgacauccucaagcagaaggcccaccagcucgccuccaugcagguccaggccuacaacggcggcaacgccaacccccgccccgccaacaacgaggaggaggaggacgaggaggacgaguacgacuacgacuacgagucccucuccgacgacaacauccucgaggaccgccccgagaacaaguccugcaacgacaagcuccaguucgaguacaacgaggagauccccaagcgcaucaagaaggccgacaacuccgccugcaacaagggcaaggucuacgacauggagcucggcgaggaguucuaccucgaccagaacaagaaggagucccgccagaucgcccccgagcucuccgaccucgucaucuacugccaggccgucaaguuccccggccucuccacccucaacgccuccggcuccucccgcggcaaggagcgcaagucccgcaaguccaucuucggcaacaaccccggccgcaugucccccggcgagaccgccuccuucaacaagaccuccggcaaguccuccugcgagggcauccgccagaccugggaggaguccuccuccccccucaaccccaccaccucccucuccgccaucauccgcacccccaagugcuaccacaucuccucccucaacgagaacgccgccaagcgccucugccgccgcuacucccagaagcucacccagcacaccgccugccagcuccuccgcaccuaccccgccgccacccgcaucgacuccuccaaccccaacccccucauguucuggcuccacggcauccagcucgucgcccucaacuaccagaccgacgaccucccccuccaccucaacgccgccauguucgaggccaacggcggcugcggcuacguccucaagccccccguccucugggacaagaacugccccauguaccagaaguucuccccccucgagcgcgaccucgacuccauggaccccgccgucuacucccucaccaucgucuccggccagaacgucugccccuccaacuccaugggcucccccugcaucgaggucgacguccucggcaugccccucgacuccugccacuuccgcaccaagcccauccaccgcaacacccucaaccccauguggaacgagcaguuccucuuccacguccacuucgaggaccucgucuuccuccgcuucgccgucgucgagaacaacuccuccgccgucaccgcccagcgcaucaucccccucaaggcccucaagcgcggcuaccgccaccuccagcuccgcaaccuccacaacgagguccucgagaucuccucccucuucaucaacucccgccgcauggaggagaacuccuccggcaacaccauguccgccuccuccauguucaacaccgaggagcgcaagugccuccagacccaccgcgucaccguccacggcguccccggccccgagcccuucaccgucuucaccaucaacggcggcaccaaggccaagcagcuccuccagcagauccucaccaacgagcaggacaucaagcccgucaccaccgacuacuuccucauggaggagaaguacuucaucuccaaggagaagaacgagugccgcaagcagcccuuccagcgcgccaucggccccgaggaggagaucaugcagauccucuccuccugguuccccgaggagggcuacaugggccgcaucguccucaagacccagcaggagaaccucgaggagaagaacaucguccaggacgacaaggaggucauccucuccuccgaggaggaguccuucuucguccagguccacgacgucucccccgagcagccccgcaccgucaucaaggccccccgcgucuccaccgcccaggacgucauccagcagacccucugcaaggccaaguacuccuacuccauccucuccaaccccaaccccuccgacuacguccuccucgaggaggucgucaaggacaccaccaacaagaagaccaccacccccaaguccucccagcgcguccuccucgaccaggagugcgucuuccaggcccaguccaaguggaagggcgccggcaaguucauccucaagcucaaggagcagguccaggccucccgcgaggacaagaagaagggcaucuccuucgccuccgagcucaagaagcucaccaaguccaccaagcagccccgcggccucaccucccccucccagcuccucaccuccgaguccauccagaccaaggaggagaagcccgucggcggccucuccuccuccgacaccauggacuaccgccaguga

SEQ ID NO: 47749 - RNA, 3876 nt, Artificial Sequence
  derived and/or modified sequence opt2 from PLCG1__Homo_sapiens__NP_002651
auggccggcgccgccucccccugcgccaacggcugcggccccggcgcccccuccgacgccgagguccuccaccucugccgcucccucgaggucggcaccgucaugacccucuucuacuccaagaagucccagcgccccgagcgcaagaccuuccaggucaagcucgagacccgccagaucaccuggucccgcggcgccgacaagaucgagggcgccaucgacauccgcgagaucaaggagauccgccccggcaagaccucccgcgacuucgaccgcuaccaggaggaccccgccuuccgccccgaccagucccacugcuucgucauccucuacggcauggaguuccgccucaagacccucucccuccaggccaccuccgaggacgaggucaacauguggaucaagggccucaccuggcucauggaggacacccuccaggcccccaccccccuccagaucgagcgcuggcuccgcaagcaguucuacuccgucgaccgcaaccgcgaggaccgcaucuccgccaaggaccucaagaacaugcucucccaggucaacuaccgcguccccaacaugcgcuuccuccgcgagcgccucaccgaccucgagcagcgcuccggcgacaucaccuacggccaguucgcccagcucuaccgcucccucauguacuccgcccagaagaccauggaccuccccuuccucgaggccuccacccuccgcgccggcgagcgccccgagcucugccgcgucucccuccccgaguuccagcaguuccuccucgacuaccagggcgagcucugggccgucgaccgccuccagguccaggaguucaugcucuccuuccuccgcgacccccuccgcgagaucgaggagcccuacuucuuccucgacgaguucgucaccuuccucuucuccaaggagaacuccgucuggaacucccagcucgacgccgucugccccgacaccaugaacaacccccucucccacuacuggaucuccuccucccacaacaccuaccucaccggcgaccaguucuccuccgaguccucccucgaggccuacgcccgcugccuccgcaugggcugccgcugcaucgagcucgacugcugggacggccccgacggcaugcccgucaucuaccacggccacacccucaccaccaagaucaaguucuccgacguccuccacaccaucaaggagcacgccuucgucgccuccgaguaccccgucauccucuccaucgaggaccacugcuccaucgcccagcagcgcaacauggcccaguacuucaagaagguccucggcgacacccuccucaccaagcccgucgagaucuccgccgacggccuccccucccccaaccagcucaagcgcaagauccucaucaagcacaagaagcucgccgagggcuccgccuacgaggagguccccaccuccaugauguacuccgagaacgacaucuccaacuccaucaagaacggcauccucuaccucgaggaccccgucaaccacgagugguacccccacuacuucguccucaccuccuccaagaucuacuacuccgaggagaccuccuccgaccagggcaacgaggacgaggaggagcccaaggaggucuccuccuccaccgagcuccacuccaacgagaagugguuccacggcaagcucggcgccggccgcgacggccgccacaucgccgagcgccuccucaccgaguacugcaucgagaccggcgcccccgacggcuccuuccucguccgcgaguccgagaccuucgucggcgacuacacccucuccuucuggcgcaacggcaagguccagcacugccgcauccacucccgccaggacgccggcacccccaaguucuuccucaccgacaaccucgucuucgacucccucuacgaccucaucacccacuaccagcaggucccccuccgcugcaacgaguucgagaugcgccucuccgagcccgucccccagaccaacgcccacgaguccaaggagugguaccacgccucccucacccgcgcccaggccgagcacaugcucaugcgcgucccccgcgacggcgccuuccucguccgcaagcgcaacgagcccaacuccuacgccaucuccuuccgcgccgagggcaagaucaagcacugccgcguccagcaggagggccagaccgucaugcucggcaacuccgaguucgacucccucgucgaccucaucuccuacuacgagaagcacccccucuaccgcaagaugaagcuccgcuaccccaucaacgaggaggcccucgagaagaucggcaccgccgagcccgacuacggcgcccucuacgagggccgcaaccccggcuucuacgucgaggccaaccccaugcccaccuucaagugcgccgucaaggcccucuucgacuacaaggcccagcgcgaggacgagcucaccuucaucaaguccgccaucauccagaacgucgagaagcaggagggcggcugguggcgcggcgacuacggcggcaagaagcagcucugguuccccuccaacuacgucgaggagauggucaaccccgucgcccucgagcccgagcgcgagcaccucgacgagaacuccccccucggcgaccuccuccgcggcguccucgacguccccgccugccagaucgccauccgccccgagggcaagaacaaccgccucuucgucuucuccaucuccauggccuccgucgcccacuggucccucgacgucgccgccgacucccaggaggagcuccaggacugggucaagaagauccgcgaggucgcccagaccgccgacgcccgccucaccgagggcaagaucauggagcgccgcaagaagaucgcccucgagcucuccgagcucgucgucuacugccgccccguccccuucgacgaggagaagaucggcaccgagcgcgccugcuaccgcgacauguccuccuuccccgagaccaaggccgagaaguacgucaacaaggccaagggcaagaaguuccuccaguacaaccgccuccagcucucccgcaucuaccccaagggccagcgccucgacuccuccaacuacgacccccuccccauguggaucugcggcucccagcucgucgcccucaacuuccagacccccgacaagcccaugcagaugaaccaggcccucuucaugaccggccgccacugcggcuacguccuccagcccuccaccaugcgcgacgaggccuucgaccccuucgacaaguccucccuccgcggccucgagcccugcgccaucuccaucgagguccucggcgcccgccaccuccccaagaacggccgcggcaucgucugccccuucgucgagaucgaggucgccggcgccgaguacgacuccaccaagcagaagaccgaguucgucgucgacaacggccucaaccccgucuggcccgccaagcccuuccacuuccagaucuccaaccccgaguucgccuuccuccgcuucgucgucuacgaggaggacauguucuccgaccagaacuuccucgcccaggccaccuuccccgucaagggccucaagaccggcuaccgcgccgucccccucaagaacaacuacuccgaggaccucgagcucgccucccuccucaucaagaucgacaucuuccccgccaagcaggagaacggcgaccucucccccuucuccggcaccucccuccgcgagcgcggcuccgacgccuccggccagcucuuccacggccgcgcccgcgagggcuccuucgagucccgcuaccagcagcccuucgaggacuuccgcaucucccaggagcaccucgccgaccacuucgacucccgcgagcgccgcgccccccgccgcacccgcgucaacggcgacaaccgccucuga

SEQ ID NO: 47750 - RNA, 3798 nt, Artificial Sequence
  derived and/or modified sequence opt2 from PLCG2__Homo_sapiens__NP_002652
auguccaccaccgucaacgucgacucccucgccgaguacgagaagucccagaucaagcgcgcccucgagcucggcaccgucaugaccgucuucuccuuccgcaaguccacccccgagcgccgcaccguccaggucaucauggagacccgccaggucgccugguccaagaccgccgacaagaucgagggcuuccucgacaucauggagaucaaggagauccgccccggcaagaacuccaaggacuucgagcgcgccaaggccguccgccagaaggaggacugcugcuucaccauccucuacggcacccaguucguccucuccacccucucccucgccgccgacuccaaggaggacgccgucaacuggcucuccggccucaagauccuccaccaggaggccaugaacgccuccacccccaccaucaucgaguccuggcuccgcaagcagaucuacuccgucgaccagacccgccgcaacuccaucucccuccgcgagcucaagaccauccucccccucaucaacuucaaggucuccuccgccaaguuccucaaggacaaguucgucgagaucggcgcccacaaggacgagcucuccuucgagcaguuccaccucuucuacaagaagcucauguucgagcagcagaaguccauccucgacgaguucaagaaggacuccuccgucuucauccucggcaacaccgaccgccccgacgccuccgccgucuaccuccacgacuuccagcgcuuccucauccacgagcagcaggagcacugggcccaggaccucaacaagguccgcgagcgcaugaccaaguucaucgacgacaccaugcgcgagaccgccgagcccuuccucuucgucgacgaguuccucaccuaccucuucucccgcgagaacuccaucugggacgagaaguacgacgccgucgacaugcaggacaugaacaacccccucucccacuacuggaucuccuccucccacaacaccuaccucaccggcgaccagcuccgcuccgaguccucccccgaggccuacauccgcugccuccgcaugggcugccgcugcaucgagcucgacugcugggacggccccgacggcaagcccgucaucuaccacggcuggacccgcaccaccaagaucaaguucgacgacgucguccaggccaucaaggaccacgccuucgucaccuccuccuuccccgucauccucuccaucgaggagcacugcuccgucgagcagcagcgccacauggccaaggccuucaaggaggucuucggcgaccuccuccucaccaagcccaccgaggccuccgccgaccagcuccccucccccucccagcuccgcgagaagaucaucaucaagcacaagaagcucggcccccgcggcgacgucgacgucaacauggaggacaagaaggacgagcacaagcagcagggcgagcucuacaugugggacuccaucgaccagaaguggacccgccacuacugcgccaucgccgacgccaagcucuccuucuccgacgacaucgagcagaccauggaggaggaggucccccaggacaucccccccaccgagcuccacuucggcgagaagugguuccacaagaaggucgagaagcgcaccuccgccgagaagcuccuccaggaguacugcauggagaccggcggcaaggacggcaccuuccucguccgcgaguccgagaccuuccccaacgacuacacccucuccuucuggcgcuccggccgcguccagcacugccgcauccgcuccaccauggagggcggcacccucaaguacuaccucaccgacaaccucaccuucuccuccaucuacgcccucauccagcacuaccgcgagacccaccuccgcugcgccgaguucgagcuccgccucaccgaccccguccccaaccccaacccccacgaguccaagcccugguacuacgacucccucucccgcggcgaggccgaggacaugcucaugcgcaucccccgcgacggcgccuuccucauccgcaagcgcgagggcuccgacuccuacgccaucaccuuccgcgcccgcggcaaggucaagcacugccgcaucaaccgcgacggccgccacuucguccucggcaccuccgccuacuucgagucccucgucgagcucgucuccuacuacgagaagcacucccucuaccgcaagaugcgccuccgcuaccccgucacccccgagcuccucgagcgcuacaacauggagcgcgacaucaacucccucuacgacgucucccgcauguacgucgaccccuccgagaucaaccccuccaugccccagcgcaccgucaaggcccucuacgacuacaaggccaagcgcuccgacgagcucuccuucugccgcggcgcccucauccacaacgucuccaaggagcccggcggcugguggaagggcgacuacggcacccgcauccagcaguacuuccccuccaacuacgucgaggacaucuccaccgccgacuucgaggagcucgagaagcagaucaucgaggacaacccccucggcucccucugccgcggcauccucgaccucaacaccuacaacgucgucaaggccccccagggcaagaaccagaaguccuucgucuucauccucgagcccaagcagcagggcgacccccccgucgaguucgccaccgaccgcgucgaggagcucuucgagugguuccaguccauccgcgagaucaccuggaagaucgacaccaaggagaacaacaugaaguacugggagaagaaccaguccaucgccaucgagcucuccgaccucgucgucuacugcaagcccaccuccaagaccaaggacaaccucgagaaccccgacuuccgcgagauccgcuccuucgucgagaccaaggccgacuccaucauccgccagaagcccgucgaccuccucaaguacaaccagaagggccucacccgcgucuaccccaagggccagcgcgucgacuccuccaacuacgaccccuuccgccucuggcucugcggcucccagauggucgcccucaacuuccagaccgccgacaaguacaugcagaugaaccacgcccucuucucccucaacggccgcaccggcuacguccuccagcccgaguccaugcgcaccgagaaguacgaccccaugccccccgagucccagcgcaagauccucaugacccucaccgucaagguccucggcgcccgccaccuccccaagcucggccgcuccaucgccugccccuucgucgaggucgagaucugcggcgccgaguacgacaacaacaaguucaagaccaccgucgucaacgacaacggccucucccccaucugggcccccacccaggagaaggucaccuucgagaucuacgaccccaaccucgccuuccuccgcuucgucgucuacgaggaggacauguucuccgaccccaacuuccucgcccacgccaccuaccccaucaaggccgucaaguccggcuuccgcuccgucccccucaagaacggcuacuccgaggacaucgagcucgccucccuccucgucuucugcgagaugcgccccguccucgaguccgaggaggagcucuacuccuccugccgccagcuccgccgccgccaggaggagcucaacaaccagcucuuccucuacgacacccaccagaaccuccgcaacgccaaccgcgacgcccucgucaaggaguucuccgucaacgagaaccagcuccagcucuaccaggagaagugcaacaagcgccuccgcgagaagcgcgucuccaacuccaaguucuacuccuga

SEQ ID NO: 47751 - RNA, 5082 nt, Artificial Sequence
  derived and/or modified sequence opt2 from PLCH1__Homo_sapiens__NP_001124432
auggccgaccucgaggucuacaagaaccucucccccgagaaggucgagcgcugcauguccgucaugcaguccggcacccagaugaucaagcucaagcgcggcaccaagggccucguccgccucuucuaccucgacgagcaccgcacccgccuccgcuggcgccccucccgcaaguccgagaaggccaagauccucaucgacuccaucuacaaggucaccgagggccgccaguccgagaucuuccaccgccaggccgagggcaacuucgaccccuccugcugcuucaccaucuaccacggcaaccacauggagucccucgaccucaucaccuccaaccccgaggaggcccgcaccuggaucaccggccucaaguaccucauggccggcaucuccgacgaggacucccucgccaagcgccagcgcacccacgaccagugggucaagcagaccuucgaggaggccgacaagaacggcgacggccuccucaacaucgaggagauccaccagcucaugcacaagcucaacgucaaccucccccgccgcaagguccgccagauguuccaggaggccgacaccgacgagaaccagggcacccucaccuucgaggaguucugcgucuucuacaagaugaugucccuccgccgcgaccucuaccuccuccuccucuccuacuccgacaagaaggaccaccucaccgucgaggagcucgcccaguuccucaaggucgagcagaagaugaacaacgucaccaccgacuacugccucgacaucaucaagaaguucgaggucuccgaggagaacaaggucaagaacguccucggcaucgagggcuucaccaacuucaugcgcucccccgccugcgacaucuucaacccccuccaccacgaggucuaccaggacauggaccagccccucugcaacuacuacaucgccuccucccacaacaccuaccucaccggcgaccagcuccucucccaguccaaggucgacauguacgcccgcguccuccaggagggcugccgcugcgucgaggucgacugcugggacggccccgacggcgagcccgucguccaccacggcuacacccucaccuccaagauccucuuccgcgacgucgucgagaccaucaacaagcacgccuucgucaagaacgaguuccccgucauccucuccaucgagaaccacugcuccauccagcagcagcgcaagaucgcccaguaccucaagggcaucuucggcgacaagcucgaccucuccuccgucgacaccggcgagugcaagcagcuccccuccccccagucccucaagggcaagauccucgucaagggcaagaagcuccccuaccaccucggcgacgacgccgaggagggcgaggucuccgacgaggacuccgccgacgagaucgaggacgagugcaaguucaagcuccacuacuccaacggcaccaccgagcaccaggucgaguccuucauccgcaagaagcucgagucccuccucaaggagucccagauccgcgacaaggaggaccccgacuccuucaccguccgcgcccuccucaaggccacccacgagggccucaacgcccaccucaagcagucccccgacgucaaggaguccggcaagaagucccacggccgcucccucaugaccaacuucggcaagcacaagaagaccaccaagucccgcuccaaguccuacuccaccgacgacgaggaggacacccagcaguccaccggcaaggagggcggccagcucuaccgccucggccgccgccgcaagaccaugaagcucugccgcgagcucuccgaccucgucgucuacaccaacuccgucgccgcccaggacaucgucgacgacggcaccaccggcaacguccucuccuucuccgagacccgcgcccaccaggucguccagcagaaguccgagcaguucaugaucuacaaccagaagcagcucacccgcaucuaccccuccgccuaccgcaucgacuccuccaacuucaacccccuccccuacuggaacgccggcugccagcucgucgcccucaacuaccaguccgagggccgcaugaugcagcucaaccgcgccaaguucaaggccaacggcaacugcggcuacguccucaagccccagcagaugugcaagggcaccuucaaccccuucuccggcgacccccuccccgccaaccccaagaagcagcucauccucaaggucaucuccggccagcagcuccccaagccccccgacuccauguucggcgaccgcggcgagaucaucgaccccuucgucgaggucgagaucaucggccuccccgucgacugcugcaaggaccagacccgcgucgucgacgacaacggcuucaaccccgucugggaggagacccucaccuucaccguccacaugcccgagaucgcccucguccgcuuccucgucugggaccacgaccccaucggccgcgacuucgucggccagcgcaccgucaccuucuccucccucguccccggcuaccgccacgucuaccucgagggccucaccgaggccuccaucuucguccacaucaccaucaacgagaucuacggcaagugguccccccucauccucaaccccuccuacaccauccuccacuuccucggcgccaccaagaaccgccagcuccagggccucaagggccucuucaacaagaacccccgccacuccuccuccgagaacaacucccacuacguccgcaagcgcuccaucggcgaccgcauccuccgccgcaccgccuccgcccccgccaagggccgcaagaaguccaagaugggcuuccaggagauggucgagaucaaggacuccgucuccgaggccacccgcgaccaggacggcguccuccgccgcaccacccgcucccuccaggcccgccccgucuccaugcccgucgaccgcaaccuccucggcgcccucucccuccccgucuccgagaccgccaaggacaucgagggcaaggagaacucccucgccgaggacaaggacggccgccgcaagggcaaggccuccaucaaggacccccacuuccucaacuucaacaagaagcucuccuccuccuccuccgcccuccuccacaaggacaccucccagggcgacaccaucgucuccaccgcccacauguccgucaccggcgagcagcucggcauguccuccccccgcggcggccgcaccaccuccaacgccaccuccaacugccaggagaaccccugccccuccaagucccucucccccaagcagcaccucgcccccgaccccgucgucaaccccacccaggaccuccacggcgucaagaucaaggagaagggcaaccccgaggacuucgucgagggcaaguccauccucuccggcuccguccucucccacuccaaccucgagaucaagaaccucgagggcaaccgcggcaagggccgcgccgccaccuccuucucccucuccgacgucuccaugcucugcuccgacauccccgaccuccacuccaccgccauccuccaggaguccgucaucucccaccucaucgacaacgucacccucaccaacgagaacgagcccggcuccuccaucuccgcccucaucggccaguucgacgagaccaacaaccaggcccucaccgucgucucccaccuccacaacaccuccgucauguccggccacugcccccuccccucccucggccucaagaugcccaucaagcacggcuucugcaagggcaaguccaaguccuccuuccucugcuccucccccgagcucaucgcccucuccuccuccgagaccaccaagcacgccaccaacaccgucuacgagaccaccugcacccccaucuccaagaccaagcccgacgacgaccucuccuccaaggccaagaccgccgcccucgaguccaaccuccccggcucccccaacaccucccgcggcuggcuccccaagucccccaccaagggcgaggacugggagacccucaaguccugcucccccgccuccucccccgaccucacccucgaggacgucaucgccgaccccacccucugcuucaacuccggcgaguccucccucgucgagaucgacggcgaguccgagaaccucucccucaccaccugcgaguaccgccgcgagggcaccucccagcucgccuccccccucaagcucaaguacaaccagggcgucgucgagcacuuccagcgcggccuccgcaacggcuacugcaaggagacccuccgccccuccguccccgagaucuucaacaacauccaggacgucaagacccaguccaucuccuaccucgccuaccagggcgccggcuucguccacaaccacuucuccgacuccgacgccaagauguuccagaccugcgucccccagcaguccuccgcccaggacaugcacguccccguccccaagcagcucgcccaccucccccuccccgcccucaagcuccccucccccugcaaguccaagucccucggcgaccucaccuccgaggacaucgccugcaacuucgaguccaaguaccagugcaucuccaaguccuucgucaccaccggcauccgcgacaagaagggcgucaccgucaagaccaagucccucgagcccaucgacgcccucaccgagcagcuccgcaagcucgucuccuucgaccaggaggacaacugccagguccucuacuccaagcaggacgccaaccagcucccccgcgcccucguccgcaagcucuccucccgcucccagucccgcguccgcaacaucgccucccgcgccaaggagaagcaggaggccaacaagcagaagguccccaaccccuccaacggcgccggcgucguccuccgcaacaagcccuccgcccccacccccgccgucaaccgccacuccaccggcuccuacaucgccggcuaccucaagaacaccaagggcggcggccucgagggccgcggcauccccgagggcgccugcaccgcccuccacuacggccacgucgaccaguucugcuccgacaacuccguccuccagaccgagcccuccuccgacgacaagcccgagaucuacuuccuccuccgccucuga

SEQ ID NO: 47752 - RNA, 3288 nt, Artificial Sequence
  derived and/or modified sequence opt2 from PLCL1__Homo_sapiens__NP_006217
auggccgagggcgccgccggccgcgaggaccccgccccccccgacgccgccggcggcgaggacgacccccgcgucggccccgacgccgccggcgacugcgucaccgccgccuccggcggccgcaugcgcgaccgccgcuccggcgucgcccuccccggcgccgccggcacccccgccgacuccgaggccggccuccucgaggccgcccgcgccaccccccgccgcuccuccaucaucaaggaccccuccaaccagaagugcggcggccgcaagaagaccgucuccuucuccuccaugcccuccgagaagaagaucuccuccgccaacgacugcaucuccuucaugcaggccggcugcgagcucaagaagguccgccccaacucccgcaucuacaaccgcuucuucacccucgacaccgaccuccaggcccuccgcugggagcccuccaagaaggaccucgagaaggccaagcucgacaucuccgccaucaaggagauccgccucggcaagaacaccgagaccuuccgcaacaacggccucgccgaccagaucugcgaggacugcgccuucuccauccuccacggcgagaacuacgagucccucgaccucgucgccaacuccgccgacgucgccaacaucugggucuccggccuccgcuaccucgucucccgcuccaagcagccccucgacuucauggagggcaaccagaacaccccccgcuucauguggcucaagaccgucuucgaggccgccgacgucgacggcaacggcaucaugcucgaggacaccuccgucgagcucaucaagcagcucaaccccacccucaaggaggccaagauccgccucaaguucaaggagauccagaaguccaaggagaagcucaccacccgcgucaccgaggaggaguucugcgaggccuucugcgagcucugcacccgccccgaggucuacuuccuccucguccagaucuccaagaacaaggaguaccucgacgccaacgaccucaugcucuuccucgaggccgagcagggcgucacccacaucaccgaggacaucugccucgacaucauccgccgcuacgagcucuccgaggagggccgccagaagggcuuccucgccaucgacggcuucacccaguaccuccucuccuccgagugcgacaucuucgaccccgagcagaagaaggucgcccaggacaugacccagccccucucccacuacuacaucaacgccucccacaacaccuaccucaucgaggaccaguuccgcggccccgccgacaucaacggcuacauccgcgcccucaagaugggcugccgcuccgucgagcucgacgucuccgacggcuccgacaacgagcccauccucugcaaccgcaacaacaugaccacccacgucuccuuccgcuccgucaucgaggucaucaacaaguucgccuucgucgccuccgaguacccccucauccucugccucggcaaccacugcucccucccccagcagaaggucauggcccagcagaugaagaaggucuucggcaacaagcucuacaccgaggccccccuccccuccgaguccuaccuccccucccccgagaagcucaagcgcaugaucaucgucaagggcaagaagcuccccuccgaccccgacguccucgagggcgaggucaccgacgaggacgaggaggccgagaugucccgccgcauguccgucgacuacaacggcgagcagaagcagauccgccucugccgcgagcucuccgaccucgucuccaucugcaaguccguccaguaccgcgacuucgagcucuccaugaagucccagaacuacugggagaugugcuccuucuccgagaccgaggccucccgcaucgccaacgaguaccccgaggacuucgucaacuacaacaagaaguuccucucccgcaucuaccccuccgccaugcgcaucgacuccuccaaccucaacccccaggacuucuggaacugcggcugccagaucgucgccaugaacuuccagacccccggccccaugauggaccuccacaccggcugguuccuccagaacggcggcugcggcuacguccuccgccccuccaucaugcgcgacgaggucuccuacuucuccgccaacaccaagggcauccuccccggcgucuccccccucgcccuccacaucaagaucaucuccggccagaacuuccccaagcccaagggcgccugcgccaagggcgacgucaucgaccccuacgucugcaucgagauccacggcauccccgccgacugcuccgagcagcgcaccaagaccguccagcagaacuccgacaaccccaucuucgacgagaccuucgaguuccaggucaaccuccccgagcucgccaugauccgcuucgucguccucgacgacgacuacaucggcgacgaguucaucggccaguacaccauccccuucgagugccuccagcccggcuaccgccacgucccccuccgcuccuucgucggcgacaucauggagcacgucacccucuucguccacaucgccaucaccaaccgcuccggcggcggcaaggcccagaagcgcucccucuccguccgcaugggcaagaagguccgcgaguacaccaugcuccgcaacaucggccucaagaccaucgacgacaucuucaagaucgccguccacccccuccgcgaggccaucgacaugcgcgagaacaugcagaacgccaucgucuccaucaaggagcucugcggccucccccccaucgccucccucaagcagugccuccucacccucuccucccgccucaucaccuccgacaacacccccuccgucucccucgucaugaaggacuccuuccccuaccucgagccccucggcgccauccccgacguccagaagaagaugcucaccgccuacgaccucaugauccaggagucccgcuuccucaucgagauggccgacaccguccaggagaagaucguccagugccagaaggccggcauggaguuccacgaggagcuccacaaccucggcgccaaggagggccucaagggccgcaagcucaacaaggccaccgaguccuucgccuggaacaucaccguccucaagggccagggcgaccuccucaagaacgccaagaacgaggccaucgagaacaugaagcagauccagcucgccugccucuccugcggccucuccaaggcccccuccuccuccgccgaggccaaguccaagcgcucccucgaggccaucgaggagaaggaguccuccgaggagaacggcaagcucuga

SEQ ID NO: 47753 - RNA, 3384 nt, Artificial Sequence
  derived and/or modified sequence opt2 from PLCL2__Homo_sapiens__NP_001137854
auggccgagugcggccgcggcggcgccgccggcggcgcccuccccaccucccccggccccgcccucggcgccaagggcgcccucaaggccggcgucggcgagggcggcggcggcggcggccgccucggccacggccgcgcccgcuacgacuccggcggcgucuccaacggcgacugcucccucggcgucuccggcgacgaggcccgcgccucccccacccgcggcccccgcggcgucgcccucgcccccacccccuccgccgucgucugcacccucccccgcgaguccaagcccggcggccucccccgccgcuccuccaucaucaaggacggcaccaagcagaagcgcgagcgcaagaagaccgucuccuucuccuccaugcccaccgagaagaagaucuccuccgccuccgacugcaucaacuccauggucgagggcuccgagcucaagaagguccgcuccaacucccgcaucuaccaccgcuacuuccuccucgacgccgacaugcagucccuccgcugggagcccuccaagaaggacuccgagaaggccaagaucgacaucaaguccaucaaggagguccgcaccggcaagaacaccgacaucuuccgcuccaacggcaucuccgaccagaucuccgaggacugcgccuucuccgucaucuacggcgagaacuacgagucccucgaccucgucgccaacuccgccgacgucgccaacaucugggucaccggccuccgcuaccucaucuccuacggcaagcacacccucgacaugcucgaguccucccaggacaacaugcgcaccuccugggucucccagauguucuccgagaucgacgucgacaaccucggccacaucacccucugcaacgccguccagugcauccgcaaccucaaccccggccucaagaccuccaagaucgagcucaaguucaaggagcuccacaaguccaaggacaaggccggcaccgaggucaccaaggaggaguucaucgaggucuuccacgagcucugcacccgccccgagaucuacuuccuccucguccaguucuccuccaacaaggaguuccucgacaccaaggaccucaugauguuccucgaggccgagcagggcgucgcccacaucaacgaggagaucucccucgagaucauccacaaguacgagcccuccaaggagggccaggagaagggcuggcucuccaucgacggcuucaccaacuaccucaugucccccgacugcuacaucuucgaccccgagcacaagaaggucugccaggacaugaagcagccccucucccacuacuucaucaacuccucccacaacaccuaccucaucgaggaccaguuccgcggccccuccgacaucaccggcuacauccgcgcccucaagaugggcugccgcuccgucgagcucgacgucugggacggccccgacaacgagcccgucaucuacaccggccacaccaugaccucccagaucgucuuccgcuccgucaucgacaucaucaacaaguacgccuucuucgccuccgaguacccccucauccucugccucgagaaccacugcuccaucaagcagcagaaggucaugguccagcacaugaagaagcuccucggcgacaagcucuacaccaccucccccaacgucgaggaguccuaccuccccucccccgacguccucaagggcaagauccucaucaaggccaagaagcucuccuccaacugcuccggcgucgagggcgacgucaccgacgaggacgagggcgccgagaugucccagcgcaugggcaaggagaacauggagcagcccaacaacguccccgucaagcgcuuccagcucugcaaggagcucuccgagcucgucuccaucugcaaguccguccaguucaaggaguuccaggucuccuuccagguccagaaguacugggaggucugcuccuucaacgagguccucgccuccaaguacgccaacgagaaccccggcgacuucgucaacuacaacaagcgcuuccucgcccgcgucuuccccucccccaugcgcaucgacuccuccaacaugaacccccaggacuucuggaagugcggcugccagaucgucgccaugaacuuccagacccccggccucaugauggaccucaacaucggcugguuccgccagaacggcaacugcggcuacguccuccgccccgccaucaugcgcgaggaggucuccuucuucuccgccaacaccaaggacuccguccccggcgucuccccccagcuccuccacaucaagaucaucuccggccagaacuuccccaagcccaagggcuccggcgccaagggcgacgucgucgaccccuacgucuacgucgagauccacggcauccccgccgacugcgccgagcagcgcaccaagaccguccaccagaacggcgacgcccccaucuucgacgaguccuucgaguuccagaucaaccuccccgagcucgccaugguccgcuucgucguccucgacgacgacuacaucggcgacgaguucaucggccaguacaccauccccuucgagugccuccagaccggcuaccgccacgucccccuccagucccucaccggcgagguccucgcccacgccucccucuucguccacgucgccaucaccaaccgccgcggcggcggcaagccccacaagcgcggccucuccguccgcaagggcaagaagucccgcgaguacgccucccuccgcacccucuggaucaagaccgucgacgaggucuucaagaacgcccagccccccauccgcgacgccaccgaccuccgcgagaacaugcagaacgccgucgucuccuucaaggagcucugcggccucuccuccgucgccaaccucaugcagugcaugcucgccgucuccccccgcuuccucggccccgacaacaccccccucgucguccucaaccucuccgagcaguaccccaccauggagcuccagggcaucguccccgagguccucaagaagaucgucaccaccuacgacaugaugauccagucccucaaggcccucaucgagaacgccgacgccgucuacgagaagaucguccacugccagaaggccgccauggaguuccacgagcaccuccacuccaucggcaccaaggagggccucaaggagcgcaagcuccagaaggccgucgaguccuucaccuggaacaucaccauccucaagggccaggccgaccuccucaaguacgccaagaacgagacccucgagaaccucaagcagauccacuucgccgccgucuccugcggccucaacaagcccggcaccgagaacgccgacguccagaagccccgccgcucccucgaggucauccccgagaaggccaacgacgagaccggcgaguga

SEQ ID NO: 47754 - RNA, 918 nt, Artificial Sequence
  derived and/or modified sequence opt2 from PLCXD2__Homo_sapiens__NP_001172035
augcucgccguccgcaaggcccgccgcaagcuccgcaugggcaccaucugcucccccaaccccuccggcaccaagaccuccuccgaggucugcaacgccgacuggauggccucccuccccccccaccuccacaaccucccccucuccaaccucgccauccccggcucccacgacuccuucuccuacugggucgacgagaagucccccgucggccccgaccagacccaggccaucaagcgccucgcccgcaucucccucgucaagaagcucaugaagaagugguccgucacccagaaccucaccuuccgcgagcagcucgaggccggcauccgcuacuucgaccuccgcgucuccuccaagcccggcgacgccgaccaggagaucuacuucauccacggccucuucggcaucaaggucugggacggccucauggagaucgacuccuuccucacccagcacccccaggagaucaucuuccucgacuucaaccacuucuacgccauggacgagacccaccacaagugccucguccuccgcauccaggaggccuucggcaacaagcucugccccgccugcuccgucgagucccucacccuccgcacccucugggagaagaacugccagguccucaucuucuaccacugccccuucuacaagcaguaccccuuccucuggcccggcaagaagauccccgcccccugggccaacaccaccuccguccgcaagcucauccucuuccucgagaccacccucuccgagcgcgccucccgcggcuccuuccacgucucccaggccauccucaccccccgcgucaagaccaucgcccgcggccucgucggcggccucaagaacacccucguccacuccaaccgcuggaacucccacggccccucccuccucucccaggagcgcuccuga

SEQ ID NO: 47755 - RNA, 966 nt, Artificial Sequence
  derived and/or modified sequence opt2 from PLCXD3__Homo_sapiens__NP_001005473
auggccuccucccagggcaagaacgagcucaagcucgccgacuggauggccacccuccccgaguccaugcacuccaucccccucaccaaccucgccauccccggcucccacgacuccuucuccuucuacaucgacgaggccucccccgucggccccgagcagcccgagaccguccagaacuucgucuccgucuucggcaccgucgccaagaagcucaugcgcaaguggcucgccacccagaccaugaacuucaccggccagcucggcgccggcauccgcuacuucgaccuccgcaucuccaccaagccccgcgaccccgacaacgagcucuacuucgcccacggccucuucuccgccaaggucaacgagggccucgaggagaucaacgccuuccucaccgaccaccacaaggaggucgucuuccucgacuucaaccacuucuacggcaugcagaaguaccaccacgagaagcucguccagaugcucaaggacaucuacggcaacaagaugugccccgccaucuucgcccaggaggucucccucaaguaccucugggagaaggacuaccagguccucgucuucuaccacucccccgucgcccucgagguccccuuccucuggcccggccagaugaugcccgcccccugggccaacaccaccgaccccgagaagcucauccaguuccuccaggccuccaucaccgagcgccgcaagaagggcuccuucuucaucucccaggucguccucacccccaaggccuccaccgucgucaagggcgucgccuccggccuccgcgagaccaucaccgagcgcgcccuccccgccaugaugcaguggguccgcacccagaagcccggcgaguccggcaucaacaucgucaccgccgacuucgucgagcucggcgacuucaucuccaccgucaucaagcucaacuacgucuucgacgagggcgaggccaacaccuga

SEQ ID NO: 47756 - RNA, 1827 nt, Artificial Sequence
  derived and/or modified sequence opt2 from PLCZ1__Homo_sapiens__NP_149114
auggagaugcgcugguuccucuccaagauccaggacgacuuccgcggcggcaagaucaaccucgagaagacccagcgccuccucgagaagcucgacauccgcugcuccuacauccacgucaagcagaucuucaaggacaacgaccgccucaagcagggccgcaucaccaucgaggaguuccgcgccaucuaccgcaucaucacccaccgcgaggagaucaucgagaucuucaacaccuacuccgagaaccgcaagauccuccucgccuccaaccucgcccaguuccucacccaggagcaguacgccgccgagauguccaaggccaucgccuucgagaucauccagaaguacgagcccaucgaggagguccgcaaggcccaccagaugucccucgagggcuucacccgcuacauggacucccgcgagugccuccucuucaagaacgagugccgcaaggucuaccaggacaugacccacccccucaacgacuacuucaucuccuccucccacaacaccuaccucgucuccgaccagcuccucggccccuccgaccucuggggcuacgucuccgcccucgucaagggcugccgcugccucgagaucgacugcugggacggcgcccagaacgagcccgucgucuaccacggcuacacccucaccuccaagcuccucuucaagaccgucauccaggccauccacaaguacgccuucaugaccuccgacuaccccgucguccucucccucgagaaccacugcuccaccgcccagcaggaggucauggccgacaaccuccaggccaccuucggcgagucccuccucuccgacaugcucgacgacuuccccgacacccuccccucccccgaggcccucaaguucaagauccucgucaagaacaagaagaucggcacccucaaggagacccacgagcgcaagggcuccgacaagcgcggcgacaaccaggacaaggagaccggcgucaagaagcuccccggcgucaugcucuucaagaagaagaagacccgcaagcucaagaucgcccucgcccucuccgaccucgucaucuacaccaaggccgagaaguucaaguccuuccagcacucccgccucuaccagcaguucaacgagaacaacuccaucggcgagacccaggcccgcaagcucuccaagcuccgcguccacgaguucaucuuccacacccgcaaguucaucacccgcaucuaccccaaggccacccgcgccgacuccuccaacuucaacccccaggaguucuggaacaucggcugccagauggucgcccucaacuuccagacccccggccuccccauggaccuccagaacggcaaguuccucgacaacggcggcuccggcuacauccucaagccccacuuccuccgcgaguccaaguccuacuucaaccccuccaacaucaaggagggcaugcccaucacccucaccauccgccucaucuccggcauccagcucccccucacccacuccuccuccaacaagggcgacucccucgucaucaucgaggucuucggcguccccaacgaccagaugaagcagcagacccgcgucaucaagaagaacgccuucuccccccgcuggaacgagaccuucaccuucaucauccacguccccgagcucgcccucauccgcuucgucgucgagggccagggccucaucgccggcaacgaguuccucggccaguacacccucccccuccucugcaugaacaagggcuaccgccgcaucccccucuucucccgcaugggcgagucccucgagcccgccucccucuucgucuacgucugguacguccgcuga

SEQ ID NO: 47757 - RNA, 3111 nt, Artificial Sequence
  derived and/or modified sequence opt2 from PLD1__Homo_sapiens__NP_001123553
augucccucaagaacgagccccgcgucaacaccuccgcccuccagaagaucgccgccgacauguccaacaucaucgagaaccucgacacccgcgagcuccacuucgagggcgaggaggucgacuacgacgucucccccuccgaccccaagauccaggaggucuacauccccuucuccgccaucuacaacacccagggcuucaaggagcccaacauccagaccuaccucuccggcugccccaucaaggcccagguccucgaggucgagcgcuucaccuccaccacccgcguccccuccaucaaccucuacaccaucgagcucacccacggcgaguucaaguggcaggucaagcgcaaguucaagcacuuccaggaguuccaccgcgagcuccucaaguacaaggccuucauccgcauccccauccccacccgccgccacaccuuccgccgccagaacguccgcgaggagccccgcgagaugcccucccucccccgcuccuccgagaacaugauccgcgaggagcaguuccucggccgccgcaagcagcucgaggacuaccucaccaagauccucaagaugcccauguaccgcaacuaccacgccaccaccgaguuccucgacaucucccagcucuccuucauccacgaccucggccccaagggcaucgagggcaugaucaugaagcgcuccggcggccaccgcauccccggccucaacugcugcggccagggccgcgccugcuaccgcugguccaagcgcuggcucaucgucaaggacuccuuccuccucuacaugaagcccgacuccggcgccaucgccuucguccuccucgucgacaaggaguucaagaucaaggucggcaagaaggagaccgagaccaaguacggcauccgcaucgacaaccucucccgcacccucauccucaagugcaacuccuaccgccacgcccgcugguggggcggcgccaucgaggaguucauccagaagcacggcaccaacuuccucaaggaccaccgcuucggcuccuacgccgccauccaggagaacgcccucgccaagugguacgucaacgccaagggcuacuucgaggacgucgccaacgccauggaggaggccaacgaggagaucuucaucaccgacugguggcucucccccgagaucuuccucaagcgccccgucgucgagggcaaccgcuggcgccucgacugcauccucaagcgcaaggcccagcagggcguccgcaucuucaucaugcucuacaaggaggucgagcucgcccucggcaucaacuccgaguacaccaagcgcacccucaugcgccuccaccccaacaucaaggucaugcgccaccccgaccacgucuccuccaccgucuaccucugggcccaccacgagaagcucgucaucaucgaccaguccgucgccuucgucggcggcaucgaccucgccuacggccgcugggacgacaacgagcaccgccucaccgacgucggcuccgucaagcgcgucaccuccggccccucccucggcucccucccccccgccgccauggaguccauggagucccuccgccucaaggacaagaacgagcccguccagaaccuccccauccagaaguccaucgacgacgucgacuccaagcucaagggcaucggcaagccccgcaaguucuccaaguucucccucuacaagcagcuccaccgccaccaccuccacgacgccgacuccaucuccuccaucgacuccaccuccaacaccggcuccauccgcucccuccagaccggcgucggcgagcuccacggcgagacccgcuucuggcacggcaaggacuacugcaacuucgucuucaaggacuggguccagcucgacaagcccuucgccgacuucaucgaccgcuacuccaccccccgcaugcccuggcacgacaucgccuccgccguccacggcaaggccgcccgcgacgucgcccgccacuucauccagcgcuggaacuucaccaagaucaugaaguccaaguaccgcucccucuccuaccccuuccuccuccccaagucccagaccaccgcccacgagcuccgcuaccagguccccggcuccguccacgccaacguccagcuccuccgcuccgccgccgacugguccgccggcaucaaguaccacgaggaguccauccacgccgccuacguccacgucaucgagaacucccgccacuacaucuacaucgagaaccaguucuucaucuccugcgccgacgacaaggucgucuucaacaagaucggcgacgccaucgcccagcgcauccucaaggcccaccgcgagaaccagaaguaccgcgucuacgucgucaucccccuccuccccggcuucgagggcgacaucuccaccggcggcggcaacgcccuccaggccaucaugcacuucaacuaccgcaccaugugccgcggcgagaacuccauccucggccagcucaaggccgagcucggcaaccaguggaucaacuacaucuccuucugcggccuccgcacccacgccgagcucgagggcaaccucgucaccgagcucaucuacguccacuccaagcuccucaucgccgacgacaacaccgucaucaucggcuccgccaacaucaacgaccgcuccaugcucggcaagcgcgacuccgagauggccgucaucguccaggacaccgagaccguccccuccgucauggacggcaaggaguaccaggccggccgcuucgcccgcggccuccgccuccagugcuuccgcgucguccucggcuaccucgacgaccccuccgaggacauccaggaccccgucuccgacaaguucuucaaggaggucugggucuccaccgccgcccgcaacgccaccaucuacgacaaggucuuccgcugccuccccaacgacgagguccacaaccucauccagcuccgcgacuucaucaacaagcccguccucgccaaggaggaccccauccgcgccgaggaggagcucaagaagauccgcggcuuccucguccaguuccccuucuacuuccucuccgaggagucccuccuccccuccgucggcaccaaggaggccaucguccccauggaggucuggaccuga

SEQ ID NO: 47758 - RNA, 2769 nt, Artificial Sequence
  derived and/or modified sequence opt2 from PLD2__Homo_sapiens__NP_001230037
augaccgccacccccgagucccucuuccccaccggcgacgagcucgacuccucccagcuccagauggaguccgacgaggucgacacccucaaggagggcgaggaccccgccgaccgcaugcaccccuuccucgccaucuacgagcuccagucccucaagguccacccccucgucuucgcccccggcguccccgucaccgcccaggucgucggcaccgagcgcuacaccuccggcuccaaggucggcaccugcacccucuacuccguccgccucacccacggcgacuucuccuggaccaccaagaagaaguaccgccacuuccaggagcuccaccgcgaccuccuccgccacaagguccucaugucccuccucccccucgcccgcuucgccgucgccuacucccccgcccgcgacgccggcaaccgcgagaugcccucccucccccgcgccggccccgagggcuccacccgccacgccgccuccaagcagaaguaccucgagaacuaccucaaccgccuccucaccauguccuucuaccgcaacuaccacgccaugaccgaguuccucgaggucucccagcucuccuucauccccgaccucggccgcaagggccucgagggcaugauccgcaagcgcuccggcggccaccgcguccccggccucaccugcugcggccgcgaccaggucugcuaccgcugguccaagcgcuggcucgucgucaaggacuccuuccuccucuacaugugccucgagaccggcgccaucuccuucguccagcucuucgaccccggcuucgagguccaggucggcaagcgcuccaccgaggcccgccacggcguccgcaucgacaccucccaccgcucccucauccucaagugcuccuccuaccgccaggcccgcuggugggcccaggagaucaccgagcucgcccagggccccggccgcgacuuccuccagcuccaccgccacgacuccuacgcccccccccgccccggcacccucgcccgcugguucgucaacggcgccggcuacuucgccgccgucgccgacgccauccuccgcgcccaggaggagaucuucaucaccgacugguggcucucccccgaggucuaccucaagcgccccgcccacuccgacgacuggcgccucgacaucaugcucaagcgcaaggccgaggagggcguccgcgucuccauccuccucuucaaggaggucgagcucgcccucggcaucaacuccggcuacuccaagcgcgcccucaugcuccuccaccccaacaucaaggucaugcgccaccccgaccaggucacccucugggcccaccacgagaagcuccucgucgucgaccaggucgucgccuuccucggcggccucgaccucgccuacggccgcugggacgaccuccacuaccgccucaccgaccucggcgacuccuccgaguccgccgccucccagccccccaccccccgccccgacucccccgccacccccgaccucucccacaaccaguucuucuggcucggcaaggacuacuccaaccucaucaccaaggacuggguccagcucgaccgccccuucgaggacuucaucgaccgcgagaccaccccccgcaugcccuggcgcgacgucggcgucgucguccacggccuccccgcccgcgaccucgcccgccacuucauccagcgcuggaacuucaccaagaccaccaaggccaaguacaagacccccaccuaccccuaccuccuccccaaguccaccuccaccgccaaccagcuccccuucacccuccccggcggccagugcaccaccguccagguccuccgcuccgucgaccgcugguccgccggcacccucgagaacuccauccucaacgccuaccuccacaccauccgcgagucccagcacuuccucuacaucgagaaccaguucuucaucuccugcuccgacggccgcaccguccucaacaaggucggcgacgagaucgucgaccgcauccucaaggcccacaagcagggcuggugcuaccgcgucuacguccuccucccccuccuccccggcuucgagggcgacaucuccaccggcggcggcaacuccauccaggccauccuccacuucaccuaccgcacccucugccgcggcgaguacuccauccuccaccgccucaaggccgccaugggcaccgccuggcgcgacuacaucuccaucugcggccuccgcacccacggcgagcucggcggccaccccgucuccgagcucaucuacauccacuccaagguccucaucgccgacgaccgcaccgucaucaucggcuccgccaacaucaacgaccgcucccuccucggcaagcgcgacuccgagcucgccguccucaucgaggacaccgagaccgagcccucccucaugaacggcgccgaguaccaggccggcuccgucauccucggcgccaacacccgccccgaccucgaccuccgcgaccccaucugcgacgacuucuuccagcucuggcaggacauggccgaguccaacgccaacaucuacgagcagaucuuccgcugccuccccuccaacgccacccgcucccuccgcacccuccgcgaguacgucgccgucgagccccucgccaccgucucccccccccucgcccgcuccgagcucacccagguccagggccaccucguccacuucccccucaaguuccucgaggacgagucccuccuccccccccucggcuccaaggagggcaugaucccccucgaggucuggaccuga

SEQ ID NO: 47759 - RNA, 1473 nt, Artificial Sequence
  derived and/or modified sequence opt2 from PLD3__Homo_sapiens__NP_001026866
augaagcccaagcucauguaccaggagcucaagguccccgccgaggagcccgccaacgagcuccccaugaacgagaucgaggccuggaaggccgccgagaagaaggcccgcuggguccuccucguccucauccucgccgucgucggcuucggcgcccucaugacccagcucuuccucugggaguacggcgaccuccaccucuucggccccaaccagcgccccgcccccugcuacgaccccugcgaggccguccucgucgaguccauccccgagggccucgacuuccccaacgccuccaccggcaaccccuccaccucccaggccuggcucggccuccucgccggcgcccacuccucccucgacaucgccuccuucuacuggacccucaccaacaacgacacccacacccaggagcccuccgcccagcagggcgaggagguccuccgccagcuccagacccucgcccccaagggcgucaacguccgcaucgccgucuccaagcccuccggcccccagccccaggccgaccuccaggcccuccuccaguccggcgcccagguccgcauggucgacaugcagaagcucacccacggcguccuccacaccaaguucugggucgucgaccagacccacuucuaccucggcuccgccaacauggacuggcgcucccucacccaggucaaggagcucggcgucgucauguacaacugcuccugccucgcccgcgaccucaccaagaucuucgaggccuacugguuccucggccaggccggcuccuccauccccuccaccuggccccgcuucuacgacacccgcuacaaccaggagacccccauggagaucugccucaacggcacccccgcccucgccuaccucgccuccgccccccccccccucugccccuccggccgcacccccgaccucaaggcccuccucaacgucgucgacaacgcccgcuccuucaucuacgucgccgucaugaacuaccuccccacccucgaguucucccacccccaccgcuucuggcccgccaucgacgacggccuccgccgcgccaccuacgagcgcggcgucaagguccgccuccucaucuccugcuggggccacuccgagcccuccaugcgcgccuuccuccucucccucgccgcccuccgcgacaaccacacccacuccgacauccaggucaagcucuucgucguccccgccgacgaggcccaggcccgcauccccuacgcccgcgucaaccacaacaaguacauggucaccgagcgcgccaccuacaucggcaccuccaacugguccggcaacuacuucaccgagaccgccggcaccucccuccucgucacccagaacggccgcggcggccuccgcucccagcucgaggccaucuuccuccgcgacugggacucccccuacucccacgaccucgacaccuccgccgacuccgucggcaacgccugccgccuccucuga

SEQ ID NO: 47760 - RNA, 1521 nt, Artificial Sequence
  derived and/or modified sequence opt2 from PLD4__Homo_sapiens__NP_620145
augcucaagccccucuggaaggccgccgucgcccccaccuggcccugcuccaugcccccccgccgccccugggaccgcgaggccggcacccuccagguccucggcgcccucgccguccucuggcucggcuccgucgcccucaucugccuccucuggcaggucccccgcccccccaccuggggccagguccagcccaaggacgucccccgcuccugggagcacggcuccucccccgccugggagccccucgaggccgaggcccgccagcagcgcgacuccugccagcucguccucgucgaguccaucccccaggaccuccccuccgccgccggcucccccuccgcccagccccucggccaggccuggcuccagcuccucgacaccgcccaggaguccguccacgucgccuccuacuacuggucccucaccggccccgacaucggcgucaacgacuccuccucccagcucggcgaggcccuccuccagaagcuccagcagcuccucggccgcaacaucucccucgccgucgccaccuccucccccacccucgcccgcaccuccaccgaccuccagguccucgccgcccgcggcgcccacguccgccagguccccaugggccgccucacccgcggcguccuccacuccaaguucugggucgucgacggccgccacaucuacaugggcuccgccaacauggacuggcgcucccucacccaggucaaggagcucggcgccgucaucuacaacugcucccaccucgcccaggaccucgagaagaccuuccagaccuacuggguccucggcguccccaaggccguccuccccaagaccuggccccagaacuucuccucccacuucaaccgcuuccagcccuuccacggccucuucgacggcguccccaccaccgccuacuucuccgccuccccccccgcccucugcccccagggccgcacccgcgaccucgaggcccuccucgccgucaugggcuccgcccaggaguucaucuacgccuccgucauggaguacuuccccaccacccgcuucucccaccccccccgcuacuggcccguccucgacaacgcccuccgcgccgccgccuucggcaagggcguccgcguccgccuccucgucggcugcggccucaacaccgaccccaccauguuccccuaccuccgcucccuccaggcccucuccaaccccgccgccaacgucuccgucgacgucaaggucuucaucguccccgucggcaaccacuccaacauccccuucucccgcgucaaccacuccaaguucauggucaccgagaaggccgccuacaucggcaccuccaacugguccgaggacuacuucuccuccaccgccggcgucggccucgucgucacccagucccccggcgcccagcccgccggcgccaccguccaggagcagcuccgccagcucuucgagcgcgacugguccucccgcuacgccgucggccucgacggccaggcccccggccaggacugcgucuggcagggcuga

SEQ ID NO: 47761 - RNA, 1425 nt, Artificial Sequence
  derived and/or modified sequence opt2 from PLD5__Homo_sapiens__NP_001182740
augucccagcagaagugcaucgucaucuucgcccucgucugcugcuucgccauccucgucgcccucaucuucuccgccgucgacaucaugggcgaggacgaggacggccucuccgagaagaacugccagaacaagugccgcaucgcccucgucgagaacauccccgagggccucaacuacuccgagaacgcccccuuccaccucucccucuuccagggcuggaugaaccuccucaacauggccaagaaguccgucgacaucgucuccucccacugggaccucaaccacacccaccccuccgccugccagggccagcgccucuucgagaagcuccuccagcucaccucccagaacaucgagaucaagcucgucuccgacgucaccgccgacuccaagguccucgaggcccucaagcucaagggcgccgaggucaccuacaugaacaugaccgccuacaacaagggccgccuccaguccuccuucuggaucgucgacaagcagcacgucuacaucggcuccgccggccucgacuggcagucccucggccagaugaaggagcucggcgucaucuucuacaacugcuccugccucguccucgaccuccagcgcaucuucgcccucuacuccucccucaaguucaagucccgcgucccccagaccugguccaagcgccucuacggcgucuacgacaacgagaagaagcuccagcuccagcucaacgagaccaagucccaggccuucgucuccaacucccccaagcucuucugccccaagaaccgcuccuucgacaucgacgccaucuacuccgucaucgacgacgccaagcaguacgucuacaucgccgucauggacuaccuccccaucuccuccaccuccaccaagcgcaccuacuggcccgaccucgacgccaagauccgcgaggcccucguccuccgcuccguccgcguccgccuccuccucuccuucuggaaggagaccgacccccucaccuucaacuucaucuccucccucaaggccaucugcaccgagaucgccaacugcucccucaaggucaaguucuucgaccucgagcgcgagaacgccugcgccaccaaggagcagaagaaccacaccuucccccgccucaaccgcaacaaguacauggucaccgacggcgccgccuacaucggcaacuucgacugggucggcaacgacuucacccagaacgccggcaccggccucgucaucaaccaggccgacguccgcaacaaccgcuccaucaucaagcagcucaaggacgucuucgagcgcgacugguacucccccuacgccaagacccuccagcccaccaagcagcccaacugcuccucccucuucaagcucaagccccucuccaacaagaccgccaccgacgacaccggcggcaaggacccccgcaacgucuga

SEQ ID NO: 47762 - RNA, 13725 nt, Artificial Sequence
  derived and/or modified sequence opt2 from PLEC__Homo_sapiens__NP_000436
auguccggcgaggacgccgagguccgcgccgucuccgaggacgucuccaacggcuccuccggcucccccucccccggcgacacccuccccuggaaccucggcaagacccagcgcucccgccgcuccggcggcggcgccggcuccaacggcuccguccucgaccccgccgagcgcgccgucauccgcaucgccgacgagcgcgaccgcguccagaagaagaccuucaccaagugggucaacaagcaccucaucaaggcccagcgccacaucuccgaccucuacgaggaccuccgcgacggccacaaccucaucucccuccucgagguccucuccggcgacucccucccccgcgagaagggccgcaugcgcuuccacaagcuccagaacguccagaucgcccucgacuaccuccgccaccgccaggucaagcucgucaacauccgcaacgacgacaucgccgacggcaaccccaagcucacccucggccucaucuggaccaucauccuccacuuccagaucuccgacauccaggucuccggccaguccgaggacaugaccgccaaggagaagcuccuccucuggucccagcgcauggucgagggcuaccagggccuccgcugcgacaacuucaccuccuccuggcgcgacggccgccucuucaacgccaucauccaccgccacaagccccuccucaucgacaugaacaaggucuaccgccagaccaaccucgagaaccucgaccaggccuucuccgucgccgagcgcgaccucggcgucacccgccuccucgaccccgaggacgucgacgucccccagcccgacgagaaguccaucaucaccuacgucuccucccucuacgacgccaugccccgcguccccgacguccaggacggcguccgcgccaacgagcuccagcuccgcuggcaggaguaccgcgagcucguccuccuccuccuccaguggaugcgccaccacaccgccgccuucgaggagcgccgcuuccccuccuccuucgaggagaucgagauccucuggucccaguuccucaaguucaaggagauggagcuccccgccaaggaggccgacaagaaccgcuccaagggcaucuaccagucccucgagggcgccguccaggccggccagcucaaggucccccccggcuaccacccccucgacgucgagaaggaguggggcaagcuccacgucgccauccucgagcgcgagaagcagcuccgcuccgaguucgagcgccucgagugccuccagcgcaucgucaccaagcuccagauggaggccggccucugcgaggagcagcucaaccaggccgacgcccuccuccaguccgacguccgccuccucgccgccggcaaggucccccagcgcgccggcgaggucgagcgcgaccucgacaaggccgacuccaugauccgccuccucuucaacgacguccagacccucaaggacggccgccacccccagggcgagcagauguaccgccgcgucuaccgccuccacgagcgccucgucgccauccgcaccgaguacaaccuccgccucaaggccggcgucgccgcccccgccacccaggucgcccaggucacccuccaguccguccagcgccgccccgagcucgaggacuccacccuccgcuaccuccaggaccuccucgccugggucgaggagaaccagcaccgcgucgacggcgccgaguggggcgucgaccuccccuccgucgaggcccagcucggcucccaccgcggccuccaccaguccaucgaggaguuccgcgccaagaucgagcgcgcccgcuccgacgagggccagcucucccccgccacccgcggcgccuaccgcgacugccucggccgccucgaccuccaguacgccaagcuccucaacuccuccaaggcccgccuccgcucccucgagucccuccacuccuucgucgccgccgccaccaaggagcucauguggcucaacgagaaggaggaggaggaggucggcuucgacugguccgaccgcaacaccaacaugaccgccaagaaggaguccuacuccgcccucaugcgcgagcucgagcucaaggagaagaagaucaaggagcuccagaacgccggcgaccgccuccuccgcgaggaccaccccgcccgccccaccgucgaguccuuccaggccgcccuccagacccagugguccuggaugcuccagcucugcugcugcaucgaggcccaccucaaggagaacgccgccuacuuccaguucuucuccgacguccgcgaggccgagggccagcuccagaagcuccaggaggcccuccgccgcaaguacuccugcgaccgcuccgccaccgucacccgccucgaggaccuccuccaggacgcccaggacgagaaggagcagcucaacgaguacaagggccaccucuccggccucgccaagcgcgccaaggccgucguccagcucaagccccgccaccccgcccaccccaugcgcggccgccucccccuccucgccgucugcgacuacaagcaggucgaggucaccguccacaagggcgacgagugccagcucgucggccccgcccagcccucccacuggaagguccucuccuccuccggcuccgaggccgccguccccuccgucugcuuccucguccccccccccaaccaggaggcccaggaggccgucacccgccucgaggcccagcaccaggcccucgucacccucuggcaccagcuccacgucgacaugaagucccuccucgccuggcagucccuccgccgcgacguccagcucauccgcuccuggucccucgccaccuuccgcacccucaagcccgaggagcagcgccaggcccuccacucccucgagcuccacuaccaggccuuccuccgcgacucccaggacgccggcggcuucggccccgaggaccgccucauggccgagcgcgaguacggcuccugcucccaccacuaccagcagcuccuccagucccucgagcagggcgcccaggaggagucccgcugccagcgcugcaucuccgagcucaaggacauccgccuccagcucgaggccugcgagacccgcaccguccaccgccuccgccucccccucgacaaggagcccgcccgcgagugcgcccagcgcaucgccgagcagcagaaggcccaggccgaggucgagggccucggcaagggcgucgcccgccucuccgccgaggccgagaagguccucgcccuccccgagcccucccccgccgcccccacccuccgcuccgagcucgagcucacccucggcaagcucgagcagguccgcucccucuccgccaucuaccucgagaagcucaagaccaucucccucgucauccgcggcacccagggcgccgaggagguccuccgcgcccacgaggagcagcucaaggaggcccaggccguccccgccacccuccccgagcucgaggccaccaaggccucccucaagaagcuccgcgcccaggccgaggcccagcagcccaccuucgacgcccuccgcgacgagcuccgcggcgcccaggaggucggcgagcgccuccagcagcgccacggcgagcgcgacgucgaggucgagcgcuggcgcgagcgcgucgcccagcuccucgagcgcuggcaggccguccucgcccagaccgacguccgccagcgcgagcucgagcagcucggccgccagcuccgcuacuaccgcgaguccgccgacccccucggcgccuggcuccaggacgcccgccgccgccaggagcagauccaggccaugccccucgccgacucccaggccguccgcgagcagcuccgccaggagcaggcccuccucgaggagaucgagcgccacggcgagaaggucgaggagugccagcgcuucgccaagcaguacaucaacgccaucaaggacuacgagcuccagcucgucaccuacaaggcccagcucgagcccgucgccucccccgccaagaagcccaagguccaguccggcuccgaguccgucauccaggaguacgucgaccuccgcacccacuacuccgagcucaccacccucaccucccaguacaucaaguucaucuccgagacccuccgccgcauggaggaggaggagcgccucgccgagcagcagcgcgccgaggagcgcgagcgccucgccgaggucgaggccgcccucgagaagcagcgccagcucgccgaggcccacgcccaggccaaggcccaggccgagcgcgaggccaaggagcuccagcagcgcaugcaggaggaggucguccgccgcgaggaggccgccgucgacgcccagcagcagaagcgcuccauccaggaggagcuccagcagcuccgccaguccuccgaggccgagauccaggccaaggcccgccaggccgaggccgccgagcgcucccgccuccgcaucgaggaggagauccgcgucguccgccuccagcucgaggccaccgagcgccagcgcggcggcgccgagggcgagcuccaggcccuccgcgcccgcgccgaggaggccgaggcccagaagcgccaggcccaggaggaggccgagcgccuccgccgccagguccaggacgagucccagcgcaagcgccaggccgaggucgagcucgccucccgcgucaaggccgaggccgaggccgcccgcgagaagcagcgcgcccuccaggcccucgaggagcuccgccuccaggccgaggaggccgagcgccgccuccgccaggccgaggucgagcgcgcccgccagguccaggucgcccucgagaccgcccagcgcuccgccgaggccgagcuccaguccaagcgcgccuccuucgccgagaagaccgcccagcucgagcgcucccuccaggaggagcacgucgccgucgcccagcuccgcgaggaggccgagcgccgcgcccagcagcaggccgaggccgagcgcgcccgcgaggaggccgagcgcgagcucgagcgcuggcagcucaaggccaacgaggcccuccgccuccgccuccaggccgaggaggucgcccagcagaagucccucgcccaggccgaggccgagaagcagaaggaggaggccgagcgcgaggcccgccgccgcggcaaggccgaggagcaggccguccgccagcgcgagcucgccgagcaggagcucgagaagcagcgccagcucgccgagggcaccgcccagcagcgccucgccgccgagcaggagcucauccgccuccgcgccgagaccgagcagggcgagcagcagcgccagcuccucgaggaggagcucgcccgccuccagcgcgaggccgccgccgccacccagaagcgccaggagcucgaggccgagcucgccaagguccgcgccgagauggagguccuccucgccuccaaggcccgcgccgaggaggagucccgcuccaccuccgagaaguccaagcagcgccucgaggccgaggccggccgcuuccgcgagcucgccgaggaggccgcccgccuccgcgcccucgccgaggaggccaagcgccagcgccagcucgccgaggaggacgccgcccgccagcgcgccgaggccgagcgcguccucgccgagaagcucgccgccaucggcgaggccacccgccucaagaccgaggccgagaucgcccucaaggagaaggaggccgagaacgagcgccuccgccgccucgccgaggacgaggccuuccagcgccgccgccucgaggagcaggccgcccagcacaaggccgacaucgaggagcgccucgcccagcuccgcaaggccuccgacuccgagcucgagcgccagaagggccucgucgaggacacccuccgccagcgccgccaggucgaggaggagauccucgcccucaaggccuccuucgagaaggccgccgccggcaaggccgagcucgagcucgagcucggccgcauccgcuccaacgccgaggacacccuccgcuccaaggagcaggccgagcucgaggccgcccgccagcgccagcucgccgccgaggaggagcgccgccgccgcgaggccgaggagcgcguccagaagucccucgccgccgaggaggaggccgcccgccagcgcaaggccgcccucgaggaggucgagcgccucaaggccaaggucgaggaggcccgccgccuccgcgagcgcgccgagcaggaguccgcccgccagcuccagcucgcccaggaggccgcccagaagcgccuccaggccgaggagaaggcccacgccuucgccguccagcagaaggagcaggagcuccagcagacccuccagcaggagcaguccguccucgaccagcuccgcggcgaggccgaggccgcccgccgcgccgccgaggaggccgaggaggcccgcguccaggccgagcgcgaggccgcccagucccgccgccaggucgaggaggccgagcgccucaagcaguccgccgaggagcaggcccaggcccgcgcccaggcccaggccgccgccgagaagcuccgcaaggaggccgagcaggaggccgcccgccgcgcccaggccgagcaggccgcccuccgccagaagcaggccgccgacgccgagauggagaagcacaagaaguucgccgagcagacccuccgccagaaggcccaggucgagcaggagcucaccacccuccgccuccagcucgaggagaccgaccaccagaagaaccuccucgacgaggagcuccagcgccucaaggccgaggccaccgaggccgcccgccagcgcucccaggucgaggaggagcucuucuccguccgcguccagauggaggagcucuccaagcucaaggcccgcaucgaggccgagaaccgcgcccucauccuccgcgacaaggacaacacccagcgcuuccuccaggaggaggccgagaagaugaagcaggucgccgaggaggccgcccgccucuccgucgccgcccaggaggccgcccgccuccgccagcucgccgaggaggaccucgcccagcagcgcgcccucgccgagaagaugcucaaggagaagaugcaggccguccaggaggccacccgccucaaggccgaggccgagcuccuccagcagcagaaggagcucgcccaggagcaggcccgccgccuccaggaggacaaggagcagauggcccagcagcucgccgaggagacccagggcuuccagcgcacccucgaggccgagcgccagcgccagcucgagauguccgccgaggccgagcgccucaagcuccgcgucgccgagaugucccgcgcccaggcccgcgccgaggaggacgcccagcgcuuccgcaagcaggccgaggagaucggcgagaagcuccaccgcaccgagcucgccacccaggagaaggucacccucguccagacccucgagauccagcgccagcaguccgaccacgacgccgagcgccuccgcgaggccaucgccgagcucgagcgcgagaaggagaagcuccagcaggaggccaagcuccuccagcucaaguccgaggagaugcagaccguccagcaggagcagcuccuccaggagacccaggcccuccagcaguccuuccucuccgagaaggacucccuccuccagcgcgagcgcuucaucgagcaggagaaggccaagcucgagcagcucuuccaggacgaggucgccaaggcccagcagcuccgcgaggagcagcagcgccagcagcagcagauggagcaggagcgccagcgccucgucgccuccauggaggaggcccgccgccgccagcacgaggccgaggagggcguccgccgcaagcaggaggagcuccagcagcucgagcagcagcgccgccagcaggaggagcuccucgccgaggagaaccagcgccuccgcgagcagcuccagcuccucgaggagcagcaccgcgccgcccucgcccacuccgaggaggucaccgccucccaggucgccgccaccaagacccuccccaacggccgcgacgcccucgacggccccgccgccgaggccgagcccgagcacuccuucgacggccuccgccgcaaggucuccgcccagcgccuccaggaggccggcauccucuccgccgaggagcuccagcgccucgcccagggccacaccaccgucgacgagcucgcccgccgcgaggacguccgccacuaccuccagggccgcuccuccaucgccggccuccuccucaaggccaccaacgagaagcucuccgucuacgccgcccuccagcgccagcuccucucccccggcaccgcccucauccuccucgaggcccaggccgccuccggcuuccuccucgaccccguccgcaaccgccgccucaccgucaacgaggccgucaaggagggcgucgucggccccgagcuccaccacaagcuccucuccgccgagcgcgccgucaccggcuacaaggaccccuacaccggccagcagaucucccucuuccaggccaugcagaagggccucaucguccgcgagcacggcauccgccuccucgaggcccagaucgccaccggcggcgucaucgaccccguccacucccaccgcguccccgucgacgucgccuaccgccgcggcuacuucgacgaggagaugaaccgcguccucgccgaccccuccgacgacaccaagggcuucuucgaccccaacacccacgagaaccucaccuaccuccagcuccucgagcgcugcgucgaggaccccgagaccggccucugccuccucccccucaccgacaaggccgccaagggcggcgagcucgucuacaccgacuccgaggcccgcgacgucuucgagaaggccaccgucuccgcccccuucggcaaguuccagggcaagaccgucaccaucugggagaucaucaacuccgaguacuucaccgccgagcagcgccgcgaccuccuccgccaguuccgcaccggccgcaucaccgucgagaagaucaucaagaucaucaucaccgucgucgaggagcaggagcagaagggccgccucugcuucgagggccuccgcucccucguccccgccgccgagcuccucgagucccgcgucaucgaccgcgagcucuaccagcagcuccagcgcggcgagcgcuccguccgcgacgucgccgaggucgacaccguccgccgcgcccuccgcggcgccaacgucaucgccggcgucuggcucgaggaggccggccagaagcucuccaucuacaacgcccucaagaaggaccuccuccccuccgacauggccgucgcccuccucgaggcccaggccggcaccggccacaucaucgaccccgccaccuccgcccgccucaccgucgacgaggccguccgcgccggccucgucggccccgaguuccacgagaagcuccucuccgccgagaaggccgucaccggcuaccgcgaccccuacaccggccaguccgucucccucuuccaggcccucaagaagggccucaucccccgcgagcagggccuccgccuccucgacgcccagcucuccaccggcggcaucgucgaccccuccaagucccaccgcgucccccucgacgucgccugcgcccgcggcugccucgacgaggagaccucccgcgcccucuccgccccccgcgccgacgccaaggccuacuccgaccccuccaccggcgagcccgccaccuacggcgagcuccagcagcgcugccgccccgaccagcucaccggccucucccuccucccccucuccgagaaggccgcccgcgcccgccaggaggagcucuacuccgagcuccaggcccgcgagaccuucgagaagacccccgucgagguccccgucggcggcuucaagggccgcaccgucaccgucugggagcucaucuccuccgaguacuucaccgccgagcagcgccaggagcuccuccgccaguuccgcaccggcaaggucaccgucgagaaggucaucaagauccucaucaccaucgucgaggaggucgagacccuccgccaggagcgccucuccuucuccggccuccgcgcccccguccccgccuccgagcuccucgccuccggcguccucucccgcgcccaguucgagcagcucaaggacggcaagaccaccgucaaggaccucuccgagcucggcuccguccgcacccuccuccagggcuccggcugccucgccggcaucuaccucgaggacaccaaggagaaggucuccaucuacgaggccaugcgccgcggccuccuccgcgccaccaccgccgcccuccuccucgaggcccaggccgccaccggcuuccucgucgaccccguccgcaaccagcgccucuacguccacgaggccgucaaggccggcgucgucggccccgagcuccacgagcagcuccucuccgccgagaaggccgucaccggcuaccgcgaccccuacuccggcuccaccaucucccucuuccaggccaugcagaagggccucguccuccgccagcacggcauccgccuccucgaggcccagaucgccaccggcggcaucaucgaccccguccacucccaccgcguccccgucgacgucgccuaccagcgcggcuacuucuccgaggagaugaaccgcguccucgccgaccccuccgacgacaccaagggcuucuucgaccccaacacccacgagaaccucaccuaccgccagcuccucgagcgcugcgucgaggaccccgagaccggccuccgccuccucccccucaagggcgccgagaaggccgaggucgucgagaccacccaggucuacaccgaggaggagacccgccgcgccuucgaggagacccagaucgacauccccggcggcggcucccacggcggcuccaccaugucccucugggaggucaugcaguccgaccucauccccgaggagcagcgcgcccagcucauggccgacuuccaggccggccgcgucaccaaggagcgcaugaucaucaucaucaucgagaucaucgagaagaccgagaucauccgccagcagggccucgccuccuacgacuacguccgccgccgccucaccgccgaggaccucuucgaggcccgcaucaucucccucgagaccuacaaccuccuccgcgagggcacccgcucccuccgcgaggcccucgaggccgaguccgccuggugcuaccucuacggcaccggcuccgucgccggcgucuaccuccccggcucccgccagacccucuccaucuaccaggcccucaagaagggccuccucuccgccgaggucgcccgccuccuccucgaggcccaggccgccaccggcuuccuccucgaccccgucaagggcgagcgccucaccgucgacgaggccguccgcaagggccucgucggccccgagcuccacgaccgccuccucuccgccgagcgcgccgucaccggcuaccgcgaccccuacaccgagcagaccaucucccucuuccaggccaugaagaaggagcucauccccaccgaggaggcccuccgccuccucgacgcccagcucgccaccggcggcaucgucgacccccgccucggcuuccaccucccccucgaggucgccuaccagcgcggcuaccucaacaaggacacccacgaccagcucuccgagcccuccgagguccgcuccuacgucgaccccuccaccgacgagcgccucuccuacacccagcuccuccgccgcugccgccgcgacgacggcaccggccagcuccuccucccccucuccgacgcccgcaagcucaccuuccgcggccuccgcaagcagaucaccauggaggagcucguccgcucccaggucauggacgaggccaccgcccuccagcuccgcgagggccucaccuccaucgaggaggucaccaagaaccuccagaaguuccucgagggcaccuccugcaucgccggcgucuucgucgacgccaccaaggagcgccucuccgucuaccaggccaugaagaagggcaucauccgccccggcaccgccuucgagcuccucgaggcccaggccgccaccggcuacgucaucgaccccaucaagggccucaagcucaccgucgaggaggccguccgcaugggcaucgucggccccgaguucaaggacaagcuccucuccgccgagcgcgccgucaccggcuacaaggaccccuacuccggcaagcucaucucccucuuccaggccaugaagaagggccucauccucaaggaccacggcauccgccuccucgaggcccagaucgccaccggcggcaucaucgaccccgaggagucccaccgccuccccgucgaggucgccuacaagcgcggccucuucgacgaggagaugaacgagauccucaccgaccccuccgacgacaccaagggcuucuucgaccccaacaccgaggagaaccucaccuaccuccagcucauggagcgcugcaucaccgacccccagaccggccucugccuccucccccucaaggagaagaagcgcgagcgcaagaccuccuccaaguccuccguccgcaagcgccgcgucgucaucgucgaccccgagaccggcaaggagauguccgucuacgaggccuaccgcaagggccucaucgaccaccagaccuaccucgagcucuccgagcaggagugcgagugggaggagaucaccaucuccuccuccgacggcgucgucaaguccaugaucaucgaccgccgcuccggccgccaguacgacaucgacgacgccaucgccaagaaccucaucgaccgcuccgcccucgaccaguaccgcgccggcacccucuccaucaccgaguucgccgacaugcucuccggcaacgccggcggcuuccgcucccgcuccuccuccgucggcuccuccuccuccuaccccaucucccccgccgucucccgcacccagcucgccuccugguccgaccccaccgaggagaccggccccgucgccggcauccucgacaccgagacccucgagaaggucuccaucaccgaggccaugcaccgcaaccucgucgacaacaucaccggccagcgccuccucgaggcccaggccugcaccggcggcaucaucgaccccuccaccggcgagcgcuuccccgucaccgacgccgucaacaagggccucgucgacaagaucauggucgaccgcaucaaccucgcccagaaggccuucugcggcuucgaggacccccgcaccaagaccaagauguccgccgcccaggcccucaagaagggcuggcucuacuacgaggccggccagcgcuuccucgagguccaguaccucaccggcggccucaucgagcccgacacccccggccgcgucccccucgacgaggcccuccagcgcggcaccgucgacgcccgcaccgcccagaagcuccgcgacgucggcgccuacuccaaguaccucaccugccccaagaccaagcucaagaucuccuacaaggacgcccucgaccgcuccauggucgaggagggcaccggccuccgccuccucgaggccgccgcccaguccaccaagggcuacuacucccccuacuccgucuccggcuccggcuccaccgccggcucccgcaccggcucccgcaccggcucccgcgccggcucccgccgcggcuccuucgacgccaccggcuccggcuucuccaugaccuucuccuccuccuccuacuccuccuccggcuacggccgccgcuacgccuccggcuccuccgccucccucggcggccccgaguccgccgucgccuga

SEQ ID NO: 47763 - RNA, 1062 nt, Artificial Sequence
  derived and/or modified sequence opt2 from PLEK2__Homo_sapiens__NP_057529
auggaggacggcguccucaaggagggcuuccucgucaagcgcggccacaucguccacaacuggaaggcccgcugguucauccuccgccagaacacccucgucuacuacaagcucgagggcggccgccgcgucaccccccccaagggccgcauccuccucgacggcugcaccaucaccugccccugccucgaguacgagaaccgcccccuccucaucaagcucaagacccagaccuccaccgaguacuuccucgaggccugcucccgcgaggagcgcgacgccugggccuucgagaucaccggcgccauccacgccggccagcccggcaagguccagcagcuccacucccuccgcaacuccuucaagcuccccccccacaucucccuccaccgcaucgucgacaagaugcacgacuccaacaccggcauccgcuccucccccaacauggagcagggcuccaccuacaagaagaccuuccucggcuccucccucgucgacuggcucaucuccaacuccuucaccgccucccgccucgaggccgucacccucgccuccaugcucauggaggagaacuuccuccgccccgucggcguccgcuccaugggcgccauccgcuccggcgaccucgccgagcaguuccucgacgacuccaccgcccucuacaccuucgccgaguccuacaagaagaagaucucccccaaggaggagaucucccucuccaccgucgagcucuccggcaccgucgucaagcagggcuaccucgccaagcagggccacaagcgcaagaacuggaagguccgccgcuucguccuccgcaaggaccccgccuuccuccacuacuacgaccccuccaaggaggagaaccgccccgucggcggcuucucccuccgcggcucccucgucuccgcccucgaggacaacggcguccccaccggcgucaagggcaacguccagggcaaccucuucaaggucaucaccaaggacgacacccacuacuacauccaggccuccuccaaggccgagcgcgccgaguggaucgaggccaucaagaagcucaccuga

SEQ ID NO: 47764 - RNA, 1215 nt, Artificial Sequence
  derived and/or modified sequence opt2 from PLEKHA1__Homo_sapiens__NP_001001974
augcccuacgucgaccgccagaaccgcaucugcggcuuccucgacaucgaggagaacgagaacuccggcaaguuccuccgccgcuacuucauccucgacacccgcgaggacuccuucgucugguacauggacaacccccagaaccuccccuccggcuccucccgcgucggcgccaucaagcucaccuacaucuccaaggucuccgacgccaccaagcuccgccccaaggccgaguucugcuucgucaugaacgccggcaugcgcaaguacuuccuccaggccaacgaccagcaggaccucgucgagugggucaacguccucaacaaggccaucaagaucaccguccccaagcaguccgacucccagcccaacuccgacaaccucucccgccacggcgagugcggcaagaagcaggucuccuaccgcaccgacaucgucggcggcguccccaucaucacccccacccagaaggaggaggucaacgagugcggcgaguccaucgaccgcaacaaccucaagcgcucccagucccaccuccccuacuucacccccaagcccccccaggacuccgccgucaucaaggccggcuacugcgucaagcagggcgccgucaugaagaacuggaagcgccgcuacuuccagcucgacgagaacaccaucggcuacuucaaguccgagcucgagaaggagccccuccgcgucaucccccucaaggagguccacaagguccaggagugcaagcaguccgacaucaugaugcgcgacaaccucuucgagaucgucaccaccucccgcaccuucuacguccaggccgacucccccgaggagaugcacuccuggaucaaggccgucuccggcgccaucgucgcccagcgcggccccggccgcuccgccuccuccgagcacccccccggccccuccgaguccaagcacgccuuccgccccaccaacgccgccaccgccaccucccacuccaccgccucccgcuccaacucccucgucuccaccuucaccauggagaagcgcggcuucuacgagucccucgccaaggucaagcccggcaacuucaagguccagaccgucuccccccgcgagcccgccuccaaggucaccgagcaggcccuccuccgcccccaguccaagaacggcccccaggagaaggacugcgaccucgucgaccucgacgacgccucccuccccgucuccgacgucuga

SEQ ID NO: 47765 - RNA, 1278 nt, Artificial Sequence
  derived and/or modified sequence opt2 from PLEKHA2__Homo_sapiens__NP_067636
augcccuacgucgaccgccagaaccgcaucugcggcuuccucgacaucgaggagcacgagaacuccggcaaguuccuccgccgcuacuucauccucgacacccaggccaacugccuccucugguacauggacaacccccagaaccucgccaugggcgccggcgccgucggcgcccuccagcucaccuacaucuccaaggucuccaucgccacccccaagcagaagcccaagacccccuucugcuucgucaucaacgcccucucccagcgcuacuuccuccaggccaacgaccagaaggacaugaaggacugggucgaggcccucaaccaggccuccaagaucaccguccccaagggcggcggccuccccaugaccaccgagguccucaagucccucgccgccccccccgcccucgagaagaagccccaggucgccuacaagaccgagaucaucggcggcgucgucguccacacccccaucucccagaacggcggcgacggccaggagggcuccgagcccggcucccacaccauccuccgccgcucccaguccuacauccccaccuccggcugccgcgccuccaccggccccccccucaucaaguccggcuacugcgucaagcagggcaacguccgcaaguccuggaagcgccgcuucuucgcccucgacgacuucaccaucugcuacuucaagugcgagcaggaccgcgagccccuccgcaccaucuuccucaaggacguccucaagacccacgagugccucgucaaguccggcgaccuccucaugcgcgacaaccucuucgagaucaucaccuccucccgcaccuucuacguccaggccgacucccccgaggacaugcacuccuggaucaaggagaucggcgccgccguccaggcccucaagugccacccccgcgagaccuccuucucccgcuccaucucccucacccgccccggcuccuccucccucuccuccggccccaacuccauccucugccgcggccgccccccccucgaggagaagaaggcccucugcaaggcccccuccgucgccuccuccuggcagcccuggacccccgucccccaggccggcgagaagcuccucccccccggcgacaccuccgaggacucccucuucaccccccgccccggcgagggcuccgcccccggcguccuccccuccucccgcauccgccaccgcuccgagccccagcaccccaaggagaagcccuucauguucaaccucgacgacgagaacauccgcaccuccgacgucuga

SEQ ID NO: 47766 - RNA, 3525 nt, Artificial Sequence
  derived and/or modified sequence opt2 from PLEKHA5__Homo_sapiens__NP_001137293
auggccgccgaccucaaccucgaguggaucucccucccccgcuccuggaccuacggcaucacccgcggcggccgcgucuucuucaucaacgaggaggccaaguccaccaccuggcuccaccccgucaccggcgaggccgucgucaccggccaccgccgccaguccaccgaccuccccaccggcugggaggaggccuacaccuucgagggcgcccgcuacuacaucaaccacaacgagcgcaaggucaccugcaagcaccccgucaccggccagcccucccaggacaacugcaucuucgucgucaacgagcagaccgucgccaccaugaccuccgaggagaagaaggagcgccccaucuccaugaucaacgaggccuccaacuacaacgucaccuccgacuacgccguccaccccaugucccccgucggccgcaccucccgcgccuccaagaagguccacaacuucggcaagcgcuccaacuccaucaagcgcaaccccaacgcccccgucguccgccgcggcuggcucuacaagcaggacuccaccggcaugaagcucuggaagaagcgcugguucguccucuccgaccucugccucuucuacuaccgcgacgagaaggaggagggcauccucggcuccauccuccuccccuccuuccagaucgcccuccucaccuccgaggaccacaucaaccgcaaguacgccuucaaggccgcccaccccaacaugcgcaccuacuacuucugcaccgacaccggcaaggagauggagcucuggaugaaggccaugcucgacgccgcccucguccagaccgagcccgucaagcgcgucgacaagaucaccuccgagaacgcccccaccaaggagaccaacaacauccccaaccaccgcguccucaucaagcccgagauccagaacaaccagaagaacaaggagauguccaagaucgaggagaagaaggcccucgaggccgagaaguacggcuuccagaaggacggccaggaccgcccccucaccaagaucaacuccgucaagcucaacucccuccccuccgaguacgaguccggcuccgccugccccgcccagaccguccacuaccgccccaucaaccucuccuccuccgagaacaagaucgucaacgucucccucgccgaccuccgcggcggcaaccgccccaacaccggcccccucuacaccgaggccgaccgcgucauccagcgcaccaacuccaugcagcagcucgagcaguggaucaagauccagaagggccgcggccacgaggaggagacccgcggcgucaucuccuaccagacccucccccgcaacaugcccucccaccgcgcccagaucauggcccgcuaccccgagggcuaccgcacccucccccgcaacuccaagacccgccccgaguccaucugcuccgucacccccuccacccacgacaagacccucggccccggcgccgaggagaagcgccgcuccaugcgcgacgacaccauguggcagcucuacgaguggcagcagcgccaguucuacaacaagcaguccacccucccccgccacuccacccucuccucccccaagaccauggucaacaucuccgaccagaccaugcacuccauccccaccucccccucccacggcuccaucgccgccuaccagggcuacuccccccagcgcaccuaccgcuccgaggucuccucccccauccagcgcggcgacgucaccaucgaccgccgccaccgcgcccaccaccccaagcacgucuacguccccgaccgccgcuccguccccgccggccucacccuccaguccgucuccccccagucccuccagggcaagacccccgaggagcucacccuccuccucaucaagcuccgccgccagcaggccgagcucuccuccauccgcgagcacacccucgcccagcucaugcagcucaagcucgaggcccacucccccaagaacgagauccucucccaccaccuccagcgcaacaccaucuaccucgaccaccagcucucccaggacgagggccgcggcacccucuacaaguaccgccccgaggaggucgacaucgacgccaagcucucccgccucugcgagcaggacaaggucguccacgcccucgaggagaagcuccagcagcuccacaaggagaaguacacccucgagcaggcccuccucuccgccucccaggagaucgagaugcacgccgacaaccccgccgccauccagaccgucguccuccagcgcgacgaccuccagaacggccuccucuccaccugccgcgagcucucccgcgccaccgccgagcucgagcgcgccuggcgcgaguacgacaagcucgaguacgacgucaccgucacccgcaaccagaugcaggagcagcucgaccaccucggcgagguccagaccgaguccgccggcauccagcgcgcccagauccagaaggagcucuggcgcauccaggacgucauggagggccucuccaagcacaagcagcagcgcggcaccaccgagaucggcaugaucggcuccaagcccuucuccaccgucaaguacaagaacgagggccccgacuaccgccucuacaaguccgagcccgagcucaccaccgucgccgaggucgacgaguccaacggcgaggagaaguccgagcccgucuccgagaucgagaccuccgucgucaagggcucccacuuccccgucggcgucguccccccccgcgccaagucccccacccccgaguccuccaccaucgccuccuacgucacccuccgcaagaccaagaagaugauggaccuccgcaccgagcgcccccgcuccgccgucgagcagcucugccucgccgaguccacccgcccccgcaugaccgucgaggagcagauggagcgcauccgccgccaccagcaggccugccuccgcgagaagaagaagggccucaacgucaucggcgccuccgaccaguccccccuccagucccccuccaaccuccgcgacaaccccuuccgcaccacccagacccgccgccgcgacgacaaggagcucgacaccgccauccgcgagaacgacgucaagcccgaccacgagacccccgccaccgagaucguccagcucaaggagaccgagccccagaacgucgacuucuccaaggagcucaagaagaccgagaacaucuccuacgagaugcucuucgagcccgagcccaacggcgucaacuccgucgagaugauggacaaggagcgcaacaaggacaagaugcccgaggacgucaccuucuccccccaggacgagacccagaccgccaaccacaagcccgaggagcaccccgaggagaacaccaagaacuccgucgacgagcaggaggagaccgucaucuccuacgaguccacccccgaggucucccgcggcaaccagaccauggccgucaagucccucucccccucccccgaguccuccgccucccccguccccuccacccagccccagcucaccgagggcucccacuucaugugcgucuga

SEQ ID NO: 47767 - RNA, 3147 nt, Artificial Sequence
  derived and/or modified sequence opt2 from PLEKHA6__Homo_sapiens__NP_055750
auguccaacaagaccggcggcaagcgccccgccaccaccaacuccgacauccccaaccacaacauggucuccgaggucccccccgagcgccccuccguccgcgccacccgcaccgcccgcaaggccgucgccuucggcaagcgcucccacuccaugaagcgcaaccccaacgcccccgucaccaaggccggcuggcucuucaagcaggccuccuccggcgucaagcaguggaacaagcgcugguucguccucgucgaccgcugccucuucuacuacaaggacgagaaggaggaguccauccucggcuccaucccccuccucuccuuccgcgucgccgccguccagcccuccgacaacaucucccgcaagcacaccuucaaggccgagcacgccggcguccgcaccuacuucuucuccgccgagucccccgaggagcaggaggccuggauccaggccaugggcgaggccgcccgcguccagaucccccccgcccagaaguccgucccccaggccguccgccacucccacgagaagcccgacuccgagaacgucccccccuccaagcaccaccagcagcccccccacaacucccuccccaagcccgagcccgaggccaagacccgcggcgagggcgacggccgcggcugcgagaaggccgagcgccgccccgagcgccccgaggucaagaaggagccccccgucaaggccaacggccuccccgccggccccgagcccgccuccgagcccggcucccccuaccccgagggcccccgcguccccggcggcggcgagcagcccgcccagcccaacggcuggcaguaccacucccccucccgccccggcuccaccgccuuccccucccaggacggcgagaccggcggccaccgccgcuccuuccccccccgcaccaaccccgacaagaucgcccagcgcaaguccuccaugaaccagcuccagcagugggucaaccuccgccgcggcguccccccccccgaggaccuccgcucccccucccgcuucuaccccgucucccgccgcguccccgaguacuacggccccuacuccucccaguaccccgacgacuaccaguacuacccccccggcguccgccccgaguccaucugcuccaugcccgccuacgaccgcaucuccccccccugggcccucgaggacaagcgccacgccuuccgcaacggcggcggccccgccuaccagcuccgcgaguggaaggagcccgccuccuacggccgccaggacgccaccgucuggauccccucccccucccgccagcccgucuacuacgacgagcucgacgccgccuccuccucccuccgccgccucucccuccagccccgcucccacuccgucccccgcucccccucccagggcuccuacucccgcgcccgcaucuacucccccguccgcucccccuccgcccgcuucgagcgccuccccccccgcuccgaggacaucuacgccgaccccgccgccuacgucaugcgccgcuccaucuccucccccaaggucccccccuaccccgaggucuuccgcgacucccuccacaccuacaagcucaacgagcaggacaccgacaagcuccucggcaagcucugcgagcagaacaaggucguccgcgagcaggaccgccucguccagcagcuccgcgccgagaaggagucccucgaguccgcccucaugggcacccaccaggagcucgagauguucggcucccagcccgccuaccccgagaagcuccgccacaagaaggacucccuccagaaccagcucaucaacauccgcgucgagcucucccaggccaccaccgcccucaccaacuccaccaucgaguacgagcaccucgaguccgaggucuccgcccuccacgacgaccucugggagcagcucaaccucgacacccagaacgagguccucaaccgccagauccagaaggagaucuggcgcauccaggacgucauggagggccuccgcaagaacaaccccucccgcggcaccgacaccgccaagcaccgcggcggccucggccccuccgccaccuacuccuccaacucccccgccuccccccucuccuccgccucccucaccuccccccucucccccuucucccucgucuccggcucccagggcucccccaccaagcccggcuccaacgagcccaaggccaacuacgagcaguccaagaaggacccccaccagacccucccccucgacaccccccgcgacaucucccucguccccacccgccaggaggucgaggccgagaagcaggccgcccucaacaaggucggcgucguccccccccgcaccaagucccccaccgacgacgaggucacccccuccgccgucguccgccgcaacgccuccggccucaccaacggccucuccucccaggagcgccccaaguccgccgucuuccccggcgagggcaaggucaagauguccgucgaggagcagaucgaccgcaugcgccgccaccaguccggcuccaugcgcgagaagcgccgcucccuccagcuccccgccucccccgcccccgaccccuccccccgccccgccuacaaggucguccgccgccaccgcuccauccacgaggucgacaucuccaaccucgaggccgcccuccgcgccgaggagcccggcggccacgccuacgagaccccccgcgaggagaucgcccgccuccgcaagauggagcucgagccccagcacuacgacgucgacaucaacaaggagcucuccacccccgacaagguccucauccccgagcgcuacaucgaccucgagcccgacaccccccucucccccgaggagcucaaggagaagcagaagaaggucgagcgcaucaagacccucaucgccaaguccuccaugcagaacgucguccccaucggcgagggcgacuccgucgacgucccccaggacuccgagucccagcuccaggagcaggagaagcgcaucgagaucuccugcgcccucgccaccgaggccucccgccgcggccgcaugcucuccguccagugcgccacccccuccccccccaccucccccgccucccccgccccccccgccaacccccucuccuccgaguccccccgcggcgccgacuccuccuacaccaugcgcgucuga

SEQ ID NO: 47768 - RNA, 3366 nt, Artificial Sequence
  derived and/or modified sequence opt2 from PLEKHA7__Homo_sapiens__NP_778228
auggccgccgccaccgucggccgcgacacccuccccgagcacugguccuacggcgucugccgcgacggccgcgucuucuucaucaacgaccagcuccgcugcaccaccuggcuccacccccgcaccggcgagcccgucaacuccggccacaugauccgcuccgaccucccccgcggcugggaggagggcuucaccgaggagggcgccuccuacuucaucgaccacaaccagcagaccaccgccuuccgccaccccgucaccggccaguucucccccgagaacuccgaguucauccuccaggaggagcccaacccccacauguccaagcaggaccgcaaccagcgccccuccuccauggucuccgagaccuccaccgccggcaccgccuccacccucgaggccaagcccggccccaagaucaucaaguccuccuccaagguccacuccuucggcaagcgcgaccaggccauccgccgcaaccccaacguccccgucgucguccgcggcuggcuccacaagcaggacuccuccggcaugcgccucuggaagcgccgcugguucguccucgccgacuacugccucuucuacuacaaggacucccgcgaggaggccguccucggcuccaucccccuccccuccuacgucaucucccccgucgcccccgaggaccgcaucucccgcaaguacuccuucaaggccguccacaccggcaugcgcgcccucaucuacaacuccuccaccgccggcucccaggccgagcaguccggcaugcgcaccuacuacuucuccgccgacacccaggaggacaugaacgccuggguccgcgccaugaaccaggccgcccagguccucucccgcuccucccucaagcgcgacauggagaaggucgagcgccaggccgucccccaggccaaccacaccgaguccugccacgagugcggccgcgucggccccggccacacccgcgacugcccccaccgcggccacgacgacaucgucaacuucgagcgccaggagcaggagggcgagcaguaccgcucccagcgcgacccccucgagggcaagcgcgaccgcuccaaggcccgcucccccuacucccccgccgaggaggacgcccucuucauggaccuccccaccggcccccgcggccagcaggcccagccccagcgcgccgagaagaacggcaugcuccccgccuccuacggccccggcgagcagaacggcaccggcggcuaccagcgcgccuuccccccccgcaccaaccccgagaagcacucccagcgcaaguccaaccucgcccaggucgagcacugggcccgcgcccagaagggcgacucccgcucccucccccucgaccagacccucccccgccagggccccggccagucccucuccuuccccgagaacuaccagacccuccccaaguccacccgccaccccuccggcggcuccuccccccccccccgcaaccuccccuccgacuacaaguacgcccaggaccgcgccucccaccucaagauguccuccgaggagcgccgcgcccaccgcgacggcaccgucuggcagcucuacgaguggcagcagcgccagcaguuccgccacggcucccccaccgcccccaucugccucggcucccccgaguucaccgaccagggccgcucccgcuccaugcucgaggucccccgcuccaucuccgucccccccucccccuccgacauccccccccccggccccccccgcgucuuccccccccgccgcccccacacccccgccgagcgcgucaccgucaagccccccgaccagcgccgcuccgucgacaucucccucggcgacuccccccgccgcgcccgcggccacgccgucaagaacuccucccacgucgaccgccgcuccaugcccuccaugggcuacaugacccacaccgucuccgcccccucccuccacggcaaguccgccgacgacaccuaccuccagcucaagaaggaccucgaguaccucgaccucaagaugaccggccgcgaccuccucaaggaccgcucccucaagcccgucaagaucgccgaguccgacaccgacgucaagcucuccaucuucugcgagcaggaccgcguccuccaggaccucgaggacaagauccgcgcccucaaggagaacaaggaccagcucgaguccguccucgagguccuccaccgccagauggagcaguaccgcgaccagccccagcaccucgagaagaucgccuaccagcagaagcuccuccaggaggaccucguccacauccgcgccgagcucucccgcgaguccaccgagauggagaacgccuggaacgaguaccucaagcucgagaacgacgucgagcagcucaagcagacccuccaggagcagcaccgccgcgccuucuucuuccaggagaagucccagauccagaaggaccucuggcgcaucgaggacgucaccgccggccucuccgccaacaaggagaacuuccgcauccucgucgaguccgucaagaaccccgagcgcaagaccgucccccucuucccccacccccccguccccucccucuccaccuccgaguccaagccccccccccagcccuccccccccaccucccccguccgcaccccccucgagguccgccucuucccccagcuccagaccuacguccccuaccgcccccaccccccccagcuccgcaaggucaccuccccccuccagucccccaccaaggccaagcccaaggucgaggacgaggcccccccccgccccccccuccccgagcucuacucccccgaggaccagccccccgccguccccccccucccccgcgaggccaccaucauccgccacaccuccguccgcggccucaagcgccaguccgacgagcgcaagcgcgaccgcgagcucggccagugcgucaacggcgacucccgcgucgagcuccgcuccuacgucuccgagcccgagcucgccacccucuccggcgacauggcccagcccucccucggccucgucggccccgagucccgcuaccagacccuccccggccgcggccucuccggcuccaccucccgccuccagcaguccuccaccaucgcccccuacgucacccuccgccgcggccucaacgccgaguccuccaaggccaccuucccccgccccaaguccgcccucgagcgccucuacuccggcgaccaccagcgcggcaagauguccgccgaggagcagcucgagcgcaugaagcgccaccagaaggcccucguccgcgagcgcaagcgcacccucggccagggcgagcgcaccggccuccccuccucccgcuaccucucccgcccccuccccggcgaccucggcuccgucugcuga

SEQ ID NO: 47769 - RNA, 627 nt, Artificial Sequence
  derived and/or modified sequence opt2 from PLEKHB1__Homo_sapiens__NP_001123505
augucccccgccgcccccgucccccccgacuccgcccucgagucccccuucgaggagauggcccucguccgcggcggcuggcucuggcgccaguccuccauccuccgccgcuggaagcgcaacugguucgcccucuggcucgacggcacccucggcuacuaccacgacgagaccgcccaggacgaggaggaccgcguccucauccacuucaacguccgcgacaucaagaucggccccgagugccacgacguccagccccccgagggccgcucccgcgacggccuccucaccgucaaccuccgcgagggcggccgccuccaccucugcgccgagaccaaggacgacgcccucgccuggaagaccgcccuccucgaggccaacuccacccccguccgcgucuacucccccuaccaggacuacuacgaggucgucccccccaacgcccacgaggccaccuacguccgcuccuacuacggcccccccuacgccggccccggcgucacccacgucaucguccgcgaggaccccugcuacuccgccggcgccccccucgccaugggcaugcucgccggcgccgccaccggcgccgcccucggcucccucauguggucccccugcugguucuga

SEQ ID NO: 47770 - RNA, 1521 nt, Artificial Sequence
  derived and/or modified sequence opt2 from PLEKHD1__Homo_sapiens__NP_001154970
auguucaccuccaaguccaacuccgucucccccucccccucccucgagcaggccgacuccgacgcccucgacaucuccaccaagguccagcucuacggcguccucuggaagcgccccuucggccgccccuccgccaaguggucccgccgcuucuucaucaucaaggaguccuuccuccucuacuacuccgaguccgagaagaaguccuucgagaccaacaaguacuucaacauccaccccaagggcgucaucccccucggcggcugccucgucgagcccaaggaggagcccuccaugcccuacgccaugaagaucucccaccaggacuuccacggcaacauccuccucgccgccgaguccgaguucgagcagacccaguggcucgagaugcuccaggaguccggcaaggucaccuggaagaacgcccagcucggcgaggccaugaucaagucccucgaggcccagggccuccagcucgccaaggagaagcaggaguaccucgacaagcucauggaggagaccgaggagcucugccuccagcgcgagcagcgcgaggagcucgagcgccucaaccagguccucgaggccgagaagcagcaguucgaggaggucguccaggagcuccgcauggagcaggagcagaucaagcgcgagcucgagcucaccgcccgcugccucaagggcgucgagcaggagaagaaggagcuccgccaccucaccgagucccuccagcagacccucgaggagcucuccaucgagaagaagaagacccucgagaugcucgaggagaacgagaaccaccuccagacccucgccaaccaguccgagcagcccccccccuccggcggccuccacuccaaccuccgccagaucgaggagaagaugcagcagcuccucgaggagaagcuccucgccgagaagcgcaugaaggagaacgaggagcgcucccgcgcccucgaggaggagcgcgaguucuacuccucccagucccaggcccuccagaacucccuccaggagcucaccgccgagaagcagcaggccgagcgcgagcucaaggccgaggucaagguccgcauggaccucgagcgccgccuccgcgaggccgagggcgcccuccgcucccucgagcagggccucaacuccaagguccgcaacaaggagaaggaggagcgcaugcgcgccgacgucucccaccucaagcgcuucuucgaggagugcauccgcaacgccgagcucgaggccaagaugcccgucaucaugaagaacuccgucuacauccacaaggccgccacccgccgcaucaaguccugccgcuuccaccgccgccgcuccuccaccuccuggaacgacaugaagcccucccaguccuucaugaccucccagcucgacgccaacaacauggaggagcucaaggaggucgccaagcgccucucccgcgaccagcgcuuccgcgaguccaucuaccacaucauggccacccagcccggcgcccccuccgcccucucccgcggcggcaaguga

SEQ ID NO: 47771 - RNA, 840 nt, Artificial Sequence
  derived and/or modified sequence opt2 from PLEKHF1__Homo_sapiens__NP_077286
auggucgaccaccucgccaacaccgagaucaacucccagcgcaucgccgccgucgaguccugcuucggcgccuccggccagccccucgcccuccccggccgcguccuccucggcgagggcguccucaccaaggagugccgcaagaaggccaagccccgcaucuucuuccucuucaacgacauccucgucuacggcuccaucguccucaacaagcgcaaguaccgcucccagcacaucaucccccucgaggaggucacccucgagcuccuccccgagacccuccaggccaagaaccgcuggaugaucaagaccgccaagaaguccuucgucgucuccgccgccuccgccaccgagcgccaggaguggaucucccacaucgaggagugcguccgccgccagcuccgcgccaccggccgcccccccuccaccgagcacgccgcccccuggauccccgacaaggccaccgacaucugcaugcgcugcacccagacccgcuucuccgcccucacccgccgccaccacugccgcaagugcggcuucgucgucugcgccgagugcucccgccagcgcuuccuccucccccgccucucccccaagcccguccgcgucugcucccucugcuaccgcgagcucgccgcccagcagcgccaggaggaggccgaggagcagggcgccggcucccccggccagcccgcccaccucgcccgccccaucugcggcgccuccuccggcgacgacgacgacuccgacgaggacaaggagggcucccgcgacggcgacuggcccuccuccgucgaguucuacgccuccggcgucgccugguccgccuuccacuccuga

SEQ ID NO: 47772 - RNA, 750 nt, Artificial Sequence
  derived and/or modified sequence opt2 from PLEKHF2__Homo_sapiens__NP_078889
auggucgaccgccucgccaacuccgaggccaacacccgccgcaucuccaucgucgagaacugcuucggcgccgccggccagccccucaccauccccggccgcguccucaucggcgagggcguccucaccaagcucugccgcaagaagcccaaggcccgccaguucuuccucuucaacgacauccucgucuacggcaacaucgucauccagaagaagaaguacaacaagcagcacaucaucccccucgagaacgucaccaucgacuccaucaaggacgagggcgaccuccgcaacggcuggcucaucaagacccccaccaaguccuucgccgucuacgccgccaccgccaccgagaaguccgaguggaugaaccacaucaacaagugcgucaccgaccuccucuccaaguccggcaagacccccuccaacgagcacgccgccgucuggguccccgacuccgaggccaccgucugcaugcgcugccagaaggccaaguucacccccgucaaccgccgccaccacugccgcaagugcggcuucgucgucugcggccccugcuccgagaagcgcuuccuccuccccucccaguccuccaagcccguccgcaucugcgacuucugcuacgaccuccucuccgccggcgacauggccaccugccagcccgcccgcuccgacuccuacucccagucccucaaguccccccucaacgacauguccgacgacgacgacgacgacgacuccuccgacuga

SEQ ID NO: 47773 - RNA, 4158 nt, Artificial Sequence
  derived and/or modified sequence opt2 from PLEKHG1__Homo_sapiens__NP_001025055
auggagcucuccgacuccgaccgccccgucuccuucggcuccaccuccuccuccgccuccucccgcgacucccacggcuccuucggcucccgcaugacccucgucuccaacucccacaugggccucuucaaccaggacaaggaggucggcgccaucaagcucgagcucauccccgcccgccccuucuccuccuccgagcuccagcgcgacaaccccgccaccggccagcagaacgccgacgagggcuccgagcgccccccccgcgcccaguggcgcgucgacuccaacggcgcccccaagaccaucgccgacuccgccaccucccccaagcuccucuacgucgaccgcgucguccaggagauccucgagaccgagcgcaccuacguccaggaccucaaguccaucgucgaggacuaccucgacugcauccgcgaccagaccaagcucccccucggcaccgaggagcgcuccgcccucuucggcaacauccaggacaucuaccacuucaacuccgagcuccuccaggaccucgagaacugcgagaacgaccccgucgccaucgccgagugcuucgucuccaaguccgaggaguuccacaucuacacccaguacugcaccaacuacccccgcuccgucgccguccucaccgagugcaugcgcaacaagauccucgccaaguucuuccgcgagcgccaggagacccucaagcacucccucccccucggcuccuaccuccucaagcccguccagcgcauccucaaguaccaccuccuccuccacgagaucgagaaccaccucgacaaggacaccgagggcuacgacgucguccucgacgccaucgacaccaugcagcgcgucgccuggcacaucaacgacaugaagcgcaagcacgagcacgccguccgccuccaggagauccagucccuccucaccaacuggaagggccccgaccucaccuccuacggcgagcucguccucgagggcaccuuccgcauccagcgcgccaagaacgagcgcacccucuuccucuucgacaagcuccuccucaucaccaagaagcgcgacgacaccuucaccuacaaggcccacauccucugcggcaaccucaugcucgucgaggucauccccaaggagccccucuccuucuccgucuuccacuacaagaaccccaagcuccagcacaccguccaggccaagucccagcaggacaagcgccucuggguccuccaccucaagcgccucauccucgagaaccacgccgccaagauccccgccaaggccaagcaggccauccucgagauggacgccauccaccaccccggcuucugcuacucccccgagggcggcaccaaggcccucuucggcuccaaggagggcuccgcccccuaccgccuccgccgcaaguccgagcccuccucccgcucccacaagguccucaagaccuccgagaccgcccaggacauccagaaggucucccgcgaggagggcuccccccagcucuccuccgcccgccccucccccgcccagcgcaacucccagcccuccuccuccaccaugaucuccguccuccgcgccggcggcgcccuccgcaacaucuggaccgaccaccagauccgccaggcccucuuccccucccgccgcuccccccaggagaacgaggacgacgaggacgacuaccagauguucguccccuccuucuccuccuccgaccucaacuccacccgccucugcgaggacuccaccuccucccgccccugcuccuggcacaugggccagauggaguccaccgagaccuccuccuccggccaccgcaucguccgccgcgccuccuccgccggcgaguccaacaccugcccccccgagaucggcaccuccgaccgcacccgcgagcuccagaacucccccaagaccgagggccaggaggagaugacccccuucggcuccuccaucgagcucaccaucgacgacaucgaccacgucuacgacaacaucuccuacgaggaccucaagcucauggucgccaagcgcgaggaggccgaguccacccccuccaaguccgcccgcgacuccguccgccccaaguccacccccgagcucgccuucaccaagcgccaggccggccacuccaagggcucccucuacgcccagaccgacggcacccucuccggcggcgaggccuccucccaguccacccacgagcuccaggccgucgaggagaacaucuacgacaccaucggccuccccgacccccccucccucggcuucaagugcuccucccucaagcgcgccaagcgcuccaccuuccucggccucgaggccgacuucgucugcugcgacucccuccgccccuucgucucccaggacucccuccagcucuccgaggacgaggcccccuaccaccaggccacccccgaccacggcuaccucucccuccucuacgacucccccuccggcaaccucuccaugccccacaagcccgucuccgacaagcucuccgaggaggucgacgagaucuggaacgaccucgagaacuacaucaagaagaacgaggacaaggcccgcgaccgccuccucgccgccuuccccgucuccaaggacgacguccccgaccgccuccacgccgaguccacccccgagcucucccgcgacgucggccgcuccgucuccacccucucccuccccgagucccaggcccuccucacccccgucaagucccgcgccggccgcgccucccgcgccaacugccccuucgaggaggaccucaucuccaaggagggcuccuucaugucccucaaccgccucucccucgccuccgagaugccccucauggacaaccccuacgaccucgccaacuccggccucucccagaccgaccccgagaaccccgaccucggcauggaggccaccgacaagaccaagucccgcgucuucaugauggcccgccaguacucccagaagaucaagaaggccaaccagcuccucaaggucaagucccucgagcucgagcagccccccgccucccagcaccagaaguccaugcacaaggaccucgccgccauccucgaggagaagaagcagggcggccccgccaucggcgcccgcaucgccgaguacucccagcucuacgaccagaucgucuuccgcgaguccccccucaagauccagaaggacggcugggccuccccccaggaguccucccuccuccgcuccgucucccccucccagguccaccacggcuccggcgacuggcuccuccacuccaccuacuccaacggcgagcucgccgacuucugccucccccccgagcaggaccuccgcucccgcuaccccaccuucgagaucaacaccaaguccaccccccgccagcucuccgccgccugcuccguccccucccuccagaccuccgacccccuccccggcuccguccagcgcugcuccgucgucgucucccagcccaacaaggagaacuggugccaggaccaccucuacaacucccucggccgcaagggcaucuccgccaagucccagcccuaccaccgcucccaguccuccuccuccguccucaucaacaaguccauggacuccaucaacuaccccuccgacgucggcaagcagcagcuccucucccuccaccgcuccucccgcugcgagucccaccaggaccuccuccccgacaucgccgacucccaccagcagggcaccgagaagcucuccgaccucacccuccaggacucccagaaggucgucgucgucaaccgcaaccucccccucaacgcccagaucgccacccagaacuacuucuccaacuucaaggagaccgacggcgacgaggacgacuacgucgagaucaaguccgaggaggacgaguccgagcucgagcucucccacaaccgccgccgcaaguccgacuccaaguucgucgacgccgacuucuccgacaacgucugcuccggcaacacccuccacucccucaacuccccccgcacccccaagaagcccgucaacuccaagcucggccucucccccuaccucacccccuacaacgacuccgacaagcucaacgacuaccucuggcgcggccccucccccaaccagcagaacaucguccagucccuccgcgagaaguuccagugccucuccuccuccuccuucgccuga

SEQ ID NO: 47774 - RNA, 4161 nt, Artificial Sequence
  derived and/or modified sequence opt2 from PLEKHG2__Homo_sapiens__NP_073746
augcccgagggcgcccagggccucucccucuccaagcccucccccucccucggcugcggccgccgcggcgaggucugcgacugcggcaccgucugcgagacccgcaccgcccccgccgcccccaccauggccuccccccgcggcuccggcuccuccaccucccucuccaccgucggcuccgagggcgaccccgcccccggccccacccccgccugcuccgccucccgccccgagccccuccccggcccccccauccgccuccaccucucccccgucggcauccccggcuccgcccgccccucccgccucgagcgcgucgcccgcgagaucgucgagaccgagcgcgccuacguccgcgaccuccgcuccaucgucgaggacuaccucggcccccuccucgacggcggcguccucggccucuccgucgagcaggucggcacccucuucgccaacaucgaggacaucuacgaguucuccuccgagcuccucgaggaccucgagaacuccuccuccgccggcggcaucgccgagugcuucguccagcgcuccgaggacuucgacaucuacacccucuacugcaugaacuaccccuccucccucgcccuccuccgcgagcucucccucuccccccccgccgcccucuggcuccaggagcgccaggcccagcuccgccacucccucccccuccaguccuuccuccucaagcccguccagcgcauccucaaguaccaccuccuccuccaggagcucggcaagcacugggccgagggccccggcaccggcggccgcgagauggucgaggaggccaucgucuccaugaccgccgucgccugguacaucaacgacaugaagcgcaagcaggagcacgccgcccgccuccaggagguccagcgccgccucggcggcuggaccggccccgagcucuccgccuucggcgagcucguccucgagggcgccuuccgcggcggcggcggcggcggcccccgccuccgcggcggcgagcgccuccucuuccucuucucccgcaugcuccucgucgccaagcgccgcggccucgaguacaccuacaagggccacaucuucugcugcaaccucuccgucuccgaguccccccgcgacccccucggcuucaaggucuccgaccucaccauccccaagcaccgccaccuccuccaggccaagaaccaggaggagaagcgccucuggauccacugccuccagcgccucuucuucgagaaccaccccgccuccauccccgccaaggccaagcagguccuccucgagaacucccuccacugcgcccccaaguccaagcccguccucgagccccucacccccccccucggcuccccccgcccccgcgacgcccgcuccuucacccccggccgccgcaacaccgcccccucccccggccccuccgucauccgccgcggccgccgccaguccgagcccgucaaggaccccuacgucauguucccccagaacgccaagcccggcuucaagcacgccggcuccgagggcgagcucuacccccccgagucccagccccccgucuccggcuccgccccccccgaggaccucgaggacgccggcccccccacccucgaccccuccggcaccuccaucaccgaggagauccucgagcuccucaaccagcgcggccuccgcgaccccggccccuccacccacgacauccccaaguuccccggcgacucccagguccccggcgacuccgagacccucaccuuccaggcccuccccucccgcgacuccuccgaggaggaggaggaggaggaggagggccucgagauggacgagcgcggccccuccccccuccacguccucgagggccucgaguccuccaucgccgccgagaugcccuccauccccugccucaccaagauccccgacguccccaaccuccccgagauccccucccgcugcgagauccccgagggcucccgccuccccucccucuccgacaucuccgacgucuucgagaugcccugccuccccgccauccccuccguccccaacacccccucccucuccuccacccccacccucuccugcgacuccuggcuccagggcccccuccaggagcccgccgaggcccccgccacccgccgcgagcucuucuccggcuccaaccccggcaagcucggcgagccccccuccggcggcaaggccggccccgaggaggacgaggagggcgucuccuucaccgacuuccagccccaggacgucacccagcaccagggcuuccccgacgagcucgccuuccgcuccugcuccgagauccgcuccgccuggcaggcccucgagcagggccagcucgcccgccccggcuuccccgagccccuccucauccucgaggacuccgaccucggcggcgacuccggcuccggcaaggccggcgcccccuccuccgagcgcaccgccucccgcguccgcgagcucgcccgccucuacuccgagcgcauccagcagaugcagcgcgccgagacccgcgccuccgccaacgccccccgccgccgcccccgcguccucgcccagccccagcccucccccugccucccccaggagcaggccgagcccggccuccuccccgccuucggccacguccucgucugcgagcucgccuucccccucaccugcgcccaggaguccgucccccucggccccgccgucuggguccaggccgccaucccccucuccaagcagggcggcucccccgacggccagggccuccacgucuccaaccuccccaagcaggaccuccccggcauccacgucuccgccgccacccuccuccccgagcagggcggcucccgccacguccaggcccccgccgccaccccccuccccaagcaggagggcccccuccaccuccagguccccgcccucaccaccuucuccgaccagggccaccccgagauccagguccccgccaccaccccccuccccgagcaccgcucccacauggucauccccgcccccuccaccgccuucugccccgagcagggccacugcgccgacauccacguccccaccacccccgcccuccccaaggagaucugcuccgacuucaccgucuccgucaccacccccguccccaagcaggagggccaccucgacuccgagucccccaccaacaucccccucaccaagcagggcggcucccgcgacguccagggccccgaccccgucugcucccagcccauccagccccucuccuggcacggcuccucccucgacccccagggccccggcgacacccuccccccccuccccugccaccuccccgaccuccagauccccggcaccuccccccuccccgcccacggcucccaccucgaccaccgcauccccgccaacgccccccucucccucucccaggagcuccccgacacccagguccccgccaccaccccccucccccucccccagguccucaccgacaucuggguccaggcccuccccaccucccccaagcagggcucccuccccgacauccagggccccgccgccgcccccccccuccccgagcccucccucaccgacacccagguccagaagcucacccccucccucgagcagaagucccucaucgacgcccacguccccgccgccaccccccuccccgagcgcggcggcucccucgacauccagggccucucccccacccccguccagaccaccaugguccucuccaagcccggcggcucccucgccucccacgucgcccgccucgaguccuccgaccucacccccccccacucccccccccccuccucccgccagcuccucggccccaacgccgccgcccucucccgcuaccucgccgccuccuacaucucccagucccucgcccgccgccagggccccggcggcggcgcccccgccgccucccgcggcuccugguccuccgcccccaccucccgcgccuccuccccccccccccagccccagcccccccccccccccgcccgccgccucuccuacgccaccaccgucaacauccacgucggcggcggcggccgccuccgccccgccaaggcccagguccgccucaaccaccccgcccuccucgccuccacccaggaguccaugggccuccaccgcgcccagggcgcccccgacgcccccuuccacauguga

SEQ ID NO: 47775 - RNA, 4026 nt, Artificial Sequence
  derived and/or modified sequence opt2 from PLEKHG3__Homo_sapiens__XP_011534927
augcccgucuccaccucccuccaccaggacggcucccaggagcgccccgucucccucaccuccaccaccuccuccuccggcuccuccugcgacucccgcuccgccauggaggagcccuccuccuccgaggcccccgccaagaacggcgccggcucccuccgcucccgccaccuccccaacuccaacaacaacuccuccuccuggcucaacgucaagggcccccucucccccuucaacucccgcgccgccgccggccccgcccaccacaagcucuccuaccucggccgcgucguccgcgagaucgucgagaccgagcgcauguacguccaggaccuccgcuccaucgucgaggacuaccuccucaagaucaucgacacccccggccuccucaagcccgagcaggucuccgcccucuucggcaacaucgagaacaucuacgcccucaacucccagcuccuccgcgaccucgacuccugcaacuccgaccccgucgccgucgccuccugcuucgucgagcgcucccaggaguucgacaucuacacccaguacugcaacaacuaccccaacuccgucgccgcccucaccgagugcaugcgcgacaagcagcaggccaaguucuuccgcgaccgccaggagcuccuccagcacucccucccccucggcuccuaccuccucaagcccguccagcgcauccucaaguaccaccuccuccuccaggagaucgccaagcacuucgacgaggaggaggacggcuucgaggucgucgaggacgccaucgacaccaugaccugcgucgccugguacaucaacgacaugaagcgccgccacgagcacgccguccgccuccaggagauccagucccuccucaucaacuggaagggccccgaccucaccaccuacggcgagcucguccucgagggcaccuuccgcguccaccgcguccgcaacgagcgcaccuucuuccucuucgacaagacccuccucaucaccaagaagcgcggcgaccacuucgucuacaagggcaacauccccugcuccucccucaugcucaucgaguccacccgcgacucccucugcuucaccgucacccacuacaagcacuccaagcagcaguacuccauccaggccaagaccgucgaggagaagcgcaacuggacccaccacaucaagcgccucauccucgagaaccaccacgccaccaucccccagaaggccaaggaggccauccucgagauggacuccuacuaccccaaccgcuaccgcugcucccccgagcgccucaagaaggccugguccucccaggacgaggucuccaccaacguccgccagggccgccgccaguccgagcccggccacucccccuacucccgcgccacccuccccuccggccagcgcggcuucgucaugcccucccucaagggccgccgcaaguccgagcccaccaagcaccuccuccgccagcucaacgagaaggcccgcgccgccggcaugaagcacgccggcuccgccggcacccuccucgacuucggccagcccucccgcacccgcggccuccagcccgaggccgagggcgccacccaggaggaggaggaggaggaggaggaggucgucgaggaggaggaggaggaggaggaggaggagcaggccuuccaggucucccucgaggaccucaccggccacgagggcaacgagaagggcgccggccccgagccccccggcuccgaggaggaggaggaggagcaggaggagucccucgccgucgccgagcagggcaagggccgccgcgaguccgaguccucccgcuccucccgccgccccuccggccgcucccccaccuccaccgagaagcgcauguccuucgaguccaucuccucccuccccgaggucgagcccgaccccgaggccggcuccgagcaggaggucuucuccgccgucgagggccccuccgccgaggagacccccuccgacaccgagucccccgagguccucgagacccagcucgacgcccaccagggccuccucggcauggacccccccggcgacauggucgacuucgucgccgccgaguccaccgaggaccucaaggcccucuccuccgaggaggaggaggagaugggcggcgccgcccaggagcccgagucccuccucccccccuccguccucgaccaggccuccgucaucgccgagcgcuucgucuccuccuucucccgccgcuccuccgucgcccaggaggacuccaaguccuccggcuucggcuccccccgccucgucucccgcuccuccuccguccucucccucgagggcuccgagaagggccucgcccgccacggcuccgccaccgacucccucuccugccagcucucccccgaggucgacaucuccgucggcgucgccaccgaggacucccccuccgucaacggcauggagccccccucccccggcugccccgucgagcccgaccgcuccuccugcaagaagaaggaguccgcccucuccacccgcgaccgccuccuccucgacaagaucaaguccuacuacgagaacgccgagcaccacgacgccggcuucuccguccgccgccgcgagucccucuccuacauccccaagggccucguccgcaacuccaucucccgcuucaacucccucccccgccccgaccccgagcccgucccccccgucggcuccaagcgccaggucggcucccgccccaccuccugggcccucuucgagcuccccggccccucccaggccgucaagggcgaccccccccccaucuccgacgccgaguuccgccccuccuccgagaucgucaagaucugggagggcauggaguccuccggcggcucccccggcaagggccccggccagggccaggccaacggcuucgaccuccacgagccccucuucauccucgaggagcacgagcucggcgccaucaccgaggaguccgccaccgccucccccgaguccuccucccccaccgagggccgcucccccgcccaccucgcccgcgagcucaaggagcucgucaaggagcucuccuccuccacccagggcgagcucgucgccccccuccacccccgcaucguccagcucucccacgucauggacucccacgucuccgagcgcgucaagaacaaggucuaccagcucgcccgccaguacucccuccgcaucaaguccaacaagcccgucauggcccgccccccccuccagugggagaaggucgcccccgagcgcgacggcaagucccccaccguccccugccuccaggaggaggccggcgagccccucggcggcaagggcaagcgcaagcccguccucucccucuucgacuacgagcagcucauggcccaggagcacuccccccccaagcccuccuccgccggcgagauguccccccagcgcuucuucuucaaccccuccgccgucucccagcgcaccaccucccccggcggccgccccuccgcccgcuccccccucucccccaccgagaccuucuccuggcccgacguccgcgagcucugcuccaaguacgccucccgcgacgaggcccgccgcgccggcggcggccgcccccgcggcccccccgucaaccgcucccacuccguccccgagaacauggucgagcccccccucuccggccgcgucggccgcugccgcucccucuccaccaagcgcggccgcggcggcggcgaggccgcccagucccccggcccccucccccaguccaagcccgacggcggcgagacccucuacgucaccgccgaccucacccucgaggacaaccgccgcgucaucgucauggagaagggcccccuccccucccccaccgccggccucgaggaguccuccggccagggccccuccucccccgucgcccuccucggccagguccaggacuuccagcaguccgccgagugccagcccaaggaggagggcucccgcgaccccgccgaccccucccagcagggccgcguccgcaaccuccgcgagaaguuccaggcccucaacuccgucggcuga

SEQ ID NO: 47776 - RNA, 3576 nt, Artificial Sequence
  derived and/or modified sequence opt2 from PLEKHG4__Homo_sapiens__NP_001123201
auggagcgcccccucgagaacggcgacgagucccccgacucccagggccacgccaccgacuggcgcuucgccgucugcuccuuccgcgacgccugggaggaggaggagcccgccucccagaugcacgucaaggaccccggccccccccgcccccccgccggcgccacccaggacgaggagcuccagggcuccccccucucccgcaaguuccagcucccccccgccgccgacgaguccggcgacgcccagcgcggcaccgucgaguccuccuccguccucuccgagggccccggccccuccggcgucgagucccuccucugccccauguccucccaccucucccucgcccagggcgaguccgacacccccggcgucggccucgucggcgaccccggccccucccgcgccaugcccuccggccucucccccggcgcccucgacuccgaccccgucggccucggcgacccccucuccgagaucuccaagcuccucgaggccgcccccuccggcuccggccuccccaagcccgccgacugccuccucgcccaggaccucugcugggagcuccucgccuccggcauggccacccuccccggcacccgcgacguccagggccgcgccguccuccuccucugcgcccacucccccgccuggcuccaguccgagugcuccucccaggagcucauccgccuccuccucuaccuccgcuccaucccccgccccgagguccaggcccucggccucaccguccucgucgacgcccgcaucugcgcccccuccuccucccucuucuccggccucucccagcuccaggaggccgcccccggcgccgucuaccagguccuccucgucggcuccacccuccucaaggagguccccuccggccuccagcucgagcagcuccccucccagucccuccucacccacauccccaccgccggccuccccaccucccucggcggcggccuccccuacugccaccaggccuggcucgacuuccgccgccgccucgaggcccuccuccagaacugccaggccgccugcgcccuccuccagggcgccaucgaguccgucaaggccgucccccagcccauggagcccggcgaggucggccagcuccuccagcagaccgagguccucaugcagcagguccucgacucccccuggcucgccuggcuccagugccagggcggccgcgagcucaccuggcucaagcaggagguccccgaggucacccucucccccgacuaccgcaccgccauggacaaggccgacgagcucuacgaccgcgucgacggccuccuccaccagcucacccuccaguccaaccagcgcauccaggcccucgagcucguccagacccucgaggcccgcgaguccggccuccaccagaucgaggucuggcuccagcaggucggcuggcccgcccucgaggaggccggcgagcccucccucgacaugcuccuccaggcccagggcuccuuccaggagcucuaccaggucgcccaggagcagguccgccagggcgagaaguuccuccagccccucaccggcugggaggccgccgagcucgacccccccggcgcccgcuuccucgcccuccgcgcccagcucaccgaguucucccgcgcccucgcccagcgcugccagcgccucgccgacgccgagcgccucuuccagcucuuccgcgaggcccucaccugggccgaggagggccagcgcguccucgccgagcucgagcaggagcgccccggcgucguccuccagcagcuccagcuccacuggacccgccaccccgaccucccccccgcccacuuccgcaagaugugggcccucgccaccggccucggcuccgaggccauccgccaggagugccgcugggccugggcccgcugccaggacaccuggcucgcccucgaccagaagcucgaggccucccucaagcucccccccgucggcuccaccgccucccucugcgucucccagguccccgccgcccccgcccaccccccccuccgcaaggccuacuccuucgaccgcaaccucggccagucccucuccgagcccgccugccacugccaccacgccgccaccaucgccgccugccgccgccccgaggccggcggcggcgcccucccccaggccucccccaccguccccccccccggcuccuccgacccccgcucccucaaccgccuccagcucguccucgccgagauggucgccaccgagcgcgaguacguccgcgcccucgaguacaccauggagaacuacuuccccgagcucgaccgccccgacgucccccagggccuccgcggccagcgcgcccaccucuucggcaaccucgagaagcuccgcgacuuccacugccacuucuuccuccgcgagcucgaggccugcacccgccaccccccccgcgucgccuacgccuuccuccgccaccgcguccaguucggcauguacgcccucuacuccaagaacaagccccgcuccgacgcccucauguccuccuacggccacaccuucuucaaggacaagcagcaggcccucggcgaccaccucgaccucgccuccuaccuccucaagcccauccagcgcaugggcaaguacgcccuccuccuccaggagcucgcccgcgccugcggcggccccacccaggagcucuccgcccuccgcgaggcccagucccucguccacuuccagcuccgccacggcaacgaccuccucgccauggacgccauccagggcugcgacgucaaccucaaggagcagggccagcucguccgccaggacgaguucgucguccgcaccggccgccacaaguccguccgccgcaucuuccucuucgaggagcuccuccucuucuccaagccccgccacggccccaccggcgucgacaccuucgccuacaagcgcuccuucaagauggccgaccucggccucaccgagugcugcggcaacuccaaccuccgcuucgagaucugguuccgccgccgcaaggcccgcgacaccuucguccuccaggccuccucccucgccaucaagcaggccuggaccgccgacaucucccaccuccucuggcgccaggccguccacaacaaggagguccgcauggccgagauggucuccaugggcgucggcaacaaggccuuccgcgacaucgcccccuccgaggaggccaucaacgaccgcaccgucaacuacguccucaagugccgcgagguccgcucccgcgccuccaucgccgucgcccccuucgaccacgacucccucuaccucggcgccuccaacucccuccccggcgaccccgccuccugcuccguccucggcucccucaaccuccaccucuaccgcgaccccgcccuccucggccuccgcugcccccucuaccccuccuuccccgaggaggccgcccucgaggccgaggccgagcucggcggccagcccucccucaccgccgaggacuccgagaucuccucccagugccccuccgccuccggcuccuccggcuccgacuccuccugcgucuccggccaggcccucggccgcggccucgaggaccuccccugcgucuga

SEQ ID NO: 47777 - RNA, 2373 nt, Artificial Sequence
  derived and/or modified sequence opt2 from PLEKHG6__Homo_sapiens__NP_001138328
augaaggccuucggccccccccacgagggcccccuccagggccucgucgccucccgcaucgagaccuacggcggccgccaccgcgccuccgcccaguccaccgccggccgccucuacccccgcggcuaccccguccucgaccccucccgccgccgccuccagcaguacguccccuucgcccgcggcuccggccaggcccgcggccucucccccaugcgccuccgcgaccccgagcccgagaagcgccacggcggccacgucggcgccggccuccuccacucccccaagcucaaggagcucaccaaggcccacgagcucgagguccgccuccacaccuucuccauguucggcaugccccgccucccccccgaggaccgccgccacugggagaucggcgagggcggcgacuccggccucaccaucgagaaguccuggcgcgagcucguccccggccacaaggagaugucccaggagcucugccaccagcaggaggcccucugggagcuccucaccaccgagcucaucuacguccgcaagcucaagaucaugaccgaccuccucgccgccggccuccucaaccuccagcgcgucggccuccucauggaggucuccgccgagacccucuucggcaacguccccucccucauccgcacccaccgcuccuucugggacgagguccucggccccacccucgaggagacccgcgccuccggccagccccucgaccccaucggccuccaguccggcuuccucaccuucggccagcgcuuccaccccuacguccaguacugccuccgcgucaagcagaccauggccuacgcccgcgagcagcaggagaccaacccccucuuccacgccuucguccaguggugcgagaagcacaagcgcuccggccgccagaugcucugcgaccuccucaucaagccccaccagcgcaucaccaaguacccccuccuccuccacgccguccucaagcgcucccccgaggcccgcgcccaggaggcccucaacgccaugaucgaggccgucgaguccuuccuccgccacaucaacggccagguccgccagggcgaggagcaggagucccucgccgccgccgcccagcgcaucggccccuacgagguccucgagccccccuccgacgaggucgagaagaaccuccgccccuucuccacccucgaccucaccucccccaugcucggcgucgccuccgagcacacccgccagcuccuccucgagggccccguccgcgucaaggagggccgcgagggcaagcucgacgucuaccucuuccucuucuccgacguccuccucgucaccaagccccagcgcaaggccgacaaggccaaggucauccgccccccccucaugcucgagaagcucgucugccagccccuccgcgaccccaacuccuuccuccucauccaccucaccgaguuccagugcgucuccuccgcccuccucguccacugccccucccccaccgaccgcgcccaguggcucgagaagacccagcaggcccaggccgcccuccagaagcucaaggccgaggaguacguccagcagaagcgcgagcuccucacccucuaccgcgaccaggaccgcgagucccccuccacccgccccuccacccccucccucgagggcucccaguccuccgccgagggccgcacccccgaguucuccaccaucaucccccaccucgucgucaccgaggacaccgacgaggacgccccccucguccccgacgacaccuccgacuccggcuacggcacccucauccccggcacccccaccggcucccgcuccccccucucccgccuccgccagcgcgcccuccgccgcgacccccgccucaccuucuccacccucgagcuccgcgacaucccccuccgcccccacccccccgacccccaggccccccagcgccgcuccgcccccgagcuccccgagggcauccucaagggcggcucccucccccaggaggacccccccaccugguccgaggaggaggacggcgccuccgagcgcggcaacgucgucgucgagacccuccaccgcgcccgccuccgcggccagcuccccuccucccccacccacgccgacuccgccggcgagucccccugggaguccuccggcgaggaggaggaggagggcccccucuuccucaaggccggccacaccucccuccgccccaugcgcgccgaggacaugcuccgcgagauccgcgaggagcucgccucccagcgcaucgagggcgccgaggagccccgcgacucccgcccccgcaagcucacccgcgcccagcuccagcgcaugcgcggcccccacaucauccagcucgacaccccccucuccgccuccgaggucuga

SEQ ID NO: 47778 - RNA, 4482 nt, Artificial Sequence
  derived and/or modified sequence opt2 from PLEKHH2__Homo_sapiens__NP_742066
auggccgagcucuccgagcccgagggccccgucgacuggaaggagcgcugcgucgcccucgagucccagcucaugaaguuccgcguccaggccuccaagauccgcgagcuccucgccgagaagaugcagcagcucgagcgccaggucaucgacgccgagcgccaggccgagaaggccuuccagcagguccaggucauggaggacaagcucaaggccgccaacauccagaccuccgaguccgagacccgccucuacaacaagugccaggaccucgagucccucauccaggagaaggacgacgucauccagaaccucgagcuccagcucgaggagcagaagcagauccgcauccaggaggccaagaucaucgaggagaaggccgccaagaucaaggagugggucaccgucaagcucaacgagcucgagcucgagaaccagaaccuccgccucaucaaccagaaccagaccgaggagauccgcaccaugcaguccaagcuccaggagguccagggcaagaaguccuccaccgucuccacccucaagcucuccgagggccagcgccucuccucccucaccuucggcugcuuccucucccgcgcccgcucccccccccaggucgucaaguccgaggagauguccaagaucuccuccaaggagcccgaguucaccgagggcaaggacauggaggagauggagauccccgagaaguccgucgacaaccagguccucgagaacaaccgcggccagcgcacccuccaccagacccccugcggcuccgagcagaaccgcaagacccgcaccuccuucgccaccgacggcggcaucucccagaacuccggcgcccccgucuccgacugguccuccgacgaggaggacggcuccaagggccgcuccaagucccgcugcaccuccacccucuccucccacaccuccgaggagggcguccagugcucccgcaugggcuccgagauguaccucaccgccuccgacgacuccuccuccaucuucgaggaggagaccuucggcaucaagcgccccgagcacaagaagcucuacuccuggcagcaggaggcccaguggaaggcccucaacuccccccucggcaagggcaacuccgagcucuccaagaaggagcaggacuccuccuccgacgagcucaacaagaaguuccagucccagcgccucgacuacuccuccuccuccuccgaggccaacacccccucccccauccucacccccgcccucaugcccaagcaccccaacucccucuccggcaagggcacccagcucguccccuccucccaccuccccccccccaagcuccgcauccccaacgucuucuccaucuccgucgcccucgccaagcgccaccucucccagccccagcucuccuccgaccgcauguucggcaccaaccgcaacgccaucuccaugauccgcccccuccgcccccaggagaccgaccucgaccucgucgacggcgacuccaccgagguccucgagaacauggacaccuccugcgacgacggccucuucuccuacgacucccucgacucccccaacuccgacgaccaggagcacugcgacuccgccaagaaggucgccuacuccaagccccccacccccccccuccaccgcuuccccuccugggagucccgcaucuacgccgucgccaaguccggcauccgcauguccgaggccuucaacauggaguccgucaacaagaacuccgccgccacccucuccuacaccaccuccggccucuacaccucccucaucuacaagaacaugaccacccccgucuacaccacccucaagggcaaggccacccagaucuccuccucccccuuccucgacgacuccuccggcuccgaggaggaggacuccucccgcuccuccucccgcaccuccgaguccgacucccgcucccgcuccggccccggcuccccccgcgccaugaagcgcggcgucucccucuccuccgucgccuccgaguccgacuacgccaucccccccgacgccuacuccaccgacaccgaguacucccagcccgagcagaagcuccccaagaccugcuccuccuccuccgacaacggcaagaacgagccccucgagaaguccggcuaccuccucaagauguccggcaaggucaaguccuggaagcgccgcugguucguccucaagggcggcgagcuccucuacuacaagucccccuccgacgucauccgcaagccccagggccacaucgagcucuccgccuccugcuccauccuccgcggcgacaacaagcagaccguccagcucaccaccgagaagcacaccuacuaccucaccgccgacucccccaacauccucgaggaguggaucaagguccuccagaacguccuccgcguccaggccgccaacccccucucccuccagcccgagggcaagcccaccaugaagggccuccucaccaaggucaagcacggcuacuccaagcgcgucuggugcacccucaucggcaagacccucuacuacuuccgcucccaggaggacaaguucccccucggccagaucaagcucugggaggccaaggucgaggaggucgaccgcuccugcgacuccgacgaggacuacgaggccuccggccgcucccuccucuccacccacuacaccaucgucauccaccccaaggaccagggccccaccuaccuccucaucggcuccaagcacgagaaggacaccuggcucuaccaccucaccgucgccgccggcuccaacaacgucaacgucggcuccgaguucgagcagcucgucugcaagcuccucaacaucgacggcgagcccuccucccagaucuggcgccaccccacccucugccacuccaaggagggcaucaucuccccccucaccacccuccccuccgaggcccuccagaccgaggccaucaagcucuucaagaccugccagcucuucaucaacgccgccgucgacucccccgccaucgacuaccacaucucccucgcccaguccgcccuccagaucugccucacccaccccgagcuccagaacgagaucugcugccagcucaucaagcagacccgccgccgccagccccagaaccagcccggcccccuccagggcuggcagcuccucgcccucugcgucggccucuuccucccccaccaccccuuccucuggcuccuccgccuccaccucaagcgcaacgccgacucccgcaccgaguucggcaaguacgccaucuacugccagcgcugcgucgagcgcacccagcagaacggcgaccgcgaggcccgccccucccgcauggagauccucuccacccuccuccgcaaccccuaccaccacucccuccccuucuccauccccguccacuucaugaacggcaucuaccaggucgucggcuucgacgccuccaccaccgucgaggaguuccucaacacccucaaccaggacaccggcaugcgcaagcccgcccaguccggcuucgcccucuucaccgacgaccccuccggccgcgaccucgagcacugccuccagggcaacaucaagaucugcgacaucaucuccaagugggagcaggccuccaaggagcagcagcccggcaagugcgagggcacccgcaccguccgccucaccuacaagaaccgccucuacuucuccguccaggcccgcggcgagaccgaccgcgagaagcuccuccucauguaccagaccaacgaccagaucaucaacggccucuucccccucaacaaggaccucgcccucgagauggccgcccuccucucccaggucgagaucggcgacuucgagcgccccuucuccacccccgccggccacgucaccaaccagugcaaggucaaccagacccucaagcaggucaucgagaaguucuaccccaagcgcuaccgcgacggcugcuccgaggagcagcuccgccagcucugccagcgccucuccacccgcuggauggcccuccgcggccacuccgccgccgacugcguccgcaucuaccucaccgucgcccgcaaguggcccuucuucggcgccaagcucuuccucgccaagcccaucacccccuccucccucggcuccaccuuccucuggcucgccguccacgaggacggccucucccuccucgaguacaacuccaugcgccucaucgucuccuacgucuacaagucccucaugaccuucggcggcuaccaggacgacuucauggucgucaucaacaacacccacuccaaggacaagcccaccgagaagcuccucuucgccauggccaagcccaagauccucgagaucacccuccucaucgccuccuacaucaacaacuuccaccagcagaaggccgccuuccaccaccucuccgcccccgcccuccucuccgcccagacccgcggcccccaggcccgcaugaugggcucccagccccuccucuccuccucccgccccaccaagggccccacccuccucuga

SEQ ID NO: 47779 - RNA, 3171 nt, Artificial Sequence
  derived and/or modified sequence opt2 from PLEKHM1__Homo_sapiens__NP_055613
augcucuccgucgucgagaacggccucgacccccaggccgccauccccgucaucaagaagaagcucgucggcuccgucaaggcccuccagaagcaguacgucucccucgacaccgucgucaccuccgaggacggcgacgccaacaccaugugcuccgcccucgaggccgucuucauccacggccuccacgccaagcacauccgcgccgaggccggcggcaagcgcaagaaguccgcccaccagaagccccucccccagcccgucuucuggccccuccucaaggccgucacccacaagcacaucaucuccgagcucgagcaccucaccuucgucaacaccgacgucggccgcugccgcgccuggcuccgccucgcccucaacgacggccucauggagugcuaccucaagcuccuccuccaggagcaggcccgccuccacgaguacuaccagcccaccgcccuccuccgcgacgccgaggagggcgaguuccuccucuccuuccuccagggccucaccucccucuccuucgagcucuccuacaaguccgccauccucaacgaguggacccucaccccccucgcccucuccggccucugcccccucuccgagcucgacccccucuccaccuccggcgccgagcuccagcgcaaggagucccucgacuccaucucccacuccuccggcuccgaggacaucgagguccaccacuccggccacaagauccgccgcaaccagaagcucaccgccuccucccucucccucgacaccgccuccuccucccagcucuccugcucccucaacuccgacuccugccuccuccaggagaacggcuccaagucccccgaccacugcgaggagcccauguccugcgacuccgaccucggcaccgccaacgccgaggacuccgaccgcucccuccaggagguccuccucgaguucuccaaggcccaggucaacuccguccccaccaacggccucucccaggagaccgagauccccaccccccaggccucccucucccuccacggccucaacaccuccaccuaccuccacugcgaggcccccgccgagccccuccccgcccaggccgccuccggcacccaggacggcguccacguccaggagccccgcccccaggcccccuccccccucgaccuccagcagcccgucgaguccaccuccggccagcagcccuccuccaccgucuccgagaccgcccgcgaggucggccagggcaacggccuccagaaggcccaggcccacgacggcgccggccucaagcucgucgucuccucccccaccucccccaagaacaaguccuggaucuccgaggacgacuucuaccgccccucccgcgagcagccccucgaguccgccuccgaccaccccaucgccuccuaccgcggcacccccggcucccgccccggccuccaccgccacuucucccaggagccccgcaagaacugcucccucggcgcccucgaccaggccugcguccccucccccggccgccgccaggcccaggccgcccccucccagggccacaaguccuuccgcgucguccaccgccgccagaugggccucuccaaccccuuccgcggccucaugaagcucggcaccgucgagcgccgcggcgccaugggcaucuggaaggagcucuucugcgagcucuccccccucgaguuccgccucuaccucuccaacgaggagcacaccugcgucgagaacugcucccuccuccgcugcgaguccgucggccccgcccacuccgacggccgcuucgagcucgucuucuccggcaagaagcucgcccuccgcgccuccucccaggacgaggccgaggacuggcucgaccgcguccgcgaggcccuccagaagguccgcccccagcaggaggacgagugggucaacguccaguaccccgaccagcccgaggagccccccgaggccccccagggcugccucucccccuccgaccuccucuccgagcccgccgcccuccagggcacccaguucgacugguccuccgcccagguccccgagcccgacgccaucaaggagucccuccucuaccucuacauggaccgcaccuggaugcccuacaucuucucccucucccucgaggcccucaagugcuuccgcauccgcaacaacgagaagaugcucuccgacucccacggcgucgagaccauccgcgacauccuccccgacaccucccucggcggccccuccuucuucaagaucaucaccgccaaggccguccucaagcuccaggccggcaacgccgaggaggccgcccucuggcgcgaccucguccgcaagguccucgccuccuaccucgagaccgccgaggaggccgucacccucggcggcucccucgacgagaacugccaggagguccucaaguucgccacccgcgagaacggcuuccuccuccaguaccucgucgccauccccauggagaagggccucgacucccagggcugcuucugcgccggcugcucccgccagaucggcuucuccuucguccgccccaagcucugcgccuucuccggccucuacuacugcgacaucugccaccaggacgacgccuccgucauccccgcccgcaucauccacaacugggaccucaccaagcgccccaucugccgccaggcccucaaguuccucacccagauccgcgcccagccccucaucaaccuccagauggucaacgccucccucuacgagcacgucgagcgcaugcaccucaucggccgccgccgcgagcagcucaagcuccucggcgacuaccucggccucugccgcuccggcgcccucaaggagcucuccaagcgccucaaccaccgcaacuaccuccucgaguccccccaccgcuucuccgucgccgaccuccagcagaucgccgacggcgucuacgagggcuuccucaaggcccucaucgaguucgccucccagcacgucuaccacugcgaccucugcacccagcgcggcuucaucugccagaucugccagcaccacgacaucaucuuccccuucgaguucgacaccaccguccgcugcgccgagugcaagaccgucuuccaccaguccugccaggccgucgucaagaagggcugcccccgcugcgcccgccgccgcaaguaccaggagcagaacaucuucgccuga

SEQ ID NO: 47780 - RNA, 681 nt, Artificial Sequence
  derived and/or modified sequence opt2 from PLEKHO1__Homo_sapiens__NP_001291653
augcucacccucgaccucauccaggaggaggaccccucccccgaggagcccaccuccugcgccgaguccuuccgcgucgaccucgacaaguccgucgcccagcucgccggcucccgccgccgcgccgacuccgaccgcauccagcccuccgccgaccgcgccuccucccucucccgccccugggagaagaccgacaagggcgccaccuacaccccccaggcccccaagaagcucacccccaccgagaagggccgcugcgccucccucgaggagauccucucccagcgcgacgccgccuccgcccgcacccuccagcuccgcgccgaggagccccccacccccgcccuccccaaccccggccagcucucccgcauccaggaccucgucgcccgcaagcucgaggagacccaggagcuccucgccgagguccagggccucggcgacggcaagcgcaaggccaaggaccccccccgcuccccccccgacuccgaguccgagcagcuccuccucgagaccgagcgccuccucggcgaggccuccuccaacuggucccaggccaagcgcguccuccaggagguccgcgagcuccgcgaccucuaccgccagauggaccuccagacccccgacucccaccuccgccagaccaccccccacucccaguaccgcaagucccucauguga

SEQ ID NO: 47781 - RNA, 1473 nt, Artificial Sequence
  derived and/or modified sequence opt2 from PLEKHO2__Homo_sapiens__NP_079477
auggaggaggagggcgucaaggaggccggcgagaagccccgcggcgcccagauggucgacaaggccggcuggaucaagaaguccuccggcggccuccucggcuucuggaaggaccgcuaccuccuccucugccaggcccagcuccucgucuacgagaacgaggacgaccagaagugcgucgagaccgucgagcucggcuccuacgagaagugccaggaccuccgcgcccuccucaagcgcaagcaccgcuucauccuccuccgcucccccggcaacaaggucuccgacaucaaguuccaggcccccaccggcgaggagaaggaguccuggaucaaggcccucaacgagggcaucaaccgcggcaagaacaaggccuucgacgaggucaaggucgacaaguccugcgcccucgagcacgucacccgcgaccgcguccgcggcggccagcgccgccgcccccccacccgcguccaccucaaggaggucgccuccgccgccuccgacggccuccuccgccucgaccucgacguccccgacuccggcccccccgucuucgcccccuccaaccacgucuccgaggcccagccccgcgagaccccccgcccccucaugccccccaccaagcccuuccucgcccccgagaccaccucccccggcgaccgcgucgagacccccgucggcgagcgcgcccccacccccgucuccgccuccuccgaggucucccccgagucccaggaggacuccgagacccccgccgaggaggacuccggcuccgagcagccccccaacuccguccuccccgacaagcucaaggucuccugggagaaccccuccccccaggaggcccccgccgccgaguccgccgagcccucccaggcccccugcuccgagaccuccgaggccgccccccgcgagggcggcaagccccccacccccccccccaagauccucuccgagaagcucaaggccuccaugggcgagaugcaggccuccggcccccccgcccccggcaccguccaggucuccgucaacggcauggacgacucccccgagcccgccaagcccucccaggccgagggcacccccggcaccccccccaaggacgccaccaccuccaccgcccucccccccugggaccuccccccccaguuccacccccgcugcuccucccucggcgaccuccucggcgagggcccccgccacccccuccagccccgcgagcgccucuaccgcgcccagcucgaggucaaggucgccuccgagcagaccgagaagcuccucaacaagguccucggcuccgagcccgcccccgucuccgccgagacccuccucucccaggccgucgagcagcuccgccaggccacccagguccuccaggagaugcgcgaccucggcgagcucucccaggaggcccccggccuccgcgagaagcgcaaggagcucgucacccucuaccgccgcuccgcccccuga

SEQ ID NO: 47782 - RNA, 1053 nt, Artificial Sequence
  derived and/or modified sequence opt2 from PLEK__Homo_sapiens__NP_002655
auggagcccaagcgcauccgcgagggcuaccucgucaagaagggcuccgucuucaacaccuggaagcccaugugggucguccuccucgaggacggcaucgaguucuacaagaagaaguccgacaacucccccaagggcaugaucccccucaagggcuccacccucaccucccccugccaggacuucggcaagcgcauguucgucuucaagaucaccaccaccaagcagcaggaccacuucuuccaggccgccuuccucgaggagcgcgacgccuggguccgcgacaucaagaaggccaucaagugcaucgagggcggccagaaguucgcccgcaaguccacccgccgcuccauccgccuccccgagaccaucgaccucggcgcccucuaccucuccaugaaggacaccgagaagggcaucaaggagcucaaccucgagaaggacaagaagaucuucaaccacugcuucaccggcaacugcgucaucgacuggcucgucuccaaccaguccguccgcaaccgccaggagggccucaugaucgccuccucccuccucaacgagggcuaccuccagcccgccggcgacauguccaaguccgccgucgacggcaccgccgagaaccccuuccucgacaaccccgacgccuucuacuacuuccccgacuccggcuucuucugcgaggagaacuccuccgacgacgacgucauccucaaggaggaguuccgcggcgucaucaucaagcagggcugccuccucaagcagggccaccgccgcaagaacuggaagguccgcaaguucauccuccgcgaggaccccgccuaccuccacuacuacgaccccgccggcgccgaggacccccucggcgccauccaccuccgcggcugcgucgucaccuccgucgaguccaacuccaacggccgcaaguccgaggaggagaaccucuucgagaucaucaccgccgacgagguccacuacuuccuccaggccgccacccccaaggagcgcaccgaguggauccgcgccauccagauggccucccgcaccggcaaguga

SEQ ID NO: 47783 - RNA, 2433 nt, Artificial Sequence
  derived and/or modified sequence opt2 from PLG__Homo_sapiens__NP_000292
auggagcacaaggaggucguccuccuccuccuccucuuccucaaguccggccagggcgagccccucgacgacuacgucaacacccagggcgccucccucuucuccgucaccaagaagcagcucggcgccggcuccaucgaggagugcgccgccaagugcgaggaggacgaggaguucaccugccgcgccuuccaguaccacuccaaggagcagcagugcgucaucauggccgagaaccgcaaguccuccaucaucauccgcaugcgcgacgucguccucuucgagaagaaggucuaccucuccgagugcaagaccggcaacggcaagaacuaccgcggcaccauguccaagaccaagaacggcaucaccugccagaagugguccuccaccuccccccaccgcccccgcuucucccccgccacccaccccuccgagggccucgaggagaacuacugccgcaaccccgacaacgacccccagggccccuggugcuacaccaccgaccccgagaagcgcuacgacuacugcgacauccucgagugcgaggaggagugcaugcacugcuccggcgagaacuacgacggcaagaucuccaagaccauguccggccucgagugccaggccugggacucccaguccccccacgcccacggcuacauccccuccaaguuccccaacaagaaccucaagaagaacuacugccgcaaccccgaccgcgagcuccgccccuggugcuucaccaccgaccccaacaagcgcugggagcucugcgacaucccccgcugcaccacccccccccccuccuccggccccaccuaccagugccucaagggcaccggcgagaacuaccgcggcaacgucgccgucaccgucuccggccacaccugccagcacugguccgcccagaccccccacacccacaaccgcacccccgagaacuuccccugcaagaaccucgacgagaacuacugccgcaaccccgacggcaagcgcgcccccuggugccacaccaccaacucccagguccgcugggaguacugcaagauccccuccugcgacuccucccccgucuccaccgagcagcucgcccccaccgccccccccgagcucacccccgucguccaggacugcuaccacggcgacggccaguccuaccgcggcaccuccuccaccaccaccaccggcaagaagugccaguccugguccuccaugaccccccaccgccaccagaagacccccgagaacuaccccaacgccggccucaccaugaacuacugccgcaaccccgacgccgacaagggccccuggugcuucaccaccgaccccuccguccgcugggaguacugcaaccucaagaagugcuccggcaccgaggccuccgucgucgcccccccccccgucguccuccuccccgacgucgagacccccuccgaggaggacugcauguucggcaacggcaagggcuaccgcggcaagcgcgccaccaccgucaccggcacccccugccaggacugggccgcccaggagccccaccgccacuccaucuucacccccgagaccaacccccgcgccggccucgagaagaacuacugccgcaaccccgacggcgacgucggcggccccuggugcuacaccaccaacccccgcaagcucuacgacuacugcgacgucccccagugcgccgcccccuccuucgacugcggcaagccccaggucgagcccaagaagugccccggccgcgucgucggcggcugcgucgcccacccccacuccuggcccuggcaggucucccuccgcacccgcuucggcaugcacuucugcggcggcacccucaucucccccgaguggguccucaccgccgcccacugccucgagaaguccccccgccccuccuccuacaaggucauccucggcgcccaccaggaggucaaccucgagccccacguccaggagaucgaggucucccgccucuuccucgagcccacccgcaaggacaucgcccuccucaagcucuccucccccgccgucaucaccgacaaggucauccccgccugccuccccucccccaacuacgucgucgccgaccgcaccgagugcuucaucaccggcuggggcgagacccagggcaccuucggcgccggccuccucaaggaggcccagcuccccgucaucgagaacaaggucugcaaccgcuacgaguuccucaacggccgcguccaguccaccgagcucugcgccggccaccucgccggcggcaccgacuccugccagggcgacuccggcggcccccucgucugcuucgagaaggacaaguacauccuccagggcgucaccuccuggggccucggcugcgcccgccccaacaagcccggcgucuacguccgcgucucccgcuucgucaccuggaucgagggcgucaugcgcaacaacuga

SEQ ID NO: 47784 - RNA, 291 nt, Artificial Sequence
  derived and/or modified sequence opt2 from PLGLB2__Homo_sapiens__NP_002656
auggagcacaaggaggucguccuccuccuccuccucuuccucaaguccggccagggcgagccccucgacgacuacgucaacacccagggccccucccucuucuccgucaccaagaagcagcucggcgccggcucccgcgaggagugcgccgccaagugcgaggaggacaaggaguucaccugccgcgccuuccaguaccacuccaaggagcagcagugcgucaucauggccgagaaccgcaaguccuccaucaucauccgcaugcgcgacgccguccucuucgagaaguga

SEQ ID NO: 47785 - RNA, 1569 nt, Artificial Sequence
  derived and/or modified sequence opt2 from PLIN1__Homo_sapiens__XP_005254991
auggccgucaacaagggccucacccuccucgacggcgaccuccccgagcaggagaacguccuccagcgcguccuccagcuccccgucgucuccggcaccugcgagugcuuccagaagaccuacaccuccaccaaggaggcccacccccucgucgccuccgucugcaacgccuacgagaagggcguccaguccgccuccucccucgccgccugguccauggagcccgucguccgccgccucuccacccaguucaccgccgccaacgagcucgccugccgcggccucgaccaccucgaggagaagauccccgcccuccaguacccccccgagaagaucgccuccgagcucaaggacaccaucuccacccgccuccgcuccgcccgcaacuccaucuccguccccaucgccuccaccuccgacaagguccucggcgccgcccucgccggcugcgagcucgccuggggcgucgcccgcgacaccgccgaguucgccgccaacacccgcgccggccgccucgccuccggcggcgccgaccucgcccucggcuccaucgagaaggucgucgaguaccuccucccccccgacaaggaggaguccgcccccgcccccggccaccagcaggcccagaagucccccaaggccaagcccucccuccucucccgcgucggcgcccucaccaacacccucucccgcuacaccguccagaccauggcccgcgcccucgagcagggccacaccgucgccauguggauccccggcgucgucccccucuccucccucgcccaguggggcgccuccgucgccaugcaggccgucucccgccgccgcuccgagguccgcguccccuggcuccacucccucgccgccgcccaggaggaggaccacgaggaccagaccgacaccgagggcgaggacaccgaggaggaggaggagcucgagaccgaggagaacaaguucuccgaggucgccgcccuccccggcccccgcggccuccucggcggcgucgcccacacccuccagaagacccuccagaccaccaucuccgccgucaccugggcccccgccgccguccucggcauggccggccgcguccuccaccucacccccgcccccgccgucuccuccaccaagggccgcgccaugucccucuccgacgcccucaagggcgucaccgacaacgucgucgacaccgucguccacuacgucccccucccccgccucucccucauggagcccgaguccgaguuccgcgacaucgacaacccccccgccgaggucgagcgccgcgaggccgagcgccgcgccuccggcgcccccuccgccggccccgagcccgccccccgccucgcccagccccgccgcucccuccgcuccgcccagucccccggcgccccccccggccccggccucgaggacgaggucgccacccccgccgccccccgccccggcuuccccgccgucccccgcgagaagcccaagcgccgcgucuccgacuccuucuuccgccccuccgucauggagcccauccucggccgcacccacuacucccagcuccgcaagaaguccuga

SEQ ID NO: 47786 - RNA, 1314 nt, Artificial Sequence
  derived and/or modified sequence opt2 from PLIN2__Homo_sapiens__NP_001113
auggccuccgucgccgucgacccccagcccuccgucgucacccgcgucgucaaccucccccucgucuccuccaccuacgaccucauguccuccgccuaccucuccaccaaggaccaguaccccuaccucaaguccgucugcgagauggccgagaacggcgucaagaccaucaccuccgucgccaugaccuccgcccuccccaucauccagaagcucgagccccagaucgccgucgccaacaccuacgccugcaagggccucgaccgcaucgaggagcgccuccccauccucaaccagcccuccacccagaucgucgccaacgccaagggcgccgucaccggcgccaaggacgccgucaccaccaccgucaccggcgccaaggacuccgucgccuccaccaucaccggcgucauggacaagaccaagggcgccgucaccggcuccgucgagaagaccaaguccgucgucuccggcuccaucaacaccguccucggcucccgcaugaugcagcucgucuccuccggcgucgagaacgcccucaccaaguccgagcuccucgucgagcaguaccucccccucaccgaggaggagcucgagaaggaggccaagaaggucgagggcuucgaccucguccagaagcccuccuacuacguccgccucggcucccucuccaccaagcuccacucccgcgccuaccagcaggcccucucccgcgucaaggaggccaagcagaagucccagcagaccaucucccagcuccacuccaccguccaccucaucgaguucgcccgcaagaacgucuacuccgccaaccagaagauccaggacgcccaggacaagcucuaccucuccugggucgaguggaagcgcuccaucggcuacgacgacaccgacgagucccacugcgccgagcacaucgagucccgcacccucgccaucgcccgcaaccucacccagcagcuccagaccaccugccacacccuccucuccaacauccagggcgucccccagaacauccaggaccaggccaagcacaugggcgucauggccggcgacaucuacuccgucuuccgcaacgccgccuccuucaaggaggucuccgacucccuccucaccuccuccaagggccagcuccagaagaugaaggagucccucgacgacgucauggacuaccucgucaacaacaccccccucaacuggcucgucggccccuucuacccccagcucaccgagucccagaacgcccaggaccagggcgccgagauggacaaguccucccaggagacccagcgcuccgagcacaagacccacuga

SEQ ID NO: 47787 - RNA, 1269 nt, Artificial Sequence
  derived and/or modified sequence opt2 from PLIN3__Homo_sapiens__NP_001157666
auguccgccgacggcgccgaggccgacggcuccacccaggucaccgucgaggagcccguccagcagcccuccgucgucgaccgcgucgccuccaugccccucaucuccuccaccugcgacauggucuccgccgccuacgccuccaccaaggaguccuacccccacaucaagaccgucugcgacgccgccgagaagggcguccgcacccucaccgccgccgccgucuccggcgcccagcccauccucuccaagcucgagccccagaucgccuccgccuccgaguacgcccaccgcggccucgacaagcucgaggagaaccuccccauccuccagcagcccaccgagaaggucuccggcgcccaggagauggucuccuccgccaaggacaccgucgccacccagcucuccgaggccgucgacgccacccgcggcgccguccaguccggcgucgacaagaccaaguccgucgucaccggcggcguccaguccgucaugggcucccgccucggccagaugguccucuccggcgucgacaccguccucggcaaguccgaggagugggccgacaaccaccucccccucaccgacgccgagcucgcccgcaucgccaccucccucgacggcuucgacgucgccuccguccagcagcagcgccaggagcaguccuacuucguccgccucggcucccucuccgagcgccuccgccagcacgccuacgagcacucccucggcaagcuccgcgccaccaagcagcgcgcccaggaggcccuccuccagcucucccagguccucucccucauggagaccgucaagcagggcgucgaccagaagcucgucgagggccaggagaagcuccaccagauguggcucuccuggaaccagaagcagcuccagggccccgagaaggagccccccaagcccgagcaggucgagucccgcgcccucaccauguuccgcgacaucgcccagcagcuccaggccaccugcaccucccucggcuccuccauccagggccuccccaccaacgucaaggaccagguccagcaggcccgccgccaggucgaggaccuccaggccaccuucuccuccauccacuccuuccaggaccucuccuccuccauccucgcccagucccgcgagcgcgucgccuccgcccgcgaggcccucgaccacauggucgaguacgucgcccagaacacccccgucaccuggcucgucggccccuucgcccccggcaucaccgagaaggcccccgaggagaagaaguga

SEQ ID NO: 47788 - RNA, 4074 nt, Artificial Sequence
  derived and/or modified sequence opt2 from PLIN4__Homo_sapiens__NP_001073869
augcagacccucggcuccuucuucggcucccuccccggcuucuccuccgcccgcaaccucgucgccaacgcccacuccuccgcccgcgcccgccccgccgccgaccccaccggcgcccccgccgccgaggccgcccagccccaggcccaggucgccgcccaccccgagcagaccgcccccuggaccgagaaggagcuccagcccuccgagaagcagauggucuccggcgccaaggaccucgucugcuccaagaugucccgcgccaaggacgccgucuccuccggcgucgccuccgucgucgacgucgccaagggcgucguccagggcggccucgacaccacccgcuccgcccucaccggcaccaaggaggucgucuccuccggcgucaccggcgccauggacauggccaagggcgccguccagggcggccucgacaccuccaaggccguccucaccggcaccaaggacaccgucuccaccggccucaccggcgccgucaacgucgccaagggcaccguccaggccggcgucgacaccaccaagaccguccucaccggcaccaaggacaccgucaccaccggcgucaugggcgccgucaaccucgccaagggcaccguccagaccggcgucgagaccuccaaggccguccucaccggcaccaaggacgccgucuccaccggccucaccggcgccgucaacgucgcccgcggcuccauccagaccggcgucgacaccuccaagaccguccucaccggcaccaaggacaccgucugcuccggcgucaccggcgccaugaacgucgccaagggcaccauccagaccggcgucgacaccuccaagaccguccucaccggcaccaaggacaccgucugcuccggcgucaccggcgccaugaacgucgccaagggcaccauccagaccggcgucgacaccuccaagaccguccucaccggcaccaaggacaccgucugcuccggcgucaccggcgccaugaacgucgccaagggcaccauccagaccggcgucgacaccaccaagaccguccucaccggcaccaagaacaccgucugcuccggcgucaccggcgccgucaaccucgccaaggaggccauccagggcggccucgacaccaccaaguccauggucaugggcaccaaggacaccauguccaccggccucaccggcgccgccaacgucgccaagggcgccaugcagaccggccucaacaccacccagaacaucgccaccggcaccaaggacaccgucugcuccggcgucaccggcgccaugaaccucgcccgcggcaccauccagaccggcgucgacaccaccaagaucguccucaccggcaccaaggacaccgucugcuccggcgucaccggcgccgccaacgucgccaagggcgccguccagggcggccucgacaccaccaaguccguccucaccggcaccaaggacgccgucuccaccggccucaccggcgccgucaacgucgccaagggcaccguccagaccggcgucgacaccaccaagaccguccucaccggcaccaaggacaccgucugcuccggcgucaccuccgccgucaacgucgccaagggcgccguccagggcggccucgacaccaccaaguccgucgucaucggcaccaaggacaccauguccaccggccucaccggcgccgccaacgucgccaagggcgccguccagaccggcgucgacaccgccaagaccguccucaccggcaccaaggacaccgucaccaccggccucgucggcgccgucaacgucgccaagggcaccguccagaccggcauggacaccaccaagaccguccucaccggcaccaaggacaccaucuacuccggcgucaccuccgccgucaacgucgccaagggcgccguccagaccggccucaagaccacccagaacaucgccaccggcaccaagaacaccuucggcuccggcgucaccuccgccgucaacgucgccaagggcgccgcccagaccggcgucgacaccgccaagaccguccucaccggcaccaaggacaccgucaccaccggccucaugggcgccgucaacgucgccaagggcaccguccagaccuccgucgacaccaccaagaccguccucaccggcaccaaggacaccgucugcuccggcgucaccggcgccgccaacgucgccaagggcgccauccagggcggccucgacaccaccaaguccguccucaccggcaccaaggacgccgucuccaccggccucaccggcgccgucaagcucgccaagggcaccguccagaccggcauggacaccaccaagaccguccucaccggcaccaaggacgccgucugcuccggcgucaccggcgccgccaacgucgccaagggcgccguccagaugggcgucgacaccgccaagaccguccucaccggcaccaaggacaccgucugcuccggcgucaccggcgccgccaacgucgccaagggcgccguccagaccggccucaagaccacccagaacaucgccaccggcaccaagaacacccucggcuccggcgucaccggcgccgccaaggucgccaagggcgccguccagggcggccucgacaccaccaaguccguccucaccggcaccaaggacgccgucuccaccggccucaccggcgccgucaaccucgccaagggcaccguccagaccggcgucgacaccuccaagaccguccucaccggcaccaaggacaccgucugcuccggcgucaccggcgccgucaacgucgccaagggcaccguccagaccggcgucgacaccgccaagaccguccucuccggcgccaaggacgccgucaccaccggcgucaccggcgccgucaacgucgccaagggcaccguccagaccggcgucgacgccuccaaggccguccucaugggcaccaaggacaccgucuucuccggcgucaccggcgccauguccauggccaagggcgccguccagggcggccucgacaccaccaagaccguccucaccggcaccaaggacgccgucuccgccggccucaugggcuccggcaacgucgccaccggcgccacccacaccggccucuccaccuuccagaacuggcuccccuccacccccgccaccuccuggggcggccucaccuccucccgcaccaccgacaacggcggcgagcagaccgcccucuccccccaggaggcccccuucuccggcaucuccaccccccccgacguccucuccgucggccccgagcccgccugggaggccgccgccaccaccaagggccucgccaccgacgucgccaccuucacccagggcgccgcccccggccgcgaggacaccggccuccucgccaccacccacggccccgaggaggccccccgccucgccaugcuccagaacgagcucgagggccucggcgacaucuuccaccccaugaacgccgaggagcaggcccagcucgccgccucccagcccggccccaagguccucuccgccgagcagggcuccuacuucguccgccucggcgaccucggccccuccuuccgccagcgcgccuucgagcacgccgucucccaccuccagcacggccaguuccaggcccgcgacacccucgcccagcuccaggacugcuuccgccucaucgagaaggcccagcaggcccccgagggccagccccgccucgaccagggcuccggcgccuccgccgaggacgccgccguccaggaggagcgcgacgccggcguccucucccgcgucugcggccuccuccgccagcuccacaccgccuacuccggccucgucuccucccuccagggccuccccgccgagcuccagcagcccgucggccgcgcccgccacucccucugcgagcucuacggcaucgucgccuccgccggcuccgucgaggagcuccccgccgagcgccucguccagucccgcgagggcguccaccaggccuggcagggccucgagcagcuccucgagggccuccagcacaaccccccccucuccuggcucgucggccccuucgcccuccccgccggcggccaguga

SEQ ID NO: 47789 - RNA, 1392 nt, Artificial Sequence
  derived and/or modified sequence opt2 from PLIN5__Homo_sapiens__NP_001013728
auguccgaggaggaggccgcccagaucccccgcuccuccgucugggagcaggaccagcagaacgucguccagcgcgucgucgcccucccccucguccgcgccaccugcaccgccgucugcgacgucuacuccgccgccaaggaccgccacccccuccucggcuccgccugccgccucgccgagaacugcgucugcggccucaccacccgcgcccucgaccacgcccagccccuccucgagcaccuccagccccagcucgccaccaugaacucccucgccugccgcggccucgacaagcucgaggagaagcuccccuuccuccagcagcccuccgagaccgucgucaccuccgccaaggacgucgucgccuccuccgucaccggcgucgucgaccucgcccgccgcggccgccgcugguccgucgagcucaagcgcuccgucucccacgccgucgacgucguccucgagaaguccgaggagcucgucgaccacuuccuccccaugaccgaggaggagcucgccgcccucgccgccgaggccgagggccccgaggucggcuccgucgaggaccagcgccgccagcagggcuacuucguccgccucggcucccucuccgcccgcauccgccaccucgccuacgagcacuccgucggcaagcuccgccaguccaagcaccgcgcccaggacacccucgcccagcuccaggagacccucgagcucaucgaccacaugcagugcggcgucacccccaccgcccccgccugccccggcaagguccacgagcucuggggcgaguggggccagcgcccccccgagucccgccgccgcucccaggccgagcucgagacccucguccucucccgcucccucacccaggagcuccagggcaccgucgaggcccucgaguccuccguccgcggccuccccgccggcgcccaggagaaggucgccgagguccgccgcuccgucgacgcccuccagaccgccuucgccgacgcccgcugcuuccgcgacguccccgccgccgcccucgccgagggccgcggccgcgucgcccacgcccacgccugcgucgacgagcuccucgagcucgucguccaggccgucccccuccccuggcucgucggccccuucgcccccauccucgucgagcgccccgagccccuccccgaccucgccgaccucgucgacgaggucaucggcggccccgacccccgcugggcccaccucgacuggcccgcccagcagcgcgccugggaggccgagcaccgcgacggcuccggcaacggcgacggcgaccgcaugggcgucgccggcgacaucugcgagcaggagcccgagacccccuccugccccgucaagcacacccucaugcccgagcucgacuucuga

SEQ ID NO: 47790 - RNA, 1812 nt, Artificial Sequence
  derived and/or modified sequence opt2 from PLK1__Homo_sapiens__NP_005021
auguccgccgccgucaccgccggcaagcucgcccgcgcccccgccgaccccggcaaggccggcguccccggcgucgccgcccccggcgcccccgccgccgccccccccgccaaggagauccccgagguccucgucgacccccgcucccgccgccgcuacguccgcggccgcuuccucggcaagggcggcuucgccaagugcuucgagaucuccgacgccgacaccaaggaggucuucgccggcaagaucguccccaagucccuccuccucaagccccaccagcgcgagaagauguccauggagaucuccauccaccgcucccucgcccaccagcacgucgucggcuuccacggcuucuucgaggacaacgacuucgucuucgucguccucgagcucugccgccgccgcucccuccucgagcuccacaagcgccgcaaggcccucaccgagcccgaggcccgcuacuaccuccgccagaucguccucggcugccaguaccuccaccgcaaccgcgucauccaccgcgaccucaagcucggcaaccucuuccucaacgaggaccucgaggucaagaucggcgacuucggccucgccaccaaggucgaguacgacggcgagcgcaagaagacccucugcggcacccccaacuacaucgcccccgagguccucuccaagaagggccacuccuucgaggucgacgucugguccaucggcugcaucauguacacccuccucgucggcaagccccccuucgagaccuccugccucaaggagaccuaccuccgcaucaagaagaacgaguacuccauccccaagcacaucaaccccgucgccgccucccucauccagaagaugcuccagaccgaccccaccgcccgccccaccaucaacgagcuccucaacgacgaguucuucaccuccggcuacauccccgcccgccuccccaucaccugccucaccauccccccccgcuucuccaucgcccccuccucccucgaccccuccaaccgcaagccccucaccguccucaacaagggccucgagaacccccuccccgagcgcccccgcgagaaggaggagcccgucguccgcgagaccggcgaggucgucgacugccaccucuccgacaugcuccagcagcuccacuccgucaacgccuccaagcccuccgagcgcggccucguccgccaggaggaggccgaggaccccgccugcauccccaucuucugggucuccaagugggucgacuacuccgacaaguacggccucggcuaccagcucugcgacaacuccgucggcguccucuucaacgacuccacccgccucauccucuacaacgacggcgacucccuccaguacaucgagcgcgacggcaccgaguccuaccucaccgucuccucccaccccaacucccucaugaagaagaucacccuccucaaguacuuccgcaacuacauguccgagcaccuccucaaggccggcgccaacaucaccccccgcgagggcgacgagcucgcccgccuccccuaccuccgcaccugguuccgcacccgcuccgccaucauccuccaccucuccaacggcuccguccagaucaacuucuuccaggaccacaccaagcucauccucugcccccucauggccgccgucaccuacaucgacgagaagcgcgacuuccgcaccuaccgccucucccuccucgaggaguacggcugcugcaaggagcucgccucccgccuccgcuacgcccgcaccauggucgacaagcuccucuccucccgcuccgccuccaaccgccucaaggccuccuga

SEQ ID NO: 47791 - RNA, 2016 nt, Artificial Sequence
  derived and/or modified sequence opt2 from PLK2__Homo_sapiens__NP_001239155
auggagcuccuccgcaccaucaccuaccagcccgccgccuccaccaagaugugcgagcaggcccucggcaagggcugcggcgccgacuccaagaagaagcgccccccccagccccccgaggagucccagcccccccagucccaggcccaggucccccccgccaucucccgcaucaucgucgaccccaccaccggcaagcgcuacugccgcggcaagguccucggcaagggcggcuucgccaagugcuacgagaugaccgaccucaccaacaacaaggucuacgccgccaagaucaucccccacucccgcgucgccaagccccaccagcgcgagaagaucgacaaggagaucgagcuccaccgcauccuccaccacaagcacgucguccaguucuaccacuacuucgaggacaaggagaacaucuacauccuccucgaguacugcucccgccgcuccauggcccacauccucaaggcccgcaagguccucaccgagcccgagguccgcuacuaccuccgccagaucgucuccggccucaaguaccuccacgagcaggagauccuccaccgcgaccucaagcucggcaacuucuucaucaacgaggccauggagcucaaggucggcgacuucggccucgccgcccgccucgagccccucgagcaccgccgccgcaccaucugcggcacccccaacuaccucucccccgagguccucaacaagcagggccacggcugcgaguccgacaucugggcccucggcugcgucauguacaccaugcuccucggccgcccccccuucgagaccaccaaccucaaggagaccuaccgcugcauccgcgaggcccgcuacaccaugcccuccucccuccucgcccccgccaagcaccucaucgccuccaugcucuccaagaaccccgaggaccgccccucccucgacgacaucauccgccacgacuucuuccuccagggcuucacccccgaccgccucuccuccuccugcugccacaccguccccgacuuccaccucuccucccccgccaagaacuucuucaagaaggccgccgccgcccucuucggcggcaagaaggacaaggcccgcuacaucgacacccacaaccgcgucuccaaggaggacgaggacaucuacaagcuccgccacgaccucaagaagaccuccaucacccagcagcccuccaagcaccgcaccgacgaggagcuccagccccccaccaccaccgucgcccgcuccggcacccccgccgucgagaacaagcagcagaucggcgacgccauccgcaugaucguccgcggcacccucggcuccugcuccuccuccuccgagugccucgaggacuccaccaugggcuccgucgccgacaccgucgcccgcguccuccgcggcugccucgagaacaugcccgaggccgacugcauccccaaggagcagcucuccaccuccuuccagugggucaccaagugggucgacuacuccaacaaguacggcuucggcuaccagcucuccgaccacaccgucggcguccucuucaacaacggcgcccacaugucccuccuccccgacaagaagaccguccacuacuacgccgagcucggccagugcuccgucuuccccgccaccgacgcccccgagcaguucaucucccaggucaccguccucaaguacuucucccacuacauggaggagaaccucauggacggcggcgaccuccccuccgucaccgacauccgccgcccccgccucuaccuccuccaguggcucaaguccgacaaggcccucaugaugcucuucaacgacggcaccuuccaggucaacuucuaccacgaccacaccaagaucaucaucugcucccagaacgaggaguaccuccucaccuacaucaacgaggaccgcaucuccaccaccuuccgccucaccacccuccucauguccggcugcuccuccgagcucaagaaccgcauggaguacgcccucaacaugcuccuccagcgcugcaacuga

SEQ ID NO: 47792 - RNA, 2817 nt, Artificial Sequence
  derived and/or modified sequence opt2 from PLK4__Homo_sapiens__NP_001177728
auggccaccugcaucggcgagaagaucgaggacuucaaggucggcaaccuccucggcaagggcuccuucgccggcgucuaccgcgccgaguccauccacaccggccucgaggucgccaucaagaugcucuacaacuacuucgaggacuccaacuacgucuaccucguccucgagaugugccacaacggcgagaugaaccgcuaccucaagaaccgcgucaagcccuucuccgagaacgaggcccgccacuucaugcaccagaucaucaccggcaugcucuaccuccacucccacggcauccuccaccgcgaccucacccucuccaaccuccuccucacccgcaacaugaacaucaagaucgccgacuucggccucgccacccagcucaagaugccccacgagaagcacuacacccucugcggcacccccaacuacaucucccccgagaucgccacccgcuccgcccacggccucgaguccgacgucuggucccucggcugcauguucuacacccuccucaucggccgcccccccuucgacaccgacaccgucaagaacacccucaacaaggucguccucgccgacuacgagaugcccuccuuccucuccaucgaggccaaggaccucauccaccagcuccuccgccgcaaccccgccgaccgccucucccucuccuccguccucgaccaccccuucaugucccgcaacuccuccaccaaguccaaggaccucggcaccgucgaggacuccaucgacuccggccacgccaccaucuccaccgccaucaccgccuccuccuccaccuccaucuccggcucccucuucgacaagcgccgccuccucaucggccagccccuccccaacaagaugaccgucuuccccaagaacaaguccuccaccgacuucuccuccuccggcgacggcaacuccuucuacacccaguggggcaaccaggagaccuccaacuccggccgcggccgcgucauccaggacgccgaggagcgcccccacucccgcuaccuccgccgcgccuacuccuccgaccgcuccggcaccuccaacucccagucccaggccaagaccuacaccauggagcgcugccacuccgccgagaugcucuccgucuccaagcgcuccggcggcggcgagaacgaggagcgcuacucccccaccgacaacaacgccaacaucuucaacuucuucaaggagaagaccuccuccuccuccggcuccuucgagcgccccgacaacaaccaggcccucuccaaccaccucugccccggcaagacccccuuccccuucgccgaccccaccccccagaccgagaccguccagcagugguucggcaaccuccagaucaacgcccaccuccgcaagaccaccgaguacgacuccaucucccccaaccgcgacuuccagggccaccccgaccuccagaaggacaccuccaagaacgccuggaccgacaccaaggucaagaagaacuccgacgccuccgacaacgcccacuccgucaagcagcagaacaccaugaaguacaugaccgcccuccacuccaagcccgagaucauccagcaggagugcgucuucggcuccgacccccucuccgagcaguccaagacccgcggcauggagccccccuggggcuaccagaaccgcacccuccgcuccaucaccuccccccucgucgcccaccgccucaagcccauccgccagaagaccaagaaggccgucgucuccauccucgacuccgaggaggucugcgucgagcucgucaaggaguacgccucccaggaguacgucaaggagguccuccagaucuccuccgacggcaacaccaucaccaucuacuaccccaacggcggccgcggcuucccccucgccgaccgcccccccucccccaccgacaacaucucccgcuacuccuucgacaaccuccccgagaaguacuggcgcaaguaccaguacgccucccgcuucguccagcucguccgcuccaagucccccaagaucaccuacuucacccgcuacgccaagugcauccucauggagaacucccccggcgccgacuucgaggucugguucuacgacggcgucaagauccacaagaccgaggacuucauccaggucaucgagaagaccggcaaguccuacacccucaaguccgaguccgaggucaacucccucaaggaggagaucaagauguacauggaccacgccaacgagggccaccgcaucugccucgcccucgaguccaucaucuccgaggaggagcgcaagacccgcuccgcccccuucuuccccaucaucaucggccgcaagcccggcuccaccuccucccccaaggcccucucccccccccccuccgucgacuccaacuaccccacccgcgagcgcgccuccuucaaccgcauggucaugcacuccgccgccucccccacccaggcccccauccucaaccccuccauggucaccaacgagggccucggccucaccaccaccgccuccggcaccgacaucuccuccaacucccucaaggacugccuccccaaguccgcccagcuccucaaguccgucuucgucaagaacgucggcugggccacccagcucaccuccggcgccgucuggguccaguucaacgacggcucccagcucgucguccaggccggcgucuccuccaucuccuacaccucccccaacggccagaccacccgcuacggcgagaacgagaagcuccccgacuacaucaagcagaagcuccagugccucuccuccauccuccucauguucuccaaccccacccccaacuuccacuga

SEQ ID NO: 47793 - RNA, 1011 nt, Artificial Sequence
  derived and/or modified sequence opt2 from PLK5__Homo_sapiens__NP_001230008
auguacaccguccucaccggcaccccccccuucauggccuccccccucuccgagauguaccagaacauccgcgagggccacuaccccgagcccgcccaccucuccgccaacgcccgccgccucaucguccaccuccucgcccccaaccccgccgagcgccccucccucgaccaccuccuccaggacgacuucuucacccagggcuucacccccgaccgccuccccgcccacuccugccacuccccccccaucuucgccaucccccccccccucggccgcaucuuccgcaaggucggccagcgccuccucacccagugccgcccccccugccccuucacccccaaggaggccuccggccccggcgagggcggccccgaccccgacuccauggagugggacggcgaguccucccucuccgccaaggagguccccugccucgagggccccauccaccucgucgcccagggcacccuccaguccgaccucgccggccccgagggcucccgccgccccgaggucgaggccgcccuccgccaccuccagcucugccucgacgucggcccccccgccacccaggacccccucggcgagcagcagcccauccucugggcccccaagugggucgacuacuccuccaaguacggcuucggcuaccagcuccucgacggcggccgcaccggccgccacccccacggccccgccaccccccgccgcgagggcacccuccccacccccgucccccccgccggccccggccucugccuccuccgcuuccucgccuccgagcacgcccuccuccuccucuucuccaacggcaugguccaggucuccuucuccggcguccccgcccagcucguccucuccggcgagggcgagggccuccagcucacccucugggagcagggcucccccggcaccuccuacucccucgacgucccccgcucccacggcugcgcccccaccaccggccagcaccuccaccacgcccuccgcaugcuccaguccaucuga

SEQ ID NO: 47794 - RNA, 549 nt, Artificial Sequence
  derived and/or modified sequence opt2 from PLLP__Homo_sapiens__NP_057077
auggccgaguuccccuccaaggucuccacccgcaccuccucccccgcccagggcgccgaggccuccgucuccgcccuccgccccgaccucggcuucguccgcucccgccucggcgcccucaugcuccuccagcucguccucggccuccucgucugggcccucaucgccgacacccccuaccaccucuaccccgccuacggcugggucauguucgucgccgucuuccucuggcucgucaccaucguccucuucaaccucuaccucuuccagcuccacaugaagcucuacaugguccccuggccccucguccucaugaucuucaacaucuccgccaccguccucuacaucaccgccuucaucgccugcuccgccgccgucgaccucaccucccuccgcggcacccgccccuacaaccagcgcgccgccgccuccuucuucgccugccucgucaugaucgccuacggcgucuccgccuucuucuccuaccaggccuggcgcggcgucggcuccaacgccgccaccucccagauggccggcggcuacgccuga

SEQ ID NO: 47795 - RNA, 159 nt, Artificial Sequence
  derived and/or modified sequence opt2 from PLN__Homo_sapiens__NP_002658
auggagaagguccaguaccucacccgcuccgccauccgccgcgccuccaccaucgagaugccccagcaggcccgccagaagcuccagaaccucuucaucaacuucugccucauccucaucugccuccuccucaucugcaucaucgucaugcuccucuga

SEQ ID NO: 47796 - RNA, 2214 nt, Artificial Sequence
  derived and/or modified sequence opt2 from PLOD2__Homo_sapiens__NP_000926
augggcggcugcaccgucaagccccagcuccuccuccucgcccucguccuccaccccuggaaccccugccucggcgccgacuccgagaagcccuccuccauccccaccgacaagcuccucgucaucaccgucgccaccaaggaguccgacggcuuccaccgcuucaugcaguccgccaaguacuucaacuacaccgucaagguccucggccagggcgaggaguggcgcggcggcgacggcaucaacuccaucggcggcggccagaagguccgccucaugaaggaggucauggagcacuacgccgaccaggacgaccucgucgucauguucaccgagugcuucgacgucaucuucgccggcggccccgaggagguccucaagaaguuccagaaggccaaccacaaggucgucuucgccgccgacggcauccucuggcccgacaagcgccucgccgacaaguaccccgucguccacaucggcaagcgcuaccucaacuccggcggcuucaucggcuacgcccccuacgucaaccgcaucguccagcaguggaaccuccaggacaacgacgacgaccagcucuucuacaccaaggucuacaucgacccccucaagcgcgaggccaucaacaucacccucgaccacaagugcaagaucuuccagacccucaacggcgccgucgacgaggucguccucaaguucgagaacggcaaggcccgcgccaagaacaccuucuacgagacccuccccgucgccaucaacggcaacggccccaccaagauccuccucaacuacuucggcaacuacguccccaacuccuggacccaggacaacggcugcacccucugcgaguucgacaccgucgaccucuccgccgucgacguccaccccaacgucuccaucggcgucuucaucgagcagcccacccccuuccucccccgcuuccucgacauccuccucacccucgacuaccccaaggaggcccucaagcucuucauccacaacaaggaggucuaccacgagaaggacaucaaggucuucuucgacaaggccaagcacgagaucaagaccaucaagaucgucggccccgaggagaaccucucccaggccgaggcccgcaacaugggcauggacuucugccgccaggacgagaagugcgacuacuacuucuccgucgacgccgacgucguccucaccaacccccgcacccucaagauccucaucgagcagaaccgcaagaucaucgccccccucgucacccgccacggcaagcucugguccaacuucuggggcgcccucucccccgacggcuacuacgcccgcuccgaggacuacgucgacaucguccagggcaaccgcgucggcgucuggaacguccccuacauggccaacgucuaccucaucaagggcaagacccuccgcuccgagaugaacgagcgcaacuacuucguccgcgacaagcucgaccccgacauggcccucugccgcaacgcccgcgagaugggcgucuucauguacaucuccaaccgccacgaguucggccgccuccucuccaccgccaacuacaacaccucccacuacaacaacgaccucuggcagaucuucgagaaccccgucgacuggaaggagaaguacaucaaccgcgacuacuccaagaucuucaccgagaacaucgucgagcagcccugccccgacgucuucugguuccccaucuucuccgagaaggccugcgacgagcucgucgaggagauggagcacuacggcaagugguccggcggcaagcaccacgacucccgcaucuccggcggcuacgagaacguccccaccgacgacauccacaugaagcaggucgaccucgagaacgucuggcuccacuucauccgcgaguucaucgcccccgucacccucaaggucuucgccggcuacuacaccaagggcuucgcccuccucaacuucgucgucaaguacucccccgagcgccagcgcucccuccgcccccaccacgacgccuccaccuucaccaucaacaucgcccucaacaacgucggcgaggacuuccagggcggcggcugcaaguuccuccgcuacaacugcuccaucgaguccccccgcaagggcugguccuucaugcaccccggccgccucacccaccuccacgagggccuccccgucaagaacggcacccgcuacaucgccgucuccuucaucgaccccuga

SEQ ID NO: 47797 - RNA, 834 nt, Artificial Sequence
  derived and/or modified sequence opt2 from PLP1__Homo_sapiens__NP_000524
augggccuccucgagugcugcgcccgcugccucgucggcgcccccuucgccucccucgucgccaccggccucugcuucuucggcgucgcccucuucugcggcugcggccacgaggcccucaccggcaccgagaagcucaucgagaccuacuucuccaagaacuaccaggacuacgaguaccucaucaacgucauccacgccuuccaguacgucaucuacggcaccgccuccuucuucuuccucuacggcgcccuccuccucgccgagggcuucuacaccaccggcgccguccgccagaucuucggcgacuacaagaccaccaucugcggcaagggccucuccgccaccgucaccggcggccagaagggccgcggcucccgcggccagcaccaggcccacucccucgagcgcgucugccacugccucggcaaguggcucggccaccccgacaaguucgucggcaucaccuacgcccucaccgucgucuggcuccucgucuucgccugcuccgccguccccgucuacaucuacuucaacaccuggaccaccugccaguccaucgccuuccccuccaagaccuccgccuccaucggcucccucugcgccgacgcccgcauguacggcguccuccccuggaacgccuuccccggcaaggucugcggcuccaaccuccucuccaucugcaagaccgccgaguuccagaugaccuuccaccucuucaucgccgccuucgucggcgccgccgccacccucgucucccuccucaccuucaugaucgccgccaccuacaacuucgccguccucaagcucaugggccgcggcaccaaguucuga

SEQ ID NO: 47798 - RNA, 459 nt, Artificial Sequence
  derived and/or modified sequence opt2 from PLP2__Homo_sapiens__NP_002659
auggccgacuccgagcgccucuccgcccccggcugcugggccgccugcaccaacuucucccgcacccgcaagggcauccuccucuucgccgagaucauccucugccucgucauccucaucugcuucuccgccuccacccccggcuacuccucccucuccgucaucgagaugauccucgccgccaucuucuucgucgucuacaugugcgaccuccacaccaagauccccuucaucaacuggcccugguccgacuucuuccgcacccucaucgccgccauccucuaccucaucaccuccaucgucguccucgucgagcgcggcaaccacuccaagaucgucgccggcguccucggccucaucgccaccugccucuucggcuacgacgccuacgucaccuuccccguccgccagccccgccacaccgccgcccccaccgaccccgccgacggccccgucuga

SEQ ID NO: 47799 - RNA, 1518 nt, Artificial Sequence
  derived and/or modified sequence opt2 from PLRG1__Homo_sapiens__NP_001188493
auggucgaggagguccagaagcacuccguccacacccucgucuuccgcucccucaagcgcacccacgacauguucgucgccgacaacggcaagcccgucccccucgacgaggagucccacaagcgcaagauggccaucaagcuccgcaacgaguacggccccguccuccacaugcccaccuccaaggagaaccucaaggagaagggcccccagaacgccaccgacuccuacguccacaagcaguaccccgccaaccagggccaggaggucgaguacuucgucgccggcgucgcccucaccgccgacaccaagauccagcgcaugcccuccgaguccgccgcccagucccucgccgucgcccucccccuccagaccaaggccgacgccaaccgcaccgcccccuccggcuccgaguaccgccaccccggcgccuccgaccgcccccagcccaccgccaugaacuccaucgucauggagaccggcaacaccaagaacuccgcccucauggccaagaaggcccccaccaugcccaagccccaguggcacccccccuggaagcucuaccgcgucaucuccggccaccucggcuggguccgcugcaucgccgucgagcccggcaaccagugguucgucaccggcuccgccgaccgcaccaucaagaucugggaccucgccuccggcaagcucaagcucucccucaccggccacaucuccaccguccgcggcgucaucgucuccacccgcucccccuaccucuucuccugcggcgaggacaagcaggucaagugcugggaccucgaguacaacaaggucauccgccacuaccacggccaccucuccgccgucuacggccucgaccuccaccccaccaucgacguccucgucaccugcucccgcgacuccaccgcccgcaucugggacguccgcaccaaggccuccguccacacccucuccggccacaccaacgccgucgccaccguccgcugccaggccgccgagccccagaucaucaccggcucccacgacaccaccauccgccucugggaccucgucgccggcaagacccgcgucacccucaccaaccacaagaaguccguccgcgccgucguccuccacccccgccacuacaccuucgccuccggcucccccgacaacaucaagcaguggaaguuccccgacggcuccuucauccagaaccucuccggccacaacgccaucaucaacacccucaccgucaacuccgacggcguccucgucuccggcgccgacaacggcaccaugcaccucugggacuggcgcaccggcuacaacuuccagcgcguccacgccgccguccagcccggcucccucgacuccgaguccggcaucuucgccugcgccuucgaccaguccgagucccgccuccucaccgccgaggccgacaagaccaucaaggucuaccgcgaggacgacaccgccaccgaggagacccaccccgucuccuggaagcccgagaucaucaagcgcaagcgcuucuga

SEQ ID NO: 47800 - RNA, 1890 nt, Artificial Sequence
  derived and/or modified sequence opt2 from PLS1__Homo_sapiens__NP_001138791
auggagaacuccaccaccaccaucucccgcgaggagcucgaggagcuccaggaggccuucaacaagaucgacaucgacaacuccggcuacgucuccgacuacgagcuccaggaccucuucaaggaggccucccucccccuccccggcuacaagguccgcgagaucgucgagaagauccucuccgucgccgacuccaacaaggacggcaagaucuccuucgaggaguucgucucccucaugcaggagcucaaguccaaggacaucuccaagaccuuccgcaagaucaucaacaagcgcgagggcaucaccgccaucggcggcaccuccaccaucuccuccgagggcacccagcacuccuacuccgaggaggagaaggucgccuucgucaacuggaucaacaaggcccucgagaacgaccccgacugcaagcaccucauccccaugaaccccaacgacgacucccucuucaagucccucgccgacggcauccuccucugcaagaugaucaaccucuccgagcccgacaccaucgacgagcgcgccaucaacaagaagaagcucacccccuucaccaucuccgagaaccucaaccucgcccucaacuccgccuccgccaucggcugcaccgucgucaacaucggcgccuccgaccucaaggagggcaagccccaccucguccucggccuccucuggcagaucaucaaggucggccucuucgccgacaucgagaucucccgcaacgaggcccucaucgcccuccucaacgagggcgaggagcucgaggagcucaugaagcucucccccgaggagcuccuccuccgcugggucaacuaccaccucaccaacgccggcuggcacaccaucuccaacuucucccaggacaucaaggacucccgcgccuacuuccaccuccucaaccagaucgcccccaagggcggcgaggacggccccgccaucgccaucgaccucuccggcaucaacgagaccaacgaccucaagcgcgccggccucaugcuccaggaggccgacaagcucggcugcaagcaguucgucacccccgccgacgucgucuccggcaaccccaagcucaaccucgccuucgucgccaaccucuucaacaccuaccccugccuccacaagcccaacaacaacgacaucgacaugaaccuccucgagggcgaguccaaggaggagcgcaccuuccgcaacuggaugaacucccucggcgucaaccccuacaucaaccaccucuacuccgaccucgccgacgcccucgucaucuuccagcucuacgagaugauccgcguccccgucaacuggucccacgucaacaagccccccuaccccgcccucggcggcaacaugaagaagaucgagaacugcaacuacgccgucgagcucggcaagaacaaggccaaguucucccucgucggcaucgccggccaggaccucaacgagggcaacuccacccucacccucgcccucgucuggcagcucaugcgccgcuacacccucaacguccucuccgaccucggcgagggcgagaaggucaacgacgagaucaucaucaagugggucaaccagacccucaaguccgccaacaagaagaccuccaucuccuccuucaaggacaaguccaucuccaccucccuccccguccucgaccucaucgacgccaucgcccccaacgccguccgccaggagaugauccgccgcgagaaccucuccgacgaggacaagcucaacaacgccaaguacgccaucuccgucgcccgcaagaucggcgcccgcaucuacgcccuccccgacgaccucgucgaggucaagcccaagauggucaugaccgucuucgccugccucaugggcaagggccucaaccgcaucaaguga

SEQ ID NO: 47801 - RNA, 1854 nt, Artificial Sequence
  derived and/or modified sequence opt2 from PLS3__Homo_sapiens__NP_001269266
auggaggaccucaacuccaacggcuucaucugcgacuacgagcuccacgagcucuucaaggaggccaacaugccccuccccggcuacaagguccgcgagaucauccagaagcucaugcucgacggcgaccgcaacaaggacggcaagaucuccuucgacgaguucgucuacaucuuccaggaggucaaguccuccgacaucgccaagaccuuccgcaaggccaucaaccgcaaggagggcaucugcgcccucggcggcaccuccgagcucuccuccgagggcacccagcacuccuacuccgaggaggagaaguacgccuucgucaacuggaucaacaaggcccucgagaacgaccccgacugccgccacgucauccccaugaaccccaacaccgacgaccucuucaaggccgucggcgacggcaucguccucugcaagaugaucaaccucuccguccccgacaccaucgacgagcgcgccaucaacaagaagaagcucacccccuucaucauccaggagaaccucaaccucgcccucaacuccgccuccgccaucggcugccacgucgucaacaucggcgccgaggaccuccgcgccggcaagccccaccucguccucggccuccucuggcagaucaucaagaucggccucuucgccgacaucgagcucucccgcaacgaggcccucgccgcccuccuccgcgacggcgagacccucgaggagcucaugaagcucucccccgaggagcuccuccuccgcugggccaacuuccaccucgagaacuccggcuggcagaagaucaacaacuucuccgccgacaucaagcucaucgacuucuccaacuccgucaaggacuccaaggccuacuuccaccuccucaaccagaucgcccccaagggccagaaggagggcgagccccgcaucgacaucaacauguccggcuucaacgagaccgacgaccucaagcgcgccgaguccaugcuccagcaggccgacaagcucggcugccgccaguucgucacccccgccgacgucgucuccggcaaccccaagcucaaccucgccuucgucgccaaccucuucaacaaguaccccgcccucaccaagcccgagaaccaggacaucgacuggacccuccucgagggcgagacccgcgaggagcgcaccuuccgcaacuggaugaacucccucggcgucaacccccacgucaaccaccucuacgccgaccuccaggacgcccucgucauccuccagcucuacgagcgcaucaagguccccgucgacugguccaaggucaacaagccccccuaccccaagcucggcgccaacaugaagaagcucgagaacugcaacuacgccgucgagcucggcaagcaccccgccaaguucucccucgucggcaucggcggccaggaccucaacgacggcaaccagacccucacccucgcccucgucuggcagcucaugcgccgcuacacccucaacguccucgaggaccucggcgacggccagaaggccaacgacgacaucaucgucaacugggucaaccgcacccucuccgaggccggcaaguccaccuccauccaguccuucaaggacaagaccaucuccuccucccucgccgucgucgaccucaucgacgccauccagcccggcugcaucaacuacgaccucgucaaguccggcaaccucaccgaggacgacaagcacaacaacgccaaguacgccgucuccauggcccgccgcaucggcgcccgcgucuacgcccuccccgaggaccucgucgaggucaagcccaagauggucaugaccgucuucgccugccucaugggccgcggcaugaagcgcgucuga

SEQ ID NO: 47802 - RNA, 957 nt, Artificial Sequence
  derived and/or modified sequence opt2 from PLSCR1__Homo_sapiens__NP_066928
auggacaagcagaacucccagaugaacgccucccaccccgagaccaaccuccccgucggcuaccccccccaguacccccccaccgccuuccagggcccccccggcuacuccggcuaccccggcccccaggucuccuacccccccccccccgccggccacuccggccccggccccgccggcuuccccguccccaaccagcccgucuacaaccagcccgucuacaaccagcccgucggcgccgccggcguccccuggaugcccgccccccagcccccccucaacugcccccccggccucgaguaccucucccagaucgaccagauccucauccaccagcagaucgagcuccucgagguccucaccggcuucgagaccaacaacaaguacgagaucaagaacuccuucggccagcgcgucuacuucgccgccgaggacaccgacugcugcacccgcaacugcugcggccccucccgccccuucacccuccgcaucaucgacaacaugggccaggaggucaucacccucgagcgcccccuccgcugcuccuccugcugcugccccugcugccuccaggagaucgagauccaggccccccccggcguccccaucggcuacgucauccagaccuggcaccccugccuccccaaguucaccauccagaacgagaagcgcgaggacguccucaagaucuccggccccugcgucgucugcuccugcugcggcgacgucgacuucgagaucaagucccucgacgagcagugcgucgucggcaagaucuccaagcacuggaccggcauccuccgcgaggccuucaccgacgccgacaacuucggcauccaguucccccucgaccucgacgucaagaugaaggccgucaugaucggcgccugcuuccucaucgacuucauguucuucgaguccaccggcucccaggagcagaaguccggcgucugguga

SEQ ID NO: 47803 - RNA, 888 nt, Artificial Sequence
  derived and/or modified sequence opt2 from PLSCR3__Homo_sapiens__NP_065093
auggccggcuaccucccccccaagggcuacgcccccuccccccccccccccuaccccgucacccccggcuaccccgagcccgcccuccaccccggccccggccaggcccccguccccgcccagguccccgcccccgcccccggcuucgcccucuuccccucccccggccccgucgcccucggcuccgccgcccccuuccucccccuccccggcguccccuccggccucgaguuccucguccagaucgaccagauccucauccaccagaaggccgagcgcgucgagaccuuccucggcugggagaccugcaaccgcuacgagcuccgcuccggcgccggccagccccucggccaggccgccgaggaguccaacugcugcgcccgccucugcugcggcgcccgccgcccccuccgcguccgccucgccgaccccggcgaccgcgagguccuccgccuccuccgcccccuccacugcggcugcuccugcugccccugcggccuccaggagauggagguccaggccccccccggcaccaccaucggccacguccuccagaccuggcaccccuuccuccccaaguucuccauccaggacgccgaccgccagaccguccuccgcgucgucggccccugcuggaccugcggcugcggcaccgacaccaacuucgaggucaagacccgcgacgagucccgcuccgucggccgcaucuccaagcaguggggcggccucguccgcgaggcccucaccgacgccgacgacuucggccuccaguucccccucgaccucgacguccgcgucaaggccguccuccucggcgccaccuuccucaucgacuacauguucuucgagaagcgcggcggcgccggccccuccgccgucaccuccuga

SEQ ID NO: 47804 - RNA, 720 nt, Artificial Sequence
  derived and/or modified sequence opt2 from PLSCR4__Homo_sapiens__NP_001121778
auguccggcgucguccccaccgcccccgagcagcccgccggcgagauggagaaccagaccaagccccccgacccccgccccgacgccccccccgaguacaacucccacuuccuccccggcccccccggcaccgccguccccccccccaccggcuaccccggcggccuccccaugggcuacuacuccccccagcagcccuccaccuucccccucuaccagcccgucggcggcauccaccccguccgcuaccagcccggcaaguaccccaugcccaaccaguccguccccaucaccuggaugcccggccccacccccauggccaacugcccccccggccucgaguaccucguccagcucgagguccagugcccccccggcgucaccaucggcuucgucgccgagcacuggaaccucugccgcgccgucuacuccauccagaacgagaagaaggagaacgucaugcgcguccgcggccccugcuccaccuacggcugcggcuccgacuccgucuucgaggucaagucccucgacggcaucuccaacaucggcuccaucauccgcaaguggaacggccuccucuccgccauggccgacgccgaccacuucgacauccacuucccccucgaccucgacgucaagaugaaggccaugaucuucggcgccugcuuccucaucgacuucauguacuucgagcgcucccccccccagcgcucccgcuga

SEQ ID NO: 47805 - RNA, 816 nt, Artificial Sequence
  derived and/or modified sequence opt2 from PLSCR5__Homo_sapiens__NP_001078889
auggccuccaaggacgcccagaaccagcgccgcggccuccccggcuuccuccccggcgcccccgaccccgaccagucccuccccgccuccuccaaccccggcaaccaggccuggcagcucucccucccccuccccuccuccuuccuccccaccgucucccucccccccggccucgaguaccucucccagcucgaccucaucaucauccaccagcaggucgagcuccucggcaugauccucggcaccgagaccuccaacaaguacgagaucaagaacucccucggccagcgcaucuacuucgccgucgaggaguccaucugcuucaaccgcaccuucugcuccacccuccgcuccugcacccuccgcaucaccgacaacuccggccgcgaggucaucaccgucaaccgcccccuccgcugcaacuccugcuggugccccugcuaccuccaggagcucgagauccaggccccccccggcaccaucgucggcuacgucacccagaagugggaccccuuccuccccaaguucaccauccagaacgccaacaaggaggacauccucaagaucgucggccccugcgucaccugcggcugcuucggcgacgucgacuucgaggucaagaccaucaacgagaagcucaccaucggcaagaucuccaaguacugguccggcuucgucaacgacgucuucaccaacgccgacaacuucggcauccacguccccgccgaccucgacgucaccgucaaggccgccaugaucggcgccugcuuccucuucgacuucauguucuucgagcacucccucgccggccucuga

SEQ ID NO: 47806 - RNA, 1197 nt, Artificial Sequence
  derived and/or modified sequence opt2 from PLTP__Homo_sapiens__NP_001229849
auggcccucuucggcgcccucuuccucgcccuccucgccggcgcccacgccgaguuccccggcugcaagauccgcgucaccuccaaggcccucgagcucgucaagcaggagggccuccgcuuccucgagcaggagcucgagaccaucaccauccccgaccuccgcggcaaggagggccacuucuacuacaacaucuccgagaaggucuacgacuuccucuccaccuucaucaccuccggcaugcgcuuccuccucaaccagcagaucugccccguccucuaccacgccggcaccguccuccucaacucccuccucgacaccguccccguccgcuccuccgucgacgagcucgucggcaucgacuacucccucaugaaggaccccgucgccuccaccuccaaccucgacauggacuuccgcggcgccuucuucccccucaccgagcgcaacuggucccuccccaaccgcgccgucgagccccagcuccaggaggaggagcgcauggucuacgucgccuucuccgaguucuucuucgacuccgccauggaguccuacuuccgcgccggcgcccuccagcuccuccucgucggcgacaaggucccccacgaccucgacaugcuccuccgcgccaccuacuucggcuccaucguccuccucucccccgccgucaucgacuccccccucaagcucgagcuccgcguccucgcccccccccgcugcaccaucaagcccuccggcaccaccaucuccgucaccgccuccgucaccaucgcccucgucccccccgaccagcccgagguccagcucuccuccaugaccauggacgcccgccucuccgccaagauggcccuccgcggcaaggcccuccgcacccagcucgaccuccgccgcuuccgcaucuacuccaaccacuccgcccucgagucccucgcccucaucccccuccaggccccccucaagaccaugcuccagaucggcgucaugcccaugcucaacgagcgcaccuggcgcggcguccagaucccccuccccgagggcaucaacuucguccacgaggucgucaccaaccacgccggcuuccucaccaucggcgccgaccuccacuucgccaagggccuccgcgaggucaucgagaagaaccgccccgccgacguccgcgccuccaccgcccccacccccuccaccgccgccgucuga

SEQ ID NO: 47807 - RNA, 1329 nt, Artificial Sequence
  derived and/or modified sequence opt2 from PLVAP__Homo_sapiens__NP_112600
augggccucgccauggagcacggcggcuccuacgcccgcgccggcggcuccucccgcggcugcugguacuaccuccgcuacuucuuccucuucgucucccucauccaguuccucaucauccucggccucguccucuucauggucuacggcaacguccacgucuccaccgaguccaaccuccaggccaccgagcgccgcgccgagggccucuacucccagcuccucggccucaccgccucccaguccaaccucaccaaggagcucaacuucaccacccgcgccaaggacgccaucaugcagauguggcucaacgcccgccgcgaccucgaccgcaucaacgccuccuuccgccagugccagggcgaccgcgucaucuacaccaacaaccagcgcuacauggccgccaucauccucuccgagaagcagugccgcgaccaguucaaggacaugaacaaguccugcgacgcccuccucuucaugcucaaccagaaggucaagacccucgaggucgagaucgccaaggagaagaccaucugcaccaaggacaaggaguccguccuccucaacaagcgcgucgccgaggagcagcucgucgagugcgucaagacccgcgagcuccagcaccaggagcgccagcucgccaaggagcagcuccagaagguccaggcccucugccucccccucgacaaggacaaguucgagauggaccuccgcaaccucuggcgcgacuccaucaucccccgcucccucgacaaccucggcuacaaccucuaccacccccucggcuccgagcucgccuccauccgccgcgccugcgaccacaugcccucccucauguccuccaaggucgaggagcucgcccgcucccuccgcgccgacaucgagcgcgucgcccgcgagaacuccgaccuccagcgccagaagcucgaggcccagcagggccuccgcgccucccaggaggccaagcagaaggucgagaaggaggcccaggcccgcgaggccaagcuccaggccgagugcucccgccagacccagcucgcccucgaggagaaggccguccuccgcaaggagcgcgacaaccucgccaaggagcucgaggagaagaagcgcgaggccgagcagcuccgcauggagcucgccauccgcaacuccgcccucgacaccugcaucaagaccaagucccagcccaugaugcccgucucccgccccaugggccccguccccaacccccagcccaucgaccccgccucccucgaggaguucaagcgcaagauccucgagucccagcgcccccccgccggcauccccgucgcccccuccuccggcuga

SEQ ID NO: 47808 - RNA, 1503 nt, Artificial Sequence
  derived and/or modified sequence opt2 from PLXDC1__Homo_sapiens__NP_065138
augcgcggcgagcucuggcuccucguccucguccuccgcgaggccgcccgcgcccucuccccccagcccggcgccggccacgacgagggccccggcuccggcugggccgccaagggcaccguccgcggcuggaaccgccgcgcccgcgagucccccggccacgucuccgagcccgaccgcacccagcucucccaggaccucggcggcggcacccucgccauggacacccuccccgacaaccgcacccgcgucgucgaggacaaccacuccuacuacgucucccgccucuacggccccuccgagccccacucccgcgagcucugggucgacgucgccgaggccaaccgcucccaggucaagauccacaccauccucuccaacacccaccgccaggccucccgcgucguccucuccuucgacuuccccuucuacggccacccccuccgccagaucaccaucgccaccggcggcuucaucuucaugggcgacgucauccaccgcaugcucaccgccacccaguacgucgccccccucauggccaacuucaaccccggcuacuccgacaacuccaccgucgucuacuucgacaacggcaccgucuucgucguccagugggaccacgucuaccuccagggcugggaggacaagggcuccuucaccuuccaggccgcccuccaccacgacggccgcaucgucuucgccuacaaggagauccccauguccguccccgagaucuccuccucccagcaccccgucaagaccggccucuccgacgccuucaugauccucaaccccucccccgacguccccgagucccgccgccgcuccaucuucgaguaccaccgcaucgagcucgaccccuccaaggucaccuccauguccgccgucgaguucaccccccuccccaccugccuccagcaccgcuccugcgacgccugcauguccuccgaccucaccuucaacugcuccuggugccacguccuccagcgcugcuccuccggcuucgaccgcuaccgccaggaguggauggacuacggcugcgcccaggaggccgagggccgcaugugcgaggacuuccaggacgaggaccacgacuccgccucccccgacaccuccuucucccccuacgacggcgaccucaccaccaccuccuccucccucuucaucgacucccucaccaccgaggacgacaccaagcucaaccccuacgccggcggcgacggccuccagaacaaccucucccccaagaccaagggcacccccguccaccucggcaccaucgucggcaucguccucgccguccuccucgucgccgccaucauccucgccggcaucuacaucaacggccaccccaccuccaacgccgcccucuucuucaucgagcgccgcccccaccacuggcccgccaugaaguuccgcucccaccccgaccacuccaccuacgccgaggucgagcccuccggccacgagaaggagggcuucauggaggccgagcagugcuga

SEQ ID NO: 47809 - RNA, 1443 nt, Artificial Sequence
  derived and/or modified sequence opt2 from PLXDC2__Homo_sapiens__NP_001269665
auggcccgcuuccccaaggccgaccucgccgccgccggcgucaugcuccucugccacuucuucaccgaccaguuccaguucgccgacggcaagcccggcgaccagauccucgacuggcaguacggcgucacccaggccuucccccacaccgaggaggaggucgaggucgacucccacgccuacucccaccgcuggaagcgcaaccucgacuuccucaaggccgucgacaccaaccgcgccuccgucggccaggacucccccgagccccgcuccuucaccgaccuccuccucgacgacggccaggacaacaacacccagaucgagcgcgucaaccucuccuucgacuuccccuucuacggccacuuccuccgcgagaucaccgucgccaccggcggcuucaucuacaccggcgaggucguccaccgcaugcucaccgccacccaguacaucgccccccucauggccaacuucgaccccuccgucucccgcaacuccaccguccgcuacuucgacaacggcaccgcccucgucguccagugggaccacguccaccuccaggacaacuacaaccucggcuccuucaccuuccaggccacccuccucauggacggccgcaucaucuucggcuacaaggagauccccguccucgucacccagaucuccuccaccaaccaccccgucaaggucggccucuccgacgccuucgucgucguccaccgcauccagcagauccccaacguccgccgccgcaccaucuacgaguaccaccgcgucgagcuccagauguccaagaucaccaacaucuccgccgucgagaugaccccccuccccaccugccuccaguucaaccgcugcggccccugcgucuccucccagaucggcuucaacugcuccuggugcuccaagcuccagcgcugcuccuccggcuucgaccgccaccgccaggacugggucgacuccggcugccccgaggaguccaaggagaagaugugcgagaacaccgagcccgucgagaccuccucccgcaccaccaccaccgucggcgccaccaccacccaguuccgcguccucaccaccacccgccgcgccgucaccucccaguuccccaccucccuccccaccgaggacgacaccaagaucgcccuccaccucaaggacaacggcgccuccaccgacgacuccgccgccgagaagaagggcggcacccuccacgccggccucaucaucggcauccucauccucguccucaucgucgccaccgccauccucgucaccgucuacauguaccaccaccccaccuccgccgccuccaucuucuucaucgagcgccgccccucccgcuggcccgccaugaaguuccgccgcggcuccggccaccccgccuacgccgaggucgagcccgucggcgagaaggagggcuucaucgucuccgagcagugcuga

SEQ ID NO: 47810 - RNA, 5691 nt, Artificial Sequence
  derived and/or modified sequence opt2 from PLXNA1__Homo_sapiens__NP_115618
augccccuccccccccgcucccuccagguccuccuccuccuccuccuccuccuccuccuccuccccggcaugugggccgaggccggccucccccgcgccggcggcggcucccagccccccuuccgcaccuucuccgccuccgacuggggccucacccaccucgucguccacgagcagaccggcgaggucuacgucggcgccgucaaccgcaucuacaagcucuccggcaaccucacccuccuccgcgcccacgucaccggccccgucgaggacaacgagaagugcuaccccccccccuccguccaguccugcccccacggccucggcuccaccgacaacgucaacaagcuccuccuccucgacuacgccgccaaccgccuccucgccugcggcuccgccucccagggcaucugccaguuccuccgccucgacgaccucuucaagcucggcgagccccaccaccgcaaggagcacuaccucuccuccguccaggaggccggcuccauggccggcguccucaucgccggcccccccggccagggccaggccaagcucuucgucggcacccccaucgacggcaaguccgaguacuuccccacccucuccucccgccgccucauggccaacgaggaggacgccgacauguucggcuucgucuaccaggacgaguucgucuccucccagcucaagauccccuccgacacccucuccaaguuccccgccuucgacaucuacuacgucuacuccuuccgcuccgagcaguucgucuacuaccucacccuccagcucgacacccagcucaccucccccgacgccgccggcgagcacuucuucaccuccaagaucguccgccucugcgucgacgaccccaaguucuacuccuacgucgaguuccccaucggcugcgagcaggccggcgucgaguaccgccucguccaggacgccuaccucucccgccccggccgcgcccucgcccaccagcucggccucgccgaggacgaggacguccucuucaccgucuucgcccagggccagaagaaccgcgucaagccccccaaggaguccgcccucugccucuucacccuccgcgccaucaaggagaagaucaaggagcgcauccaguccugcuaccgcggcgagggcaagcucucccuccccuggcuccucaacaaggagcucggcugcaucaacuccccccuccagaucgacgacgacuucugcggccaggacuucaaccagccccucggcggcaccgucaccaucgagggcaccccccucuucgucgacaaggacgacggccucaccgccgucgccgccuacgacuaccgcggccgcaccgucgucuucgccggcacccgcuccggccgcauccgcaagauccucgucgaccucuccaaccccggcggccgccccgcccucgccuacgaguccgucgucgcccaggagggcucccccauccuccgcgaccucguccucucccccaaccaccaguaccucuacgccaugaccgagaagcaggucacccgcguccccgucgaguccugcguccaguacaccuccugcgagcucugccucggcucccgcgacccccacugcggcuggugcguccuccacuccaucugcucccgccgcgacgccugcgagcgcgccgacgagccccagcgcuucgccgccgaccuccuccagugcguccagcucaccguccagccccgcaacgucuccgucaccaugucccaggucccccucguccuccaggccuggaacguccccgaccucuccgccggcgucaacugcuccuucgaggacuucaccgaguccgaguccguccucgaggacggccgcauccacugccgcucccccuccgcccgcgaggucgcccccaucacccgcggccagggcgaccagcgcgucgucaagcucuaccucaaguccaaggagaccggcaagaaguucgccuccgucgacuucgucuucuacaacugcuccguccaccaguccugccucuccugcgucaacggcuccuuccccugccacuggugcaaguaccgccacgucugcacccacaacgucgccgacugcgccuuccucgagggccgcgucaacgucuccgaggacugcccccagauccuccccuccacccagaucuacguccccgucggcgucgucaagcccaucacccucgccgcccgcaaccucccccagccccaguccggccagcgcggcuacgagugccucuuccacauccccggcucccccgcccgcgucaccgcccuccgcuucaacuccuccucccuccagugccagaacuccuccuacuccuacgagggcaacgacgucuccgaccuccccgucaaccucuccgucgucuggaacggcaacuucgucaucgacaacccccagaacauccaggcccaccucuacaagugccccgcccuccgcgaguccugcggccucugccucaaggccgacccccgcuucgagugcggcuggugcgucgccgagcgccgcugcucccuccgccaccacugcgccgccgacacccccgccuccuggaugcacgcccgccacggcuccucccgcugcaccgaccccaagauccucaagcucucccccgagaccggcccccgccagggcggcacccgccucaccaucaccggcgagaaccucggccuccgcuucgaggacguccgccucggcguccgcgucggcaagguccucugcucccccgucgaguccgaguacaucuccgccgagcagaucgucugcgagaucggcgacgccuccuccguccgcgcccacgacgcccucgucgaggucugcguccgcgacugcuccccccacuaccgcgcccucucccccaagcgcuucaccuucgucacccccaccuucuaccgcgucucccccucccgcggcccccucuccggcggcaccuggaucggcaucgagggcucccaccucaacgccggcuccgacgucgccgucuccgucggcggccgccccugcuccuucuccuggcgcaacucccgcgagauccgcugccucaccccccccggccagucccccggcuccgcccccaucaucaucaacaucaaccgcgcccagcucaccaaccccgaggucaaguacaacuacaccgaggaccccaccauccuccgcaucgaccccgagugguccaucaacuccggcggcacccuccucaccgucaccggcaccaaccucgccaccguccgcgagccccgcauccgcgccaaguacggcggcaucgagcgcgagaacggcugccucgucuacaacgacaccaccauggucugccgcgcccccuccgucgccaaccccguccgcuccccccccgagcucggcgagcgccccgacgagcucggcuucgucauggacaacguccgcucccuccucguccucaacuccaccuccuuccucuacuaccccgaccccguccucgagccccucucccccaccggccuccucgagcucaagcccuccuccccccucauccucaagggccgcaaccuccucccccccgcccccggcaacucccgccucaacuacaccguccucaucggcuccacccccugcacccucaccgucuccgagacccagcuccucugcgaggcccccaaccucaccggccagcacaaggucaccguccgcgccggcggcuucgaguucucccccggcacccuccaggucuacuccgacucccuccucacccuccccgccaucgucggcaucggcggcggcggcggccuccuccuccucgucaucgucgccguccucaucgccuacaagcgcaagucccgcgacgccgaccgcacccucaagcgccuccagcuccagauggacaaccucgagucccgcgucgcccucgagugcaaggaggccuucgccgagcuccagaccgacauccacgagcucaccaacgaccucgacggcgccggcauccccuuccucgacuaccgcaccuacgccaugcgcguccucuuccccggcaucgaggaccaccccguccucaaggagauggagguccaggccaacgucgagaagucccucacccucuucggccagcuccucaccaagaagcacuuccuccucaccuucauccgcacccucgaggcccagcgcuccuucuccaugcgcgaccgcggcaacgucgccucccucaucaugaccgcccuccagggcgagauggaguacgccaccggcguccucaagcagcuccucuccgaccucaucgagaagaaccucgaguccaagaaccaccccaagcuccuccuccgccgcaccgaguccgucgccgagaagaugcucaccaacugguucaccuuccuccucuacaaguuccucaaggagugcgccggcgagccccucuucaugcucuacugcgccaucaagcagcagauggagaagggccccaucgacgccaucaccggcgaggcccgcuacucccucuccgaggacaagcucauccgccagcagaucgacuacaagacccucacccucaacugcgucaaccccgagaacgagaacgcccccgagguccccgucaagggccucgacugcgacaccgucacccaggccaaggagaagcuccucgacgccgccuacaagggcguccccuacucccagcgccccaaggccgccgacauggaccucgaguggcgccagggccgcauggcccgcaucauccuccaggacgaggacgucaccaccaagaucgacaacgacuggaagcgccucaacacccucgcccacuaccaggucaccgacggcuccuccgucgcccucguccccaagcagaccuccgccuacaacaucuccaacuccuccaccuucaccaagucccucucccgcuacgaguccaugcuccgcaccgccuccucccccgacucccuccgcucccgcacccccaugaucacccccgaccucgaguccggcaccaagcucuggcaccucgucaagaaccacgaccaccucgaccagcgcgagggcgaccgcggcuccaagauggucuccgagaucuaccucacccgccuccucgccaccaagggcacccuccagaaguucgucgacgaccucuucgagaccaucuucuccaccgcccaccgcggcuccgcccucccccucgccaucaaguacauguucgacuuccucgacgagcaggccgacaagcaccagauccacgacgccgacguccgccacaccuggaaguccaacugccucccccuccgcuucugggucaacgucaucaagaacccccaguucgucuucgacauccacaagaacuccaucaccgacgccugccucuccgucgucgcccagaccuucauggacuccugcuccaccuccgagcacaagcucggcaaggacucccccuccaacaagcuccucuacgccaaggacauccccaacuacaaguccugggucgagcgcuacuacgccgacaucgccaagaugcccgccaucuccgaccaggacauguccgccuaccucgccgagcagucccgccuccaccucucccaguucaacuccauguccgcccuccacgagaucuacuccuacaucaccaaguacaaggacgagauccucgccgcccucgagaaggacgagcaggcccgccgccagcgccuccgcuccaagcucgagcaggucgucgacaccauggcccucuccuccuga

SEQ ID NO: 47811 - RNA, 5685 nt, Artificial Sequence
  derived and/or modified sequence opt2 from PLXNA2__Homo_sapiens__NP_079455
auggagcagcgccgccccuggccccgcgcccucgaggucgacucccgcuccgucguccuccucuccgucgucuggguccuccucgccccccccgccgccggcaugccccaguucuccaccuuccacuccgagaaccgcgacuggaccuucaaccaccucaccguccaccagggcaccggcgccgucuacgucggcgccaucaaccgcgucuacaagcucaccggcaaccucaccauccaggucgcccacaagaccggccccgaggaggacaacaaguccugcuaccccccccucaucguccagcccugcuccgagguccucacccucaccaacaacgucaacaagcuccucaucaucgacuacuccgagaaccgccuccucgccugcggcucccucuaccagggcgucugcaagcuccuccgccucgacgaccucuucauccucgucgagcccucccacaagaaggagcacuaccucuccuccgucaacaagaccggcaccauguacggcgucaucguccgcuccgagggcgaggacggcaagcucuucaucggcaccgccgucgacggcaagcaggacuacuuccccacccucuccucccgcaagcucccccgcgaccccgaguccuccgccaugcucgacuacgagcuccacuccgacuucgucuccucccucaucaagauccccuccgacacccucgcccucgucucccacuucgacaucuucuacaucuacggcuucgccuccggcggcuucgucuacuuccucaccguccagcccgagacccccgagggcgucgccaucaacuccgccggcgaccucuucuacaccucccgcaucguccgccucugcaaggacgaccccaaguuccacuccuacgucucccuccccuucggcugcacccgcgccggcgucgaguaccgccuccuccaggccgccuaccucgccaagcccggcgacucccucgcccaggccuucaacaucaccucccaggacgacguccucuucgccaucuucuccaagggccagaagcaguaccaccacccccccgacgacuccgcccucugcgccuuccccauccgcgccaucaaccuccagaucaaggagcgccuccaguccugcuaccagggcgagggcaaccucgagcucaacuggcuccucggcaaggacguccagugcaccaaggcccccguccccaucgacgacaacuucugcggccucgacaucaaccagccccucggcggcuccacccccgucgagggccucacccucuacaccaccucccgcgaccgcaugaccuccgucgccuccuacgucuacaacggcuacuccgucgucuucgucggcaccaaguccggcaagcucaagaagauccgcgccgacggccccccccacggcggcguccaguacgagauggucuccguccucaaggacggcucccccauccuccgcgacauggccuucuccaucgaccagcgcuaccucuacgucauguccgagcgccaggucacccgcguccccgucgaguccugcgagcaguacaccaccugcggcgagugccucuccuccggcgacccccacugcggcuggugcgcccuccacaacaugugcucccgccgcgacaagugccagcaggccugggagcccaaccgcuucgccgccuccaucucccagugcgucucccucgccguccaccccuccuccaucuccgucuccgagcacucccgccuccucucccucgucgucuccgacgcccccgaccucuccgccggcaucgccugcgccuucggcaaccucaccgaggucgagggccaggucuccggcucccaggucaucugcaucucccccggccccaaggacguccccgucaucccccucgaccaggacugguucggccucgagcuccagcuccgcuccaaggagaccggcaagaucuucgucuccaccgaguucaaguucuacaacugcuccgcccaccagcucugccucuccugcgucaacuccgccuuccgcugccacuggugcaaguaccgcaaccucugcacccacgaccccaccaccugcuccuuccaggagggccgcaucaacaucuccgaggacugcccccagcucguccccaccgaggagauccucauccccgucggcgaggucaagcccaucacccucaaggcccgcaaccucccccagccccaguccggccagcgcggcuacgagugcguccucaacauccagggcgccauccaccgcguccccgcccuccgcuucaacuccuccuccguccagugccagaacuccuccuaccaguacgacggcauggacaucuccaaccucgccgucgacuucgccgucgucuggaacggcaacuucaucaucgacaacccccaggaccucaagguccaccucuacaagugcgccgcccagcgcgaguccugcggccucugccucaaggccgaccgcaaguucgagugcggcuggugcuccggcgagcgccgcugcacccuccaccagcacugcaccucccccuccucccccuggcucgacugguccucccacaacgucaagugcuccaacccccagaucaccgagauccucaccgucuccggcccccccgagggcggcacccgcgucaccauccacggcgucaaccucggccucgacuucuccgagaucgcccaccacguccaggucgccggcguccccugcaccccccuccccggcgaguacaucaucgccgagcagaucgucugcgagaugggccacgcccucgucggcaccaccuccggccccguccgccucugcaucggcgagugcaagcccgaguucaugaccaagucccaccagcaguacaccuucgucaaccccuccguccucucccucaaccccauccgcggccccgaguccggcggcaccauggucaccaucaccggccacuaccucggcgccggcuccuccgucgccgucuaccucggcaaccagaccugcgaguucuacggccgcuccauguccgagaucgucugcgucuccccccccuccuccaacggccucggccccguccccgucuccgucuccgucgaccgcgcccacgucgacuccaaccuccaguucgaguacaucgacgacccccgcguccagcgcaucgagcccgagugguccaucgccuccggccacaccccccucaccaucaccggcuucaaccucgacgucauccaggagccccgcauccgcgucaaguucaacggcaaggaguccgucaacgucugcaaggucgucaacaccaccacccucaccugccucgcccccucccucaccaccgacuaccgccccggccucgacaccgucgagcgccccgacgaguucggcuucgucuucaacaacguccagucccuccucaucuacaacgacaccaaguucaucuacuaccccaaccccaccuucgagcuccucucccccaccggcguccucgaccagaagcccggcucccccaucauccucaagggcaagaaccucugcccccccgccuccggcggcgccaagcucaacuacaccguccucaucggcgagacccccugcgccgucaccgucuccgagacccagcuccucugcgagccccccaaccucaccggccagcacaaggucaugguccacgucggcggcauggucuucucccccggcuccgucuccgucaucuccgacucccuccucacccuccccgccaucgucuccaucgccgccggcggcucccuccuccucaucaucgucaucaucguccucaucgccuacaagcgcaagucccgcgagaacgaccucacccucaagcgccuccagaugcagauggacaaccucgagucccgcgucgcccucgagugcaaggaggccuucgccgagcuccagaccgacaucaacgagcucaccuccgaccucgaccgcuccggcauccccuaccucgacuaccgcaccuacgccaugcgcguccucuuccccggcaucgaggaccaccccguccuccgcgagcucgagguccagggcaacggccagcagcacgucgagaaggcccucaagcucuucgcccagcucaucaacaacaaggucuuccuccucaccuucauccgcacccucgagcuccagcgcuccuucuccaugcgcgaccgcggcaacgucgccucccucaucaugaccggccuccagggccgccucgaguacgccaccgacguccucaagcagcuccucuccgaccucaucgacaagaaccucgagaacaagaaccaccccaagcuccuccuccgccgcaccgaguccgucgccgagaagaugcucaccaacugguucgccuuccuccuccacaaguuccucaaggagugcgccggcgagccccucuucaugcucuacugcgccaucaagcagcagauggagaagggccccaucgacgccaucaccggcgaggcccgcuacucccucuccgaggacaagcucauccgccagcagaucgaguacaagacccucauccucaacugcgucaaccccgacaacgagaacucccccgagauccccgucaagguccucaacugcgacaccaucacccaggucaaggagaagauccucgacgccgucuacaagaacguccccuacucccagcgcccccgcgccgucgacauggaccucgaguggcgccagggccgcaucgcccgcgucguccuccaggacgaggacaucaccaccaagaucgagggcgacuggaagcgccucaacacccucaugcacuaccaggucuccgaccgcuccgucgucgcccucguccccaagcagaccuccuccuacaacauccccgccuccgccuccaucucccgcaccuccaucucccgcuacgacuccuccuuccgcuacaccggcucccccgacucccuccgcucccgcgcccccaugaucacccccgaccucgaguccggcgucaaggucuggcaccucgucaagaaccacgaccacggcgaccagaaggagggcgaccgcggcuccaagauggucuccgagaucuaccucacccgccuccucgccaccaagggcacccuccagaaguucgucgacgaccucuucgagacccucuucuccaccguccaccgcggcuccgcccucccccucgccaucaaguacauguucgacuuccucgacgagcaggccgaccgccacuccauccacgacaccgacguccgccacaccuggaaguccaacugccucccccuccgcuucugggucaacgucaucaagaacccccaguucgucuucgacauccacaagggcuccaucaccgacgccugccucuccgucgucgcccagaccuucauggacuccugcuccaccuccgagcaccgccucggcaaggacucccccuccaacaagcuccucuacgccaaggacauccccuccuacaaguccugggucgagcgcuacuacgccgacaucgccaagcuccccgccaucuccgaccaggacaugaacgccuaccucgccgagcagucccgccuccacgccgucgaguucaacaugcucuccgcccucaacgagaucuacuccuacgucuccaaguacuccgaggagcucaucggcgcccucgagcaggacgagcaggcccgccgccagcgccucgccuacaaggucgagcagcucaucaacgccauguccaucgaguccuga

SEQ ID NO: 47812 - RNA, 5616 nt, Artificial Sequence
  derived and/or modified sequence opt2 from PLXNA3__Homo_sapiens__NP_059984
augcccuccgucugccuccuccuccuccucuuccucgccgucggcggcgcccucggcaaccgccccuuccgcgccuucgucgucaccgacaccacccucacccaccucgccguccaccgcgucaccggcgaggucuucgucggcgccgucaaccgcgucuucaagcucgcccccaaccucaccgagcuccgcgcccacgucaccggccccgucgaggacaacgcccgcugcuaccccccccccuccaugcgcgucugcgcccaccgccucgcccccgucgacaacaucaacaagcuccuccucaucgacuacgccgcccgccgccucgucgccugcggcuccaucuggcagggcaucugccaguuccuccgccucgacgaccucuucaagcucggcgagccccaccaccgcaaggagcacuaccucuccggcgcccaggagcccgacuccauggccggcgucaucgucgagcagggccagggccccuccaagcucuucgucggcaccgccgucgacggcaaguccgaguacuuccccacccucuccucccgcaagcucaucuccgacgaggacuccgccgacauguucucccucgucuaccaggacgaguucgucuccucccagaucaagauccccuccgacacccucucccucuaccccgccuucgacaucuacuacaucuacggcuucgucuccgccuccuucgucuacuuccucacccuccagcucgacacccagcagacccuccucgacaccgccggcgagaaguucuucaccuccaagaucguccgcaugugcgccggcgacuccgaguucuacuccuacgucgaguuccccaucggcugcuccuggcgcggcgucgaguaccgccucguccaguccgcccaccucgccaagcccggccuccuccucgcccaggcccucggcguccccgccgacgaggacguccucuucaccaucuucucccagggccagaagaaccgcgccucccccccccgccagaccauccucugccucuucacccucuccaacaucaacgcccacauccgccgccgcauccaguccugcuaccgcggcgagggcacccucgcccuccccuggcuccucaacaaggagcuccccugcaucaacacccccaugcagaucaacggcaacuucugcggccucguccucaaccagccccucggcggccuccacgucaucgagggccucccccuccucgccgacuccaccgacggcauggccuccgucgccgccuacaccuaccgccagcacuccgucgucuucaucggcacccgcuccggcucccucaagaagguccgcgucgacggcuuccaggacgcccaccucuacgagaccguccccgucgucgacggcucccccauccuccgcgaccuccucuucucccccgaccaccgccacaucuaccuccucuccgagaagcaggucucccagcuccccgucgagaccugcgagcaguaccaguccugcgccgccugccucggcuccggcgacccccacugcggcuggugcguccuccgccaccgcugcugccgcgagggcgccugccucggcgccuccgccccccacggcuucgccgaggagcucuccaagugcguccagguccgcguccgccccaacaacgucuccgucaccucccccggcguccagcucaccgucacccuccacaacguccccgaccucuccgccggcgucuccugcgccuucgaggccgccgccgagaacgaggccguccuccuccccuccggcgagcuccucugccccucccccucccuccaggagcuccgcgcccucacccgcggccacggcgccacccgcaccguccgccuccagcuccucuccaaggagaccggcguccgcuucgccggcgccgacuucgucuucuacaacugcuccguccuccaguccugcauguccugcgucggcucccccuaccccugccacuggugcaaguaccgccacaccugcaccucccgcccccacgagugcuccuuccaggagggccgcguccacucccccgagggcugccccgagauccuccccuccggcgaccuccucauccccgucggcgucaugcagccccucacccuccgcgccaagaaccucccccagccccaguccggccagaagaacuacgagugcgucguccgcguccagggccgccagcagcgcguccccgccguccgcuucaacuccuccuccguccagugccagaacgccuccuacuccuacgagggcgacgagcacggcgacaccgagcucgacuucuccgucgucugggacggcgacuuccccaucgacaagccccccuccuuccgcgcccuccucuacaagugcugggcccagcgccccuccugcggccucugccucaaggccgacccccgcuucaacugcggcuggugcaucuccgagcaccgcugccagcuccgcacccacugccccgcccccaagaccaacuggaugcaccucucccagaagggcacccgcugcucccacccccgcaucacccagauccacccccucgucggccccaaggagggcggcacccgcgucaccaucgucggcgagaaccucggccuccucucccgcgaggucggccuccgcgucgccggcguccgcugcaacuccauccccgccgaguacaucuccgccgagcgcaucgucugcgagauggaggagucccucguccccucccccccccccggccccgucgagcucugcgucggcgacugcuccgccgacuuccgcacccaguccgagcaggucuacuccuucgucacccccaccuucgaccaggucucccccucccgcggccccgccuccggcggcacccgccucaccaucuccggcuccucccucgacgccggcucccgcgucaccgucaccguccgcgacuccgagugccaguucguccgccgcgacgccaaggccaucgucugcaucuccccccucuccacccucggccccucccaggcccccaucacccucgccaucgaccgcgccaacaucuccucccccggccucaucuacaccuacacccaggaccccaccgucacccgccucgagcccaccugguccaucaucaacggcuccaccgccaucaccgucuccggcacccaccuccucaccguccaggagccccgcguccgcgccaaguaccgcggcaucgagaccaccaacaccugccaggucaucaacgacaccgccaugcucugcaaggcccccggcaucuuccucggccgcccccagccccgcgcccagggcgagcaccccgacgaguucggcuuccuccucgaccacguccagaccgcccgcucccucaaccgcuccuccuucaccuacuaccccgaccccuccuucgagccccucggccccuccggcguccucgacgucaagcccggcucccacgucguccucaagggcaagaaccucauccccgccgccgccggcuccucccgccucaacuacaccguccucaucggcggccagcccugcucccucaccgucuccgacacccagcuccucugcgacucccccucccagaccggccgccagcccgucaugguccucgucggcggccucgaguucuggcucggcacccuccacaucuccgccgagcgcgcccucacccuccccgccaugaugggccucgccgccggcggcggccuccuccuccucgccaucaccgccguccucgucgccuacaagcgcaagacccaggacgccgaccgcacccucaagcgccuccagcuccagauggacaaccucgagucccgcgucgcccucgagugcaaggaggccuucgccgagcuccagaccgacaucaacgagcucaccaaccacauggacgagguccagauccccuuccucgacuaccgcaccuacgccguccgcguccucuuccccggcaucgaggcccaccccguccucaaggagcucgacaccccccccaacgucgagaaggcccuccgccucuucggccagcuccuccacucccgcgccuucguccucaccuucauccacacccucgaggcccaguccuccuucuccaugcgcgaccgcggcaccgucgccucccucaccauggucgcccuccagucccgccucgacuacgccaccggccuccucaagcagcuccucgccgaccucaucgagaagaaccucgaguccaagaaccaccccaagcuccuccuccgccgcaccgaguccgucgccgagaagaugcucaccaacugguucaccuuccuccuccacaaguuccucaaggagugcgccggcgagccccucuuccuccucuacugcgccaucaagcagcagauggagaagggccccaucgacgccaucaccggcgaggcccgcuacucccucuccgaggacaagcucauccgccagcagaucgacuacaagacccucacccuccacugcgucugccccgagaacgagggcuccgcccagguccccgucaagguccucaacugcgacuccaucacccaggccaaggacaagcuccucgacaccgucuacaagggcauccccuacucccagcgccccaaggccgaggacauggaccucgaguggcgccagggccgcaugacccgcaucauccuccaggacgaggacgucaccaccaagaucgagugcgacuggaagcgccucaacucccucgcccacuaccaggucaccgacggcucccucgucgcccucguccccaagcaggucuccgccuacaacauggccaacuccuucaccuucacccgcucccucucccgcuacgagucccuccuccgcaccgccuccucccccgacucccuccgcucccgcgcccccaugaucacccccgaccaggagaccggcaccaagcucuggcaccucgucaagaaccacgaccacgccgaccaccgcgagggcgaccgcggcuccaagauggucuccgagaucuaccucacccgccuccucgccaccaagggcacccuccagaaguucgucgacgaccucuucgagaccgucuucuccaccgcccaccgcggcuccgcccucccccucgccaucaaguacauguucgacuuccucgacgagcaggccgaccagcgccagaucuccgaccccgacguccgccacaccuggaaguccaacugccucccccuccgcuucugggucaacgucaucaagaacccccaguucgucuucgacauccacaagaacuccaucaccgacgccugccucuccgucgucgcccagaccuucauggacuccugcuccaccuccgagcaccgccucggcaaggacucccccuccaacaagcuccucuacgccaaggacauccccaacuacaaguccugggucgagcgcuacuaccgcgacaucgccaagauggccuccaucuccgaccaggacauggacgccuaccucgucgagcagucccgccuccacgccuccgacuucuccguccucuccgcccucaacgagcucuacuucuacgucaccaaguaccgccaggagauccucaccgcccucgaccgcgacgccuccugccgcaagcacaagcuccgccagaagcucgagcagaucaucucccucgucuccuccgacuccuga

SEQ ID NO: 47813 - RNA, 1479 nt, Artificial Sequence
  derived and/or modified sequence opt2 from PLXNA4__Homo_sapiens__NP_001099013
augaaggccaugcccuggaacuggaccugccuccucucccaccuccucauggucggcaugggcuccuccacccuccucacccgccagcccgccccccucucccagaagcagcgcuccuucgucaccuuccgcggcgagcccgccgagggcuucaaccaccucgucgucgacgagcgcaccggccacaucuaccucggcgccgucaaccgcaucuacaagcucuccuccgaccucaagguccucgucacccacgagaccggccccgacgaggacaaccccaagugcuaccccccccgcaucguccagaccugcaacgagccccucaccaccaccaacaacgucaacaagaugcuccucaucgacuacaaggagaaccgccucaucgccugcggcucccucuaccagggcaucugcaagcuccuccgccucgaggaccucuucaagcucggcgagcccuaccacaagaaggagcacuaccucuccggcgucaacgaguccggcuccgucuucggcgucaucgucuccuacuccaaccucgacgacaagcucuucaucgccaccgccgucgacggcaagcccgaguacuuccccaccaucuccucccgcaagcucaccaagaacuccgaggccgacggcauguucgccuacgucuuccacgacgaguucgucgccuccaugaucaagauccccuccgacaccuucaccaucauccccgacuucgacaucuacuacgucuacggcuucuccuccggcaacuucgucuacuuccucacccuccagcccgagauggucuccccccccggcuccaccaccaaggagcaggucuacaccuccaagcucguccgccucugcaaggaggacaccgccuucaacuccuacgucgagguccccaucggcugcgagcgcuccggcgucgaguaccgccuccuccaggccgccuaccucuccaaggccggcgccguccucggccgcacccucggcguccaccccgacgacgaccuccucuucaccgucuucuccaagggccagaagcgcaagaugaagucccucgacgaguccgcccucugcaucuucauccucaagcagaucaacgaccgcaucaaggagcgccuccaguccugcuaccgcggcgagggcacccucgaccucgccuggcucaaggucaaggacauccccugcuccuccgcccuccucaccaucgacgacaacuucugcggccucgacaugaacgccccccucggcgucuccgacaugguccgcggcauccccgucuucaccgaggaccgcgaccgcaugaccuccgucaucgccuacgucuacaagaaccacucccucgccuucgucggcaccaaguccggcaagcucaagaagaugcccggcaccucccucugccccacccucgagcuccagaccggcccccgcucccaccgcgccaccgucacccucgagcuccucuucuccuccugcuccuccaacuga

SEQ ID NO: 47814 - RNA, 6408 nt, Artificial Sequence
  derived and/or modified sequence opt2 from PLXNB1__Homo_sapiens__NP_001123554
augcccgcccucggccccgcccuccuccaggcccucugggccggcuggguccucacccuccagccccucccccccaccgccuucacccccaacggcaccuaccuccagcaccucgcccgcgaccccaccuccggcacccucuaccucggcgccaccaacuuccucuuccagcucucccccggccuccagcucgaggccaccgucuccaccggccccguccucgacucccgcgacugccucccccccgucaugcccgacgagugcccccaggcccagcccaccaacaaccccaaccagcuccuccucgucucccccggcgcccucgucgucugcggcuccguccaccagggcgucugcgagcagcgccgccucggccagcucgagcagcuccuccuccgccccgagcgccccggcgacacccaguacgucgccgccaacgaccccgccgucuccaccgucggccucgucgcccagggccucgccggcgagccccuccucuucgucggccgcggcuacaccucccgcggcgucggcggcggcaucccccccaucaccacccgcgcccucuggccccccgacccccaggccgccuucuccuacgaggagaccgccaagcucgccgucggccgccucuccgaguacucccaccacuucgucuccgccuucgcccgcggcgccuccgccuacuuccucuuccuccgccgcgaccuccaggcccagucccgcgccuuccgcgccuacgucucccgcgucugccuccgcgaccagcacuacuacuccuacgucgagcucccccucgccugcgagggcggccgcuacggccucauccaggccgccgccgucgccaccucccgcgaggucgcccacggcgagguccucuucgccgccuucuccuccgccgccccccccaccgucggccgcccccccuccgccgccgccggcgccuccggcgccuccgcccucugcgccuucccccucgacgaggucgaccgccucgccaaccgcacccgcgacgccugcuacacccgcgagggccgcgccgaggacggcaccgaggucgccuacaucgaguacgacgucaacuccgacugcgcccagcuccccgucgacacccucgacgccuaccccugcggcuccgaccacacccccucccccauggccucccgcgucccccucgaggccacccccauccucgaguggcccggcauccagcucaccgccgucgccgucaccauggaggacggccacaccaucgccuuccucggcgacucccagggccagcuccaccgcgucuaccucggccccggcuccgacggccaccccuacuccacccaguccauccagcagggcuccgccgucucccgcgaccucaccuucgacggcaccuucgagcaccucuacgucaugacccaguccacccuccucaagguccccgucgccuccugcgcccagcaccucgacugcgccuccugccucgcccaccgcgaccccuacugcggcuggugcguccuccucggccgcugcucccgccgcuccgagugcucccgcggccagggccccgagcaguggcucugguccuuccagcccgagcucggcugccuccaggucgccgccaugucccccgccaacaucucccgcgaggagacccgcgaggucuuccucuccguccccgaccuccccccccucuggcccggcgaguccuacuccugccacuucggcgagcaccagucccccgcccuccucaccggcuccggcgucaugugccccucccccgaccccuccgaggcccccguccucccccgcggcgccgacuacgucuccgucuccgucgagcuccgcuucggcgccgucgucaucgccaagaccucccucuccuucuacgacugcgucgccgucaccgagcuccgccccuccgcccagugccaggccugcgucuccucccgcuggggcugcaacuggugcgucuggcagcaccucugcacccacaaggccuccugcgacgccggccccauggucgccucccaccaguccccccucgucucccccgacccccccgcccgcggcggccccucccccuccccccccaccgcccccaaggcccucgccacccccgcccccgacacccuccccgucgagcccggcgcccccuccaccgccaccgccuccgacaucucccccggcgccucccccucccuccucucccccuggggccccugggccggcuccggcuccaucuccucccccggcuccaccggcuccccccuccacgaggagcccuccccccccuccccccagaacggccccggcaccgccguccccgcccccaccgacuuccgccccuccgccacccccgaggaccuccucgccuccccccucucccccuccgaggucgccgccgucccccccgccgaccccggccccgaggcccuccaccccaccgucccccucgaccucccccccgccaccguccccgccaccaccuuccccggcgccaugggcuccgucaagcccgcccucgacuggcucacccgcgagggcggcgagcuccccgaggccgacgaguggaccggcggcgacgcccccgccuucuccaccuccacccuccucuccggcgacggcgacuccgccgagcucgagggcccccccgccccccucauccuccccuccucccucgacuaccaguacgacacccccggccucugggagcucgaggaggccacccucggcgccuccuccugccccugcgucgaguccguccagggcuccacccucaugcccguccacgucgagcgcgagauccgccuccucggccgcaaccuccaccucuuccaggacggccccggcgacaacgagugcgucauggagcucgagggccucgaggucgucgucgaggcccgcgucgagugcgagcccccccccgacacccagugccacgucaccugccagcagcaccagcucuccuacgaggcccuccagcccgagcuccgcgucggccucuuccuccgccgcgccggccgccuccgcgucgacuccgccgagggccuccacgucguccucuacgacugcuccgucggccacggcgacugcucccgcugccagaccgccaugccccaguacggcugcgucuggugcgagggcgagcgcccccgcugcgucacccgcgaggccugcggcgaggccgaggccgucgccacccagugccccgccccccucauccacuccgucgagccccucaccggccccgucgacggcggcacccgcgucaccauccgcggcuccaaccucggccagcacguccaggacguccucggcauggucaccgucgccggcguccccugcgccgucgacgcccaggaguacgaggucuccuccucccucgucugcaucaccggcgccuccggcgaggaggucgccggcgccaccgccgucgagguccccggccgcggccgcggcgucuccgagcacgacuucgccuaccaggaccccaagguccacuccaucuuccccgcccgcggcccccgcgccggcggcacccgccucacccucaacggcuccaagcuccucaccggccgccucgaggacauccgcgucgucgucggcgaccagcccugccaccuccuccccgagcagcaguccgagcagcuccgcugcgagaccuccccccgccccacccccgccacccuccccgucgccgucugguucggcgccaccgagcgccgccuccagcgcggccaguucaaguacacccucgaccccaacaucaccuccgccggccccaccaaguccuuccucuccggcggccgcgagaucugcguccgcggccagaaccucgacgucguccagaccccccgcauccgcgucaccgucgucucccgcaugcuccagcccucccagggccucggccgccgccgccgcgucguccccgagaccgccugcucccucggccccuccugcuccucccagcaguucgaggagcccugccacgucaacuccucccagcucaucaccugccgcacccccgcccuccccggccuccccgaggaccccuggguccgcgucgaguucauccucgacaaccucgucuucgacuucgccacccucaaccccacccccuucuccuacgaggccgaccccacccuccagccccucaaccccgaggaccccaccaugcccuuccgccacaagcccggcuccgucuucuccgucgagggcgagaaccucgaccucgccauguccaaggaggaggucgucgccaugaucggcgacggccccugcgucgucaagacccucacccgccaccaccucuacugcgagccccccgucgagcagccccucccccgccaccacgcccuccgcgaggcccccgacucccuccccgaguucaccguccagaugggcaaccuccgcuucucccucggccacguccaguacgacggcgagucccccggcgccuuccccgucgccgcccaggucggccucggcgucggcaccucccuccucgcccucggcgucaucaucaucguccucauguaccgccgcaaguccaagcaggcccuccgcgacuacaagaagguccagauccagcucgagaaccucgaguccuccguccgcgaccgcugcaagaaggaguucaccgaccucaugaccgagaugaccgaccucaccuccgaccuccucggcuccggcauccccuuccucgacuacaaggucuacgccgagcgcaucuucuuccccggccaccgcgaguccccccuccaccgcgaccucggcguccccgagucccgccgccccaccgucgagcagggccucggccagcucuccaaccuccucaacuccaagcucuuccucaccaaguucauccacacccucgagucccagcgcaccuucuccgcccgcgaccgcgccuacgucgccucccuccucaccgucgcccuccacggcaagcucgaguacuucaccgacauccuccgcacccuccucuccgaccucgucgcccaguacgucgccaagaaccccaagcucaugcuccgccgcaccgagaccgucgucgagaagcuccucaccaacuggauguccaucugccucuacaccuucguccgcgacuccgucggcgagccccucuacaugcucuuccgcggcaucaagcaccaggucgacaagggccccgucgacuccgucaccggcaaggccaaguacacccucaacgacaaccgccuccuccgcgaggacgucgaguaccgcccccucacccucaacgcccuccucgccgucggccccggcgccggcgaggcccagggcguccccgucaagguccucgacugcgacaccaucucccaggccaaggagaagaugcucgaccagcucuacaagggcgucccccucacccagcgccccgacccccgcacccucgacgucgaguggcgcuccggcgucgccggccaccucauccucuccgacgaggacgucaccuccgagguccagggccucuggcgccgccucaacacccuccagcacuacaagguccccgacggcgccaccgucgcccucguccccugccucaccaagcacguccuccgcgagaaccaggacuacguccccggcgagcgcacccccaugcucgaggacgucgacgagggcggcauccgccccuggcaccucgucaagcccuccgacgagcccgagcccccccgcccccgccgcggcucccuccgcggcggcgagcgcgagcgcgccaaggccauccccgagaucuaccucacccgccuccucuccaugaagggcacccuccagaaguucgucgacgaccucuuccaggucauccucuccaccucccgccccgucccccucgccgucaaguacuucuucgaccuccucgacgagcaggcccagcagcacggcaucuccgaccaggacaccauccacaucuggaagaccaacucccucccccuccgcuucuggaucaacaucaucaagaacccccaguucgucuucgacguccagaccuccgacaacauggacgccguccuccucgucaucgcccagaccuucauggacgccugcacccucgccgaccacaagcucggccgcgacucccccaucaacaagcuccucuacgcccgcgacaucccccgcuacaagcgcauggucgagcgcuacuacgccgacauccgccagaccguccccgccuccgaccaggagaugaacuccguccucgccgagcucuccuggaacuacuccggcgaccucggcgcccgcgucgcccuccacgagcucuacaaguacaucaacaaguacuacgaccagaucaucaccgcccucgaggaggacggcaccgcccagaagaugcagcucggcuaccgccuccagcagaucgccgccgccgucgagaacaaggucaccgaccucuga

SEQ ID NO: 47815 - RNA, 5799 nt, Artificial Sequence
  derived and/or modified sequence opt2 from PLXNB3__Homo_sapiens__NP_001156729
auggagcucacccccgccuccucccucaccugcucccuccucuccccccgccuccccggcuccuucccccagcuccgccgcgucccccccugcucccgccccuggcuccccaaggcccccgucauggcccgcuggccccccuucggccucugccuccuccuccuccuccucuccccccccccccucccccucaccggcgcccaccgcuucuccgcccccaacaccacccucaaccaccucgcccucgcccccggccgcggcacccucuacgucggcgccgucaaccgccucuuccagcucucccccgagcuccagcucgaggccgucgccgucaccggccccgucaucgacucccccgacugcguccccuuccgcgaccccgccgagugcccccaggcccagcucaccgacaacgccaaccagcuccuccucgucuccucccgcgcccaggagcucgucgccugcggccagguccgccagggcgucugcgagacccgccgccucggcgacgucgccgagguccucuaccaggccgaggaccccggcgacggccaguucgucgccgccaacacccccggcgucgccaccgucggccucgucgucccccuccccggccgcgaccuccuccucgucgcccgcggccucgccggcaagcucuccgccggcguccccccccucgccauccgccagcucgccggcucccagcccuucuccuccgagggccucggccgccucgucgucggcgacuucuccgacuacaacaacuccuacgucggcgccuucgccgacgcccgcuccgccuacuucgucuuccgccgccgcggcgcccgcgcccaggccgaguaccgcuccuacgucgcccgcgucugccucggcgacaccaaccucuacuccuacgucgaggucccccucgccugccagggccagggccucauccaggccgccuuccucgcccccggcacccuccucggcgucuucgccgccggcccccgcggcacccaggccgcccucugcgccuuccccauggucgagcucggcgccuccauggagcaggcccgccgccucugcuacaccgccggcggccgcggccccuccggcgccgaggaggccaccgucgaguacggcgucaccucccgcugcgucacccucccccucgacucccccgaguccuaccccugcggcgacgagcacacccccucccccaucgccggccgccagccccucgagguccagccccuccucaagcucggccagcccgucuccgccgucgccgcccuccaggccgacggccacaugaucgccuuccucggcgacacccagggccagcucuacaaggucuuccuccacggcucccagggccaggucuaccacucccagcaggucggcccccccggcuccgccaucucccccgaccuccuccucgacuccuccggcucccaccucuacguccucaccgcccaccaggucgaccgcauccccgucgccgccugcccccaguuccccgacugcgccuccugccuccaggcccaggacccccucugcggcuggugcguccuccagggccgcugcacccgcaagggccagugcggccgcgccggccagcucaaccaguggcucugguccuacgaggaggacucccacugccuccacauccagucccuccuccccggccaccacccccgccaggagcagggccaggucacccucuccgucccccgccuccccauccucgacgccgacgaguacuuccacugcgccuucggcgacuacgacucccucgcccacgucgagggcccccacgucgccugcgucacccccccccaggaccaggucccccucaacccccccggcaccgaccacgucaccgucccccucgcccucauguucgaggacgucaccgucgccgccaccaacuucuccuucuacgacugcuccgccguccaggcccucgaggccgccgcccccugccgcgccugcgucggcuccaucuggcgcugccacuggugcccccaguccucccacugcgucuacggcgagcacugccccgagggcgagcgcaccaucuacuccgcccaggaggucgacauccagguccgcggccccggcgccugcccccaggucgagggccucgccggcccccaccucguccccgucggcugggagucccaccucgcccuccgcguccgcaaccuccagcacuuccgcggccuccccgccuccuuccacugcuggcucgagcuccccggcgagcuccgcggccuccccgccacccucgaggagaccgccggcgacuccggccucauccacugccaggcccaccaguucuaccccuccaugucccagcgcgagcuccccguccccaucuacgucacccagggcgaggcccagcgccucgacaacacccacgcccucuacgucauccucuacgacugcgccaugggccaccccgacugcucccacugccaggccgccaaccgcucccucggcugccucuggugcgccgacggccagcccgccugccgcuacggcccccucugcccccccggcgccgucgagcuccucugccccgcccccuccaucgacgccgucgagccccucaccggcccccccgagggcggccucgcccucaccauccucggcuccaaccucggccgcgccuucgccgacguccaguacgccgucuccgucgccucccgccccugcaaccccgagcccucccucuaccgcaccuccgcccgcaucgucugcgucaccucccccgcccccaacggcaccaccggccccguccgcgucgccaucaagucccagccccccggcaucuccucccagcacuucaccuaccaggaccccguccuccucucccucuccccccgcuggggcccccaggccggcggcacccagcucaccauccgcggccagcaccuccagaccggcggcaacaccuccgccuucgucggcggccagcccugccccauccucgagcccgucugccccgaggccaucgucugccgcacccgcccccaggccgcccccggcgaggccgccguccucgucgucuucggccacgcccagcgcacccuccucgccucccccuuccgcuacaccgccaacccccagcucgucgccgccgagcccuccgccuccuuccgcggcggcggccgccucauccgcguccgcggcaccggccucgacgucguccagcgcccccuccucuccgucuggcucgaggccgacgccgagguccaggccucccgcgcccagccccaggacccccagccccgccgcuccugcggcgcccccgccgccgacccccaggccugcauccagcucggcggcggccuccuccagugcuccaccgucugcuccgucaacuccuccucccuccuccucugccgcucccccgccguccccgaccgcgcccacccccagcgcgucuucuucacccucgacaacguccaggucgacuucgccuccgccuccggcggccagggcuuccucuaccagcccaacccccgccucgccccccucucccgcgagggccccgcccgccccuaccgccucaagcccggccacguccucgacgucgagggcgagggccucaaccucggcaucuccaaggaggagguccgcguccacaucggccgcggcgagugccucgucaagacccucacccgcacccaccucuacugcgagccccccgcccacgccccccagcccgccaacggcuccggccucccccaguucgucguccagaugggcaacguccagcucgcccucggccccguccaguacgaggccgagcccccccucuccgccuuccccgucgaggcccaggccggcgucggcaugggcgccgccguccucaucgccgccguccuccuccucacccucauguaccgccacaaguccaagcaggcccuccgcgacuaccagaagguccucguccagcucgagucccucgagaccggcgucggcgaccagugccgcaaggaguucaccgaccucaugaccgagaugaccgaccucuccuccgaccucgagggcuccggcauccccuuccucgacuaccgcaccuacgccgagcgcgccuucuuccccggccacggcggcugcccccuccagcccaagcccgagggccccggcgaggacggccacugcgccaccguccgccagggccucacccagcucuccaaccuccucaacuccaagcucuuccuccucacccucauccacacccucgaggagcagcccuccuucucccagcgcgaccgcugccacgucgccucccuccucucccucgcccuccacggcaagcucgaguaccucaccgacaucaugcgcacccuccucggcgaccucgccgcccacuacguccaccgcaaccccaagcucaugcuccgccgcaccgagaccauggucgagaagcuccucaccaacuggcucuccaucugccucuacgccuuccuccgcgaggucgccggcgagccccucuacaugcucuuccgcgccauccaguaccaggucgacaagggccccgucgacgccgucaccggcaaggccaagcgcacccucaacgacucccgccuccuccgcgaggacgucgaguuccagccccucacccucaugguccucgucggccccggcgccggcggcgccgccggcuccuccgagaugcagcgcguccccgcccgcguccucgacaccgacaccaucacccaggucaaggagaagguccucgaccaggucuacaagggcacccccuucucccagcgccccuccguccacgcccucgaccucgaguggcgcuccggccucgccggccaccucacccucuccgacgaggaccucaccuccgucacccagaaccacuggaagcgccucaacacccuccagcacuacaagguccccgacggcgccaccgucggccucgucccccagcuccaccgcggcuccaccaucucccagucccucgcccagcgcugcccccucggcgagaacauccccacccucgaggacggcgaggagggcggcgucugccucuggcaccucgucaaggccaccgaggagcccgagggcgccaagguccgcugcuccucccuccgcgagcgcgagcccgcccgcgccaaggccauccccgagaucuaccucacccgccuccucuccaugaagggcacccuccagaaguucgucgacgacaccuuccaggccauccucuccgucaaccgccccauccccaucgccgucaaguaccucuucgaccuccucgacgagcucgccgagaagcacggcaucgaggaccccggcacccuccacaucuggaagaccaacucccuccuccuccgcuucugggucaacgcccucaagaacccccagcucaucuucgacguccgcgucuccgacaacgucgacgccauccucgccgucaucgcccagaccuucaucgacuccugcaccaccuccgagcacaaggucggccgcgacucccccgucaacaagcuccucuacgcccgcgagaucccccgcuacaagcagauggucgagcgcuacuacgccgacauccgccaguccucccccgccuccuaccaggagaugaacuccgcccucgccgagcucuccggcaacuacaccuccgccccccacugccucgaggcccuccaggagcucuacaaccacauccaccgcuacuacgaccagaucaucuccgcccucgaggaggaccccgucggccagaagcuccagcucgccugccgccuccagcaggucgccgcccucgucgagaacaaggucaccgaccucuga

SEQ ID NO: 47816 - RNA, 4707 nt, Artificial Sequence
  derived and/or modified sequence opt2 from PLXNC1__Homo_sapiens__NP_005752
auggaggucucccgccgcaaggcccccccccgccccccccgccccgccgccccccucccccuccucgccuaccuccucgcccucgccgcccccggccgcggcgccgacgagcccgucuggcgcuccgagcaggccaucggcgccaucgccgccucccaggaggacggcgucuucgucgccuccggcuccugccucgaccagcucgacuacucccucgagcacucccucucccgccucuaccgcgaccaggccggcaacugcaccgagcccgucucccucgccccccccgcccgcccccgccccggcuccuccuucuccaagcuccuccuccccuaccgcgagggcgccgccggccucggcggccuccuccucaccggcuggaccuucgaccgcggcgccugcgagguccgcccccucggcaaccucucccgcaacucccuccgcaacggcaccgaggucgucuccugccacccccagggcuccaccgccggcgucgucuaccgcgccggccgcaacaaccgcugguaccucgccgucgccgccaccuacguccuccccgagcccgagaccgccucccgcugcaaccccgccgccuccgaccacgacaccgccaucgcccucaaggacaccgagggccgcucccucgccacccaggagcucggccgccucaagcucugcgagggcgccggcucccuccacuucgucgacgccuuccucuggaacggcuccaucuacuuccccuacuaccccuacaacuacaccuccggcgccgccaccggcuggcccuccauggcccgcaucgcccaguccaccgagguccucuuccagggccaggccucccucgacugcggccacggccaccccgacggccgccgccuccuccucuccuccucccucgucgaggcccucgacgucugggccggcgucuucuccgccgccgccggcgagggccaggagcgccgcucccccaccaccaccgcccucugccucuuccgcauguccgagauccaggcccgcgccaagcgcgucuccugggacuucaagaccgccgagucccacugcaaggagggcgaccagcccgagcgcguccagcccaucgccuccuccacccucauccacuccgaccucaccuccgucuacggcaccgucgucaugaaccgcaccguccucuuccucggcaccggcgacggccagcuccucaaggucauccucggcgagaaccucaccuccaacugccccgaggucaucuacgagaucaaggaggagacccccgucuucuacaagcucguccccgaccccgucaagaacaucuacaucuaccucaccgccggcaaggagguccgccgcauccgcgucgccaacugcaacaagcacaaguccugcuccgagugccucaccgccaccgacccccacugcggcuggugccacucccuccagcgcugcaccuuccagggcgacugcguccacuccgagaaccucgagaacuggcucgacaucuccuccggcgccaagaagugccccaagauccagaucauccgcuccuccaaggagaagaccaccgucaccauggucggcuccuucuccccccgccacuccaagugcauggucaagaacgucgacuccucccgcgagcucugccagaacaagucccagcccaaccgcaccugcaccugcuccauccccacccgcgccaccuacaaggacgucuccgucgucaacgucauguucuccuucggcuccuggaaccucuccgaccgcuucaacuucaccaacugcuccucccucaaggagugccccgccugcgucgagaccggcugcgccuggugcaaguccgcccgccgcugcauccaccccuucaccgccugcgaccccuccgacuacgagcgcaaccaggagcagugccccgucgccgucgagaagaccuccggcggcggccgccccaaggagaacaagggcaaccgcaccaaccaggcccuccaggucuucuacaucaaguccaucgagccccagaaggucuccacccucggcaaguccaacgucaucgucaccggcgccaacuucacccgcgccuccaacaucaccaugauccucaagggcaccuccaccugcgacaaggacgucauccaggucucccacguccucaacgacacccacaugaaguucucccuccccuccucccgcaaggagaugaaggacgucugcauccaguucgacggcggcaacugcuccuccgucggcucccucuccuacaucgcccucccccacugcucccucaucuuccccgccaccaccuggaucuccggcggccagaacaucaccaugaugggccgcaacuucgacgucaucgacaaccucaucaucucccacgagcucaagggcaacaucaacgucuccgaguacugcgucgccaccuacugcggcuuccucgcccccucccucaaguccuccaagguccgcaccaacgucaccgucaagcuccgcguccaggacaccuaccucgacugcggcacccuccaguaccgcgaggacccccgcuucaccggcuaccgcgucgaguccgaggucgacaccgagcucgaggucaagauccagaaggagaacgacaacuucaacaucuccaagaaggacaucgagaucacccucuuccacggcgagaacggccagcucaacugcuccuucgagaacaucacccgcaaccaggaccucaccaccauccucugcaagaucaagggcaucaagaccgccuccaccaucgccaacuccuccaagaagguccgcgucaagcucggcaaccucgagcucuacgucgagcaggaguccguccccuccaccugguacuuccucaucguccuccccguccuccucgucaucgucaucuucgccgccgucggcgucacccgccacaaguccaaggagcucucccgcaagcagucccagcagcucgagcuccucgaguccgagcuccgcaaggagauccgcgacggcuucgccgagcuccagauggacaagcucgacgucgucgacuccuucggcaccguccccuuccucgacuacaagcacuucgcccuccgcaccuucuuccccgaguccggcggcuucacccacaucuucaccgaggacaugcacaaccgcgacgccaacgacaagaacgagucccucaccgcccucgacgcccucaucugcaacaaguccuuccucgucaccgucauccacacccucgagaagcagaagaacuucuccgucaaggaccgcugccucuucgccuccuuccucaccaucgcccuccagaccaagcucgucuaccucaccuccauccucgagguccucacccgcgaccucauggagcagugcuccaacaugcagcccaagcucaugcuccgccgcaccgaguccgucgucgagaagcuccucaccaacuggauguccgucugccucuccggcuuccuccgcgagaccgucggcgagcccuucuaccuccucgucaccacccucaaccagaagaucaacaagggccccgucgacgucaucaccugcaaggcccucuacacccucaacgaggacuggcuccucuggcagguccccgaguucuccaccgucgcccucaacgucgucuucgagaagauccccgagaacgaguccgccgacgucugccgcaacaucuccgucaacguccucgacugcgacaccaucggccaggccaaggagaagaucuuccaggccuuccucuccaagaacggcucccccuacggccuccagcucaacgagaucggccucgagcuccagaugggcacccgccagaaggagcuccucgacaucgacuccuccuccgucauccucgaggacggcaucaccaagcucaacaccaucggccacuacgagaucuccaacggcuccaccaucaaggucuucaagaagaucgccaacuucaccuccgacgucgaguacuccgacgaccacugccaccucauccuccccgacuccgaggccuuccaggacguccagggcaagcgccaccgcggcaagcacaaguucaaggucaaggagauguaccucaccaagcuccucuccaccaaggucgccauccacuccguccucgagaagcucuuccgcuccaucuggucccuccccaacucccgcgcccccuucgccaucaaguacuucuucgacuuccucgacgcccaggccgagaacaagaagaucaccgaccccgacgucguccacaucuggaagaccaacucccucccccuccgcuucugggucaacauccucaagaacccccaguucgucuucgacaucaagaagaccccccacaucgacggcugccucuccgucaucgcccaggccuucauggacgccuucucccucaccgagcagcagcucggcaaggaggcccccaccaacaagcuccucuacgccaaggacauccccaccuacaaggaggaggucaaguccuacuacaaggccauccgcgaccuccccccccucuccuccuccgagauggaggaguuccucacccaggaguccaagaagcacgagaacgaguucaacgaggaggucgcccucaccgagaucuacaaguacaucgucaaguacuucgacgagauccucaacaagcucgagcgcgagcgcggccucgaggaggcccagaagcagcuccuccacgucaagguccucuucgacgagaagaagaagugcaaguggauguga

SEQ ID NO: 47817 - RNA, 5778 nt, Artificial Sequence
  derived and/or modified sequence opt2 from PLXND1__Homo_sapiens__NP_055918
auggccccccgcgccgccggcggcgccccccucuccgcccgcgccgccgccgccucccccccccccuuccagacccccccccgcugccccgucccccuccuccuccuccuccuccucggcgccgcccgcgccggcgcccucgagauccagcgccgcuuccccucccccacccccaccaacaacuucgcccucgacggcgccgccggcaccgucuaccucgccgccgucaaccgccucuaccagcucuccggcgccaaccucucccucgaggccgaggccgccgucggccccguccccgacuccccccucugccacgccccccagcucccccaggccuccugcgagcacccccgccgccucaccgacaacuacaacaagauccuccagcucgaccccggccagggccucgucgucgucugcggcuccaucuaccagggcuucugccagcuccgccgccgcggcaacaucuccgccgucgccguccgcuucccccccgccgccccccccgccgagcccgucaccgucuuccccuccaugcucaacgucgccgccaaccaccccaacgccuccaccgucggccucguccucccccccgccgccggcgccggcggcucccgccuccucgucggcgccaccuacaccggcuacggcuccuccuucuucccccgcaaccgcucccucgaggaccaccgcuucgagaacacccccgagaucgccauccgcucccucgacacccgcggcgaccucgccaagcucuucaccuucgaccucaaccccuccgacgacaacauccucaagaucaagcagggcgccaaggagcagcacaagcucggcuucgucuccgccuuccuccaccccuccgaccccccccccggcgcccaguccuacgccuaccucgcccucaacuccgaggcccgcgccggcgacaaggagucccaggcccgcucccuccucgcccgcaucugccucccccacggcgccggcggcgacgccaagaagcucaccgaguccuacauccagcucggccuccagugcgccggcggcgccggccgcggcgaccucuacucccgccucgucuccgucuuccccgcccgcgagcgccucuucgccgucuucgagcgcccccagggcucccccgccgcccgcgccgcccccgccgcccucugcgccuuccgcuucgccgacguccgcgccgccauccgcgccgcccgcaccgccugcuucgucgagcccgcccccgacgucgucgccguccucgacuccgucguccagggcaccggccccgccugcgagcgcaagcucaacauccagcuccagcccgagcagcucgacugcggcgccgcccaccuccagcacccccucuccauccuccagccccucaaggccacccccgucuuccgcgcccccggccucaccuccgucgccgucgccuccgucaacaacuacaccgccgucuuccucggcaccgucaacggccgccuccucaagaucaaccucaacgaguccaugcaggucgucucccgccgcgucgucaccgucgccuacggcgagcccguccaccacgucaugcaguucgaccccgccgacuccggcuaccucuaccucaugaccucccaccagauggcccgcgucaaggucgccgccugcaacguccacuccaccugcggcgacugcgucggcgccgccgacgccuacugcggcuggugcgcccucgagacccgcugcacccuccagcaggacugcaccaacuccucccagcagcacuucuggaccuccgccuccgagggccccucccgcugccccgccaugaccguccuccccuccgagaucgacguccgccaggaguaccccggcaugauccuccagaucuccggcucccuccccucccucuccggcauggagauggccugcgacuacggcaacaacauccgcaccgucgcccgcguccccggccccgccuucggccaccagaucgccuacugcaaccuccucccccgcgaccaguucccccccuucccccccaaccaggaccacgucaccgucgagauguccguccgcgucaacggccgcaacaucgucaaggccaacuucaccaucuacgacugcucccgcaccgcccaggucuacccccacaccgccugcaccuccugccucuccgcccaguggcccugcuucuggugcucccagcagcacuccugcgucuccaaccagucccgcugcgaggccucccccaaccccaccuccccccaggacugcccccgcacccuccucuccccccucgcccccguccccaccggcggcucccagaacauccucgucccccucgccaacaccgccuucuuccagggcgccgcccucgagugcuccuucggccucgaggagaucuucgaggccgucugggucaacgaguccgucguccgcugcgaccaggucguccuccacaccacccgcaagucccaggucuucccccucucccuccagcucaagggccgccccgcccgcuuccucgacucccccgagcccaugaccgucauggucuacaacugcgccaugggcucccccgacugcucccagugccucggccgcgaggaccucggccaccucugcaugugguccgacggcugccgccuccgcggcccccuccagcccauggccggcaccugccccgcccccgagauccgcgccaucgagccccucuccggcccccucgacggcggcacccuccucaccauccgcggccgcaaccucggccgccgccucuccgacgucgcccacggcgucuggaucggcggcgucgccugcgagccccuccccgaccgcuacaccgucuccgaggagaucgucugcgucaccggccccgcccccggcccccucuccggcgucgucaccgucaacgccuccaaggagggcaagucccgcgaccgcuucuccuacguccucccccucguccacucccucgagcccaccaugggccccaaggccggcggcacccgcaucaccauccacggcaacgaccuccacgucggcuccgagcuccagguccucgucaacgacaccgaccccugcaccgagcucaugcgcaccgacaccuccaucgccugcaccaugcccgagggcgcccuccccgcccccguccccgucugcguccgcuucgagcgccgcggcugcguccacggcaaccucaccuucugguacaugcagaaccccgucaucaccgccaucuccccccgccgcucccccgucuccggcggccgcaccaucaccgucgccggcgagcgcuuccacaugguccagaacgucuccauggccguccaccacaucggccgcgagcccacccucugcaagguccucaacuccacccucaucaccugccccucccccggcgcccucuccaacgccuccgcccccgucgacuucuucaucaacggccgcgccuacgccgacgaggucgccgucgccgaggagcuccucgaccccgaggaggcccagcgcggcucccgcuuccgccucgacuaccuccccaacccccaguucuccaccgccaagcgcgagaaguggaucaagcaccaccccggcgagccccucacccucgucauccacaaggagcaggacucccucggccuccagucccacgaguaccgcgucaagaucggccaggucuccugcgacauccagaucgucuccgaccgcaucauccacugcuccgucaacgagucccucggcgccgccgucggccagcuccccaucaccauccaggucggcaacuucaaccagaccaucgccacccuccagcucggcggcuccgagaccgccaucaucgucuccaucgucaucugcuccguccuccuccuccucuccgucgucgcccucuucgucuucugcaccaagucccgccgcgccgagcgcuacuggcagaagacccuccuccagauggaggagauggagucccagauccgcgaggagauccgcaagggcuucgccgagcuccagaccgacaugaccgaccucaccaaggagcucaaccgcucccagggcauccccuuccucgaguacaagcacuucgucacccgcaccuucuuccccaagugcuccucccucuacgaggagcgcuacguccuccccucccagacccucaacucccagggcuccucccaggcccaggagacccacccccuccucggcgaguggaagauccccgaguccugccgccccaacauggaggagggcaucucccucuucuccucccuccucaacaacaagcacuuccucaucgucuucguccacgcccucgagcagcagaaggacuucgccguccgcgaccgcugcucccucgccucccuccucaccaucgcccuccacggcaagcucgaguacuacaccuccaucaugaaggagcuccucgucgaccucaucgacgccuccgccgccaagaaccccaagcucaugcuccgccgcaccgaguccgucgucgagaagaugcucaccaacuggauguccaucugcauguacuccugccuccgcgagaccgucggcgagcccuucuuccuccuccucugcgccaucaagcagcagaucaacaagggcuccaucgacgccaucaccggcaaggcccgcuacacccucaacgaggaguggcuccuccgcgagaacaucgaggccaagccccgcaaccucaacgucuccuuccagggcugcggcauggacucccucuccguccgcgccauggacaccgacacccucacccaggucaaggagaagauccucgaggccuucugcaagaacguccccuacucccaguggccccgcgccgaggacgucgaccucgagugguucgccuccuccacccaguccuacauccuccgcgaccucgacgacaccuccgucgucgaggacggccgcaagaagcucaacacccucgcccacuacaagauccccgagggcgccucccucgccaugucccucaucgacaagaaggacaacacccucggccgcgucaaggaccucgacaccgagaaguacuuccaccucguccuccccaccgacgagcucgccgagcccaagaagucccaccgccagucccaccgcaagaagguccuccccgagaucuaccucacccgccuccucuccaccaagggcacccuccagaaguuccucgacgaccucuucaaggccauccucuccauccgcgaggacaagcccccccucgccgucaaguacuucuucgacuuccucgaggagcaggccgagaagcgcggcaucuccgaccccgacacccuccacaucuggaagaccaacucccucccccuccgcuucugggucaacauccucaagaacccccaguucgucuucgacaucgacaagaccgaccacaucgacgccugccucuccgucaucgcccaggccuucaucgacgccugcuccaucuccgaccuccagcucggcaaggacucccccaccaacaagcuccucuacgccaaggagauccccgaguaccgcaagaucguccagcgcuacuacaagcagauccaggacaugaccccccucuccgagcaggagaugaacgcccaccucgccgaggagucccgcaaguaccagaacgaguucaacaccaacgucgccauggccgagaucuacaaguacgccaagcgcuaccgcccccagaucauggccgcccucgaggccaaccccaccgcccgccgcacccagcuccagcacaaguucgagcaggucgucgcccucauggaggacaacaucuacgagugcuacuccgaggccuga

SEQ ID NO: 47818 - RNA, 1509 nt, Artificial Sequence
  derived and/or modified sequence opt2 from PM20D1__Homo_sapiens__NP_689704
auggcccagcgcugcgucugcguccucgcccucgucgccaugcuccuccucgucuuccccaccgucucccgcuccaugggcccccgcuccggcgagcaccagcgcgccucccgcauccccucccaguucuccaaggaggagcgcgucgccaugaaggaggcccucaagggcgccauccagauccccaccgucaccuucuccuccgagaaguccaacaccaccgcccucgccgaguucggcaaguacauccacaaggucuuccccaccgucgucuccaccuccuucauccagcacgaggucgucgaggaguacucccaccucuucaccauccagggcuccgaccccucccuccagcccuaccuccucauggcccacuucgacgucguccccgcccccgaggagggcugggaggucccccccuucuccggccucgagcgcgacggcaucaucuacggccgcggcacccucgacgacaagaacuccgucauggcccuccuccaggcccucgagcuccuccucauccgcaaguacaucccccgccgcuccuucuucaucucccucggccacgacgaggaguccuccggcaccggcgcccagcgcaucuccgcccuccuccagucccgcggcguccagcucgccuucaucgucgacgagggcggcuucauccucgacgacuucauccccaacuucaagaagcccaucgcccucaucgccgucuccgagaagggcuccaugaaccucaugcuccaggucaacaugaccuccggccacuccuccgccccccccaaggagaccuccaucggcauccucgccgccgccgucucccgccucgagcagacccccaugcccaucaucuucggcuccggcaccgucgucaccguccuccagcagcucgccaacgaguuccccuuccccgucaacaucauccucuccaaccccuggcucuucgagccccucaucucccgcuucauggagcgcaacccccucaccaacgccaucauccgcaccaccaccgcccucaccaucuucaaggccggcgucaaguucaacgucaucccccccgucgcccaggccaccgucaacuuccgcauccaccccggccagaccguccaggagguccucgagcucaccaagaacaucgucgccgacaaccgcguccaguuccacguccucuccgccuucgacccccuccccgucucccccuccgacgacaaggcccucggcuaccagcuccuccgccagaccguccaguccgucuuccccgaggucaacaucaccgcccccgucaccuccaucggcaacaccgacucccgcuucuucaccaaccucaccaccggcaucuaccgcuucuaccccaucuacauccagcccgaggacuucaagcgcauccacggcgucaacgagaagaucuccguccaggccuacgagacccaggucaaguucaucuucgagcucauccagaacgccgacaccgaccaggagcccgucucccaccuccacaagcucuga

SEQ ID NO: 47819 - RNA, 165 nt, Artificial Sequence
  derived and/or modified sequence opt2 from PMAIP1__Homo_sapiens__NP_066950
augcccggcaagaaggcccgcaagaacgcccagcccucccccgcccgcgcccccgccgagcucgaggucgagugcgccacccagcuccgccgcuucggcgacaagcucaacuuccgccagaagcuccucaaccucaucuccaagcucuucugcuccggcaccuga

SEQ ID NO: 47820 - RNA, 498 nt, Artificial Sequence
  derived and/or modified sequence opt2 from PMCH__Homo_sapiens__NP_002665
auggccaagaugaaccucuccuccuacauccucauccucaccuucucccucuucucccagggcauccuccucuccgccuccaaguccauccgcaaccucgacgacgacauggucuucaacaccuuccgccucggcaagggcuuccagaaggaggacaccgccgagaaguccgucaucgcccccucccucgagcaguacaagaacgacgaguccuccuucaugaacgaggaggagaacaaggucuccaagaacaccggcuccaagcacaacuuccucaaccacggccucccccucaaccucgccaucaagcccuaccucgcccucaagggcuccgucgccuuccccgccgagaacggcguccagaacaccgaguccacccaggagaagcgcgagaucggcgacgaggagaacuccgccaaguuccccaucggccgccgcgacuucgacaugcuccgcugcaugcucggccgcgucuaccgccccugcuggcaggucuga

SEQ ID NO: 47821 - RNA, 1728 nt, Artificial Sequence
  derived and/or modified sequence opt2 from PMEL__Homo_sapiens__NP_001186982
auggaccucguccucaagcgcugccuccuccaccucgccgucaucggcgcccuccucgccgucggcgccaccaagggcucccaggucuggggcggccagcccgucuacccccaggagaccgacgacgccugcaucuuccccgacggcggccccugccccuccggcuccuggucccagaagcgcuccuucgucuacgucuggaagaccuggggccaguacuggcagguccucggcggccccgucuccggccucuccaucggcaccggccgcgccaugcucggcacccacaccauggaggucaccgucuaccaccgccgcggcucccgcuccuacgucccccucgcccacuccuccuccgccuucaccaucaccgaccagguccccuucuccgucuccgucucccagcuccgcgcccucgacggcggcaacaagcacuuccuccgcaaccagccccucaccuucgcccuccagcuccacgaccccuccggcuaccucgccgaggccgaccucuccuacaccugggacuucggcgacuccuccggcacccucaucucccgcgcccucgucgucacccacaccuaccucgagcccggccccgucaccgcccaggucguccuccaggccgccaucccccucaccuccugcggcuccucccccguccccggcaccaccgacggccaccgccccaccgccgaggcccccaacaccaccgccggccagguccccaccaccgaggucgucggcaccacccccggccaggcccccaccgccgagcccuccggcaccaccuccguccagguccccaccaccgaggucaucuccaccgcccccguccagaugcccaccgccgaguccaccggcaugacccccgagaagguccccgucuccgaggucaugggcaccacccucgccgagauguccacccccgaggccaccggcaugacccccgccgaggucuccaucgucguccucuccggcaccaccgccgcccaggucaccaccaccgagugggucgagaccaccgcccgcgagcuccccauccccgagcccgagggccccgacgccuccuccaucauguccaccgaguccaucaccggcucccucggcccccuccucgacggcaccgccacccuccgccucgucaagcgccaggucccccucgacugcguccucuaccgcuacggcuccuucuccgucacccucgacaucguccagggcaucgaguccgccgagauccuccaggccguccccuccggcgagggcgacgccuucgagcucaccgucuccugccagggcggccuccccaaggaggccugcauggagaucuccucccccggcugccagccccccgcccagcgccucugccagcccguccuccccucccccgccugccagcucguccuccaccagauccucaagggcggcuccggcaccuacugccucaacgucucccucgccgacaccaacucccucgccgucgucuccacccagcucaucaugcccggccaggaggccggccucggccaggucccccucaucgucggcauccuccucguccucauggccgucguccucgccucccucaucuaccgccgccgccucaugaagcaggacuucuccgucccccagcucccccacuccuccucccacuggcuccgccucccccgcaucuucugcuccugccccaucggcgagaacuccccccuccucuccggccagcaggucuga

SEQ ID NO: 47822 - RNA, 780 nt, Artificial Sequence
  derived and/or modified sequence opt2 from PMEPA1__Homo_sapiens__NP_001242905
augcccgccauccccgcccacggcgccgagcucgaguucguccagaucaucaucaucgucgucgucaugauggucauggucgucgucaucaccugccuccucucccacuacaagcucuccgcccgcuccuucaucucccgccacucccagggccgccgccgcgaggacgcccucuccuccgagggcugccucuggcccuccgaguccaccgucuccggcaacggcauccccgagccccaggucuacgcccccccccgccccaccgaccgccucgccgucccccccuucgcccagcgcgagcgcuuccaccgcuuccagcccaccuaccccuaccuccagcacgagaucgaccucccccccaccaucucccucuccgacggcgaggagcccccccccuaccagggccccugcacccuccagcuccgcgaccccgagcagcagcucgagcucaaccgcgaguccguccgcgccccccccaaccgcaccaucuucgacuccgaccucauggacuccgcccgccucggcggccccugcccccccuccuccaacuccggcaucuccgccaccugcuacggcuccggcggccgcauggagggccccccccccaccuacuccgaggucaucggccacuaccccggcuccuccuuccagcaccagcaguccuccggcccccccucccuccucgagggcacccgccuccaccacacccacaucgccccccucgaguccgccgccaucugguccaaggagaaggacaagcagaagggccacccccucuga

SEQ ID NO: 47823 - RNA, 663 nt, Artificial Sequence
  derived and/or modified sequence opt2 from PMF1-BGLAP__Homo_sapiens__NP_001186590
auggccgaggccuccuccgccaaccucggcuccggcugcgaggagaagcgccacgagggcuccuccuccgaguccgucccccccggcaccaccaucucccgcgucaagcuccucgacaccauggucgacaccuuccuccagaagcucgucgccgccggcuccuaccagcgcuucaccgacugcuacaagugcuucuaccagcuccagcccgccaugacccagcagaucuacgacaaguucaucgcccagcuccagaccuccauccgcgaggagaucuccgacaucaaggaggagggcaaccucgaggccguccucaacgcccucgacaagaucgucgaggagggcaagguccgcaaggagcccgccugcaacggcacccccugcggcgccaugugccgcaaccgccgcccccgcaccuccuccuggcagaugcccuccuggcagggcggcggccgcuggcgcuccugcuccuaccgcucccgccccuccucccgccccggccgcugcgaggcccagcgcugccgcguccagcagcgcugcucccucugcguccaggccggcggccagcgcggcuccgaggagacccaggcccuccccgucuccauggccggcucccccuccccccuccccggcucccccggcgcccaggagggcggcgucuga

SEQ ID NO: 47824 - RNA, 543 nt, Artificial Sequence
  derived and/or modified sequence opt2 from PMF1__Homo_sapiens__NP_001186582
auggccgaggccuccuccgccaaccucggcuccggcugcgaggagaagcgccacgagggcuccuccuccgaguccgucccccccggcaccaccaucucccgcgucaagcuccucgacaccauggucgacaccuuccuccagaagcucgucgccgccggcuccuaccagcgcuucaccgacugcuacaagugcuucuaccagcuccagcccgccaugacccagcagaucuacgacaaguucaucgcccagcuccagaccuccauccgcgaggagaucuccgacaucaaggaggagggcaaccucgaggccguccucaacgcccucgacaagaucgucgaggagggcaagguccgcaaggagcccgccugcaacggcacccccugcggcgccaugugccgcaaccgccgcccccgcaccuccuccuggcagaugcccuccuggcagggcggcggccgcuggcgcuccugcuccuaccgcucccgccccuccucccgccccggccgccucuacaccgagaaccgcggcuccuggcuccucugcuga

SEQ ID NO: 47825 - RNA, 1902 nt, Artificial Sequence
  derived and/or modified sequence opt2 from PML__Homo_sapiens__NP_002666
auggagcccgcccccgcccgcuccccccgcccccagcaggaccccgcccgcccccaggagcccaccaugcccccccccgagacccccuccgagggccgccagcccucccccucccccucccccaccgagcgcgcccccgccuccgaggaggaguuccaguuccuccgcugccagcagugccaggccgaggccaagugccccaagcuccuccccugccuccacacccucugcuccggcugccucgaggccuccggcaugcagugccccaucugccaggcccccuggccccucggcgccgacacccccgcccucgacaacgucuucuucgagucccuccagcgccgccucuccgucuaccgccagaucgucgacgcccaggccgucugcacccgcugcaaggaguccgccgacuucuggugcuucgagugcgagcagcuccucugcgccaagugcuucgaggcccaccagugguuccucaagcacgaggcccgcccccucgccgagcuccgcaaccaguccguccgcgaguuccucgacggcacccgcaagaccaacaacaucuucugcuccaaccccaaccaccgcacccccacccucaccuccaucuacugccgcggcugcuccaagccccucugcugcuccugcgcccuccucgacuccucccacuccgagcucaagugcgacaucuccgccgagauccagcagcgccaggaggagcucgacgccaugacccaggcccuccaggagcaggacuccgccuucggcgccguccacgcccagaugcacgccgccgucggccagcucggccgcgcccgcgccgagaccgaggagcucauccgcgagcgcguccgccaggucgucgcccacguccgcgcccaggagcgcgagcuccucgaggccgucgacgcccgcuaccagcgcgacuacgaggagauggccucccgccucggccgccucgacgccguccuccagcgcauccgcaccggcuccgcccucguccagcgcaugaagugcuacgccuccgaccaggagguccucgacaugcacggcuuccuccgccaggcccucugccgccuccgccaggaggagccccagucccuccaggccgccguccgcaccgacggcuucgacgaguucaagguccgccuccaggaccucuccuccugcaucacccagggcaaggacgccgccgucuccaagaaggccucccccgaggccgccuccaccccccgcgaccccaucgacgucgaccuccccgaggaggccgagcgcgucaaggcccagguccaggcccucggccucgccgaggcccagcccauggccgucguccaguccguccccggcgcccaccccguccccgucuacgccuucuccaucaagggccccuccuacggcgaggacgucuccaacaccaccaccgcccagaagcgcaagugcucccagacccagugcccccgcaaggucaucaagauggaguccgaggagggcaaggaggcccgccucgcccgcuccucccccgagcagccccgccccuccaccuccaaggccgucucccccccccaccucgacggcccccccuccccccgcucccccgucaucggcuccgaggucuuccuccccaacuccaaccacgucgccuccggcgccggcgaggccgaggagcgcgucgucgucaucuccuccuccgaggacuccgacgccgagaacuccuccucccgcgagcucgacgacuccuccuccgaguccuccgaccuccagcucgagggccccuccacccuccgcguccucgacgagaaccucgccgacccccaggccgaggaccgcccccucgucuucuucgaccucaagaucgacaacgaguccggcuucuccuggggcuacccccaccccuuccucaucuga

SEQ ID NO: 47826 - RNA, 789 nt, Artificial Sequence
  derived and/or modified sequence opt2 from PMM1__Homo_sapiens__NP_002667
auggccgucaccgcccaggccgcccgccgcaaggagcgcguccucugccucuucgacgucgacggcacccucacccccgcccgccagaagaucgaccccgaggucgccgccuuccuccagaagcuccgcucccgcguccagaucggcgucgucggcggcuccgacuacugcaagaucgccgagcagcucggcgacggcgacgaggucaucgagaaguucgacuacgucuucgccgagaacggcaccguccaguacaagcacggccgccuccucuccaagcagaccauccagaaccaccucggcgaggagcuccuccaggaccucaucaacuucugccucuccuacauggcccuccuccgccuccccaagaagcgcggcaccuucaucgaguuccgcaacggcaugcucaacaucucccccaucggccgcuccugcacccucgaggagcgcaucgaguucuccgagcucgacaagaaggagaagauccgcgagaaguucgucgaggcccucaagaccgaguucgccggcaagggccuccgcuucucccgcggcggcaugaucuccuucgacgucuuccccgagggcugggacaagcgcuacugccucgacucccucgaccaggacuccuucgacaccauccacuucuucggcaacgagaccucccccggcggcaacgacuucgagaucuucgccgacccccgcaccgucggccacuccgucgucuccccccaggacaccguccagcgcugccgcgagaucuucuuccccgagaccgcccacgaggccuga

SEQ ID NO: 47827 - RNA, 741 nt, Artificial Sequence
  derived and/or modified sequence opt2 from PMM2__Homo_sapiens__NP_000294
auggccgcccccggccccgcccucugccucuucgacgucgacggcacccucaccgccccccgccagaagaucaccaaggagauggacgacuuccuccagaagcuccgccagaagaucaagaucggcgucgucggcggcuccgacuucgagaagguccaggagcagcucggcaacgacgucgucgagaaguacgacuacgucuuccccgagaacggccucgucgccuacaaggacggcaagcuccucugccgccagaacauccagucccaccucggcgaggcccucauccaggaccucaucaacuacugccucuccuacaucgccaagaucaagcuccccaagaagcgcggcaccuucaucgaguuccgcaacggcaugcucaacgucucccccaucggccgcuccugcucccaggaggagcgcaucgaguucuacgagcucgacaagaaggagaacauccgccagaaguucgucgccgaccuccgcaaggaguucgccggcaagggccucaccuucuccaucggcggccagaucuccuucgacgucuuccccgacggcugggacaagcgcuacugccuccgccacgucgagaacgacggcuacaagaccaucuacuucuucggcgacaagaccaugcccggcggcaacgaccacgagaucuucaccgacccccgcaccaugggcuacuccgucaccgcccccgaggacacccgccgcaucugcgagcuccucuucuccuga

SEQ ID NO: 47828 - RNA, 483 nt, Artificial Sequence
  derived and/or modified sequence opt2 from PMP22__Homo_sapiens__NP_000295
augcuccuccuccuccucuccaucaucguccuccacgucgccguccucguccuccucuucgucuccaccaucgucucccaguggaucgucggcaacggccacgccaccgaccucuggcagaacugcuccaccuccuccuccggcaacguccaccacugcuucuccuccucccccaacgaguggcuccaguccguccaggccaccaugauccucuccaucaucuucuccauccucucccucuuccucuucuucugccagcucuucacccucaccaagggcggccgcuucuacaucaccggcaucuuccagauccucgccggccucugcgucauguccgccgccgccaucuacaccguccgccaccccgaguggcaccucaacuccgacuacuccuacggcuucgccuacauccucgccugggucgccuucccccucgcccuccucuccggcgucaucuacgucauccuccgcaagcgcgaguga

SEQ ID NO: 47829 - RNA, 1185 nt, Artificial Sequence
  derived and/or modified sequence opt2 from PMPCA__Homo_sapiens__NP_001269873
augaagcgcaacacccucgucgagcuccucaccuucuggaagaacuggcacuuccgccuccuccucgaccucaccgccaagaugaaguucugccuccgcuggaaguccaugggcgucuccgucaccgcccgccaccaggacgaggaggucgagaugacccgcauggccguccaguucgagcucgaggaccucaaccuccgccccgaccccgagccccuccucaccgagaugauccacgaggccgccuaccgcgagaacaccgucggccuccaccgcuucugccccaccgagaacgucgccaagaucaaccgcgagguccuccacuccuaccuccgcaacuacuacacccccgaccgcaugguccucgccggcgucggcgucgagcacgagcaccucgucgacugcgcccgcaaguaccuccucggcguccagcccgccuggggcuccgccgaggccgucgacaucgaccgcuccgucgcccaguacaccggcggcaucgccaagcucgagcgcgacauguccaacgucucccucggccccacccccauccccgagcucacccacaucauggucggccucgaguccugcuccuuccucgaggaggacuucauccccuucgccguccucaacaugaugaugggcggcggcggcuccuucuccgccggcggccccggcaagggcauguucucccgccucuaccucaacguccucaaccgccaccacuggauguacaacgccaccuccuaccaccacuccuacgaggacaccggccuccucugcauccacgccuccgccgacccccgccagguccgcgagauggucgagaucaucaccaaggaguucauccucaugggcggcaccgucgacaccgucgagcucgagcgcgccaagacccagcucaccuccaugcucaugaugaaccucgagucccgccccgucaucuucgaggacgucggccgccagguccucgccacccgcucccgcaagcucccccacgagcucugcacccucauccgcaacgucaagcccgaggacgucaagcgcgucgccuccaagaugcuccgcggcaagcccgccgucgccgcccucggcgaccucaccgaccuccccaccuacgagcacauccagaccgcccucuccuccaaggacggccgccucccccgcaccuaccgccucuuccgcuga

SEQ ID NO: 47830 - RNA, 1470 nt, Artificial Sequence
  derived and/or modified sequence opt2 from PMPCB__Homo_sapiens__NP_004270
auggccgccgccgccgcccgcgucguccucuccuccgccgcccgccgccgccucuggggcuucuccgagucccuccucauccgcggcgccgccggccgcucccucuacuucggcgagaaccgccuccgcuccacccaggccgccacccaggucguccucaacguccccgagacccgcgucaccugccucgaguccggccuccgcgucgccuccgaggacuccggccucuccaccugcaccgucggccucuggaucgacgccggcucccgcuacgagaacgagaagaacaacggcaccgcccacuuccucgagcacauggccuucaagggcaccaagaagcgcucccagcucgaccucgagcucgagaucgagaacaugggcgcccaccucaacgccuacaccucccgcgagcagaccgucuacuacgccaaggccuucuccaaggaccucccccgcgccgucgagauccucgccgacaucauccagaacuccacccucggcgaggccgagaucgagcgcgagcgcggcgucauccuccgcgagaugcaggaggucgagaccaaccuccaggaggucgucuucgacuaccuccacgccaccgccuaccagaacaccgcccucggccgcaccauccucggccccaccgagaacaucaaguccaucucccgcaaggaccucgucgacuacaucaccacccacuacaagggcccccgcaucguccucgccgccgccggcggcgucucccacgacgagcuccucgaccucgccaaguuccacuucggcgacucccucugcacccacaagggcgagauccccgcccucccccccugcaaguucaccggcuccgagauccgcguccgcgacgacaagaugccccucgcccaccucgccaucgccgucgaggccgucggcugggcccaccccgacaccaucugccucauggucgccaacacccucaucggcaacugggaccgcuccuucggcggcggcaugaaccucuccuccaagcucgcccagcucaccugccacggcaaccucugccacuccuuccaguccuucaacaccuccuacaccgacaccggccucuggggccucuacauggucugcgaguccuccaccgucgccgacaugcuccacgucguccagaaggaguggaugcgccucugcaccuccgucaccgaguccgaggucgcccgcgcccgcaaccuccucaagaccaacaugcuccuccagcucgacggcuccacccccaucugcgaggacaucggccgccagaugcucugcuacaaccgccgcauccccauccccgagcucgaggcccgcaucgacgccgucaacgccgagaccauccgcgaggucugcaccaaguacaucuacaaccgcucccccgccaucgccgccgucggccccaucaagcagcuccccgacuucaagcagauccgcuccaacaugugcuggcuccgcgacuga

SEQ ID NO: 47831 - RNA, 2799 nt, Artificial Sequence
  derived and/or modified sequence opt2 from PMS1__Homo_sapiens__NP_000525
augaagcagcuccccgccgccaccguccgccuccucuccuccucccagaucaucaccuccgucgucuccgucgucaaggagcucaucgagaacucccucgacgccggcgccaccuccgucgacgucaagcucgagaacuacggcuucgacaagaucgagguccgcgacaacggcgagggcaucaaggccgucgacgcccccgucauggccaugaaguacuacaccuccaagaucaacucccacgaggaccucgagaaccucaccaccuacggcuuccgcggcgaggcccucggcuccaucugcugcaucgccgagguccucaucaccacccgcaccgccgccgacaacuucuccacccaguacguccucgacggcuccggccacauccucucccagaagcccucccaccucggccagggcaccaccgucaccgcccuccgccucuucaagaaccuccccguccgcaagcaguucuacuccaccgccaagaagugcaaggacgagaucaagaagauccaggaccuccucauguccuucggcauccucaagcccgaccuccgcaucgucuucguccacaacaaggccgucaucuggcagaagucccgcgucuccgaccacaagauggcccucauguccguccucggcaccgccgucaugaacaacauggaguccuuccaguaccacuccgaggagucccagaucuaccucuccggcuuccuccccaagugcgacgccgaccacuccuucaccucccucuccacccccgagcgcuccuucaucuucaucaacucccgccccguccaccagaaggacauccucaagcucauccgccaccacuacaaccucaagugccucaaggaguccacccgccucuaccccgucuucuuccucaagaucgacguccccaccgccgacgucgacgucaaccucacccccgacaagucccagguccuccuccagaacaaggaguccguccucaucgcccucgagaaccucaugaccaccugcuacggcccccuccccuccaccaacuccuacgagaacaacaagaccgacgucuccgccgccgacaucguccucuccaagaccgccgagaccgacguccucuucaacaaggucgaguccuccggcaagaacuacuccaacgucgacaccuccgucauccccuuccagaacgacaugcacaacgacgaguccggcaagaacaccgacgacugccucaaccaccagaucuccaucggcgacuucggcuacggccacugcuccuccgagaucuccaacaucgacaagaacaccaagaacgccuuccaggacaucuccauguccaacgucuccugggagaacucccagaccgaguacuccaagaccugcuucaucuccuccgucaagcacacccaguccgagaacggcaacaaggaccacaucgacgaguccggcgagaacgaggaggaggccggccucgagaacuccuccgagaucuccgccgacgaguggucccgcggcaacauccucaagaacuccgucggcgagaacaucgagcccgucaagauccucguccccgagaagucccuccccugcaaggucuccaacaacaacuaccccauccccgagcagaugaaccucaacgaggacuccugcaacaagaaguccaacgucaucgacaacaaguccggcaaggucaccgccuacgaccuccucuccaaccgcgucaucaagaagcccauguccgccuccgcccucuucguccaggaccaccgcccccaguuccucaucgagaaccccaagaccucccucgaggacgccacccuccagaucgaggagcucuggaagacccucuccgaggaggagaagcucaaguacgaggagaaggccaccaaggaccucgagcgcuacaacucccagaugaagcgcgccaucgagcaggagucccagaugucccucaaggacggccgcaagaagaucaagcccaccuccgccuggaaccucgcccagaagcacaagcucaagaccucccucuccaaccagcccaagcucgacgagcuccuccagucccagaucgagaagcgccgcucccagaacaucaagaugguccagauccccuucuccaugaagaaccucaagaucaacuucaagaagcagaacaaggucgaccucgaggagaaggacgagcccugccucauccacaaccuccgcuuccccgacgccuggcucaugaccuccaagaccgaggucaugcuccucaaccccuaccgcgucgaggaggcccuccucuucaagcgccuccucgagaaccacaagcuccccgccgagccccucgagaagcccaucaugcucaccgagucccucuucaacggcucccacuaccucgacguccucuacaagaugaccgccgacgaccagcgcuacuccggcuccaccuaccucuccgacccccgccucaccgccaacggcuucaagaucaagcucauccccggcgucuccaucaccgagaacuaccucgagaucgagggcauggccaacugccuccccuucuacggcgucgccgaccucaaggagauccucaacgccauccucaaccgcaacgccaaggaggucuacgagugccgcccccgcaaggucaucuccuaccucgagggcgaggccguccgccucucccgccagcuccccauguaccucuccaaggaggacauccaggacaucaucuaccgcaugaagcaccaguucggcaacgagaucaaggagugcguccacggccgccccuucuuccaccaccucaccuaccuccccgagaccaccuga

SEQ ID NO: 47832 - RNA, 2589 nt, Artificial Sequence
  derived and/or modified sequence opt2 from PMS2__Homo_sapiens__NP_000526
auggagcgcgccgaguccuccuccaccgagcccgccaaggccaucaagcccaucgaccgcaaguccguccaccagaucugcuccggccaggucguccucucccucuccaccgccgucaaggagcucgucgagaacucccucgacgccggcgccaccaacaucgaccucaagcucaaggacuacggcgucgaccucaucgaggucuccgacaacggcugcggcgucgaggaggagaacuucgagggccucacccucaagcaccacaccuccaagauccaggaguucgccgaccucacccaggucgagaccuucggcuuccgcggcgaggcccucuccucccucugcgcccucuccgacgucaccaucuccaccugccacgccuccgccaaggucggcacccgccucauguucgaccacaacggcaagaucauccagaagacccccuacccccgcccccgcggcaccaccgucuccguccagcagcucuucuccacccuccccguccgccacaaggaguuccagcgcaacaucaagaaggaguacgccaagaugguccagguccuccacgccuacugcaucaucuccgccggcauccgcgucuccugcaccaaccagcucggccagggcaagcgccagcccgucgucugcaccggcggcucccccuccaucaaggagaacaucggcuccgucuucggccagaagcagcuccagucccucauccccuucguccagcucccccccuccgacuccgucugcgaggaguacggccucuccugcuccgacgcccuccacaaccucuucuacaucuccggcuucaucucccagugcacccacggcgucggccgcuccuccaccgaccgccaguucuucuucaucaaccgccgccccugcgaccccgccaaggucugccgccucgucaacgaggucuaccacauguacaaccgccaccaguaccccuucgucguccucaacaucuccgucgacuccgagugcgucgacaucaacgucacccccgacaagcgccagauccuccuccaggaggagaagcuccuccucgccguccucaagaccucccucaucggcauguucgacuccgacgucaacaagcucaacgucucccagcagccccuccucgacgucgagggcaaccucaucaagaugcacgccgccgaccucgagaagcccauggucgagaagcaggaccagucccccucccuccgcaccggcgaggagaagaaggacgucuccaucucccgccuccgcgaggccuucucccuccgccacaccaccgagaacaagccccacucccccaagacccccgagccccgccgcuccccccucggccagaagcgcggcaugcucuccuccuccaccuccggcgccaucuccgacaagggcguccuccgcccccagaaggaggccgucuccuccucccacggccccuccgaccccaccgaccgcgccgaggucgagaaggacuccggccacggcuccaccuccgucgacuccgagggcuucuccauccccgacaccggcucccacugcuccuccgaguacgccgccuccucccccggcgaccgcggcucccaggagcacgucgacucccaggagaaggcccccaagaccgacgacuccuucuccgacgucgacugccacuccaaccaggaggacaccggcugcaaguuccgcguccucccccagcccaccaaccucgccacccccaacaccaagcgcuucaagaaggaggagauccucuccuccuccgacaucugccagaagcucgucaacacccaggacauguccgccucccaggucgacgucgccgucaagaucaacaagaaggucgucccccucgacuucuccauguccucccucgccaagcgcaucaagcagcuccaccacgaggcccagcaguccgagggcgagcagaacuaccgcaaguuccgcgccaagaucugccccggcgagaaccaggccgccgaggacgagcuccgcaaggagaucuccaagaccauguucgccgagauggagaucaucggccaguucaaccucggcuucaucaucaccaagcucaacgaggacaucuucaucgucgaccagcacgccaccgacgagaaguacaacuucgagaugcuccagcagcacaccguccuccagggccagcgccucaucgccccccagacccucaaccucaccgccgucaacgaggccguccucaucgagaaccucgagaucuuccgcaagaacggcuucgacuucgucaucgacgagaacgcccccgucaccgagcgcgccaagcucaucucccuccccaccuccaagaacuggaccuucggcccccaggacgucgacgagcucaucuucaugcucuccgacucccccggcgucaugugccgccccucccgcgucaagcagauguucgccucccgcgccugccgcaaguccgucaugaucggcaccgcccucaacaccuccgagaugaagaagcucaucacccacaugggcgagauggaccaccccuggaacugcccccacggccgccccaccaugcgccacaucgccaaccucggcgucaucucccagaacuga

SEQ ID NO: 47833 - RNA, 579 nt, Artificial Sequence
  derived and/or modified sequence opt2 from PMVK__Homo_sapiens__NP_006547
auggccccccucggcggcgccccccgccucguccuccucuucuccggcaagcgcaaguccggcaaggacuucgucaccgaggcccuccagucccgccucggcgccgacgucugcgccguccuccgccucuccggcccccucaaggagcaguacgcccaggagcacggccucaacuuccagcgccuccucgacaccuccaccuacaaggaggccuuccgcaaggacaugauccgcuggggcgaggagaagcgccaggccgaccccggcuucuucugccgcaagaucgucgagggcaucucccagcccaucuggcucgucuccgacacccgccgcgucuccgacauccagugguuccgcgaggccuacggcgccgucacccagaccguccgcgucgucgcccucgagcagucccgccagcagcgcggcugggucuucacccccggcgucgacgacgccgaguccgagugcggccucgacaacuucggcgacuucgacugggucaucgagaaccacggcgucgagcagcgccucgaggagcagcucgagaaccucaucgaguucauccgcucccgccucuga

SEQ ID NO: 47834 - RNA, 1281 nt, Artificial Sequence
  derived and/or modified sequence opt2 from PNCK__Homo_sapiens__NP_001034671
auggaggccgccuucggccaggucgccggcuccgccugcccccgccgcggcggcgagggccgcgacuggaaggccgagucccucgccgaccucuggcccaaguccucccccggcgacucccaccgcuggugcaagggccccggcgccggccccgccggcccccagcuccgcgaggccgcccgcgccuccuccggccucggcggcggcggccgccaccccucccgcauccccgccaucgcccuccaggacaugcuccuccucaagaagcacaccgaggacaucuccuccgucuacgagauccgcgagcgccucggcuccggcgccuucuccgaggucguccucgcccaggagcgcggcuccgcccaccucgucgcccucaagugcauccccaagaaggcccuccgcggcaaggaggcccucgucgagaacgagaucgccguccuccgccgcaucucccaccccaacaucgucgcccucgaggacguccacgagucccccucccaccucuaccucgccauggagcucgucaccggcggcgagcucuucgaccgcaucauggagcgcggcuccuacaccgagaaggacgccucccaccucgucggccagguccucggcgccgucuccuaccuccacucccucggcaucguccaccgcgaccucaagcccgagaaccuccucuacgccacccccuucgaggacuccaagaucauggucuccgacuucggccucuccaagauccaggccggcaacaugcucggcaccgccugcggcacccccggcuacgucgcccccgagcuccucgagcagaagcccuacggcaaggccgucgacgucugggcccucggcgucaucuccuacauccuccucugcggcuacccccccuucuacgacgaguccgaccccgagcucuucucccagauccuccgcgccuccuacgaguucgacucccccuucugggacgacaucuccgaguccgccaaggacuucauccgccaccuccucgagcgcgacccccagaagcgcuucaccugccagcaggcccuccgccaccucuggaucuccggcgacaccgccuucgaccgcgacauccucggcuccgucuccgagcagauccgcaagaacuucgcccgcacccacuggaagcgcgccuucaacgccaccuccuuccuccgccacauccgcaagcucggccagauccccgagggcgagggcgccuccgagcagggcauggcccgccacucccacuccggccuccgcgccggccagccccccaagugguga

SEQ ID NO: 47835 - RNA, 429 nt, Artificial Sequence
  derived and/or modified sequence opt2 from PNKD__Homo_sapiens__NP_001070867
auggccgccgucgucgccgccaccgcccucaagggccgcggcgcccgcaacgcccgcguccuccgcggcauccucgccggcgccaccgccaacaaggccucccacaaccgcacccgcgcccuccagucccacuccucccccgagggcaaggaggagcccgagccccucucccccgagcucgaguacaucccccgcaagcgcggcaagaaccccaugaaggccgucggccucgccugggccaucggcuuccccugcggcauccuccucuucauccucaccaagcgcgaggucgacaaggaccgcgucaagcagaugaaggcccgccagaacaugcgccucuccaacaccggcgaguacgagucccagcgcuuccgcgccuccucccaguccgcccccucccccgacgucggcuccggcguccagaccuga

SEQ ID NO: 47836 - RNA, 1566 nt, Artificial Sequence
  derived and/or modified sequence opt2 from PNKP__Homo_sapiens__NP_009185
augggcgaggucgaggcccccggccgccucuggcucgaguccccccccggcggcgccccccccaucuuccuccccuccgacggccaggcccucguccucggccgcggcccccucacccaggucaccgaccgcaagugcucccgcacccaggucgagcucgucgccgaccccgagacccgcaccgucgccgucaagcagcucggcgucaaccccuccaccaccggcacccaggagcucaagcccggccucgagggcucccucggcgucggcgacacccucuaccucgucaacggccuccacccccucacccuccgcugggaggagacccgcacccccgagucccagcccgacaccccccccggcaccccccucgucucccaggacgagaagcgcgacgccgagcuccccaagaagcgcaugcgcaaguccaaccccggcugggagaaccucgagaagcuccucgucuucaccgccgccggcgucaagccccagggcaaggucgccggcuucgaccucgacggcacccucaucaccacccgcuccggcaaggucuuccccaccggccccuccgacuggcgcauccucuaccccgagaucccccgcaagcuccgcgagcucgaggccgagggcuacaagcucgucaucuucaccaaccagauguccaucggccgcggcaagcuccccgccgaggaguucaaggccaaggucgaggccgucgucgagaagcucggcguccccuuccagguccucgucgccacccacgccggccucuaccgcaagcccgucaccggcaugugggaccaccuccaggagcaggccaacgacggcacccccaucuccaucggcgacuccaucuucgucggcgacgccgccggccgccccgccaacugggcccccggccgcaagaagaaggacuucuccugcgccgaccgccucuucgcccucaaccucggccuccccuucgccacccccgaggaguucuuccucaaguggcccgccgccggcuucgagcuccccgccuucgacccccgcaccgucucccgcuccggcccccucugccuccccgagucccgcgcccuccucuccgccucccccgaggucgucgucgccgucggcuuccccggcgccggcaaguccaccuuccucaagaagcaccucgucuccgccggcuacguccacgucaaccgcgacacccucggcuccuggcagcgcugcgucaccaccugcgagaccgcccucaagcagggcaagcgcgucgccaucgacaacaccaaccccgacgccgccucccgcgcccgcuacguccagugcgcccgcgccgccggcguccccugccgcugcuuccucuucaccgccacccucgagcaggcccgccacaacaaccgcuuccgcgagaugaccgacuccucccacauccccgucuccgacauggucauguacggcuaccgcaagcaguucgaggcccccacccucgccgagggcuucuccgccauccucgagauccccuuccgccucugggucgagccccgccucggccgccucuacugccaguucuccgagggcuga

SEQ ID NO: 47837 - RNA, 1596 nt, Artificial Sequence
  derived and/or modified sequence opt2 from PNLDC1__Homo_sapiens__NP_001258791
auggacgucggcgccgacgaguucgaggagucccucccccuccuccaggagcucguccaggaggccgacuucgucggccucgacaucgaguucaccggccuccgcuccaaccucuccggcccccagcagaucucccucuucgaccuccccuccgagugguaccucaagacccgccaguccguccagcaguucaccgucugccagaucggccucuccgucuucuccgccaucgagggcgaggccaacaaguacaucgcccacuccugcaacuucuaccucuuccccaccaccuucggcauccucgacuccgaguucuccuuccaggccuccuccguccaguuccucaaccaguacggcuucaacuacaacaaguuccucaagaacggcauccccuacaugaacgaggagcaggagaagaagauccgccacgacauccucaccggcaacuggcgcguccgcuccucccccgacaaggaccagaucaaggucgucaucgacgaggucacccgcuggcucgagcucgccaaggagggcgacuggaugacccuccccggcaucaccggcuuccaggccuucgagguccagcucguccuccgccaggcccuccccaacaucuggaccguccucaaggacgagggcgucgucgucaagaaggucuccaagcagcaccgcugguaccuccagaacaccuccugcgaccgcgaguccugcuggaaggagaacauccuccucuccgcccgcggcuucuccgucuucuuccagaugcucgucaaggcccagaagccccucgucggccacaacaugaugauggaccuccuccaccuccacgagaaguucuuccgcccccuccccgaguccuacgaccaguucaagcagaacauccacucccucuuccccguccucaucgacaccaaguccgucaccaaggacaucuggaaggagaugaacuucccccgcgucuccaaccucuccgaggucuacgagguccucaacuccgaccucaaccccaccaagaacuccggccccgagaucguccacgccucccgcugcgagaaguacgucgagaccaagugcccccacgaggccgccuacgacgccuuccucugcggcuccguccuccucaaggucgcccaccuccuccuccagaagaucuaccacaucgaccccguccccgaguccuccuucccccaguaccucgacguccucgcccccuacgucaaccaggucaaccucauccgcgccggcguccccaagaucaacuucuccggccccgacuaccccuccauccgcccccccauccucauccucuccgucaagcgcuggcccggcgucuccgagcagcaggucuaccacaaguuccagaaccucugcaaguucgacguccgccgccucacccgcucccaguuccuccuccucaccaacaaguucaaggacgcccgcaacauccucaaggaguaccgcgaccaccccacccucugcaucucccucuaccgcuacuggcgccacucccccaacgucaacugccuccuccaggucugcggcaucgucaccgccugggcccuccucgccuucauccucggccgcuccggcaccuga

SEQ ID NO: 47838 - RNA, 1398 nt, Artificial Sequence
  derived and/or modified sequence opt2 from PNLIP__Homo_sapiens__NP_000927
augcucccccucuggacccucucccuccuccucggcgccgucgccggcaaggaggucugcuacgagcgccucggcugcuucuccgacgacucccccugguccggcaucaccgagcgcccccuccacauccuccccuggucccccaaggacgucaacacccgcuuccuccucuacaccaacgagaaccccaacaacuuccaggaggucgccgccgacuccuccuccaucuccggcuccaacuucaagaccaaccgcaagacccgcuucaucauccacggcuucaucgacaagggcgaggagaacuggcucgccaacgucugcaagaaccucuucaaggucgaguccgucaacugcaucugcgucgacuggaagggcggcucccgcaccggcuacacccaggccucccagaacauccgcaucgucggcgccgaggucgccuacuucgucgaguuccuccaguccgccuucggcuacucccccuccaacguccacgucaucggccacucccucggcgcccacgccgccggcgaggccggccgccgcaccaacggcaccaucggccgcaucaccggccucgaccccgccgagcccugcuuccagggcacccccgagcucguccgccucgaccccuccgacgccaaguucgucgacgucauccacaccgacggcgcccccaucguccccaaccucggcuucggcaugucccaggucgucggccaccucgacuucuuccccaacggcggcgucgagaugcccggcugcaagaagaacauccucucccagaucgucgacaucgacggcaucugggagggcacccgcgacuucgccgccugcaaccaccuccgcuccuacaaguacuacaccgacuccaucgucaaccccgacggcuucgccggcuuccccugcgccuccuacaacgucuucaccgccaacaagugcuuccccugccccuccggcggcugcccccagaugggccacuacgccgaccgcuaccccggcaagaccaacgacgucggccagaaguucuaccucgacaccggcgacgccuccaacuucgcccgcuggcgcuacaaggucuccgucacccucuccggcaagaaggucaccggccacauccucgucucccucuucggcaacaagggcaacuccaagcaguacgagaucuucaagggcacccucaagcccgacuccacccacuccaacgaguucgacuccgacgucgacgucggcgaccuccagauggucaaguucaucugguacaacaacgucaucaaccccacccucccccgcgucggcgccuccaagaucaucgucgagaccaacgucggcaagcaguucaacuucugcucccccgagaccguccgcgaggagguccuccucacccucacccccugcuga

SEQ ID NO: 47839 - RNA, 1413 nt, Artificial Sequence
  derived and/or modified sequence opt2 from PNLIPRP2__Homo_sapiens__NP_005387
augaugcucccccccuggacccucggccuccuccuccucgccaccguccgcggcaaggaggucugcuacggccagcucggcugcuucuccgacgagaagcccugggccggcacccuccagcgccccgucaagcuccuccccuggucccccgaggacaucgacacccgcuuccuccucuacaccaacgagaaccccaacaacuuccagcucaucaccggcaccgagcccgacaccaucgaggccuccaacuuccagcucgaccgcaagacccgcuucaucauccacggcuuccucgacaaggccgaggacuccuggcccuccgacaugugcaagaagauguucgaggucgagaaggucaacugcaucugcgucgacuggcgccacggcucccgcgccauguacacccaggccguccagaacauccgcgucgucggcgccgagaccgccuuccucauccaggcccucuccacccagcucggcuacucccucgaggacguccacgucaucggccacucccucggcgcccacaccgccgccgaggccggccgccgccucggcggccgcgucggccgcaucaccggccucgaccccgccggccccugcuuccaggacgagcccgaggagguccgccucgaccccuccgacgccgucuucgucgacgucauccacaccgacuccucccccaucguccccucccucggcuucggcaugucccagaaggucggccaccucgacuucuuccccaacggcggcaaggagaugcccggcugcaagaagaacguccucuccaccaucaccgacaucgacggcaucugggagggcaucggcggcuucgucuccugcaaccaccuccgcuccuucgaguacuacuccuccuccguccucaaccccgacggcuuccucggcuaccccugcgccuccuacgacgaguuccaggaguccaagugcuuccccugccccgccgagggcugccccaagaugggccacuacgccgaccaguucaagggcaagaccuccgccgucgagcagaccuucuuccucaacaccggcgaguccggcaacuucaccuccuggcgcuacaaggucuccgucacccucuccggcaaggagaaggucaacggcuacauccgcaucgcccucuacggcuccaacgagaacuccaagcaguacgagaucuucaagggcucccucaagcccgacgccucccacaccugcgccaucgacgucgacuucaacgucggcaagauccagaaggucaaguuccucuggaacaagcgcggcaucaaccucuccgagcccaagcucggcgccucccagaucaccguccaguccggcgaggacggcaccgaguacaacuucugcuccuccgacaccgucgaggagaacguccuccagucccucuaccccugcuga

SEQ ID NO: 47840 - RNA, 1062 nt, Artificial Sequence
  derived and/or modified sequence opt2 from PNMA1__Homo_sapiens__NP_006020
auggccaugacccuccucgaggacuggugccgcggcauggacgucaacucccagcgcgcccuccucgucuggggcauccccgucaacugcgacgaggccgagaucgaggagacccuccaggccgccaugccccaggucuccuaccgcaugcucggccgcauguucuggcgcgaggagaacgccaaggccgcccuccucgagcucaccggcgccgucgacuacgccgccaucccccgcgagaugcccggcaagggcggcgucuggaagguccucuucaagccccccaccuccgacgccgaguuccucgagcgccuccaccucuuccucgcccgcgagggcuggaccguccaggacgucgcccgcguccucggcuuccagaaccccacccccacccccggccccgagaugcccgccgagaugcucaacuacauccucgacaacgucauccagccccucgucgaguccaucugguacaagcgccucacccucuucuccggccgcgacauccccggccccggcgaggagaccuucgaccccuggcucgagcacaccaacgagguccucgaggaguggcaggucuccgacgucgagaagcgccgccgccucauggagucccuccgcggccccgccgccgacgucauccgcauccucaaguccaacaaccccgccaucaccaccgccgagugccucaaggcccucgagcaggucuucggcuccgucgaguccucccgcgacgcccagaucaaguuccucaacaccuaccagaaccccggcgagaagcucuccgccuacgucauccgccucgagccccuccuccagaaggucgucgagaagggcgccaucgacaaggacaacgucaaccaggcccgccucgagcaggucaucgccggcgccaaccacuccggcgccauccgccgccagcucuggcucaccggcgccggcgagggccccgcccccaaccucuuccagcuccucguccagauccgcgaggaggaggccaaggaggaggaggaggaggccgaggccacccuccuccagcucggccucgagggccacuucuga

SEQ ID NO: 47841 - RNA, 1095 nt, Artificial Sequence
  derived and/or modified sequence opt2 from PNMA2__Homo_sapiens__NP_009188
auggcccucgcccuccucgaggacuggugccgcaucauguccgucgacgagcagaagucccucauggucaccggcauccccgccgacuucgaggaggccgagauccaggagguccuccaggagacccucaagucccucggccgcuaccgccuccucggcaagaucuuccgcaagcaggagaacgccaacgccguccuccucgagcuccucgaggacaccgacgucuccgccauccccuccgagguccagggcaagggcggcgucuggaaggucaucuucaagacccccaaccaggacaccgaguuccucgagcgccucaaccucuuccucgagaaggagggccagaccgucuccggcauguuccgcgcccucggccaggagggcgucucccccgccaccguccccugcaucucccccgagcuccucgcccaccuccucggccaggccauggcccacgccccccagccccuccuccccaugcgcuaccgcaagcuccgcgucuucuccggcuccgccguccccgcccccgaggaggaguccuucgaggucuggcucgagcaggccaccgagaucgucaaggaguggcccgucaccgaggccgagaagaagcgcuggcucgccgagucccuccgcggccccgcccucgaccucaugcacaucguccaggccgacaaccccuccaucuccgucgaggagugccucgaggccuucaagcaggucuucggcucccucgagucccgccgcaccgcccagguccgcuaccucaagaccuaccaggaggagggcgagaaggucuccgccuacguccuccgccucgagacccuccuccgccgcgccgucgagaagcgcgccaucccccgccgcaucgccgaccagguccgccucgagcaggucauggccggcgccacccucaaccagaugcucuggugccgccuccgcgagcucaaggaccagggccccccccccuccuuccucgagcucaugaaggucauccgcgaggaggaggaggaggaggccuccuucgagaacgaguccaucgaggagcccgaggagcgcgacggcuacggccgcuggaaccacgagggcgacgacuga

SEQ ID NO: 47842 - RNA, 849 nt, Artificial Sequence
  derived and/or modified sequence opt2 from PNMT__Homo_sapiens__NP_002677
auguccggcgccgaccgcucccccaacgccggcgccgcccccgacuccgcccccggccaggccgccgucgccuccgccuaccagcgcuucgagccccgcgccuaccuccgcaacaacuacgcccccccccgcggcgaccucugcaaccccaacggcgucggccccuggaagcuccgcugccucgcccagaccuucgccaccggcgaggucuccggccgcacccucaucgacaucggcuccggccccaccgucuaccagcuccucuccgccugcucccacuucgaggacaucaccaugaccgacuuccucgaggucaaccgccaggagcucggccgcuggcuccaggaggagcccggcgccuucaacugguccauguacucccagcacgccugccucaucgagggcaagggcgagugcuggcaggacaaggagcgccagcuccgcgcccgcgucaagcgcguccuccccaucgacguccaccagccccagccccucggcgccggcucccccgccccccuccccgccgacgcccucgucuccgccuucugccucgaggccgucucccccgaccucgccuccuuccagcgcgcccucgaccacaucaccacccuccuccgccccggcggccaccuccuccucaucggcgcccucgaggaguccugguaccucgccggcgaggcccgccucaccgucguccccgucuccgaggaggagguccgcgaggcccucguccgcuccggcuacaagguccgcgaccuccgcaccuacaucaugcccgcccaccuccagaccggcgucgacgacgucaagggcgucuucuucgccugggcccagaaggucggccucuga

SEQ ID NO: 47843 - RNA, 2154 nt, Artificial Sequence
  derived and/or modified sequence opt2 from PNN__Homo_sapiens__NP_002678
auggccgucgccguccgcacccuccaggagcagcucgagaaggccaaggagucccucaagaacgucgacgagaacauccgcaagcucaccggccgcgaccccaacgacguccgccccauccaggcccgccuccucgcccucuccggccccggcggcggccgcggccgcggcucccuccuccuccgccgcggcuucuccgacuccggcggcggcccccccgccaagcagcgcgaccucgagggcgccgucucccgccucggcggcgagcgccgcacccgccgcgagucccgccaggaguccgaccccgaggacgacgacgucaagaagcccgcccuccaguccuccgucgucgccaccuccaaggagcgcacccgccgcgaccucauccaggaccagaacauggacgagaagggcaagcagcgcaaccgccgcaucuucggccuccucaugggcacccuccagaaguucaagcaggaguccaccgucgccaccgagcgccagaagcgccgccaggagaucgagcagaagcucgagguccaggccgaggaggagcgcaagcaggucgagaacgagcgccgcgagcucuucgaggagcgccgcgccaagcagaccgagcuccgccuccucgagcagaaggucgagcucgcccagcuccaggaggaguggaacgagcacaacgccaagaucaucaaguacauccgcaccaagaccaagccccaccucuucuacauccccggccgcaugugccccgccacccagaagcucaucgaggagucccagcgcaagaugaacgcccucuucgagggccgccgcaucgaguucgccgagcagaucaacaagauggaggcccgcccccgccgccaguccaugaaggagaaggagcaccaggucguccgcaacgaggagcagaaggccgagcaggaggagggcaaggucgcccagcgcgaggaggagcucgaggagaccggcaaccagcacaacgacgucgagaucgaggaggccggcgaggaggaggagaaggagaucgccaucguccacuccgacgccgagaaggagcaggaggaggaggagcagaagcaggagauggaggucaagauggaggaggagaccgagguccgcgaguccgagaagcagcaggacucccagcccgaggaggucauggacguccucgagauggucgagaacgucaagcacgucaucgccgaccaggaggucauggagaccaaccgcgucgaguccgucgagcccuccgagaacgaggccuccaaggagcucgagcccgagauggaguucgagaucgagcccgacaaggagugcaagucccucucccccggcaaggagaacgucuccgcccucgacauggagaaggaguccgaggagaaggaggagaaggaguccgagccccagcccgagcccgucgcccagccccagccccagucccagccccagcuccagcuccagucccagucccagcccguccuccagucccagccccccucccagcccgaggaccucucccucgccguccuccagcccaccccccaggucacccaggagcagggccaccuccuccccgagcgcaaggacuuccccgucgaguccgucaagcucaccgagguccccgucgagcccguccucaccguccaccccgaguccaaguccaagaccaagacccgcucccgcucccgcggccgcgcccgcaacaagaccuccaagucccgcucccgcuccuccuccuccuccuccuccuccuccuccuccaccuccuccuccuccggcuccuccuccuccuccggcuccuccuccucccgcuccuccuccuccuccuccuccuccaccuccggcuccuccucccgcgacuccuccuccuccaccuccuccuccuccgagucccgcucccgcucccgcggccgcggccacaaccgcgaccgcaagcaccgccgcuccgucgaccgcaagcgccgcgacaccuccggccucgagcgcucccacaaguccuccaagggcggcuccucccgcgacaccaagggcuccaaggacaagaacucccgcuccgaccgcaagcgcuccaucuccgaguccucccgcuccggcaagcgcuccucccgcuccgagcgcgaccgcaaguccgaccgcaaggacaagcgccgcuga

SEQ ID NO: 47844 - RNA, 759 nt, Artificial Sequence
  derived and/or modified sequence opt2 from PNO1__Homo_sapiens__NP_064528
auggaguccgagauggagacccaguccgcccgcgccgaggagggcuucacccaggucacccgcaagggcggccgccgcgccaagaagcgccaggccgagcagcucuccgccgccggcgagggcggcgacgccggccgcauggacaccgaggaggcccgccccgccaagcgccccgucuuccccccccucugcggcgacggccuccucuccggcaaggaggagacccgcaagauccccguccccgccaaccgcuacaccccccucaaggagaacuggaugaagaucuucacccccaucgucgagcaccucggccuccagauccgcuucaaccucaagucccgcaacgucgagauccgcaccugcaaggagaccaaggacgucuccgcccucaccaaggccgccgacuucgucaaggccuucauccucggcuuccaggucgaggacgcccucgcccucauccgccucgacgaccucuuccucgaguccuucgagaucaccgacgucaagccccucaagggcgaccaccucucccgcgccaucggccgcaucgccggcaagggcggcaagaccaaguucaccaucgagaacgucacccgcacccgcaucguccucgccgacgucaagguccacauccucggcuccuuccagaacaucaagauggcccgcaccgccaucugcaaccucauccucggcaacccccccuccaaggucuacggcaacauccgcgccgucgccucccgcuccgccgaccgcuucuga

SEQ ID NO: 47845 - RNA, 531 nt, Artificial Sequence
  derived and/or modified sequence opt2 from PNOC__Homo_sapiens__NP_006219
augaagguccuccucugcgaccuccuccuccucucccucuucuccuccgucuucuccuccugccagcgcgacugccucaccugccaggagaagcuccaccccgcccucgacuccuucgaccucgaggucugcauccucgagugcgaggagaaggucuuccccuccccccucuggacccccugcaccaaggucauggcccgcuccuccuggcagcucucccccgccgcccccgagcacgucgccgccgcccucuaccagccccgcgccuccgagaugcagcaccuccgccgcaugccccgcguccgcucccucuuccaggagcaggaggagcccgagcccggcauggaggaggccggcgagauggagcagaagcagcuccagaagcgcuucggcggcuucaccggcgcccgcaaguccgcccgcaagcucgccaaccagaagcgcuucuccgaguucaugcgccaguaccucguccucuccaugcaguccucccagcgccgccgcacccuccaccagaacggcaacgucuga

SEQ ID NO: 47846 - RNA, 870 nt, Artificial Sequence
  derived and/or modified sequence opt2 from PNP__Homo_sapiens__NP_000261
auggagaacggcuacaccuacgaggacuacaagaacaccgccgaguggcuccucucccacaccaagcaccgcccccaggucgccaucaucugcggcuccggccucggcggccucaccgacaagcucacccaggcccagaucuucgacuacggcgagauccccaacuucccccgcuccaccguccccggccacgccggccgccucgucuucggcuuccucaacggccgcgccugcgucaugaugcagggccgcuuccacauguacgagggcuacccccucuggaaggucaccuuccccguccgcgucuuccaccuccucggcgucgacacccucgucgucaccaacgccgccggcggccucaaccccaaguucgaggucggcgacaucaugcucauccgcgaccacaucaaccuccccggcuucuccggccagaacccccuccgcggccccaacgacgagcgcuucggcgaccgcuuccccgccauguccgacgccuacgaccgcaccaugcgccagcgcgcccucuccaccuggaagcagaugggcgagcagcgcgagcuccaggagggcaccuacgucauggucgccggccccuccuucgagaccgucgccgagugccgcguccuccagaagcucggcgccgacgccgucggcauguccaccguccccgaggucaucgucgcccgccacugcggccuccgcgucuucggcuucucccucaucaccaacaaggucaucauggacuacgagucccucgagaaggccaaccacgaggagguccucgccgccggcaagcaggccgcccagaagcucgagcaguucgucuccauccucauggccuccaucccccuccccgacaaggccuccuga

SEQ ID NO: 47847 - RNA, 1341 nt, Artificial Sequence
  derived and/or modified sequence opt2 from PNPLA1__Homo_sapiens__NP_001139188
augguccagaugaugcgccaguuccucuaccgcguccuccccgaggacuccuacaaggucaccaccggcaagcuccacgucucccucacccgccucaccgacggcgagaacgucgucgucuccgaguucaccuccaaggaggagcucaucgaggcccucuacugcuccugcuucguccccgucuacugcggccucaucccccccaccuaccgcggcgucugggccuuccucacccuccccccccagcgcuacaucgacggcggcuucaccggcaugcagcccugcgccuucuggaccgacgccaucaccaucuccaccuucuccggccagcaggacaucugcccccgcgacugccccgccaucuuccacgacuuccgcauguucaacugcuccuuccaguucucccucgagaacaucgcccgcaugacccacgcccucuucccccccgaccucgucauccuccacgacuacuacuaccgcggcuacgaggacgccguccucuaccuccgccgccucaacgccgucuaccucaacuccuccuccaagcgcgucaucuucccccgcgucgaggucuacugccagaucgagcucgcccucggcaacgagugccccgagcgcucccagcccucccuccgcgcccgccaggccucccucgagggcgccacccagccccacaaggaguggguccccaagggcgacggccgcggcucccacggcccccccgucucccagcccguccagacccucgaguucaccugcgagucccccgucuccgcccccgucuccccccucgagcagccccccgcccagccccucgccuccuccaccccccucucccucuccggcaugccccccgucuccuuccccgccguccacaagccccccuccuccacccccggcuccucccuccccacccccccccccggccucuccccccucuccccccagcagcagguccagcccuccggcucccccgcccgcucccuccacucccaggcccccaccuccccccgccccucccucggccccuccaccgucggcgccccccagacccucccccgcuccucccucuccgccuuccccgcccagccccccgucgaggagcucggccaggagcagccccaggccgucgcccuccucgucuccuccaagcccaaguccgccgucccccucguccacgucaaggagaccgucuccaagcccuacgucaccgagucccccgccgaggacuccaacugggucaacaaggucuucaagaagaacaagcagaagaccuccggcacccgcaagggcuucccccgccacuccggcuccaagaagcccuccuccaagguccaguga

SEQ ID NO: 47848 - RNA, 1515 nt, Artificial Sequence
  derived and/or modified sequence opt2 from PNPLA2__Homo_sapiens__NP_065109
auguucccccgcgagaagaccuggaacaucuccuucgccggcugcggcuuccucggcgucuacuacgucggcgucgccuccugccuccgcgagcacgcccccuuccucgucgccaacgccacccacaucuacggcgccuccgccggcgcccucaccgccaccgcccucgucaccggcgucugccucggcgaggccggcgccaaguucaucgaggucuccaaggaggcccgcaagcgcuuccucggcccccuccaccccuccuucaaccucgucaagaucauccgcuccuuccuccucaagguccuccccgccgacucccacgagcacgccuccggccgccucggcaucucccucacccgcgucuccgacggcgagaacgucaucaucucccacuucaacuccaaggacgagcucauccaggccaacgucugcuccggcuucauccccgucuacugcggccucaucccccccucccuccagggcguccgcuacgucgacggcggcaucuccgacaaccucccccucuacgagcucaagaacaccaucaccgucucccccuucuccggcgaguccgacaucugcccccaggacuccuccaccaacauccacgagcuccgcgucaccaacaccuccauccaguucaaccuccgcaaccucuaccgccucuccaaggcccucuucccccccgagccccucguccuccgcgagaugugcaagcagggcuaccgcgacggccuccgcuuccuccagcgcaacggccuccucaaccgccccaacccccuccucgcccucccccccgcccgcccccacggccccgaggacaaggaccaggccgucgaguccgcccaggccgaggacuacucccagcuccccggcgaggaccacauccucgagcaccuccccgcccgccucaacgaggcccuccucgaggccugcgucgagcccaccgaccuccucaccacccucuccaacaugcuccccguccgccucgccaccgccaugaugguccccuacacccucccccucgaguccgcccucuccuucaccauccgccuccucgaguggcuccccgacguccccgaggacauccgcuggaugaaggagcagaccggcuccaucugccaguaccucgucaugcgcgccaagcgcaagcucggccgccaccuccccucccgccuccccgagcaggucgagcuccgccgcguccagucccuccccuccgucccccucuccugcgccgccuaccgcgaggcccuccccggcuggaugcgcaacaaccucucccucggcgacgcccucgccaagugggaggagugccagcgccagcuccuccucggccucuucugcaccaacgucgccuucccccccgaggcccuccgcaugcgcgcccccgccgaccccgcccccgcccccgccgaccccgccuccccccagcaccagcucgccggccccgccccccuccucuccacccccgcccccgaggcccgccccgucaucggcgcccucggccucuga

SEQ ID NO: 47849 - RNA, 1446 nt, Artificial Sequence
  derived and/or modified sequence opt2 from PNPLA3__Homo_sapiens__NP_079501
auguacgacgccgagcgcggcuggucccucuccuucgccggcugcggcuuccucggcuucuaccacgucggcgccacccgcugccucuccgagcacgccccccaccuccuccgcgacgcccgcaugcucuucggcgccuccgccggcgcccuccacugcgucggcguccucuccggcaucccccucgagcagacccuccagguccucuccgaccucguccgcaaggcccgcucccgcaacaucggcaucuuccaccccuccuucaaccucuccaaguuccuccgccagggccucugcaagugccuccccgccaacguccaccagcucaucuccggcaagaucggcaucucccucacccgcgucuccgacggcgagaacguccucgucuccgacuuccgcuccaaggacgaggucgucgacgcccucgucugcuccugcuucauccccuucuacuccggccucaucccccccuccuuccgcggcguccgcuacgucgacggcggcgucuccgacaacguccccuucaucgacgccaagaccaccaucaccgucucccccuucuacggcgaguacgacaucugccccaaggucaaguccaccaacuuccuccacgucgacaucaccaagcucucccuccgccucugcaccggcaaccucuaccuccucucccgcgccuucgucccccccgaccucaagguccucggcgagaucugccuccgcggcuaccucgacgccuuccgcuuccucgaggagaagggcaucugcaaccgcccccagcccggccucaaguccuccuccgagggcauggaccccgaggucgccaugcccuccugggccaacaugucccucgacuccucccccgaguccgccgcccucgccguccgccucgagggcgacgagcuccucgaccaccuccgccucuccauccuccccugggacgaguccauccucgacacccucuccccccgccucgccaccgcccucuccgaggagaugaaggacaagggcggcuacauguccaagaucugcaaccuccuccccauccgcaucauguccuacgucaugcuccccugcacccuccccgucgaguccgccaucgccaucguccagcgccucgucaccuggcuccccgacaugcccgacgacguccucuggcuccagugggucaccucccaggucuucacccgcguccucaugugccuccuccccgccucccgcucccagaugcccgucuccucccagcaggccucccccugcacccccgagcaggacuggcccugcuggacccccugcucccccaagggcugccccgccgagaccaaggccgaggccaccccccgcuccauccuccgcuccucccucaacuucuuccucggcaacaagguccccgccggcgccgagggccucuccaccuuccccuccuucucccucgagaagucccucuga

SEQ ID NO: 47850 - RNA, 501 nt, Artificial Sequence
  derived and/or modified sequence opt2 from PNPLA4__Homo_sapiens__NP_001166143
auggcccgccuccgcuccggcauggaguccauccucccccccuccgcccacgagcucgcccagaaccgccuccacgucuccaucaccaacgccaagacccgcgagaaccaccucgucuccaccuucuccucccgcgaggaccucaucaagguccuccucgccuccuccuucguccccaucuacgccggccucaagcucgucgaguacaagggccagaagugggucgacggcggccucaccaacgcccuccccauccuccccgucggccgcaccgucaccaucucccccuucuccggccgccucgacaucuccccccaggacaagggccagcucgaccucuacgucaacaucgccaagcaggacaucaugcucucccucgccaaccucguccgccucaaccaggcccucuucccccccuccaagcgcaagauggagucccucuaccagugcggcuucgacgacaccgucaaguuccuccucaaggagaacugguucgaguga

SEQ ID NO: 47851 - RNA, 948 nt, Artificial Sequence
  derived and/or modified sequence opt2 from PNPLA5__Homo_sapiens__NP_001171146
augggcuuccucgaggaggagggccgcuggaaccucuccuucuccggcgccggcuaccucggcgcccaccacgucggcgccaccgagugccuccgccagcgcgccccccgccuccuccagggcgcccgccgcaucuacggcuccuccuccggcgcccucaacgccgucuccaucgucugcggcaaguccgucgacugccccuccaccaucaccgucucccccuuccacggcaccgucgacaucugcccccaguccaccucccccaaccuccacgagcucaacgucuucaacuucuccuuccagaucuccaccgagaacuucuuccucggccucaucugccucaucccccccucccucgaggucgucgccgacaacugccgccagggcuaccucgacgcccuccgcuuccucgagcgccgcggccucaccaaggagcccguccucuggacccucgucuccaaggagccccccgcccccgccgacggcaacugggacgccggcugcgaccagcgcuggaagggcggccucucccucaacuggaaggucccccacguccaggucaaggacguccccaacuucgagcagcucucccccgagcucgaggccgcccucaagaaggccugcacccgcgaccccucccgcugggcccgcuucuggcacuccggccccggccagguccucaccuaccuccuccuccccugcacccuccccuucgaguacaucuacuuccgcucccgccgccucgucgucuggcuccccgacguccccgccgaccucugguggaugcagggccuccuccgcaacauggcccucgaggucuucucccgcaccaaggcccagcuccucggccccaucuccccccccgccacccgcguccucgagaccuccccccuccagccccagaucgccccccaccgcgaggagcucggccccacccaccaggccuga

SEQ ID NO: 47852 - RNA, 4128 nt, Artificial Sequence
  derived and/or modified sequence opt2 from PNPLA6__Homo_sapiens__NP_001159583
auggaggccccccuccagaccggcaugaugggcaccuccucccacggccucgccaccaacuccuccggcgccaaggucgccgagcgcgacggcuuccaggacguccucgcccccggcgagggcuccgccggccgcaucugcggcgcccagcccguccccuucgucccccagguccucggcgucaugaucggcgccggcgucgccgucgucgucaccgccguccucauccuccucgucguccgccgccuccgcguccccaagacccccgcccccgacggcccccgcuaccgcuuccgcaagcgcgacaagguccucuucuacggccgcaagaucaugcgcaaggucucccaguccaccuccucccucgucgacaccuccgucuccgccaccucccgcccccgcaugcgcaagaagcucaagaugcucaacaucgccaagaagauccuccgcauccagaaggagacccccacccuccagcgcaaggagcccccccccgccguccucgaggccgaccucaccgagggcgaccucgccaacucccaccuccccuccgagguccucuacaugcucaagaacguccgcguccucggccacuucgagaagccccucuuccucgagcucugccgccacauggucuuccagcgccucggccagggcgacuacgucuuccgccccggccagcccgacgccuccaucuacgucguccaggacggccuccucgagcucugccuccccggccccgacggcaaggagugcgucgucaaggaggucguccccggcgacuccgucaacucccuccucuccauccucgacgucaucaccggccaccagcacccccagcgcaccgucuccgcccgcgccgcccgcgacuccaccguccuccgccuccccgucgaggccuucuccgccgucuucaccaaguaccccgagucccucguccgcgucguccagaucaucaugguccgccuccagcgcgucaccuuccucgcccuccacaacuaccucggccucaccaacgagcucuucucccacgagauccagccccuccgccucuuccccucccccggccuccccacccgcaccucccccguccgcggcuccaagcgcauggucuccaccuccgccaccgacgagccccgcgagacccccggccgcccccccgaccccaccggcgccccccuccccggccccaccggcgaccccgucaagcccaccucccucgagacccccuccgccccccuccucucccgcugcgucuccaugcccggcgacaucuccggccuccagggcggcccccgcuccgacuucgacauggccuacgagcgcggccgcaucuccgucucccuccaggaggaggccuccggcggcucccucgccgcccccgcccgcacccccacccaggagccccgcgagcagcccgccggcgccugcgaguacuccuacugcgaggacgaguccgccaccggcggcugccccuucggccccuaccagggccgccagaccuccuccaucuucgaggccgccaagcaggagcucgccaagcucaugcgcaucgaggaccccucccuccucaacucccgcguccuccuccaccacgccaaggccggcaccaucaucgcccgccagggcgaccaggacgucucccuccacuucguccucuggggcugccuccacgucuaccagcgcaugaucgacaaggccgaggacgucugccucuucgucgcccagcccggcgagcucgucggccagcucgccguccucaccggcgagccccucaucuucacccuccgcgcccagcgcgacugcaccuuccuccgcaucuccaaguccgacuucuacgagaucaugcgcgcccagcccuccgucguccucuccgccgcccacaccgucgccgcccgcaugucccccuucguccgccagauggacuucgccaucgacuggaccgccgucgaggccggccgcgcccucuaccgccagggcgaccgcuccgacugcaccuacaucguccucaacggccgccuccgcuccgucauccagcgcggcuccggcaagaaggagcucgucggcgaguacggccgcggcgaccucaucggcgucgucgaggcccucacccgccagccccgcgccaccaccguccacgccguccgcgacaccgagcucgccaagcuccccgagggcacccucggccacaucaagcgccgcuacccccaggucgucacccgccucauccaccuccucucccagaagauccucggcaaccuccagcagcuccagggccccuuccccgccggcuccggccucggcguccccccccacuccgagcucaccaaccccgccuccaaccucgccaccgucgccauccuccccgucugcgccgagguccccauggucgccuucacccucgagcuccagcacgcccuccaggccaucggccccacccuccuccucaacuccgacaucauccgcgcccgccucggcgccuccgcccucgacuccauccaggaguuccgccucuccggcuggcucgcccagcaggaggacgcccaccgcaucguccucuaccagaccgacgccucccucacccccuggaccguccgcugccuccgccaggccgacugcauccucaucgucggccucggcgaccaggagcccacccucggccagcucgagcagaugcucgagaacaccgccguccgcgcccucaagcagcucguccuccuccaccgcgaggagggcgccggccccacccgcaccgucgaguggcucaacaugcgcuccuggugcuccggccaccuccaccuccgcugcccccgccgccucuucucccgccgcucccccgccaagcuccacgagcucuacgagaaggucuucucccgccgcgccgaccgccacuccgacuucucccgccucgcccgcguccucaccggcaacaccaucgcccucguccucggcggcggcggcgcccgcggcugcucccacaucggcguccucaaggcccucgaggaggccggcguccccgucgaccucgucggcggcaccuccaucggcuccuucaucggcgcccucuacgccgaggagcgcuccgccucccgcaccaagcagcgcgcccgcgagugggccaaguccaugaccuccguccucgagcccguccucgaccucaccuaccccgucaccuccauguucaccggcuccgccuucaaccgcuccauccaccgcgucuuccaggacaagcagaucgaggaccucuggcuccccuacuucaacgucaccaccgacaucaccgccuccgccaugcgcguccacaaggacggcucccucuggcgcuacguccgcgccuccaugacccucuccggcuaccuccccccccucugcgaccccaaggacggccaccuccucauggacggcggcuacaucaacaaccuccccgccgacaucgcccgcuccaugggcgccaagaccgucaucgccaucgacgucggcucccaggacgagaccgaccucuccaccuacggcgacucccucuccggcugguggcuccucuggaagcgccucaaccccugggccgacaaggucaagguccccgacauggccgagauccagucccgccucgccuacgucuccugcguccgccagcucgaggucgucaaguccuccuccuacugcgaguaccuccgcccccccaucgacugcuucaagaccauggacuucggcaaguucgaccagaucuacgacgucggcuaccaguacggcaaggccgucuucggcggcuggucccgcggcaacgucaucgagaagaugcucaccgaccgccgcuccaccgaccucaacgagucccgccgcgccgacguccucgccuuccccuccuccggcuucaccgaccucgccgagaucgucucccgcaucgagccccccaccuccuacgucuccgacggcugcgccgacggcgaggaguccgacugccucaccgaguacgaggaggacgccggccccgacugcucccgcgacgagggcggcucccccgagggcgccucccccuccaccgccuccgagauggaggaggagaaguccauccuccgccagcgccgcugccucccccaggagccccccggcuccgccaccgacgccuga

SEQ ID NO: 47853 - RNA, 2349 nt, Artificial Sequence
  derived and/or modified sequence opt2 from PNPLA8__Homo_sapiens__NP_001242937
auguccaucaaccucaccgucgacaucuacaucuaccuccucuccaacgcccgcuccgucugcggcaagcagcgcuccaagcagcucuacuuccucuucucccccaagcacuacuggcgcaucucccacaucucccuccagcgcggcuuccacaccaacaucauccgcugcaaguggaccaaguccgaggcccacuccugcuccaagcacugcuacucccccuccaaccacggccuccacaucggcauccucaagcucuccaccuccgcccccaagggccucaccaaggucaacaucugcaugucccgcaucaaguccacccucaacuccgucuccaaggccgucuucggcaaccagaacgagaugaucucccgccucgcccaguucaagcccuccucccagauccuccgcaaggucuccgacuccggcuggcucaagcagaagaacaucaagcaggccaucaagucccucaagaaguacuccgacaaguccgccgagaagucccccuuccccgaggagaagucccacaucaucgacaaggaggaggacaucggcaagcgcucccucuuccacuacaccuccuccaucaccaccaaguucggcgacuccuucuacuuccucuccaaccacaucaacuccuacuucaagcgcaaggagaagaugucccagcagaaggagaacgagcacuuccgcgacaaguccgagcucgaggacaagaaggucgaggagggcaagcuccgcucccccgaccccggcauccucgccuacaagcccggcuccgaguccguccacaccgucgacaagcccaccucccccuccgccauccccgacguccuccaggucuccaccaagcaguccaucgccaacuuccucucccgccccaccgagggcguccaggcccucgucggcggcuacaucggcggccucguccccaagcucaaguacgacuccaagucccaguccgaggagcaggaggagcccgccaagaccgaccaggccgucuccaaggaccgcaacgccgaggagaagaagcgccucucccuccagcgcgagaagaucaucgcccgcgucuccaucgacaaccgcacccgcgcccucguccaggcccuccgccgcaccaccgaccccaagcucugcaucacccgcgucgaggagcucaccuuccaccuccucgaguuccccgagggcaagggcgucgccgucaaggagcgcaucauccccuaccuccuccgccuccgccagaucaaggacgagacccuccaggccgccguccgcgagauccucgcccucaucggcuacgucgaccccgucaagggccgcggcauccgcauccucuccaucgacggcggcggcacccgcggcgucgucgcccuccagacccuccgcaagcucgucgagcucacccagaagcccguccaccagcucuucgacuacaucugcggcgucuccaccggcgccauccucgccuucaugcucggccucuuccacaugccccucgacgagugcgaggagcucuaccgcaagcucggcuccgacgucuucucccagaacgucaucgucggcaccgucaagauguccuggucccacgccuucuacgacucccagaccugggagaacauccucaaggaccgcaugggcuccgcccucaugaucgagaccgcccgcaaccccaccugccccaaggucgccgccgucuccaccaucgucaaccgcggcaucacccccaaggccuucgucuuccgcaacuacggccacuuccccggcaucaacucccacuaccucggcggcugccaguacaagauguggcaggccauccgcgccuccuccgccgcccccggcuacuucgccgaguacgcccucggcaacgaccuccaccaggacggcggccuccuccucaacaaccccuccgcccucgccaugcacgagugcaagugccucuggcccgacgucccccucgagugcaucgucucccucggcaccggccgcuacgaguccgacguccgcaacaccgucaccuacaccucccucaagaccaagcucuccaacgucaucaacuccgccaccgacaccgaggagguccacaucaugcucgacggccuccucccccccgacaccuacuuccgcuucaaccccgucaugugcgagaacaucccccucgacgagucccgcaacgagaagcucgaccagcuccagcucgagggccucaaguacaucgagcgcaacgagcagaagaugaagaaggucgccaagauccucucccaggagaagaccacccuccagaagaucaacgacuggaucaagcucaagaccgacauguacgagggccuccccuucuucuccaagcucuga

SEQ ID NO: 47854 - RNA, 786 nt, Artificial Sequence
  derived and/or modified sequence opt2 from PNPO__Homo_sapiens__NP_060599
augaccugcuggcuccgcggcgucaccgccaccuucggccgccccgccgaguggcccggcuaccucucccaccucugcggccgcuccgccgccauggaccucggccccaugcgcaaguccuaccgcggcgaccgcgaggccuucgaggagacccaccucaccucccucgaccccgucaagcaguucgccgccugguucgaggaggccguccagugccccgacaucggcgaggccaacgccaugugccucgccaccugcacccgcgacggcaagcccuccgcccgcaugcuccuccucaagggcuucggcaaggacggcuuccgcuucuucaccaacuucgagucccgcaagggcaaggagcucgacuccaaccccuucgccucccucgucuucuacugggagccccucaaccgccagguccgcgucgagggccccgucaagaagcuccccgaggaggaggccgagugcuacuuccacucccgccccaaguccucccagaucggcgccgucgucucccaccaguccuccgucauccccgaccgcgaguaccuccgcaagaagaacgaggagcucgagcagcucuaccaggaccaggagguccccaagcccaaguccuggggcggcuacguccucuacccccaggucauggaguucuggcagggccagaccaaccgccuccacgaccgcaucgucuuccgccgcggccuccccaccggcgacuccccccucggccccaugacccaccgcggcgaggaggacuggcucuacgagcgccucgcccccuga

SEQ ID NO: 47855 - RNA, 2352 nt, Artificial Sequence
  derived and/or modified sequence opt2 from PNPT1__Homo_sapiens__NP_149100
auggccgccugccgcuacugcugcuccugccuccgccuccgcccccucuccgacggccccuuccuccucccccgccgcgaccgcgcccucacccagcuccagguccgcgcccucugguccuccgccggcucccgcgccgucgccgucgaccucggcaaccgcaagcucgagaucuccuccggcaagcucgcccgcuucgccgacggcuccgccgucguccaguccggcgacaccgccgucauggucaccgccgucuccaagaccaagcccucccccucccaguucaugccccucgucgucgacuaccgccagaaggccgccgccgccggccgcauccccaccaacuaccuccgccgcgagaucggcaccuccgacaaggagauccucaccucccgcaucaucgaccgcuccauccgcccccucuuccccgccggcuacuucuacgacacccagguccucugcaaccuccucgccgucgacggcgucaacgagcccgacguccucgccaucaacggcgccuccgucgcccucucccucuccgacauccccuggaacggccccgucggcgccguccgcaucggcaucaucgacggcgaguacgucgucaaccccacccgcaaggagauguccuccuccacccucaaccucgucgucgccggcgcccccaagucccagaucgucaugcucgaggccuccgccgagaacauccuccagcaggacuucugccacgccaucaaggucggcgucaaguacacccagcagaucauccagggcauccagcagcucgucaaggagaccggcgucaccaagcgcaccccccagaagcucuucacccccucccccgagaucgucaaguacacccacaagcucgccauggagcgccucuacgccgucuucaccgacuacgagcacgacaaggucucccgcgacgaggccgucaacaagauccgccucgacaccgaggagcagcucaaggagaaguuccccgaggccgaccccuacgagaucaucgaguccuucaacgucgucgccaaggaggucuuccgcuccaucguccucaacgaguacaagcgcugcgacggccgcgaccucaccucccuccgcaacgucuccugcgaggucgacauguucaagacccuccacggcuccgcccucuuccagcgcggccagacccagguccucugcaccgucaccuucgacucccucgaguccggcaucaaguccgaccaggucaucaccgccaucaacggcaucaaggacaagaacuucaugcuccacuacgaguucccccccuacgccaccaacgagaucggcaaggucaccggccucaaccgccgcgagcucggccacggcgcccucgccgagaaggcccucuaccccgucaucccccgcgacuuccccuucaccauccgcgucaccuccgagguccucgaguccaacggcuccuccuccauggccuccgccugcggcggcucccucgcccucauggacuccggcguccccaucuccuccgccgucgccggcgucgccaucggccucgucaccaagaccgaccccgagaagggcgagaucgaggacuaccgccuccucaccgacauccucggcaucgaggacuacaacggcgacauggacuucaagaucgccggcaccaacaagggcaucaccgcccuccaggccgacaucaagcuccccggcauccccaucaagaucgucauggaggccauccagcaggccuccgucgccaagaaggagauccuccagaucaugaacaagaccaucuccaagccccgcgccucccgcaaggagaacggccccgucgucgagaccguccaggucccccucuccaagcgcgccaaguucgucggccccggcggcuacaaccucaagaagcuccaggccgagaccggcgucaccaucucccaggucgacgaggagaccuucuccgucuucgcccccacccccuccgccaugcacgaggcccgcgacuucaucaccgagaucugcaaggacgaccaggagcagcagcucgaguucggcgccgucuacaccgccaccaucaccgagauccgcgacaccggcgucauggucaagcucuaccccaacaugaccgccguccuccuccacaacacccagcucgaccagcgcaagaucaagcaccccaccgcccucggccucgaggucggccaggagauccaggucaaguacuucggccgcgaccccgccgacggccgcaugcgccucucccgcaagguccuccagucccccgccaccaccgucguccgcacccucaacgaccgcuccuccaucgucaugggcgagcccaucucccaguccuccuccaacucccaguga

SEQ ID NO: 47856 - RNA, 984 nt, Artificial Sequence
  derived and/or modified sequence opt2 from PNRC1__Homo_sapiens__NP_006804
augaccgucgucuccgucccccagcgcgagccccucguccucggcggccgccucgccccccucggcuucuccucccgcggcuacuucggcgcccuccccauggucaccaccgccccccccccccucccccgcauccccgacccccgcgcccucccccccacccucuuccucccccacuuccucggcggcgacggccccugccucaccccccagccccgcgcccccgccgcccuccccaaccgcucccucgccgucgccggcggcaccccccgcgccgcccccaagaagcgccgcaagaagaagguccgcgccucccccgccggccagcuccccucccgcuuccaccaguaccagcagcaccgccccucccucgagggcggccgcucccccgccaccggccccuccggcgcccaggagguccccggccccgccgccgcccucgcccccucccccgccgccgccgccggcaccgagggcgccucccccgaccucgccccccuccgccccgccgcccccggccagaccccccuccgcaaggagguccucaaguccaagaugggcaaguccgagaagaucgcccucccccacggccagcucguccacggcauccaccucuacgagcagcccaagaucaaccgccagaaguccaaguacaaccucccccucaccaagaucaccuccgccaagcgcaacgagaacaacuucuggcaggacuccgucuccuccgaccgcauccagaagcaggagaagaagcccuucaagaacaccgagaacaucaagaacucccaccucaagaaguccgccuuccucaccgaggucucccagaaggagaacuacgccggcgccaaguucuccgacccccccucccccuccguccuccccaagccccccucccacuggaugggcuccaccgucgagaacuccaaccagaaccgcgagcucauggccguccaccucaagacccuccucaagguccagaccuga

SEQ ID NO: 47857 - RNA, 1080 nt, Artificial Sequence
  derived and/or modified sequence opt2 from POC1A__Homo_sapiens__NP_001155052
auggccgcccccugcgccgaggaccccucccucgagcgccacuucaagggccaccgcgacgccgucaccugcgucgacuucuccaucaacaccaagcagcucgccuccggcuccauggacuccugccucauggucuggcacaugaagccccagucccgcgccuaccgcuucaccggccacaaggacgccgucaccugcgucaacuucucccccuccggccaccuccucgccuccggcucccgcgacaagaccguccgcaucuggguccccaacgucaagggcgaguccaccgucuuccgcgcccacaccgccaccguccgcuccguccacuucugcuccgacggccaguccuucgucaccgccuccgacgacaagaccgucaaggucugggccacccaccgccagaaguuccucuucucccucucccagcacaucaacuggguccgcugcgccaaguucucccccgacggccgccucaucgucuccgccuccgacgacaagaccgucaagcucugggacaaguccucccgcgagugcguccacuccuacugcgagcacggcggcuucgucaccuacgucgacuuccaccccuccggcaccugcaucgccgccgccggcauggacaacaccgucaaggucugggacguccgcacccaccgccuccuccagcacuaccagcuccacuccgccgccgucaacggccucuccuuccaccccuccggcaacuaccucaucaccgccuccuccgacuccacccucaagauccucgaccucauggagggccgccuccucuacacccuccacggccaccagggccccgccaccaccgucgccuucucccgcaccggcgaguacuucgccuccggcggcuccgacgagcaggucauggucuggaaguccaacuucgacaucgucgaccacggcgaggucaccaaggucccccgcccccccgccacccucgccuccuccaugggcaaccucaccgucuccauccucgagcagcgccucacccucaccgaggacaagcucaagcagugccucgagaaccagcagcucaucaugcagcgcgccacccccuga

SEQ ID NO: 47858 - RNA, 1311 nt, Artificial Sequence
  derived and/or modified sequence opt2 from POC1B__Homo_sapiens__NP_001186706
augcucuggaacuucaagccccacgcccgcgccuaccgcuacgucggccacaaggacgucgucaccuccguccaguucuccccccacggcaaccuccucgccuccgccucccgcgaccgcaccguccgccucuggauccccgacaagcgcggcaaguucuccgaguucaaggcccacaccgcccccguccgcuccgucgacuucuccgccgacggccaguuccucgccaccgccuccgaggacaaguccaucaaggucugguccauguaccgccagcgcuuccucuacucccucuaccgccacacccacuggguccgcugcgccaaguucucccccgacggccgccucaucgucuccugcuccgaggacaagaccaucaagaucugggacaccaccaacaagcagugcgucaacaacuucuccgacuccgucggcuucgccaacuucgucgacuucaaccccuccggcaccugcaucgccuccgccggcuccgaccagaccgucaaggucugggacguccgcgucaacaagcuccuccagcacuaccagguccacuccggcggcgucaacugcaucuccuuccaccccuccggcaacuaccucaucaccgccuccuccgacggcacccucaagauccucgaccuccucgagggccgccucaucuacacccuccagggccacaccggccccgucuucaccgucuccuucuccaagggcggcgagcucuucgccuccggcggcgccgacacccagguccuccucuggcgcaccaacuucgacgagcuccacugcaagggccucaccaagcgcaaccucaagcgccuccacuucgacucccccccccaccuccucgacaucuacccccgcaccccccacccccacgaggagaaggucgagaccgucgagaucaaccccaagcucgaggucaucgaccuccagaucuccaccccccccgucauggacauccucuccuucgacuccaccaccaccaccgagaccuccggccgcacccuccccgacaagggcgaggaggccugcggcuacuuccucaaccccucccucaugucccccgagugccuccccaccaccaccaagaagaagaccgaggacauguccgaccuccccugcgagucccagcgcuccaucccccucgccgucaccgacgcccucgagcacaucauggagcagcucaacguccucacccagaccgucuccauccucgagcagcgccucacccucaccgaggacaagcucaaggacugccucgagaaccagcagaagcucuucuccgccguccagcagaaguccuga

SEQ ID NO: 47859 - RNA, 1728 nt, Artificial Sequence
  derived and/or modified sequence opt2 from POC5__Homo_sapiens__NP_001092741
auguccuccgacgaggagaaguacucccuccccgucguccagaacgacuccucccgcggcuccuccgucuccuccaaccuccaggaggaguacgaggagcuccuccacuacgccaucgucacccccaacaucgagcccugcgccucccaguccucccaccccaagggcgagcucguccccgacguccgcaucuccaccauccacgacauccuccacucccagggcaacaacuccgagguccgcgagaccgccaucgaggucggcaagggcugcgacuuccacaucuccucccacuccaagaccgacgaguccucccccguccucuccccccgcaagcccucccaccccgucauggacuucuucuccucccaccuccucgccgacuccuccucccccgccaccaacuccucccacaccgacgcccacgagauccucgucuccgacuuccucgucuccgacgagaaccuccagaagauggagaacguccucgaccucugguccuccggccucaagaccaacaucaucuccgagcucuccaaguggcgccucaacuucaucgacuggcaccgcauggagaugcgcaaggagaaggagaagcacgccgcccaccucaagcagcucugcaaccagaucaacgagcucaaggagcuccagaagaccuucgagaucuccaucggccgcaaggacgaggucaucuccucccucucccacgccaucggcaagcagaaggagaagaucgagcucaugcgcaccuucuuccacuggcgcaucggccacguccgcgcccgccaggacgucuacgagggcaagcucgccgaccaguacuaccagcgcacccuccucaagaaggucuggaaggucuggcgcuccgucguccagaagcaguggaaggacgucgucgagcgcgccugccaggcccgcgccgaggaggucugcauccagaucuccaacgacuacgaggccaaggucgccaugcucuccggcgcccucgagaacgccaaggccgagauccagcgcaugcagcacgagaaggagcacuucgaggacuccaugaagaaggccuucaugcgcggcgucugcgcccucaaccucgaggccaugaccaucuuccagaaccgcaacgacgccggcaucgacuccaccaacaacaagaaggaggaguacggccccggcguccagggcaaggagcacuccgcccaccucgaccccuccgccccccccaugccccuccccgucaccuccccccuccuccccuccccccccgccgccgucggcggcgccuccgccaccgccguccccuccgccgccuccaugaccuccacccgcgccgccuccgccuccuccguccacguccccgucuccgcccucggcgccggcuccgccgccaccgccgccuccgaggagauguacgucccccgcgucgucaccuccgcccagcagaaggccggccgcaccaucaccgcccgcaucaccggccgcugcgacuucgccuccaagaaccgcaucuccuccucccucgccaucaugggcgucuccccccccauguccuccgucgucgucgagaagcaccaccccgucaccguccagaccaucccccaggccaccgccgccaaguacccccgcaccauccaccccgaguccuccaccuccgccucccgcucccucggcacccgcuccgcccacacccagucccucaccuccguccacuccaucaaggucgucgacuga

SEQ ID NO: 47860 - RNA, 1677 nt, Artificial Sequence
  derived and/or modified sequence opt2 from PODXL__Homo_sapiens__NP_001018121
augcgcugcgcccucgcccucuccgcccuccuccuccuccucuccacccccccccuccuccccuccucccccucccccucccccucccccucccagaacgccacccagaccaccaccgacuccuccaacaagaccgcccccacccccgccuccuccgucaccaucauggccaccgacaccgcccagcaguccaccguccccaccuccaaggccaacgagauccucgccuccgucaaggccaccacccucggcgucuccuccgacucccccggcaccaccacccucgcccagcaggucuccggccccgucaacaccaccgucgcccgcggcggcggcuccggcaaccccaccaccaccaucgagucccccaaguccaccaaguccgccgacaccaccaccgucgccaccuccaccgccaccgccaagcccaacaccaccuccucccagaacggcgccgaggacaccaccaacuccggcggcaaguccucccacuccgucaccaccgaccucaccuccaccaaggccgagcaccucaccaccccccaccccaccuccccccucuccccccgccagcccaccuccacccaccccgucgccacccccaccuccuccggccacgaccaccucaugaagaucuccuccuccuccuccaccgucgccauccccggcuacaccuucaccucccccggcaugaccaccacccuccucgagaccgucuuccaccacgucucccaggccggccucgagcuccucaccuccggcgaccuccccacccucgccucccaguccgccggcaucaccgccuccuccgucaucucccagcgcacccagcagaccuccucccagaugcccgccuccuccaccgcccccuccucccaggagaccguccagcccaccucccccgccaccgcccuccgcacccccacccuccccgagaccauguccuccucccccaccgccgccuccaccacccaccgcuaccccaagacccccucccccaccgucgcccacgaguccaacugggccaagugcgaggaccucgagacccagacccaguccgagaagcagcucguccucaaccucaccggcaacacccucugcgccggcggcgccuccgacgagaagcucaucucccucaucugccgcgccgucaaggccaccuucaaccccgcccaggacaagugcggcauccgccucgccuccguccccggcucccagaccgucgucgucaaggagaucaccauccacaccaagcuccccgccaaggacgucuacgagcgccucaaggacaagugggacgagcucaaggaggccggcgucuccgacaugaagcucggcgaccagggcccccccgaggaggccgaggaccgcuucuccaugccccucaucaucaccaucgucugcauggccuccuuccuccuccucgucgccgcccucuacggcugcugccaccagcgccucucccagcgcaaggaccagcagcgccucaccgaggagcuccagaccgucgagaacggcuaccacgacaaccccacccucgaggucauggagaccuccuccgagaugcaggagaagaaggucgucucccucaacggcgagcucggcgacuccuggaucgucccccucgacaaccucaccaaggacgaccucgacgaggaggaggacacccaccucuga

SEQ ID NO: 47861 - RNA, 1770 nt, Artificial Sequence
  derived and/or modified sequence opt2 from POF1B__Homo_sapiens__NP_079197
auguccuccuccuacugguccgagaccuccuccuccuccugcggcacccagcagcuccccgagguccuccagugccagccccagcacuaccacugcuaccaccaguccucccaggcccagcagccccccgagaagaacgucgucuacgagcgcguccgcaccuacuccggccccaugaacaaggucguccaggcccucgaccccuucaacucccgcgagguccucuccccccucaagaccaccuccuccuaccagaaccucgucugguccgaccacucccaggagcuccacucccccacccucaagaucuccaccugcgcccccuccacccuccacaucacccagaacaccgagcaggagcuccacucccccaccgucaagcucaccaccuacccccagaccaccauccgcaaguacgucguccagaaccccgagcaggagccccucucccaguuccuccgcggcucccacuucuuccccggcaacaacgucaucuacgagaagaccauccgcaaggucgagaagcucaacaccgaccagggcugccacccccaggcccagugccaccaccacaucauccagcagccccaggucauccacuccgcccacuggcagcagcccgacuccucccagcagauccaggccaucaccggcaacaaccccaucuccacccacaucggcaacgagcucugccacuccggcuccucccagaucugcgagcaggucaucauccaggacgacggccccgagaagcucgacccccgcuacuucggcgagcuccucgccgaccucucccgcaagaacaccgaccucuaccacugccuccucgagcaccuccagcgcaucggcggcuccaagcaggacuucgaguccaccgacgaguccgaggacaucgagucccucauccccaagggccucuccgaguucaccaagcagcagauccgcuacauccuccagaugcgcggcauguccgacaagucccuccgccucguccucuccaccuucuccaacauccgcgaggagcucggccaccuccagaacgacaugaccucccucgagaacgacaagaugcgccucgagaaggaccucuccuucaaggacacccagcucaaggaguacgaggagcuccucgccuccguccgcgccaacaaccaccagcagcagcagggccuccaggacuccuccuccaagugccaggcccucgaggagaacaaccucucccuccgccacacccucuccgacauggaguaccgccucaaggagcucgaguacugcaagcgcaaccucgagcaggagaaccagaaccuccgcaugcaggucuccgagaccugcaccggccccaugcuccaggccaagauggacgagaucggcaaccacuacaccgagauggucaagaaccuccgcauggagaaggaccgcgagaucugccgccuccgcucccagcucaaccaguaccacaaggacgucuccaagcgcgagggcuccugcuccgacuuccaguucaagcuccacgagcucaccucccuccucgaggagaaggacucccucaucaagcgccaguccgaggagcucuccaagcuccgccaggagaucuacuccucccacaaccagcccuccaccggcggccgcaccaccaucaccaccaagaaguaccgcacccaguaccccauccucggccuccucuacgacgacuacgaguacaucccccccggcuccgagacccagaccaucgucaucgagaagaccgaggacaaguacaccugccccuga

SEQ ID NO: 47862 - RNA, 1167 nt, Artificial Sequence
  derived and/or modified sequence opt2 from POFUT1__Homo_sapiens__NP_056167
augggcgccgccgccugggcccgcccccucuccgucuccuuccuccuccuccuccucccccuccccggcaugcccgccggcuccugggaccccgccggcuaccuccucuacugccccugcaugggccgcuucggcaaccaggccgaccacuuccucggcucccucgccuucgccaagcuccucaaccgcacccucgccgucccccccuggaucgaguaccagcaccacaagccccccuucaccaaccuccacgucuccuaccagaaguacuucaagcucgagccccuccaggccuaccaccgcgucaucucccucgaggacuucauggagaagcucgcccccacccacuggccccccgagaagcgcgucgccuacugcuucgaggucgccgcccagcgcucccccgacaagaagaccugccccaugaaggagggcaaccccuucggccccuucugggaccaguuccacgucuccuucaacaaguccgagcucuucaccggcaucuccuucuccgccuccuaccgcgagcaguggucccagcgcuucucccccaaggagcaccccguccucgcccuccccggcgcccccgcccaguuccccguccucgaggagcaccgcccccuccagaaguacauggucugguccgacgagauggucaagaccggcgaggcccagauccacgcccaccucguccgccccuacgucggcauccaccuccgcaucggcuccgacuggaagaacgccugcgccaugcucaaggacggcaccgccggcucccacuucauggccuccccccagugcgucggcuacucccgcuccaccgccgccccccucaccaugaccaugugccuccccgaccucaaggagauccagcgcgccgucaagcucuggguccgcucccucgacgcccaguccgucuacgucgccaccgacuccgaguccuacguccccgagcuccagcagcucuucaagggcaaggucaaggucgucucccucaagcccgaggucgcccaggucgaccucuacauccucggccaggccgaccacuucaucggcaacugcgucuccuccuucaccgccuucgucaagcgcgagcgcgaccuccagggccgccccuccuccuucuucggcauggaccgcccccccaagcuccgcgacgaguucuga

SEQ ID NO: 47863 - RNA, 1275 nt, Artificial Sequence
  derived and/or modified sequence opt2 from POFUT2__Homo_sapiens__NP_056042
auggccacccucuccuucgucuuccuccuccucggcgccgucuccuggccccccgccuccgccuccggccaggaguucuggcccggccaguccgccgccgacauccucuccggcgccgccucccgccgccgcuaccuccucuacgacgucaacccccccgagggcuucaaccuccgccgcgacgucuacauccgcaucgccucccuccucaagacccuccucaagaccgaggaguggguccucguccucccccccuggggccgccucuaccacuggcagucccccgacauccaccagguccgcauccccugguccgaguucuucgaccuccccucccucaacaagaacauccccgucaucgaguacgagcaguucaucgccgaguccggcggccccuucaucgaccaggucuacguccuccaguccuacgccgagggcuggaaggagggcaccugggaggagaaggucgacgagcgccccugcaucgaccagcuccucuacucccaggacaagcacgaguacuaccgcggcugguucuggggcuacgaggagacccgcggccucaacgucuccugccucuccguccagggcuccgccuccaucgucgccccccuccuccuccgcaacaccuccgcccgcuccgucaugcucgaccgcgccgagaaccuccuccacgaccacuacggcggcaaggaguacugggacacccgccgcuccauggucuucgcccgccaccuccgcgaggucggcgacgaguuccgcucccgccaccucaacuccaccgacgacgccgaccgcauccccuuccaggaggacuggaugaagaugaaggucaagcucggcuccgcccucggcggccccuaccucggcguccaccuccgccgcaaggacuucaucuggggccaccgccaggacguccccucccucgagggcgccguccgcaagauccgcucccucaugaagacccaccgccucgacaaggucuucgucgccaccgacgccguccgcaaggaguacgaggagcucaagaagcuccuccccgagaugguccgcuucgagcccaccugggaggagcucgagcucuacaaggacggcggcgucgccaucaucgaccaguggaucugcgcccacgcccgcugccuccccaccucccucuccgccgaguccggcuccggcggcuuccagcgcuucuucugccccaaguacuccgucuccgagcagauggucgccugcguccacuccggccacuuccacaccgucugccuccucgucuga

SEQ ID NO: 47864 - RNA, 1830 nt, Artificial Sequence
  derived and/or modified sequence opt2 from POGK__Homo_sapiens__NP_060012
auggaguccaccgccuacccccucaaccucucccucaaggaggaggaggaggaggaggagauccagucccgcgagcucgaggacggccccgccgacaugcagaagguccgcaucugcuccgagggcggcuggguccccgcccucuucgacgaggucgccaucuacuucuccgacgaggagugggagguccucaccgagcagcagaaggcccucuaccgcgaggucaugcgcaugaacuacgagaccguccucucccucgaguuccccuuccccaagcccgacaugaucacccgccucgagggcgaggaggagucccagaacuccgacgaguggcagcuccagggcggcaccuccgccgagaacgaggaguccgacgucaagccccccgacuggcccaaccccaugaacgccaccucccaguucccccagccccagcacuucgacuccuucggccuccgccucccccgcgacaucaccgagcuccccgagugguccgagggcuaccccuucuacauggccaugggcuuccccggcuacgaccucuccgccgacgacaucgccggcaaguuccaguucucccgcggcaugcgccgcuccuacgacgccggcuucaagcucauggucgucgaguacgccgaguccaccaacaacugccaggccgccaagcaguucggcguccucgagaagaacguccgcgacuggcgcaaggucaagccccagcuccagaacgcccacgccaugcgccgcgccuuccgcggccccaagaacggccgcuucgcccucgucgaccagcgcgucgccgaguacguccgcuacaugcaggccaagggcgaccccaucacccgcgaggccaugcagcucaaggcccucgagaucgcccaggagaugaacauccccgagaagggcuucaaggccucccucggcuggugccgccgcaugaugcgccgcuacgaccucucccuccgccacaagguccccgucccccagcaccuccccgaggaccucaccgagaagcucgucaccuaccagcgcuccguccucgcccuccgccgcgcccacgacuacgaggucgcccagaugggcaacgccgacgagacccccaucugccucgagguccccucccgcgucaccgucgacaaccagggcgagaagcccguccucgucaagacccccggccgcgagaagcucaagaucaccgccaugcucggcguccucgccgacggccgcaagcucccccccuacaucauccuccgcggcaccuacaucccccccggcaaguuccccuccggcauggagauccgcugccaccgcuacggcuggaugaccgaggaccucaugcaggacuggcucgaggucgucuggcgccgccgcaccggcgccguccccaagcagcgcggcaugcucauccucaacggcuuccgcggccacgccaccgacuccgucaagaacuccauggaguccaugaacaccgacauggucaucauccccggcggccucaccucccagcuccagguccucgacgucgucgucuacaagccccucaacgacuccguccgcgcccaguacuccaacuggcuccucgccggcaaccucgcccucucccccaccggcaacgccaagaagcccccccucggccucuuccucgagugggucauggucgccuggaacuccaucuccuccgaguccaucguccagggcuucaagaagugccacaucuccuccaaccucgaggaggaggacgacguccucugggagaucgaguccgagcuccccggcggcggcgagccccccaaggacugcgacaccgaguccauggccgaguccaacuga

SEQ ID NO: 47865 - RNA, 1179 nt, Artificial Sequence
  derived and/or modified sequence opt2 from POGLUT1__Homo_sapiens__NP_689518
auggaguggugggccuccuccccccuccgccucuggcuccuccucuuccuccuccccuccgcccagggccgccagaaggaguccggcuccaaguggaaggucuucaucgaccagaucaaccgcucccucgagaacuacgagcccugcuccucccagaacugcuccugcuaccacggcgucaucgaggaggaccucacccccuuccgcggcggcaucucccgcaagaugauggccgaggucguccgccgcaagcucggcacccacuaccagaucaccaagaaccgccucuaccgcgagaacgacugcauguuccccucccgcugcuccggcgucgagcacuucauccucgaggucaucggccgccuccccgacauggagauggucaucaacguccgcgacuacccccagguccccaaguggauggagcccgccauccccgucuucuccuucuccaagaccuccgaguaccacgacaucauguaccccgccuggaccuucugggagggcggccccgccgucuggcccaucuaccccaccggccucggccgcugggaccucuuccgcgaggaccucguccgcuccgccgcccaguggcccuggaagaagaagaacuccaccgccuacuuccgcggcucccgcaccucccccgagcgcgacccccucauccuccucucccgcaagaaccccaagcucgucgacgccgaguacaccaagaaccaggccuggaaguccaugaaggacacccucggcaagcccgccgccaaggacguccaccucgucgaccacugcaaguacaaguaccucuucaacuuccgcggcgucgccgccuccuuccgcuucaagcaccucuuccucugcggcucccucgucuuccacgucggcgacgaguggcucgaguucuucuacccccagcucaagcccuggguccacuacauccccgucaagaccgaccucuccaacguccaggagcuccuccaguucgucaaggccaacgacgacgucgcccaggagaucgccgagcgcggcucccaguucauccgcaaccaccuccagauggacgacaucaccugcuacugggagaaccuccucuccgaguacuccaaguuccucuccuacaacgucacccgccgcaagggcuacgaccagaucauccccaagaugcucaagaccgagcucuga

SEQ ID NO: 47866 - RNA, 4389 nt, Artificial Sequence
  derived and/or modified sequence opt2 from POLA1__Homo_sapiens__NP_058633
auggcccccguccacggcgacgacucccucuccgacuccggcuccuucgucuccucccgcgcccgccgcgagaagaaguccaagaagggccgccaggaggcccucgagcgccucaagaaggccaaggccggcgagaaguacaaguacgaggucgaggacuucaccggcgucuacgaggaggucgacgaggagcaguacuccaagcucguccaggcccgccaggacgacgacuggaucgucgacgacgacggcaucggcuacgucgaggacggccgcgagaucuucgacgacgaccucgaggacgacgcccucgacgccgacgagaagggcaaggacggcaaggcccgcaacaaggacaagcgcaacgucaagaagcucgccgucaccaagcccaacaacaucaaguccauguucaucgccugcgccggcaagaagaccgccgacaaggccgucgaccucuccaaggacggccuccucggcgacauccuccaggaccucaacaccgagaccccccagaucacccccccccccgucaugauccucaagaagaagcgcuccaucggcgccucccccaaccccuucuccguccacaccgccaccgccguccccuccggcaagaucgccucccccgucucccgcaaggagcccccccucacccccgucccccucaagcgcgccgaguucgccggcgacgacguccaggucgaguccaccgaggaggagcaggaguccggcgccauggaguucgaggacggcgacuucgacgagcccauggaggucgaggaggucgaccucgagcccauggccgccaaggccugggacaaggaguccgagcccgccgaggaggucaagcaggaggccgacuccggcaagggcaccgucuccuaccucggcuccuuccuccccgacgucuccugcugggacaucgaccaggagggcgacuccuccuucuccguccaggagguccaggucgacuccucccaccucccccucgucaagggcgccgacgaggagcaggucuuccacuucuacuggcucgacgccuacgaggaccaguacaaccagcccggcgucgucuuccucuucggcaaggucuggaucgaguccgccgagacccacgucuccugcugcgucauggucaagaacaucgagcgcacccucuacuuccucccccgcgagaugaagaucgaccucaacaccggcaaggagaccggcacccccaucuccaugaaggacgucuacgaggaguucgacgagaagaucgccaccaaguacaagaucaugaaguucaaguccaagcccgucgagaagaacuacgccuucgagauccccgacguccccgagaaguccgaguaccucgaggucaaguacuccgccgagaugccccagcucccccaggaccucaagggcgagaccuucucccacgucuucggcaccaacaccuccucccucgagcucuuccucaugaaccgcaagaucaagggccccugcuggcucgaggucaaguccccccagcuccucaaccagcccgucuccuggugcaaggucgaggccauggcccucaagcccgaccucgucaacgucaucaaggacgucuccccccccccccucgucgucauggccuucuccaugaagaccaugcagaacgccaagaaccaccagaacgagaucaucgccauggccgcccucguccaccacuccuucgcccucgacaaggccgcccccaagccccccuuccagucccacuucugcgucgucuccaagcccaaggacugcaucuuccccuacgccuucaaggaggucaucgagaagaagaacgucaaggucgaggucgccgccaccgagcgcacccuccucggcuucuuccucgccaagguccacaagaucgaccccgacaucaucgucggccacaacaucuacggcuucgagcucgagguccuccuccagcgcaucaacgucugcaaggccccccacugguccaagaucggccgccucaagcgcuccaacaugcccaagcucggcggccgcuccggcuucggcgagcgcaacgccaccugcggccgcaugaucugcgacgucgagaucuccgccaaggagcucauccgcugcaaguccuaccaccucuccgagcucguccagcagauccucaagaccgagcgcgucgucauccccauggagaacauccagaacauguacuccgaguccucccagcuccucuaccuccucgagcacaccuggaaggacgccaaguucauccuccagaucaugugcgagcucaacguccucccccucgcccuccagaucaccaacaucgccggcaacaucaugucccgcacccucaugggcggccgcuccgagcgcaacgaguuccuccuccuccacgccuucuacgagaacaacuacaucguccccgacaagcagaucuuccgcaagccccagcagaagcucggcgacgaggacgaggagaucgacggcgacaccaacaaguacaagaagggccgcaagaaggccgccuacgccggcggccucguccucgaccccaaggucggcuucuacgacaaguucauccuccuccucgacuucaacucccucuaccccuccaucauccaggaguucaacaucugcuucaccaccguccagcgcgucgccuccgaggcccagaaggucaccgaggacggcgagcaggagcagauccccgagcuccccgaccccucccucgagaugggcauccucccccgcgagauccgcaagcucgucgagcgccgcaagcaggucaagcagcucaugaagcagcaggaccucaaccccgaccucauccuccaguacgacauccgccagaaggcccucaagcucaccgccaacuccauguacggcugccucggcuucuccuacucccgcuucuacgccaagccccucgccgcccucgucaccuacaagggccgcgagauccucaugcacaccaaggagaugguccagaagaugaaccucgaggucaucuacggcgacaccgacuccaucaugaucaacaccaacuccaccaaccucgaggaggucuucaagcucggcaacaaggucaaguccgaggucaacaagcucuacaagcuccucgagaucgacaucgacggcgucuucaagucccuccuccuccucaagaagaagaaguacgccgcccucgucgucgagcccaccuccgacggcaacuacgucaccaagcaggagcucaagggccucgacaucguccgccgcgacuggugcgaccucgccaaggacaccggcaacuucgucaucggccagauccucuccgaccagucccgcgacaccaucgucgagaacauccagaagcgccucaucgagaucggcgagaacguccucaacggcuccguccccgucucccaguucgagaucaacaaggcccucaccaaggacccccaggacuaccccgacaagaagucccucccccacguccacgucgcccucuggaucaacucccagggcggccgcaaggucaaggccggcgacaccgucuccuacgucaucugccaggacggcuccaaccucaccgccucccagcgcgccuacgcccccgagcagcuccagaagcaggacaaccucaccaucgacacccaguacuaccucgcccagcagauccaccccgucgucgcccgcaucugcgagcccaucgacggcaucgacgccguccucaucgccaccuggcucggccucgaccccacccaguuccgcguccaccacuaccacaaggacgaggagaacgacgcccuccucggcggccccgcccagcucaccgacgaggagaaguaccgcgacugcgagcgcuucaagugccccugccccaccugcggcaccgagaacaucuacgacaacgucuucgacggcuccggcaccgacauggagcccucccucuaccgcugcuccaacaucgacugcaaggccuccccccucaccuucaccguccagcucuccaacaagcucaucauggacauccgccgcuucaucaagaaguacuacgacggcuggcucaucugcgaggagcccaccugccgcaaccgcacccgccaccucccccuccaguucucccgcaccggcccccucugccccgccugcaugaaggccacccuccagcccgaguacuccgacaagucccucuacacccagcucugcuucuaccgcuacaucuucgacgccgagugcgcccucgagaagcucaccaccgaccacgagaaggacaagcucaagaagcaguucuucacccccaagguccuccaggacuaccgcaagcucaagaacaccgccgagcaguuccucucccgcuccggcuacuccgaggucaaccucuccaagcucuucgccggcugcgccgucaaguccuga

SEQ ID NO: 47867 - RNA, 1797 nt, Artificial Sequence
  derived and/or modified sequence opt2 from POLA2__Homo_sapiens__NP_002680
auguccgccuccgcccagcagcucgccgaggagcuccagaucuucggccucgacugcgaggaggcccucaucgagaagcucgucgagcucugcguccaguacggccagaacgaggagggcauggucggcgagcucaucgccuucugcaccuccacccacaaggucggccucaccuccgagauccucaacuccuucgagcacgaguuccucuccaagcgccucuccaaggcccgccacuccaccugcaaggacuccggccacgccggcgcccgcgacaucgucuccauccaggagcucaucgaggucgaggaggaggaggagauccuccucaacuccuacaccacccccuccaagggcucccagaagcgcgccaucuccacccccgagaccccccucaccaagcgcuccgucuccacccgcuccccccaccagcuccucucccccuccuccuucucccccuccgccacccccucccagaaguacaacucccgcuccaaccgcggcgaggucgucaccuccuucggccucgcccagggcgucuccugguccggccgcggcggcgccggcaacaucucccucaagguccucggcugccccgaggcccucaccggcuccuacaaguccauguuccagaagcuccccgacauccgcgagguccucaccugcaagaucgaggagcucggcuccgagcucaaggagcacuacaagaucgaggccuucaccccccuccucgcccccgcccaggagcccgucacccuccucggccagaucggcugcgacuccaacggcaagcucaacaacaaguccgucauccucgagggcgaccgcgagcacuccuccggcgcccagauccccgucgaccucuccgagcucaaggaguacucccucuuccccggccaggucgucaucauggagggcaucaacaccaccggccgcaagcucgucgccaccaagcucuacgagggcgucccccuccccuucuaccagcccaccgaggaggacgccgacuucgagcaguccaugguccucgucgccugcggccccuacaccaccuccgacuccaucaccuacgacccccuccucgaccucaucgccgucaucaaccacgaccgccccgacgucugcauccucuucggccccuuccucgacgccaagcacgagcaggucgagaacugccuccucaccucccccuucgaggacaucuucaagcagugccuccgcaccaucaucgagggcacccgcuccuccggcucccaccucgucuucguccccucccuccgcgacguccaccacgagcccgucuacccccagccccccuucuccuacuccgaccucucccgcgaggacaagaagcagguccaguucgucuccgagcccugcucccucuccaucaacggcgucaucuucggccucaccuccaccgaccuccucuuccaccucggcgccgaggagaucuccuccuccuccggcaccuccgaccgcuucucccgcauccucaagcacauccucacccagcgcuccuacuacccccucuaccccccccaggaggacauggccaucgacuacgaguccuucuacgucuacgcccagcuccccgucacccccgacguccucaucauccccuccgagcuccgcuacuucgucaaggacguccucggcugcgucugcgucaaccccggccgccucaccaagggccaggucggcggcaccuucgcccgccucuaccuccgccgccccgccgccgacggcgccgagcgccagucccccugcaucgccguccaggucguccgcaucuga

SEQ ID NO: 47868 - RNA, 1008 nt, Artificial Sequence
  derived and/or modified sequence opt2 from POLB__Homo_sapiens__NP_002681
auguccaagcgcaaggccccccaggagacccucaacggcggcaucaccgacaugcucaccgagcucgccaacuucgagaagaacgucucccaggccauccacaaguacaacgccuaccgcaaggccgccuccgucaucgccaaguacccccacaagaucaaguccggcgccgaggccaagaagcuccccggcgucggcaccaagaucgccgagaagaucgacgaguuccucgccaccggcaagcuccgcaagcucgagaagauccgccaggacgacaccuccuccuccaucaacuuccucacccgcgucuccggcaucggccccuccgccgcccgcaaguucgucgacgagggcaucaagacccucgaggaccuccgcaagaacgaggacaagcucaaccaccaccagcgcaucggccucaaguacuucggcgacuucgagaagcgcaucccccgcgaggagaugcuccagaugcaggacaucguccucaacgaggucaagaaggucgacuccgaguacaucgccaccgucugcggcuccuuccgccgcggcgccgaguccuccggcgacauggacguccuccucacccaccccuccuucaccuccgaguccaccaagcagcccaagcuccuccaccaggucgucgagcagcuccagaagguccacuucaucaccgacacccucuccaagggcgagaccaaguucaugggcgucugccagcuccccuccaagaacgacgagaaggaguacccccaccgccgcaucgacauccgccucauccccaaggaccaguacuacugcggcguccucuacuucaccggcuccgacaucuucaacaagaacaugcgcgcccacgcccucgagaagggcuucaccaucaacgaguacaccauccgcccccucggcgucaccggcgucgccggcgagccccuccccgucgacuccgagaaggacaucuucgacuacauccaguggaaguaccgcgagcccaaggaccgcuccgaguga

SEQ ID NO: 47869 - RNA, 3324 nt, Artificial Sequence
  derived and/or modified sequence opt2 from POLD1__Homo_sapiens__NP_001243778
auggacggcaagcgccgccccggccccggccccggcgucccccccaagcgcgcccgcggcggccucugggacgacgacgacgccccccgccccucccaguucgaggaggaccucgcccucauggaggagauggaggccgagcaccgccuccaggagcaggaggaggaggagcuccaguccguccucgagggcgucgccgacggccaggucccccccuccgccaucgacccccgcuggcuccgccccaccccccccgcccucgacccccagaccgagccccucaucuuccagcagcucgagaucgaccacuacgucggccccgcccagcccguccccggcggccccccccccucccgcggcuccguccccguccuccgcgccuucggcgucaccgacgagggcuucuccgucugcugccacauccacggcuucgcccccuacuucuacacccccgccccccccggcuucggccccgagcacaugggcgaccuccagcgcgagcucaaccucgccaucucccgcgacucccgcggcggccgcgagcucaccggccccgccguccucgccgucgagcucugcucccgcgaguccauguucggcuaccacggccacggccccucccccuuccuccgcaucaccgucgcccucccccgccucgucgcccccgcccgccgccuccucgagcagggcauccgcgucgccggccucggcacccccuccuucgcccccuacgaggccaacgucgacuucgagauccgcuucauggucgacaccgacaucgucggcugcaacuggcucgagcuccccgccggcaaguacgcccuccgccucaaggagaaggccacccagugccagcucgaggccgacguccucugguccgacgucgucucccacccccccgagggccccuggcagcgcaucgccccccuccgcguccucuccuucgacaucgagugcgccggccgcaagggcaucuuccccgagcccgagcgcgaccccgucauccagaucugcucccucggccuccgcuggggcgagcccgagcccuuccuccgccucgcccucacccuccgccccugcgcccccauccucggcgccaagguccaguccuacgagaaggaggaggaccuccuccaggccugguccaccuucauccgcaucauggaccccgacgucaucaccggcuacaacauccagaacuucgaccuccccuaccucaucucccgcgcccagacccucaagguccagaccuuccccuuccucggccgcgucgccggccucugcuccaacauccgcgacuccuccuuccaguccaagcagaccggccgccgcgacaccaaggucgucuccauggucggccgcguccagauggacaugcuccagguccuccuccgcgaguacaagcuccgcuccuacacccucaacgccgucuccuuccacuuccucggcgagcagaaggaggacguccagcacuccaucaucaccgaccuccagaacggcaacgaccagacccgccgccgccucgccgucuacugccucaaggacgccuaccucccccuccgccuccucgagcgccucaugguccucgucaacgccgucgagauggcccgcgucaccggcgucccccucuccuaccuccucucccgcggccagcaggucaaggucgucucccagcuccuccgccaggccaugcacgagggccuccucaugcccgucgucaaguccgagggcggcgaggacuacaccggcgccaccgucaucgagccccucaagggcuacuacgacguccccaucgccacccucgacuucuccucccucuaccccuccaucaugauggcccacaaccucugcuacaccacccuccuccgccccggcaccgcccagaagcucggccucaccgaggaccaguucauccgcacccccaccggcgacgaguucgucaagaccuccguccgcaagggccuccucccccagauccucgagaaccuccucuccgcccgcaagcgcgccaaggccgagcucgccaaggagaccgacccccuccgccgccagguccucgacggccgccagcucgcccucaaggucuccgccaacuccgucuacggcuucaccggcgcccaggucggcaagcuccccugccucgagaucucccaguccgucaccggcuucggccgccagaugaucgagaagaccaagcagcucgucgaguccaaguacaccgucgagaacggcuacuccaccuccgccaaggucgucuacggcgacaccgacuccgucaugugccgcuucggcgucuccuccgucgccgaggccauggcccucggccgcgaggccgccgacugggucuccggccacuuccccucccccauccgccucgaguucgagaaggucuacuuccccuaccuccucaucuccaagaagcgcuacgccggccuccucuucuccucccgccccgacgcccacgaccgcauggacugcaagggccucgaggccguccgccgcgacaacugcccccucgucgccaaccucgucaccgccucccuccgccgccuccucaucgaccgcgaccccgagggcgccgucgcccacgcccaggacgucaucuccgaccuccucugcaaccgcaucgacaucucccagcucgucaucaccaaggagcucacccgcgccgccuccgacuacgccggcaagcaggcccacgucgagcucgccgagcgcaugcgcaagcgcgaccccggcuccgcccccucccucggcgaccgcguccccuacgucaucaucuccgccgccaagggcgucgccgccuacaugaaguccgaggacccccucuucguccucgagcacucccuccccaucgacacccaguacuaccucgagcagcagcucgccaagccccuccuccgcaucuucgagcccauccucggcgagggccgcgccgaggccguccuccuccgcggcgaccacacccgcugcaagaccguccucaccggcaaggucggcggccuccucgccuucgccaagcgccgcaacugcugcaucggcugccgcaccguccucucccaccagggcgccgucugcgaguucugccagccccgcgaguccgagcucuaccagaaggaggucucccaccucaacgcccucgaggagcgcuucucccgccucuggacccagugccagcgcugccagggcucccuccacgaggacgucaucugcaccucccgcgacugccccaucuucuacaugcgcaagaagguccgcaaggaccucgaggaccaggagcagcuccuccgccgcuucggcccccccggccccgaggccugguga

SEQ ID NO: 47870 - RNA, 1410 nt, Artificial Sequence
  derived and/or modified sequence opt2 from POLD2__Homo_sapiens__NP_001243808
auguucuccgagcaggccgcccagcgcgcccacacccuccucuccccccccuccgccaacaacgccaccuucgcccgcguccccgucgccaccuacaccaacuccucccagcccuuccgccucggcgagcgcuccuucucccgccaguacgcccacaucuacgccacccgccucauccagaugcgccccuuccucgagaaccgcgcccagcagcacuggggcuccggcgucggcgucaagaagcucugcgagcuccagcccgaggagaagugcugcgucgucggcacccucuucaaggccaugccccuccagcccuccauccuccgcgaggucuccgaggagcacaaccuccucccccagcccccccgcuccaaguacauccaccccgacgacgagcucguccucgaggacgagcuccagcgcaucaagcucaagggcaccaucgacgucuccaagcucgucaccggcaccguccucgccgucuucggcuccguccgcgacgacggcaaguuccucgucgaggacuacugcuucgccgaccucgccccccagaagcccgcccccccccucgacaccgaccgcuucguccuccucgucuccggccucggccucggcggcggcggcggcgagucccuccucggcacccagcuccucgucgacgucgucaccggccagcucggcgacgagggcgagcagugcuccgccgcccacgucucccgcgucauccucgccggcaaccuccucucccacuccacccagucccgcgacuccaucaacaaggccaaguaccucaccaagaagacccaggccgccuccgucgaggccgucaagaugcucgacgagauccuccuccagcucuccgccuccguccccgucgacgucaugcccggcgaguucgaccccaccaacuacacccucccccagcagccccuccaccccugcauguucccccucgccaccgccuacuccacccuccagcucgucaccaaccccuaccaggccaccaucgacggcguccgcuuccucggcaccuccggccagaacgucuccgacaucuuccgcuacuccuccauggaggaccaccucgagauccucgaguggacccuccgcguccgccacaucucccccaccgcccccgacacccucggcugcuaccccuucuacaagaccgaccccuucaucuuccccgagugcccccacgucuacuucugcggcaacacccccuccuucggcuccaagaucauccgcggccccgaggaccagaccguccuccucgucaccguccccgacuucuccgccacccagaccgccugccucgucaaccuccgcucccucgccugccagcccaucuccuucuccggcuucggcgccgaggacgacgaccucggcggccucggccucggccccuga

SEQ ID NO: 47871 - RNA, 1401 nt, Artificial Sequence
  derived and/or modified sequence opt2 from POLD3__Homo_sapiens__NP_006582
auggccgaccagcucuaccucgagaacaucgacgaguucgucaccgaccagaacaagaucgucaccuacaaguggcucuccuacacccucggcguccacgucaaccaggccaagcagaugcucuacgacuacgucgagcgcaagcgcaaggagaacuccggcgcccagcuccacgucaccuaccucgucuccggcucccucauccagaacggccacuccugccacaaggucgccgucguccgcgaggacaagcucgaggccgucaaguccaagcucgccgucaccgccuccauccacgucuacuccauccagaaggccaugcucaaggacuccggcccccucuucaacaccgacuacgacauccucaaguccaaccuccagaacugcuccaaguucuccgccauccagugcgccgccgccgucccccgcgcccccgccgaguccuccuccuccuccaagaaguucgagcagucccaccuccacauguccuccgagacccaggccaacaacgagcucaccaccaacggccacggcccccccgccuccaagcaggucucccagcagcccaagggcaucaugggcauguucgccuccaaggccgccgccaagacccaggagaccaacaaggagaccaagaccgaggccaaggaggucaccaacgccuccgccgccggcaacaaggcccccggcaagggcaacaugauguccaacuucuucggcaaggccgccaugaacaaguucaaggucaaccucgacuccgagcaggccgucaaggaggagaagaucgucgagcagcccaccgucuccgucaccgagcccaagcucgccacccccgccggccucaagaaguccuccaagaaggccgagcccgucaagguccuccagaaggagaagaagcgcggcaagcgcgucgcccucuccgacgacgagaccaaggagaccgagaacaugcgcaagaagcgccgccgcaucaagcuccccgaguccgacuccuccgaggacgaggucuuccccgacucccccggcgccuacgaggccgagucccccucccccccccccccccccucccccccccucgagcccguccccaagaccgagcccgagccccccuccgucaaguccuccuccggcgagaacaagcgcaagcgcaagcgcguccucaaguccaagaccuaccucgacggcgagggcugcaucgucaccgagaaggucuacgaguccgaguccugcaccgacuccgaggaggagcucaacaugaagaccuccuccguccaccgcccccccgccaugaccgucaagaaggagccccgcgaggagcgcaagggccccaagaagggcaccgccgcccucggcaaggccaaccgccaggucuccaucaccggcuucuuccagcgcaaguga

SEQ ID NO: 47872 - RNA, 240 nt, Artificial Sequence
  derived and/or modified sequence opt2 from POLD4__Homo_sapiens__NP_001243799
augggccgcaagcgccucaucaccgacuccuaccccgucgucaagcgccgcgagggccccgccggccacuccaagggcgagcucgcccccgagcucggcgaggagccccagccccgcgacgaggaggaggccgagcucgagcuccuccgccaguucgaccucgccuggcaguacggccccugcaccgucuccggcaucuccauccccuacgaggccccccgcaagaccuccugccccuga

SEQ ID NO: 47873 - RNA, 1317 nt, Artificial Sequence
  derived and/or modified sequence opt2 from POLDIP3__Homo_sapiens__NP_001265586
auggccgacaucucccucgacgagcucauccgcaagcgcggcgccgccgccaagggccgccucaacgcccgccccggcgucggcggcguccgcucccgcgucggcauccagcagggccuccucucccaguccacccgcaccgccaccuuccagcagcgcuucgacgcccgccagaagaucggccucuccgacgcccgccucaagcucggcgucaaggacgcccgcgagaagcuccuccagaaggacgcccgcuuccgcaucaagggcaagguccaggacgcccgcgagaugcucaacucccgcaagcagcagaccaccgucccccagaagccccgccaggucgccgacgcccgcgagaagaucucccucaagcgcuccucccccgccgccuucaucaacccccccaucggcaccgucacccccgcccucaagcucaccaagaccauccagcgcaugcacgucgaccccgucggcuggauccucaccaccgagugcuuccaggucccccagcagaaggccauggccccccuccacccccaccccgccggcaugcgcaucaacgucgucaacaaccaccaggccaagcagaaccucuacgaccucgacgaggacgacgacggcaucgccuccguccccaccaagcagaugaaguucgccgccuccggcggcuuccuccaccacauggccggccucuccuccuccaagcucuccauguccaaggcccucccccucaccaaggucguccagaacgacgccuacaccgcccccgcccuccccuccuccauccgcaccaaggcccucaccaacaugucccgcacccucgucaacaaggaggagccccccaaggagcuccccgccgccgagcccguccucuccccccucgagggcaccaagaugaccgucaacaaccuccacccccgcgucaccgaggaggacaucgucgagcucuucugcgucugcggcgcccucaagcgcgcccgccucguccaccccggcgucgccgaggucgucuucgucaagaaggacgacgccaucaccgccuacaagaaguacaacaaccgcugccucgacggccagcccaugaagugcaaccuccacaugaacggcaacgucaucaccuccgaccagcccauccuccuccgccucuccgacucccccuccaugaagaaggaguccgagcucccccgccgcgucaacuccgccuccuccuccaacccccccgccgaggucgaccccgacaccauccucaaggcccucuucaaguccuccggcgccuccgucaccacccagcccaccgaguucaagaucaagcucuga

SEQ ID NO: 47874 - RNA, 1506 nt, Artificial Sequence
  derived and/or modified sequence opt2 from POLE2__Homo_sapiens__NP_001184259
auggcccccgagcgccuccgcucccgcgcccucuccgccuucaagcuccgcggccuccuccuccgcggcgaggccaucaaguaccucaccgaggcccuccaguccaucuccgagcucgagcucgaggacaagcucgagaagaucaucaacgccgucgagaagcagccccucuccuccaacaugaucgagcgcuccgucgucgaggccgccguccaggagugcucccaguccgucgacgagaccauccuccucaugaccaaccaccccgcccccaaccucuucggcaccccccgcgacaaggccgagauguuccgcgagcgcuacaccauccuccaccagcgcacccaccgccacgagcucuucaccccccccgucaucggcucccaccccgacgaguccggcuccaaguuccagcucaagaccaucgagacccuccucggcuccaccaccaagaucggcgacgccaucguccucggcaugaucacccagcucaaggagggcaaguucuuccucgaggaccccaccggcaccguccagcucgaccucuccaaggcccaguuccacuccggccucuacaccgaggccugcuucguccucgccgagggcugguucgaggaccaggucuuccacgucaacgccuucggcuucccccccaccgagcccuccuccaccacccgcgccuacuacggcaacaucaacuucuucggcggccccuccaacaccuccgucaagaccuccgccaagcucaagcagcucgaggaggagaacaaggacgccauguucgucuuccucuccgacgucuggcucgaccaggucgagguccucgagaagcuccgcaucauguucgccggcuacucccccgccccccccaccugcuucauccucugcggcaacuucuccuccgcccccuacggcaagaaccagguccaggcccucaaggacucccucaagacccucgccgacaucaucugcgaguaccccgacauccaccaguccucccgcuucgucuucguccccggccccgaggaccccggcuucggcuccauccucccccgccccccccucgccgaguccaucaccaacgaguuccgccagcgcguccccuucuccgucuucaccaccaaccccugccgcauccaguacugcacccaggagaucaccgucuuccgcgaggaccucgucaacaagaugugccgcaacugcguccgcuuccccuccuccaaccucgccauccccaaccacuucgucaagaccauccucucccagggccaccucaccccccucccccucuacgucugccccgucuacugggccuacgacuacgcccuccgcgucuaccccguccccgaccuccucgucaucgccgacaaguacgaccccuucaccaccaccaacaccgagugccucugcaucaaccccggcuccuucccccgcuccggcuucuccuucaaggucuucuaccccuccaacaagaccgucgaggacuccaagcuccagggcuucuga

SEQ ID NO: 47875 - RNA, 444 nt, Artificial Sequence
  derived and/or modified sequence opt2 from POLE3__Homo_sapiens__NP_059139
auggccgagcgccccgaggaccucaaccuccccaacgccgucaucacccgcaucaucaaggaggcccuccccgacggcgucaacaucuccaaggaggcccgcuccgccaucucccgcgccgccuccgucuucguccucuacgccaccuccugcgccaacaacuucgccaugaagggcaagcgcaagacccucaacgccuccgacguccucuccgccauggaggagauggaguuccagcgcuucgucaccccccucaaggaggcccucgaggccuaccgccgcgagcagaagggcaagaaggaggccuccgagcagaagaagaaggacaaggacaagaagaccgacuccgaggagcaggacaagucccgcgacgaggacaacgacgaggacgaggagcgccucgaggaggaggagcagaacgaggaggaggaggucgacaacuga

SEQ ID NO: 47876 - RNA, 354 nt, Artificial Sequence
  derived and/or modified sequence opt2 from POLE4__Homo_sapiens__NP_063949
auggccgccgccgccgccgccggcuccggcaccccccgcgaggaggagggccccgccggcgaggccgccgccucccagccccaggcccccaccuccguccccggcgcccgccucucccgccucccccucgcccgcgucaaggcccucgucaaggccgaccccgacgucacccucgccggccaggaggccaucuucauccucgcccgcgccgccgagcucuucgucgagaccaucgccaaggacgccuacugcugcgcccagcagggcaagcgcaagacccuccagcgccgcgaccucgacaacgccaucgaggccgucgacgaguucgccuuccucgagggcacccucgacuga

SEQ ID NO: 47877 - RNA, 6861 nt, Artificial Sequence
  derived and/or modified sequence opt2 from POLE__Homo_sapiens__NP_006222
augucccuccgcuccggcggccgccgccgcgccgaccccggcgccgacggcgaggccucccgcgacgacggcgccaccuccuccgucuccgcccucaagcgccucgagcgcucccaguggaccgacaagauggaccuccgcuucggcuucgagcgccucaaggagcccggcgagaagaccggcuggcucaucaacaugcaccccaccgagauccucgacgaggacaagcgccucggcuccgccgucgacuacuacuucauccaggacgacggcucccgcuucaaggucgcccuccccuacaagcccuacuucuacaucgccacccgcaagggcugcgagcgcgaggucuccuccuuccucuccaagaaguuccagggcaagaucgccaaggucgagaccguccccaaggaggaccucgaccuccccaaccaccucgucggccucaagcgcaacuacauccgccucuccuuccacaccgucgaggaccucgucaagguccgcaaggagaucucccccgccgucaagaagaaccgcgagcaggaccacgccuccgacgccuacaccgcccuccucuccuccguccuccagcgcggcggcgucaucaccgacgaggaggagaccuccaagaagaucgccgaccagcucgacaacaucgucgacaugcgcgaguacgacguccccuaccacauccgccucuccaucgaccucaagauccacgucgcccacugguacaacguccgcuaccgcggcaacgccuuccccgucgagaucacccgccgcgacgaccucgucgagcgccccgaccccgucguccucgccuucgacaucgagaccaccaagcucccccucaaguuccccgacgccgagaccgaccagaucaugaugaucuccuacaugaucgacggccagggcuaccucaucaccaaccgcgagaucgucuccgaggacaucgaggacuucgaguucacccccaagcccgaguacgagggccccuucugcgucuucaacgagcccgacgaggcccaccucauccagcgcugguucgagcacguccaggagaccaagcccaccaucauggucaccuacaacggcgacuucuucgacuggcccuucgucgaggcccgcgccgccguccacggccucuccaugcagcaggagaucggcuuccagaaggacucccagggcgaguacaaggccccccagugcauccacauggacugccuccgcugggucaagcgcgacuccuaccuccccgucggcucccacaaccucaaggccgccgccaaggccaagcucggcuacgaccccgucgagcucgaccccgaggacaugugccgcauggccaccgagcagccccagacccucgccaccuacuccgucuccgacgccgucgccaccuacuaccucuacaugaaguacguccaccccuucaucuucgcccucugcaccaucauccccauggagcccgacgagguccuccgcaagggcuccggcacccucugcgaggcccuccucaugguccaggccuuccacgccaacaucaucuuccccaacaagcaggagcaggaguucaacaagcucaccgacgacggccacguccucgacuccgagaccuacgucggcggccacgucgaggcccucgaguccggcgucuuccgcuccgacauccccugccgcuuccgcaugaaccccgccgccuucgacuuccuccuccagcgcgucgagaagacccuccgccacgcccucgaggaggaggagaagguccccgucgagcaggucaccaacuucgaggaggucugcgacgagaucaaguccaagcucgccucccucaaggacguccccucccgcaucgagugcccccucaucuaccaccucgacgucggcgccauguaccccaacaucauccucaccaaccgccuccagcccuccgccauggucgacgaggccaccugcgccgccugcgacuucaacaagcccggcgccaacugccagcgcaagauggccuggcaguggcgcggcgaguucaugcccgccucccgcuccgaguaccaccgcauccagcaccagcucgaguccgagaaguuccccccccucuuccccgagggccccgcccgcgccuuccacgagcucucccgcgaggagcaggccaaguacgagaagcgccgccucgccgacuacugccgcaaggccuacaagaagauccacaucaccaaggucgaggagcgccucaccaccaucugccagcgcgagaacuccuucuacgucgacaccguccgcgccuuccgcgaccgccgcuacgaguucaagggccuccacaaggucuggaagaagaagcucuccgccgccgucgaggucggcgacgccgccgaggucaagcgcugcaagaacauggagguccucuacgacucccuccagcucgcccacaagugcauccucaacuccuucuacggcuacgucaugcgcaagggcgcccgcugguacuccauggagauggccggcaucgucugcuucaccggcgccaacaucaucacccaggcccgcgagcucaucgagcagaucggccgcccccucgagcucgacaccgacggcaucuggugcguccuccccaacuccuuccccgagaacuucgucuucaagaccaccaacgucaagaagcccaaggucaccaucuccuaccccggcgccaugcucaacaucauggucaaggagggcuucaccaacgaccaguaccaggagcucgccgagcccuccucccucaccuacgucacccgcuccgagaacuccaucuucuucgaggucgacggccccuaccucgccaugauccuccccgccuccaaggaggagggcaagaagcucaagaagcgcuacgccgucuucaacgaggacggcucccucgccgagcucaagggcuucgaggucaagcgccgcggcgagcuccagcucaucaagaucuuccaguccuccgucuucgaggccuuccucaagggcuccacccucgaggaggucuacggcuccgucgccaaggucgccgacuacuggcucgacguccucuacuccaaggccgccaacaugcccgacuccgagcucuucgagcucaucuccgagaaccgcuccaugucccgcaagcucgaggacuacggcgagcagaaguccaccuccaucuccaccgccaagcgccucgccgaguuccucggcgaccagauggucaaggacgccggccucuccugccgcuacaucaucucccgcaagcccgagggcucccccgucaccgagcgcgccaucccccucgccaucuuccaggccgagcccaccguccgcaagcacuuccuccgcaaguggcucaaguccuccucccuccaggacuucgacauccgcgccauccucgacugggacuacuacaucgagcgccucggcuccgccauccagaagaucaucaccauccccgccgcccuccagcaggucaagaaccccgucccccgcgucaagcaccccgacuggcuccacaagaagcuccucgagaagaacgacgucuacaagcagaagaagaucuccgagcucuucacccucgagggccgccgccaggucaccauggccgaggccuccgaggacuccccccgccccuccgcccccgacauggaggacuucggccucgucaagcucccccaccccgccgcccccgucaccgucaagcgcaagcgcguccucugggagucccaggaggagucccaggaccucacccccaccguccccuggcaggagauccucggccagccccccgcccucggcaccucccaggaggaguggcucgucuggcuccgcuuccacaagaagaaguggcagcuccaggcccgccagcgccucgcccgccgcaagcgccagcgccucgaguccgccgagggcguccuccgccccggcgccauccgcgacggccccgccaccggccucggcuccuuccuccgccgcaccgcccgcuccauccucgaccuccccuggcagaucguccagaucuccgagaccucccaggccggccucuuccgccucugggcccucgucggcuccgaccuccacugcauccgccucuccaucccccgcgucuucuacgucaaccagcgcgucgccaaggccgaggagggcgccuccuaccgcaaggucaaccgcguccucccccgcuccaacauggucuacaaccucuacgaguacuccguccccgaggacauguaccaggagcacaucaacgagaucaacgccgagcucuccgcccccgacaucgagggcgucuacgagacccaggucccccuccucuuccgcgcccucguccaccucggcugcgucugcgucgucaacaagcagcucguccgccaccucuccggcugggaggccgagaccuucgcccucgagcaccucgagaugcgcucccucgcccaguucuccuaccucgagcccggcuccauccgccacaucuaccucuaccaccacgcccaggcccacaaggcccucuucggcaucuucauccccucccagcgccgcgccuccgucuucguccucgacaccguccgcuccaaccagaugcccucccucggcgcccucuacuccgccgagcacggccuccuccucgagaaggucggccccgagcuccuccccccccccaagcacaccuucgagguccgcgccgagaccgaccucaagaccaucugccgcgccauccagcgcuuccuccucgccuacaaggaggagcgccgcggccccacccucaucgccguccaguccuccugggagcucaagcgccucgccuccgagauccccguccucgaggaguucccccucguccccaucugcgucgccgacaagaucaacuacggcguccucgacuggcagcgccacggcgcccgccgcaugauccgccacuaccucaaccucgacaccugccucucccaggccuucgagaugucccgcuacuuccacauccccaucggcaaccuccccgaggacaucuccaccuucggcuccgaccucuucuucgcccgccaccuccagcgccacaaccaccuccucuggcucucccccaccgcccgccccgaccucggcggcaaggaggccgacgacaacugccucgucauggaguucgacgaccaggccaccgucgagaucaacuccuccggcugcuacuccaccgucugcgucgagcucgaccuccagaaccucgccgucaacaccauccuccagucccaccacgucaacgacauggagggcgccgacuccaugggcaucuccuucgacgucauccagcaggccucccucgaggacaugaucaccggcggccaggccgccuccgcccccgccuccuacgacgagaccgcccucugcuccaacaccuuccgcauccucaaguccauggucgucggcugggucaaggagaucacccaguaccacaacaucuacgccgacaaccaggucaugcacuucuaccgcuggcuccgcucccccuccucccuccuccacgaccccgcccuccaccgcacccuccacaacaugaugaagaagcucuuccuccagcucaucgccgaguucaagcgccucggcuccuccgucaucuacgccaacuucaaccgcaucauccucugcaccaagaagcgccgcgucgaggacgccaucgccuacgucgaguacaucaccuccuccauccacuccaaggagaccuuccacucccucaccaucuccuucucccgcugcugggaguuccuccucuggauggaccccuccaacuacggcggcaucaagggcaaggucuccucccgcauccacugcggccuccaggacucccagaaggccggcggcgccgaggacgagcaggagaacgaggacgacgaggaggagcgcgacggcgaggaggaggaggaggccgaggaguccaacgucgaggaccuccucgagaacaacuggaacauccuccaguuccucccccaggccgccuccugccagaacuacuuccucaugaucgucuccgccuacaucgucgccgucuaccacugcaugaaggacggccuccgccgcuccgcccccggcuccacccccguccgccgccgcggcgccucccagcucucccaggaggccgagggcgccgucggcgcccuccccggcaugaucaccuucucccaggacuacgucgccaacgagcucacccaguccuucuucaccaucacccagaagauccagaagaaggucaccggcucccgcaacuccaccgagcucuccgagauguuccccguccuccccggcucccaccuccuccucaacaaccccgcccucgaguucaucaaguacgucugcaagguccucucccucgacaccaacaucaccaaccaggucaacaagcucaaccgcgaccuccuccgccucgucgacgucggcgaguucuccgaggaggcccaguuccgcgaccccugccgcuccuacguccuccccgaggucaucugccgcuccugcaacuucugccgcgaccucgaccucugcaaggacuccuccuucuccgaggacggcgccguccucccccaguggcucugcuccaacugccaggcccccuacgacuccuccgccaucgagaugacccucgucgagguccuccagaagaagcucauggccuucacccuccaggaccucgucugccucaagugccgcggcgucaaggagaccuccaugcccgucuacugcuccugcgccggcgacuucgcccucaccauccacacccaggucuucauggagcagaucggcaucuuccgcaacaucgcccagcacuacggcauguccuaccuccucgagacccucgaguggcuccuccagaagaacccccagcucggccacuga

SEQ ID NO: 47878 - RNA, 1458 nt, Artificial Sequence
  derived and/or modified sequence opt2 from POLG2__Homo_sapiens__NP_009146
augcgcucccgcgucgccguccgcgccugccacaaggucugccgcugccuccucuccggcuucggcggccgcgucgacgccggccagcccgagcuccucaccgagcgcuccucccccaagggcggccacgucaagucccacgccgagcucgagggcaacggcgagcaccccgaggcccccggcuccggcgagggcuccgaggcccuccucgagaucugccagcgccgccacuuccucuccggcuccaagcagcagcucucccgcgacucccuccucuccggcugccaccccggcuucggcccccucggcgucgagcuccgcaagaaccucgccgccgagugguggaccuccgucgucgucuuccgcgagcaggucuuccccgucgacgcccuccaccacaagcccggcccccuccuccccggcgacuccgccuuccgccucgucuccgccgagacccuccgcgagauccuccaggacaaggagcucuccaaggagcagcucgucgccuuccucgagaacguccucaagaccuccggcaagcuccgcgagaaccuccuccacggcgcccucgagcacuacgucaacugccucgaccucgucaacaagcgccuccccuacggccucgcccagaucggcgucugcuuccaccccgucuucgacaccaagcagauccgcaacggcgucaaguccaucggcgagaagaccgaggccucccucgucugguucacccccccccgcaccuccaaccaguggcucgacuucuggcuccgccaccgccuccagugguggcgcaaguucgccaugucccccuccaacuucuccuccuccgacugccaggacgaggagggccgcaagggcaacaagcucuacuacaacuuccccuggggcaaggagcucaucgagacccucuggaaccucggcgaccacgagcuccuccacauguaccccggcaacgucuccaagcuccacggccgcgacggccgcaagaacgucguccccugcguccucuccgucaacggcgaccucgaccgcggcaugcucgccuaccucuacgacuccuuccagcucaccgagaacuccuucacccgcaagaagaaccuccaccgcaagguccucaagcuccaccccugccucgcccccaucaaggucgcccucgacgucggccgcggccccacccucgagcuccgccaggucugccagggccucuucaacgagcuccucgagaacggcaucuccgucuggcccggcuaccucgagaccaugcaguccucccucgagcagcucuacuccaaguacgacgagauguccauccucuucaccguccucgucaccgagaccacccucgagaacggccucauccaccuccgcucccgcgacaccaccaugaaggagaugaugcacaucuccaagcucaaggacuuccucaucaaguacaucuccuccgccaagaacgucuga

SEQ ID NO: 47879 - RNA, 3720 nt, Artificial Sequence
  derived and/or modified sequence opt2 from POLG__Homo_sapiens__NP_002684
augucccgccuccucuggcgcaaggucgccggcgccaccgucggccccggccccguccccgcccccggccgcugggucuccuccuccguccccgccuccgaccccuccgacggccagcgccgccgccagcagcagcagcagcagcagcagcagcagcagcagcagccccagcagccccagguccucuccuccgagggcggccagcuccgccacaacccccucgacauccagaugcucucccgcggccuccacgagcagaucuucggccagggcggcgagaugcccggcgaggccgccguccgccgcuccgucgagcaccuccagaagcacggccucuggggccagcccgccgucccccuccccgacgucgagcuccgccuccccccccucuacggcgacaaccucgaccagcacuuccgccuccucgcccagaagcagucccuccccuaccucgaggccgccaaccuccuccuccaggcccagcucccccccaagccccccgccugggccugggccgagggcuggacccgcuacggccccgagggcgaggccguccccgucgccauccccgaggagcgcgcccucgucuucgacgucgaggucugccucgccgagggcaccugccccacccucgccgucgccaucucccccuccgccugguacuccuggugcucccagcgccucgucgaggagcgcuacuccuggaccucccagcucucccccgccgaccucaucccccucgagguccccaccggcgccuccucccccacccagcgcgacuggcaggagcagcucgucgucggccacaacgucuccuucgaccgcgcccacauccgcgagcaguaccucauccagggcucccgcaugcgcuuccucgacaccauguccaugcacauggccaucuccggccucuccuccuuccagcgcucccucuggaucgccgccaagcagggcaagcacaagguccagccccccaccaagcagggccagaagucccagcgcaaggcccgccgcggccccgccaucuccuccugggacuggcucgacaucuccuccgucaacucccucgccgagguccaccgccucuacgucggcggccccccccucgagaaggagccccgcgagcucuucgucaagggcaccaugaaggacauccgcgagaacuuccaggaccucaugcaguacugcgcccaggacgucugggccacccacgaggucuuccagcagcagcucccccucuuccucgagcgcugcccccaccccgucacccucgccggcaugcucgagaugggcgucuccuaccuccccgucaaccagaacugggagcgcuaccucgccgaggcccagggcaccuacgaggagcuccagcgcgagaugaagaagucccucauggaccucgccaacgacgccugccagcuccucuccggcgagcgcuacaaggaggaccccuggcucugggaccucgagugggaccuccaggaguucaagcagaagaaggccaagaaggucaagaaggagcccgccaccgccuccaagcuccccaucgagggcgccggcgcccccggcgaccccauggaccaggaggaccucggccccugcuccgaggaggaggaguuccagcaggacgucauggcccgcgccugccuccagaagcucaagggcaccaccgagcuccuccccaagcgcccccagcaccuccccggccaccccggcugguaccgcaagcucugcccccgccucgacgaccccgccuggacccccggccccucccuccucucccuccagaugcgcgucacccccaagcucauggcccucaccugggacggcuucccccuccacuacuccgagcgccacggcuggggcuaccucguccccggccgccgcgacaaccucgccaagcuccccaccggcaccacccucgaguccgccggcgucgucugccccuaccgcgccaucgagucccucuaccgcaagcacugccucgagcagggcaagcagcagcucaugccccaggaggccggccucgccgaggaguuccuccucaccgacaacuccgccaucuggcagaccgucgaggagcucgacuaccucgaggucgaggccgaggccaagauggagaaccuccgcgccgccguccccggccagccccucgcccucaccgcccgcggcggccccaaggacacccagcccuccuaccaccacggcaacggccccuacaacgacgucgacauccccggcugcugguucuucaagcucccccacaaggacggcaacuccugcaacgucggcucccccuucgccaaggacuuccuccccaagauggaggacggcacccuccaggccggccccggcggcgccuccggcccccgcgcccucgagaucaacaagaugaucuccuucuggcgcaacgcccacaagcgcaucuccucccagauggucgucuggcucccccgcuccgcccucccccgcgccgucauccgccaccccgacuacgacgaggagggccucuacggcgccauccucccccaggucgucaccgccggcaccaucacccgccgcgccgucgagcccaccuggcucaccgccuccaacgcccgccccgaccgcgucggcuccgagcucaaggccaugguccaggccccccccggcuacacccucgucggcgccgacgucgacucccaggagcucuggaucgccgccguccucggcgacgcccacuucgccggcaugcacggcugcaccgccuucggcuggaugacccuccagggccgcaagucccgcggcaccgaccuccacuccaagaccgccaccaccgucggcaucucccgcgagcacgccaagaucuucaacuacggccgcaucuacggcgccggccagcccuucgccgagcgccuccucaugcaguucaaccaccgccucacccagcaggaggccgccgagaaggcccagcagauguacgccgccaccaagggccuccgcugguaccgccucuccgacgagggcgaguggcucguccgcgagcucaaccuccccgucgaccgcaccgagggcggcuggaucucccuccaggaccuccgcaagguccagcgcgagaccgcccgcaagucccaguggaagaagugggaggucgucgccgagcgcgccuggaagggcggcaccgaguccgagauguucaacaagcucgaguccaucgccaccuccgacaucccccgcacccccguccucggcugcugcaucucccgcgcccucgagcccuccgccguccaggaggaguucaugaccucccgcgucaacugggucguccaguccuccgccgucgacuaccuccaccucaugcucgucgccaugaaguggcucuucgaggaguucgccaucgacggccgcuucugcaucuccauccacgacgagguccgcuaccucguccgcgaggaggaccgcuaccgcgccgcccucgcccuccagaucaccaaccuccucacccgcugcauguucgccuacaagcucggccucaacgaccucccccaguccgucgccuucuucuccgccgucgacaucgaccgcugccuccgcaaggaggucaccauggacugcaagacccccuccaaccccaccggcauggagcgccgcuacggcaucccccagggcgaggcccucgacaucuaccagaucaucgagcucaccaagggcucccucgagaagcgcucccagcccggccccuga

SEQ ID NO: 47880 - RNA, 1245 nt, Artificial Sequence
  derived and/or modified sequence opt2 from POLH__Homo_sapiens__NP_001278899
auggccaccggccaggaccgcgucgucgcccucgucgacauggacugcuucuucguccaggucgagcagcgccagaacccccaccuccgcaacaagcccugcgccgucguccaguacaaguccuggaagggcggcggcaucaucgccgucuccuacgaggcccgcgccuucggcgucacccgcuccaugugggccgacgacgccaagaagcucugccccgaccuccuccucgcccagguccgcgagucccgcggcaaggccaaccucaccaaguaccgcgaggccuccgucgaggucauggagaucaugucccgcuucgccgucaucgagcgcgccuccaucgacgaggccuacgucgaccucaccuccgccguccaggagcgccuccagaagcuccagggccagcccaucuccgccgaccuccuccccuccaccuacaucgagggccucccccagggccccaccaccgccgaggagaccguccagaaggagggcaugcgcaagcagggccucuuccaguggcucgacucccuccagaucgacaaccucaccucccccgaccuccagcucaccgucggcgccgucaucgucgaggagaugcgcgccgccaucgagcgcgagaccggcuuccagugcuccgccggcaucucccacaacaagguccucgccaagcucgccugcggccucaacaagcccaaccgccagacccucgucucccacggcuccgucccccagcucuucucccagaugcccauccgcaagauccgcucccucggcggcaagcucggcgccuccgucaucgagauccucggcaucgaguacaugggcgagcucacccaguucaccgagucccagcuccagucccacuucggcgagaagaacggcuccuggcucuacgccaugugccgcggcaucgagcacgaccccgucaagccccgccagcuccccaagaccaucggcugcuccaagaacuuccccggcaagaccgcccucgccacccgcgagcagguccagugguggcuccuccagcucgcccaggagcucgaggagcgccucaccaaggaccgcaacgacaacgaccgcgucgccacccagcucgucgucuccauccgcguccagggcgacaagcgccucuccucccuccgccgcugcugcgcccucacccgcuacgacgcccacaagaugucccacgacgccuucaccgucaucaagaacugcaacaccuccggcauccagaccgaguga

SEQ ID NO: 47881 - RNA, 2223 nt, Artificial Sequence
  derived and/or modified sequence opt2 from POLI__Homo_sapiens__NP_009126
auggagaagcucggcgucgagcccgaggaggagggcggcggcgacgacgacgaggaggacgccgaggccugggccauggagcucgccgacgucggcgccgccgccuccucccagggcguccacgaccagguccuccccacccccaacgccuccucccgcgucaucguccacgucgaccucgacugcuucuacgcccaggucgagaugaucuccaaccccgagcucaaggacaagccccucggcguccagcagaaguaccucgucgucaccugcaacuacgaggcccgcaagcucggcgucaagaagcucaugaacguccgcgacgccaaggagaagugcccccagcucguccucgucaacggcgaggaccucacccgcuaccgcgagauguccuacaaggucaccgagcuccucgaggaguucucccccgucgucgagcgccucggcuucgacgagaacuucgucgaccucaccgagauggucgagaagcgccuccagcagcuccaguccgacgagcucuccgccgucaccgucuccggccacgucuacaacaaccaguccaucaaccuccucgacguccuccacauccgccuccucgucggcucccagaucgccgccgagaugcgcgaggccauguacaaccagcucggccucaccggcugcgccggcgucgccuccaacaagcuccucgccaagcucgucuccggcgucuucaagcccaaccagcagaccguccuccuccccgaguccugccagcaccucauccacucccucaaccacaucaaggagauccccggcaucggcuacaagaccgccaagugccucgaggcccucggcaucaacuccguccgcgaccuccagaccuucucccccaagauccucgagaaggagcucggcaucuccgucgcccagcgcauccagaagcucuccuucggcgaggacaacucccccgucauccucuccggccccccccaguccuucuccgaggaggacuccuucaagaagugcuccuccgaggucgaggccaagaacaagaucgaggagcuccucgccucccuccucaaccgcgucugccaggacggccgcaagccccacaccguccgccucaucauccgccgcuacuccuccgagaagcacuacggccgcgagucccgccagugccccauccccucccacgucauccagaagcucggcaccggcaacuacgacgucaugacccccauggucgacauccucaugaagcucuuccgcaacauggucaacgucaagaugcccuuccaccucacccuccucuccgucugcuucugcaaccucaaggcccucaacaccgccaagaagggccucaucgacuacuaccucaugcccucccucuccaccaccucccgcuccggcaagcacuccuucaagaugaaggacacccacauggaggacuuccccaaggacaaggagaccaaccgcgacuuccuccccuccggccgcaucgaguccacccgcacccgcgaguccccccucgacaccaccaacuucuccaaggagaaggacaucaacgaguucccccucugcucccuccccgagggcgucgaccaggaggucuucaagcagcuccccgucgacauccaggaggagauccucuccggcaagucccgcgagaaguuccagggcaagggcuccgucuccugcccccuccacgccucccgcggcguccucuccuucuucuccaagaagcagaugcaggacauccccaucaacccccgcgaccaccucuccuccuccaagcaggucuccuccgucucccccugcgagcccggcaccuccggcuucaacuccuccuccuccuccuacauguccucccagaaggacuacuccuacuaccucgacaaccgccucaaggacgagcgcaucucccagggccccaaggagccccagggcuuccacuucaccaacuccaaccccgccgucuccgccuuccacuccuuccccaaccuccaguccgagcagcucuucucccgcaaccacaccaccgacucccacaagcagaccgucgccaccgacucccacgagggccucaccgagaaccgcgagcccgacuccgucgacgagaagaucaccuuccccuccgacaucgacccccaggucuucuacgagcuccccgaggccguccagaaggagcuccucgccgaguggaagcgcgccggcuccgacuuccacaucggccacaaguga

SEQ ID NO: 47882 - RNA, 2613 nt, Artificial Sequence
  derived and/or modified sequence opt2 from POLK__Homo_sapiens__NP_057302
auggacuccaccaaggagaagugcgacuccuacaaggacgaccuccuccuccgcaugggccucaacgacaacaaggccggcauggagggccucgacaaggagaagaucaacaagaucaucauggaggccaccaagggcucccgcuucuacggcaacgagcucaagaaggagaagcaggucaaccagcgcaucgagaacaugaugcagcagaaggcccagaucaccucccagcagcuccgcaaggcccagcuccaggucgaccgcuucgccauggagcucgagcagucccgcaaccucuccaacaccaucguccacaucgacauggacgccuucuacgccgccgucgagaugcgcgacaaccccgagcucaaggacaagcccaucgccgucggcuccauguccaugcucuccaccuccaacuaccacgcccgccgcuucggcguccgcgccgccaugcccggcuucaucgccaagcgccucugcccccagcucaucaucgucccccccaacuucgacaaguaccgcgccgucuccaaggaggucaaggagauccucgccgacuacgaccccaacuucauggccaugucccucgacgaggccuaccucaacaucaccaagcaccucgaggagcgccagaacuggcccgaggacaagcgccgcuacuucaucaagaugggcuccuccgucgagaacgacaaccccggcaaggaggucaacaagcucuccgagcacgagcgcuccaucuccccccuccucuucgaggagucccccuccgacguccagccccccggcgaccccuuccaggucaacuucgaggagcagaacaacccccagauccuccagaacuccgucgucuucggcaccuccgcccaggaggucgucaaggagauccgcuuccgcaucgagcagaagaccacccucaccgccuccgccggcaucgcccccaacaccaugcucgccaaggucugcuccgacaagaacaagcccaacggccaguaccagauccuccccaaccgccaggccgucauggacuucaucaaggaccuccccauccgcaaggucuccggcaucggcaaggucaccgagaagaugcucaaggcccucggcaucaucaccugcaccgagcucuaccagcagcgcgcccuccucucccuccucuucuccgagaccuccuggcacuacuuccuccacaucucccucggccucggcuccacccaccucacccgcgacggcgagcgcaaguccauguccgucgagcgcaccuucuccgagaucaacaaggccgaggagcaguacucccucugccaggagcucugcuccgagcucgcccaggaccuccagaaggagcgccucaagggccgcaccgucaccaucaagcucaagaacgucaacuucgaggucaagacccgcgccuccaccgucuccuccgucgucuccaccgccgaggagaucuucgccaucgccaaggagcuccucaagaccgagaucgacgccgacuucccccacccccuccgccuccgccucaugggcguccgcaucuccuccuuccccaacgaggaggaccgcaagcaccagcagcgcuccaucaucggcuuccuccaggccggcaaccaggcccucuccgccaccgagugcacccucgagaagaccgacaaggacaaguucgucaagccccucgagaugucccacaagaaguccuucuucgacaagaagcgcuccgagcgcaaguggucccaccaggacaccuucaagugcgaggccgucaacaagcaguccuuccagaccucccagcccuuccagguccucaagaagaagaugaacgagaaccucgagaucuccgagaacuccgacgacugccagauccucaccugccccgucugcuuccgcgcccagggcugcaucucccucgaggcccucaacaagcacgucgacgagugccucgacggccccuccaucuccgagaacuucaagauguucuccugcucccacgucuccgccaccaaggucaacaagaaggagaacguccccgccuccucccucugcgagaagcaggacuacgaggcccaccccaagaucaaggagaucuccuccgucgacugcaucgcccucgucgacaccaucgacaacuccuccaaggccgaguccaucgacgcccucuccaacaagcacuccaaggaggagugcuccucccuccccuccaaguccuucaacaucgagcacugccaccagaacuccuccuccaccgucucccucgagaacgaggacgucggcuccuuccgccaggaguaccgccagcccuaccucugcgaggucaagaccggccaggcccucgucugccccgucugcaacgucgagcagaagaccuccgaccucacccucuucaacguccacgucgacgucugccucaacaaguccuucauccaggagcuccgcaaggacaaguucaaccccgucaaccagcccaaggaguccucccgcuccaccggcuccuccuccggcguccagaaggccgucacccgcaccaagcgccccggccucaugaccaaguacuccaccuccaagaagaucaagcccaacaaccccaagcacacccucgacaucuucuucaaguga

SEQ ID NO: 47883 - RNA, 1728 nt, Artificial Sequence
  derived and/or modified sequence opt2 from POLL__Homo_sapiens__NP_001167555
auggacccccgcggcauccucaaggccuuccccaagcgccagaagauccacgccgacgccuccuccaagguccucgccaagaucccccgccgcgaggagggcgaggaggccgaggaguggcucuccucccuccgcgcccacgucguccgcaccggcaucggccgcgcccgcgccgagcucuucgagaagcagaucguccagcacggcggccagcucugccccgcccagggccccggcgucacccacaucgucgucgacgagggcauggacuacgagcgcgcccuccgccuccuccgccucccccagcucccccccggcgcccagcucgucaaguccgccuggcucucccucugccuccaggagcgccgccucgucgacgucgccggcuucuccaucuucauccccucccgcuaccucgaccacccccagcccuccaaggccgagcaggacgccuccaucccccccggcacccacgaggcccuccuccagaccgcccucucccccccccccccccccacccgccccgucucccccccccagaaggccaaggaggcccccaacacccaggcccagcccaucuccgacgacgaggccuccgacggcgaggagacccaggucuccgccgccgaccucgaggcccucaucuccggccacuaccccaccucccucgagggcgacugcgagcccucccccgcccccgccguccucgacaagugggucugcgcccagcccuccucccagaaggccaccaaccacaaccuccacaucaccgagaagcucgagguccucgccaaggccuacuccguccagggcgacaaguggcgcgcccucggcuacgccaaggccaucaacgcccucaaguccuuccacaagcccgucaccuccuaccaggaggccugcuccauccccggcaucggcaagcgcauggccgagaagaucaucgagauccucgaguccggccaccuccgcaagcucgaccacaucuccgaguccguccccguccucgagcucuucuccaacaucuggggcgccggcaccaagaccgcccagaugugguaccagcagggcuuccgcucccucgaggacauccgcucccaggccucccucaccacccagcaggccaucggccucaagcacuacuccgacuuccucgagcgcaugccccgcgaggaggccaccgagaucgagcagaccguccagaaggccgcccaggccuucaacuccggccuccucugcgucgccugcggcuccuaccgccgcggcaaggccaccugcggcgacgucgacguccucaucacccaccccgacggccgcucccaccgcggcaucuucucccgccuccucgacucccuccgccaggagggcuuccucaccgacgaccucgucucccaggaggagaacggccagcagcagaaguaccucggcgucugccgccuccccggccccggccgccgccaccgccgccucgacaucaucgucguccccuacuccgaguucgccugcgcccuccucuacuucaccggcuccgcccacuucaaccgcuccaugcgcgcccucgccaagaccaagggcaugucccucuccgagcacgcccucuccaccgccgucguccgcaacacccacggcugcaaggucggccccggccgcguccuccccacccccaccgagaaggacgucuuccgccuccucggccuccccuaccgcgagcccgccgagcgcgacugguga

SEQ ID NO: 47884 - RNA, 1527 nt, Artificial Sequence
  derived and/or modified sequence opt2 from POLM__Homo_sapiens__NP_001271259
augcuccccaagcgccgccgcgcccgcgucggcucccccuccggcgacgccgccuccuccaccccccccuccacccgcuuccccggcgucgccaucuaccucgucgagccccgcaugggccgcucccgccgcgccuuccucaccggccucgcccgcuccaagggcuuccgcguccucgacgccugcuccuccgaggccacccacgucgucauggaggagaccuccgccgaggaggccgucuccuggcaggagcgccgcauggccgccgccccccccggcugcaccccccccgcccuccucgacaucuccuggcucaccgagucccucggcgccggccagcccguccccgucgagugccgccaccgccucgaggucgccggcccccgcaagggcccccucucccccgccuggaugcccgccuacgccugccagcgccccaccccccucacccaccacaacaccggccucuccgaggcccucgagauccucgccgaggccgccggcuucgagggcuccgagggccgccuccucaccuucugccgcgccgccuccguccucaaggcccuccccucccccgucaccacccucucccagcuccagggccucccccacuucggcgagcacuccucccgcgucguccaggagcuccucgagcacggcgucugcgaggaggucgagcgcguccgccgcuccgagcgcgcccccgccccccccggccccgagcaccccucccccgccguccgcugccgcugccccgccgccggcggcggcggcuccugcggcgccggccccgccuggggccaccgccacgccgaccgccgccucccccagggccucauccucuaccaccagcaccagcacuccugcugcgagucccccacccgccucgcccagcagucccacauggacgccuucgagcgcuccuucugcaucuuccgccucccccagccccccggcgccgccgucggcggcuccacccgccccugccccuccuggaaggccguccgcgucgaccucgucgucgcccccgucucccaguuccccuucgcccuccucggcuggaccggcuccaagcucuuccagcgcgagcuccgccgcuucucccgcaaggagaagggccucuggcucaacucccacggccucuucgaccccgagcagggcuccuccuccggcaagaccccccgcucccgcaaguccugcuucugcugccgccgccacuucuccaagcgccuccagcgcaagaccuccuccgacaccugggcccucuccaccuuccuccagucccgcgagacccccgagcccgccugcgucccccacuuccacuccggcaacugggccgcccccaaccucgccaccgagugccuccaggccgacaugcucccccccgacccccaccuccaccccucccccccccgccccggcuccuccggcggccagcucugccuccaggaccagcucucccccugcuggugcgccgccggcugcgacgaggucggcgcccucuccgccucccucaucaccgucuga

SEQ ID NO: 47885 - RNA, 2703 nt, Artificial Sequence
  derived and/or modified sequence opt2 from POLN__Homo_sapiens__NP_861524
auggagaacuacgaggcccucgucggcuucgaccucugcaacaccccccucuccuccgucgcccagaagaucauguccgccaugcacuccggcgaccucgucgacuccaagaccuggggcaaguccaccgagaccauggaggucaucaacaaguccuccgucaaguacuccguccagcucgaggaccgcaagacccagucccccgagaagaaggaccucaagucccuccgcucccagaccucccgcggcuccgccaagcucuccccccaguccuucuccguccgccucaccgaccagcucuccgccgaccagaagcagaaguccaucuccucccucacccucuccuccugccucaucccccaguacaaccaggaggccuccguccuccagaagaagggccacaagcgcaagcacuuccucauggagaacaucaacaacgagaacaagggcuccaucaaccucaagcgcaagcacaucaccuacaacaaccucuccgagaagaccuccaagcagauggcccucgaggaggacaccgacgacgccgagggcuaccucaacuccggcaacuccggcgcccucaagaagcacuucugcgacauccgccaccucgacgacugggccaagucccagcucaucgagaugcucaagcaggccgccgcccucgucaucaccgucauguacaccgacggcuccacccagcucggcgccgaccagacccccgucuccuccguccgcggcaucgucguccucgucaagcgccaggccgagggcggccacggcugccccgacgcccccgccugcggccccguccucgagggcuucgucuccgacgaccccugcaucuacauccagaucgagcacuccgccaucugggaccaggagcaggaggcccaccagcaguucgcccgcaacguccucuuccagaccaugaagugcaagugccccgucaucugcuucaacgccaaggacuucguccgcaucguccuccaguucuucggcaacgacggcuccuggaagcacgucgccgacuucaucggccucgacccccgcaucgccgccuggcucaucgaccccuccgacgccacccccuccuucgaggaccucgucgagaaguacugcgagaaguccaucaccgucaaggucaacuccaccuacggcaacuccucccgcaacaucgucaaccagaacguccgcgagaaccucaagacccucuaccgccucaccauggaccucugcuccaagcucaaggacuacggccucuggcagcucuuccgcacccucgagcucccccucauccccauccucgccgucauggagucccacgccauccaggucaacaaggaggagauggagaagaccuccgcccuccucggcgcccgccucaaggagcucgagcaggaggcccacuucgucgccggcgagcgcuuccucaucaccuccaacaaccagcuccgcgagauccucuucggcaagcucaagcuccaccuccucucccagcgcaacucccucccccgcaccggccuccagaaguaccccuccaccuccgaggccguccucaacgcccuccgcgaccuccacccccuccccaagaucauccucgaguaccgccagguccacaagaucaaguccaccuucgucgacggccuccucgccugcaugaagaagggcuccaucuccuccaccuggaaccagaccggcaccgucaccggccgccucuccgccaagcaccccaacauccagggcaucuccaagcaccccauccagaucaccacccccaagaacuucaagggcaaggaggacaagauccucaccaucuccccccgcgccauguucgucuccuccaagggccacaccuuccucgccgccgacuucucccagaucgagcuccgcauccucacccaccucuccggcgaccccgagcuccucaagcucuuccaggaguccgagcgcgacgacgucuucuccacccucaccucccaguggaaggacguccccgucgagcaggucacccacgccgaccgcgagcagaccaagaaggucgucuacgccgucgucuacggcgccggcaaggagcgccucgccgccugccucggcguccccauccaggaggccgcccaguuccucgaguccuuccuccagaaguacaagaagaucaaggacuucgcccgcgccgccaucgcccagugccaccagaccggcugcgucgucuccaucaugggccgccgccgcccccucccccgcauccacgcccacgaccagcagcuccgcgcccaggccgagcgccaggccgucaacuucgucguccagggcuccgccgccgaccucugcaagcucgccaugauccacgucuucaccgccgucgccgccucccacacccucaccgcccgccucgucgcccagauccacgacgagcuccucuucgaggucgaggacccccagauccccgagugcgccgcccucguccgccgcaccauggagucccucgagcagguccaggcccucgagcuccagcuccaggucccccucaaggucucccucuccgccggccgcuccuggggccaccucgucccccuccaggaggccuggggccccccccccggccccugccgcaccgagucccccuccaacucccucgccgcccccggcucccccgccuccacccagccccccccccuccacuucucccccuccuucugccucuga

SEQ ID NO: 47886 - RNA, 7773 nt, Artificial Sequence
  derived and/or modified sequence opt2 from POLQ__Homo_sapiens__NP_955452
augaaccuccuccgccgcuccggcaagcgccgccgcuccgaguccggcuccgacuccuucuccggcuccggcggcgacuccuccgccuccccccaguuccucuccggcuccguccucucccccccccccggccucggccgcugccucaaggccgccgccgccggcgagugcaagcccaccguccccgacuacgagcgcgacaagcuccuccucgccaacuggggccuccccaaggccguccucgagaaguaccacuccuucggcgucaagaagauguucgaguggcaggccgagugccuccuccucggccagguccucgagggcaagaaccucgucuacuccgcccccaccuccgccggcaagacccucgucgccgagcuccucauccucaagcgcguccucgagaugcgcaagaaggcccucuucauccuccccuucgucuccgucgccaaggagaagaaguacuaccuccagucccucuuccaggaggucggcaucaaggucgacggcuacaugggcuccaccucccccucccgccacuucuccucccucgacaucgccgucugcaccaucgagcgcgccaacggccucaucaaccgccucaucgaggagaacaagauggaccuccucggcauggucgucgucgacgagcuccacaugcucggcgacucccaccgcggcuaccuccucgagcuccuccucaccaagaucugcuacaucacccgcaaguccgccuccugccaggccgaccucgccuccucccucuccaacgccguccagaucgucggcauguccgccacccuccccaaccucgagcucgucgccuccuggcucaacgccgagcucuaccacaccgacuuccgccccgucccccuccucgaguccgucaaggucggcaacuccaucuacgacuccuccaugaagcucguccgcgaguucgagcccaugcuccaggucaagggcgacgaggaccacgucgucucccucugcuacgagaccaucugcgacaaccacuccguccuccucuucugccccuccaagaaguggugcgagaagcucgccgacaucaucgcccgcgaguucuacaaccuccaccaccaggccgagggccucgucaagcccuccgagugcccccccgucauccucgagcagaaggagcuccucgaggucauggaccagcuccgccgccuccccuccggccucgacuccguccuccagaagaccguccccuggggcgucgccuuccaccacgccggccucaccuucgaggagcgcgacaucaucgagggcgccuuccgccagggccucauccgcguccucgccgccaccuccacccucuccuccggcgucaaccuccccgcccgccgcgucaucauccgcacccccaucuucggcggccgcccccucgacauccucaccuacaagcagauggucggccgcgccggccgcaagggcgucgacaccgucggcgaguccauccucaucugcaagaacuccgagaaguccaagggcaucgcccuccuccagggcucccucaagcccguccgcuccugccuccagcgccgcgagggcgaggaggucaccggcuccaugauccgcgccauccucgagaucaucgucggcggcgucgccuccaccucccaggacaugcacaccuacgccgccugcaccuuccucgccgccuccaugaaggagggcaagcagggcauccagcgcaaccaggaguccguccagcucggcgccaucgaggccugcgucauguggcuccucgagaacgaguucauccaguccaccgaggccuccgacggcaccgagggcaaggucuaccaccccacccaccucggcuccgccacccucuccuccucccucucccccgccgacacccucgacaucuucgccgaccuccagcgcgccaugaagggcuucguccucgagaacgaccuccacauccucuaccucgucacccccauguucgaggacuggaccaccaucgacugguaccgcuucuucugccucugggagaagcuccccaccuccaugaagcgcgucgccgagcucgucggcgucgaggagggcuuccucgcccgcugcgucaagggcaaggucgucgcccgcaccgagcgccagcaccgccagauggccauccacaagcgcuucuucaccucccucguccuccucgaccucaucuccgaggucccccuccgcgagaucaaccagaaguacggcugcaaccgcggccagauccagucccuccagcaguccgccgccgucuacgccggcaugaucaccgucuucuccaaccgccucggcuggcacaacauggagcuccuccucucccaguuccagaagcgccucaccuucggcauccagcgcgagcucugcgaccucguccgcgucucccuccucaacgcccagcgcgcccgcguccucuacgccuccggcuuccacaccgucgccgaccucgcccgcgccaacaucgucgaggucgaggucauccucaagaacgccguccccuucaaguccgcccgcaaggccgucgacgaggaggaggaggccgucgaggagcgccgcaacaugcgcaccaucugggucaccggccgcaagggccucaccgagcgcgaggccgccgcccucaucgucgaggaggcccgcaugauccuccagcaggaccucgucgagaugggcguccaguggaaccccugcgcccuccuccacuccuccaccugcucccucacccacuccgaguccgaggucaaggagcacaccuucaucucccagaccaaguccuccuacaagaagcucaccuccaagaacaaguccaacaccaucuucuccgacuccuacaucaagcacucccccaacaucguccaggaccucaacaagucccgcgagcacaccuccuccuucaacugcaacuuccagaacggcaaccaggagcaccagaccugcuccaucuuccgcgcccgcaagcgcgccucccucgacaucaacaaggagaagcccggcgccucccagaacgagggcaagaccuccgacaagaaggucguccagaccuucucccagaagaccaagaaggccccccucaacuucaacuccgagaagaugucccgcuccuuccgcuccuggaagcgccgcaagcaccucaagcgcucccgcgacuccuccccccucaaggacuccggcgccugccgcauccaccuccagggccagacccucuccaaccccucccucugcgaggaccccuucacccucgacgagaagaagaccgaguuccgcaacuccggccccuucgccaagaacgucucccucuccggcaaggagaaggacaacaagaccuccuucccccuccagaucaagcagaacugcuccuggaacaucacccucaccaacgacaacuucgucgagcacaucgucaccggcucccaguccaagaacgucaccugccaggccaccuccgucgucuccgagaagggccgcggcgucgccgucgaggccgagaagaucaacgagguccucauccagaacggcuccaagaaccagaacgucuacaugaagcaccacgacauccaccccaucaaccaguaccuccgcaagcagucccacgagcagaccuccaccaucaccaagcagaagaacaucaucgagcgccagaugcccugcgaggccgucuccuccuacaucaaccgcgacuccaacgucaccaucaacugcgagcgcaucaagcucaacaccgaggagaacaagcccucccacuuccaggcccucggcgacgacaucucccgcaccgucauccccuccgagguccuccccuccgccggcgccuucuccaaguccgagggccagcacgagaacuuccucaacaucucccgccuccaggagaagaccggcaccuacaccaccaacaagaccaagaacaaccacgucuccgaccucggccucguccucugcgacuucgaggacuccuucuaccucgacacccaguccgagaagaucauccagcagauggccaccgagaacgccaagcucggcgccaaggacaccaaccucgccgccggcaucaugcagaagucccucguccagcagaacuccaugaacuccuuccagaaggagugccacauccccuuccccgccgagcagcacccccucggcgccaccaagaucgaccaccucgaccucaagaccgucggcaccaugaagcaguccuccgacucccacggcgucgacauccucacccccgagucccccaucuuccacucccccauccuccucgaggagaacggccucuuccucaagaagaacgaggucuccgucaccgacucccagcucaacuccuuccuccagggcuaccagacccaggagaccgucaagcccgucauccuccucaucccccagaagcgcacccccaccggcgucgagggcgagugccuccccguccccgagaccucccucaacauguccgacucccuccucuucgacuccuucuccgacgacuaccucgucaaggagcagcuccccgacaugcagaugaaggagccccuccccuccgaggucaccuccaaccacuucuccgacucccucugccuccaggaggaccucaucaagaaguccaacgucaacgagaaccaggacacccaccagcagcucaccugcuccaacgacgaguccaucaucuucuccgagauggacuccguccagauggucgaggcccucgacaacgucgacaucuuccccguccaggagaagaaccacaccgucgucuccccccgcgcccucgagcucuccgaccccguccucgacgagcaccaccagggcgaccaggacggcggcgaccaggacgagcgcgccgagaaguccaagcucaccggcacccgccagaaccacuccuucaucugguccggcgccuccuucgaccucucccccggccuccagcgcauccucgacaaggucuccuccccccucgagaacgagaagcucaaguccaugaccaucaacuucuccucccucaaccgcaagaacaccgagcucaacgaggagcaggaggucaucuccaaccucgagaccaagcagguccagggcaucuccuucuccuccaacaacgaggucaaguccaagaucgagaugcucgagaacaacgccaaccacgacgagaccuccucccuccucccccgcaaggaguccaacaucgucgacgacaacggccucaucccccccacccccauccccaccuccgccuccaagcucaccuuccccggcauccucgagacccccgucaaccccuggaagaccaacaacguccuccagcccggcgaguccuaccucuucggcucccccuccgacaucaagaaccacgaccucucccccggcucccgcaacggcuucaaggacaacucccccaucuccgacaccuccuucucccuccagcucucccaggacggccuccagcucacccccgccuccuccuccuccgagucccucuccaucaucgacgucgccuccgaccagaaccucuuccagaccuucaucaaggaguggcgcugcaagaagcgcuucuccaucucccucgccugcgagaagauccgcucccucaccuccuccaagaccgccaccaucggcucccgcuucaagcaggccuccuccccccaggagauccccauccgcgacgacggcuuccccaucaagggcugcgacgacacccucgucgucggccucgccgucugcuggggcggccgcgacgccuacuacuucucccuccagaaggagcagaagcacuccgagaucuccgccucccucgucccccccucccucgaccccucccucacccucaaggaccgcaugugguaccuccaguccugccuccgcaaggaguccgacaaggagugcuccgucgucaucuacgacuucauccaguccuacaagauccuccuccucuccugcggcaucucccucgagcaguccuacgaggaccccaaggucgccugcuggcuccucgaccccgacucccaggagcccacccuccacuccaucgucaccuccuuccucccccacgagcucccccuccucgagggcauggagaccucccagggcauccagucccucggccucaacgccggcuccgagcacuccggccgcuaccgcgccuccgucgaguccauccucaucuucaacuccaugaaccagcucaacucccuccuccagaaggagaaccuccaggacgucuuccgcaaggucgagaugcccucccaguacugccucgcccuccucgagcucaacggcaucggcuucuccaccgccgagugcgagucccagaagcacaucaugcaggccaagcucgacgccaucgagacccaggccuaccagcucgccggccacuccuucuccuucaccuccuccgacgacaucgccgagguccucuuccucgagcucaagcucccccccaaccgcgagaugaagaaccagggcuccaagaagacccucggcuccacccgccgcggcaucgacaacggccgcaagcuccgccucggccgccaguucuccaccuccaaggacguccucaacaagcucaaggcccuccacccccuccccggccucauccucgaguggcgccgcaucaccaacgccaucaccaaggucgucuucccccuccagcgcgagaagugccucaaccccuuccucggcauggagcgcaucuaccccgucucccagucccacaccgccaccggccgcaucaccuucaccgagcccaacauccagaacgucccccgcgacuucgagaucaagaugcccacccucgucggcgaguccccccccucccaggccgucggcaagggccuccuccccaugggccgcggcaaguacaagaagggcuucuccgucaacccccgcugccaggcccagauggaggagcgcgccgccgaccgcggcaugcccuucuccaucuccaugcgccacgccuucguccccuuccccggcggcuccauccucgccgccgacuacucccagcucgagcuccgcauccucgcccaccucucccacgaccgccgccucauccagguccucaacaccggcgccgacgucuuccgcuccaucgccgccgaguggaagaugaucgagcccgaguccgucggcgacgaccuccgccagcaggccaagcagaucugcuacggcaucaucuacggcaugggcgccaagucccucggcgagcagaugggcaucaaggagaacgacgccgccugcuacaucgacuccuucaagucccgcuacaccggcaucaaccaguucaugaccgagaccgucaagaacugcaagcgcgacggcuucguccagaccauccucggccgccgccgcuaccuccccggcaucaaggacaacaaccccuaccgcaaggcccacgccgagcgccaggccaucaacaccaucguccagggcuccgccgccgacaucgucaagaucgccaccgucaacauccagaagcagcucgagaccuuccacuccaccuucaagucccacggccaccgcgagggcaugcuccaguccgaccagaccggccucucccgcaagcgcaagcuccagggcauguucugccccauccgcggcggcuucuucauccuccagcuccacgacgagcuccucuacgaggucgccgaggaggacgucguccaggucgcccagaucgucaagaacgagauggaguccgccgucaagcucuccgucaagcucaaggucaaggucaagaucggcgccuccuggggcgagcucaaggacuucgacgucuga

SEQ ID NO: 47887 - RNA, 5163 nt, Artificial Sequence
  derived and/or modified sequence opt2 from POLR1A__Homo_sapiens__NP_056240
augcucaucuccaagaacaugcccuggcgccgccuccagggcaucuccuucggcauguacuccgccgaggagcucaagaagcucuccgucaaguccaucaccaacccccgcuaccucgacucccucggcaaccccuccgccaacggccucuacgaccucgcccucggccccgccgacuccaaggaggucugcuccaccugcguccaggacuucuccaacugcuccggccaccucggccacaucgagcucccccucaccgucuacaacccccuccucuucgacaagcucuaccuccuccuccgcggcuccugccucaacugccacaugcucaccugcccccgcgccgucauccaccuccuccucugccagcuccgcguccucgaggucggcgcccuccaggccgucuacgagcucgagcgcauccucaaccgcuuccucgaggagaaccccgaccccuccgccuccgagauccgcgaggagcucgagcaguacaccaccgagaucguccagaacaaccuccucggcucccagggcgcccacgucaagaacgucugcgaguccaaguccaagcucaucgcccucuucuggaaggcccacaugaacgccaagcgcugcccccacugcaagaccggccgcuccgucguccgcaaggagcacaacuccaagcucaccaucaccuuccccgccaugguccaccgcaccgccggccagaaggacuccgagccccucggcaucgaggaggcccagaucggcaagcgcggcuaccucacccccaccuccgcccgcgagcaccucuccgcccucuggaagaacgagggcuucuuccucaacuaccucuucuccggcauggacgacgacggcauggagucccgcuucaaccccuccgucuucuuccucgacuuccucgucgucccccccucccgcuaccgccccgucucccgccucggcgaccagauguucaccaacggccagaccgucaaccuccaggccgucaugaaggacgucguccucauccgcaagcuccucgcccucauggcccaggagcagaagcuccccgaggaggucgccacccccaccaccgacgaggagaaggacucccucaucgccaucgaccgcuccuuccucuccacccuccccggccagucccucaucgacaagcucuacaacaucuggauccgccuccagucccacgucaacaucgucuucgacuccgagauggacaagcucaugauggacaaguaccccggcauccgccagauccucgagaagaaggagggccucuuccgcaagcacaugaugggcaagcgcgucgacuacgccgcccgcuccgucaucugccccgacauguacaucaacaccaacgagaucggcauccccauggucuucgccaccaagcucaccuacccccagcccgucacccccuggaacguccaggagcuccgccaggccgucaucaacggccccaacguccaccccggcgccuccauggucaucaacgaggacggcucccgcaccgcccucuccgccgucgacaugacccagcgcgaggccgucgccaagcagcuccucacccccgccaccggcgcccccaagccccagggcaccaagaucgucugccgccacgucaagaacggcgacauccuccuccucaaccgccagcccacccuccaccgccccuccauccaggcccaccgcgcccgcauccuccccgaggagaagguccuccgccuccacuacgccaacugcaaggccuacaacgccgacuucgacggcgacgagaugaacgcccacuucccccaguccgagcucggccgcgccgaggccuacguccucgccugcaccgaccagcaguaccucguccccaaggacggccagccccucgccggccucauccaggaccacauggucuccggcgccuccaugaccacccgcggcugcuucuucacccgcgagcacuacauggagcucgucuaccgcggccucaccgacaaggucggccgcgucaagcuccucucccccuccauccucaagcccuucccccucuggaccggcaagcaggucgucuccacccuccucaucaacaucauccccgaggaccacaucccccucaaccucuccggcaaggccaagaucaccggcaaggccugggucaaggagaccccccgcuccguccccggcuucaaccccgacuccaugugcgagucccaggucaucauccgcgagggcgagcuccucugcggcguccucgacaaggcccacuacggcuccuccgccuacggccucguccacugcugcuacgagaucuacggcggcgagaccuccggcaagguccucaccugccucgcccgccucuucaccgccuaccuccagcucuaccgcggcuucacccucggcgucgaggacauccucgucaagcccaaggccgacgucaagcgccagcgcaucaucgaggaguccacccacugcggcccccaggccguccgcgccgcccucaaccuccccgaggccgccuccuacgacgagguccgcggcaaguggcaggacgcccaccucggcaaggaccagcgcgacuucaacaugaucgaccucaaguucaaggaggaggucaaccacuacuccaacgagaucaacaaggccugcaugcccuucggccuccaccgccaguuccccgagaacucccuccagaugaugguccaguccggcgccaagggcuccaccgucaacaccaugcagaucuccugccuccucggccagaucgagcucgagggccgccgccccccccucauggccuccggcaagucccuccccugcuucgagcccuacgaguucaccccccgcgccggcggcuucgucaccggccgcuuccucaccggcaucaagccccccgaguucuucuuccacugcauggccggccgcgagggccucgucgacaccgccgucaagaccucccgcuccggcuaccuccagcgcugcaucaucaagcaccucgagggccucgucguccaguacgaccucaccguccgcgacuccgacggcuccgucguccaguuccucuacggcgaggacggccucgacauccccaagacccaguuccuccagcccaagcaguuccccuuccucgccuccaacuacgaggucaucaugaagucccagcaccuccacgagguccucucccgcgccgaccccaagaaggcccuccaccacuuccgcgccaucaagaaguggcaguccaagcaccccaacacccuccuccgccgcggcgccuuccucuccuacucccagaagauccaggaggccgucaaggcccucaagcucgaguccgagaaccgcaacggccgcucccccggcacccaggagaugcuccgcaugugguacgagcucgacgaggagucccgccgcaaguaccagaagaaggccgccgccugccccgaccccucccucuccgucuggcgccccgacaucuacuucgccuccgucuccgagaccuucgagaccaaggucgacgacuacucccaggagugggccgcccagaccgagaaguccuacgagaaguccgagcucucccucgaccgccuccgcacccuccuccagcucaaguggcagcgcucccucugcgagcccggcgaggccgucggccuccucgccgcccaguccaucggcgagcccuccacccagaugacccucaacaccuuccacuucgccggccgcggcgagaugaacgucacccucggcaucccccgccuccgcgagauccucauggucgccuccgccaacaucaagacccccaugauguccguccccguccucaacaccaagaaggcccucaagcgcgucaagucccucaagaagcagcucacccgcgucugccucggcgagguccuccagaagaucgacguccaggaguccuucugcauggaggagaagcagaacaaguuccaggucuaccagcuccgcuuccaguuccucccccacgccuacuaccagcaggagaagugccuccgccccgaggacauccuccgcuucauggagacccgcuucuucaagcuccucauggaguccaucaagaagaagaacaacaaggccuccgccuuccgcaacgucaacacccgccgcgccacccagcgcgaccucgacaacgccggcgagcucggccgcucccgcggcgagcaggagggcgacgaggaggaggagggccacaucgucgacgccgaggccgaggagggcgacgccgacgccuccgacgccaagcgcaaggagaagcaggaggaggaggucgacuacgaguccgaggaggaggaggagcgcgagggcgaggagaacgacgacgaggacaugcaggaggagcgcaacccccaccgcgagggcgcccgcaagacccaggagcaggacgaggaggucggccucggcaccgaggaggaccccucccuccccgcccuccucacccagccccgcaagcccacccacucccaggagccccagggccccgaggccauggagcgccgcguccaggccguccgcgagauccaccccuucaucgacgacuaccaguacgacaccgaggagucccucuggugccaggucaccgucaagcucccccucaugaagaucaacuucgacauguccucccucgucgucucccucgcccacggcgccgucaucuacgccaccaagggcaucacccgcugccuccucaacgagaccaccaacaacaagaacgagaaggagcucguccucaacaccgagggcaucaaccuccccgagcucuucaaguacgccgagguccucgaccuccgccgccucuacuccaacgacauccacgccaucgccaacaccuacggcaucgaggccgcccuccgcgucaucgagaaggagaucaaggacgucuucgccgucuacggcaucgccgucgacccccgccaccucucccucgucgccgacuacaugugcuucgagggcgucuacaagccccucaaccgcuucggcauccgcuccaacuccuccccccuccagcagaugaccuucgagaccuccuuccaguuccucaagcaggccaccaugcucggcucccacgacgagcuccgcucccccuccgccugccucgucgucggcaaggucguccgcggcggcaccggccucuucgagcucaagcagccccuccgcuga

SEQ ID NO: 47888 - RNA, 3240 nt, Artificial Sequence
  derived and/or modified sequence opt2 from POLR1B__Homo_sapiens__NP_001131076
auggaccccggcucccgcuggcgcaaccuccccuccggccccucccucaagcaccucaccgaccccuccuacggcaucccccgcgagcagcagaaggccgcccuccaggagcucacccgcgcccacgucgaguccuucaacuacgccguccacgagggccucggccucgccguccaggccgacaucaacugggccgucaacggcaucuccaagggcaucaucaagcaguuccucggcuacguccccaucauggucaaguccaagcucugcaaccuccgcaaccuccccccccaggcccucaucgagcaccacgaggaggccgaggagaugggcggcuacuucaucaucaacggcaucgagaaggucauccgcaugcucaucaugccccgccgcaacuuccccaucgccaugauccgccccaaguggaagacccgcggccccggcuacacccaguacggcgucuccaugcacugcguccgcgaggagcacuccgccgucaacaugaaccuccacuaccucgagaacggcaccgucaugcucaacuucaucuaccgcaaggagcucuucuuccucccccucggcuucgcccucaaggcccucgucuccuucuccgacuaccagaucuuccaggagcucaucaagggcaaggaggacgacuccuuccuccgcaacuccgucucccagaugcuccgcaucgucauggaggagggcugcuccacccagaagcagguccucaacuaccucggcgagugcuuccgcgucaagcucaacguccccgacugguaccccaacgagcaggccgccgaguuccucuucaaccagugcaucugcauccaccucaaguccaacaccgagaaguucuacaugcucugccucaugacccgcaagcucuucgcccucgccaagggcgagugcauggaggacaaccccgacucccucgucaaccaggagguccucacccccggccagcucuuccucauguuccucaaggagaagcucgagggcuggcucgucuccaucaagaucgccuucgacaagaaggcccagaagaccuccgucuccaugaacaccgacaaccucaugcgcaucuucaccaugggcaucgaccucaccaagcccuucgaguaccucuucgccaccggcaaccuccgcuccaagaccggccucggccuccuccaggacuccggccucugcgucgucgccgacaagcucaacuucauccgcuaccucucccacuuccgcugcguccaccgcggcgccgacuucgccaagaugcgcaccaccaccguccgccgccuccuccccgaguccuggggcuuccucugccccguccacacccccgacggcgagcccugcggccucaugaaccaccucaccgccgucugcgaggucgucacccaguucgucuacaccgccuccauccccgcccuccucugcaaccucggcgucacccccaucgacggcgccccccaccgcuccuacuccgagugcuaccccguccuccucgacggcgucauggucggcugggucgacaaggaccucgcccccggcaucgccgacucccuccgccacuucaagguccuccgcgagaagcgcaucccccccuggauggaggucguccucauccccaugaccggcaagcccucccucuaccccggccucuuccucuucaccacccccugccgccucguccgccccguccagaaccucgcccucggcaaggaggagcucaucggcaccauggagcagaucuucaugaacgucgccaucuucgaggacgaggucuucgccggcgucaccacccaccaggagcucuucccccacucccuccucuccgucaucgccaacuucauccccuucuccgaccacaaccaguccccccgcaacauguaccagugccagaugggcaagcagaccaugggcuucccccuccucaccuaccaggaccgcuccgacaacaagcucuaccgccuccagaccccccaguccccccucguccgccccuccauguacgacuacuacgacauggacaacuaccccaucggcaccaacgccaucgucgccgucaucuccuacaccggcuacgacauggaggacgccaugaucgucaacaaggccuccugggagcgcggcuucgcccacggcuccgucuacaaguccgaguucaucgaccucuccgagaagaucaagcagggcgacuccucccucgucuucggcaucaagcccggcgacccccgcguccuccagaagcucgacgacgacggccuccccuucaucggcgccaagcuccaguacggcgaccccuacuacuccuaccucaaccucaacaccggcgaguccuucgucauguacuacaaguccaaggagaacugcgucgucgacaacaucaaggucugcuccaacgacaccggcuccggcaaguucaagugcgucugcaucaccaugcgcgucccccgcaaccccaccaucggcgacaaguucgccucccgccacggccagaagggcauccucucccgccucuggcccgccgaggacaugcccuucaccgaguccggcaugguccccgacauccucuucaacccccacggcuuccccucccgcaugaccaucggcaugcucaucgaguccauggccggcaaguccgccgcccuccacggccucugccacgacgccacccccuucaucuucuccgaggagaacuccgcccucgaguacuucggcgagaugcucaaggccgccggcuacaacuucuacggcaccgagcgccucuacuccggcaucuccggccucgagcucgaggccgacaucuucaucggcgucgucuacuaccagcgccuccgccacauggucuccgacaaguuccagguccgcaccaccggcgcccgcgaccgcgucaccaaccagcccaucggcggccgcaacguccagggcggcauccgcuucggcgagauggagcgcgacgcccuccucgcccacggcaccuccuuccuccuccacgaccgccucuucaacugcuccgaccgcuccgucgcccacgucugcgucaagugcggcucccuccucuccccccuccucgagaagcccccccccuccugguccgccaugcgcaaccgcaaguacaacugcacccucugcucccgcuccgacaccaucgacaccgucuccguccccuacgucuuccgcuacuucgucgccgagcucgccgccaugaacaucaaggucaagcucgacgucgucuga

SEQ ID NO: 47889 - RNA, 1041 nt, Artificial Sequence
  derived and/or modified sequence opt2 from POLR1C__Homo_sapiens__NP_976035
auggccgccucccaggccgucgaggagaugcgcucccgcgucguccucggcgaguucggcguccgcaacguccacaccaccgacuuccccggcaacuacuccggcuacgacgacgccugggaccaggaccgcuucgagaagaacuuccgcgucgacgucguccacauggacgagaacucccucgaguucgacauggucggcaucgacgccgccaucgccaacgccuuccgccgcauccuccucgccgagguccccaccauggccgucgagaagguccucgucuacaacaacaccuccaucguccaggacgagauccucgcccaccgccucggccucauccccauccacgccgacccccgccucuucgaguaccgcaaccagggcgacgaggagggcaccgagaucgacacccuccaguuccgccuccagguccgcugcacccgcaacccccacgccgccaaggacuccuccgaccccaacgagcucuacgucaaccacaaggucuacacccgccacaugaccuggaucccccucggcaaccaggccgaccucuuccccgagggcaccauccgccccguccacgacgacauccucaucgcccagcuccgccccggccaggagaucgaccuccucaugcacugcgucaagggcaucggcaaggaccacgccaaguucucccccgucgccaccgccuccuaccgccuccuccccgacaucacccuccucgagcccgucgagggcgaggccgccgaggagcucucccgcugcuucucccccggcgucaucgagguccaggagguccagggcaagaaggucgcccgcgucgccaacccccgccucgacaccuucucccgcgagaucuuccgcaacgagaagcucaagaaggucguccgccucgcccgcguccgcgaccacuacaucuucuccgucgaguccaccggcguccucccccccgacguccucgucuccgaggccaucaagguccucaugggcaagugccgccgcuuccucgacgagcucgacgccguccagauggacuga

SEQ ID NO: 47890 - RNA, 402 nt, Artificial Sequence
  derived and/or modified sequence opt2 from POLR1D__Homo_sapiens__NP_057056
auggaggaggaccaggagcucgagcgcaagaucuccggccucaagaccuccauggccgagggcgagcgcaagaccgcccucgagaugguccaggccgccggcaccgaccgccacugcgucaccuucguccuccacgaggaggaccacacccucggcaacucccuccgcuacaugaucaugaagaaccccgaggucgaguucugcggcuacaccaccacccaccccuccgaguccaagaucaaccuccgcauccagacccgcggcacccuccccgccgucgagcccuuccagcgcggccucaacgagcucaugaacgucugccagcacguccucgacaaguucgaggccuccaucaaggacuacaaggaccagaaggccucccgcaacgaguccaccuucuga

SEQ ID NO: 47891 - RNA, 5913 nt, Artificial Sequence
  derived and/or modified sequence opt2 from POLR2A__Homo_sapiens__NP_000928
augcacggcggcggcccccccuccggcgacuccgccugcccccuccgcaccaucaagcgcguccaguucggcguccucucccccgacgagcucaagcgcauguccgucaccgagggcggcaucaaguaccccgagaccaccgagggcggccgccccaagcucggcggccucauggacccccgccagggcgucaucgagcgcaccggccgcugccagaccugcgccggcaacaugaccgagugccccggccacuucggccacaucgagcucgccaagcccgucuuccacgucggcuuccucgucaagaccaugaagguccuccgcugcgucugcuucuucugcuccaagcuccucgucgacuccaacaaccccaagaucaaggacauccucgccaaguccaagggccagcccaagaagcgccucacccacgucuacgaccucugcaagggcaagaacaucugcgagggcggcgaggagauggacaacaaguucggcgucgagcagcccgagggcgacgaggaccucaccaaggagaagggccacggcggcugcggccgcuaccagccccgcauccgccgcuccggccucgagcucuacgccgaguggaagcacgucaacgaggacucccaggagaagaagauccuccucucccccgagcgcguccacgagaucuucaagcgcaucuccgacgaggagugcuucguccucggcauggagccccgcuacgcccgccccgaguggaugaucgucaccguccuccccguccccccccucuccguccgccccgccgucgucaugcagggcuccgcccgcaaccaggacgaccucacccacaagcucgccgacaucgucaagaucaacaaccagcuccgccgcaacgagcagaacggcgccgccgcccacgucaucgccgaggacgucaagcuccuccaguuccacgucgccaccauggucgacaacgagcuccccggccucccccgcgccaugcagaaguccggccgcccccucaagucccucaagcagcgccucaagggcaaggagggccgcguccgcggcaaccucaugggcaagcgcgucgacuucuccgcccgcaccgucaucacccccgaccccaaccucuccaucgaccaggucggcgucccccgcuccaucgccgccaacaugaccuucgccgagaucgucacccccuucaacaucgaccgccuccaggagcucguccgccgcggcaacucccaguaccccggcgccaaguacaucauccgcgacaacggcgaccgcaucgaccuccgcuuccaccccaagcccuccgaccuccaccuccagaccggcuacaaggucgagcgccacaugugcgacggcgacaucgucaucuucaaccgccagcccacccuccacaagauguccaugaugggccaccgcguccgcauccuccccugguccaccuuccgccucaaccucuccgucaccacccccuacaacgccgacuucgacggcgacgagaugaaccuccaccucccccagucccucgagacccgcgccgagauccaggagcucgccauggucccccgcaugaucgucaccccccaguccaaccgccccgucaugggcaucguccaggacacccucaccgccguccgcaaguucaccaagcgcgacgucuuccucgagcgcggcgaggucaugaaccuccucauguuccucuccaccugggacggcaaggucccccagcccgccauccucaagccccgcccccucuggaccggcaagcagaucuucucccucaucauccccggccacaucaacugcauccgcacccacuccacccaccccgacgacgaggacuccggccccuacaagcacaucucccccggcgacaccaaggucgucgucgagaacggcgagcucaucaugggcauccucugcaagaagucccucggcaccuccgccggcucccucguccacaucuccuaccucgagaugggccacgacaucacccgccucuucuacuccaacauccagaccgucaucaacaacuggcuccucaucgagggccacaccaucggcaucggcgacuccaucgccgacuccaagaccuaccaggacauccagaacaccaucaagaaggccaagcaggacgucaucgaggucaucgagaaggcccacaacaacgagcucgagcccacccccggcaacacccuccgccagaccuucgagaaccaggucaaccgcauccucaacgacgcccgcgacaagaccggcuccuccgcccagaagucccucuccgaguacaacaacuucaaguccauggucgucuccggcgccaagggcuccaagaucaacaucucccaggucaucgccgucgucggccagcagaacgucgagggcaagcgcauccccuucggcuucaagcaccgcacccucccccacuucaucaaggacgacuacggccccgagucccgcggcuucgucgagaacuccuaccucgccggccucacccccaccgaguucuucuuccacgccaugggcggccgcgagggccucaucgacaccgccgucaagaccgccgagaccggcuacauccagcgccgccucaucaaguccauggaguccgucauggucaaguacgacgccaccguccgcaacuccaucaaccaggucguccagcuccgcuacggcgaggacggccucgccggcgaguccgucgaguuccagaaccucgccacccucaagcccuccaacaaggccuucgagaagaaguuccgcuucgacuacaccaacgagcgcgcccuccgccgcacccuccaggaggaccucgucaaggacguccucuccaacgcccacauccagaacgagcucgagcgcgaguucgagcgcaugcgcgaggaccgcgagguccuccgcgucaucuuccccaccggcgacuccaaggucguccuccccugcaaccuccuccgcaugaucuggaacgcccagaagaucuuccacaucaacccccgccuccccuccgaccuccaccccaucaaggucgucgagggcgucaaggagcucuccaagaagcucgucaucgucaacggcgacgacccccucucccgccaggcccaggagaacgccacccuccucuucaacauccaccuccgcuccacccucugcucccgccgcauggccgaggaguuccgccucuccggcgaggccuucgacuggcuccucggcgagaucgaguccaaguucaaccaggccaucgcccaccccggcgagauggucggcgcccucgccgcccagucccucggcgagcccgccacccagaugacccucaacaccuuccacuacgccggcgucuccgccaagaacgucacccucggcgucccccgccucaaggagcucaucaacaucuccaagaagcccaagacccccucccucaccgucuuccuccucggccaguccgcccgcgacgccgagcgcgccaaggacauccucugccgccucgagcacaccacccuccgcaaggucaccgccaacaccgccaucuacuacgaccccaacccccaguccaccgucgucgccgaggaccaggagugggucaacgucuacuacgagaugcccgacuucgacgucgcccgcaucucccccuggcuccuccgcgucgagcucgaccgcaagcacaugaccgaccgcaagcucaccauggagcagaucgccgagaagaucaacgccggcuucggcgacgaccucaacugcaucuucaacgacgacaacgccgagaagcucguccuccgcauccgcaucaugaacuccgacgagaacaagaugcaggaggaggaggaggucgucgacaagauggacgacgacgucuuccuccgcugcaucgaguccaacaugcucaccgacaugacccuccagggcaucgagcagaucuccaaggucuacaugcaccucccccagaccgacaacaagaagaagaucaucaucaccgaggacggcgaguucaaggcccuccaggaguggauccucgagaccgacggcgucucccucaugcgcguccucuccgagaaggacgucgaccccguccgcaccaccuccaacgacaucgucgagaucuucaccguccucggcaucgaggccguccgcaaggcccucgagcgcgagcucuaccacgucaucuccuucgacggcuccuacgucaacuaccgccaccucgcccuccucugcgacaccaugaccugccgcggccaccucauggccaucacccgccacggcgucaaccgccaggacaccggcccccucaugaagugcuccuucgaggagaccgucgacguccucauggaggccgccgcccacggcgaguccgaccccaugaagggcgucuccgagaacaucaugcucggccagcucgcccccgccggcaccggcugcuucgaccuccuccucgacgccgagaagugcaaguacggcauggagauccccaccaacauccccggccucggcgccgccggccccaccggcauguucuucggcuccgcccccucccccaugggcggcaucucccccgccaugacccccuggaaccagggcgccacccccgccuacggcgccuggucccccuccgucggcuccggcaugacccccggcgccgccggcuucucccccuccgccgccuccgacgccuccggcuucucccccggcuacucccccgccuggucccccacccccggcucccccggcucccccggccccuccucccccuacauccccucccccggcggcgccaugucccccuccuacucccccaccucccccgccuacgagccccgcucccccggcggcuacaccccccagucccccuccuacucccccaccucccccuccuacucccccaccucccccuccuacucccccaccucccccaacuacucccccaccucccccuccuacucccccaccucccccuccuacucccccaccucccccuccuacucccccaccucccccuccuacucccccaccucccccuccuacucccccaccucccccuccuacucccccaccucccccuccuacucccccaccucccccuccuacucccccaccucccccuccuacucccccaccucccccuccuacucccccaccucccccuccuacucccccaccucccccuccuacucccccaccucccccuccuacucccccaccucccccuccuacucccccaccucccccuccuacucccccaccucccccaacuacucccccaccucccccaacuacacccccaccucccccuccuacucccccaccucccccuccuacucccccaccucccccaacuacacccccaccucccccaacuacucccccaccucccccuccuacucccccaccucccccuccuacucccccaccucccccuccuacucccccuccuccccccgcuacaccccccagucccccaccuacacccccuccucccccuccuacucccccuccucccccuccuacucccccaccucccccaaguacacccccaccucccccuccuacucccccuccucccccgaguacacccccaccucccccaaguacucccccaccucccccaaguacucccccaccucccccaaguacucccccaccucccccaccuacucccccaccacccccaaguacucccccaccucccccaccuacucccccaccucccccgucuacacccccaccucccccaaguacucccccaccucccccaccuacucccccaccucccccaaguacucccccaccucccccaccuacucccccaccucccccaagggcuccaccuacucccccaccucccccggcuacucccccaccucccccaccuacucccucaccucccccgccaucucccccgacgacuccgacgaggagaacuga

SEQ ID NO: 47892 - RNA, 3525 nt, Artificial Sequence
  derived and/or modified sequence opt2 from POLR2B__Homo_sapiens__NP_000929
auguacgacgccgacgaggacaugcaguacgacgaggacgacgacgagaucacccccgaccucuggcaggaggccugcuggaucgucaucuccuccuacuucgacgagaagggccucguccgccagcagcucgacuccuucgacgaguucauccagauguccguccagcgcaucgucgaggacgccccccccaucgaccuccaggccgaggcccagcacgccuccggcgaggucgaggagcccccccgcuaccuccucaaguucgagcagaucuaccucuccaagcccacccacugggagcgcgacggcgcccccucccccaugaugcccaacgaggcccgccuccgcaaccucaccuacuccgccccccucuacgucgacaucaccaagaccgucaucaaggagggcgaggagcagcuccagacccagcaccagaagaccuucaucggcaagauccccaucaugcuccgcuccaccuacugccuccucaacggccucaccgaccgcgaccucugcgagcucaacgagugcccccucgaccccggcggcuacuucaucaucaacggcuccgagaagguccucaucgcccaggagaagauggccaccaacaccgucuacgucuucgccaagaaggacuccaaguacgccuacaccggcgagugccgcuccugccucgagaacuccucccgccccaccuccaccaucugggucuccaugcucgcccgcggcggccagggcgccaagaaguccgccaucggccagcgcaucgucgccacccuccccuacaucaagcaggagguccccaucaucaucgucuuccgcgcccucggcuucgucuccgaccgcgacauccucgagcacaucaucuacgacuucgaggaccccgagaugauggagauggucaagcccucccucgacgaggccuucgucauccaggagcagaacgucgcccucaacuucaucggcucccgcggcgccaagcccggcgucaccaaggagaagcgcaucaaguacgccaaggagguccuccagaaggagaugcucccccacgucggcgucuccgacuucugcgagaccaagaaggccuacuuccucggcuacaugguccaccgccuccuccucgccgcccucggccgccgcgagcucgacgaccgcgaccacuacggcaacaagcgccucgaccucgccggcccccuccucgccuuccucuuccgcggcauguucaagaaccuccucaaggagguccgcaucuacgcccagaaguucaucgaccgcggcaaggacuucaaccucgagcucgccaucaagacccgcaucaucuccgacggccucaaguacucccucgccaccggcaacuggggcgaccagaagaaggcccaccaggcccgcgccggcgucucccagguccucaaccgccucaccuucgccuccacccucucccaccuccgccgccucaacucccccaucggccgcgacggcaagcucgccaagccccgccagcuccacaacacccucuggggcauggucugccccgccgagacccccgagggccacgccgucggccucgucaagaaccucgcccucauggccuacaucuccgucggcucccagcccucccccauccucgaguuccucgaggagugguccauggagaaccucgaggagaucucccccgccgccaucgccgacgccaccaagaucuucgucaacggcugcugggucggcauccacaaggaccccgagcagcucaugaacacccuccgcaagcuccgccgccagauggacaucaucgucuccgaggucuccaugauccgcgacauccgcgagcgcgagauccgcaucuacaccgacgccggccgcaucugccgcccccuccucaucgucgagaagcagaagcuccuccucaagaagcgccacaucgaccagcucaaggagcgcgaguacaacaacuacuccuggcaggaccucgucgccuccggcgucgucgaguacaucgacacccucgaggaggagaccgucaugcucgccaugacccccgacgaccuccaggagaaggaggucgccuacugcuccaccuacacccacugcgagauccaccccuccaugauccucggcgucugcgccuccaucauccccuuccccgaccacaaccaguccccccgcaacaccuaccaguccgccaugggcaagcaggccaugggcgucuacaucaccaacuuccacguccgcauggacacccucgcccacguccucuacuacccccagaagccccucgucaccacccgcuccauggaguaccuccgcuuccgcgagcuccccgccggcaucaacuccaucgucgccaucgccuccuacaccggcuacaaccaggaggacuccgucaucaugaaccgcuccgccgucgaccgcggcuucuuccgcuccgucuucuaccgcuccuacaaggagcaggaguccaagaagggcuucgaccaggaggaggucuucgagaagcccacccgcgagaccugccagggcaugcgccacgccaucuacgacaagcucgacgacgacggccucaucgcccccggcguccgcgucuccggcgacgacgucaucaucggcaagaccgucacccuccccgagaacgaggacgagcucgaguccaccaaccgccgcuacaccaagcgcgacugcuccaccuuccuccgcaccuccgagaccggcaucgucgaccaggucauggucacccucaaccaggagggcuacaaguucugcaagauccgcguccgcuccguccgcaucccccagaucggcgacaaguucgccucccgccacggccagaagggcaccugcggcauccaguaccgccaggaggacaugcccuucaccugcgagggcaucacccccgacaucaucaucaacccccacgccauccccucccgcaugaccaucggccaccucaucgagugccuccagggcaaggucuccgccaacaagggcgagaucggcgacgccacccccuucaacgacgccgucaacguccagaagaucuccaaccuccucuccgacuacggcuaccaccuccgcggcaacgagguccucuacaacggcuucaccggccgcaagaucaccucccagaucuucaucggccccaccuacuaccagcgccucaagcacauggucgacgacaagauccacucccgcgcccgcggccccauccagauccucaaccgccagcccauggagggccgcucccgcgacggcggccuccgcuucggcgagauggagcgcgacugccagaucgcccacggcgccgcccaguuccuccgcgagcgccucuucgaggccuccgaccccuaccagguccacgucugcaaccucugcggcaucauggccaucgccaacacccgcacccacaccuacgagugccgcggcugccgcaacaagacccagaucucccucguccgcaugcccuacgccugcaagcuccucuuccaggagcucauguccauguccaucgccccccgcaugauguccgucuga

SEQ ID NO: 47893 - RNA, 828 nt, Artificial Sequence
  derived and/or modified sequence opt2 from POLR2C__Homo_sapiens__NP_116558
augcccuacgccaaccagcccaccguccgcaucaccgagcucaccgacgagaacgucaaguucaucaucgagaacaccgaccucgccgucgccaacuccauccgccgcgucuucaucgccgagguccccaucaucgccaucgacuggguccagaucgacgccaacuccuccguccuccacgacgaguucaucgcccaccgccucggccucaucccccucaucuccgacgacaucgucgacaagcuccaguacucccgcgacugcaccugcgaggaguucugccccgagugcuccgucgaguucacccucgacguccgcugcaacgaggaccagacccgccacgucaccucccgcgaccucaucuccaacuccccccgcgucauccccgucaccucccgcaaccgcgacaacgaccccaacgacuacgucgagcaggacgacauccucaucgucaagcuccgcaagggccaggagcuccgccuccgcgccuacgccaagaagggcuucggcaaggagcacgccaaguggaaccccaccgccggcgucgccuucgaguacgaccccgacaacgcccuccgccacaccgucuaccccaagcccgaggaguggcccaaguccgaguacuccgagcucgacgaggacgagucccaggcccccuacgaccccaacggcaagcccgagcgcuucuacuacaacgucgaguccugcggcucccuccgccccgagaccaucguccucuccgcccucuccggccucaagaagaagcucuccgaccuccagacccagcucucccacgagauccaguccgacguccucaccaucaacuga

SEQ ID NO: 47894 - RNA, 429 nt, Artificial Sequence
  derived and/or modified sequence opt2 from POLR2D__Homo_sapiens__NP_004796
auggccgccggcggcuccgacccccgcgccggcgacgucgaggaggacgccucccagcucaucuuccccaaggaguucgagaccgccgagacccuccucaacuccgagguccacaugcuccucgagcaccgcaagcagcagaacgaguccgccgaggacgagcaggagcucuccgaggucuucaugaagacccucaacuacaccgcccgcuucucccgcuucaagaaccgcgagaccaucgccuccguccgcucccuccuccuccagaagaagcuccacaaguucgagcucgccugccucgccaaccucugccccgagaccgccgaggaguccaaggcccucauccccucccucgagggccgcuucgaggacgaggagcuccagcagauccucgacgacauccagaccaagcgcuccuuccaguacuga

SEQ ID NO: 47895 - RNA, 633 nt, Artificial Sequence
  derived and/or modified sequence opt2 from POLR2E__Homo_sapiens__NP_002686
auggacgacgaggaggagaccuaccgccucuggaagauccgcaagaccaucaugcagcucugccacgaccgcggcuaccucgucacccaggacgagcucgaccagacccucgaggaguucaaggcccaguucggcgacaagcccuccgagggccgcccccgccgcaccgaccucaccguccucgucgcccacaacgacgaccccaccgaccagauguucgucuucuuccccgaggagcccaaggucggcaucaagaccaucaaggucuacugccagcgcaugcaggaggagaacaucacccgcgcccucaucgucguccagcagggcaugacccccuccgccaagcagucccucgucgacauggcccccaaguacauccucgagcaguuccuccagcaggagcuccucaucaacaucaccgagcacgagcucguccccgagcacgucgucaugaccaaggaggaggucaccgagcuccucgcccgcuacaagcuccgcgagaaccagcucccccgcauccaggccggcgaccccgucgcccgcuacuucggcaucaagcgcggccaggucgucaagaucauccgccccuccgagaccgccggccgcuacaucaccuaccgccucguccaguga

SEQ ID NO: 47896 - RNA, 357 nt, Artificial Sequence
  derived and/or modified sequence opt2 from POLR2F__Homo_sapiens__NP_001288058
auggucuccaucuccugccucgucauccgccccccccgcccccccaagguccucggccuccaggagggccaggagaacgucgagauccuccccuccggcgagcgcccccaggccaaccagaagcgcaucaccacccccuacaugaccaaguacgagcgcgcccgcguccucggcacccgcgcccuccagaucgccaugugcgcccccgucauggucgagcucgagggcgagaccgacccccuccucaucgccaugaaggagcucaaggcccgcaagauccccaucaucauccgccgcuaccuccccgacggcuccuacgaggacuggggcgucgacgagcucaucaucaccgacuga

SEQ ID NO: 47897 - RNA, 519 nt, Artificial Sequence
  derived and/or modified sequence opt2 from POLR2G__Homo_sapiens__NP_002687
auguucuaccacaucucccucgagcacgagauccuccuccacccccgcuacuucggccccaaccuccucaacaccgucaagcagaagcucuucaccgaggucgagggcaccugcaccggcaaguacggcuucgucaucgccgucaccaccaucgacaacaucggcgccggcgucauccagcccggccgcggcuucguccucuaccccgucaaguacaaggccaucgucuuccgccccuucaagggcgaggucgucgacgccgucgucacccaggucaacaaggucggccucuucaccgagaucggccccauguccugcuucaucucccgccacuccauccccuccgagauggaguucgaccccaacuccaacccccccugcuacaagaccauggacgaggacaucgucauccagcaggacgacgagauccgccucaagaucgucggcacccgcgucgacaagaacgacaucuucgccaucggcucccucauggacgacuaccucggccucgucuccuga

SEQ ID NO: 47898 - RNA, 369 nt, Artificial Sequence
  derived and/or modified sequence opt2 from POLR2H__Homo_sapiens__NP_001265643
auggccggcauccucuucgaggacaucuucgacgucaaggacaucgaccccgagggcaagaaguucgaccgcgucucccgccuccacugcgaguccgaguccuucaagauggaccucauccucgacgucaacauccagaucuaccccgucgaccucggcgacaaguuccgccucgucaucgccuccacccucuacgaggacggcacccucgacgacggcgaguacaaccccaccgacgaccgccccuccuccuccgccuacgucuccuacggcggccuccucaugcgccuccagggcgacgccaacaaccuccacggcuucgaggucgacucccgcgucuaccuccucaugaagaagcucgccuucuga

SEQ ID NO: 47899 - RNA, 354 nt, Artificial Sequence
  derived and/or modified sequence opt2 from POLR2J__Homo_sapiens__NP_006225
augaacgccccccccgccuucgaguccuuccuccucuucgagggcgagaagaagaucaccaucaacaaggacaccaagguccccaacgccugccucuucaccaucaacaaggaggaccacacccucggcaacaucaucaagucccagcuccucaaggacccccagguccucuucgccggcuacaaggucccccacccccucgagcacaagaucaucauccgcguccagaccacccccgacuacuccccccaggaggccuucaccaacgccaucaccgaccucaucuccgagcucucccuccucgaggagcgcuuccgcgucgccaucaaggacaagcaggagggcaucgaguga

SEQ ID NO: 47900 - RNA, 177 nt, Artificial Sequence
  derived and/or modified sequence opt2 from POLR2K__Homo_sapiens__NP_005025
auggacacccagaaggacguccagccccccaagcagcagcccaugaucuacaucugcggcgagugccacaccgagaacgagaucaagucccgcgaccccauccgcugccgcgagugcggcuaccgcaucauguacaagaagcgcaccaagcgccucgucgucuucgacgcccgcuga

SEQ ID NO: 47901 - RNA, 636 nt, Artificial Sequence
  derived and/or modified sequence opt2 from POLR2M__Homo_sapiens__NP_001018112
augugcucccucccccgcggcuucgagccccaggcccccgaggaccucgcccagcgcucccucgucgagcuccgcgagaugcucaagcgccaggagcgccuccuccgcaacgagcuccagcgcaucaccaucgccgaccagggcgagcagcaguccgaggagaacgccuccaccaagaaccucaccggccucuccuccggcaccgagaagaagccccacuacauggagguccucgagaugcgcgccaagaaccccgucccccagcuccgcaaguucaagaccaacguccuccccuuccgccagaacgacuccuccucccacugccagaaguccggcucccccaucuccuccgaggagcgccgccgccgcgacaagcagcaccucgacgacaucaccgccgcccgccuccucccccuccaccacaugcccacccagcuccucuccaucgaggagucccucgcccuccagaagcagcagaagcagaacuacgaggagaugcaggccaagcucgccgcccagaagcucgccgagcgccucaacaucaagaugcgcuccuacaaccccgagggcgaguccuccggccgcuaccgcgagguccgcgacgaggacgacgacugguccuccgacgaguucuga

SEQ ID NO: 47902 - RNA, 4173 nt, Artificial Sequence
  derived and/or modified sequence opt2 from POLR3A__Homo_sapiens__NP_008986
auggucaaggagcaguuccgcgagaccgacgucgccaagaagaucucccacaucugcuucggcaugaagucccccgaggagaugcgccagcaggcccacauccaggucgucuccaagaaccucuacucccaggacaaccagcacgccccccuccucuacggcguccucgaccaccgcaugggcaccuccgagaaggaccgccccugcgagaccugcggcaagaaccucgccgacugccucggccacuacggcuacaucgaccucgagcuccccugcuuccacgucggcuacuuccgcgccgucaucggcauccuccagaugaucugcaagaccugcugccacaucaugcucucccaggaggagaagaagcaguuccucgacuaccucaagcgccccggccucaccuaccuccagaagcgcggccucaagaagaagaucuccgacaagugccgcaagaagaacaucugccaccacugcggcgccuucaacggcaccgucaagaagugcggccuccucaagaucauccacgagaaguacaagaccaacaagaaggucgucgaccccaucgucuccaacuuccuccaguccuucgagaccgccaucgagcacaacaaggaggucgagccccuccucggccgcgcccaggagaaccucaacccccucgucguccucaaccucuucaagcgcauccccgccgaggacgucccccuccuccucaugaaccccgaggccggcaagcccuccgaccucauccucacccgccuccucguccccccccucugcauccgccccuccgucgucuccgaccucaaguccggcaccaacgaggacgaccucaccaugaagcucaccgagaucaucuuccucaacgacgucaucaagaagcaccgcaucuccggcgccaagacccagaugaucauggaggacugggacuuccuccagcuccagugcgcccucuacaucaacuccgagcucuccggcaucccccucaacauggcccccaagaaguggacccgcggcuucguccagcgccucaagggcaagcagggccgcuuccgcggcaaccucuccggcaagcgcgucgacuucuccggccgcaccgucaucucccccgaccccaaccuccgcaucgacgaggucgccguccccguccacgucgccaagauccucaccuuccccgagaaggucaacaaggccaacaucaacuuccuccgcaagcucguccagaacggccccgagguccaccccggcgccaacuucauccagcagcgccacacccagaugaagcgcuuccucaaguacggcaaccgcgagaagauggcccaggagcucaaguacggcgacaucgucgagcgccaccucaucgacggcgacgucguccucuucaaccgccagcccucccuccacaagcucuccaucauggcccaccucgcccgcgucaagccccaccgcaccuuccgcuucaacgagugcgucugcacccccuacaacgccgacuucgacggcgacgagaugaaccuccaccucccccagaccgaggaggccaaggccgaggcccucguccucaugggcaccaaggccaaccucgucaccccccgcaacggcgagccccucaucgccgccauccaggacuuccucaccggcgccuaccuccucacccucaaggacaccuucuucgaccgcgccaaggccugccagaucaucgccuccauccucgucggcaaggacgagaagaucaagguccgccuccccccccccaccauccucaagcccgucacccucuggaccggcaagcagaucuucuccgucauccuccgccccuccgacgacaaccccguccgcgccaaccuccgcaccaagggcaagcaguacugcggcaagggcgaggaccucugcgccaacgacuccuacgucaccauccagaacuccgagcucauguccggcuccauggacaagggcacccucggcuccggcuccaagaacaacaucuucuacauccuccuccgcgacuggggccagaacgaggccgccgacgccaugucccgccucgcccgccucgcccccgucuaccucuccaaccgcggcuucuccaucggcaucggcgacgucacccccggccagggccuccucaaggccaaguacgagcuccucaacgccggcuacaagaagugcgacgaguacaucgaggcccucaacaccggcaagcuccagcagcagcccggcugcaccgccgaggagacccucgaggcccucauccucaaggagcucuccgucauccgcgaccacgccggcuccgccugccuccgcgagcucgacaaguccaacuccccccucaccauggcccucugcggcuccaagggcuccuucaucaacaucucccagaugaucgccugcgucggccagcaggccaucuccggcucccgcguccccgacggcuucgagaaccgcucccucccccacuucgagaagcacuccaagcuccccgccgccaagggcuucgucgccaacuccuucuacuccggccucacccccaccgaguucuucuuccacaccauggccggccgcgagggccucgucgacaccgccgucaagaccgccgagaccggcuacaugcagcgccgccucgucaagucccucgaggaccucugcucccaguacgaccucaccguccgcuccuccaccggcgacaucauccaguucaucuacggcggcgacggccucgaccccgccgccauggagggcaaggacgagccccucgaguucaagcgcguccucgacaacaucaaggccgucuuccccugccccuccgagcccgcccucuccaagaacgagcucauccucaccaccgaguccaucaugaagaaguccgaguuccucugcugccaggacuccuuccuccaggagaucaagaaguucaucaagggcgucuccgagaagaucaagaagacccgcgacaaguacggcaucaacgacaacggcaccaccgagccccgcguccucuaccagcucgaccgcaucacccccacccaggucgagaaguuccucgagaccugccgcgacaaguacaugcgcgcccagauggagcccggcuccgccgucggcgcccucugcgcccaguccaucggcgagcccggcacccagaugacccucaagaccuuccacuucgccggcgucgccuccaugaacaucacccucggcgucccccgcaucaaggagaucaucaacgccuccaaggccaucuccacccccaucaucaccgcccagcucgacaaggacgacgacgccgacuacgcccgccucgucaagggccgcaucgagaagacccuccucggcgagaucuccgaguacaucgaggaggucuuccuccccgacgacugcuucauccucgucaagcucucccucgagcgcauccgccuccuccgccucgaggucaacgccgagaccguccgcuacuccaucugcaccuccaagcuccgcgucaagcccggcgacgucgccguccacggcgaggccgucgucugcgucaccccccgcgagaacuccaaguccuccauguacuacguccuccaguuccucaaggaggaccuccccaaggucgucguccagggcauccccgaggucucccgcgccgucauccacaucgacgagcaguccggcaaggagaaguacaagcuccucgucgagggcgacaaccuccgcgccgucauggccacccacggcgucaagggcacccgcaccaccuccaacaacaccuacgaggucgagaagacccucggcaucgaggccgcccgcaccaccaucaucaacgagauccaguacaccauggucaaccacggcauguccaucgaccgccgccacgucaugcuccucuccgaccucaugaccuacaagggcgagguccucggcaucacccgcuucggccucgccaagaugaaggaguccguccucaugcucgccuccuucgagaagaccgccgaccaccucuucgacgccgccuacuucggccagaaggacuccgucugcggcgucuccgagugcaucaucaugggcauccccaugaacaucggcaccggccucuucaagcuccuccacaaggccgaccgcgaccccaacccccccaagcgcccccucaucuucgacaccaacgaguuccacaucccccucgucaccuga

SEQ ID NO: 47903 - RNA, 3228 nt, Artificial Sequence
  derived and/or modified sequence opt2 from POLR3B__Homo_sapiens__NP_001154180
augaaggccaacgagaaggucaccuccgacgccgaccccaugugguaccucaaguaccucaacaucuacgucggccuccccgacgucgaggaguccuucaacgucacccgccccgucuccccccacgagugccgccuccgcgacaugaccuacuccgcccccaucaccgucgacaucgaguacacccgcggcucccagcgcaucauccgcaacgcccuccccaucggccgcaugcccaucaugcuccgcuccuccaacugcguccucaccggcaagacccccgccgaguucgccaagcucaacgagugcccccucgaccccggcggcuacuucaucgucaagggcgucgagaaggucauccucauccaggagcagcucuccaagaaccgcaucaucgucgaggccgaccgcaagggcgccgucggcgccuccgucaccuccuccacccacgagaagaagucccgcaccaacauggccgucaagcagggccgcuucuaccuccgccacaacacccucuccgaggacauccccaucgucaucaucuucaaggccaugggcgucgaguccgaccaggagaucguccagaugaucggcaccgaggagcacgucauggccgccuucggccccucccucgaggagugccagaaggcccagaucuucacccagaugcaggcccucaaguacaucggcaacaagguccgccgccagcgcauguggggcggcggccccaagaagaccaagaucgaggaggcccgcgagcuccucgccuccaccauccucacccacguccccgucaaggaguucaacuuccgcgccaagugcaucuacaccgccgucaugguccgccgcgucauccucgcccagggcgacaacaaggucgacgaccgcgacuacuacggcaacaagcgccucgagcucgccggccagcuccucucccuccucuucgaggaccucuucaagaaguucaacuccgagaugaagaagaucgccgaccaggucauccccaagcagcgcgccgcccaguucgacgucgucaagcacaugcgccaggaccagaucaccaacggcauggucaacgccaucuccaccggcaacuggucccucaagcgcuucaagauggaccgccagggcgucacccagguccucucccgccucuccuacaucuccgcccucggcaugaugacccgcaucuccucccaguucgagaagacccgcaaggucuccggcccccgcucccuccagcccucccaguggggcaugcucugccccuccgacacccccgagggcgaggccugcggccucgucaagaaccucgcccucaugacccacaucaccaccgacauggaggacggccccaucgucaagcucgccuccaaccucggcgucgaggacgucaaccuccucugcggcgaggagcucuccuaccccaacgucuuccucgucuuccucaacggcaacauccucggcgucauccgcgaccacaagaagcucgucaacaccuuccgccucaugcgccgcgccggcuacaucaacgaguucgucuccaucuccaccaaccucaccgaccgcugcgucuacaucuccuccgacggcggccgccucugccgccccuacaucaucgucaagaagcagaagcccgccgucaccaacaagcacauggaggagcucgcccagggcuaccgcaacuucgaggacuuccuccacgagucccucgucgaguaccucgacgucaacgaggagaacgacugcaacaucgcccucuacgagcacaccaucaacaaggacaccacccaccucgagaucgagcccuucacccuccucggcgucugcgccggccucauccccuacccccaccacaaccaguccccccgcaacaccuaccagugcgccaugggcaagcaggccaugggcaccaucggcuacaaccagcgcaaccgcaucgacacccucauguaccuccucgccuacccccagaagcccauggucaagaccaagaccaucgagcucaucgaguucgagaagcuccccgccggccagaacgccaccgucgccgucauguccuacuccggcuacgacaucgaggacgcccucguccucaacaaggccucccucgaccgcggcuucggccgcugccucgucuacaagaacgccaagugcacccucaagcgcuacaccaaccagaccuucgacaaggucaugggccccaugcucgacgccgccacccgcaagcccaucuggcgccacgagauccucgacgccgacggcaucugcucccccggcgagaaggucgagaacaagcagguccucgucaacaaguccaugcccaccgucacccagaucccccucgagggcuccaacgucccccagcagccccaguacaaggacguccccaucaccuacaagggcgccaccgacuccuacaucgagaaggucaugaucuccuccaacgccgaggacgccuuccucaucaagaugcuccuccgccagacccgccgccccgagaucggcgacaaguucuccucccgccacggccagaagggcgucugcggccucaucgucccccaggaggacaugcccuucugcgacuccggcaucugccccgacaucaucaugaacccccacggcuuccccucccgcaugaccgucggcaagcucaucgagcuccucgccggcaaggccggcguccucgacggccgcuuccacuacggcaccgccuucggcggcuccaaggucaaggacgucugcgaggaccucguccgccacggcuacaacuaccucggcaaggacuacgucaccuccggcaucaccggcgagccccucgaggccuacaucuacuucggccccgucuacuaccagaagcucaagcacaugguccucgacaagaugcacgcccgcgcccgcggcccccgcgccguccucacccgccagcccaccgagggccgcucccgcgacggcggccuccgccucggcgagauggagcgcgacugccucaucggcuacggcgccuccaugcuccuccucgagcgccucaugaucuccuccgacgccuucgaggucgacgucugcggccagugcggccuccucggcuacuccggcuggugccacuacugcaaguccuccugccacgucuccucccuccgcauccccuacgccugcaagcuccucuuccaggagcuccaguccaugaacaucaucccccgccucaagcucuccaaguacaacgaguga

SEQ ID NO: 47904 - RNA, 2064 nt, Artificial Sequence
  derived and/or modified sequence opt2 from POLR3E__Homo_sapiens__NP_001244962
auggccaacgaggaggacgaccccgucguccaggagaucgacgucuaccucgccaagucccucgccgagaagcucuaccucuuccaguaccccguccgccccgccuccaugaccuacgacgacaucccccaccucuccgccaagaucaagcccaagcagcagaaggucgagcucgagauggccaucgacacccucaaccccaacuacugccgcuccaagggcgagcagaucgcccucaacgucgacggcgccugcgccgacgagaccuccaccuacuccuccaagcucauggacaagcagaccuucugcuccucccagaccaccuccaacaccucccgcuacgccgccgcccucuaccgccagggcgagcuccaccucaccccccuccacggcauccuccagcuccgccccuccuucuccuaccucgacaaggccgacgccaagcaccgcgagcgcgaggccgccaacgaggccggcgacuccucccaggacgaggccgaggacgacgucaagcagaucaccguccgcuucucccgccccgaguccgagcaggcccgccagcgccgcguccaguccuacgaguuccuccagaagaagcacgccgaggagcccuggguccaccuccacuacuacggccuccgcgacucccgcuccgagcacgagcgccaguaccuccucugccccggcuccuccggcgucgagaacaccgagcucgucaagucccccuccgaguaccucaugaugcucaugccccccucccaggaggaggagaaggacaagcccgucgcccccuccaacguccucuccauggcccagcuccgcacccucccccucgccgaccagaucaagauccucaugaagaacgucaaggucaugcccuucgccaaccucaugucccuccucggccccuccaucgacuccgucgccguccuccgcggcauccagaaggucgccaugcucguccagggcaacugggucgucaaguccgacauccucuaccccaaggacuccuccuccccccacuccggcguccccgccgagguccucugccgcggccgcgacuucgucauguggaaguucacccagucccgcugggucguccgcaaggaggucgccaccgucaccaagcucugcgccgaggacgucaaggacuuccucgagcacauggccgucguccgcaucaacaagggcugggaguucauccuccccuacgacggcgaguucaucaagaagcaccccgacgucguccagcgccagcacaugcucuggaccggcauccaggccaagcucgagaaggucuacaaccucgucaaggagaccaugcccaagaagcccgacgcccaguccggccccgccggccucgucugcggcgaccagcgcauccaggucgccaagaccaaggcccagcagaaccacgcccuccucgagcgcgagcuccagcgccgcaaggagcagcuccgcguccccgccgucccccccggcguccgcaucaaggaggagcccgucuccgaggagggcgaggaggacgaggagcaggaggccgaggaggagcccauggacaccucccccuccggccuccacuccaagcucgccaacggccucccccucggccgcgccgccggcaccgacuccuucaacggccaccccccccagggcugcgccuccacccccgucgcccgcgagcucaaggccuucgucgaggccaccuuccagcgccaguucguccucacccucuccgagcucaagcgccucuucaaccuccaccucgccucccucccccccggccacacccucuucuccggcaucuccgaccgcaugcuccaggacaccguccucgccgccggcugcaagcagauccucguccccuuccccccccagaccgccgccucccccgacgagcagaaggucuucgcccucugggaguccggcgacauguccgaccagucccgccucacccaggagugcggcgaggaccucuccaagcaggaggucgacaagguccucaaggacugcugcgucuccuacggcggcaugugguaccucaagggcaccguccaguccuga

SEQ ID NO: 47905 - RNA, 327 nt, Artificial Sequence
  derived and/or modified sequence opt2 from POLR3K__Homo_sapiens__NP_057394
augcuccucuucugccccggcugcggcaacggccucaucgucgaggagggccagcgcugccaccgcuucgccugcaacaccugccccuacguccacaacaucacccgcaaggucaccaaccgcaaguaccccaagcucaaggaggucgacgacguccucggcggcgccgccgccugggagaacgucgacuccaccgccgaguccugccccaagugcgagcacccccgcgccuacuucaugcagcuccagacccgcuccgccgacgagcccaugaccaccuucuacaagugcugcaacgcccagugcggccaccgcuggcgcgacuga

SEQ ID NO: 47906 - RNA, 3693 nt, Artificial Sequence
  derived and/or modified sequence opt2 from POLRMT__Homo_sapiens__NP_005026
auguccgcccucugcuggggccgcggcgccgccggccucaagcgcgcccuccgccccugcggccgccccggccuccccggcaaggagggcaccgccggcggcgucugcggcccccgccgcuccuccuccgccuccccccaggagcaggaccaggaccgccgcaaggacuggggccacgucgagcuccucgagguccuccaggcccgcguccgccagcuccaggccgaguccgucuccgaggucgucgucaaccgcgucgacgucgcccgccuccccgagugcggcuccggcgacggcucccuccagcccccccgcaagguccagaugggcgccaaggacgccacccccguccccugcggccgcugggccaagauccucgagaaggacaagcgcacccagcagaugcgcaugcagcgccucaaggccaagcuccagaugcccuuccaguccggcgaguucaaggcccucacccgccgccuccaggucgagccccgccuccucuccaagcagauggccggcugccucgaggacugcacccgccaggcccccgagucccccugggaggagcagcucgcccgccuccuccaggaggcccccggcaagcucucccucgacgucgagcaggcccccuccggccagcacucccaggcccagcucuccggccagcagcagcgccuccucgccuucuucaagugcugccuccucaccgaccagcucccccucgcccaccaccuccucgucguccaccacggccagcgccagaagcgcaagcuccucacccucgacauguacaacgccgucaugcucggcugggcccgccagggcgccuucaaggagcucgucuacguccucuucauggucaaggacgccggccucacccccgaccuccucuccuacgccgccgcccuccagugcaugggccgccaggaccaggacgccggcaccaucgagcgcugccucgagcagaugucccaggagggccucaagcuccaggcccucuucaccgccguccuccucuccgaggaggaccgcgccaccguccucaaggccguccacaaggucaagcccaccuucucccuccccccccagcuccccccccccgucaacaccuccaagcuccuccgcgacgucuacgccaaggacggccgcgucuccuaccccaagcuccaccucccccucaagacccuccagugccucuucgagaagcagcuccacauggagcucgccucccgcgucugcgucgucuccgucgagaagcccacccuccccuccaaggaggucaagcacgcccgcaagacccucaagacccuccgcgaccagugggagaaggcccucugccgcgcccuccgcgagaccaagaaccgccucgagcgcgaggucuacgagggccgcuucucccucuaccccuuccucugccuccucgacgagcgcgaggucguccgcaugcuccuccagguccuccaggcccuccccgcccagggcgaguccuucaccacccucgcccgcgagcucuccgcccgcaccuucucccgccacgucguccagcgccagcgcgucuccggccagguccaggcccuccagaaccacuaccgcaaguaccucugccuccucgccuccgacgccgagguccccgagcccugccucccccgccaguacugggaggagcucggcgcccccgaggcccuccgcgagcagcccuggccccuccccguccagauggagcucggcaagcuccucgccgagaugcucguccaggccacccagaugcccugcucccucgacaagccccaccgcuccucccgccucguccccguccucuaccacgucuacuccuuccgcaacguccagcagaucggcauccucaagccccaccccgccuacguccagcuccucgagaaggccgccgagcccacccucaccuucgaggccgucgacguccccaugcucugccccccccuccccuggaccuccccccacuccggcgccuuccuccucucccccaccaagcucaugcgcaccgucgagggcgccacccagcaccaggagcuccucgagaccugcccccccaccgcccuccacggcgcccucgacgcccucacccagcucggcaacugcgccuggcgcgucaacggccgcguccucgaccucguccuccagcucuuccaggccaagggcugcccccagcucggcguccccgccccccccuccgaggccccccagccccccgaggcccaccucccccacuccgccgcccccgcccgcaaggccgagcuccgccgcgagcucgcccacugccagaaggucgcccgcgagaugcacucccuccgcgccgaggcccucuaccgccucucccucgcccagcaccuccgcgaccgcgucuucuggcucccccacaacauggacuuccgcggccgcaccuaccccugccccccccacuucaaccaccucggcuccgacgucgcccgcgcccuccucgaguucgcccagggccgcccccucggcccccacggccucgacuggcucaagauccaccucgucaaccucaccggccucaagaagcgcgagccccuccgcaagcgccucgccuucgccgaggaggucauggacgacauccucgacuccgccgaccagccccucaccggccgcaagugguggaugggcgccgaggagcccuggcagacccucgccugcugcauggaggucgccaacgccguccgcgccuccgaccccgccgccuacgucucccaccuccccguccaccaggacggcuccugcaacggccuccagcacuacgccgcccucggccgcgacuccgucggcgccgccuccgucaaccucgagcccuccgacgucccccaggacgucuacuccggcgucgccgcccaggucgaggucuuccgccgccaggacgcccagcgcggcaugcgcgucgcccagguccucgagggcuucaucacccgcaaggucgucaagcagaccgucaugaccgucgucuacggcgucacccgcuacggcggccgccuccagaucgagaagcgccuccgcgagcucuccgacuucccccaggaguucgucugggaggccucccacuaccucguccgccaggucuucaagucccuccaggagauguucuccggcacccgcgccauccagcacuggcucaccgaguccgcccgccucaucucccacaugggcuccgucgucgagugggucaccccccucggcguccccgucauccagcccuaccgccucgacuccaaggucaagcagaucggcggcggcauccaguccaucaccuacacccacaacggcgacaucucccgcaagcccaacacccgcaagcagaagaacggcuucccccccaacuucauccacucccucgacuccucccacaugaugcucaccgcccuccacugcuaccgcaagggccucaccuucgucuccguccacgacugcuacuggacccacgccgccgacgucuccgucaugaaccaggucugccgcgagcaguucguccgccuccacuccgagcccauccuccaggaccucucccgcuuccucgucaagcgcuucugcuccgagccccagaagauccucgaggccucccagcucaaggagacccuccaggccguccccaagcccggcgccuucgaccucgagcaggucaagcgcuccaccuacuucuucuccuga

SEQ ID NO: 47907 - RNA, 3000 nt, Artificial Sequence
  derived and/or modified sequence opt2 from POM121__Homo_sapiens__NP_001244119
auggucugcucccccgucaccguccgcaucgccccccccgaccgccgcuucucccgcuccgccauccccgagcagaucaucuccuccacccucuccucccccuccuccaacgcccccgaccccugcgccaaggagaccguccucuccgcccucaaggagaaggagaagaagcgcaccgucgaggaggaggaccagaucuuccucgacggccaggagaacaagcgccgccgccacgacuccuccggcuccggccacuccgccuucgagccccucgucgccaacggcguccccgccuccuucguccccaagcccggcucccucaagcgcggccucaacucccaguccuccgacgaccaccucaacaagcgcucccgcuccuccuccauguccucccucaccggcgccuacgccuccggcauccccuccuccucccgcaacgccaucaccuccuccuacuccuccacccgcggcaucucccagcucuggaagcgcaacggccccuccuccucccccuucuccucccccgccuccucccgcucccagacccccgagcgccccgccaagaagauccgcgaggaggagcucugccaccacuccuccuccuccaccccccucgccgccgaccgcgagucccagggcgagaaggccgccgacaccaccccccgcaagaagcagaacuccaacucccaguccacccccggcuccuccggccagcgcaagcgcaagguccagcuccuccccucccgccgcggcgagcagcucacccuccccccccccccccagcucggcuacuccaucaccgccgaggaccucgaccucgagaagaaggccucccuccagugguucaaccaggcccucgaggacaaguccgacgccgccuccaacuccgucaccgagaccccccccaucacccagcccuccuucaccuucacccuccccgccgccgcccccgccuccccccccaccucccuccucgcccccuccaccaacccccuccucgagucccucaagaagaugcagaccccccccucccucccccccugccccgaguccgccggcgccgccaccaccgaggcccucuccccccccaagacccccucccuccuccccccccucggccucucccaguccggcccccccggccuccuccccucccccuccuucgacuccaagccccccaccacccuccucggccucauccccgcccccuccaugguccccgccaccgacaccaaggccccccccacccuccaggccgagaccgccaccaagccccaggccaccuccgcccccucccccgcccccaagcaguccuuccucuucggcacccagaacaccucccccuccucccccgccgcccccgccgccuccuccgccccccccauguucaagcccaucuucaccgccccccccaaguccgagaaggagggccccaccccccccggccccuccgucaccgccaccgcccccuccuccuccucccuccccaccaccaccuccaccaccgcccccaccuuccagcccgucuucuccuccaugggcccccccgccuccgucccccuccccgcccccuucuucaagcagaccaccacccccgccaccgcccccaccaccaccgccccccucuucaccggccucgccuccgccaccuccgccgucgcccccaucaccuccgccucccccuccaccgacuccgccuccaagcccgccuucggcuucggcaucaacuccgucuccuccuccuccgucuccaccaccaccuccaccgccaccgccgccucccagcccuuccucuucggcgccccccaggccuccgccgccuccuucacccccgccaugggcuccaucuuccaguucggcaagccccccgcccuccccaccaccaccaccgucaccaccuucucccagucccuccacaccgccguccccaccgccaccuccuccuccgccgccgacuucuccggcuucggcuccacccucgccaccuccgcccccgccaccuccucccagcccacccucaccuucuccaacaccuccacccccaccuucaacauccccuucggcuccuccgccaaguccccccuccccuccuaccccggcgccaacccccagcccgccuucggcgccgccgagggccagccccccggcgccgccaagcccgcccucgcccccuccuucggcuccuccuucaccuucggcaacuccgccgcccccgccgccgcccccacccccgccccccccuccaugaucaaggucguccccgccuacguccccacccccauccaccccaucuucggcggcgccacccacuccgccuucggccucaaggccaccgccuccgccuucggcgcccccgccuccucccagcccgccuucggcggcuccaccgccgucuucuucggcgccgccaccuccuccggcuucggcgccaccacccagaccgccuccuccggcuccuccuccuccgucuucggcuccaccacccccucccccuucaccuucggcggcuccgccgcccccgccggcuccggcuccuucggcaucaacgucgccacccccggcuccuccaccaccaccggcgccuucuccuucggcgccggccaguccggcuccaccgccaccuccacccccuucgccggcggccucggccagaacgcccucggcaccaccggccaguccacccccuucgccuucaacgucuccuccaccaccgaguccaagcccgucuucggcggcaccgccacccccaccuucggccucaacacccccgcccccggcgucggcaccuccggcuccucccucuccuucggcgccuccuccgcccccgcccagggcuucgucggcgucgcccccuucggcaacaccuucgcccaccagcaggagcacuccccccgcaagggccccaacaaccucuccaagcgcaagcuccuccccgccguccgcgcccagggccucccccgccgcggccaggccuccuccuuccccacccgcaaggaguga

SEQ ID NO: 47908 - RNA, 804 nt, Artificial Sequence
  derived and/or modified sequence opt2 from POMC__Homo_sapiens__NP_001306134
augccccgcuccugcugcucccgcuccggcgcccuccuccucgcccuccuccuccaggccuccauggagguccgcggcuggugccucgaguccucccagugccaggaccucaccaccgaguccaaccuccucgagugcauccgcgccugcaagcccgaccucuccgccgagacccccauguuccccggcaacggcgacgagcagccccucaccgagaacccccgcaaguacgucaugggccacuuccgcugggaccgcuucggccgccgcaacuccuccuccuccggcuccuccggcgccggccagaagcgcgaggacgucuccgccggcgaggacugcggcccccuccccgagggcggccccgagccccgcuccgacggcgccaagcccggcccccgcgagggcaagcgcuccuacuccauggagcacuuccgcuggggcaagcccgucggcaagaagcgccgccccgucaaggucuaccccaacggcgccgaggacgaguccgccgaggccuucccccucgaguucaagcgcgagcucaccggccagcgccuccgcgagggcgacggccccgacggccccgccgacgacggcgccggcgcccaggccgaccucgagcacucccuccucgucgccgccgagaagaaggacgagggccccuaccgcauggagcacuuccgcuggggcuccccccccaaggacaagcgcuacggcggcuucaugaccuccgagaagucccagaccccccucgucacccucuucaagaacgccaucaucaagaacgccuacaagaagggcgaguga

SEQ ID NO: 47909 - RNA, 1554 nt, Artificial Sequence
  derived and/or modified sequence opt2 from POMGNT1__Homo_sapiens__NP_001277059
auggccaagcgcgucuucgacaccuacuccccccacgaggacgaggccaugguccucuuccucaacauggucgcccccggccgcguccucaucugcaccgucaaggacgagggcuccuuccaccucaaggacaccgccaaggcccuccuccgcucccucggcucccaggccggccccgcccucggcuggcgcgacaccugggccuucgucggccgcaagggcggccccgucuucggcgagaagcacuccaagucccccgcccucuccuccuggggcgaccccguccuccucaagaccgacgucccccucuccuccgccgaggaggccgagugccacugggccgacaccgagcucaaccgccgccgccgccgcuucugcuccaaggucgagggcuacggcuccgucugcuccugcaaggaccccacccccaucgaguucucccccgacccccuccccgacaacaagguccucaacguccccgucgccgucaucgccggcaaccgccccaacuaccucuaccgcaugcuccgcucccuccucuccgcccagggcgucuccccccagaugaucaccgucuucaucgacggcuacuacgaggagcccauggacgucgucgcccucuucggccuccgcggcauccagcacacccccaucuccaucaagaacgcccgcgucucccagcacuacaaggccucccucaccgccaccuucaaccucuuccccgaggccaaguucgccgucguccucgaggaggaccucgacaucgccgucgacuucuucuccuuccucucccaguccauccaccuccucgaggaggacgacucccucuacugcaucuccgccuggaacgaccagggcuacgagcacaccgccgaggaccccgcccuccucuaccgcgucgagaccaugcccggccucggcuggguccuccgccgcucccucuacaaggaggagcucgagcccaaguggcccacccccgagaagcucugggacugggacauguggaugcgcaugcccgagcagcgccgcggccgcgagugcaucauccccgacgucucccgcuccuaccacuucggcaucgucggccucaacaugaacggcuacuuccacgaggccuacuucaagaagcacaaguucaacaccguccccggcguccagcuccgcaacgucgacucccucaagaaggaggccuacgaggucgagguccaccgccuccucuccgaggccgagguccucgaccacuccaagaaccccugcgaggacuccuuccuccccgacaccgagggccacaccuacgucgccuucauccgcauggagaaggacgacgacuucaccaccuggacccagcucgccaagugccuccacaucugggaccucgacguccgcggcaaccaccgcggccucuggcgccucuuccgcaagaagaaccacuuccucgucgucggcguccccgccucccccuacuccgucaagaagccccccuccgucacccccaucuuccucgagcccccccccaaggaggagggcgcccccggcgcccccgagcagaccuga

SEQ ID NO: 47910 - RNA, 1743 nt, Artificial Sequence
  derived and/or modified sequence opt2 from POMGNT2__Homo_sapiens__NP_116195
augcaccucuccgccgucuucaacgcccuccucgucuccguccucgccgccguccucuggaagcacguccgccuccgcgagcacgccgccacccucgaggaggagcucgcccucucccgccaggccaccgagcccgcccccgcccuccgcaucgacuaccccaaggcccuccagauccucauggagggcggcacccacauggucugcaccggccgcacccacaccgaccgcaucugccgcuucaaguggcucugcuacuccaacgaggccgaggaguucaucuucuuccacggcaacaccuccgucaugcuccccaaccucggcucccgccgcuuccagcccgcccuccucgaccucuccaccgucgaggaccacaacacccaguacuucaacuucgucgagcuccccgccgccgcccuccgcuucaugcccaagcccgucuucguccccgacgucgcccucaucgccaaccgcuucaaccccgacaaccucaugcacgucuuccacgacgaccuccucccccucuucuacacccuccgccaguuccccggccucgcccacgaggcccgccucuucuucauggagggcuggggcgagggcgcccacuucgaccucuacaagcuccucucccccaagcagccccuccuccgcgcccagcucaagacccucggccgccuccucugcuucucccacgccuucgucggccucuccaagaucaccaccugguaccaguacggcuucguccagccccagggccccaaggccaacauccucgucuccggcaacgagauccgccaguucgcccgcuucaugaccgagaagcucaacgucucccacaccggcgucccccucggcgaggaguacauccucgucuucucccgcacccagaaccgccucauccucaacgaggccgagcuccuccucgcccucgcccaggaguuccagaugaagaccgucaccgucucccucgaggaccacaccuucgccgacgucguccgccucgucuccaacgccuccaugcucgucuccaugcacggcgcccagcucgucaccacccucuuccucccccgcggcgccaccgucgucgagcucuuccccuacgccgucaaccccgaccacuacacccccuacaagacccucgccaugcuccccggcauggaccuccaguacgucgccuggcgcaacaugaugcccgagaacaccgucacccaccccgagcgccccugggaccagggcggcaucacccaccucgaccgcgccgagcaggcccgcauccuccagucccgcgaggucccccgccaccucugcugccgcaaccccgaguggcucuuccgcaucuaccaggacaccaaggucgacauccccucccucauccagaccauccgccgcgucgucaagggccgccccggcccccgcaagcagaaguggaccgucggccucuaccccggcaagguccgcgaggcccgcugccaggccuccguccacggcgccuccgaggcccgccucaccgucuccuggcagauccccuggaaccucaaguaccucaagguccgcgaggucaaguacgaggucuggcuccaggagcagggcgagaacaccuacguccccuacauccucgcccuccagaaccacaccuucaccgagaacaucaagcccuucaccaccuaccucgucuggguccgcugcaucuucaacaagauccuccucggccccuucgccgacguccucgucugcaacaccuga

SEQ ID NO: 47911 - RNA, 1053 nt, Artificial Sequence
  derived and/or modified sequence opt2 from POMK__Homo_sapiens__NP_115613
auggagaagcagccccagaacucccgccgcggccucgccccccgcgaggucccccccgccgucggccuccuccucaucauggcccucaugaacacccuccucuaccucugccucgaccacuucuucaucgccccccgccaguccaccgucgaccccacccacugccccuacggccacuuccgcaucggccagaugaagaacugcucccccuggcucuccugcgaggagcuccgcaccgagguccgccagcucaagcgcgucggcgagggcgccgucaagcgcgucuuccucuccgaguggaaggagcacaaggucgcccucucccagcucaccucccucgagaugaaggacgacuuccuccacggccuccagaugcucaagucccuccagggcacccacgucgucacccuccucggcuacugcgaggacgacaacaccaugcucaccgaguaccacccccucggcucccucuccaaccucgaggagacccucaaccucuccaaguaccagaacgucaacaccuggcagcaccgccucgagcucgccauggacuacgucuccaucaucaacuaccuccaccacucccccgucggcacccgcgucaugugcgacuccaacgaccuccccaagacccucucccaguaccuccucaccuccaacuucuccauccucgccaacgaccucgacgcccucccccucgucaaccacuccuccggcaugcucgucaagugcggccaccgcgagcuccacggcgacuucgucgcccccgagcagcucuggcccuacggcgaggacguccccuuccacgacgaccucaugcccuccuacgacgagaagaucgacaucuggaagauccccgacaucuccuccuuccuccucggccacaucgagggcuccgacaugguccgcuuccaccucuucgacauccacaaggccugcaagucccagacccccuccgagcgccccaccgcccaggacguccucgagaccuaccagaagguccucgacacccuccgcgacgccaugaugucccaggcccgcgagaugcucuga

SEQ ID NO: 47912 - RNA, 426 nt, Artificial Sequence
  derived and/or modified sequence opt2 from POMP__Homo_sapiens__NP_057016
augaacgcccgcggccucggcuccgagcucaaggacuccauccccgucaccgagcucuccgccuccggccccuucgagucccacgaccuccuccgcaagggcuucuccugcgucaagaacgagcuccuccccucccacccccucgagcucuccgagaagaacuuccagcucaaccaggacaagaugaacuucuccacccuccgcaacauccagggccucuucgccccccucaagcuccagauggaguucaaggccguccagcagguccagcgccuccccuuccucuccuccuccaaccucucccucgacguccuccgcggcaacgacgagaccaucggcuucgaggacauccucaacgaccccucccaguccgaggucaugggcgagccccaccucauggucgaguacaagcucggccuccucuga

SEQ ID NO: 47913 - RNA, 2016 nt, Artificial Sequence
  derived and/or modified sequence opt2 from POMT1__Homo_sapiens__NP_001070834
augaagcagaucuucuuccucgacgacuccggcccccccuucggccacaugguccucgcccucggcggcuaccucggcggcuucgacggcaacuuccucuggaaccgcaucggcgccgaguacuccuccaacguccccgucuggucccuccgccuccuccccgcccucgccggcgcccucuccguccccauggccuaccagaucguccucgagcuccacuucucccacugcgccgccaugggcgccgcccuccucaugcucaucgagaacgcccucaucacccagucccgccucaugcuccucgaguccguccucaucuucuucaaccuccucgccguccucuccuaccucaaguucuucaacugccagaagcacucccccuucucccucuccuggugguucuggcucacccucaccggcgucgccugcuccugcgccgucggcaucaaguacaugggcgucuucaccuacguccucguccucggcgucgccgccguccacgccuggcaccuccucggcgaccagacccucuccaacgucugcgucuucugccaccuccucgcccgcgccgucgcccuccucgucauccccgucguccucuaccuccucuucuucuacguccaccucauccucgucuuccgcuccggcccccacgaccagaucauguccuccgccuuccaggccucccucgagggcggccucgcccgcaucacccagggccagccccucgaggucgccuucggcucccaggucacccuccgcaacgucuucggcaagcccguccccugcuggcuccacucccaccaggacaccuaccccaugaucuacgagaacggccgcggcuccucccaccagcagcaggucaccugcuaccccuucaaggacgucaacaacugguggaucgucaaggacccccgccgccaccagcucgucgucuccucccccccccgccccguccgccacggcgacaugguccagcucguccacggcaugaccacccgcucccucaacacccacgacgucgccgccccccucuccccccacucccaggaggucuccugcuacaucgacuacaacaucuccaugcccgcccagaaccucuggcgccucgagaucgucaaccgcggcuccgacaccgacgucuggaagaccauccucuccgagguccgcuucguccacgucaacaccuccgccguccucaagcucuccggcgcccaccuccccgacuggggcuaccgccagcucgagaucgucggcgagaagcucucccgcggcuaccacggcuccaccgucuggaacgucgaggagcaccgcuacggcgccucccaggagcagcgcgagcgcgagcgcgagcuccacucccccgcccaggucgacgucucccgcaaccucuccuucauggcccgcuucuccgagcuccaguggcgcaugcucgcccuccgcuccgacgacuccgagcacaaguacuccuccuccccccucgagugggucacccucgacaccaacaucgccuacuggcuccacccccgcaccuccgcccagauccaccuccucggcaacaucgucaucugggucuccggcucccucgcccucgccaucuacgcccuccucucccucugguaccuccuccgccgccgccgcaacguccacgaccucccccaggacgccuggcuccgcuggguccucgccggcgcccucugcgccggcggcugggccgucaacuaccuccccuucuuccucauggagaagacccucuuccucuaccacuaccuccccgcccucaccuuccagauccuccuccuccccgucguccuccagcacaucuccgaccaccucugccgcucccagcuccagcgcuccaucuucuccgcccucgucgucgccugguacuccuccgccugccacgucuccaacacccuccgcccccucaccuacggcgacaagucccucuccccccacgagcucaaggcccuccgcuggaaggacuccugggacauccucauccgcaagcacuga

SEQ ID NO: 47914 - RNA, 2253 nt, Artificial Sequence
  derived and/or modified sequence opt2 from POMT2__Homo_sapiens__NP_037514
augccccccgccaccggcggcggccucgccgaguccgagcuccgcccccgccgcggccgcugcggcccccaggccgcccgcgccgccggccgcgacgucgccgccgaggccgucgcccgcucccccaagcgccccgccuggggcucccgccgcuucgaggccgucggcuggugggcccuccucgcccucgucacccuccucuccuucgccacccgcuuccaccgccucgacgagcccccccacaucugcugggacgagacccacuucggcaagaugggcuccuacuacaucaaccgcaccuucuucuucgacguccaccccccccucggcaagaugcucaucggccucgccggcuaccucuccggcuacgacggcaccuuccucuuccagaagcccggcgacaaguacgagcaccacuccuacaugggcaugcgcggcuucugcgccuuccucggcuccuggcucguccccuucgccuaccucaccguccucgaccucuccaagucccucuccgccgcccuccucaccgccgcccuccucaccuucgacaccggcugccucacccucucccaguacauccuccucgaccccauccucauguucuucaucauggccgccaugcucuccauggucaaguacaacuccugcgccgaccgccccuucuccgcccccuggugguucuggcucucccucaccggcgucucccucgccggcgcccucggcgucaaguucgucggccucuucaucauccuccaggucggccucaacaccaucgccgaccucugguaccucuucggcgaccucucccucucccucgucaccgucggcaagcaccucaccgcccgcguccucugccucaucguccucccccucgcccucuacaccgccaccuucgccguccacuucaugguccucuccaaguccggccccggcgacggcuucuucuccuccgccuuccaggcccgccucuccggcaacaaccuccacaacgccuccauccccgagcaccucgccuacggcuccgucaucaccgucaagaaccuccgcauggccaucggcuaccuccacucccaccgccaccucuaccccgagggcaucggcgcccgccagcagcaggucaccaccuaccuccacaaggacuacaacaaccucuggaucaucaagaagcacaacaccaacuccgacccccucgaccccuccuuccccgucgaguucguccgccacggcgacaucauccgccucgagcacaaggagaccucccgcaaccuccacucccacuaccacgaggcccccaugacccgcaagcacuaccaggucaccggcuacggcaucaacggcaccggcgacuccaacgacuucuggcgcaucgaggucgucaaccgcaaguucggcaaccgcaucaagguccuccgcucccgcauccgcuucauccaccucgucaccggcugcguccucggcuccuccggcaagguccuccccaaguggggcugggagcagcucgaggucaccugcacccccuaccucaaggagacccucaacuccaucuggaacgucgaggaccacaucaaccccaagcuccccaacaucucccucgacguccuccagcccuccuuccccgagauccuccucgagucccacauggucaugauccgcggcaacuccggccucaagcccaaggacaacgaguucaccuccaagcccuggcacuggcccaucaacuaccagggccuccgcuucuccggcgucaacgacaccgacuuccgcgucuaccuccucggcaaccccgucgucugguggcucaaccuccucuccaucgcccucuaccuccucuccggcuccaucaucgccgucgccaugcagcgcggcgcccgccuccccgccgaggucgccggccucucccagguccuccuccgcggcggcggccagguccuccucggcuggacccuccacuacuuccccuucuuccucaugggccgcguccucuacuuccaccacuacuuccccgccaugcucuucuccuccaugcucaccggcauccucugggacacccuccuccgccucugcgccuggggccucgccuccuggccccucgcccgcggcauccacgucgccggcauccucucccuccuccucggcaccgccuacuccuucuaccucuuccacccccucgccuacggcauggucggcccccucgcccaggacccccagucccccauggccggccuccgcuggcucgacuccugggacuucuga

SEQ ID NO: 47915 - RNA, 564 nt, Artificial Sequence
  derived and/or modified sequence opt2 from POMZP3__Homo_sapiens__NP_036362
auggucugcucccccgucacccuccgcaucgccccccccgaccgccgcuucucccgcuccgccauccccgagcagaucaucuccuccacccucuccucccccuccuccaacgcccccgaccccugcgccaaggagaccguccucuccgcccucaaggagaagaagaagaagcgcaccgucgaggaggaggaccagaucuuccucgacggccaggagaacaagcgcuccugccucgucgacggccucaccgacgccuccuccgccuucaaggucccccgccccggccccgacacccuccaguucaccgucgacgucuuccacuucgccaacgacucccgcaacaugaucuacaucaccugccaccucaaggucacccucgccgagcaggaccccgacgagcucaacaaggccugcuccuucuccaagcccuccaacuccugguuccccgucgagggccucgccgacaucugccagugcugcaacaagggcgacugcggcacccccucccacucccgccgccagccccgcgucgucucccagugguccaccuccgccucccucuga

SEQ ID NO: 47916 - RNA, 1068 nt, Artificial Sequence
  derived and/or modified sequence opt2 from PON1__Homo_sapiens__NP_000437
auggccaagcucaucgcccucacccuccucggcaugggccucgcccucuuccgcaaccaccaguccuccuaccagacccgccucaacgcccuccgcgagguccagcccgucgagcuccccaacugcaaccucgucaagggcaucgagaccggcuccgaggaccucgagauccuccccaacggccucgccuucaucuccuccggccucaaguaccccggcaucaaguccuucaaccccaacucccccggcaagauccuccucauggaccucaacgaggaggaccccaccguccucgagcucggcaucaccggcuccaaguucgacgucuccuccuucaacccccacggcaucuccaccuucaccgacgaggacaacgccauguaccuccucgucgucaaccaccccgacgccaaguccaccgucgagcucuucaaguuccaggaggaggagaagucccuccuccaccucaagaccauccgccacaagcuccuccccaaccucaacgacaucgucgccgucggccccgagcacuucuacggcaccaacgaccacuacuuccucgaccccuaccuccaguccugggagauguaccucggccucgccugguccuacgucgucuacuacucccccuccgagguccgcgucgucgccgagggcuucgacuucgccaacggcaucaacaucucccccgacggcaaguacgucuacaucgccgagcuccucgcccacaagauccacgucuacgagaagcacgccaacuggacccucaccccccucaagucccucgacuucaacacccucgucgacaacaucuccgucgaccccgagaccggcgaccucugggucggcugccaccccaacggcaugaagaucuucuucuacgacuccgagaacccccccgccuccgagguccuccgcauccagaacauccucaccgaggagcccaaggucacccaggucuacgccgagaacggcaccguccuccagggcuccaccgucgccuccgucuacaagggcaagcuccucaucggcaccgucuuccacaaggcccucuacugcgagcucuga

SEQ ID NO: 47917 - RNA, 1065 nt, Artificial Sequence
  derived and/or modified sequence opt2 from PON2__Homo_sapiens__NP_000296
augggccgccucgucgccgucggccuccucggcaucgcccucgcccuccucggcgagcgccuccucgcccuccgcaaccgccucaaggccucccgcgaggucgaguccgucgaccucccccacugccaccucaucaagggcaucgaggccggcuccgaggacaucgacauccuccccaacggccucgccuucuucuccgucggccucaaguuccccggccuccacuccuucgcccccgacaagcccggcggcauccucaugauggaccucaaggaggagaagccccgcgcccgcgagcuccgcaucucccgcggcuucgaccucgccuccuucaacccccacggcaucuccaccuucaucgacaacgacgacaccgucuaccucuucgucgucaaccaccccgaguucaagaacaccgucgagaucuucaaguucgaggaggccgagaacucccuccuccaccucaagaccgucaagcacgagcuccuccccuccgucaacgacaucaccgccgucggccccgcccacuucuacgccaccaacgaccacuacuucuccgaccccuuccucaaguaccucgagaccuaccucaaccuccacugggccaacgucgucuacuacucccccaacgaggucaaggucgucgccgagggcuucgacuccgccaacggcaucaacaucucccccgacgacaaguacaucuacgucgccgacauccucgcccacgagauccacguccucgagaagcacaccaacaugaaccucacccagcucaagguccucgagcucgacacccucgucgacaaccucuccaucgaccccuccuccggcgacaucugggucggcugccaccccaacggccagaagcucuucgucuacgaccccaacaacccccccuccuccgagguccuccgcauccagaacauccucuccgagaagcccaccgucaccaccgucuacgccaacaacggcuccguccuccagggcuccuccgucgccuccgucuacgacggcaagcuccucaucggcacccucuaccaccgcgcccucuacugcgagcucuga

SEQ ID NO: 47918 - RNA, 1065 nt, Artificial Sequence
  derived and/or modified sequence opt2 from PON3__Homo_sapiens__NP_000931
augggcaagcucgucgcccucguccuccucggcgucggccucucccucgucggcgagauguuccucgccuuccgcgagcgcgucaacgccucccgcgaggucgagcccgucgagcccgagaacugccaccucaucgaggagcucgaguccggcuccgaggacaucgacauccuccccuccggccucgccuucaucuccuccggccucaaguaccccggcaugcccaacuucgcccccgacgagcccggcaagaucuuccucauggaccucaacgagcagaacccccgcgcccaggcccucgagaucuccggcggcuucgacaaggagcucuucaacccccacggcaucuccaucuucaucgacaaggacaacaccgucuaccucuacgucgucaaccacccccacaugaaguccaccgucgagaucuucaaguucgaggagcagcagcgcucccucgucuaccucaagaccaucaagcacgagcuccucaaguccgucaacgacaucgucguccucggccccgagcaguucuacgccacccgcgaccacuacuucaccaacucccuccucuccuucuucgagaugauccucgaccuccgcuggaccuacguccucuucuacuccccccgcgaggucaaggucgucgccaagggcuucugcuccgccaacggcaucaccgucuccgccgaccagaaguacgucuacgucgccgacgucgccgccaagaacauccacaucauggagaagcacgacaacugggaccucacccagcucaaggucauccagcucggcacccucgucgacaaccucaccgucgaccccgccaccggcgacauccucgccggcugccaccccaaccccaugaagcuccucaacuacaaccccgaggacccccccggcuccgagguccuccgcauccagaacguccucuccgagaagccccgcgucuccaccgucuacgccaacaacggcuccguccuccagggcaccuccgucgccuccgucuaccacggcaagauccucaucggcaccgucuuccacaagacccucuacugcgagcucuga

SEQ ID NO: 47919 - RNA, 3075 nt, Artificial Sequence
  derived and/or modified sequence opt2 from POP1__Homo_sapiens__NP_001139332
auguccaacgccaaggagcgcaagcacgccaagaagaugcgcaaccagcccaccaacgucacccucuccuccggcuucgucgccgaccgcggcgucaagcaccacuccggcggcgagaagcccuuccaggcccagaagcaggagccccaccccggcaccucccgccagcgccagacccgcgucaacccccacucccuccccgaccccgaggucaacgagcaguccuccuccaagggcauguuccgcaagaagggcggcuggaaggccggccccgagggcaccucccaggagauccccaaguacaucaccgccuccaccuucgcccaggcccgcgccgccgagaucuccgccaugcucaaggccgucacccagaaguccuccaacucccucgucuuccagacccucccccgccacaugcgccgccgcgccaugucccacaacgucaagcgccucccccgccgccuccaggagaucgcccagaaggaggccgagaaggccguccaccagaagaaggagcacuccaagaacaagugccacaaggcccgccgcugccacaugaaccgcacccucgaguucaaccgccgccagaagaagaacaucuggcucgagacccacaucuggcacgccaagcgcuuccacauggucaagaaguggggcuacugccucggcgagcgccccaccgucaagucccaccgcgccugcuaccgcgccaugaccaaccgcugccuccuccaggaccucuccuacuacugcugccucgagcucaagggcaaggaggaggagauccucaaggcccucuccggcaugugcaacaucgacaccggccucaccuucgccgccguccacugccucuccggcaagcgccagggcucccucguccucuaccgcgucaacaaguacccccgcgagaugcucggccccgucaccuucaucuggaagucccagcgcacccccggcgaccccuccgagucccgccagcucuggaucuggcuccaccccacccucaagcaggacauccucgaggagaucaaggccgccugccagugcgucgagcccaucaaguccgccgucugcaucgccgacccccuccccacccccucccaggagaagucccagaccgagcuccccgacgagaagaucggcaagaagcgcaagcgcaaggacgacggcgagaacgccaagcccaucaagaagaucaucggcgacggcacccgcgaccccugccuccccuacuccuggaucucccccaccaccggcaucaucaucuccgaccucaccauggagaugaaccgcuuccgccucaucggcccccucucccacuccauccucaccgaggccaucaaggccgccuccguccacaccgucggcgaggacaccgaggagaccccccaccgcugguggaucgagaccugcaagaagcccgacuccgucucccuccacugccgccaggaggccaucuucgagcuccucggcggcaucaccucccccgccgagauccccgccggcaccauccucggccucaccgucggcgacccccgcaucaaccucccccagaagaaguccaaggcccuccccaaccccgagaagugccaggacaacgagaagguccgccagcuccuccucgagggcguccccgucgagugcacccacuccuucaucuggaaccaggacaucugcaaguccgucaccgagaacaagaucuccgaccaggaccucaaccgcaugcgcuccgagcuccucguccccggcucccagcucauccucggcccccacgaguccaagauccccauccuccucauccagcagcccggcaaggucaccggcgaggaccgccucggcuggggcuccggcugggacguccuccuccccaagggcuggggcauggccuucuggauccccuucaucuaccgcggcguccgcgucggcggccucaaggaguccgccguccacucccaguacaagcgcucccccaacguccccggcgacuuccccgacugccccgccggcaugcucuucgccgaggagcaggccaagaaccuccucgagaaguacaagcgccgcccccccgccaagcgccccaacuacgucaagcucggcacccucgcccccuucugcugccccugggagcagcucacccaggacugggagucccgcguccaggccuacgaggagcccuccgucgccuccucccccaacggcaaggaguccgaccuccgccgcuccgagguccccugcgcccccaugcccaagaagacccaccagcccuccgacgaggucggcaccuccaucgagcacccccgcgaggccgaggaggucauggacgccggcugccaggaguccgccggccccgagcgcaucaccgaccaggaggccuccgagaaccacgucgccgccaccggcucccaccucugcguccuccgcucccgcaagcuccucaagcagcucuccgccuggugcggccccuccuccgaggacucccgcggcggccgccgcgcccccggccgcggccagcagggccucacccgcgaggccugccucuccauccucggccacuucccccgcgcccucgucugggucucccucucccuccucuccaagggcucccccgagccccacaccaugaucugcguccccgccaaggaggacuuccuccagcuccacgaggacuggcacuacugcggcccccaggaguccaagcacuccgaccccuuccgcuccaagauccucaagcagaaggagaagaagaagcgcgagaagcgccagaagcccggccgcgccuccuccgacggccccgccggcgaggagcccgucgccggccaggaggcccucacccucggccucugguccggcccccucccccgcgucacccuccacugcucccgcacccuccucggcuucgucacccagggcgacuucuccauggccgucggcugcggcgaggcccucggcuucgucucccucaccggccuccucgacaugcucuccucccagcccgccgcccagcgcggccucguccuccuccgcccccccgccucccuccaguaccgcuucgcccgcaucgccaucgaggucuga

SEQ ID NO: 47920 - RNA, 663 nt, Artificial Sequence
  derived and/or modified sequence opt2 from POP4__Homo_sapiens__NP_006618
augaaguccgucaucuaccacgcccucucccagaaggaggccaacgacuccgacguccagcccuccggcgcccagcgcgccgaggccuucguccgcgccuuccucaagcgcuccaccccccgcauguccccccaggcccgcgaggaccagcuccagcgcaaggccgucguccucgaguacuucacccgccacaagcgcaaggagaagaagaagaaggccaagggccucuccgcccgccagcgccgcgagcuccgccucuucgacaucaagcccgagcagcagcgcuacucccucuuccucccccuccacgagcucuggaagcaguacauccgcgaccucugcuccggccucaagcccgacacccagccccagaugauccaggccaagcuccucaaggccgaccuccacggcgccaucaucuccgucaccaaguccaagugccccuccuacgucggcaucaccggcauccuccuccaggagaccaagcacaucuucaagaucaucaccaaggaggaccgccucaaggucauccccaagcucaacugcgucuucaccgucgagaccgacggcuucaucuccuacaucuacggcuccaaguuccagcuccgcuccuccgagcgcuccgccaagaaguucaaggccaagggcaccaucgaccucuga

SEQ ID NO: 47921 - RNA, 876 nt, Artificial Sequence
  derived and/or modified sequence opt2 from POPDC3__Homo_sapiens__NP_071756
auggagcgcaacuccucccucuggaagaaccucaucgacgagcaccccgucugcaccaccuggaagcaggaggccgagggcgccaucuaccaccucgccuccauccucuucgucgucggcuucaugggcggcuccggcuucuucggccuccucuacgucuucucccuccucggccucggcuuccucugcuccgccgucugggccugggucgacgucugcgccgccgacaucuucuccuggaacuucguccucuucgucaucugcuucaugcaguucguccacaucgccuaccagguccgcuccaucaccuucgcccgcgaguuccagguccucuacuccucccucuuccagccccucggcaucucccuccccgucuuccgcaccaucgcccucuccuccgaggucgucacccucgagaaggagcacugcuacgccaugcagggcaagaccuccaucgacaagcucucccuccucgucuccggccgcauccgcgucaccgucgacggcgaguuccuccacuacaucuucccccuccaguuccucgacucccccgagugggacucccuccgccccaccgaggagggcaucuuccaggucacccucaccgccgagaccgacugccgcuacgucuccuggcgccgcaagaagcucuaccuccucuucgcccagcaccgcuacaucucccgccucuucuccguccucaucggcuccgacaucgccgacaagcucuacgcccucaacgaccgcgucuacaucggcaagcgcuaccacuacgacauccgccuccccaacuucuaccagauguccacccccgagauccgccgcuccccccucacccagcacuuccagaacucccgccgcuacugcgacaaguga

SEQ ID NO: 47922 - RNA, 1140 nt, Artificial Sequence
  derived and/or modified sequence opt2 from PORCN__Homo_sapiens__NP_001269096
auggucugggucguccuccucucccuccucugcuaccucguccucuuccucugccgccacuccucccaccgcggcgucuuccucuccgucaccauccucaucuaccuccucaugggcgagaugcacauggucgacaccgucaccuggcacaagaugcgcggcgcccagaugaucgucgccaugaaggccgucucccucggcuucgaccucgaccgcggcgaggucggcaccguccccucccccgucgaguucaugggcuaccucuacuucgucggcaccaucgucuucggccccuggaucuccuuccacuccuaccuccaggccguccagggccgcccccucuccugccgcuggcuccagaaggucgcccgcucccucgcccucgcccuccucugccucguccucuccaccugcgucggccccuaccucuuccccuacuucaucccccucaacggcgaccgccuccuccgcaaguggcuccgcgccuacgaguccgccgucuccuuccacuucuccaacuacuucgucggcuuccucuccgaggccaccgccacccucgccggcgccggcuucaccgaggagaaggaccaccucgagugggaccucaccgucuccaagccccucaacgucgagcucccccgcuccauggucgaggucgucaccuccuggaaccuccccauguccuacuggcucaacaacuacgucuucaagaacgcccuccgccucggcaccuucuccgccguccucgucaccuacgccgccuccgcccuccuccacggcuucuccuuccaccucgccgccguccuccucucccucgccuucaucaccuacgucgagcacguccuccgcaagcgccucgcccgcauccucuccgccugcguccucuccaagcgcugcccccccgacugcucccaccagcaccgccucggccucggcguccgcgcccucaaccuccucuucggcgcccucgccaucuuccaccucgccuaccucggcucccucuucgacgucgacgucgacgacaccaccgaggagcagggcuacggcauggccuacaccguccacaagugguccgagcucuccugggccucccacugggucaccuucggcugcuggaucuucuaccgccucaucggcuga

SEQ ID NO: 47923 - RNA, 2043 nt, Artificial Sequence
  derived and/or modified sequence opt2 from POR__Homo_sapiens__NP_000932
augaucaacaugggcgacucccacgucgacaccuccuccaccgucuccgaggccgucgccgaggaggucucccucuucuccaugaccgacaugauccucuucucccucaucgucggccuccucaccuacugguuccucuuccgcaagaagaaggaggagguccccgaguucaccaagauccagacccucaccuccuccguccgcgaguccuccuucgucgagaagaugaagaagaccggccgcaacaucaucgucuucuacggcucccagaccggcaccgccgaggaguucgccaaccgccucuccaaggacgcccaccgcuacggcaugcgcggcauguccgccgaccccgaggaguacgaccucgccgaccucuccucccuccccgagaucgacaacgcccucgucgucuucugcauggccaccuacggcgagggcgaccccaccgacaacgcccaggacuucuacgacuggcuccaggagaccgacgucgaccucuccggcgucaaguucgccgucuucggccucggcaacaagaccuacgagcacuucaacgccaugggcaaguacgucgacaagcgccucgagcagcucggcgcccagcgcaucuucgagcucggccucggcgacgacgacggcaaccucgaggaggacuucaucaccuggcgcgagcaguucuggcccgccgucugcgagcacuucggcgucgaggccaccggcgaggaguccuccauccgccaguacgagcucgucguccacaccgacaucgacgccgccaaggucuacaugggcgagaugggccgccucaaguccuacgagaaccagaagccccccuucgacgccaagaaccccuuccucgccgccgucaccaccaaccgcaagcucaaccagggcaccgagcgccaccucaugcaccucgagcucgacaucuccgacuccaagauccgcuacgaguccggcgaccacgucgccgucuaccccgccaacgacuccgcccucgucaaccagcucggcaagauccucggcgccgaccucgacgucgucaugucccucaacaaccucgacgaggaguccaacaagaagcaccccuuccccugccccaccuccuaccgcaccgcccucaccuacuaccucgacaucaccaaccccccccgcaccaacguccucuacgagcucgcccaguacgccuccgagcccuccgagcaggagcuccuccgcaagauggccuccuccuccggcgagggcaaggagcucuaccucuccugggucgucgaggcccgccgccacauccucgccauccuccaggacugccccucccuccgcccccccaucgaccaccucugcgagcuccucccccgccuccaggcccgcuacuacuccaucgccuccuccuccaagguccaccccaacuccguccacaucugcgccgucgucgucgaguacgagaccaaggccggccgcaucaacaagggcgucgccaccaacuggcuccgcgccaaggagcccgccggcgagaacggcggccgcgcccucguccccauguucguccgcaagucccaguuccgccuccccuucaaggccaccacccccgucaucauggucggccccggcaccggcgucgcccccuucaucggcuucauccaggagcgcgccuggcuccgccagcagggcaaggaggucggcgagacccuccucuacuacggcugccgccgcuccgacgaggacuaccucuaccgcgaggagcucgcccaguuccaccgcgacggcgcccucacccagcucaacgucgccuucucccgcgagcagucccacaaggucuacguccagcaccuccucaagcaggaccgcgagcaccucuggaagcucaucgagggcggcgcccacaucuacgucugcggcgacgcccgcaacauggcccgcgacguccagaacaccuucuacgacaucgucgccgagcucggcgccauggagcacgcccaggccgucgacuacaucaagaagcucaugaccaagggccgcuacucccucgacgucugguccuga

SEQ ID NO: 47924 - RNA, 2340 nt, Artificial Sequence
  derived and/or modified sequence opt2 from POSTN__Homo_sapiens__NP_001129406
augauccccuuccuccccauguucucccuccuccuccuccucaucgucaaccccaucaacgccaacaaccacuacgacaagauccucgcccacucccgcauccgcggccgcgaccagggccccaacgucugcgcccuccagcagauccucggcaccaagaagaaguacuucuccaccugcaagaacugguacaagaaguccaucugcggccagaagaccaccguccucuacgagugcugccccggcuacaugcgcauggagggcaugaagggcugccccgccguccuccccaucgaccacgucuacggcacccucggcaucgucggcgccaccaccacccagcgcuacuccgacgccuccaagcuccgcgaggagaucgagggcaagggcuccuucaccuacuucgcccccuccaacgaggccugggacaaccucgacuccgacauccgccgcggccucgaguccaacgucaacgucgagcuccucaacgcccuccacucccacaugaucaacaagcgcaugcucaccaaggaccucaagaacggcaugaucauccccuccauguacaacaaccucggccucuucaucaaccacuaccccaacggcgucgucaccgucaacugcgcccgcaucauccacggcaaccagaucgccaccaacggcgucguccacgucaucgaccgcguccucacccagaucggcaccuccauccaggacuucaucgaggccgaggacgaccucuccuccuuccgcgccgccgccaucaccuccgacauccucgaggcccucggccgcgacggccacuucacccucuucgcccccaccaacgaggccuucgagaagcucccccgcggcguccucgagcgcaucaugggcgacaaggucgccuccgaggcccucaugaaguaccacauccucaacacccuccagugcuccgaguccaucaugggcggcgccgucuucgagacccucgagggcaacaccaucgagaucggcugcgacggcgacuccaucaccgucaacggcaucaagauggucaacaagaaggacaucgucaccaacaacggcgucauccaccucaucgaccagguccucauccccgacuccgccaagcaggucaucgagcucgccggcaagcagcagaccaccuucaccgaccucgucgcccagcucggccucgccuccgcccuccgccccgacggcgaguacacccuccucgcccccgucaacaacgccuucuccgacgacacccucuccauggaccagcgccuccucaagcucauccuccagaaccacauccucaaggucaaggucggccucaacgagcucuacaacggccagauccucgagaccaucggcggcaagcagcuccgcgucuucgucuaccgcaccgccgucugcaucgagaacuccugcauggagaagggcuccaagcagggccgcaacggcgccauccacaucuuccgcgagaucaucaagcccgccgagaagucccuccacgagaagcucaagcaggacaagcgcuucuccaccuuccucucccuccucgaggccgccgaccucaaggagcuccucacccagcccggcgacuggacccucuucguccccaccaacgacgccuucaagggcaugaccuccgaggagaaggagauccucauccgcgacaagaacgcccuccagaacaucauccucuaccaccucacccccggcgucuucaucggcaagggcuucgagcccggcgucaccaacauccucaagaccacccagggcuccaagaucuuccucaaggaggucaacgacacccuccucgucaacgagcucaaguccaaggaguccgacaucaugaccaccaacggcgucauccacgucgucgacaagcuccucuaccccgccgacacccccgucggcaacgaccagcuccucgagauccucaacaagcucaucaaguacauccagaucaaguucguccgcggcuccaccuucaaggagauccccgucaccgucuacaagcccaucaucaagaaguacaccaagaucaucgacggcguccccgucgagaucaccgagaaggagacccgcgaggagcgcaucaucaccggccccgagaucaaguacacccgcaucuccaccggcggcggcgagaccgaggagacccucaagaagcuccuccaggaggaggucaccaaggucaccaaguucaucgagggcggcgacggccaccucuucgaggacgaggagaucaagcgccuccuccagggcgacacccccguccgcaagcuccaggccaacaagaagguccagggcucccgccgccgccuccgcgagggccgcucccaguga

SEQ ID NO: 47925 - RNA, 1905 nt, Artificial Sequence
  derived and/or modified sequence opt2 from POT1__Homo_sapiens__XP_006715980
augucccucguccccgccaccaacuacaucuacaccccccucaaccagcucaagggcggcaccaucgucaacgucuacggcgucgucaaguucuucaagccccccuaccucuccaagggcaccgacuacugcuccgucgucaccaucgucgaccagaccaacgucaagcucaccugccuccucuucuccggcaacuacgaggcccuccccaucaucuacaagaacggcgacaucguccgcuuccaccgccucaagauccaggucuacaagaaggagacccagggcaucaccuccuccggcuucgccucccucaccuucgagggcacccucggcgcccccaucaucccccgcaccuccuccaaguacuucaacuucaccaccgaggaccacaagauggucgaggcccuccgcgucugggccuccacccacaugucccccuccuggacccuccucaagcucugcgacguccagcccaugcaguacuucgaccucaccugccagcuccucggcaaggccgaggucgacggcgccuccuuccuccucaaggucugggacggcacccgcacccccuuccccuccuggcgcguccucauccaggaccucguccucgagggcgaccucucccacauccaccgccuccagaaccucaccaucgacauccucgucuacgacaaccacguccacgucgcccgcucccucaaggucggcuccuuccuccgcaucuacucccuccacaccaagcuccaguccaugaacuccgagaaccagaccaugcucucccucgaguuccaccuccacggcggcaccuccuacggccgcggcauccgcguccuccccgaguccaacuccgacgucgaccagcucaagaaggaccucgaguccgccaaccucaccgccaaccagcacuccgacgucaucugccaguccgagcccgacgacuccuuccccuccuccggcuccgucucccucuacgaggucgagcgcugccagcagcucuccgccaccauccucaccgaccaccaguaccucgagcgcaccccccucugcgccauccucaagcagaaggccccccagcaguaccgcauccgcgccaagcuccgcuccuacaagccccgccgccucuuccaguccgucaagcuccacugccccaagugccaccuccuccaggaggucccccacgagggcgaccucgacaucaucuuccaggacggcgccaccaagacccccgacgucaagcuccagaacaccucccucuacgacuccaagaucuggaccaccaagaaccagaagggccgcaaggucgccguccacuucgucaagaacaacggcauccucccccucuccaacgagugccuccuccucaucgagggcggcacccucuccgagaucugcaagcucuccaacaaguucaacuccgucauccccguccgcuccggccacgaggaccucgagcuccucgaccucuccgcccccuuccucauccagggcaccauccaccacuacggcugcaagcagugcuccucccuccgcuccauccagaaccucaacucccucgucgacaagaccuccuggauccccuccuccgucgccgaggcccucggcaucgucccccuccaguacgucuucgucaugaccuucacccucgacgacggcaccggcguccucgaggccuaccucauggacuccgacaaguucuuccagauccccgccuccgagguccucauggacgacgaccuccagaaguccgucgacaugaucauggacauguucugcccccccggcaucaagaucgacgccuaccccuggcucgagugcuucaucaaguccuacaacgucaccaacggcaccgacaaccagaucugcuaccagaucuucgacaccaccgucgccgaggacgucaucuga

SEQ ID NO: 47926 - RNA, 1755 nt, Artificial Sequence
  derived and/or modified sequence opt2 from POTED__Homo_sapiens__NP_778146
auggucgccgaggucugcuccaugcccaccgccuccaccgucaagaagcccuucgaccuccgcuccaagaugggcaaguggugccaccaccgcuuccccugcugccgcggcuccggcaaguccaacaugggcaccuccggcgaccacgacgacuccuucaugaagaugcuccgcuccaagaugggcaagugcugccgccacugcuuccccugcugccgcggcuccggcaccuccaacgucggcaccuccggcgaccacgagaacuccuucaugaagaugcuccgcuccaagaugggcaaguggugcugccacugcuuccccugcugccgcggcuccggcaaguccaacgucggcgccuggggcgacuacgaccacuccgccuucauggagccccgcuaccacauccgccgcgaggaccucgacaagcuccaccgcgccgccugguggggcaaggucccccgcaaggaccucaucgucaugcuccgcgacaccgacaugaacaagcgcgacaaggagaagcgcaccgcccuccaccucgccuccgccaacggcaacuccgaggucguccagcuccuccucgaccgccgcugccagcucaacguccucgacaacaagaagcgcaccgcccucaucaaggccauccagugccaggaggacgagugcguccucaugcuccucgagcacggcgccgaccgcaacauccccgacgaguacggcaacaccgcccuccacuacgccaucuacaacgaggacaagcucauggccaaggcccuccuccucuacggcgccgacaucgaguccaagaacaagugcggccucaccccccuccuccucggcguccacgagcagaagcagcaggucgucaaguuccucaucaagaagaaggccaaccucaacguccucgaccgcuacggccgcaccgcccucauccucgccgucugcugcggcuccgccuccaucgucaaccuccuccucgagcagaacgucgacgucuccucccaggaccucuccggccagaccgcccgcgaguacgccgucuccucccaccaccacgucaucugcgagcuccucuccgacuacaaggagaagcagaugcucaagaucuccuccgagaacuccaaccccgagcaggaccucaagcucaccuccgaggaggagucccagcgccucaaggucuccgagaacucccagcccgagaagaugucccaggagcccgagaucaacaaggacugcgaccgcgaggucgaggaggagaucaagaagcacggcuccaaccccgucggccuccccgagaaccucaccaacggcgccuccgccggcaacggcgacgacggccucaucccccagcgccgcucccgcaagcccgagaaccagcaguuccccgacaccgagaacgaggaguaccacuccgacgagcagaacgacacccgcaagcagcucuccgaggagcagaacaccggcaucucccaggacgagauccucaccaacaagcagaagcagaucgaggucgccgagcagaagaugaacuccgagcucucccucucccacaagaaggaggaggaccuccuccgcgagaacuccguccuccaggaggagaucgccaugcuccgccucgagcucgacgagaccaagcaccagaaccagcuccgcgagaacaagauccucgaggagaucgaguccgucaaggagaagaccgacaagcuccuccgcgccaugcagcucaacgaggaggcccucaccaagaccaacaucuga

SEQ ID NO: 47927 - RNA, 3228 nt, Artificial Sequence
  derived and/or modified sequence opt2 from POTEF__Homo_sapiens__NP_001093241
auggucgucgaggucgacuccaugcccgccgccuccuccgucaagaagcccuucggccuccgcuccaagaugggcaaguggugcugccgcugcuuccccugcugccgcgaguccggcaaguccaacgucggcaccuccggcgaccacgacgacuccgccaugaagacccuccgcuccaagaugggcaaguggugccgccacugcuuccccugcugccgcggcuccggcaaguccaacgucggcgccuccggcgaccacgacgacuccgccaugaagacccuccgcaacaagaugggcaaguggugcugccacugcuuccccugcugccgcggcuccuccaaguccaaggucggcgccuggggcgacuacgacgacuccgccuucauggagccccgcuaccacguccgcggcgaggaccucgacaagcuccaccgcgccgccugguggggcaaggucccccgcaaggaccucaucgucaugcuccgcgacaccgacgucaacaagcaggacaagcagaagcgcaccgcccuccaccucgccuccgccaacggcaacuccgaggucgucaagcuccuccucgaccgccgcugccagcucaacguccucgacaacaagaagcgcaccgcccucaucaaggccguccagugccaggaggacgagugcgcccucaugcuccucgagcacggcaccgaccccaacauccccgacgaguacggcaacaccacccuccacuacgccaucuacaacgaggacaagcucauggccaaggcccuccuccucuacggcgccgacaucgaguccaagaacaagcacggccucaccccccuccuccucggcguccacgagcagaagcagcaggucgucaaguuccucaucaagaagaaggccaaccucaacgcccucgaccgcuacggccgcaccgcccucauccucgccgucugcugcggcuccgccuccaucgucucccuccuccucgagcagaacaucgacgucuccucccaggaccucuccggccagaccgcccgcgaguacgccgucuccucccaccaccacgucaucugccagcuccucuccgacuacaaggagaagcagaugcucaagaucuccuccgagaacuccaaccccgagcaggaccucaagcucaccuccgaggaggagucccagcgcuucaagggcuccgagaacucccagcccgagaagaugucccaggagcccgagaucaacaaggacggcgaccgcgaggucgaggaggagaugaagaagcacgaguccaacaacgucggccuccucgagaaccucaccaacggcgucaccgccggcaacggcgacaacggccucaucccccagcgcaagucccgcacccccgagaaccagcaguuccccgacaacgaguccgaggaguaccaccgcaucugcgagcuccucuccgacuacaaggagaagcagaugcccaaguacuccuccgagaacuccaaccccgagcaggaccucaagcucaccuccgaggaggagucccagcgccucaagggcuccgagaacggccagcccgagaagcgcucccaggagcccgagaucaacaaggacggcgaccgcgagcucgagaacuucauggccaucgaggagaugaagaagcaccgcuccacccacgucggcuuccccgagaaccucaccaacggcgccaccgccggcaacggcgacgacggccucauccccccccgcaagucccgcacccccgagucccagcaguuccccgacaccgagaacgaggaguaccacuccgacgagcagaacgacacccagaagcaguucugcgaggagcagaacaccggcauccuccacgacgagauccucauccacgaggagaagcagaucgaggucgucgagaagaugaacuccgagcucucccucuccugcaagaaggagaaggacauccuccacgagaacuccacccuccgcgaggagaucgccaugcuccgccucgagcucgacaccaugaagcaccagucccagcuccgcgagaagaaguaccucgaggacaucgaguccgucaagaagcgcaacgacaaccuccucaaggcccuccagcucaacgagcucaccauggacgacgacaccgccguccucgucaucgacaacggcuccggcaugugcaaggccggcuucgccggcgacgacgccccccgcgccgucuuccccuccaucgucggccgcccccgccagcagggcaugaugggcggcaugcaccagaaggaguccuacgucggcaaggaggcccaguccaagcgcggcauccucacccucaaguaccccauggagcacggcaucaucaccaacugggacgacauggagaagaucuggcaccacaccuucuacaacgagcuccgcgucgcccccgaggagcaccccguccuccucaccgaggccacccucaaccccaaggccaaccgcgagaagaugacccagaucauguucgagaccuucaacacccccgccauguacgucgccauccaggccguccucucccucuacaccuccggccgcaccaccggcaucgucauggacuccggcgacggcgucacccacaccguccccaucuacgagggcaacgcccucccccacgccacccuccgccucgaccucgccggccgcgagcuccccgacuaccucaugaagauccucaccgagcacggcuaccgcuucaccaccauggccgagcgcgagaucguccgcgacaucaaggagaagcucugcuacgucgcccucgacuucgagcaggagauggccaccgucgccuccuccuccucccucgagaaguccuacgagcuccccgacggccaggucaucaccaucggcaacgagcgcuuccgcugccccgaggcccucuuccagcccugcuuccucggcauggaguccugcggcauccacgagaccaccuucaacuccaucaugaaguccgacgucgacauccgcaaggaccucuacaccaacaccguccucuccggcggcaccaccauguaccccggcauggcccaccgcaugcagaaggagaucgccgcccucgcccccuccaugaugaagauccgcaucaucgccccccccaagcgcaaguacuccgucugggucggcggcuccauccucgccucccucuccaccuuccagcagauguggaucuccaagcaggaguacgacgaguccggccccuccaucguccaccgcaagugccucuga

SEQ ID NO: 47928 - RNA, 1527 nt, Artificial Sequence
  derived and/or modified sequence opt2 from POTEG__Homo_sapiens__NP_001005356
auggucgccgaggccggcuccaugcccgccgccuccuccgucaagaagcccuucggccuccgcuccaagaugggcaaguggugccgccacugcuuccccuggugccgcggcuccggcaaguccaacgucggcaccuccggcgaccacgacgacuccgccaugaagacccuccgcuccaagaugggcaaguggugccgccacugcuuccccuggugccgcggcuccuccaaguccaacgucggcaccuccggcgaccacgacgacuccgccaugaagacccuccgcuccaagaugggcaaguggugcugccacugcuuccccugcugccgcggcuccggcaaguccaaggucggccccuggggcgacuacgacgacuccgccuucauggagccccgcuaccacguccgccgcgaggaccucgacaagcuccaccgcgccgccugguggggcaaggucccccgcaaggaccucaucgucaugcucaaggacaccgacaugaacaagaaggacaagcagaagcgcaccgcccuccaccucgccuccgccaacggcaacuccgaggucgucaagcuccuccucgaccgccgcugccagcucaacauccucgacaacaagaagcgcaccgcccucaccaaggccguccagugccgcgaggacgagugcgcccucaugcuccucgagcacggcaccgaccccaacauccccgacgaguacggcaacaccgcccuccacuacgccaucuacaacgaggacaagcucauggccaaggcccuccuccucuacggcgccgacaucgaguccaagaacaagcacggccucaccccccuccuccucggcguccacgagcagaagcagcaggucgucaaguuccucaucaagaagaaggccaaccucaacgcccucgaccgcuacggccgcaccgcccucauccucgccgucugcugcggcuccgccuccaucgucucccuccuccucgagcagaacaucgacgucuccucccaggaccucuccggccagaccgcccgcgaguacgccgucuccucccaccacaacgucaucugccagcuccucuccgacuacaaggagaagcagaugcucaaggucuccuccgagaacuccaaccccgagcaggaccucaagcucaccuccgaggaggagucccagcgccucaagggcuccgagaacucccagcccgaggagaugucccaggagcccgagaucaacaagggcggcgaccgcaaggucgaggaggagaugaagaagcacggcuccacccacaugggcuuccccgagaaccuccccaacggcgccaccgccgacaacggcgacgacggccucauccccccccgcaagucccgcacccccgagucccagcaguuccccgacaccgagaacgagcaguaccacuccgacgagcagaacgacacccagaagcagcucuccgaggagcagaacaccggcauccuccaggacgagauccucauccacgaggagaagcagaucgaggucgccgagaacgaguucuga

SEQ ID NO: 47929 - RNA, 1638 nt, Artificial Sequence
  derived and/or modified sequence opt2 from POTEH__Homo_sapiens__NP_001129685
auggucgccgaggccggcuccaugcccgccgccuccuccgucaagaagcccuucggccuccgcuccaagaugggcaaguggugccgccacugcuucgccuggugccgcggcuccggcaaguccaacgucggcaccuccggcgaccacgacgacuccgccaugaagacccuccgcuccaagaugggcaaguggugcugccacugcuuccccuggugccgcggcuccggcaaguccaacgucggcaccuccggcgaccacgacgacuccgccaugaagacccuccgcuccaagaugggcaaguggugcugccacugcuuccccugcugccgcggcuccggcaaguccaacgucggcaccuccggcgaccacgacgacuccgccaugaagacccuccgcuccaagaugggcaaguggugcugccacugcuuccccugcugccgcggcuccggcaagaacaaggucggccccuggggcgacuacgacgacuccgccuucauggagccccgcuaccacguccgccgcgaggaccucgacaagcuccaccgcgccgccugguggggcaaggucccccgcaaggaccucaucgucaugcucaaggacaccgacaugaacaagaaggacaagcagaagcgcaccgcccuccaccucgccuccgccaacggcaacuccgaggucgucaagcuccuccucgaccgccgcugccagcucaacauccucgacaacaagaagcgcaccgcccucaccaaggccguccagugccaggaggacgagugcgcccucaugcuccucgagcacggcaccgaccccaacauccccgacgaguacggcaacaccgcccuccacuacgccaucuacaacgaggacaagcucauggccaaggcccuccuccucuacggcgccgacaucgaguccaagaacaagcacggccucaccccccuccuccucggcguccacgagcagaagcagcaggucgucaaguuccucaucaagaagaaggccaaccucaacgcccucgaccgcuacggccgcaccgcccucauccucgccgucugcugcggcuccgccuccaucgucucccuccuccucgagcagaacaucgacgucuccucccaggaccucuccggccagaccgcccgcgaguacgccgucuccucccgccacaacgucaucugccagcuccucuccgacuacaaggagaagcagauccucaaggucuccuccgagaacuccaaccccgagcaggaccucaagcucaccuccgaggaggagucccagcgccucaagggcuccgagaacucccagcccgaggagaugucccaggagcccgagaucaacaagggcggcgaccgcaaggucgaggaggagaugaagaagcacggcuccacccacaugggcuuccccgagaaccucaccaacggcgccaccgccgacaacggcgacgacggccucauccccccccgcaagucccgcacccccgagucccagcaguuccccgacaccgagaacgagcaguaccacuccgacgagcagaacgacacccagaagcagcucuccgaggagcagaacaccggcauccuccaggacgagauccucauccacgaggagaagcagaucgaggucgccgagaacgaguucuga

SEQ ID NO: 47930 - RNA, 1527 nt, Artificial Sequence
  derived and/or modified sequence opt2 from POTEM__Homo_sapiens__NP_001138914
auggucgccgaggccggcuccaugcccgccgccuccuccgucaagaagcccuucggccuccgcuccaagaugggcaaguggugccgccacugcuuccccuggugccgcggcuccggcaaguccaacgucggcaccuccggcgaccacgacgacuccgccaugaagacccuccgcuccaagaugggcaaguggugccgccacugcuuccccuggugccgcggcuccggcaaguccaacgucggcaccuccggcgaccacgacgacuccgccaugaagacccuccgcuccaagaugggcaaguggugcugccacugcuuccccugcugccgcggcuccggcaaguccaaggucggccccuggggcgacuacgacgacuccgccuucauggagccccgcuaccacguccgccgcgaggaccucgacaagcuccaccgcgccgccugguggggcaaggucccccgcaaggaccucaucgucaugcucaaggacaccgacaugaacaagaaggacaagcagaagcgcaccgcccuccaccucgccuccgccaacggcaacuccgaggucgucaagcuccuccucgaccgccgcugccagcucaacauccucgacaacaagaagcgcaccgcccucaccaaggccguccagugccaggaggacgagugcgcccucaugcuccucgagcacggcaccgaccccaacauccccgacgaguacggcaacaccgcccuccacuacgccaucuacaacgaggacaagcucauggccaaggcccuccuccucuacggcgccgacaucgaguccaagaacaagcacggccucaccccccuccuccucggcguccacgagcagaagcagcaggucgucaaguuccucaucaagaagaaggccaaccucaacgcccucgaccgcuacggccgcaccguccucauccucgccgucugcugcggcuccgccuccaucgucucccuccuccucgagcagaacaucgacgucuccucccaggaccucuccggccagaccgcccgcgaguacgccgucuccucccgccacaacgucaucugccagcuccucuccgacuacaaggagaagcagauccucaaggucuccuccgagaacuccaaccccgagcaggaccucaagcucaccuccgaggaggagucccagcgccucaagggcuccgagaacucccagcccgaggagaugucccaggagcccgagaucaacaagggcggcgaccgcaaggucgaggaggagaugaagaagcacggcuccacccacaugggcuuccccgagaaccuccccaacggcgccaccgccgacaacggcgacgacggccucauccccccccgcaagucccgcacccccgagucccagcaguuccccgacaccgagaacgagcaguaccacuccgacgagcagaacgacacccagaagcagcucuccgaggagcagaacaccggcauccuccaggacgagauccucauccacgaggagaagcagaucgaggucgccgagaacgaguucuga

SEQ ID NO: 47931 - RNA, 876 nt, Artificial Sequence
  derived and/or modified sequence opt2 from POU1F1__Homo_sapiens__NP_000297
auguccugccaggccuucaccuccgccgacaccuucaucccccucaacuccgacgccuccgccacccucccccucaucaugcaccacuccgccgccgagugccuccccgucuccaaccacgccaccaacgucauguccaccgccaccggccuccacuacuccguccccuccugccacuacggcaaccagcccuccaccuacggcgucauggccggcucccucacccccugccucuacaaguuccccgaccacacccucucccacggcuucccccccauccaccagccccuccucgccgaggaccccaccgccgccgacuucaagcaggagcuccgccgcaaguccaagcucgucgaggagcccaucgacauggacucccccgagauccgcgagcucgagaaguucgccaacgaguucaagguccgccgcaucaagcucggcuacacccagaccaacgucggcgaggcccucgccgccguccacggcuccgaguucucccagaccaccaucugccgcuucgagaaccuccagcucuccuucaagaacgccugcaagcucaaggccauccucuccaaguggcucgaggaggccgagcaggucggcgcccucuacaacgagaaggucggcgccaacgagcgcaagcgcaagcgccgcaccaccaucuccaucgccgccaaggacgcccucgagcgccacuucggcgagcagaacaagcccuccucccaggagaucaugcgcauggccgaggagcucaaccucgagaaggaggucguccgcgucugguucugcaaccgccgccagcgcgagaagcgcgucaagaccucccucaaccagucccucuucuccaucuccaaggagcaccucgagugccgcuga

SEQ ID NO: 47932 - RNA, 771 nt, Artificial Sequence
  derived and/or modified sequence opt2 from POU2AF1__Homo_sapiens__NP_006226
augcucuggcagaagcccaccgcccccgagcaggcccccgcccccgcccgccccuaccagggcguccgcgucaaggagcccgucaaggagcuccuccgccgcaagcgcggccacgccuccuccggcgccgcccccgcccccaccgccgucguccucccccaccagccccucgccaccuacaccaccgucggccccuccugccucgacauggagggcuccgucuccgccgucaccgaggaggccgcccucugcgccggcuggcucucccagcccacccccgccacccuccagccccucgcccccuggacccccuacaccgaguacgucccccacgaggccgucuccugccccuacuccgccgacauguacguccagcccgucugccccuccuacaccgucgucggccccuccuccguccucaccuacgccucccccccccucaucaccaacgucaccacccgcuccuccgccacccccgccgucggccccccccucgagggccccgagcaccaggccccccucaccuacuuccccuggccccagccccucuccacccuccccaccuccacccuccaguaccagccccccgcccccgcccuccccggcccccaguucguccagcuccccaucuccauccccgagcccguccuccaggacauggaggacccccgccgcgccgccuccucccucaccaucgacaagcuccuccucgaggaggaggacuccgacgccuacgcccucaaccacacccucuccgucgagggcuucuga

SEQ ID NO: 47933 - RNA, 2268 nt, Artificial Sequence
  derived and/or modified sequence opt2 from POU2F1__Homo_sapiens__NP_001185712
augcucgacugcuccgacuacguccucgacucccgcaugaacaaccccuccgagaccuccaagcccuccauggaguccggcgacggcaacaccggcacccagaccaacggccucgacuuccagaagcagcccguccccgucggcggcgccaucuccaccgcccaggcccaggccuuccucggccaccuccaccagguccagcucgccggcaccucccuccaggccgccgcccagucccucaacguccaguccaaguccaacgaggaguccggcgacucccagcagcccucccagcccucccagcagcccuccguccaggccgccaucccccagacccagcucaugcucgccggcggccagaucaccggccucacccucacccccgcccagcagcagcuccuccuccagcaggcccaggcccaggcccagcuccucgccgccgccguccagcagcacuccgccucccagcagcacuccgccgccggcgccaccaucuccgccuccgccgccacccccaugacccagaucccccucucccagcccauccagaucgcccaggaccuccagcagcuccagcagcuccagcagcagaaccucaaccuccagcaguucguccucguccaccccaccaccaaccuccagcccgcccaguucaucaucucccagaccccccagggccagcagggccuccuccaggcccagaaccuccucacccagcucccccagcagucccaggccaaccuccuccagucccagcccuccaucacccucaccucccagcccgccacccccacccgcaccaucgccgccacccccauccagacccucccccagucccaguccacccccaagcgcaucgacacccccucccucgaggagcccuccgaccucgaggagcucgagcaguucgccaagaccuucaagcagcgccgcaucaagcucggcuucacccagggcgacgucggccucgccaugggcaagcucuacggcaacgacuucucccagaccaccaucucccgcuucgaggcccucaaccucuccuucaagaacaugugcaagcucaagccccuccucgagaaguggcucaacgacgccgagaaccucuccuccgacuccucccucuccucccccuccgcccucaacucccccggcaucgagggccucucccgccgccgcaagaagcgcaccuccaucgagaccaacauccgcgucgcccucgagaaguccuuccucgagaaccagaagcccaccuccgaggagaucaccaugaucgccgaccagcucaacauggagaaggaggucauccgcgucugguucugcaaccgccgccagaaggagaagcgcaucaacccccccuccuccggcggcaccuccuccucccccaucaaggccaucuuccccucccccaccucccucgucgccaccacccccucccucgucaccuccuccgccgccaccacccucaccgucucccccguccucccccucaccuccgccgccgucaccaaccucuccgucaccggcaccuccgacaccaccuccaacaacaccgccaccgucaucuccaccgccccccccgccuccuccgccgucaccucccccucccucucccccucccccuccgccuccgccuccaccuccgaggccuccuccgccuccgagaccuccaccacccagaccaccuccaccccccucuccuccccccucggcaccucccaggucauggucaccgccuccggccuccagaccgccgccgccgccgcccuccagggcgccgcccagcuccccgccaacgccucccucgccgccauggccgccgccgccggccucaaccccucccucauggcccccucccaguucgccgccggcggcgcccuccucucccucaaccccggcacccucuccggcgcccucucccccgcccucauguccaacuccacccucgccaccauccaggcccucgccuccggcggcucccuccccaucaccucccucgacgccaccggcaaccucgucuucgccaacgccggcggcgcccccaacaucgucaccgccccccucuuccucaacccccagaaccucucccuccucaccuccaaccccgucucccucgucuccgccgccgccgccuccgccggcaacuccgcccccgucgccucccuccacgccaccuccaccuccgccgaguccauccagaacucccucuucaccgucgccuccgccuccggcgccgccuccaccaccaccaccgccuccaaggcccaguga

SEQ ID NO: 47934 - RNA, 1440 nt, Artificial Sequence
  derived and/or modified sequence opt2 from POU2F2__Homo_sapiens__NP_001193954
augguccacuccuccaugggcgcccccgagauccgcauguccaagccccucgaggccgagaagcagggccucgacucccccuccgagcacaccgacaccgagcgcaacggccccgacaccaaccaccagaacccccagaacaagaccucccccuucuccgucucccccaccggccccuccaccaagaucaaggccgaggaccccuccggcgacuccgcccccgccgccccccuccccccccagcccgcccagccccaccucccccaggcccagcucaugcucaccggcucccagcucgccggcgacauccagcagcuccuccagcuccagcagcucguccucguccccggccaccaccuccagccccccgcccaguuccuccucccccaggcccagcagucccagcccggccuccuccccacccccaaccucuuccagcucccccagcagacccagggcgcccuccucaccucccagccccgcgccggccuccccacccaggccgucacccgccccacccuccccgacccccaccucucccacccccagccccccaagugccucgagccccccucccaccccgaggagcccuccgaccucgaggagcucgagcaguucgcccgcaccuucaagcagcgccgcaucaagcucggcuucacccagggcgacgucggccucgccaugggcaagcucuacggcaacgacuucucccagaccaccaucucccgcuucgaggcccucaaccucuccuucaagaacaugugcaagcucaagccccuccucgagaaguggcucaacgacgccgagaccauguccgucgacuccucccuccccucccccaaccagcucuccucccccucccucggcuucgacggccuccccggccgccgccgcaagaagcgcaccuccaucgagaccaacguccgcuucgcccucgagaaguccuuccucgccaaccagaagcccaccuccgaggagauccuccucaucgccgagcagcuccacauggagaaggaggucauccgcgucugguucugcaaccgccgccagaaggagaagcgcaucaaccccugcuccgccgcccccaugcuccccucccccggcaagcccgccuccuacuccccccacauggucaccccccagggcggcgccggcacccucccccucucccaggccuccuccucccucuccaccaccgucaccacccucuccuccgccgucggcacccuccaccccucccgcaccgccggcggcggcggcggcggcggcggcgccgcccccccccucaacuccauccccuccgucaccccccccccccccgccaccaccaacuccaccaaccccuccccccagggcucccacuccgccaucggccucuccggccucaaccccuccaccggccccggccucugguggaaccccgcccccuaccagcccuga

SEQ ID NO: 47935 - RNA, 1317 nt, Artificial Sequence
  derived and/or modified sequence opt2 from POU2F3__Homo_sapiens__NP_001231611
auggaguccccccgcaccgccaagggcggccgcgacaucaagauguccggcgacgucgccgacuccaccgacgcccgcuccacccucucccaggucgagcccggcaacgaccgcaacggccucgacuucaaccgccagaucaagaccgaggaccucuccgacucccuccagcagacccucucccaccgccccugccaccucucccagggccccgccaugauguccggcaaccagauguccggccucaacgccucccccugccaggacauggccucccuccacccccuccagcagcucguccucguccccggccaccuccaguccgucucccaguuccuccucucccagacccagcccggccagcagggccuccagcccaaccuccuccccuucccccagcagcaguccggccuccuccucccccagaccggccccggccucgccucccaggccuucggccaccccggccuccccggcuccucccucgagccccaccucgaggccucccagcaccuccccguccccaagcaccuccccuccuccggcggcgccgacgagcccuccgaccucgaggagcucgagaaguucgccaagaccuucaagcagcgccgcaucaagcucggcuucacccagggcgacgucggccucgccaugggcaagcucuacggcaacgacuucucccagaccaccaucucccgcuucgaggcccucaaccucuccuucaagaacaugugcaagcucaagccccuccucgagaaguggcucaacgacgccgaguccucccccuccgaccccuccgucuccacccccuccuccuaccccucccucuccgaggucuucggccgcaagcgcaagaagcgcaccuccaucgagaccaacauccgccucacccucgagaagcgcuuccaggacaaccccaagcccuccuccgaggagaucuccaugaucgccgagcagcucuccauggagaaggaggucguccgcgucugguucugcaaccgccgccagaaggagaagcgcaucaacugccccgucgccacccccaucaagccccccgucuacaacucccgccucgucucccccuccggcucccucggcccccucuccgucccccccguccacuccaccaugcccggcaccgucaccuccuccugcucccccggcaacaacucccgccccuccucccccggcuccggccuccacgccuccucccccaccgccucccagaacaacuccaaggccgccgucaacuccgccuccuccuucaacuccuccggcuccugguaccgcuggaaccacuccaccuaccuccacuga

SEQ ID NO: 47936 - RNA, 1332 nt, Artificial Sequence
  derived and/or modified sequence opt2 from POU3F2__Homo_sapiens__NP_005595
auggccaccgccgccuccaaccacuacucccuccucaccuccuccgccuccaucguccacgccgagccccccggcggcaugcagcagggcgccggcggcuaccgcgaggcccagucccucguccagggcgacuacggcgcccuccaguccaacggccacccccucucccacgcccaccaguggaucaccgcccucucccacggcggcggcggcggcggcggcggcggcggcggcggcggcggcggcggcggcggcggcggcggcgacggcucccccugguccaccuccccccucggccagcccgacaucaagcccuccgucgucguccagcagggcggccgcggcgacgagcuccacggccccggcgcccuccagcagcagcaccagcagcagcagcagcagcagcagcagcagcagcagcagcagcagcagcagcagcagcagcagcgccccccccaccucguccaccacgccgccaaccaccaccccggccccggcgccuggcgcuccgccgccgccgccgcccaccucccccccuccaugggcgccuccaacggcggccuccucuacucccagcccuccuucaccgucaacggcaugcucggcgccggcggccagcccgccggccuccaccaccacggccuccgcgacgcccacgacgagccccaccacgccgaccaccacccccacccccacucccacccccaccagcagccccccccccccccccccccccagggcccccccggccaccccggcgcccaccacgacccccacuccgacgaggacacccccaccuccgacgaccucgagcaguucgccaagcaguucaagcagcgccgcaucaagcucggcuucacccaggccgacgucggccucgcccucggcacccucuacggcaacgucuucucccagaccaccaucugccgcuucgaggcccuccagcucuccuucaagaacaugugcaagcucaagccccuccucaacaaguggcucgaggaggccgacuccuccuccggcucccccaccuccaucgacaagaucgccgcccagggccgcaagcgcaagaagcgcaccuccaucgaggucuccgucaagggcgcccucgagucccacuuccucaagugccccaagcccuccgcccaggagaucaccucccucgccgacucccuccagcucgagaaggaggucguccgcgucugguucugcaaccgccgccagaaggagaagcgcaugaccccccccggcggcacccuccccggcgccgaggacgucuacggcggcucccgcgacacccccccccaccacggcguccagacccccguccaguga

SEQ ID NO: 47937 - RNA, 1503 nt, Artificial Sequence
  derived and/or modified sequence opt2 from POU3F3__Homo_sapiens__NP_006227
auggccaccgccgccuccaaccccuaccuccccggcaacucccuccucgccgccggcuccaucguccacuccgacgccgccggcgccggcggcggcggcggcggcggcggcggcggcggcggcggcggcgccggcggcggcggcggcggcaugcagcccggcuccgccgccgucaccuccggcgccuaccgcggcgaccccuccuccgucaagaugguccaguccgacuucaugcagggcgccauggccgccuccaacggcggccacaugcucucccacgcccaccagugggucaccgcccucccccacgccgccgccgccgccgccgccgccgccgccgccgccgucgaggccuccucccccugguccggcuccgccgucggcauggccggcuccccccagcagcccccccagcccccccccccccccccccagggccccgacgucaagggcggcgccggccgcgacgaccuccacgccggcaccgcccuccaccaccgcggccccccccaccucggccccccccccccccccccccaccagggccaccccggcggcuggggcgccgccgccgccgccgccgccgccgccgccgccgccgccgccgccgcccaccuccccuccauggccggcggccagcagccccccccccagucccuccucuacucccagcccggcggcuucaccgucaacggcaugcucuccgccccccccggccccggcggcggcggcggcggcgccggcggcggcgcccagucccucguccaccccggccucguccgcggcgacacccccgagcucgccgagcaccaccaccaccaccaccaccacgcccacccccaccccccccacccccaccacgcccagggccccccccaccacggcggcggcggcggcggcgccggccccggccucaacucccacgacccccacuccgacgaggacacccccaccuccgacgaccucgagcaguucgccaagcaguucaagcagcgccgcaucaagcucggcuucacccaggccgacgucggccucgcccucggcacccucuacggcaacgucuucucccagaccaccaucugccgcuucgaggcccuccagcucuccuucaagaacaugugcaagcucaagccccuccucaacaaguggcucgaggaggccgacuccuccaccggcucccccaccuccaucgacaagaucgccgcccagggccgcaagcgcaagaagcgcaccuccaucgaggucuccgucaagggcgcccucgagucccacuuccucaagugccccaagcccuccgcccaggagaucaccaaccucgccgacucccuccagcucgagaaggaggucguccgcgucugguucugcaaccgccgccagaaggagaagcgcaugaccccccccggcauccagcagcagacccccgacgacgucuacucccaggucggcaccgucuccgccgacaccccccccccccaccacggccuccagaccuccguccaguga

SEQ ID NO: 47938 - RNA, 1086 nt, Artificial Sequence
  derived and/or modified sequence opt2 from POU3F4__Homo_sapiens__NP_000298
auggccaccgccgccuccaaccccuacuccauccucuccuccaccucccucguccacgccgacuccgccggcaugcagcagggcucccccuuccgcaacccccagaagcuccuccaguccgacuaccuccagggcguccccuccaacggccacccccucggccaccacugggucaccucccucuccgacggcggccccugguccuccacccucgccaccuccccccucgaccagcaggacgucaagcccggccgcgaggaccuccagcucggcgccaucauccaccaccgcuccccccacgucgcccaccacuccccccacaccaaccaccccaacgccuggggcgccucccccgcccccaaccccuccaucaccuccuccggccagccccucaacgucuacucccagcccggcuucaccgucuccggcaugcucgagcacggcggccucacccccccccccgccgccgccuccgcccagucccuccaccccguccuccgcgagccccccgaccacggcgagcucggcucccaccacugccaggaccacuccgacgaggagacccccaccuccgacgagcucgagcaguucgccaagcaguucaagcagcgccgcaucaagcucggcuucacccaggccgacgucggccucgcccucggcacccucuacggcaacgucuucucccagaccaccaucugccgcuucgaggcccuccagcucuccuucaagaacaugugcaagcucaagccccuccucaacaaguggcucgaggaggccgacuccuccaccggcucccccaccuccaucgacaagaucgccgcccagggccgcaagcgcaagaagcgcaccuccaucgaggucuccgucaagggcguccucgagacccacuuccucaagugccccaagcccgccgcccaggagaucuccucccucgccgacucccuccagcucgagaaggaggucguccgcgucugguucugcaaccgccgccagaaggagaagcgcaugaccccccccggcgaccagcagccccacgaggucuacucccacaccgucaagaccgacaccuccugccacgaccucuga

SEQ ID NO: 47939 - RNA, 1260 nt, Artificial Sequence
  derived and/or modified sequence opt2 from POU4F1__Homo_sapiens__NP_006228
augauguccaugaacuccaagcagccccacuucgccaugcaccccacccuccccgagcacaaguaccccucccuccacuccuccuccgaggccauccgccgcgccugccuccccacccccccccuccaguccaaccucuucgccucccucgacgagacccuccucgcccgcgccgaggcccucgccgccgucgacaucgccgucucccagggcaagucccaccccuucaagcccgacgccaccuaccacaccaugaacuccguccccugcaccuccaccuccaccgucccccucgcccaccaccaccaccaccaccaccaccaccaggcccucgagcccggcgaccuccucgaccacaucuccucccccucccucgcccucauggccggcgccggcggcgccggcgccgccgccggcggcggcggcgcccacgacggccccggcggcggcggcggccccggcggcggcggcggccccggcggcggccccggcggcggcggcggcggcggccccggcggcggcggcggcggccccggcggcggccuccucggcggcuccgcccacccccacccccacaugcacucccucggccaccucucccaccccgccgccgccgccgccaugaacaugcccuccggccucccccaccccggccucgucgccgccgccgcccaccacggcgccgccgccgccgccgccgccgccgccgccggccaggucgccgccgccuccgccgccgccgccgucgucggcgccgccggccucgccuccaucugcgacuccgacaccgacccccgcgagcucgaggccuucgccgagcgcuucaagcagcgccgcaucaagcucggcgucacccaggccgacgucggcuccgcccucgccaaccucaagauccccggcgucggcucccucucccaguccaccaucugccgcuucgagucccucacccucucccacaacaacaugaucgcccucaagcccauccuccaggccuggcucgaggaggccgagggcgcccagcgcgagaagaugaacaagcccgagcucuucaacggcggcgagaagaagcgcaagcgcaccuccaucgccgcccccgagaagcgcucccucgaggccuacuucgccguccagccccgccccuccuccgagaagaucgccgccaucgccgagaagcucgaccucaagaagaacgucguccgcgucugguucugcaaccagcgccagaagcagaagcgcaugaaguucuccgccaccuacuga

SEQ ID NO: 47940 - RNA, 1230 nt, Artificial Sequence
  derived and/or modified sequence opt2 from POU4F2__Homo_sapiens__NP_004566
augaugaugaugucccucaacuccaagcaggccuucuccaugccccacggcggcucccuccacgucgagcccaaguacuccgcccuccacuccaccucccccggcuccuccgcccccaucgcccccuccgccuccucccccuccuccuccuccaacgccggcggcggcggcggcggcggcggcggcggcggcggcggcggcggccgcuccuccuccuccuccuccuccggcuccuccggcggcggcggcuccgaggccaugcgccgcgccugccuccccaccccccccuccaacaucuucggcggccucgacgagucccuccucgcccgcgccgaggcccucgccgccgucgacaucgucucccaguccaagucccaccaccaccaccccccccaccacucccccuucaagcccgacgccaccuaccacaccaugaacaccauccccugcaccuccgccgccuccuccuccuccguccccaucucccaccccuccgcccucgccggcacccaccaccaccaccaccaccaccaccaccaccaccaccagccccaccaggcccucgagggcgagcuccucgagcaccucucccccggccucgcccucggcgccauggccggccccgacggcgccgucgucuccacccccgcccacgccccccacauggccaccaugaaccccaugcaccaggccgcccucuccauggcccacgcccacggccuccccucccacaugggcugcauguccgacgucgacgccgacccccgcgaccucgaggccuucgccgagcgcuucaagcagcgccgcaucaagcucggcgucacccaggccgacgucggcuccgcccucgccaaccucaagauccccggcgucggcucccucucccaguccaccaucugccgcuucgagucccucacccucucccacaacaacaugaucgcccucaagcccauccuccaggccuggcucgaggaggccgagaagucccaccgcgagaagcucaccaagcccgagcucuucaacggcgccgagaagaagcgcaagcgcaccuccaucgccgcccccgagaagcgcucccucgaggccuacuucgccauccagccccgccccuccuccgagaagaucgccgccaucgccgagaagcucgaccucaagaagaacgucguccgcgucugguucugcaaccagcgccagaagcagaagcgcaugaaguacuccgccggcaucuga

SEQ ID NO: 47941 - RNA, 1017 nt, Artificial Sequence
  derived and/or modified sequence opt2 from POU4F3__Homo_sapiens__NP_002691
augauggccaugaacuccaagcagcccuucggcaugcaccccguccuccaggagcccaaguucuccucccuccacuccggcuccgaggccaugcgccgcgucugccuccccgccccccagcuccagggcaacaucuucggcuccuucgacgagucccuccucgcccgcgccgaggcccucgccgccgucgacaucgucucccacggcaagaaccaccccuucaagcccgacgccaccuaccacaccauguccuccguccccugcaccuccaccuccuccaccguccccaucucccaccccgccgcccucaccucccacccccaccacgccguccaccagggccucgagggcgaccuccucgagcacaucucccccacccucuccgucuccggccucggcgcccccgagcacuccgucaugcccgcccagauccacccccaccaccucggcgccaugggccaccuccaccaggccaugggcaugucccacccccacaccgucgccccccacuccgccaugcccgccugccucuccgacgucgaguccgacccccgcgagcucgaggccuucgccgagcgcuucaagcagcgccgcaucaagcucggcgucacccaggccgacgucggcgccgcccucgccaaccucaagauccccggcgucggcucccucucccaguccaccaucugccgcuucgagucccucacccucucccacaacaacaugaucgcccucaagcccguccuccaggccuggcucgaggaggccgaggccgccuaccgcgagaagaacuccaagcccgagcucuucaacggcuccgagcgcaagcgcaagcgcaccuccaucgccgcccccgagaagcgcucccucgaggccuacuucgccauccagccccgccccuccuccgagaagaucgccgccaucgccgagaagcucgaccucaagaagaacgucguccgcgucugguucugcaaccagcgccagaagcagaagcgcaugaaguacuccgccguccacuga

SEQ ID NO: 47942 - RNA, 1080 nt, Artificial Sequence
  derived and/or modified sequence opt2 from POU5F1B__Homo_sapiens__NP_001153014
auggccggccaccucgccuccgacuucgccuucucccccccccccggcggcggcggcgacggccccuggggcgccgagcccggcugggucgacccccucaccuggcucuccuuccagggcccccccggcggccccggcaucggccccggcgucggccccggcuccgaggucuggggcaucccccccugccccccccccuacgagcucugcggcggcauggccuacugcggcccccaggucggcgucggccucgucccccagggcggccucgagaccucccagcccgaguccgaggccggcgucggcgucgaguccaacuccaacggcgccucccccgagcccugcaccgucccccccggcgccgucaagcucgagaaggagaagcucgagcagaaccccgagaagucccaggacaucaaggcccuccagaaggagcucgagcaguucgccaagcuccucaagcagaagcgcaucacccucggcuacacccaggccgacgucggccucauccucggcguccucuucggcaaggucuucucccagaagaccaucugccgcuucgaggcccuccagcucuccuucaagaacaugugcaagcuccgcccccuccuccagaagugggucgaggaggccgacaacaacgagaaccuccaggagaucugcaaggccgagacccucaugcaggcccgcaagcgcaagcgcaccuccaucgagaaccgcguccgcggcaaccucgagaaccucuuccuccagugccccaagcccacccuccagaucucccacaucgcccagcagcucggccucgagaaggacgucguccgcgucugguucugcaaccgccgccagaagggcaagcgcuccuccuccgacuacgcccagcgcgaggacuucgaggccgccggcucccccuucuccggcggccccgucuccuucccccccgcccccggcccccacuucggcacccccggcuacggcuccccccacuucaccgcccucuacuccuccguccccuuccccgagggcgaggucuucccccccgucuccgucaucacccucggcucccccaugcacuccaacuga

SEQ ID NO: 47943 - RNA, 495 nt, Artificial Sequence
  derived and/or modified sequence opt2 from POU5F1__Homo_sapiens__NP_001272915
augugcaagcuccgcccccuccuccagaagugggucgaggaggccgacaacaacgagaaccuccaggagaucugcaaggccgagacccucguccaggcccgcaagcgcaagcgcaccuccaucgagaaccgcguccgcggcaaccucgagaaccucuuccuccagugccccaagcccacccuccagcagaucucccacaucgcccagcagcucggccucgagaaggacgucguccgcgucugguucugcaaccgccgccagaagggcaagcgcuccuccuccgacuacgcccagcgcgaggacuucgaggccgccggcucccccuucuccggcggccccgucuccuucccccucgcccccggcccccacuucggcacccccggcuacggcuccccccacuucaccgcccucuacuccuccguccccuuccccgagggcgaggccuucccccccgucuccgucaccacccucggcucccccaugcacuccaacuga

SEQ ID NO: 47944 - RNA, 906 nt, Artificial Sequence
  derived and/or modified sequence opt2 from POU6F1__Homo_sapiens__NP_002693
augcccggcaucuccucccagauccucaccaacgcccagggccaggucaucggcacccuccccugggucgucaacuccgccuccgucgccgcccccgcccccgcccagucccuccagguccaggccgucaccccccagcuccuccucaacgcccagggccaggucaucgccacccucgccuccuccccccuccccccccccgucgccguccgcaagcccuccacccccgagucccccgccaaguccgagguccagcccauccagcccacccccaccgucccccagcccgccgucgucaucgccucccccgcccccgccgccaagcccuccgccuccgcccccauccccaucaccugcuccgagacccccaccgucucccagcucgucuccaagccccacacccccucccucgacgaggacggcaucaaccucgaggagauccgcgaguucgccaagaacuucaagauccgccgccucucccucggccucacccagacccaggucggccaggcccucaccgccaccgagggccccgccuacucccaguccgccaucugccgcuucgagaagcucgacaucacccccaaguccgcccagaagcucaagcccguccucgagaaguggcucaacgaggccgagcuccgcaaccaggagggccagcagaaccucauggaguucgucggcggcgagcccuccaagaagcgcaagcgccgcaccuccuucaccccccaggccaucgaggcccucaacgccuacuucgagaagaacccccuccccaccggccaggagaucaccgagaucgccaaggagcucaacuacgaccgcgaggucguccgcgucugguucugcaaccgccgccagacccucaagaacaccuccaagcucaacgucuuccagauccccuga

SEQ ID NO: 47945 - RNA, 1968 nt, Artificial Sequence
  derived and/or modified sequence opt2 from POU6F2__Homo_sapiens__NP_001159490
auguccgcccuccuccaggaccccaugaucgccggccaggucuccaagccccuccucuccguccgcuccgagaugaacgccgagcuccgcggcgaggacaaggccgccaccuccgacuccgagcucaacgagccccuccucgcccccgucgaguccaacgacuccgaggacacccccuccaagcucuucggcgcccgcggcaaccccgcccucuccgaccccggcacccccgaccagcaccaggccucccagacccacccccccuuccccgucggcccccagccccuccucaccgcccagcagcucgccuccgccgucgccggcgucaugcccggcggcccccccgcccucaaccagcccauccucauccccuucaacauggccggccagcucggcggccagcagggccucguccucacccuccccaccgccaaccucaccaacauccagggccucgucgccgccgccgccgccggcggcaucaugacccucccccuccagaaccuccaggccaccuccucccucaacucccagcuccagcagcuccagcuccagcuccagcagcagcagcagcagcagcagcagcagcccccccccuccaccaaccagcacccccagcccgccccccaggcccccucccagucccagcagcagccccuccagcccacccccccccagcagcccccccccgccucccagcagccccccgcccccaccucccagcuccagcaggccccccagccccagcagcaccagccccacucccacucccagaaccagaaccagcccucccccacccagcaguccuccucccccccccagaagcccucccagucccccggccacggccuccccuccccccucaccccccccaacccccuccagcucgucaacaacccccucgccucccaggccgccgccgccgccgccgccauguccuccaucgccuccucccaggccuucggcaacgcccucuccucccuccagggcgucaccggccagcucgucaccaacgcccagggccagaucaucggcaccaucccccucaugcccaaccccggccccuccucccaggccgccuccggcacccagggccuccagguccagcccaucaccccccagcuccucaccaacgcccagggccagaucaucgccaccgucaucggcaaccagauccuccccgucaucaacacccagggcaucacccucucccccaucaagcccggccagcagcuccaccagcccucccagaccuccgucggccaggccgccucccagggcaaccuccuccaccucgcccacucccaggccuccaugucccagucccccguccgccaggccuccuccuccuccuccuccuccuccuccuccuccgcccucuccgucggccagcucgucuccaacccccagaccgccgccggcgaggucgacggcgucaaccucgaggagauccgcgaguucgccaaggccuucaagauccgccgccucucccucggccucacccagacccaggucggccaggcccucuccgccaccgagggccccgccuacucccaguccgccaucugccgcuucgagaagcucgacaucacccccaaguccgcccagaagaucaagcccguccucgagcgcuggauggccgaggccgaggcccgccaccgcgccggcaugcagaaccucaccgaguucaucggcuccgagcccuccaagaagcgcaagcgccgcaccuccuucaccccccaggcccucgagauccucaacgcccacuucgagaagaacacccaccccuccggccaggagaugaccgagaucgccgagaagcucaacuacgaccgcgaggucguccgcgucugguucugcaacaagcgccaggcccucaagaacaccaucaagcgccucaagcagcacgagcccgccaccgccgucccccucgagccccucaccgacucccucgaggagaacuccuga

SEQ ID NO: 47946 - RNA, 870 nt, Artificial Sequence
  derived and/or modified sequence opt2 from PPA1__Homo_sapiens__NP_066952
auguccggcuucuccaccgaggagcgcgccgcccccuucucccucgaguaccgcgucuuccucaagaacgagaagggccaguacaucucccccuuccacgacauccccaucuacgccgacaaggacgucuuccacauggucgucgaggucccccgcugguccaacgccaagauggagaucgccaccaaggacccccucaaccccaucaagcaggacgucaagaagggcaagcuccgcuacgucgccaaccucuuccccuacaagggcuacaucuggaacuacggcgccaucccccagaccugggaggaccccggccacaacgacaagcacaccggcugcugcggcgacaacgaccccaucgacgucugcgagaucggcuccaaggucugcgcccgcggcgagaucaucggcgucaagguccucggcauccucgccaugaucgacgagggcgagaccgacuggaaggucaucgccaucaacgucgacgaccccgacgccgccaacuacaacgacaucaacgacgucaagcgccucaagcccggcuaccucgaggccaccgucgacugguuccgccgcuacaagguccccgacggcaagcccgagaacgaguucgccuucaacgccgaguucaaggacaaggacuucgccaucgacaucaucaaguccacccacgaccacuggaaggcccucgucaccaagaagaccaacggcaagggcaucuccugcaugaacaccacccucuccgagucccccuucaagugcgaccccgacgccgcccgcgccaucgucgacgcccuccccccccccugcgaguccgccugcaccguccccaccgacgucgacaagugguuccaccaccagaagaacuga

SEQ ID NO: 47947 - RNA, 918 nt, Artificial Sequence
  derived and/or modified sequence opt2 from PPA2__Homo_sapiens__NP_008834
auguccgcccuccuccgccuccuccgcaccggcgcccccgccgccgccugccuccgccucggcaccuccgccggcaccggcucccgccgcgccauggcccucuaccacaccgaggagcgcggccagcccugcucccagaacuaccgccucuucuucaagaacgucaccggccacuacaucucccccuuccacgacaucccccucaaggucaacuccaaggaggagaacggcauccccaugaagaaggcccgcaacgacgaguacgagaaccucuucaacaugaucgucgagaucccccgcuggaccaacgccaagauggagaucgccaccaaggagcccaugaaccccaucaagcaguacgucaaggacggcaagcuccgcuacgucgccaacaucuuccccuacaagggcuacaucuggaacuacggcacccucccccagauccucuccugcggcgaggucauccacgucaagauccucggcauccucgcccucaucgacgagggcgagaccgacuggaagcucaucgccaucaacgccaacgaccccgaggccuccaaguuccacgacaucgacgacgucaagaaguucaagcccggcuaccucgaggccacccucaacugguuccgccucuacaagguccccgacggcaagcccgagaaccaguucgccuucaacggcgaguucaagaacaaggccuucgcccucgaggucaucaaguccacccaccagugcuggaaggcccuccucaugaagaagugcaacggcggcgccaucaacugcaccaacguccagaucuccgacucccccuuccgcugcacccaggaggaggcccgcucccucgucgaguccgucuccuccucccccaacaaggaguccaacgaggaggagcaggucuggcacuuccucggcaaguga

SEQ ID NO: 47948 - RNA, 855 nt, Artificial Sequence
  derived and/or modified sequence opt2 from PPAP2A__Homo_sapiens__NP_003702
auguucgacaagacccgccuccccuacgucgcccucgacguccucugcguccuccucgccggccuccccuucgccauccucaccucccgccacacccccuuccagcgcggcgucuucugcaacgacgaguccaucaaguaccccuacaaggaggacaccauccccuacgcccuccucggcggcaucaucauccccuucuccaucaucgucaucauccucggcgagacccucuccgucuacugcaaccuccuccacuccaacuccuucauccgcaacaacuacaucgccaccaucuacaaggccaucggcaccuuccucuucggcgccgccgccucccagucccucaccgacaucgccaaguacuccaucggccgccuccgcccccacuuccucgacgucugcgaccccgacugguccaagaucaacugcuccgacggcuacaucgaguacuacaucugccgcggcaacgccgagcgcgucaaggagggccgccucuccuucuacuccggccacuccuccuucuccauguacugcaugcucuucgucgcccucuaccuccaggcccgcaugaagggcgacugggcccgccuccuccgccccacccuccaguucggccucgucgccgucuccaucuacgucggccucucccgcgucuccgacuacaagcaccacugguccgacguccucaccggccucauccagggcgcccucgucgccauccucgucgccgucuacgucuccgacuucuucaaggagcgcaccuccuucaaggagcgcaaggaggaggacucccacaccacccuccacgagacccccaccaccggcaaccacuaccccuccaaccaccagcccuga

SEQ ID NO: 47949 - RNA, 867 nt, Artificial Sequence
  derived and/or modified sequence opt2 from PPAP2C__Homo_sapiens__NP_003703
augcagcgccgcugggucuucguccuccucgacguccucugccuccucgucgccucccuccccuucgccauccucacccucgucaacgcccccuacaagcgcggcuucuacugcggcgacgacuccauccgcuaccccuaccgccccgacaccaucacccacggccucauggccggcgucaccaucaccgccaccgucauccucgucuccgccggcgaggccuaccucgucuacaccgaccgccucuacucccgcuccgacuucaacaacuacgucgccgccgucuacaagguccucggcaccuuccucuucggcgccgccgucucccagucccucaccgaccucgccaaguacaugaucggccgccuccgccccaacuuccucgccgucugcgaccccgacuggucccgcgucaacugcuccgucuacguccagcucgagaaggucugccgcggcaaccccgccgacgucaccgaggcccgccucuccuucuacuccggccacuccuccuucggcauguacugcauggucuuccucgcccucuacguccaggcccgccucugcuggaagugggcccgccuccuccgccccaccguccaguucuuccucgucgccuucgcccucuacgucggcuacacccgcgucuccgacuacaagcaccacugguccgacguccucgucggccuccuccagggcgcccucgucgccgcccucaccgucugcuacaucuccgacuucuucaaggcccgccccccccagcacugccucaaggaggaggagcucgagcgcaagcccucccucucccucacccucacccucggcgaggccgaccacaaccacuacggcuacccccacuccuccuccuga

SEQ ID NO: 47950 - RNA, 795 nt, Artificial Sequence
  derived and/or modified sequence opt2 from PPAPDC1B__Homo_sapiens__NP_001096029
augggcaaggccgccgccgccgucgccuucggcgccgaggucggcguccgccucgcccucuucgccgccuuccucgucaccgagcuccucccccccuuccagcgccucauccagcccgaggagauguggcucuaccgcaaccccuacgucgaggccgaguacuuccccaccaagcccauguucgucaucgccuuccucuccccccucucccucaucuuccucgccaaguuccucaagaaggccgacacccgcgacucccgccaggccugccucgccgccucccucgcccucgcccucaacggcgucuucaccaacaccaucaagcucaucgucggccgcccccgccccgacuucuucuaccgcugcuuccccgacggccucgcccacuccgaccucaugugcaccggcgacaaggacgucgucaacgagggccgcaaguccuuccccuccggccacuccuccuucgccuucgccggccucgccuucgccuccuucuaccucgccggcaagcuccacugcuucaccccccagggccgcggcaaguccuggcgcuucugcgccuuccucuccccccuccucuucgccgccgucaucgcccucucccgcaccugcgacuacaagcaccacuggcaggacguccucgucggcuccaugaucggcaugaccuucgccuacgucugcuaccgccaguacuaccccccccucaccgacgccgagugccacaagcccuuccaggacaagcucguccucuccaccgcccagaagcccggcgacuccuacugcuucgacaucuga

SEQ ID NO: 47951 - RNA, 888 nt, Artificial Sequence
  derived and/or modified sequence opt2 from PPAPDC2__Homo_sapiens__NP_982278
augcccuccccccgccgcuccauggagggccgcccccucggcgucuccgccuccuccuccuccuccucccccggcucccccgcccacggcggcggcggcggcggcucccgcuucgaguuccagucccuccucuccucccgcgccaccgccgucgaccccaccugcgcccgccuccgcgccuccgagucccccguccaccgccgcggcuccuucccccucgccgccgccggccccucccagucccccgcccccccccuccccgaggaggaccgcauggaccucaaccccuccuuccucggcaucgcccuccgcucccuccucgccaucgaccucuggcucuccaagaagcucggcgucugcgccggcgaguccuccuccuggggcuccguccgcccccucaugaagcuccucgagaucuccggccacggcauccccuggcuccucggcacccucuacugccucugccgcuccgacuccugggccggccgcgagguccucaugaaccuccucuucgcccuccuccucgaccuccuccucgucgcccucaucaagggccucguccgccgccgccgccccgcccacaaccagauggacauguucgucacccucuccgucgacaaguacuccuuccccuccggccacgccacccgcgccgcccucaugucccgcuucauccucaaccaccucguccucgccaucccccuccgcguccucgucguccucugggccuucguccucggccucucccgcgucaugcucggccgccacaacgucaccgacgucgccuucggcuucuuccucggcuacaugcaguacuccaucgucgacuacugcuggcucuccccccacaacgcccccguccucuuccuccucuggucccagcgcuga

SEQ ID NO: 47952 - RNA, 816 nt, Artificial Sequence
  derived and/or modified sequence opt2 from PPAPDC3__Homo_sapiens__NP_116117
augcccgccucccagucccgcgcccgcgcccgcgaccgcaacaacguccucaaccgcgccgaguuccucucccucaaccagccccccaagggcggccccgagccccgcuccuccggccgcaaggccuccggccccuccgcccagcccccccccgccggcgacggcgcccgcgagcgccgccagucccagcagcuccccgaggaggacugcaugcagcucaaccccuccuucaagggcaucgccuucaacucccuccucgccaucgacaucugcauguccaagcgccucggcgucugcgccggccgcgccgccuccugggccuccgcccgcuccauggucaagcucaucggcaucaccggccacggcauccccuggaucggcggcaccauccucugccucgucaaguccuccacccucgccggccaggagguccucaugaaccuccuccucgcccuccuccucgacaucaugaccgucgccggcguccagaagcucaucaagcgccgcggccccuacgagaccucccccucccuccucgacuaccucaccauggacaucuacgccuuccccgccggccacgccucccgcgccgccauggucuccaaguucuuccucucccaccucguccucgccgucccccuccgcguccuccucguccucugggcccucugcgucggccucucccgcgucaugaucggccgccaccacgucaccgacguccucuccggcuucgucaucggcuaccuccaguuccgccucgucgagcucgucuggaugcccuccuccaccugccagaugcucaucuccgccugguga

SEQ ID NO: 47953 - RNA, 1407 nt, Artificial Sequence
  derived and/or modified sequence opt2 from PPARA__Homo_sapiens__XP_011528545
auggucgacaccgaguccccccucugcccccucuccccccucgaggccggcgaccucgaguccccccucuccgaggaguuccuccaggagaugggcaacauccaggagaucucccaguccaucggcgaggacuccuccggcuccuucggcuucaccgaguaccaguaccucggcuccugccccggcuccgacggcuccgucaucaccgacacccucucccccgccuccucccccuccuccgucaccuaccccgucguccccggcuccgucgacgagucccccuccggcgcccucaacaucgagugccgcaucugcggcgacaaggccuccggcuaccacuacggcguccacgccugcgagggcugcaagggcuucuuccgccgcaccauccgccucaagcucgucuacgacaagugcgaccgcuccugcaagauccagaagaagaaccgcaacaagugccaguacugccgcuuccacaagugccucuccgucggcaugucccacaacgccauccgcuucggccgcaugccccgcuccgagaaggccaagcucaaggccgagauccucaccugcgagcacgacaucgaggacuccgagaccgccgaccucaagucccucgccaagcgcaucuacgaggccuaccucaagaacuucaacaugaacaaggucaaggcccgcgucauccucuccggcaaggccuccaacaacccccccuucgucauccacgacauggagacccucugcauggccgagaagacccucgucgccaagcucgucgccaacggcauccagaacaaggaggccgagguccgcaucuuccacugcugccagugcaccuccgucgagaccgucaccgagcucaccgaguucgccaaggccauccccggcuucgccaaccucgaccucaacgaccaggucacccuccucaaguacggcgucuacgaggccaucuucgccaugcucuccuccgucaugaacaaggacggcaugcucgucgccuacggcaacggcuucaucacccgcgaguuccucaagucccuccgcaagcccuucugcgacaucauggagcccaaguucgacuucgccaugaaguucaacgcccucgagcucgacgacuccgacaucucccucuucgucgccgccaucaucugcugcggcgaccgccccggccuccucaacgucggccacaucgagaagaugcaggagggcaucguccacguccuccgccuccaccuccaguccaaccaccccgacgacaucuuccucuuccccaagcuccuccagaagauggccgaccuccgccagcucgucaccgagcacgcccagcucguccagaucaucaagaagaccgaguccgacgccgcccuccacccccuccuccaggagaucuaccgcgacauguacuga

SEQ ID NO: 47954 - RNA, 1209 nt, Artificial Sequence
  derived and/or modified sequence opt2 from PPARD__Homo_sapiens__NP_001165290
augcaccagcgcgaccucucccgcuccuccuccccccccucccuccucgaccagcuccagaugggcugcgacggcgccuccugcggcucccucaacauggagugccgcgucugcggcgacaaggccuccggcuuccacuacggcguccacgccugcgagggcugcaagggcuucuuccgccgcaccauccgcaugaagcucgaguacgagaagugcgagcgcuccugcaagauccagaagaagaaccgcaacaagugccaguacugccgcuuccagaagugccucgcccucggcaugucccacaacgccauccgcuucggccgcaugcccgaggccgagaagcgcaagcucgucgccggccucaccgccaacgagggcucccaguacaacccccaggucgccgaccucaaggccuucuccaagcacaucuacaacgccuaccucaagaacuucaacaugaccaagaagaaggcccgcuccauccucaccggcaaggccucccacaccgcccccuucgucauccacgacaucgagacccucuggcaggccgagaagggccucgucuggaagcagcucgucaacggccucccccccuacaaggagaucuccguccacgucuucuaccgcugccagugcaccaccgucgagaccguccgcgagcucaccgaguucgccaaguccauccccuccuucuccucccucuuccucaacgaccaggucacccuccucaaguacggcguccacgaggccaucuucgccaugcucgccuccaucgucaacaaggacggccuccucgucgccaacggcuccggcuucgucacccgcgaguuccuccgcucccuccgcaagcccuucuccgacaucaucgagcccaaguucgaguucgccgucaaguucaacgcccucgagcucgacgacuccgaccucgcccucuucaucgccgccaucauccucugcggcgaccgccccggccucaugaacgucccccgcgucgaggccauccaggacaccauccuccgcgcccucgaguuccaccuccaggccaaccaccccgacgcccaguaccucuuccccaagcuccuccagaagauggccgaccuccgccagcucgucaccgagcacgcccagaugaugcagcgcaucaagaagaccgagaccgagaccucccuccacccccuccuccaggagaucuacaaggacauguacuga

SEQ ID NO: 47955 - RNA, 2397 nt, Artificial Sequence
  derived and/or modified sequence opt2 from PPARGC1A__Homo_sapiens__NP_037393
auggccugggacaugugcaaccaggacuccgaguccgucugguccgacaucgagugcgccgcccucgucggcgaggaccagccccucugccccgaccuccccgagcucgaccucuccgagcucgacgucaacgaccucgacaccgacuccuuccucggcggccucaaguggugcuccgaccaguccgagaucaucuccaaccaguacaacaacgagcccuccaacaucuucgagaagaucgacgaggagaacgaggccaaccuccucgccguccucaccgagacccucgacucccuccccgucgacgaggacggccuccccuccuucgacgcccucaccgacggcgacgucaccaccgacaacgaggccucccccuccuccaugcccgacggcaccccccccccccaggaggccgaggagcccucccuccucaagaagcuccuccucgcccccgccaacacccagcucuccuacaacgagugcuccggccucuccacccagaaccacgccaaccacaaccaccgcauccgcaccaaccccgccaucgucaagaccgagaacuccugguccaacaaggccaaguccaucugccagcagcagaagccccagcgccgccccugcuccgagcuccucaaguaccucaccaccaacgacgaccccccccacaccaagcccaccgagaaccgcaacuccucccgcgacaagugcaccuccaagaagaagucccacacccagucccagucccagcaccuccaggccaagcccaccacccucucccucccccucacccccgagucccccaacgaccccaagggcucccccuucgagaacaagaccaucgagcgcacccucuccgucgagcucuccggcaccgccggccucaccccccccaccacccccccccacaaggccaaccaggacaaccccuuccgcgccucccccaagcucaaguccuccugcaagaccgucguccccccccccuccaagaagccccgcuacuccgaguccuccggcacccagggcaacaacuccaccaagaagggccccgagcaguccgagcucuacgcccagcucuccaaguccuccguccucaccggcggccacgaggagcgcaagaccaagcgccccucccuccgccucuucggcgaccacgacuacugccaguccaucaacuccaagaccgagauccucaucaacaucucccaggagcuccaggacucccgccagcucgagaacaaggacgucuccuccgacuggcagggccagaucugcuccuccaccgacuccgaccagugcuaccuccgcgagacccucgaggccuccaagcaggucucccccugcuccacccgcaagcagcuccaggaccaggagauccgcgccgagcucaacaagcacuucggccaccccucccaggccgucuucgacgacgaggccgacaagaccggcgagcuccgcgacuccgacuucuccaacgagcaguucuccaagcuccccauguucaucaacuccggccucgccauggacggccucuucgacgacuccgaggacgaguccgacaagcucuccuaccccugggacggcacccaguccuacucccucuucaacgucucccccuccugcuccuccuucaacucccccugccgcgacuccgucuccccccccaagucccucuucucccagcgcccccagcgcaugcgcucccgcucccgcuccuucucccgccaccgcuccugcucccgcucccccuacucccgcucccgcucccgcucccccggcucccgcuccuccucccgcuccugcuacuacuacgaguccucccacuaccgccaccgcacccaccgcaacuccccccucuacguccgcucccgcucccgcucccccuacucccgccgcccccgcuacgacuccuacgaggaguaccagcacgagcgccucaagcgcgaggaguaccgccgcgaguacgagaagcgcgaguccgagcgcgccaagcagcgcgagcgccagcgccagaaggccaucgaggagcgccgcgucaucuacgucggcaagauccgccccgacaccacccgcaccgagcuccgcgaccgcuucgaggucuucggcgagaucgaggagugcaccgucaaccuccgcgacgacggcgacuccuacggcuucaucaccuaccgcuacaccugcgacgccuucgccgcccucgagaacggcuacacccuccgccgcuccaacgagaccgacuucgagcucuacuucugcggccgcaagcaguucuucaaguccaacuacgccgaccucgacuccaacuccgacgacuucgaccccgccuccaccaaguccaaguacgacucccucgacuucgacucccuccucaaggaggcccagcgcucccuccgccgcuga

SEQ ID NO: 47956 - RNA, 2955 nt, Artificial Sequence
  derived and/or modified sequence opt2 from PPARGC1B__Homo_sapiens__NP_001166169
auggccggcaacgacugcggcgcccuccucgacgaggagcucuccuccuucuuccucaacuaccucgccgacacccagggcggcggcuccggcgaggagcagcucuacgccgacuuccccgagcucgaccucucccagcucgacgccuccgacuucgacuccgccaccugcuucggcgagcuccaguggugccccgagaacuccgagaccgagcccaaccaguacucccccgacgacuccgagcucuuccagaucgacuccgagaacgaggcccuccucgccgagcucaccaagacccucgacgacauccccgaggacgacgucggccucgccgccuuccccgcccucgacggcggcgacgcccucuccugcaccuccgccucccccgcccccuccuccgccccccccucccccgcccccgagaagcccuccgcccccgcccccgaggucgacgagcucucccucgccgacuccacccaggacaagaaggcccccaugaugcagucccagucccgcuccugcaccgagcuccacaagcaccucaccuccgcccagugcugccuccaggaccgcggccuccagccccccugccuccaguccccccgccuccccgccaaggaggacaaggagcccggcgaggacugccccuccccccagcccgcccccgccuccccccgcgacucccucgcccucggccgcgccgaccccggcgcccccgucucccaggaggacaugcaggccaugguccagcucauccgcuacaugcacaccuacugccucccccagcgcaagcuccccccccagacccccgagccccuccccaaggccugcuccaaccccucccagcagguccgcucccgccccuggucccgccaccacuccaaggccuccugggccgaguucuccauccuccgcgagcuccucgcccaggacguccucugcgacgucuccaagcccuaccgccucgccacccccgucuacgccucccucaccccccgcucccgcccccgcccccccaaggacucccaggccucccccggccgccccuccuccgucgaggagguccgcaucgccgccucccccaaguccaccggcccccgccccucccuccgcccccuccgccucgaggucaagcgcgagguccgccgccccgcccgccuccagcagcaggaggaggaggacgaggaggaggaggaggaggaggaggaggaggagaaggaggaggaggaggaguggggccgcaagcgccccggccgcggccuccccuggaccaagcucggccgcaagcucgaguccuccgucugccccguccgccgcucccgccgccucaaccccgagcucggccccuggcucaccuucgccgacgagccccucguccccuccgagccccagggcgcccuccccucccucugccucgcccccaaggccuacgacgucgagcgcgagcucggcucccccaccgacgaggacuccggccaggaccagcagcuccuccgcggcccccagauccccgcccucgagucccccugcgaguccggcugcggcgacauggacgaggaccccuccugcccccagcuccccccccgcgacuccccccgcugccucaugcucgcccucucccaguccgaccccaccuucggcaagaaguccuucgagcagacccucaccgucgagcucugcggcaccgccggccucaccccccccaccaccccccccuacaagcccaccgaggaggaccccuucaagcccgacaucaagcacucccucggcaaggagaucgcccucucccuccccucccccgagggccucucccucaaggccacccccggcgccgcccacaagcuccccaagaagcaccccgagcgcuccgagcuccucucccaccuccgccacgccaccgcccagcccgccucccaggccggccagaagcgccccuucuccugcuccuucggcgaccacgacuacugccagguccuccgccccgagggcguccuccagcgcaagguccuccgcuccugggagcccuccggcguccaccucgaggacuggccccagcagggcgcccccugggccgaggcccaggcccccggccgcgaggaggaccgcuccugcgacgccggcgccccccccaaggacuccacccuccuccgcgaccacgagauccgcgccucccucaccaagcacuucggccuccucgagaccgcccucgaggaggaggaccucgccuccugcaagucccccgaguacgacaccgucuucgaggacuccuccuccuccuccggcgaguccuccuuccuccccgaggaggaggaggaggagggcgaggaggaggaggaggacgacgaggaggaggacuccggcgucucccccaccugcuccgaccacugccccuaccaguccccccccuccaaggccaaccgccagcucugcucccgcucccgcuccuccuccggcuccucccccugccacuccuggucccccgccacccgccgcaacuuccgcugcgagucccgcggccccugcuccgaccgcacccccuccauccgccacgcccgcaagcgccgcgagaaggccaucggcgagggccgcgucgucuacauccagaaccucuccuccgacauguccucccgcgagcucaagcgccgcuucgaggucuucggcgagaucgaggagugcgagguccucacccgcaaccgccgcggcgagaaguacggcuucaucaccuaccgcugcuccgagcacgccgcccucucccucaccaagggcgccgcccuccgcaagcgcaacgagcccuccuuccagcucuccuacggcggccuccgccacuucugcuggccccgcuacaccgacuacgacuccaacuccgaggaggcccuccccgccuccggcaaguccaaguacgaggccauggacuucgacucccuccucaaggaggcccagcagucccuccacuga

SEQ ID NO: 47957 - RNA, 1434 nt, Artificial Sequence
  derived and/or modified sequence opt2 from PPARG__Homo_sapiens__NP_005028
augaccauggucgacaccgagaugcccuucuggcccaccaacuucggcaucuccuccgucgaccucuccgucauggaggaccacucccacuccuucgacaucaagcccuucaccaccgucgacuucuccuccaucuccaccccccacuacgaggacauccccuucacccgcaccgaccccgucgucgccgacuacaaguacgaccucaagcuccaggaguaccaguccgccaucaaggucgagcccgccuccccccccuacuacuccgagaagacccagcucuacaacaagccccacgaggagcccuccaacucccucauggccaucgagugccgcgucugcggcgacaaggccuccggcuuccacuacggcguccacgccugcgagggcugcaagggcuucuuccgccgcaccauccgccucaagcucaucuacgaccgcugcgaccucaacugccgcauccacaagaagucccgcaacaagugccaguacugccgcuuccagaagugccucgccgucggcaugucccacaacgccauccgcuucggccgcaugccccaggccgagaaggagaagcuccucgccgagaucuccuccgacaucgaccagcucaaccccgaguccgccgaccuccgcgcccucgccaagcaccucuacgacuccuacaucaaguccuucccccucaccaaggccaaggcccgcgccauccucaccggcaagaccaccgacaagucccccuucgucaucuacgacaugaacucccucaugaugggcgaggacaagaucaaguucaagcacaucaccccccuccaggagcaguccaaggaggucgccauccgcaucuuccagggcugccaguuccgcuccgucgaggccguccaggagaucaccgaguacgccaaguccauccccggcuucgucaaccucgaccucaacgaccaggucacccuccucaaguacggcguccacgagaucaucuacaccaugcucgccucccucaugaacaaggacggcguccucaucuccgagggccagggcuucaugacccgcgaguuccucaagucccuccgcaagcccuucggcgacuucauggagcccaaguucgaguucgccgucaaguucaacgcccucgagcucgacgacuccgaccucgccaucuucaucgccgucaucauccucuccggcgaccgccccggccuccucaacgucaagcccaucgaggacauccaggacaaccuccuccaggcccucgagcuccagcucaagcucaaccaccccgaguccucccagcucuucgccaagcuccuccagaagaugaccgaccuccgccagaucgucaccgagcacguccagcuccuccaggucaucaagaagaccgagaccgacaugucccuccacccccuccuccaggagaucuacaaggaccucuacuga

SEQ ID NO: 47958 - RNA, 1554 nt, Artificial Sequence
  derived and/or modified sequence opt2 from PPAT__Homo_sapiens__NP_002694
auggagcucgaggagcucggcauccgcgaggagugcggcgucuucggcugcaucgccuccggcgaguggcccacccagcucgacgucccccacgucaucacccucggccucgucggccuccagcaccgcggccaggaguccgccggcaucgucaccuccgacggcuccuccguccccaccuucaagucccacaagggcaugggccucgucaaccacgucuucaccgaggacaaccucaagaagcucuacgucuccaaccucggcaucggccacacccgcuacgccaccaccggcaagugcgagcucgagaacugccagcccuucgucgucgagacccuccacggcaagaucgccgucgcccacaacggcgagcucgucaacgccgcccgccuccgcaagaagcuccuccgccacggcaucggccucuccaccuccuccgacuccgagaugaucacccagcuccucgccuacacccccccccaggagcaggacgacacccccgacugggucgcccgcaucaagaaccucaugaaggaggcccccaccgccuacucccuccucaucaugcaccgcgacgucaucuacgccguccgcgaccccuacggcaaccgcccccucugcaucggccgccucauccccgucuccgacaucaacgacaaggagaagaagaccuccgagaccgagggcugggucgucuccuccgaguccugcuccuuccucuccaucggcgcccgcuacuaccgcgagguccuccccggcgagaucgucgagaucucccgccacaacguccagacccucgacaucaucucccgcuccgagggcaaccccgucgccuucugcaucuucgaguacgucuacuucgcccgccccgacuccauguucgaggaccagauggucuacaccguccgcuaccgcugcggccagcagcucgccaucgaggcccccgucgacgccgaccucgucuccaccguccccgaguccgccacccccgccgcccucgccuacgccggcaagugcggccuccccuacgucgagguccucugcaagaaccgcuacgucggccgcaccuucauccagcccaacaugcgccuccgccagcucggcgucgccaagaaguucggcguccucuccgacaacuucaagggcaagcgcaucguccucgucgacgacuccaucguccgcggcaacaccaucucccccaucaucaagcuccucaaggaguccggcgccaaggagguccacauccgcgucgccuccccccccaucaaguaccccugcuucaugggcaucaacauccccaccaaggaggagcucaucgccaacaagcccgaguucgaccaccucgccgaguaccucggcgccaacuccgucgucuaccucuccgucgagggccucgucuccuccguccaggagggcaucaaguucaagaagcagaaggagaagaagcacgacaucaugauccaggagaacggcaacggccucgagugcuucgagaaguccggccacugcaccgccugccucaccggcaaguaccccgucgagcucgagugguga

SEQ ID NO: 47959 - RNA, 387 nt, Artificial Sequence
  derived and/or modified sequence opt2 from PPBP__Homo_sapiens__NP_002695
augucccuccgccucgacaccacccccuccugcaacuccgcccgcccccuccacgcccuccagguccuccuccuccucucccuccuccucaccgcccucgccuccuccaccaagggccagaccaagcgcaaccucgccaagggcaaggaggagucccucgacuccgaccucuacgccgagcuccgcugcaugugcaucaagaccaccuccggcauccaccccaagaacauccagucccucgaggucaucggcaagggcacccacugcaaccaggucgaggucaucgccacccucaaggacggccgcaagaucugccucgaccccgacgccccccgcaucaagaagaucguccagaagaagcucgccggcgacgaguccgccgacuga

SEQ ID NO: 47960 - RNA, 246 nt, Artificial Sequence
  derived and/or modified sequence opt2 from PPCDC__Homo_sapiens__NP_001288034
augcgcgccugggaccgcuccaagccccuccucuucugccccgccaugaacaccgccaugugggagcaccccaucaccgcccagcaggucgaccagcucaaggccuucggcuacgucgagauccccugcgucgccaagaagcucgucugcggcgacgagggccucggcgccauggccgaggucggcaccaucgucgacaaggucaaggagguccucuuccagcacuccggcuuccagcaguccuga

SEQ ID NO: 47961 - RNA, 1776 nt, Artificial Sequence
  derived and/or modified sequence opt2 from PPEF1__Homo_sapiens__NP_689412
augggcugcuccuccuccuccaccaagacccgccgcuccgacaccucccuccgcgccgcccucaucauccagaacugguaccgcggcuacaaggcccgccucaaggcccgccagcacuacgcccucaccaucuuccaguccaucgaguacgccgacgagcagggccagaugcagcucuccaccuucuucuccuucaugcucgagaacuacacccacauccacaaggaggagcucgagcuccgcaaccagucccucgaguccgagcaggacaugcgcgaccgcugggacuacgucgacuccaucgacguccccgacuccuacaacggcccccgccuccaguucccccucaccugcaccgacaucgaccuccuccucgaggccuucaaggagcagcagauccuccacgcccacuacguccucgagguccucuucgagaccaagaagguccucaagcagaugcccaacuucacccacauccagaccucccccuccaaggaggucaccaucugcggcgaccuccacggcaagcucgacgaccucuuccucaucuucuacaagaacggccuccccuccgagcgcaaccccuacgucuucaacggcgacuucgucgaccgcggcaagaacuccaucgagauccucaugauccucugcgucuccuuccucgucuaccccaacgaccuccaccucaaccgcggcaaccacgaggacuucaugaugaaccuccgcuacggcuucaccaaggagauccuccacaaguacaagcuccacggcaagcgcauccuccagauccucgaggaguucuacgccuggcuccccaucggcaccaucgucgacaacgagauccucgucauccacggcggcaucuccgagaccaccgaccucaaccuccuccaccgcgucgagcgcaacaagaugaaguccguccucaucccccccaccgagaccaaccgcgaccacgacaccgacuccaagcacaacaaggucggcgucaccuucaacgcccacggccgcaucaagaccaacggcucccccaccgagcaccucaccgagcacgagugggagcaggucgucaccaucuucuccgccuccaacuacuacgaggagggcuccaaccgcggcgccuacaucaagcucugcuccggcaccaccccccgcuucuuccaguaccaggucaccaaggccaccugcuuccagccccuccgccagcgcgucgacaccauggagaacuccgccaucaagauccuccgcgagcgcgucaucucccgcaaguccgaccucacccgcgccuuccagcuccaggaccaccgcaaguccggcaagcucuccgucucccagugggccuucugcauggagaacauccucggccucaaccuccccuggcgcucccucuccuccaaccucgucaacaucgaccagaacggcaacgucgaguacauguccuccuuccagaacauccgcaucgagaagcccguccaggaggcccacuccacccucgucgagacccucuaccgcuaccgcuccgaccucgagaucaucuucaacgccaucgacaccgaccacuccggccucaucuccgucgaggaguuccgcgccauguggaagcucuucuccucccacuacaacguccacaucgacgacucccaggucaacaagcucgccaacaucauggaccucaacaaggacggcuccaucgacuucaacgaguuccucaaggccuucuacgucguccaccgcuacgaggaccucaugaagcccgacgucaccaaccucggcuga

SEQ ID NO: 47962 - RNA, 2262 nt, Artificial Sequence
  derived and/or modified sequence opt2 from PPEF2__Homo_sapiens__XP_011530341
augggcuccggcaccuccacccagcaccacuucgccuuccagaacgccgagcgcgccuucaaggccgccgcccucauccagcgcugguaccgccgcuacgucgcccgccucgagaugcgccgccgcugcaccugguccaucuuccaguccaucgaguacgccggccagcaggaccaggucaagcuccacgacuucuucuccuaccucauggaccacuucauccccuccucccacaacgaccgcgacuuccucacccgcaucuucaccgaggaccgcuucgcccaggacuccgagaugaagaagugcuccgacuacgaguccaucgagguccccgacuccuacaccggcccccgccucuccuucccccuccuccccgaccacgccaccgcccucgucgaggccuuccgccucaagcagcagcuccacgcccgcuacguccucaaccuccucuacgagaccaagaagcaccucguccagcuccccaacaucaaccgcgucuccaccugcuacuccgaggagaucaccgucugcggcgaccuccacggccagcucgacgaccucaucuucaucuucuacaagaacggccuccccucccccgagcgcuccuacgucuucaacggcgacuucgucgaccgcggcaaggacuccgucgagauccucaugauccucuucgccuucaugcucgucuaccccaaggaguuccaccucaaccgcggcaaccacgaggaccacauggucaaccuccgcuacggcuucaccaaggaggucaugaacaaguacaagguccacggcaaggagauccuccgcacccuccaggacgucuucugcuggcucccccucgccacccucaucgacgagaagguccucauccuccacggcggcgucuccgacaucaccgaccucgagcuccucgacaagaucgagcgcuccaagaucgucuccaccaugcgcugcaagacccgccagaaguccgagaagcagauggaggagaagcgccgcgccaaccagaaguccuccgcccagggccccauccccugguuccuccccgagucccgcucccuccccuccuccccccuccgccucggcuccuacaaggcccagaagaccucccgcuccuccuccauccccugcuccggcucccucgacggccgcgagcucucccgccagguccgcuccuccgucgagcucgagcucgagcgcugccgccagcaggccggccuccucgucaccggcgagaaggaggagcccucccgcuccgccuccgaggccgacuccgaggccggcgagcuccgcaagcccacccaggaggaguggcgccaggucgucgacauccucugguccgaccccauggcccaggagggcugcaaggccaacaccauccgcggcggcggcugcuacuucggccccgacgucacccagcagcuccuccagaaguacaacaugcaguuccucauccgcucccacgagugcaagcccgagggcuacgaguucugccacaaccgcaagguccucaccaucuucuccgccuccaacuacuacgaggucggcuccaaccgcggcgccuacgucaagcucggccccgcccucaccccccacaucguccaguaccaggccaacaaggucacccacacccucaccaugcgccagcgcaucucccgcgucgaggaguccgcccuccgcgcccuccgcgagaagcucuucgcccacuccuccgaccuccucuccgaguucaagaagcacgacgccgacaaggucggccucaucacccucuccgacugggccgccgccgucgaguccguccuccaccucggccuccccuggcgcaugcuccgcccccagcucgucaacuccuccgccgacaacaugcucgaguacaaguccuggcucaagaaccucgccaaggagcagcucucccgcgagaacauccaguccucccuccucgagacccucuaccgcaaccgcuccaaccucgagaccaucuuccgcaucaucgacuccgaccacuccggcuucaucucccucgacgaguuccgccagaccuggaagcucuucuccucccacaugaacaucgacaucaccgacgacugcaucugcgaccucgcccgcuccaucgacuucaacaaggacggccacaucgacaucaacgaguuccucgaggccuuccgccucgucgagaaguccugccccgagggcgacgccuccgagugcccccaggccaccaacgccaaggacuccggcugcuccucccccggcgcccacuga

SEQ ID NO: 47963 - RNA, 3609 nt, Artificial Sequence
  derived and/or modified sequence opt2 from PPFIA1__Homo_sapiens__NP_003617
augaugugcgaggucaugcccaccaucuccgaggccgagggcccccccggcggcggcggcggccacggcuccggcucccccucccagcccgacgccgacucccacuucgagcagcucauggucuccaugcucgaggagcgcgaccgccuccucgacacccuccgcgagacccaggagacccucgcccucacccagggcaagcuccacgaggucggccacgagcgcgacucccuccagcgccagcucaacaccgcccucccccaggaguucgccgcccucaccaaggagcucaacgucugccgcgagcagcuccucgagcgcgaggaggagaucgccgagcucaaggccgagcgcaacaacacccgccuccuccucgagcaccucgagugccucgucucccgccacgagcgcucccuccgcaugaccgucgucaagcgccaggcccagucccccgccggcgucuccuccgaggucgagguccucaaggcccucaagucccucuucgagcaccacaaggcccucgacgagaagguccgcgagcgccuccgcgucgcccucgagcgcugcucccuccucgaggaggagcucggcgccacccacaaggagcucaugauccucaaggagcagaacaaccagaagaagacccucaccgacggcguccucgacaucaaccacgagcaggagaacacccccuccaccuccggcaagcgcuccuccgacggcucccucucccacgaggaggaccucgccaaggucaucgagcuccaggagaucaucuccaagcagucccgcgagcagucccagaugaaggagcgccucgccucccucuccucccacgucaccgagcucgaggaggaccucgacaccgcccgcaaggaccucaucaaguccgaggagaugaacaccaagcuccagcgcgacguccgcgaggccauggcccagaaggaggacauggaggagcgcaucaccacccucgagaagcgcuaccucgccgcccagcgcgaggccaccuccguccacgaccucaacgacaagcucgagaacgagaucgccaacaaggacuccaugcaccgccagaccgaggacaagaaccgccagcuccaggagcgccucgagcucgccgagcagaagcuccagcagacccuccgcaaggccgagacccuccccgaggucgaggccgagcucgcccagcgcgucgccgcccucuccaaggccgaggagcgccacggcaacaucgaggagcgccuccgccagauggaggcccagcucgaggagaagaaccaggagcuccagcgcgcccgccagcgcgagaagaugaacgaggagcacaacaagcgccucuccgacaccgucgacaagcuccucuccgaguccaacgagcgccuccagcuccaccucaaggagcgcauggccgcccucgaggacaagaacucccuccuccgcgaggucgaguccgccaagaagcagcucgaggagacccagcacgacaaggaccagcucguccucaacaucgaggcccuccgcgccgagcucgaccacaugcgccuccgcggcgccucccuccaccacggccgcccccaccucggcuccguccccgacuuccgcuuccccauggccgacggccacaccgacuccuacuccaccuccgccguccuccgccgcccccagaagggccgccucgccgcccuccgcgacgagcccuccaagguccagacccucaacgagcaggacugggagcgcgcccagcaggccuccguccucgccaacgucgcccaggccuucgaguccgacgccgacgucuccgacggcgaggacgaccgcgacacccuccucuccuccgucgaccuccucucccccuccggccaggccgacgcccacacccucgccaugaugcuccaggagcagcucgacgccaucaacaaggagauccgccucauccaggaggagaaggagaacaccgagcagcgcgccgaggagaucgagucccgcgucggcuccggcucccucgacaaccucggccgcuuccgcuccauguccuccaucccccccuaccccgccuccucccucgccuccuccuccccccccggcuccggccgcuccaccccccgccgcaucccccacucccccgcccgcgaggucgaccgccucggcgucaugacccuccucccccccucccgcgaggagguccgcgacgacaagaccaccaucaagugcgagaccuccccccccuccuccccccgcgcccuccgccucgaccgccuccacaagggcgcccuccacaccgucucccacgaggacauccgcgacauccgcaacuccaccggcucccaggacggccccgucuccaaccccuccuccuccaacuccucccaggacucccuccacaaggcccccaagaagaagggcaucaaguccuccaucggccgccucuucggcaagaaggagaagggccgccccggccagaccggcaaggaggcccucggccaggccggcgucuccgagaccgacaacuccucccaggacgcccucggccucuccaagcucggcggccaggccgagaagaaccgcaagcuccagaagaagcacgagcuccucgaggaggcccgccgccagggccuccccuucgcccagugggacggccccaccgucgucgucuggcucgagcucugggucggcaugcccgccugguacgucgccgccugccgcgccaacgucaaguccggcgccaucauguccgcccucuccgacaccgagauccagcgcgagaucggcaucuccaacccccuccaccgccucaagcuccgccucgccauccaggagaucaugucccucaccucccccuccgccccccccaccucccgcaccacccucgccuacggcgacaugaaccacgaguggaucggcaacgaguggcuccccucccucggccucccccaguaccgcuccuacuucauggagugccucgucgacgcccgcaugcucgaccaccucaccaagaaggaccuccgcggccagcucaagauggucgacuccuuccaccgcaacuccuuccagugcggcaucaugugccuccgccgccucaacuacgaccgcaaggagcucgagcgcaagcgcgaggagucccaguccgagaucaaggacguccucgucugguccaacgaccgcgucauccgcuggauccucuccaucggccucaaggaguacgccaacaaccucaucgaguccggcguccacggcgcccuccucgcccucgacgagaccuucgacuucuccgcccucgcccuccuccuccagauccccacccagaacacccaggcccgcgccguccucgagcgcgaguucaacaaccuccucgucaugggcaccgaccgccgcuucgacgaggacgacgacaaguccuuccgccgcgcccccuccuggcgcaagaaguuccgccccaaggacauccgcggccucgccgccggcuccgccgagacccuccccgccaacuuccgcgucaccuccuccauguccucccccuccaugcagcccaagaagaugcagauggacggcaacgucuccggcacccagcgccucgacuccgccaccguccgcaccuacuccugcuga

SEQ ID NO: 47964 - RNA, 3744 nt, Artificial Sequence
  derived and/or modified sequence opt2 from PPFIA2__Homo_sapiens__NP_001207402
augaugugcgaggucaugcccaccaucaacgaggacacccccaugucccagcgcggcucccaguccuccggcuccgacuccgacucccacuucgagcagcucauggucaacaugcucgacgagcgcgaccgccuccucgacacccuccgcgagacccaggagucccucucccucgcccagcagcgccuccaggacgucaucuacgaccgcgacucccuccagcgccagcucaacuccgcccucccccaggacaucgagucccucaccggcggccucgccggcuccaagggcgccgacccccccgaguucgccgcccucaccaaggagcucaacgccugccgcgagcagcuccucgagaaggaggaggagaucuccgagcucaaggccgagcgcaacaacacccgccuccuccucgagcaccucgagugccucgucucccgccacgagcgcucccuccgcaugaccgucgucaagcgccaggcccagucccccuccggcgucuccuccgaggucgagguccucaaggcccucaagucccucuucgagcaccacaaggcccucgacgagaagguccgcgagcgccuccgcgucucccucgagcgcgucuccgcccucgaggaggagcucgccgccgccaaccaggagaucgucgcccuccgcgagcagaacguccacauccagcgcaagauggccuccuccgagggcuccaccgaguccgagcaccucgagggcauggagcccggccagaagguccacgagaagcgccucuccaacggcuccaucgacuccaccgacgagaccucccagaucgucgagcuccaggagcuccucgagaagcagaacuacgagauggcccagaugaaggagcgccucgccgcccucuccucccgcgucggcgaggucgagcaggaggccgagaccgcccgcaaggaccucaucaagaccgaggagaugaacaccaaguaccagcgcgacauccgcgaggccauggcccagaaggaggacauggaggagcgcaucaccacccucgagaagcgcuaccucuccgcccagcgcgaguccaccuccauccacgacaugaacgacaagcucgagaacgagcucgccaacaaggaggccauccuccgccagauggaggagaagaaccgccagcuccaggagcgccucgagcucgccgagcagaagcuccagcagaccaugcgcaaggccgagacccuccccgaggucgaggccgagcucgcccagcgcaucgccgcccucaccaaggccgaggagcgccacggcaacaucgaggagcgcaugcgccaccucgagggccagcucgaggagaagaaccaggagcuccagcgcgcccgccagcgcgagaagaugaacgaggagcacaacaagcgccucuccgacaccgucgaccgccuccucaccgaguccaacgagcgccuccagcuccaccucaaggagcgcauggccgcccucgaggagaagaacguccucauccaggaguccgagaccuuccgcaagaaccucgaggagucccuccacgacaaggagcgccucgccgaggagaucgagaagcuccgcuccgagcucgaccagcucaagaugcgcaccggcucccucaucgagcccaccaucccccgcacccaccucgacaccuccgccgagcuccgcuacuccgucggcucccucgucgacucccaguccgacuaccgcaccaccaaggucauccgccgcccccgccgcggccgcaugggcguccgccgcgacgagcccaaggucaagucccucggcgaccacgaguggaaccgcacccagcagaucggcguccucuccucccaccccuucgaguccgacaccgagauguccgacaucgacgacgacgaccgcgagaccaucuucuccuccauggaccuccucucccccuccggccacuccgacgcccagacccucgccaugaugcuccaggagcagcucgacgccaucaacaaggagauccgccucauccaggaggagaaggaguccaccgagcuccgcgccgaggagaucgagaaccgcgucgccuccgucucccucgagggccucaaccucgcccgcguccaccccggcaccuccaucaccgccuccgucaccgccuccucccucgccuccuccuccccccccuccggccacuccacccccaagcucaccccccgcucccccgcccgcgagauggaccgcaugggcgucaugacccuccccuccgaccuccgcaagcaccgccgcaagaucgccgucgucgaggaggacggccgcgaggacaaggccaccaucaagugcgagaccucccccccccccaccccccgcgcccuccgcaugacccacacccuccccuccuccuaccacaacgacgcccgcuccucccucuccgucucccucgagcccgagucccucggccucggcuccgccaacuccucccaggacucccuccacaaggcccccaagaagaagggcaucaaguccuccaucggccgccucuucggcaagaaggagaaggcccgccucggccagcuccgcggcuucauggagaccgaggccgccgcccaggagucccucggccucggcaagcucggcacccaggccgagaaggaccgccgccucaagaagaagcacgagcuccucgaggaggcccgccgcaagggccuccccuucgcccagugggacggccccaccgucgucgccuggcucgagcucuggcucggcaugcccgccugguacgucgccgccugccgcgccaacgucaaguccggcgccaucauguccgcccucuccgacaccgagauccagcgcgagaucggcaucuccaacccccuccaccgccucaagcuccgccucgccauccaggagauggucucccucaccucccccuccgccccccccaccucccgcacccccuccggcaacgucugggucacccacgaggagauggagaaccucgccgcccccgccaagaccaaggaguccgaggagggcuccugggcccagugccccgucuuccuccagacccucgccuacggcgacaugaaccacgaguggaucggcaacgaguggcuccccucccucggccucccccaguaccgcuccuacuucauggagugccucgucgacgcccgcaugcucgaccaccucaccaagaaggaccuccgcguccaccucaagauggucgacuccuuccaccgcaccucccuccaguacggcaucaugugccucaagcgccucaacuacgaccgcaaggagcucgagcgccgccgcgaggccucccagcacgagaucaaggacguccucgucugguccaacgaccgcgucauccgcuggauccaggccaucggccuccgcgaguacgccaacaacauccucgaguccggcguccacggcucccucaucgcccucgacgagaacuucgacuacuccucccucgcccuccuccuccagauccccacccagaacacccaggcccgccagauccucgagcgcgaguacaacaaccuccucgcccucggcaccgagcgccgccucgacgaguccgacgacaagaacuuccgccgcggcuccaccuggcgccgccaguuccccccccgcgagguccacggcaucuccaugaugcccggcuccuccgagacccuccccgccggcuuccgccucaccaccaccuccggccagucccgcaagaugaccaccgacgacggcgucuucuccgucuacuccaccuga

SEQ ID NO: 47965 - RNA, 3624 nt, Artificial Sequence
  derived and/or modified sequence opt2 from PPFIA4__Homo_sapiens__NP_001291260
augugcgaggucaugcccaccaucaacgagggcgaccgccucggccccccccacggcgccgacgccgacgccaacuucgagcagcucauggucaacaugcucgacgagcgcgagaagcuccucgagucccuccgcgagucccaggagacccucgccgccacccagucccgccuccaggacgccauccacgagcgcgaccagcuccagcgccaccucaacuccgcccucccccaggaguucgccacccucacccgcgagcucuccaugugccgcgagcagcuccucgagcgcgaggaggagaucuccgagcucaaggccgagcgcaacaacacccgccuccuccucgagcaccucgagugccucgucucccgccacgagcgcucccuccgcaugaccgucgucaagcgccaggcccagucccccuccggcgucuccuccgaggucgagguccucaaggcccucaagucccucuucgagcaccacaaggcccucgacgagaagguccgcgagcgccuccgcgccgcccucgagcgcgucaccacccucgaggagcagcucgccggcgcccaccagcaggucuccgcccuccagcagggcgccggcguccgcgacggcgccgccgaggaggagggcaccgucgagcucggccccaagcgccucuggaaggaggacaccggccgcgucgaggagcuccaggagcuccucgagaagcagaacuucgagcucucccaggcccgcgagcgccucgucacccucaccaccaccgucaccgagcucgaggaggaccucggcaccgcccgccgcgaccucaucaaguccgaggagcucuccuccaagcaccagcgcgaccuccgcgaggcccucgcccagaaggaggacauggaggagcgcaucaccacccucgagaagcgcuaccucgccgcccagcgcgaggccaccuccauccacgaccucaacgacaagcucgagaacgagcucgccaacaaggagucccuccaccgccagugcgaggagaaggcccgccaccuccaggagcuccucgaggucgccgagcagaagcuccagcagaccaugcgcaaggccgagacccuccccgaggucgaggccgagcucgcccagcgcaucgccgcccucaccaaggccgaggagcgccacggcaacaucgaggagcaccuccgccagcucgagggccagcucgaggagaagaaccaggagcucgcccgcguccgccagcgcgagaagaugaacgaggaccacaacaagcgccucuccgacaccgucgaccgccuccucuccgaguccaacgagcgccuccagcuccaccucaaggagcgcauggccgcccucgaggagaagaacacccucauccaggagcucgaguccucccagcgccagaucgaggagcagcaccaccacaagggccgccucuccgaggagaucgagaagcuccgccaggaggucgaccagcucaagggccgcggcggccccuucgucgacggcguccacucccgcucccacaugggcuccgccgccgacguccgcuucucccucggcaccaccacccacgccccccccggcguccaccgccgcuacuccgcccuccgcgaggaguccgccaaggacugggagaccuccccccuccccggcaugcucgcccccgccgccggccccgccuucgacuccgaccccgagaucuccgacgucgacgaggacgagcccggcggccucgucggcuccgccgacgucgucucccccuccggccacuccgacgcccagacccucgccaugaugcuccaggagcagcucgacgccaucaacgaggagauccgcaugauccaggaggagaaggaguccaccgagcuccgcgccgaggagaucgagacccgcgucaccuccggcuccauggaggcccucaaccucaagcagcuccgcaagcgcggcuccauccccaccucccucaccgcccucucccucgccuccgccucccccccccucuccggccgcuccacccccaagcucaccucccgcuccgccgcccaggaccucgaccgcaugggcgucaugacccuccccuccgaccuccgcaagcaccgccgcaagcuccucucccccgucucccgcgaggagaaccgcgaggacaaggccaccaucaagugcgagaccuccccccccuccuccccccgcacccuccgccucgagaagcucggccaccccgcccucucccaggaggagggcaaguccgcccucgaggaccagggcuccaaccccuccuccuccaacuccucccaggacucccuccacaagggcgccaagcgcaagggcaucaaguccuccaucggccgccucuucggcaagaaggagaagggccgccucauccagcucucccgcgacggcgccaccggccacguccuccucaccgacuccgaguucuccaugcaggagcccaugguccccgccaagcucggcacccaggccgagaaggaccgccgccucaagaagaagcaccagcuccucgaggacgcccgccgcaagggcaugcccuucgcccagugggacggccccaccgucgucuccuggcucgagcucugggucggcaugcccgccugguacgucgccgccugccgcgccaacgucaaguccggcgccaucauguccgcccucuccgacaccgagauccagcgcgagaucggcaucuccaacgcccuccaccgccucaagcuccgccucgccauccaggagauggucucccucaccucccccuccgccccccccaccucccgcaccuccuccggcaacgucugggucacccacgaggagauggagacccucgagaccuccaccaagaccgacuccgaggagggcuccugggcccagacccucgccuacggcgacaugaaccacgaguggaucggcaacgaguggcuccccucccucggccucccccaguaccgcuccuacuucauggagugccucgucgacgcccgcaugcucgaccaccucaccaagaaggaccuccgcguccaccucaagauggucgacuccuuccaccgcaccucccuccaguacggcaucaugugccucaagcgccucaacuacgaccgcaaggagcucgagaagcgccgcgaggagucccagcacgagaucaaggacguccucgucuggaccaacgaccaggucguccacuggguccaguccaucggccuccgcgacuacgccggcaaccuccacgaguccggcguccacggcgcccuccucgcccucgacgagaacuucgaccacaacacccucgcccucauccuccagauccccacccagaacacccaggcccgccaggucauggagcgcgaguucaacaaccuccucgcccucggcaccgaccgcaagcucgacgacggcgacgacaaggucuuccgccgcgcccccuccuggcgcaagcgcuuccgcccccgcgagcaccacggccgcggcggcaugcucuccgccuccgccgagacccuccccgccggcuuccgcgucuccacccucggcacccuccagcccccccccgccccccccaagaagaucaugcccgaggcccacucccacuaccucuacggccacaugcucuccgccuuccgcgacuga

SEQ ID NO: 47966 - RNA, 2577 nt, Artificial Sequence
  derived and/or modified sequence opt2 from PPFIBP1__Homo_sapiens__NP_001185844
augcuccagcaggagcuccucucccgcaccucccucgagacccagaagcucgaccucauggccgagaucuccaaccucaagcucaagcucaccgccgucgagaaggaccgccucgacuacgaggacaaguuccgcgacaccgagggccucauccaggagaucaacgaccuccgccucaaggucuccgagauggacuccgagcgccuccaguacgagaagaagcucaaguccaccaagucccucauggccaagcucuccuccaugaagaucaaggucggccagaugcaguacgagaagcagcgcauggagcagaagugggagucccucaaggacgagcucgccucccucaaggagcagcucgaggagaaggaguccgaggucaagcgccuccaggagaagcucgucugcaagaugaagggcgagggcgucgagaucgucgaccgcgacaucgagguccagaagaugaagaaggccgucgagucccucauggccgccaacgaggagaaggaccgcaagaucgaggaccuccgccagugccucaaccgcuacaagaagaugcaggacaccgucguccucgcccagggcaaggacggcgaguacgaggagcuccucaacuccuccuccaucuccucccuccucgacgcccagggcuucuccgaccucgagaagucccccucccccacccccgucaugggcucccccuccugcgaccccuucaacaccuccguccccgaggaguuccacaccaccauccuccaggucuccauccccucccuccuccccgccaccgucuccauggagaccuccgagaaguccaagcucacccccaagcccgagaccuccuucgaggagaacgacggcaacaucauccucggcgccaccgucgacacccagcucugcgacaagcuccucaccuccucccuccagaaguccuccucccucggcaaccucaagaaggagaccuccgacggcgagaaggagaccauccagaagaccuccgaggaccgcgcccccgccgagucccgccccuucggcacccuccccccccgcccccccggccaggacaccuccauggacgacaaccccuucggcacccgcaagguccgcuccuccuucggccgcggcuucuucaagaucaaguccaacaagcgcaccgccuccgcccccaaccucgccgagaccgagaaggagaccgccgagcaccucgaccucgccggcgccuccucccgccccaaggacucccagcgcaacucccccuuccagauccccccccccucccccgacuccaagaagaagucccgcggcaucaugaagcucuucggcaagcuccgccgcucccaguccaccaccuucaaccccgacgacauguccgagcccgaguucaagcgcggcggcacccgcgccaccgccggcccccgccucggcuggucccgcgaccucggccaguccaacuccgaccucgacaugcccuucgccaaguggaccaaggagcaggucugcaacuggcucauggagcagggccucggcuccuaccucaacuccggcaagcacuggaucgccuccggccagacccuccuccaggccucccagcaggaccucgagaaggagcucggcaucaagcacucccuccaccgcaagaagcuccagcucgcccuccaggcccucggcuccgaggaggagaccaaccacggcaagcucgacuucaacugggucacccgcuggcucgacgacaucggccucccccaguacaagacccaguucgacgagggccgcgucgacggccgcaugcuccacuacaugaccgucgacgaccuccucucccucaaggucgucuccguccuccaccaccucuccaucaagcgcgccauccagguccuccgcaucaacaacuucgagcccaacugccuccgccgccgccccuccgacgagaacaccaucgcccccuccgagguccagaaguggaccaaccaccgcgucauggaguggcuccgcuccgucgaccucgccgaguacgcccccaaccuccgcggcuccggcguccacggcggccucaugguccucgagccccgcuucaacgucgagaccauggcccagcuccucaacaucccccccaacaagacccuccuccgccgccaccucgccacccacuucaaccuccucaucggcgccgaggcccagcaccagaagcgcgacgccauggagcuccccgacuacguccuccucaccgccaccgccaaggucaagcccaagaagcucgccuucuccaacuucggcaaccuccgcaagaagaagcaggaggacggcgaggaguacgucugccccauggagcucggccaggccuccggcuccgccuccaagaagggcuucaagcccggccucgacaugcgccucuacgaggaggacgaccucgaccgccucgagcagauggaggacuccgagggcaccguccgccagaucggcgccuucuccgagggcaucaacaaccucacccacaugcucaaggaggacgacauguucaaggacuucgccgcccgcucccccuccgccuccaucaccgacgaggacuccaacgucuga

SEQ ID NO: 47967 - RNA, 2295 nt, Artificial Sequence
  derived and/or modified sequence opt2 from PPFIBP2__Homo_sapiens__NP_001243497
auguccuccgagcaguggccccgccuccccggcaaggucuccguccucaccgaccaggucgaggcccagggcgagaagauccgcgaccucgaggucugccucgagggccaccaggucaagcucaacgccgccgaggagaugcuccagcaggagcuccucucccgcaccucccucgagacccagaagcucgaccucaugaccgaggucuccgagcucaagcucaagcucgucggcauggagaaggagcagcgcgagcaggaggagaagcagcgcaaggccgaggagcuccuccaggagcuccgccaccucaagaucaaggucgaggagcucgagaacgagcgcaaccaguacgaguggaagcucaaggccaccaaggccgaggucgcccagcuccaggagcaggucgcccucaaggacgccgagaucgagcgccuccacucccagcucucccgcaccgccgcccuccacuccgagucccacaccgagcgcgaccaggagauccagcgccucaagaugggcauggagacccuccuccucgccaacgaggacaaggaccgccgcaucgaggagcucaccggccuccucaaccaguaccgcaaggucaaggagaucgucauggucacccagggccccuccgagcgcacccucuccaucaacgaggaggagcccgagggcggcuucuccaaguggaacgccaccaacaaggaccccgaggagcucuucaagcaggagaugcccccccgcugcuccucccccaccgucggcccccccccccucccccagaagucccucgagacccgcgcccagaagaagcucuccugcucccucgaggaccuccgcuccgaguccgucgacaagugcauggacggcaaccagcccuuccccguccucgagcccaaggacucccccuuccucgccgagcacaaguaccccacccuccccggcaagcucuccggcgccacccccaacggcgaggccgccaaguccccccccaccaucugccagcccgacgccaccggcuccucccuccuccgccuccgcgacaccgaguccggcugggacgacaccgccgucgucaacgaccucuccuccaccuccuccggcaccgaguccggcccccaguccccccucacccccgacggcaagcgcaaccccaagggcaucaagaaguucuggggcaagauccgccgcacccaguccggcaacuucuacaccgacacccucggcauggccgaguuccgccgcggcggccuccgcgccaccgccggcccccgccucucccgcacccgcgacuccaagggccagaaguccgacgccaacgcccccuucgcccagugguccaccgagcgcgucugcgccuggcucgaggacuucggccucgcccaguacgucaucuucgcccgccagugggucuccuccggccacacccuccucaccgccaccccccaggacauggagaaggagcucggcaucaagcacccccuccaccgcaagaagcucguccucgccgucaaggccaucaacaccaagcaggaggagaaguccgcccuccucgaccacaucugggucacccgcuggcucgacgacaucggccucccccaguacaaggaccaguuccacgagucccgcgucgacggccgcaugcuccaguaccucaccgucaacgaccuccucuuccucaaggucaccucccagcuccaccaccucuccaucaagugcgccauccacguccuccacgucaacaaguucaacccccacugccuccaccgccgccccgccgacgaguccaaccucucccccuccgaggucguccagugguccaaccaccgcgucauggaguggcuccgcuccgucgaccucgccgaguacgcccccaaccuccgcggcuccggcguccacggcggccucaucauccucgagccccgcuucaccggcgacacccucgccaugcuccucaacauccccccccagaagacccuccuccgccgccaccucaccaccaaguucaacgcccucaucggccccgaggccgagcaggagaagcgcgagaagauggccucccccgccuacaccccccucaccaccaccgccaagguccgcccccgcaagcucggcuucucccacuucggcaacauccgcaagaagaaguucgacgaguccaccgacuacaucugccccauggagcccuccgacggcgucuccgacucccaccgcgucuacuccggcuaccgcggccucuccccccucgacgcccccgagcucgacggccucgaccaggucggccagaucuccuga

SEQ ID NO: 47968 - RNA, 318 nt, Artificial Sequence
  derived and/or modified sequence opt2 from PPIA__Homo_sapiens__NP_001287910
augugccagggcggcgacuucacccgccacaacggcaccggcggcaaguccaucuacggcgagaaguucgaggacgagaacuucauccucaagcacaccggccccggcauccucuccauggccaacgccggccccaacaccaacggcucccaguucuucaucugcaccgccaagaccgaguggcucgacggcaagcacgucgucuucggcaaggucaaggagggcaugaacaucgucgaggccauggagcgcuucggcucccgcaacggcaagaccuccaagaagaucaccaucgccgacugcggccagcucgaguga

SEQ ID NO: 47969 - RNA, 651 nt, Artificial Sequence
  derived and/or modified sequence opt2 from PPIB__Homo_sapiens__NP_000933
augcuccgccucuccgagcgcaacaugaagguccuccucgccgccgcccucaucgccggcuccgucuucuuccuccuccuccccggccccuccgccgccgacgagaagaagaagggccccaaggucaccgucaaggucuacuucgaccuccgcaucggcgacgaggacgucggccgcgucaucuucggccucuucggcaagaccguccccaagaccgucgacaacuucgucgcccucgccaccggcgagaagggcuucggcuacaagaacuccaaguuccaccgcgucaucaaggacuucaugauccagggcggcgacuucacccgcggcgacggcaccggcggcaaguccaucuacggcgagcgcuuccccgacgagaacuucaagcucaagcacuacggccccggcugggucuccauggccaacgccggcaaggacaccaacggcucccaguucuucaucaccaccgucaagaccgccuggcucgacggcaagcacgucgucuucggcaagguccucgagggcauggaggucguccgcaaggucgaguccaccaagaccgacucccgcgacaagccccucaaggacgucaucaucgccgacugcggcaagaucgaggucgagaagcccuucgccaucgccaaggaguga

SEQ ID NO: 47970 - RNA, 639 nt, Artificial Sequence
  derived and/or modified sequence opt2 from PPIC__Homo_sapiens__NP_000934
augggccccggcccccgccuccuccucccccucguccucugcgucggccucggcgcccucgucuucuccuccggcgccgagggcuuccgcaagcgcggccccuccgucaccgccaaggucuucuucgacguccgcaucggcgacaaggacgucggccgcaucgucaucggccucuucggcaaggucguccccaagaccgucgagaacuucgucgcccucgccaccggcgagaagggcuacggcuacaagggcuccaaguuccaccgcgucaucaaggacuucaugauccagggcggcgacaucaccaccggcgacggcaccggcggcgucuccaucuacggcgagaccuuccccgacgagaacuucaagcucaagcacuacggcaucggcugggucuccauggccaacgccggccccgacaccaacggcucccaguucuucaucacccucaccaagcccaccuggcucgacggcaagcacgucgucuucggcaaggucaucgacggcaugaccgucguccacuccaucgagcuccaggccaccgacggccacgaccgcccccucaccaacugcuccaucaucaacuccggcaagaucgacgucaagacccccuucgucgucgagaucgccgacugguga

SEQ ID NO: 47971 - RNA, 1113 nt, Artificial Sequence
  derived and/or modified sequence opt2 from PPID__Homo_sapiens__NP_005029
augucccaccccuccccccaggccaagcccuccaaccccuccaacccccgcgucuucuucgacgucgacaucggcggcgagcgcgucggccgcaucguccucgagcucuucgccgacaucguccccaagaccgccgagaacuuccgcgcccucugcaccggcgagaagggcaucggccacaccaccggcaagccccuccacuucaagggcugccccuuccaccgcaucaucaagaaguucaugauccagggcggcgacuucuccaaccagaacggcaccggcggcgaguccaucuacggcgagaaguucgaggacgagaacuuccacuacaagcacgaccgcgagggccuccucuccauggccaacgccggccgcaacaccaacggcucccaguucuucaucaccaccguccccaccccccaccucgacggcaagcacgucgucuucggccaggucaucaagggcaucggcgucgcccgcauccucgagaacgucgaggucaagggcgagaagcccgccaagcucugcgucaucgccgagugcggcgagcucaaggagggcgacgacggcggcaucuuccccaaggacggcuccggcgacucccaccccgacuuccccgaggacgccgacaucgaccucaaggacgucgacaagauccuccucaucaccgaggaccucaagaacaucggcaacaccuucuucaagucccagaacugggagauggccaucaagaaguacgccgagguccuccgcuacgucgacuccuccaaggccgucaucgagaccgccgaccgcgccaagcuccagcccaucgcccucuccugcguccucaacaucggcgccugcaagcucaagauguccaacuggcagggcgccaucgacuccugccucgaggcccucgagcucgaccccuccaacaccaaggcccucuaccgccgcgcccagggcuggcagggccucaaggaguacgaccaggcccucgccgaccucaagaaggcccagggcaucgcccccgaggacaaggccauccaggccgagcuccucaaggucaagcagaagaucaaggcccagaaggacaaggagaaggccgucuacgccaagauguucgccuga

SEQ ID NO: 47972 - RNA, 624 nt, Artificial Sequence
  derived and/or modified sequence opt2 from PPIF__Homo_sapiens__NP_005720
augcucgcccuccgcugcggcucccgcuggcucggccuccucuccgucccccgcuccgucccccuccgccuccccgccgcccgcgccugcuccaagggcuccggcgaccccuccuccuccuccuccuccggcaacccccucgucuaccucgacgucgacgccaacggcaagccccucggccgcgucguccucgagcucaaggccgacgucguccccaagaccgccgagaacuuccgcgcccucugcaccggcgagaagggcuucggcuacaagggcuccaccuuccaccgcgucauccccuccuucaugugccaggccggcgacuucaccaaccacaacggcaccggcggcaaguccaucuacggcucccgcuuccccgacgagaacuucacccucaagcacgucggccccggcguccucuccauggccaacgccggccccaacaccaacggcucccaguucuucaucugcaccaucaagaccgacuggcucgacggcaagcacgucgucuucggccacgucaaggagggcauggacgucgucaagaagaucgaguccuucggcuccaaguccggccgcaccuccaagaagaucgucaucaccgacugcggccagcucuccuga

SEQ ID NO: 47973 - RNA, 2265 nt, Artificial Sequence
  derived and/or modified sequence opt2 from PPIG__Homo_sapiens__NP_004783
augggcaucaagguccagcgcccccgcugcuucuucgacaucgccaucaacaaccagcccgccggccgcgucgucuucgagcucuucuccgacgucugccccaagaccugcgagaacuuccgcugccucugcaccggcgagaagggcaccggcaaguccacccagaagccccuccacuacaaguccugccucuuccaccgcgucgucaaggacuucaugguccagggcggcgacuucuccgagggcaacggccgcggcggcgaguccaucuacggcggcuucuucgaggacgaguccuucgccgucaagcacaacaaggaguuccuccucuccauggccaaccgcggcaaggacaccaacggcucccaguucuucaucaccaccaagcccaccccccaccucgacggccaccacgucgucuucggccaggucaucuccggccaggaggucguccgcgagaucgagaaccagaagaccgacgccgccuccaagcccuucgccgagguccgcauccucuccugcggcgagcucauccccaaguccaaggucaagaaggaggagaagaagcgccacaaguccuccuccuccuccuccuccuccuccuccgacuccgacuccuccuccgacucccaguccuccuccgacuccuccgacuccgaguccgccaccgaggagaaguccaagaagcgcaagaagaagcaccgcaagaacucccgcaagcacaagaaggagaagaagaagcgcaagaaguccaagaaguccgccuccuccgaguccgaggccgagaaccucgaggcccagccccaguccaccguccgccccgaggagaucccccccauccccgagaaccgcuuccucaugcgcaaguccccccccaaggccgacgagaaggagcgcaagaaccgcgagcgcgagcgcgagcgcgagugcaacccccccaacucccagcccgccuccuaccagcgccgccuccucgucacccgcuccggccgcaagaucaagggccgcggcccccgccgcuaccgcacccccucccgcucccgcucccgcgaccgcuuccgccgcuccgagacccccccccacuggcgccaggagaugcagcgcgcccagcgcaugcgcgucuccuccggcgagcgcuggaucaagggcgacaaguccgagcucaacgagaucaaggagaaccagcgcucccccguccgcgucaaggagcgcaagaucaccgaccaccgcaacgucuccgagucccccaaccgcaagaacgagaaggagaagaaggucaaggaccacaaguccaacuccaaggagcgcgacauccgccgcaacuccgagaaggacgacaaguacaagaacaaggucaagaagcgcgccaaguccaagucccgcuccaaguccaaggagaaguccaaguccaaggagcgcgacuccaagcacaaccgcaacgaggagaagcgcaugcgcucccgcuccaagggccgcgaccacgagaacgucaaggagaaggagaagcaguccgacuccaagggcaaggaccaggagcgcucccgcuccaaggagaaguccaagcagcucgaguccaaguccaacgagcacgaccacuccaaguccaaggagaaggaccgccgcgcccagucccgcucccgcgagugcgacaucaccaagggcaagcacuccuacaacucccgcacccgcgagcgcucccgcucccgcgaccgcucccgccgcguccgcucccgcacccacgaccgcgaccgcucccgcuccaaggaguaccaccgcuaccgcgagcaggaguaccgccgccgcggccgcucccgcucccgcgagcgccgcaccccccccggccgcucccgcuccaaggaccgccgccgccgccgccgcgacucccgcuccuccgagcgcgaggagucccagucccgcaacaaggacaaguaccgcaaccaggaguccaaguccucccaccgcaaggagaacuccgaguccgagaagcgcauguacuccaagucccgcgaccacaacuccuccaacaacucccgcgagaagaaggccgaccgcgaccagucccccuucuccaagaucaagcaguccucccaggacaacgagcucaaguccuccaugcucaagaacaaggaggacgagaagauccgcuccuccgucgagaaggagaaccagaaguccaagggccaggagaacgaccacguccacgagaagaacaagaaguucgaccacgaguccucccccggcaccgacgaggacaaguccggcuga

SEQ ID NO: 47974 - RNA, 501 nt, Artificial Sequence
  derived and/or modified sequence opt2 from PPIL1__Homo_sapiens__NP_057143
auggccgccaucccccccgacuccuggcagccccccaacgucuaccucgagaccuccaugggcaucaucguccucgagcucuacuggaagcacgcccccaagaccugcaagaacuucgccgagcucgcccgccgcggcuacuacaacggcaccaaguuccaccgcaucaucaaggacuucaugauccagggcggcgaccccaccggcaccggccgcggcggcgccuccaucuacggcaagcaguucgaggacgagcuccaccccgaccucaaguucaccggcgccggcauccucgccauggccaacgccggccccgacaccaacggcucccaguucuucgucacccucgcccccacccaguggcucgacggcaagcacaccaucuucggccgcgucugccagggcaucggcauggucaaccgcgucggcauggucgagaccaacucccaggaccgccccgucgacgacgucaagaucaucaaggccuaccccuccggcuga

SEQ ID NO: 47975 - RNA, 1563 nt, Artificial Sequence
  derived and/or modified sequence opt2 from PPIL2__Homo_sapiens__NP_680480
augggcaagcgccagcaccagaaggacaagauguacaucaccugcgccgaguacacccacuucuacggcggcaagaagcccgaccucccccagaccaacuuccgccgccuccccuucgaccacugcucccucucccuccagcccuucgucuaccccgucugcacccccgacggcaucgucuucgaccuccucaacaucguccccuggcucaagaaguacggcaccaaccccuccaacggcgagaagcucgacggccgcucccucaucaagcucaacuucuccaagaacuccgagggcaaguaccacugccccguccucuucaccgucuucaccaacaacacccacaucgucgccguccgcaccaccggcaacgucuacgccuacgaggccgucgagcagcucaacaucaaggccaagaacuuccgcgaccuccucaccgacgagcccuucucccgccaggacaucaucacccuccaggaccccaccaaccucgacaaguucaacgucuccaacuucuaccacgucaagaacaacaugaagaucaucgaccccgacgaggagaaggccaagcaggaccccuccuacuaccucaagaacaccaacgccgagacccgcgagacccuccaggagcucuacaaggaguucaagggcgacgagauccucgccgccaccaugaaggcccccgagaagaagaaggucgacaagcucaacgccgcccacuacuccaccggcaaggucuccgccuccuucaccuccaccgccaugguccccgagaccacccacgaggccgccgccaucgacgaggacguccuccgcuaccaguucgucaagaagaagggcuacguccgccuccacaccaacaagggcgaccucaaccucgagcuccacugcgaccucacccccaagaccugcgagaacuucauccgccucugcaagaagcacuacuacgacggcaccaucuuccaccgcuccauccgcaacuucgucauccagggcggcgaccccaccggcaccggcaccggcggcgaguccuacuggggcaagcccuucaaggacgaguuccgccccaaccucucccacaccggccgcggcauccucuccauggccaacuccggccccaacuccaaccgcucccaguucuucaucaccuuccgcuccugcgccuaccucgacaagaagcacaccaucuucggccgcgucgucggcggcuucgacguccucaccgccauggagaacgucgaguccgaccccaagaccgaccgccccaaggaggagauccgcaucgacgccaccaccgucuucgucgaccccuacgaggaggccgacgcccagaucgcccaggagcgcaagacccagcucaaggucgcccccgagaccaaggucaaguccucccagccccaggccggcucccagggcccccagaccuuccgccagggcgucggcaaguacaucaaccccgccgccaccaagcgcgccgccgaggaggagcccuccaccuccgccaccguccccauguccaagaagaagcccucccgcggcuucggcgacuucuccuccugguga

SEQ ID NO: 47976 - RNA, 498 nt, Artificial Sequence
  derived and/or modified sequence opt2 from PPIL3__Homo_sapiens__NP_115861
auguccgucacccuccacaccgacgucggcgacaucaagaucgaggucuucugcgagcgcacccccaagaccugcgagauggagucccgcugcgucccccaggccggcguccaguggcgcgaccucggcucccuccagccccccccccccggcuucaagcaggucuucugccucucccucccccgcaccggccgcggcggcaacuccaucuggggcaagaaguucgaggacgaguacuccgaguaccucaagcacaacguccgcggcgucgucuccauggccaacaacggccccaacaccaacggcucccaguucuucaucaccuacggcaagcagccccaccucgacaugaaguacaccgucuucggcaaggucaucgacggccucgagacccucgacgagcucgagaagcuccccgucaacgagaagaccuaccgcccccucaacgacguccacaucaaggacaucaccauccacgccaaccccuucgcccaguga

SEQ ID NO: 47977 - RNA, 4302 nt, Artificial Sequence
  derived and/or modified sequence opt2 from PPIP5K1__Homo_sapiens__NP_001124330
auguggucccucaccgccuccgagggcgaguccaccaccgcccacuucuuccucggcgccggcgacgagggccucggcacccgcggcaucggcaugcgccccgaggaguccgacuccgagcuccucgaggacgaggaggacgaggucccccccgagccccagaucaucgucggcaucugcgccaugaccaagaaguccaaguccaagcccaugacccagauccucgagcgccucugccgcuucgacuaccucaccgucgucauccucggcgaggacgucauccucaacgagcccgucgagaacuggcccuccugccacugccucaucuccuuccacuccaagggcuucccccucgacaaggccgucgccuacuccaagcuccgcaaccccuuccucaucaacgaccucgccaugcaguacuacauccaggaccgccgcgaggucuaccgcauccuccaggaggagggcaucgaccucccccgcuacgccguccucaaccgcgaccccgcccgccccgaggagugcaaccucaucgagggcgaggaccaggucgaggucaacggcgccgucuuccccaagcccuucgucgagaagcccgucuccgccgaggaccacaacgucuacaucuacuaccccuccuccgccggcggcggcucccagcgccucuuccgcaagaucggcucccgcuccuccgucuacucccccgaguccuccguccgcaagaccggcuccuacaucuacgaggaguucaugcccaccgacggcaccgacgucaaggucuacaccgucggccccgacuacgcccacgccgaggcccgcaagucccccgcccucgacggcaaggucgagcgcgacuccgagggcaaggagauccgcuaccccgucaugcucaccgccauggagaagcucgucgcccgcaaggucugcgucgccuucaagcagaccgucugcggcuucgaccuccuccgcgccaacggccacuccuucgucugcgacgucaacggcuucuccuucgucaagaacuccaugaaguacuacgacgacugcgccaagauccucggcaacaccaucaugcgcgagcucgccccccaguuccagauccccugguccauccccaccgaggccgaggacauccccaucguccccaccaccuccggcaccaugauggagcuccgcugcgucaucgccaucauccgccacggcgaccgcacccccaagcagaagaugaagauggaggucaagcacccccgcuucuucgcccucuucgagaagcacggcggcuacaagaccggcaagcucaagcucaagcgccccgagcagcuccaggagguccucgacaucacccgccuccuccucgccgagcucgagaaggagcccggcggcgagaucgaggagaagaccggcaagcucgagcagcucaaguccguccucgagauguacggccacuucuccggcaucaaccgcaagguccagcucaccuacuacccccacggcgucaaggccuccaacgagggccaggacccccagcgcgagacccucgcccccucccuccuccucguccucaaguggggcggcgagcucacccccgccggccgcguccaggccgaggagcucggccgcgccuuccgcugcauguaccccggcggccagggcgacuacgccggcuuccccggcugcggccuccuccgccuccacuccaccuuccgccacgaccucaagaucuacgccuccgacgagggccgcguccagaugaccgccgccgccuucgccaagggccuccucgcccucgagggcgagcucacccccauccucguccagauggucaaguccgccaacaugaacggccuccucgacuccgacggcgacucccucuccuccugccagcaccgcgucaaggcccgccuccaccacauccuccagcaggacgcccccuucggccccgaggacuacgaccagcucgcccccacccgcuccaccucccuccucaacuccaugaccaucauccagaaccccgucaaggucugcgaccaggucuucgcccucaucgagaaccucacccaccagauccgcgagcgcaugcaggacccccgcuccgucgaccuccagcucuaccacuccgagacccucgagcucaugcuccagcgcugguccaagcucgagcgcgacuuccgccagaaguccggccgcuacgacaucuccaagauccccgacaucuacgacugcgucaaguacgacguccagcacaacggcucccucggccuccagggcaccgccgagcuccuccgccucuccaaggcccucgccgacgucgucaucccccaggaguacggcaucucccgcgaggagaagcucgagaucgccgucggcuucugccucccccuccuccgcaagauccuccucgaccuccagcgcacccacgaggacgaguccgucaacaagcuccacccccucugcuaccuccgcuacucccgcggcguccucucccccggccgccacguccgcacccgccucuacuucaccuccgagucccacguccacucccuccucuccgucuuccgcuacggcggccuccucgacgagacccaggacgcccaguggcagcgcgcccucgacuaccucuccgccaucuccgagcucaacuacaugacccagaucgucaucaugcucuacgaggacaacacccaggacccccucuccgaggagcgcuuccacgucgagcuccacuucucccccggcgucaagggcgucgaggaggagggcuccgcccccgccggcugcggcuuccgccccgccuccuccgagaacgaggagaugaagaccaaccagggcuccauggagaaccucugccccggcaaggccuccgacgagcccgaccgcgcccuccagaccuccccccagccccccgagggccccggccucccccgccgcuccccccucauccgcaaccgcaaggccggcuccauggagguccucuccgagaccuccuccucccgccccggcggcuaccgccucuucuccuccucccgcccccccaccgagaugaagcaguccggccucggcucccagugcaccggccucuucuccaccaccguccucggcggcuccuccuccgcccccaaccuccaggacuacgcccgcucccacggcaagaagcucccccccgccucccucaagcaccgcgacgagcuccucuucguccccgccgucaagcgcuucuccgucuccuucgccaagcaccccaccaacggcuucgagggcugcuccaugguccccaccaucuacccccucgagacccuccacaacgcccucucccuccgccaggucuccgaguuccucucccgcgucugccagcgccacaccgacgcccaggcccaggccuccgccgcccucuucgacuccaugcacuccucccaggccuccgacaaccccuucucccccccccgcacccuccacucccccccccuccagcuccagcagcgcuccgagaagccccccugguacuccuccggccccuccuccaccgucuccuccgccggccccuccucccccaccaccgucgacggcaacucccaguucggcuucuccgaccagcccucccucaacucccacgucgccgaggagcaccagggccucggccuccuccaggagacccccggcuccggcgcccaggagcucuccaucgagggcgagcaggagcucuucgagcccaaccaguccccccaggucccccccauggagaccucccagcccuacgaggaggucucccagcccugccaggagguccccgacaucucccagcccugccaggacaucuccgaggcccucucccagcccugccagaagguccccgacaucucccagcagugccaggagaaccacgacaacggcaaccacaccugccaggaggucccccacaucucccagcccugccagaaguccucccagcucugccagaaggucuccgaggaggucugccagcucugccucgagaacuccgaggaggucucccagcccugccagggcgucuccgucgaggucggcaagcucguccacaaguuccacgucggcgucggcucccucguccaggagacccucgucgaggucggcucccccgccgaggagauccccgaggaggucauccagcccuaccaggaguucuccgucgaggucggccgccucgcccaggagaccuccgccaucaaccuccucucccagggcauccccgagaucgacaagcccucccaggaguuccccgaggagaucgaccuccaggcccaggagguccccgaggagaucaacuga

SEQ ID NO: 47978 - RNA, 5271 nt, Artificial Sequence
  derived and/or modified sequence opt2 from PPL__Homo_sapiens__NP_002696
augaacucccucuuccgcaagcgcaacaagggcaaguacucccccaccguccagacccgcuccaucuccaacaaggagcucuccgagcucaucgagcagcuccagaagaacgccgaccaggucgagaagaacaucgucgacaccgaggccaagaugcaguccgaccucgcccgccuccaggagggccgccagcccgagcaccgcgacgucacccuccagaagguccucgacuccgagaagcuccucuacguccucgaggccgacgccgccaucgccaagcacaugaagcacccccagggcgacaugaucgccgaggacauccgccagcucaaggagcgcgucaccaaccuccgcggcaagcacaagcagaucuaccgccucgccgucaaggaggucgacccccaggucaacugggccgcccucgucgaggagaagcucgacaagcucaacaaccaguccuucggcaccgaccucccccucgucgaccaccaggucgaggagcacaacaucuuccacaacgaggucaaggccaucggcccccaccucgccaaggacggcgacaaggagcagaacuccgagcuccgcgccaaguaccagaagcuccucgccgccucccaggcccgccagcagcaccucuccucccuccaggacuacaugcagcgcugcaccaacgagcucuacuggcucgaccagcaggccaagggccgcaugcaguacgacugguccgaccgcaaccucgacuaccccucccgccgccgccaguacgagaacuucaucaaccgcaaccucgaggccaaggaggagcgcaucaacaagcuccacuccgagggcgaccagcuccucgccgccgagcaccccggccgcaacuccaucgaggcccacauggaggccguccacgccgacuggaaggaguaccucaaccuccucaucugcgaggagucccaccucaaguacauggaggacuaccaccaguuccacgaggacgucaaggacgcccaggagcuccuccgcaaggucgacuccgaccucaaccagaaguacggccccgacuucaaggaccgcuaccagaucgagcuccuccuccgcgagcucgacgaccaggagaagguccucgacaaguacgaggacgucguccagggccuccagaagcgcggccagcaggucgucccccucaaguaccgccgcgagaccccccucaagcccauccccgucgaggcccucugcgacuucgagggcgagcagggccucaucucccgcggcuacuccuacacccuccagaagaacaacggcgaguccugggagcucauggacuccgccggcaacaagcucaucgcccccgccgucugcuucgucaucccccccaccgaccccgaggcccucgcccucgccgacucccucggcucccaguaccgcuccguccgccagaaggccgccggcuccaagcgcacccuccagcagcgcuacgagguccucaagaccgagaaccccggcgacgccuccgaccuccagggccgccagcuccucgccggccucgacaaggucgccuccgaccucgaccgccaggagaaggccaucaccggcauccuccgccccccccucgagcagggccgcgccguccaggacuccgccgagcgcgccaaggaccucaagaacaucaccaacgagcuccuccgcaucgagcccgagaagacccgcuccaccgccgagggcgaggccuucauccaggcccuccccggcuccggcaccaccccccuccuccgcacccgcgucgaggacaccaaccgcaaguacgagcaccuccuccagcuccucgaccucgcccaggagaaggucgacgucgccaaccgccucgagaagucccuccagcaguccugggagcuccucgccacccacgagaaccaccucaaccaggacgacaccguccccgaguccucccgcguccucgacuccaagggccaggagcucgccgccauggccugcgagcuccaggcccagaagucccuccucggcgaggucgagcagaaccuccaggccgccaagcagugcuccuccacccucgccucccgcuuccaggagcacugccccgaccucgagcgccaggaggccgagguccacaagcucggccagcgcuucaacaaccuccgccagcaggucgagcgccgcgcccagucccuccaguccgccaaggccgccuacgagcacuuccaccgcggccacgaccacguccuccaguuccucgucuccauccccuccuacgagccccaggagaccgacucccucucccagauggagaccaagcucaagaaccagaagaaccuccucgacgagaucgccucccgcgagcaggagguccagaagaucugcgccaacucccagcaguaccagcaggccgucaaggacuacgagcucgaggccgagaagcuccgcucccuccucgaccucgagaacggccgcuccucccacgucuccaagcgcgcccgccuccagucccccgccaccaaggucaaggaggaggaggccgcccucgccgccaaguucaccgaggucuacgccaucaaccgccagcgccuccagaaccucgaguucgcccucaaccuccuccgccagcagcccgaggucgaggucacccacgagacccuccagcgcaaccgccccgacuccggcgucgaggaggccuggaagauccgcaaggagcucgacgaggagaccgagcgccgccgccagcucgagaacgaggucaaguccacccaggaggagaucuggacccuccgcaaccagggcccccaggaguccgucguccgcaaggagguccucaagaagguccccgaccccguccucgaggaguccuuccagcagcuccagcgcacccucgccgaggagcagcacaagaaccagcuccuccaggaggagcucgaggcccuccagcuccagcuccgcgcccucgagcaggagacccgcgacggcggccaggaguacgucgucaaggagguccuccgcaucgagcccgaccgcgcccaggccgacgagguccuccagcuccgcgaggagcucgaggcccuccgccgccagaagggcgcccgcgaggccgagguccuccuccuccagcagcgcgucgccgcccucgccgaggagaagucccgcgcccaggagaaggucaccgagaaggaggucgucaagcuccagaacgacccccagcucgaggccgaguaccagcagcuccaggaggaccaccagcgccaggaccagcuccgcgagaagcaggaggaggagcucuccuuccuccaggacaagcucaagcgccucgagaaggagcgcgccauggccgagggcaagaucaccgucaaggagguccucaaggucgagaaggacgccgccaccgagcgcgaggucuccgaccucacccgccaguacgaggacgaggccgccaaggcccgcgccucccagcgcgagaagaccgagcuccuccgcaagaucugggcccucgaggaggagaacgccaaggucgucguccaggagaagguccgcgagaucguccgccccgaccccaaggccgaguccgaggucgccaaccuccgccucgagcucgucgagcaggagcgcaaguaccgcggcgccgaggagcagcuccgcuccuaccaguccgagcucgaggcccuccgccgccgcggcccccaggucgaggucaaggaggucaccaaggaggucaucaaguacaagaccgaccccgagauggagaaggagcuccagcgccuccgcgaggagaucgucgacaagacccgccucaucgagcgcugcgaccucgagaucuaccagcucaagaaggagauccaggcccucaaggacaccaagccccagguccagaccaaggaggucguccaggagauccuccaguuccaggaggacccccagaccaaggaggaggucgccucccuccgcgccaagcucuccgaggagcagaagaagcaggucgaccucgagcgcgagcgcgccucccaggaggagcagaucgcccgcaaggaggaggagcucucccgcgucaaggagcgcgucguccagcaggaggucguccgcuacgaggaggagcccggccuccgcgccgaggccuccgccuucgccgaguccaucgacgucgagcuccgccagaucgacaagcuccgcgccgagcuccgccgccuccagcgccgccgcaccgagcucgagcgccagcucgaggagcucgagcgcgagcgccaggcccgccgcgaggccgagcgcgagguccagcgccuccagcagcgccucgccgcccucgagcaggaggaggccgaggcccgcgagaaggucacccacacccagaaggucguccuccagcaggacccccagcaggcccgcgagcacgcccuccuccgccuccagcucgaggaggagcagcaccgccgccagcuccucgagggcgagcucgagacccuccgccgcaagcucgccgcccucgagaaggccgaggucaaggagaaggucguccucuccgaguccguccaggucgagaagggcgacaccgagcaggagauccagcgccucaaguccucccucgaggaggagucccgcuccaagcgcgagcucgacgucgaggucucccgccucgaggcccgccucuccgagcucgaguuccacaacuccaaguccuccaaggagcucgacuuccuccgcgaggagaaccacaagcuccagcucgagcgccagaaccuccagcucgagacccgccgccuccaguccgagaucaacauggccgccaccgagacccgcgaccuccgcaacaugaccgucgccgacuccggcaccaaccacgacucccgccucuggucccucgagcgcgagcucgacgaccucaagcgccucuccaaggacaaggaccucgagaucgacgagcuccagaagcgccucggcuccgucgccgucaagcgcgagcagcgcgagaaccaccuccgccgcuccaucgucgucauccaccccgacaccggccgcgagcucucccccgaggaggcccaccgcgccggccucaucgacuggaacauguucgucaagcuccgcucccaggagugcgacugggaggagaucuccgucaagggccccaacggcgaguccuccgucauccacgaccgcaaguccggcaagaaguucuccaucgaggaggcccuccaguccggccgccucacccccgcccaguacgaccgcuacgucaacaaggacauguccauccaggagcucgccguccucgucuccggccagaaguga

SEQ ID NO: 47979 - RNA, 1149 nt, Artificial Sequence
  derived and/or modified sequence opt2 from PPM1A__Homo_sapiens__NP_066283
augggcgccuuccucgacaagcccaagauggagaagcacaacgcccagggccagggcaacggccuccgcuacggccucuccuccaugcagggcuggcgcgucgagauggaggacgcccacaccgccgucaucggccuccccuccggccucgaguccugguccuucuucgccgucuacgacggccacgccggcucccaggucgccaaguacugcugcgagcaccuccucgaccacaucaccaacaaccaggacuucaagggcuccgccggcgcccccuccgucgagaacgucaagaacggcauccgcaccggcuuccucgagaucgacgagcacaugcgcgucauguccgagaagaagcacggcgccgaccgcuccggcuccaccgccgucggcguccucaucuccccccagcacaccuacuucaucaacugcggcgacucccgcggccuccucugccgcaaccgcaagguccacuucuucacccaggaccacaagcccuccaacccccucgagaaggagcgcauccagaacgccggcggcuccgucaugauccagcgcgucaacggcucccucgccgucucccgcgcccucggcgacuucgacuacaagugcguccacggcaagggccccaccgagcagcucgucucccccgagcccgagguccacgacaucgagcgcuccgaggaggacgaccaguucaucauccucgccugcgacggcaucugggacgucaugggcaacgaggagcucugcgacuucguccgcucccgccucgaggucaccgacgaccucgagaaggucugcaacgaggucgucgacaccugccucuacaagggcucccgcgacaacauguccgucauccucaucugcuuccccaacgcccccaaggucucccccgaggccgucaagaaggaggccgagcucgacaaguaccucgagugccgcgucgaggagaucaucaagaagcagggcgagggcguccccgaccucguccacgucaugcgcacccucgccuccgagaacauccccucccucccccccggcggcgagcucgccuccaagcgcaacgucaucgaggccgucuacaaccgccucaaccccuacaagaacgacgacaccgacuccaccuccaccgacgacaugugguga

SEQ ID NO: 47980 - RNA, 1143 nt, Artificial Sequence
  derived and/or modified sequence opt2 from PPM1B__Homo_sapiens__NP_001028729
augggcgccuuccucgacaagcccaagaccgagaagcacaacgcccacggcgccggcaacggccuccgcuacggccucuccuccaugcagggcuggcgcgucgagauggaggacgcccacaccgccgucgucggcaucccccacggccucgaggacugguccuucuucgccgucuacgacggccacgccggcucccgcgucgccaacuacugcuccacccaccuccucgagcacaucaccaccaacgaggacuuccgcgccgccggcaaguccggcuccgcccucgagcucuccgucgagaacgucaagaacggcauccgcaccggcuuccucaagaucgacgaguacaugcgcaacuucuccgaccuccgcaacggcauggaccgcuccggcuccaccgccgucggcgucaugaucucccccaagcacaucuacuucaucaacugcggcgacucccgcgccguccucuaccgcaacggccaggucugcuucuccacccaggaccacaagcccugcaacccccgcgagaaggagcgcauccagaacgccggcggcuccgucaugauccagcgcgucaacggcucccucgccgucucccgcgcccucggcgacuacgacuacaagugcgucgacggcaagggccccaccgagcagcucgucucccccgagcccgaggucuacgagauccuccgcgccgaggaggacgaguucaucauccucgccugcgacggcaucugggacgucauguccaacgaggagcucugcgaguacgucaagucccgccucgaggucuccgacgaccucgagaacgucugcaacugggucgucgacaccugccuccacaagggcucccgcgacaacauguccaucguccucgucugcuucuccaacgcccccaaggucuccgacgaggccgucaagaaggacuccgagcucgacaagcaccucgagucccgcgucgaggagaucauggagaaguccggcgaggagggcaugcccgaccucgcccacgucaugcgcauccucuccgccgagaacauccccaaccucccccccggcggcggccucgccggcaagcgcaacgucaucgaggccgucuacucccgccucaacccccaccgcgaguccgacggccagaaguga

SEQ ID NO: 47981 - RNA, 1818 nt, Artificial Sequence
  derived and/or modified sequence opt2 from PPM1D__Homo_sapiens__NP_003611
auggccggccucuacucccucggcgucuccgucuucuccgaccagggcggccgcaaguacauggaggacgucacccagaucgucgucgagcccgagcccaccgccgaggagaagcccuccccccgccgcucccucucccagccccuccccccccgccccucccccgccgcccuccccggcggcgaggucuccggcaagggccccgccgucgccgcccgcgaggcccgcgacccccuccccgacgccggcgccucccccgcccccucccgcugcugccgccgccgcuccuccgucgccuucuucgccgucugcgacggccacggcggccgcgaggccgcccaguucgcccgcgagcaccucuggggcuucaucaagaagcagaagggcuucaccuccuccgagcccgccaaggucugcgccgccauccgcaagggcuuccucgccugccaccucgccauguggaagaagcucgccgaguggcccaagaccaugaccggccuccccuccaccuccggcaccaccgccuccgucgucaucauccgcggcaugaagauguacgucgcccacgucggcgacuccggcgucguccucggcauccaggacgaccccaaggacgacuucguccgcgccgucgaggucacccaggaccacaagcccgagcuccccaaggagcgcgagcgcaucgagggccucggcggcuccgucaugaacaaguccggcgucaaccgcgucgucuggaagcgcccccgccucacccacaacggccccguccgccgcuccaccgucaucgaccagauccccuuccucgccgucgcccgcgcccucggcgaccucugguccuacgacuucuucuccggcgaguucgucgucucccccgagcccgacaccuccguccacacccucgacccccagaagcacaaguacaucauccucggcuccgacggccucuggaacaugauccccccccaggacgccaucuccaugugccaggaccaggaggagaagaaguaccucaugggcgagcacggccaguccugcgccaagaugcucgucaaccgcgcccucggccgcuggcgccagcgcaugcuccgcgccgacaacaccuccgccaucgucaucugcaucucccccgaggucgacaaccagggcaacuucaccaacgaggacgagcucuaccucaaccucaccgacucccccuccuacaacucccaggagaccugcgucaugacccccucccccugcuccaccccccccgucaagucccucgaggaggaccccuggccccgcgucaacuccaaggaccacauccccgcccucguccgcuccaacgccuucuccgagaacuuccucgaggucuccgccgagaucgcccgcgagaacguccagggcgucgucauccccuccaaggaccccgagccccucgaggagaacugcgccaaggcccucacccuccgcauccacgacucccucaacaacucccuccccaucggccucguccccaccaacuccaccaacaccgucauggaccagaagaaccucaagauguccacccccggccagaugaaggcccaggagaucgagcgcaccccccccaccaacuucaagcgcacccucgaggaguccaacuccggcccccucaugaagaagcaccgccgcaacggccucucccgcuccuccggcgcccagcccgccucccuccccaccaccucccagcgcaagaacuccgucaagcucaccaugcgccgccgccuccgcggccagaagaagaucggcaacccccuccuccaccagcaccgcaagaccgucugcgucugcuga

SEQ ID NO: 47982 - RNA, 2268 nt, Artificial Sequence
  derived and/or modified sequence opt2 from PPM1E__Homo_sapiens__NP_055721
auggccggcugcauccccgaggagaagaccuaccgccgcuuccucgagcucuuccucggcgaguuccgcggccccugcggcggcggcgagcccgagcccgagcccgagcccgagcccgagcccgagcccgaguccgagcccgagcccgagcccgagcucgucgaggccgaggccgccgaggccuccgucgaggagcccggcgaggaggccgccaccgucgccgccaccgaggagggcgaccaggagcaggaccccgagcccgaggaggaggccgccgucgagggcgaggaggaggaggagggcgccgccaccgccgccgccgcccccggccacuccgccgucccccccccccccccccagcuccccccccuccccccccucccccgcccccucuccgagcgcaucacccgcgaggaggucgagggcgagucccucgaccucugccuccagcagcucuacaaguacaacugccccuccuuccucgccgccgcccucgcccgcgccaccuccgacgagguccuccaguccgaccucuccgcccacuacauccccaaggagaccgacggcaccgagggcaccgucgagaucgagaccgucaagcucgcccgcuccgucuucuccaagcuccacgagaucugcugcuccugggucaaggacuucccccuccgccgccgcccccagcucuacuacgagaccuccauccacgccaucaagaacaugcgccgcaagauggaggacaagcacgucugcauccccgacuucaacaugcucuucaaccucgaggaccaggaggagcaggccuacuucgccgucuucgacggccacggcggcgucgacgccgccaucuacgccuccauccaccuccacgucaaccucguccgccaggagauguucccccacgaccccgccgaggcccucugccgcgccuuccgcgucaccgacgagcgcuucguccagaaggccgcccgcgagucccuccgcugcggcaccaccggcgucgucaccuucauccgcggcaacaugcuccacgucgccugggucggcgacucccaggucaugcucguccgcaagggccaggccgucgagcucaugaagccccacaagcccgaccgcgaggacgagaagcagcgcaucgaggcccucggcggcugcgucgucugguucggcgccuggcgcgucaacggcucccucuccgucucccgcgccaucggcgacgccgagcacaagcccuacaucugcggcgacgccgacuccgccuccaccguccucgacggcaccgaggacuaccucauccucgccugcgacggcuucuacgacaccgucaaccccgacgaggccgucaaggucgucuccgaccaccucaaggagaacaacggcgacuccuccauggucgcccacaagcucgucgccuccgcccgcgacgccggcuccuccgacaacaucaccgucaucgucgucuuccuccgcgacaugaacaaggccgucaacgucuccgaggaguccgacuggaccgagaacuccuuccagggcggccaggaggacggcggcgacgacaaggagaaccacggcgagugcaagcgccccuggccccagcaccagugcuccgcccccgccgaccucggcuacgacggccgcgucgacuccuucaccgaccgcaccucccucucccccggcucccagaucaacguccucgaggaccccggcuaccucgaccucacccagaucgaggccuccaagccccacuccgcccaguuccuccuccccgucgagauguucggccccggcgcccccaagaaggccaaccucaucaacgagcucaugauggagaagaaguccguccaguccucccuccccgagugguccggcgccggcgaguuccccaccgccuucaaccucggcuccaccggcgagcagaucuaccgcaugcagucccucucccccgucugcuccggccucgagaacgagcaguucaagucccccggcaaccgcgucucccgccucucccaccuccgccaccacuacuccaagaaguggcaccgcuuccgcuucaaccccaaguucuacuccuuccucuccgcccaggagcccucccacaagaucggcaccucccucuccucccucaccggcuccggcaagcgcaaccgcauccgcuccucccuccccuggcgccagaacuccuggaagggcuacuccgagaacaugcgcaagcuccgcaagacccacgacauccccugccccgaccuccccugguccuacaagaucgaguga

SEQ ID NO: 47983 - RNA, 1365 nt, Artificial Sequence
  derived and/or modified sequence opt2 from PPM1F__Homo_sapiens__NP_055449
auguccuccggcgccccccagaaguccucccccauggccuccggcgccgaggagacccccggcuuccucgacacccuccuccaggacuuccccgcccuccucaaccccgaggacccccuccccuggaaggcccccggcaccguccucucccaggaggaggucgagggcgagcucgccgagcucgccaugggcuuccucggcucccgcaaggccccccccccccucgccgccgcccucgcccacgaggccgucucccagcuccuccagaccgaccucuccgaguuccgcaagcucccccgcgaggaggaggaggaggaggaggacgacgacgaggaggagaaggcccccgucacccuccucgacgcccagucccucgcccaguccuucuucaaccgccucugggaggucgccggccaguggcagaagcaggucccccucgccgcccgcgccucccagcgccaguggcucgucuccauccacgccauccgcaacacccgccgcaagauggaggaccgccacgucucccuccccuccuucaaccagcucuucggccucuccgaccccgucaaccgcgccuacuucgccgucuucgacggccacggcggcgucgacgccgcccgcuacgccgccguccacguccacaccaacgccgcccgccagcccgagcuccccaccgaccccgagggcgcccuccgcgaggccuuccgccgcaccgaccagauguuccuccgcaaggccaagcgcgagcgccuccaguccggcaccaccggcgucugcgcccucaucgccggcgccacccuccacgucgccuggcucggcgacucccaggucauccucguccagcagggccaggucgucaagcucauggagccccaccgccccgagcgccaggacgagaaggcccgcaucgaggcccucggcggcuucgucucccacauggacugcuggcgcgucaacggcacccucgccgucucccgcgccaucggcgacgucuuccagaagcccuacgucuccggcgaggccgacgccgccucccgcgcccucaccggcuccgaggacuaccuccuccucgccugcgacggcuucuucgacgucgucccccaccaggaggucgucggccucguccagucccaccucacccgccagcagggcuccggccuccgcgucgccgaggagcucgucgccgccgcccgcgagcgcggcucccacgacaacaucaccgucauggucgucuuccuccgcgacccccaggagcuccucgagggcggcaaccagggcgagggcgacccccaggccgagggccgccgccaggaccuccccuccucccuccccgagcccgagacccaggcccccccccgcuccuga

SEQ ID NO: 47984 - RNA, 1641 nt, Artificial Sequence
  derived and/or modified sequence opt2 from PPM1G__Homo_sapiens__NP_817092
augggcgccuaccucucccagcccaacaccgucaagugcuccggcgacggcgucggcgccccccgccucccccuccccuacggcuucuccgccaugcagggcuggcgcgucuccauggaggacgcccacaacugcauccccgagcucgacuccgagaccgccauguucuccgucuacgacggccacggcggcgaggaggucgcccucuacugcgccaaguaccuccccgacaucaucaaggaccagaaggccuacaaggagggcaagcuccagaaggcccucgaggacgccuuccucgccaucgacgccaagcucaccaccgaggaggucaucaaggagcucgcccagaucgccggccgccccaccgaggacgaggacgagaaggagaaggucgccgacgaggacgacgucgacaacgaggaggccgcccuccuccacgaggaggccaccaugaccaucgaggagcuccucacccgcuacggccagaacugccacaagggccccccccacuccaaguccggcggcggcaccggcgaggagcccggcucccagggccucaacggcgaggccggccccgaggacuccacccgcgagacccccucccaggagaacggccccaccgccaaggccuacaccggcuucuccuccaacuccgagcgcggcaccgaggccggccaggucggcgagcccggcauccccaccggcgaggccggccccuccugcuccuccgccuccgacaagcucccccgcgucgccaaguccaaguucuucgaggacuccgaggacgaguccgacgaggccgaggaggaggaggaggacuccgaggagugcuccgaggaggaggacggcuacuccuccgaggaggccgagaacgaggaggacgaggacgacaccgaggaggccgaggaggacgacgaggaggaggaggaggagaugaugguccccggcauggagggcaaggaggagcccggcuccgacuccggcaccaccgccgucgucgcccucauccgcggcaagcagcucaucgucgccaacgccggcgacucccgcugcgucgucuccgaggccggcaaggcccucgacauguccuacgaccacaagcccgaggacgaggucgagcucgcccgcaucaagaacgccggcggcaaggucaccauggacggccgcgucaacggcggccucaaccucucccgcgccaucggcgaccacuucuacaagcgcaacaagaaccucccccccgaggagcagaugaucuccgcccuccccgacaucaagguccucacccucaccgacgaccacgaguucauggucaucgccugcgacggcaucuggaacgucauguccucccaggaggucgucgacuucauccaguccaagaucucccagcgcgacgagaacggcgagcuccgccuccucuccuccaucgucgaggagcuccucgaccagugccucgcccccgacaccuccggcgacggcaccggcugcgacaacaugaccugcaucaucaucugcuucaagccccgcaacaccgccgagcuccagcccgaguccggcaagcgcaagcucgaggagguccucuccaccgagggcgccgaggagaacggcaacuccgacaagaagaagaaggccaagcgcgacuga

SEQ ID NO: 47985 - RNA, 1545 nt, Artificial Sequence
  derived and/or modified sequence opt2 from PPM1H__Homo_sapiens__NP_065751
augcucacccgcgucaaguccgccgucgccaacuucaugggcggcaucauggccggcuccuccggcuccgagcacggcggcggcuccugcggcggcuccgaccucccccuccgcuuccccuacggccgccccgaguuccucggccucucccaggacgaggucgagugcuccgccgaccacaucgcccgccccauccucauccucaaggagacccgccgccuccccugggccaccggcuacgccgaggucaucaacgccggcaaguccacccacaacgaggaccaggccuccugcgagguccucaccgucaagaagaaggccggcgccgucaccuccacccccaaccgcaacuccuccaagcgccgcuccucccuccccaacggcgagggccuccagcucaaggagaacuccgaguccgagggcgucuccugccacuacuggucccucuucgacggccacgccggcuccggcgccgccgucgucgccucccgccuccuccagcaccacaucaccgagcagcuccaggacaucgucgacauccucaagaacuccgccguccucccccccaccugccucggcgaggagcccgagaacacccccgccaacucccgcacccucacccgcgccgccucccuccgcggcggcgucggcgcccccggcucccccuccaccccccccacccgcuucuucaccgagaagaagaucccccacgagugccucgucaucggcgcccucgaguccgccuucaaggagauggaccuccagaucgagcgcgagcgcuccuccuacaacaucuccggcggcugcaccgcccucaucgucaucugccuccucggcaagcucuacgucgccaacgccggcgacucccgcgccaucaucauccgcaacggcgagaucauccccauguccuccgaguucacccccgagaccgagcgccagcgccuccaguaccucgccuucaugcagccccaccuccucggcaacgaguucacccaccucgaguucccccgccgcguccagcgcaaggagcucggcaagaagaugcucuaccgcgacuucaacaugaccggcugggccuacaagaccaucgaggacgaggaccucaaguucccccucaucuacggcgagggcaagaaggcccgcgucauggccaccaucggcgucacccgcggccucggcgaccacgaccucaagguccacgacuccaacaucuacaucaagcccuuccucuccuccgcccccgagguccgcaucuacgaccucuccaaguacgaccacggcuccgacgacguccucauccucgccaccgacggccucugggacguccucuccaacgaggaggucgccgaggccaucacccaguuccuccccaacugcgaccccgacgacccccaccgcuacacccucgccgcccaggaccucgucaugcgcgcccgcggcguccucaaggaccgcggcuggcgcaucuccaacgaccgccucggcuccggcgacgacaucuccgucuacgucaucccccucauccacggcaacaagcucuccuga

SEQ ID NO: 47986 - RNA, 1119 nt, Artificial Sequence
  derived and/or modified sequence opt2 from PPM1K__Homo_sapiens__NP_689755
auguccaccgccgcccucaucacccucguccgcuccggcggcaaccagguccgccgccgcguccuccucuccucccgccuccuccaggacgaccgccgcgucacccccaccugccacuccuccaccuccgagccccgcugcucccgcuucgaccccgacggcuccggcucccccgccaccugggacaacuucggcaucugggacaaccgcaucgacgagcccauccuccucccccccuccaucaaguacggcaagcccauccccaagaucucccucgagaacgucggcugcgccucccagaucggcaagcgcaaggagaacgaggaccgcuucgacuucgcccagcucaccgacgagguccucuacuucgccgucuacgacggccacggcggccccgccgccgccgacuucugccacacccacauggagaagugcaucauggaccuccuccccaaggagaagaaccucgagacccuccucacccucgccuuccucgagaucgacaaggccuucuccucccacgcccgccucuccgccgacgccacccuccucaccuccggcaccaccgccaccgucgcccuccuccgcgacggcaucgagcucgucgucgccuccgucggcgacucccgcgccauccucugccgcaagggcaagcccaugaagcucaccaucgaccacacccccgagcgcaaggacgagaaggagcgcaucaagaagugcggcggcuucgucgccuggaacucccucggccagccccacgucaacggccgccucgccaugacccgcuccaucggcgaccucgaccucaagaccuccggcgucaucgccgagcccgagaccaagcgcaucaagcuccaccacgccgacgacuccuuccucguccucaccaccgacggcaucaacuucauggucaacucccaggagaucugcgacuucgucaaccagugccacgaccccaacgaggccgcccacgccgucaccgagcaggccauccaguacggcaccgaggacaacuccaccgccgucgucguccccuucggcgccuggggcaaguacaagaacuccgagaucaacuucuccuucucccgcuccuucgccuccuccggccgcugggccuga

SEQ ID NO: 47987 - RNA, 1083 nt, Artificial Sequence
  derived and/or modified sequence opt2 from PPM1L__Homo_sapiens__NP_640338
augaucgaggacaccaugacccuccucucccuccucggccgcaucaugcgcuacuuccuccuccgccccgagacccucuuccuccucugcaucucccucgcccucugguccuacuucuuccacaccgacgaggucaagaccaucgucaaguccucccgcgacgccgucaagauggucaagggcaaggucgccgagaucaugcagaacgaccgccucggcggccucgacguccucgaggccgaguucuccaagaccugggaguucaagaaccacaacgucgccgucuacuccauccagggccgccgcgaccacauggaggaccgcuucgagguccucaccgaccucgccaacaagacccaccccuccaucuucggcaucuucgacggccacggcggcgagaccgccgccgaguacgucaagucccgccuccccgaggcccucaagcagcaccuccaggacuacgagaaggacaaggagaacuccguccucuccuaccagaccauccucgagcagcagauccucuccaucgaccgcgagaugcucgagaagcucaccgucuccuacgacgaggccggcaccaccugccucaucgcccuccucuccgacaaggaccucaccgucgccaacgucggcgacucccgcggcguccucugcgacaaggacggcaacgccaucccccucucccacgaccacaagcccuaccagcucaaggagcgcaagcgcaucaagcgcgccggcggcuucaucuccuucaacggcuccuggcgcguccagggcauccucgccaugucccgcucccucggcgacuacccccucaagaaccucaacgucgucauccccgaccccgacauccucaccuucgaccucgacaagcuccagcccgaguucaugauccucgccuccgacggccucugggacgccuucuccaacgaggaggccguccgcuucaucaaggagcgccucgacgagccccacuucggcgccaaguccaucguccuccaguccuucuaccgcggcugccccgacaacaucaccgucauggucgucaaguuccgcaacuccuccaagaccgaggagcaguga

SEQ ID NO: 47988 - RNA, 744 nt, Artificial Sequence
  derived and/or modified sequence opt2 from PPM1M__Homo_sapiens__NP_001116342
augggcggcugcaccgcccucgucgccgucucccuccagggcaagcucuacauggccaacgccggcgacucccgcgccauccucguccgccgcgacgagauccgcccccucuccuucgaguucacccccgagaccgagcgccagcgcauccagcagcucgccuucgucuaccccgagcuccucgccggcgaguucacccgccucgaguucccccgccgccucaagggcgacgaccucggccagaagguccucuuccgcgaccaccacauguccggcugguccuacaagcgcgucgagaaguccgaccucaaguacccccucauccacggccagggccgccaggcccgccuccucggcacccucgccgucucccgcggccucggcgaccaccagcuccgcguccucgacaccaacauccagcucaagcccuuccuccucuccgucccccaggucaccguccucgacgucgaccagcucgagcuccaggaggacgacgucgucgucauggccaccgacggccucugggacguccucuccaacgagcaggucgccuggcucguccgcuccuuccuccccggcaaccaggaggacccccaccgcuucuccaagcucgcccagaugcucauccacuccacccagggcaaggaggacucccucaccgaggagggccaggucuccuacgacgacgucuccgucuucgucaucccccuccacucccagggccaggaguccuccgaccacuga

SEQ ID NO: 47989 - RNA, 1203 nt, Artificial Sequence
  derived and/or modified sequence opt2 from PPME1__Homo_sapiens__NP_001258522
auguccgcccucgagaaguccaugcaccucggccgccuccccucccgccccccccuccccggcuccggcggcucccaguccggcgccaagaugcgcaugggccccggccgcaagcgcgacuucucccccguccccuggucccaguacuucgaguccauggaggacgucgaggucgagaacgagaccggcaaggacaccuuccgcgucuacaaguccggcuccgagggccccguccuccuccuccuccacggcggcggccacuccgcccucuccugggccgucuucaccgccgccaucaucucccgcguccagugccgcaucgucgcccucgaccuccgcucccacggcgagaccaaggucaagaaccccgaggaccucuccgccgagaccauggccaaggacgucggcaacgucgucgaggccauguacggcgaccuccccccccccaucaugcucaucggccacuccaugggcggcgccaucgccguccacaccgccuccuccaaccucguccccucccuccucggccucugcaugaucgacgucgucgagggcaccgccauggacgcccucaacuccaugcagaacuuccuccgcggccgccccaagaccuucaagucccucgagaacgccaucgagugguccgucaaguccggccagauccgcaaccucgaguccgcccgcgucuccauggucggccaggucaagcagugcgagggcaucaccucccccgagggcuccaaguccaucgucgagggcaucaucgaggaggaggaggaggacgaggagggcuccgaguccaucuccaagcgcaagaaggaggacgacauggagggccuccccuccgagacccagaaccuccuccucuuccuccagaccaagaaggaccaccccuacaccuggcgcaucgagcucgccaagaccgagaaguacugggacggcugguuccgcggccucuccaaccucuuccucuccugccccauccccaagcuccuccuccucgccggcgucgaccgccucgacaaggaccucaccaucggccagaugcagggcaaguuccagaugcagguccucccccagugcggccacgccguccacgaggacgcccccgacaaggucgccgaggccgucgccaccuuccucauccgccaccgcuucgccgagcccaucggcggcuuccagugcgucuuccccggcugcuga

SEQ ID NO: 47990 - RNA, 1434 nt, Artificial Sequence
  derived and/or modified sequence opt2 from PPOX__Homo_sapiens__NP_001116236
augggccgcaccgucgucguccucggcggcggcaucuccggccucgccgccuccuaccaccucucccgcgcccccugcccccccaaggucguccucgucgaguccuccgagcgccucggcggcuggauccgcuccguccgcggccccaacggcgccaucuucgagcucggcccccgcggcauccgccccgccggcgcccucggcgcccgcacccuccuccucgucuccgagcucggccucgacuccgagguccuccccguccgcggcgaccaccccgccgcccagaaccgcuuccucuacgucggcggcgcccuccacgcccuccccaccggccuccgcggccuccuccgccccuccccccccuucuccaagccccucuucugggccggccuccgcgagcucaccaagccccgcggcaaggagcccgacgagaccguccacuccuucgcccagcgccgccucggccccgaggucgccucccucgccauggacucccucugccgcggcgucuucgccggcaacucccgcgagcucuccauccgcuccugcuuccccucccucuuccaggccgagcagacccaccgcuccauccuccucggccuccuccucggcgccggccgcaccccccagcccgacuccgcccucauccgccaggcccucgccgagcgcuggucccaguggucccuccgcggcggccucgagaugcucccccaggcccucgagacccaccucaccucccgcggcgucuccguccuccgcggccagcccgucugcggccucucccuccaggccgagggccgcuggaaggucucccuccgcgacuccucccucgaggccgaccacgucaucuccgccauccccgccuccguccucuccgagcuccuccccgccgaggccgccccccucgcccgcgcccucuccgccaucaccgccgucuccgucgccgucgucaaccuccaguaccagggcgcccaccuccccguccagggcuucggccaccucguccccuccuccgaggaccccggcguccucggcaucgucuacgacuccgucgccuuccccgagcaggacggcuccccccccggccuccgcgucaccgucaugcucggcggcuccuggcuccagacccucgaggccuccggcugcguccucucccaggagcucuuccagcagcgcgcccaggaggccgccgccacccagcucggccucaaggagaugcccucccacugccucguccaccuccacaagaacugcaucccccaguacacccucggccacuggcagaagcucgaguccgcccgccaguuccucaccgcccaccgccucccccucacccucgccggcgccuccuacgagggcgucgccgucaacgacugcaucgaguccggccgccaggccgccgucuccguccucggcaccgagcccaacuccuga

SEQ ID NO: 47991 - RNA, 1026 nt, Artificial Sequence
  derived and/or modified sequence opt2 from PPP1CA__Homo_sapiens__NP_001008709
auguccgacuccgagaagcucaaccucgacuccaucaucggccgccuccucgagggcucccgcguccucaccccccacugcgcccccguccagggcucccgccccggcaagaacguccagcucaccgagaacgagauccgcggccucugccucaagucccgcgagaucuuccucucccagcccauccuccucgagcucgaggccccccucaagaucugcggcgacauccacggccaguacuacgaccuccuccgccucuucgaguacggcggcuucccccccgaguccaacuaccucuuccucggcgacuacgucgaccgcggcaagcagucccucgagaccaucugccuccuccucgccuacaagaucaaguaccccgagaacuucuuccuccuccgcggcaaccacgagugcgccuccaucaaccgcaucuacggcuucuacgacgagugcaagcgccgcuacaacaucaagcucuggaagaccuucaccgacugcuucaacugccuccccaucgccgccaucgucgacgagaagaucuucugcugccacggcggccucucccccgaccuccaguccauggagcagauccgccgcaucaugcgccccaccgacguccccgaccagggccuccucugcgaccuccucugguccgaccccgacaaggacguccagggcuggggcgagaacgaccgcggcgucuccuucaccuucggcgccgaggucgucgccaaguuccuccacaagcacgaccucgaccucaucugccgcgcccaccaggucgucgaggacggcuacgaguucuucgccaagcgccagcucgucacccucuucuccgcccccaacuacugcggcgaguucgacaacgccggcgccaugauguccgucgacgagacccucaugugcuccuuccagauccucaagcccgccgacaagaacaagggcaaguacggccaguucuccggccucaaccccggcggccgccccaucacccccccccgcaacuccgccaaggccaagaaguga

SEQ ID NO: 47992 - RNA, 1014 nt, Artificial Sequence
  derived and/or modified sequence opt2 from PPP1CC__Homo_sapiens__NP_001231903
auggccgaccucgacaagcucaacaucgacuccaucauccagcgccuccucgagguccgcggcuccaagcccggcaagaacguccagcuccaggagaacgagauccgcggccucugccucaagucccgcgagaucuuccucucccagcccauccuccucgagcucgaggccccccucaagaucugcggcgacauccacggccaguacuacgaccuccuccgccucuucgaguacggcggcuucccccccgaguccaacuaccucuuccucggcgacuacgucgaccgcggcaagcagucccucgagaccaucugccuccuccucgccuacaagaucaaguaccccgagaacuucuuccuccuccgcggcaaccacgagugcgccuccaucaaccgcaucuacggcuucuacgacgagugcaagcgccgcuacaacaucaagcucuggaagaccuucaccgacugcuucaacugccuccccaucgccgccaucgucgacgagaagaucuucugcugccacggcggccucucccccgaccuccaguccauggagcagauccgccgcaucaugcgccccaccgacguccccgaccagggccuccucugcgaccuccucugguccgaccccgacaaggacguccucggcuggggcgagaacgaccgcggcgucuccuucaccuucggcgccgaggucgucgccaaguuccuccacaagcacgaccucgaccucaucugccgcgcccaccaggucgucgaggacggcuacgaguucuucgccaagcgccagcucgucacccucuucuccgcccccaacuacugcggcgaguucgacaacgccggcgccaugauguccgucgacgagacccucaugugcuccuuccagauccucaagcccgccgagaagaagaagcccaacgccacccgccccgucacccccccccgcgucgccuccggccucaaccccuccauccagaaggccuccaacuaccgcaacaacaccguccucuacgaguga

SEQ ID NO: 47993 - RNA, 2823 nt, Artificial Sequence
  derived and/or modified sequence opt2 from PPP1R10__Homo_sapiens__NP_002705
augggcuccggccccaucgaccccaaggagcuccucaagggccucgacuccuuccucaaccgcgacggcgaggucaaguccgucgacggcaucuccaagaucuucucccucaugaaggaggcccgcaagauggucucccgcugcaccuaccucaacauccuccuccagacccgcucccccgagauccucgucaaguucaucgacgucggcggcuacaagcuccucaacaacuggcucaccuacuccaagaccaccaacaacaucccccuccuccagcagauccuccucacccuccagcaccucccccucaccgucgaccaccucaagcagaacaacaccgccaagcucgucaagcagcucuccaaguccuccgaggacgaggagcuccgcaagcucgccuccguccucgucuccgacuggauggccgucauccgcucccaguccuccacccagcccgccgagaaggacaagaagaagcgcaaggacgagggcaagucccgcaccacccuccccgagcgcccccucaccgaggucaaggccgagacccgcgccgaggaggcccccgagaagaagcgcgagaagcccaagucccuccgcaccaccgcccccucccacgccaaguuccgcuccaccggccucgagcucgagacccccucccucguccccgucaagaagaacgccuccaccgucgucgucuccgacaaguacaaccucaagcccaucccccucaagcgccaguccaacgucgccgcccccggcgacgccaccccccccgccgagaagaaguacaagccccucaacaccacccccaacgccaccaaggagaucaaggucaagaucauccccccccagcccauggagggccucggcuuccucgacgcccucaacuccgcccccguccccggcaucaagaucaagaagaagaagaagguccucucccccaccgccgccaagcccucccccuucgagggcaagaccuccaccgagcccuccaccgccaagcccuccucccccgagcccgccccccccuccgaggccauggacgccgaccgccccggcacccccgucccccccgucgagguccccgagcucauggacaccgccucccucgagcccggcgcccucgacgccaagcccgucgagucccccggcgaccccaaccagcucacccgcaagggccgcaagcgcaaguccgucaccuggcccgaggagggcaagcuccgcgaguacuucuacuucgagcucgacgagaccgagcgcgucaacgucaacaagaucaaggacuucggcgaggccgccaagcgcgagauccucuccgaccgccacgccuucgagaccgcccgccgccucucccacgacaacauggaggagaagguccccugggucugcccccgcccccucguccuccccuccccccucgucacccccggcuccaacucccaggagcgcuacauccaggccgagcgcgagaagggcauccuccaggagcucuuccucaacaaggaguccccccacgagcccgaccccgagcccuacgagcccaucccccccaagcucaucccccucgacgaggagugcuccauggacgagacccccuacgucgagacccucgagcccggcggcuccggcggcucccccgacggcgccggcggcuccaagcucccccccguccucgccaaccucaugggcuccaugggcgccggcaagggcccccagggccccggcggcggcggcaucaacguccaggagauccucaccuccaucaugggcucccccaacucccaccccuccgaggagcuccucaagcagcccgacuacuccgacaagaucaagcagaugcucgucccccacggccuccucggccccggccccaucgccaacggcuucccccccggcggccccggcggccccaagggcaugcagcacuucccccccggccccggcggccccaugcccggcccccacggcggccccggcggccccgucggcccccgccuccucggcccccccccccccccccgcggcggcgaccccuucugggacggccccggcgaccccaugcgcggcggccccaugcgcggcggccccggccccggccccggccccuaccaccgcggccgcggcggccgcggcggcaacgagcccccccccccccccccccccuuccgcggcgcccgcggcggccgcuccggcggcggcccccccaacggccgcggcggccccggcggcggcauggucggcggcggcggccaccgcccccacgagggccccggcggcggcaugggcaacuccuccggccaccgcccccacgagggccccggcggcggcaugggcuccggccaccgcccccacgagggccccggcggcuccaugggcggcggcggcggccaccgcccccacgagggccccggcggcggcaucuccggcggcuccggccaccgcccccacgagggccccggcggcggcaugggcgccggcggcggccaccgcccccacgagggccccggcggcuccaugggcggcuccggcggccaccgcccccacgagggccccggccacggcggcccccacggccaccgcccccacgacguccccggccaccgcggccacgaccaccgcggcccccccccccacgagcaccgcggccacgacggccccggccacggcggcggcggccaccgcggccacgacggcggccacucccacggcggcgacauguccaaccgccccgucugccgccacuucaugaugaagggcaacugccgcuacgagaacaacugcgccuucuaccaccccggcgucaacggccccccccuccccuga

SEQ ID NO: 47994 - RNA, 381 nt, Artificial Sequence
  derived and/or modified sequence opt2 from PPP1R11__Homo_sapiens__NP_068778
auggccgaggccggcgccggccucuccgagaccgucaccgagaccaccgucaccgucaccaccgagcccgagaaccgcucccucaccaucaagcuccgcaagcgcaagcccgagaagaaggucgaguggaccuccgacaccgucgacaacgagcacaugggccgccgcuccuccaagugcugcugcaucuacgagaagccccgcgccuucggcgaguccuccaccgaguccgacgaggaggaggaggagggcugcggccacacccacugcguccgcggccaccgcaagggccgccgccgcgccacccucggccccacccccaccacccccccccagccccccgaccccucccagcccccccccggccccaugcagcacuga

SEQ ID NO: 47995 - RNA, 3093 nt, Artificial Sequence
  derived and/or modified sequence opt2 from PPP1R12A__Homo_sapiens__NP_001137357
augaagauggccgacgccaagcagaagcgcaacgagcagcucaagcgcuggaucggcuccgagaccgaccucgagccccccgucgucaagcgccagaagaccaaggucaaguucgacgacggcgccgucuuccucgccgccugcuccuccggcgacaccgacgagguccucaagcuccuccaccgcggcgccgacaucaacuacgccaacgucgacggccucaccgcccuccaccaggccugcaucgacgacaacgucgacauggucaaguuccucgucgagaacggcgccaacaucaaccagcccgacaacgagggcuggaucccccuccacgccgccgccuccugcggcuaccucgacaucgccgaguuccucaucggccagggcgcccacgucggcgccgucaacuccgagggcgacaccccccucgacaucgccgaggaggaggccauggaggagcuccuccagaacgaggucaaccgccagggcgucgacaucgaggccgcccgcaaggaggaggagcgcaucaugcuccgcgacgcccgccaguggcucaacuccggccacaucaacgacguccgccacgccaaguccggcggcaccgcccuccacgucgccgccgccaagggcuacaccgagguccucaagcuccucauccaggccggcuacgacgucaacaucaaggacuacgacggcuggaccccccuccacgccgccgcccacuggggcaaggaggaggccugccgcauccucgucgacaaccucugcgacauggagauggucaacaaggucggccagaccgccuucgacgucgccgacgaggacauccucggcuaccucgaggagcuccagaagaagcagaaccuccuccacuccgagaagcgcgacaagaaguccccccucaucgaguccaccgccaacauggacaacaaccagucccagaagaccuucaagaacaaggagacccucaucaucgagcccgagaagaacgccucccgcaucgagucccucgagcaggagaaggucgacgaggaggaggagggcaagaaggacgaguccuccugcuccuccgaggaggacgaggaggacgacuccgaguccgaggccgagaccgacaagaccaagccccucgccuccgucaccaacgccaacaccuccuccacccaggccgcccccgucgccgucaccacccccaccgucuccuccggccaggccacccccaccucccccaucaagaaguuccccaccaccgccaccaagaucucccccaaggaggaggagcgcaaggacgagucccccgccaccuggcgccucggccuccgcaagaccggcuccuacggcgcccucgccgagaucaccgccuccaaggagggccagaaggagaaggacaccgccggcgucacccgcuccgccuccuccccccgccucuccuccucccucgacaacaaggagaaggagaaggacuccaagggcacccgccucgccuacgucgcccccaccaucccccgccgccucgccuccaccuccgacaucgaggagaaggagaaccgcgacuccuccucccuccgcaccuccuccuccuacacccgccgcaagugggaggacgaccucaagaagaacuccuccgucaacgagggcuccaccuaccacaaguccugcuccuucggccgccgccaggacgaccucaucuccuccuccguccccuccaccaccuccacccccaccgucaccuccgccgccggccuccagaagucccuccucuccuccaccuccaccaccaccaagaucaccaccggcuccuccuccgccggcacccaguccuccaccuccaaccgccucugggccgaggacuccaccgagaaggagaaggacuccguccccaccgccgucaccauccccgucgcccccaccgucgucaacgccgccgccuccaccaccacccucaccaccaccaccgccggcaccgucuccuccaccaccgagguccgcgagcgccgccgcuccuaccucacccccguccgcgacgaggaguccgagucccagcgcaaggcccgcucccgccaggcccgccagucccgccgcuccacccagggcgucacccucaccgaccuccaggaggccgagaagaccaucggccgcucccgcuccacccgcacccgcgagcaggagaacgaggagaaggagaaggaggagaaggagaagcaggacaaggagaagcaggaggagaagaaggaguccgagaccucccgcgaggacgaguacaagcagaaguacucccgcaccuacgacgagaccuaccagcgcuaccgccccgucuccaccuccuccuccaccacccccuccuccucccucuccaccauguccuccucccucuacgccuccucccagcucaaccgccccaacucccucgucggcaucaccuccgccuacucccgcggcaucaccaaggagaacgagcgcgagggcgagaagcgcgaggaggagaaggagggcgaggacaagucccagcccaaguccauccgcgagcgccgccgcccccgcgagaagcgccgcuccaccggcgucuccuucuggacccaggacuccgacgagaacgagcaggagcagcaguccgacaccgaggagggcuccaacaagaaggagacccagaccgacuccaucucccgcuacgagaccuccuccaccuccgccggcgaccgcuacgacucccuccucggccgcuccggcuccuacuccuaccucgaggagcgcaagcccuacuccucccgccucgagaaggacgacuccaccgacuucaagaagcucuacgagcagauccucgccgagaacgagaagcucaaggcccagcuccacgacaccaacauggagcucaccgaccucaagcuccagcucgagaaggccacccagcgccaggagcgcuucgccgaccgcucccuccucgagauggagaagcgcgagcgccgcgcccucgagcgccgcaucuccgagauggaggaggagcucaagaugcuccccgaccucaaggccgacaaccagcgccucaaggacgagaacggcgcccucauccgcgucaucuccaagcucuccaaguga

SEQ ID NO: 47996 - RNA, 1548 nt, Artificial Sequence
  derived and/or modified sequence opt2 from PPP1R12B__Homo_sapiens__NP_001161329
auggccgagcucgagcaccucggcggcaagcgcgccgaguccgcccgcaugcgccgcgccgagcagcuccgccgcuggcgcggcucccucaccgagcaggagcccgccgagcgccgcggcgccggccgccagccccucacccgccgcggcuccccccgcguccgcuucgaggacggcgccgucuuccucgccgccugcuccuccggcgacaccgacgagguccgcaagcuccucgcccgcggcgccgacaucaacaccgucaacgucgacggccucaccgcccuccaccaggccugcaucgacgagaaccucgacauggucaaguuccucgucgagaaccgcgccaacgucaaccagcaggacaacgagggcuggaccccccuccacgccgccgccuccugcggcuaccucaacaucgccgaguacuucaucaaccacggcgccuccgucggcaucgucaacuccgagggcgagguccccuccgaccucgccgaggagcccgccaugaaggaccuccuccucgagcaggucaagaagcagggcgucgaccucgagcagucccgcaaggaggaggagcagcagaugcuccaggacgcccgccaguggcucaacuccggcaagaucgaggacguccgccaggcccgcuccggcgccaccgcccuccacgucgccgccgccaagggcuacuccgagguccuccgccuccucauccaggccggcuacgagcucaacguccaggacuacgacggcuggaccccccuccacgccgccgcccacuggggcgucaaggaggccugcuccauccucgccgaggcccucugcgacauggacauccgcaacaagcucggccagacccccuucgacgucgccgacgagggccucgucgagcaccucgagcuccuccagaagaagcagaacguccuccgcuccgagaaggagacccgcaacaagcucaucgaguccgaccucaacuccaagauccaguccggcuucuucaagaacaaggagaagaugcucuacgaggaggagacccccaagucccaggagauggaggaggagaacaaggaguccuccuccuccuccuccgaggaggaggagggcgaggacgaggccuccgaguccgagaccgagaaggaggccgacaagaagcccgaggccuucgucaaccacuccaacuccgaguccaaguccuccaucaccgagcagauccccgcccccgcccagaacaccuucuccgccuccuccgcccgccgcuucuccuccggccucuucaacaagcccgaggagcccaaggacgagucccccuccuccuggcgccucggccuccgcaagaccggcucccacaacaugcucuccgaggucgccaacucccgcgagcccauccgcgaccgcggcuccuccaucuaccgcuccuccuccuccccccgcaucuccgcccuccucgacaacaaggacaagguccaguucggccgcgucuggggcaacuccaaggccgucuucuucuuccacgagaacuccauccucggcaccaacgagaacaucuucuga

SEQ ID NO: 47997 - RNA, 2349 nt, Artificial Sequence
  derived and/or modified sequence opt2 from PPP1R12C__Homo_sapiens__NP_060077
auguccggcgaggacggccccgccgccggccccggcgccgccgccgccgccgcccgcgagcgccgccgcgagcagcuccgccaguggggcgcccgcgccggcgccgagcccggccccggcgagcgccgcgcccgcaccguccgcuucgagcgcgccgccgaguuccucgccgccugcgccggcggcgaccucgacgaggcccgccucaugcuccgcgccgccgaccccggccccggcgccgagcucgaccccgccgcccccccccccgcccgcgccguccucgacuccaccaacgccgacggcaucuccgcccuccaccaggccugcaucgacgagaaccucgaggucguccgcuuccucgucgagcagggcgccaccgucaaccaggccgacaacgagggcuggaccccccuccacgucgccgccuccugcggcuaccucgacaucgcccgcuaccuccucucccacggcgccaacaucgccgccgucaacuccgacggcgaccucccccucgaccucgccgaguccgacgccauggagggccuccucaaggccgagaucgcccgccgcggcgucgacgucgaggccgccaagcgcgccgaggaggagcuccuccuccacgacacccgcugcuggcucaacggcggcgccaugcccgaggcccgccacccccgcaccggcgccuccgcccuccacgucgccgccgccaagggcuacaucgaggucaugcgccuccuccuccaggccggcuacgaccccgagcuccgcgacggcgacggcuggaccccccuccacgccgccgcccacuggggcgucgaggacgccugccgccuccucgccgagcacggcggcggcauggacucccucacccacgccggccagcgccccugcgaccucgccgacgaggagguccucucccuccucgaggagcucgcccgcaagcaggaggaccuccgcaaccagaaggaggccucccagucccgcggccaggagccccaggcccccuccuccuccaagcaccgccgcuccuccgucugccgccucuccucccgcgagaagaucucccuccaggaccucuccaaggagcgccgccccggcggcgccggcggcccccccauccaggacgaggacgagggcgaggagggccccaccgagcccccccccgccgagccccgcacccucaacggcgucuccucccccccccaccccucccccaagucccccguccagcucgaggaggcccccuucucccgccgcuucggccuccucaagaccggcuccuccggcgcccucggcccccccgagcgccgcaccgccgagggcgcccccggcgccggccuccagcgcuccgccuccuccuccuggcucgagggcaccuccacccaggccaaggagcuccgccucgcccgcaucacccccacccccucccccaagcuccccgagcccuccguccucuccgaggucaccaagcccccccccugccucgagaacuccuccccccccucccgcauccccgagcccgagucccccgccaagcccaacguccccaccgccuccaccgccccccccgccgacucccgcgaccgccgccgcuccuaccagaugcccguccgcgacgaggaguccgagucccagcgcaaggcccgcucccgccucaugcgccagucccgccgcuccacccagggcgucacccucaccgaccucaaggaggccgagaaggccgccggcaaggcccccgaguccgagaagcccgcccagucccucgaccccucccgccgcccccgcguccccggcgucgagaacuccgacucccccgcccagcgcgccgaggcccccgacggccagggccccggcccccaggccgcccgcgagcaccgcaaggucggcaaggaguggcgcggccccgccgagggcgaggaggccgagcccgccgaccgcucccaggaguccuccacccucgagggcggccccuccgcccgccgccagcgcuggcagcgcgaccucaaccccgagcccgagcccgaguccgaggagcccgacggcggcuuccgcacccucuacgccgagcuccgccgcgagaacgagcgccuccgcgaggcccucaccgagaccacccuccgccucgcccagcucaaggucgagcucgagcgcgccacccagcgccaggagcgcuucgccgagcgccccgcccuccucgagcucgagcgcuucgagcgccgcgcccucgagcgcaaggccgccgagcucgaggaggagcucaaggcccucuccgaccuccgcgccgacaaccagcgccucaaggacgagaacgccgcccucauccgcgucaucuccaagcucuccaaguga

SEQ ID NO: 47998 - RNA, 3273 nt, Artificial Sequence
  derived and/or modified sequence opt2 from PPP1R13B__Homo_sapiens__NP_056131
augaugcccaugauccucaccgucuuccucuccaacaacgagcagauccucaccgagguccccaucacccccgagaccaccugccgcgacgucgucgaguucugcaaggagcccggcgagggcuccugccaccucgccgaggucuggcgcggcaacgagcgccccauccccuucgaccacaugauguacgagcaccuccagaaguggggcccccgccgcgaggaggucaaguucuuccuccgccacgaggacucccccaccgagaacuccgagcagggcggccgccagacccaggagcagcgcacccagcgcaacgucaucaacguccccggcgagaagcgcaccgagaacggcgucggcaacccccgcgucgagcucacccucuccgagcuccaggacauggccgcccgccagcagcagcagaucgagaaccagcagcagaugcucgucgccaaggagcagcgccuccacuuccucaagcagcaggagcgccgccagcagcaguccaucuccgagaacgagaagcuccagaagcucaaggagcgcgucgaggcccaggagaacaagcucaagaagauccgcgccaugcgcggccaggucgacuacuccaagaucaugaacggcaaccucuccgccgagaucgagcgcuucuccgccauguuccaggagaagaagcaggagguccagaccgccauccuccgcgucgaccagcucucccagcagcucgaggaccucaagaagggcaagcucaacggcuuccaguccuacaacggcaagcucaccggccccgccgccgucgagcucaagcgccucuaccaggagcuccagauccgcaaccagcucaaccaggagcagaacuccaagcuccagcagcagaaggagcuccucaacaagcgcaacauggaggucgccaugauggacaagcgcaucuccgagcuccgcgagcgccucuacggcaagaagauccagcucaaccgcgucaacggcaccuccuccccccaguccccccucuccaccuccggccgcgucgccgccgucggccccuacauccagguccccuccgccggcuccuuccccguccucggcgaccccaucaagccccagucccucuccaucgccuccaacgccgcccacggccgcuccaaguccgccaacgacggcaacuggcccacccucaagcagaacuccuccuccuccgucaagcccguccaggucgccggcgccgacuggaaggaccccuccgucgagggcuccgucaagcagggcaccgucuccucccagcccguccccuucuccgcccucggccccaccgagaagcccggcaucgagaucggcaagguccccccccccauccccggcgucggcaagcagcucccccccuccuacggcaccuaccccucccccaccccccucggccccggcuccaccuccucccucgagcgccgcaaggagggcucccucccccgccccuccgccggccuccccucccgccagcgccccacccuccuccccgccaccggcuccaccccccagcccggcuccucccagcagauccagcagcgcaucuccgucccccccucccccaccuacccccccgccggcccccccgccuuccccgccggcgacuccaagcccgagcucccccucaccgucgccauccgccccuuccucgccgacaagggcucccgcccccaguccccccgcaagggcccccagaccgucaacuccuccuccaucuacuccauguaccuccagcaggccaccccccccaagaacuaccagcccgccgcccacuccgcccucaacaaguccgucaaggccgucuacggcaagcccguccuccccuccggcuccaccucccccuccccccuccccuuccuccacggcucccucuccaccggcaccccccagccccagccccccuccgaguccaccgagaaggagcccgagcaggacggccccgccgcccccgccgacggcuccaccgucgagucccucccccgcccccucucccccaccaagcucacccccaucguccacuccccccuccgcuaccaguccgacgccgaccucgaggcccuccgccgcaagcucgccaacgccccccgcccccucaagaagcgcuccuccaucaccgagcccgagggccccggcggccccaacauccagaagcuccucuaccagcgcuucaacacccucgccggcggcauggagggcacccccuucuaccagcccucccccucccaggacuucaugggcacccucgccgacgucgacaacggcaacaccaacgccaacggcaaccucgaggagcucccccccgcccagcccaccgccccccuccccgccgagcccgcccccuccuccgacgccaacgacaacgagcuccccucccccgagcccgaggagcucaucugcccccagaccacccaccagaccgccgagcccgccgaggacaacaacaacaacgucgccaccguccccaccaccgagcagauccccucccccgucgccgaggcccccucccccggcgaggagcaggucccccccgccccccucccccccgccucccacccccccgccaccuccaccaacaagcgcaccaaccucaagaagcccaacuccgagcgcaccggccacggccuccgcguccgcuucaacccccucgcccuccuccucgacgccucccucgagggcgaguucgaccucguccagcgcaucaucuacgaggucgaggaccccuccaagcccaacgacgagggcaucaccccccuccacaacgccgucugcgccggccaccaccacaucgucaaguuccuccucgacuucggcgucaacgucaacgccgccgacuccgacggcuggaccccccuccacugcgccgccuccugcaacuccguccaccucugcaagcagcucgucgaguccggcgccgccaucuucgccuccaccaucuccgacaucgagaccgccgccgacaagugcgaggagauggaggagggcuacauccagugcucccaguuccucuacggcguccaggagaagcucggcgucaugaacaagggcgucgccuacgcccucugggacuacgaggcccagaacuccgacgagcucuccuuccacgagggcgacgcccucaccauccuccgccgcaaggacgaguccgagaccgagugguggugggcccgccucggcgaccgcgagggcuacguccccaagaaccuccucggccucuacccccgcaucaagccccgccagcgcacccucgccuga

SEQ ID NO: 47999 - RNA, 2487 nt, Artificial Sequence
  derived and/or modified sequence opt2 from PPP1R13L__Homo_sapiens__NP_001135974
auggacuccgaggccuuccaguccgcccgcgacuuccucgacaugaacuuccagucccucgccaugaagcacauggaccucaagcagauggagcucgacaccgccgccgccaaggucgacgagcucaccaagcagcucgagucccucugguccgacucccccgccccccccggcccccaggccggcccccccucccgccccccccgcuacuccuccuccuccauccccgagcccuucggcucccgcggcuccccccgcaaggccgccaccgacggcgccgacacccccuucggccgcuccgaguccgcccccacccuccaccccuacuccccccucucccccaagggccgccccuccuccccccgcaccccccucuaccuccagcccgacgccuacggcucccucgaccgcgccaccuccccccgcccccgcgccuucgacggcgccggcuccucccucggccgcgcccccuccccccgccccggccccggcccccuccgccagcagggcccccccacccccuucgacuuccucggccgcgccggcuccccccgcggcuccccccucgccgagggcccccaggccuucuuccccgagcgcggccccuccccccgcccccccgccaccgccuacgacgcccccgccuccgccuucggcuccucccuccucggcuccggcggcuccgccuucgcccccccccuccgcgcccaggacgaccucacccuccgccgccgcccccccaaggccuggaacgaguccgaccucgacgucgccuacgagaagaagcccucccagaccgccuccuacgagcgccucgacgucuucgcccgccccgccucccccucccuccagcuccuccccuggcgcgaguccucccucgacggccucggcggcaccggcaaggacaaccucaccuccgccacccucccccgcaacuacaaggucuccccccucgccuccgaccgccgcuccgacgccggcuccuaccgccgcucccucggcuccgccggccccuccggcacccucccccgcuccuggcagcccgucucccgcauccccaugccccccuccuccccccagccccgcggcgccccccgccagcgccccaucccccucuccaugaucuucaagcuccagaacgccuucugggagcacggcgccucccgcgccaugcuccccggcuccccccucuucacccgcgcccccccccccaagcuccagccccagccccagccccagccccagccccagucccagccccagccccagcuccccccccagccccagacccagccccagacccccacccccgccccccagcacccccagcagaccuggccccccgucaacgagggcccccccaagccccccaccgagcucgagcccgagcccgagaucgagggccuccucacccccguccucgaggccggcgacgucgacgagggccccgucgcccgcccccucucccccacccgccuccagcccgcccucccccccgaggcccaguccguccccgagcucgaggaggucgcccgcguccucgccgagaucccccgcccccucaagcgccgcggcuccauggagcaggcccccgccgucgcccucccccccacccacaagaagcaguaccagcagaucaucucccgccucuuccaccgccacggcggccccggccccggcggccccgagcccgagcucucccccaucaccgagggcuccgaggcccgcgccggcccccccgcccccgccccccccgcccccauccccccccccgcccccucccaguccuccccccccgagcagccccaguccauggagaugcgcuccguccuccgcaaggccggcuccccccgcaaggcccgccgcgcccgccucaacccccucguccuccuccucgacgccgcccucaccggcgagcucgaggucguccagcaggccgucaaggagaugaacgaccccucccagcccaacgaggagggcaucaccgcccuccacaacgccaucugcggcgccaacuacuccaucgucgacuuccucaucaccgccggcgccaacgucaacucccccgacucccacggcuggaccccccuccacugcgccgccuccugcaacgacaccgucaucugcauggcccucguccagcacggcgccgccaucuucgccaccacccucuccgacggcgccaccgccuucgagaagugcgaccccuaccgcgagggcuacgccgacugcgccaccuaccucgccgacgucgagcaguccaugggccucaugaacuccggcgccgucuacgcccucugggacuacuccgccgaguucggcgacgagcucuccuuccgcgagggcgaguccgucaccguccuccgccgcgacggccccgaggagaccgacugguggugggccgcccuccacggccaggagggcuacgucccccgcaacuacuucggccucuucccccgcgucaagccccagcgcuccaaggucuga

SEQ ID NO: 48000 - RNA, 363 nt, Artificial Sequence
  derived and/or modified sequence opt2 from PPP1R14A__Homo_sapiens__NP_001230876
auggccgcccagcgccucggcaagcgcguccucuccaagcuccagucccccucccgcgcccgcggccccggcggcucccccggcggccuccagaagcgccacgcccgcgucaccgucaaguacgaccgccgcgagcuccagcgccgccucgacgucgagaaguggaucgacggccgccucgaggagcucuaccgcggcaugggccuccucaaguccugcggcaagcccgucgaggacuucauccaggagcuccucgccaagcuccagggccuccaccgccagcccggccuccgccagcccucccccucccacgacggcucccucuccccccuccaggaccgcgcccgcaccgcccaccccuga

SEQ ID NO: 48001 - RNA, 444 nt, Artificial Sequence
  derived and/or modified sequence opt2 from PPP1R14B__Homo_sapiens__NP_619634
auggccgacuccggcaccgccggcggcgccgcccucgccgcccccgcccccggccccggcuccggcggccccggcccccgcgucuacuuccaguccccccccggcgccgccggcgagggccccggcggcgccgacgacgagggccccguccgccgccagggcaaggucaccgucaaguacgaccgcaaggagcuccgcaagcgccucaaccucgaggaguggauccucgagcagcucacccgccucuacgacugccaggaggaggagauccccgagcucgagaucgacgucgacgagcuccucgacauggaguccgacgacgcccgcgccgcccgcgucaaggagcuccucgucgacugcuacaagcccaccgaggccuucaucuccggccuccucgacaagauccgcggcaugcagaagcucuccaccccccagaagaaguga

SEQ ID NO: 48002 - RNA, 498 nt, Artificial Sequence
  derived and/or modified sequence opt2 from PPP1R14C__Homo_sapiens__NP_112211
auguccgucgccaccggcuccuccgagaccgccggcggcgccuccggcggcggcgcccgcgucuucuuccaguccccccgcggcggcgccggcggcucccccggcuccuccuccggcuccggcuccucccgcgaggacuccgcccccgucgccaccgccgccgccgccggccagguccagcagcagcagcagcgccgccaccagcagggcaaggucaccgucaaguacgaccgcaaggagcuccgcaagcgccucguccucgaggaguggaucgucgagcagcucggccagcucuacggcugcgaggaggaggagaugcccgaggucgagaucgacaucgacgaccuccucgacgccgacuccgacgaggagcgcgccuccaagcuccaggaggcccucgucgacugcuacaagcccaccgaggaguucaucaaggagcuccucucccgcauccgcggcaugcgcaagcucucccccccccagaagaaguccgucuga

SEQ ID NO: 48003 - RNA, 2025 nt, Artificial Sequence
  derived and/or modified sequence opt2 from PPP1R15A__Homo_sapiens__NP_055145
auggcccccggccaggccccccaccaggccacccccuggcgcgacgcccaccccuucuuccuccucucccccgucaugggccuccucucccgcgccuggucccgccuccgcggccucggcccccucgagcccuggcucgucgaggccgucaagggcgccgcccucgucgaggccggccucgagggcgaggcccgcaccccccucgccaucccccacacccccuggggccgccgccccgaggaggaggccgaggacuccggcggccccggcgaggaccgcgagacccucggccucaagaccuccuccucccuccccgaggccuggggccuccucgacgacgacgacggcauguacggcgagcgcgaggccaccuccgucccccgcggccagggcucccaguucgccgacggccagcgcgccccccucucccccucccuccucauccgcacccuccagggcuccgacaagaaccccggcgaggagaaggccgaggaggagggcgucgccgaggaggagggcgucaacaaguucuccuacccccccucccaccgcgagugcugccccgccgucgaggaggaggacgacgaggaggccgucaagaaggaggcccaccgcaccuccaccuccgcccucucccccggcuccaagcccuccaccugggucuccugccccggcgaggaggagaaccaggccaccgaggacaagcgcaccgagcgcuccaagggcgcccgcaagaccuccgucuccccccgcuccuccggcuccgacccccgcuccugggaguaccgcuccggcgaggccuccgaggagaaggaggagaaggcccacaaggagaccggcaagggcgaggccgcccccggcccccaguccuccgcccccgcccagcgcccccagcucaaguccugguggugccagcccuccgacgaggaggagggcgaggucaaggcccucggcgccgccgagaaggacggcgaggccgagugcccccccugcauccccccccccuccgccuuccucaaggccugggucuacuggcccggcgaggacaccgaggaggaggaggacgaggaggaggacgaggacuccgacuccggcuccgacgaggaggagggcgaggccgaggccuccuccuccacccccgccaccggcgucuuccucaaguccugggucuaccagcccggcgaggacaccgaggaggaggaggacgaggacuccgacaccggcuccgccgaggacgagcgcgaggccgagaccuccgccuccaccccccccgccuccgccuuccucaaggccugggucuaccgccccggcgaggacaccgaggaggaggaggacgaggacgucgacuccgaggacaaggaggacgacuccgaggccgcccucggcgaggccgaguccgacccccaccccucccaccccgaccagcgcgcccacuuccgcggcuggggcuaccgccccggcaaggagaccgaggaggaggaggccgccgaggacuggggcgaggccgagcccugccccuuccgcgucgccaucuacguccccggcgagaagccccccccccccugggcccccccccgccucccccuccgccuccagcgccgccucaagcgccccgagacccccacccacgaccccgaccccgagaccccccucaaggcccgcaagguccgcuucuccgagaaggucaccguccacuuccucgccgucugggccggccccgcccaggccgcccgccagggccccugggagcagcucgcccgcgaccgcucccgcuucgcccgccgcaucacccaggcccaggaggagcucucccccugccucacccccgccgcccgcgcccgcgccugggcccgccuccgcaaccccccccucgcccccauccccgcccucacccagacccuccccuccuccuccguccccuccucccccguccagaccaccccccucucccaggccgucgccacccccucccgcuccuccgccgccgccgccgccgcccucgaccucuccggccgccgcggcuga

SEQ ID NO: 48004 - RNA, 2142 nt, Artificial Sequence
  derived and/or modified sequence opt2 from PPP1R15B__Homo_sapiens__NP_116222
auggagcccggcaccggcggcucccgcaagcgccucggcccccgcgccggcuuccgcuucuggccccccuucuucccccgccgcucccaggccggcuccuccaaguuccccaccccccucggccccgagaacuccggcaaccccacccuccucuccuccgcccagcccgagacccgcgucuccuacuggaccaagcuccucucccagcuccucgccccccuccccggccuccuccagaagguccucaucuggucccagcucuucggcggcauguuccccacccgcuggcucgacuucgccggcgucuacuccgcccuccgcgcccucaagggccgcgagaagcccgccgcccccaccgcccagaagucccucuccucccuccagcucgacuccuccgaccccuccgucaccuccccccucgacuggcucgaggagggcauccacuggcaguacuccccccccgaccucaagcucgagcucaaggccaagggcuccgcccucgaccccgccgcccaggccuuccuccucgagcagcagcucuggggcgucgagcuccuccccuccucccuccagucccgccucuacuccaaccgcgagcucggcuccucccccuccggcccccucaacauccagcgcaucgacaacuucuccgucgucuccuaccuccucaaccccuccuaccucgacugcuucccccgccucgaggucuccuaccagaacuccgacggcaacuccgaggucgucggcuuccagacccucacccccgaguccuccugccuccgcgaggaccacugccacccccagccccucuccgccgagcucauccccgccuccuggcagggcugccccccccucuccaccgagggccuccccgagauccaccaccuccgcaugaagcgccucgaguuccuccagcaggccuccaagggccaggaccuccccacccccgaccaggacaacggcuaccacucccucgaggaggagcacucccuccuccgcauggaccccaagcacugccgcgacaaccccacccaguucguccccgccgccggcgacauccccggcaacacccaggaguccaccgaggagaagaucgagcuccucaccaccgaggucccccucgcccucgaggaggagucccccuccgagggcugccccuccuccgagauccccauggagaaggagcccggcgagggccgcaucuccgucgucgacuacuccuaccucgagggcgaccuccccaucuccgcccgccccgccugcuccaacaagcucaucgacuacauccucggcggcgccuccuccgaccucgagaccuccuccgaccccgagggcgaggacugggacgaggaggccgaggacgacggcuucgacuccgacuccucccucuccgacuccgaccucgagcaggaccccgagggccuccaccucuggaacuccuucugcuccgucgaccccuacaacccccagaacuucaccgccaccauccagaccgccgcccgcaucguccccgaggagcccuccgacuccgagaaggaccucuccggcaaguccgaccucgagaacuccucccaguccggcucccuccccgagacccccgagcacuccuccggcgaggaggacgacugggaguccuccgccgacgaggccgagucccucaagcucuggaacuccuucugcaacuccgacgaccccuacaacccccucaacuucaaggcccccuuccagaccuccggcgagaacgagaagggcugccgcgacuccaagacccccuccgaguccaucgucgccaucuccgagugccacacccuccucuccugcaagguccagcuccucggcucccaggaguccgagugccccgacuccguccagcgcgacguccucuccggcggccgccacacccacgucaagcgcaagaaggucaccuuccucgaggaggucaccgaguacuacaucuccggcgacgaggaccgcaagggccccugggaggaguucgcccgcgacggcugccgcuuccagaagcgcauccaggagaccgaggacgccaucggcuacugccucaccuucgagcaccgcgagcgcauguucaaccgccuccagggcaccugcuucaagggccucaacguccucaagcagugcuga

SEQ ID NO: 48005 - RNA, 315 nt, Artificial Sequence
  derived and/or modified sequence opt2 from PPP1R17__Homo_sapiens__NP_001138595
augauguccaccgagcagaugcagccccucgagcucuccgaggaccgccucgacaagcucgacccccgcugcucccaccucggcgucuucuccgagcaccucaucaagcgcuacgacguccaggagcgccaccccaagggcaagaugauccccguccuccacaacaccgaccucgagcagaagaagccccgccgcaaggacacccccgcccuccacaugucccccuucgccgccggcgucacccuccuccgcgacgagcgccccaaggccaucgucgaggacgacgagaaggacggcgacaagaucgccaucuga

SEQ ID NO: 48006 - RNA, 1842 nt, Artificial Sequence
  derived and/or modified sequence opt2 from PPP1R18__Homo_sapiens__NP_001128342
auggccaccauccccgacuggaagcuccagcuccucgcccgccgccgccaggaggaggccuccguccgcggccgcgagaaggccgagcgcgagcgccucucccagaugcccgccuggaagcgcggccuccucgagcgccgccgcgccaagcucggccucucccccggcgagcccucccccguccucggcaccgucgaggccggcccccccgaccccgacgaguccgccguccuccucgaggccaucggccccguccaccagaaccgcuucauccgccaggagcgccagcagcagcagcagcagcagcagcgcuccgaggagcuccucgccgagcgcaagcccggcccccucgaggcccgcgagcgccgccccucccccggcgagaugcgcgaccagucccccaagggccgcgagucccgcgaggagcgccucuccccccgcgagacccgcgagcgccgccucggcaucggcggcgcccaggagcucucccuccgcccccucgaggcccgcgacuggcgccagucccccggcgaggucggcgaccgcuccucccgccucuccgaggccuggaaguggcgccucucccccggcgagacccccgagcgcucccuccgccucgccgagucccgcgagcaguccccccgccgcaaggaggucgagucccgccucucccccggcgaguccgccuaccagaagcucggccucaccgaggcccacaaguggcgccccgacucccgcgagucccaggagcagucccucguccagcucgaggccaccgaguggcgccuccgcuccggcgaggagcgccaggacuacuccgaggagugcggccgcaaggaggaguggcccguccccggcgucgcccccaaggagaccgccgagcucuccgagacccucacccgcgaggcccagggcaacuccuccgccggcgucgaggccgccgagcagcgccccgucgaggacggcgagcgcggcaugaagcccaccgagggcuggaaguggacccucaacuccggcaaggcccgcgaguggaccccccgcgacaucgaggcccagacccagaagcccgagccccccgaguccgccgagaagcuccucgagucccccggcgucgaggccggcgagggcgaggccgagaaggaggaggccggcgcccagggccgcccccuccgcgcccuccagaacugcugcuccguccccuccccccucccccccgaggacgccggcaccggcggccuccgccagcaggaggaggaggccgucgagcuccagccccccccccccgccccccucuccccccccccccccgcccccaccgccccccagccccccggcgacccccucaugucccgccucuucuacggcgucaaggccggccccggcgucggcgccccccgccgcuccggccacaccuucaccgucaacccccgccgcuccgucccccccgccacccccgccacccccaccucccccgccaccgucgacgccgccguccccggcgccggcaagaagcgcuaccccaccgccgaggagauccucguccucggcggcuaccuccgccucucccgcuccugccucgccaagggcucccccgagcgccaccacaagcagcucaagaucuccuucuccgagaccgcccucgagaccaccuaccaguaccccuccgaguccuccguccucgaggagcucggccccgagcccgagguccccuccgcccccaacccccccgccgcccagcccgacgacgaggaggacgaggaggagcuccuccuccuccagcccgagcuccagggcggccuccgcaccaaggcccucaucgucgacgaguccugccgccgcuga

SEQ ID NO: 48007 - RNA, 516 nt, Artificial Sequence
  derived and/or modified sequence opt2 from PPP1R1A__Homo_sapiens__NP_006732
auggagcaggacaacuccccccgcaagauccaguucaccgucccccuccucgagccccaccucgaccccgaggccgccgagcagauccgccgccgccgccccacccccgccacccucguccucaccuccgaccaguccucccccgagaucgacgaggaccgcauccccaacccccaccucaaguccacccucgccauguccccccgccagcgcaagaagaugacccgcaucacccccaccaugaaggagcuccagaugauggucgagcaccaccucggccagcagcagcagggcgaggagcccgagggcgccgccgaguccaccggcacccaggagucccgcccccccggcauccccgacaccgaggucgagucccgccucggcaccuccggcaccgccaagaagaccgccgagugcauccccaagacccacgagcgcggcuccaaggagcccuccaccaaggagcccuccacccacauccccccccucgacuccaagggcgccaacuccgucuga

SEQ ID NO: 48008 - RNA, 615 nt, Artificial Sequence
  derived and/or modified sequence opt2 from PPP1R1B__Homo_sapiens__NP_115568
auggaccccaaggaccgcaagaagauccaguucuccguccccgccccccccucccagcucgacccccgccaggucgagaugauccgccgccgccgccccacccccgccaugcucuuccgccucuccgagcacuccucccccgaggaggaggccuccccccaccagcgcgccuccggcgagggccaccaccucaaguccaagcgccccaaccccugcgccuacaccccccccucccucaaggccguccagcgcaucgccgagucccaccuccaguccaucuccaaccucaacgagaaccaggccuccgaggaggaggacgagcucggcgagcuccgcgagcucggcuacccccgcgaggaggacgaggaggaggaggaggacgacgaggaggaggaggaggaggaggacucccaggccgagguccucaaggucauccgccaguccgccggccagaagaccaccugcggccagggccucgagggccccugggagcgcccccccccccucgacgaguccgagcgcgacggcggcuccgaggaccaggucgaggaccccgcccucuccgagcccggcgaggagccccagcgccccucccccuccgagcccggcaccuga

SEQ ID NO: 48009 - RNA, 618 nt, Artificial Sequence
  derived and/or modified sequence opt2 from PPP1R2__Homo_sapiens__NP_006232
auggccgccuccaccgccucccaccgccccaucaagggcauccucaagaacaagaccuccaccaccuccuccauggucgccuccgccgagcagccccgcggcaacgucgacgaggagcucuccaagaagucccagaagugggacgagaugaacauccucgccaccuaccaccccgccgacaaggacuacggccucaugaagaucgacgagcccuccacccccuaccacuccaugaugggcgacgacgaggacgccugcuccgacaccgaggccaccgaggccauggcccccgacauccucgcccgcaagcucgccgccgccgagggccucgagcccaaguaccgcauccaggagcaggaguccuccggcgaggaggacuccgaccucucccccgaggagcgcgagaagaagcgccaguucgagaugaagcgcaagcuccacuacaacgagggccucaacaucaagcucgcccgccagcucaucuccaaggaccuccacgacgacgacgaggacgaggagaugcucgagaccgccgacggcgaguccaugaacaccgaggaguccaaccagggcuccacccccuccgaccagcagcagaacaagcuccgcuccuccuga

SEQ ID NO: 48010 - RNA, 3369 nt, Artificial Sequence
  derived and/or modified sequence opt2 from PPP1R3A__Homo_sapiens__NP_002702
auggagcccuccgagguccccucccagaucuccaaggacaacuuccucgagguccccaaccucuccgacucccucugcgaggacgaggaggucaccuuccagcccggcuucuccccccagcccucccgccgcggcuccgacuccuccgaggacaucuaccucgacacccccuccuccggcacccgccgcgucuccuucgccgacuccuucggcuucaaccucgucuccgucaaggaguucgacugcugggagcuccccuccgccuccaccaccuucgaccucggcaccgacaucuuccacaccgaggaguacguccucgccccccucuucgaccuccccuccuccaaggaggaccucaugcagcagcuccagauccagaaggccauccucgaguccaccgagucccuccucggcuccaccuccaucaagggcaucauccgcguccucaacgucuccuucgagaagcucgucuacguccgcaugucccucgacgacuggcagacccacuacgacauccucgccgaguacguccccaacuccugcgacggcgagaccgaccaguucuccuucaagaucguccucgucccccccuaccagaaggacggcuccaaggucgaguucugcauccgcuacgagaccuccgucggcaccuucugguccaacaacaacggcaccaacuacaccuucaucugccagaagaaggagcaggagcccgagcccgucaagcccuggaaggagguccccaaccgccagaucaagggcugccucaaggucaaguccuccaaggaggaguccuccgucaccuccgaggagaacaacuucgagaaccccaagaacaccgacaccuacauccccaccaucaucugcucccacgaggacaaggaggaccucgaggccuccaaccgcaacgucaaggacgucaaccgcgagcacgacgagcacaacgagaaggagcucgagcucaugaucaaccagcaccucauccgcacccgcuccaccgccucccgcgacgagcgcaacaccuucuccaccgaccccgucaacuuccccaacaaggccgagggccucgagaagaagcagauccacggcgagaucugcaccgaccucuuccagcgcucccucucccccuccuccuccgccgaguccuccgucaagggcgacuucuacugcaacgagaaguacuccuccggcgacgacugcacccaccagcccuccgaggagaccaccuccaacaugggcgagaucaagcccucccucggcgacaccuccuccgacgagcucguccagcuccacaccggcuccaaggagguccucgacgacaacgccaaccccgcccacggcaacggcaccguccagauccccugccccuccuccgaccagcucauggccggcaaccucaacaagaagcacgagggcggcgccaagaacaucgaggucaaggaccucggcugccuccgccgcgacuuccacuccgacaccuccgccugccucaaggaguccaccgaggagggcuccuccaaggaggacuacuacggcaacggcaaggacgacgaggagcagcgcaucuaccucggcgucaacgagaagcagcgcaagaacuuccagaccauccuccacgaccaggagcgcaagaugggcaaccccaagaucuccgucgccggcaucggcgccuccaaccgcgaccucgccacccuccucuccgagcacaccgccauccccacccgcgccaucaccgccgacgucucccacuccccccgcaccaaccucuccugggaggaggccguccucacccccgagcaccaccaccucaccuccgagggcuccgcccucggcggcaucaccggccaggucugcuccucccgcaccggcaacguccuccgcaacgacuaccucuuccaggucgaggagaaguccggcggcaucaacuccgaggaccaggacaacuccccccagcacaagcaguccuggaacguccucgagucccagggcaagucccgcgagaacaagaccaacaucaccgagcacaucaagggccagaccgacugcgaggacgucuggggcaagcgcgacaacacccgcucccucaaggccaccaccgaggagcucuucaccugccaggagaccgucugcugcgagcucuccucccucgccgaccacggcaucaccgagaaggccgaggccggcaccgccuacaucaucaagaccaccuccgaguccacccccgaguccauguccgcccgcgagaaggccaucaucgccaagcucccccaggagaccgcccgcuccgaccgccccaucgaggucaaggagaccgccuucgacccccacgagggccgcaacgacgacucccacuacacccucugccagcgcgacaccgucggcgucaucuacgacaacgacuucgagaaggagucccgccucggcaucugcaacguccgcgucgacgagauggagaaggaggagaccauguccauguacaacccccgcaagacccacgaccgcgagaagugcggcaccggcaacaucaccuccgucgaggaguccuccugggucaucaccgaguaccagaaggccaccuccaagcucgaccuccagcucggcaugcuccccaccgacaagaccgucuucuccgagaaccgcgaccuccgccagguccaggagcucuccaagaagaccgacuccgacgccaucguccacuccgccuucaacuccgacaccaaccgcgccccccagaacuccucccccuucuccaagcaccacaccgagaucuccgucuccaccaacgagcaggccaucgccgucgagaacgccgucaccaccauggccucccagcccaucuccaccaaguccgagaacaucugcaacuccacccgcgagauccagggcaucgagaagcaccccuaccccgaguccaagcccgaggaggucucccgcuccuccggcaucgucaccuccggcucccgcaaggagcgcugcaucggccagaucuuccagaccgaggaguacuccgucgagaagucccucggccccaugauccucaucaacaagccccucgagaacauggaggaggcccgccacgagaacgagggccucgucuccuccggccagucccucuacaccuccggcgagaaggaguccgacuccuccgccuccaccucccuccccgucgaggagucccaggcccagggcaacgagucccucuucuccaaguacaccaacuccaagauccccuacuuccuccucuuccucaucuuccucaucaccgucuaccacuacgaccucaugaucggccucaccuucuacguccucucccucuccuggcucuccugggaggagggccgccagaaggaguccgucaagaagaaguga

SEQ ID NO: 48011 - RNA, 858 nt, Artificial Sequence
  derived and/or modified sequence opt2 from PPP1R3B__Homo_sapiens__NP_078883
augauggccgucgacaucgaguaccgcuacaacugcauggcccccucccuccgccaggagcgcuucgccuucaagaucucccccaagcccuccaagccccuccgccccugcauccagcucuccuccaagaacgaggccuccggcauggucgcccccgccguccaggagaagaaggucaagaagcgcgucuccuucgccgacaaccagggccucgcccucaccauggucaaggucuucuccgaguucgacgacccccucgacaugcccuucaacaucaccgagcuccucgacaacaucgucucccucaccaccgccgaguccgaguccuucguccucgacuucucccagcccuccgccgacuaccucgacuuccgcaaccgccuccaggccgaccacgucugccucgagaacugcguccucaaggacaaggccaucgccggcaccgucaagguccagaaccucgccuucgagaagaccgucaagauccgcaugaccuucgacaccuggaaguccuacaccgacuuccccugccaguacgucaaggacaccuacgccggcuccgaccgcgacaccuucuccuucgacaucucccuccccgagaagauccaguccuacgagcgcauggaguucgccgucuacuacgagugcaacggccagaccuacugggacuccaaccgcggcaagaacuaccgcaucauccgcgccgagcucaaguccacccagggcaugaccaagccccacuccggccccgaccucggcaucuccuucgaccaguucggcuccccccgcugcuccuacggccucuuccccgaguggcccuccuaccucggcuacgagaagcucggccccuacuacuga

SEQ ID NO: 48012 - RNA, 954 nt, Artificial Sequence
  derived and/or modified sequence opt2 from PPP1R3C__Homo_sapiens__NP_005389
auguccugcacccgcaugauccagguccucgacccccgcccccucaccuccuccgucaugcccgucgacgucgccaugcgccucugccucgcccacuccccccccgucaaguccuuccucggccccuacgacgaguuccagcgccgccacuucgucaacaagcucaagccccucaaguccugccucaacaucaagcacaaggccaagucccagaacgacuggaagugcucccacaaccaggccaagaagcgcgucgucuucgccgacuccaagggccucucccucaccgccauccacgucuucuccgaccuccccgaggagcccgccugggaccuccaguucgaccuccucgaccucaacgacaucuccuccgcccucaagcaccacgaggagaagaaccucauccucgacuucccccagcccuccaccgacuaccucuccuuccgcucccacuuccagaagaacuucgucugccucgagaacugcucccuccaggagcgcaccgucaccggcaccgucaaggucaagaacgucuccuucgagaagaagguccagauccgcaucaccuucgacuccuggaagaacuacaccgacgucgacugcgucuacaugaagaacgucuacggcggcaccgacuccgacaccuucuccuucgccaucgaccucccccccgucauccccaccgagcagaagaucgaguucugcaucuccuaccacgccaacggccaggucuucugggacaacaacgacggccagaacuaccgcaucguccacguccaguggaagcccgacggcguccagacccagauggccccccaggacugcgccuuccaccagaccucccccaagaccgagcucgaguccaccaucuucggcuccccccgccucgccuccggccucuuccccgaguggcaguccuggggccgcauggagaaccucgccuccuaccgcuga

SEQ ID NO: 48013 - RNA, 687 nt, Artificial Sequence
  derived and/or modified sequence opt2 from PPP1R42__Homo_sapiens__NP_001013648
augguccgccucacccucgaccucaucgcccgcaacuccaaccucaagccccgcaaggaggagaccaucucccagugccucaagaagaucacccacaucaacuucuccgacaagaacaucgacgccaucgaggaccucucccucugcaagaaccucuccguccucuaccucuacgacaacugcaucucccagaucaccaaccucaacuacgccaccaaccucacccaccucuaccuccagaacaacugcaucuccugcaucgagaaccuccgcucccucaagaagcucgagaagcucuaccucggcggcaacuacaucgccgucaucgagggccucgagggccucggcgagcuccgcgagcuccacgucgagaaccagcgccucccccucggcgagaagcuccucuucgacccccgcacccuccacucccucgccaagucccucugcauccucaacaucuccaacaacaacaucgacgacaucaccgaccucgagcuccucgagaaccucaaccagcucaucgccgucgacaaccagcuccuccacgucaaggaccucgaguuccuccucaacaagcucaugaagcucuggaagaucgaccucaacggcaaccccgucugccucaagcccaaguaccgcgaccgccucauccucgucuccaagucccucggcaccuaccucuacuga

SEQ ID NO: 48014 - RNA, 954 nt, Artificial Sequence
  derived and/or modified sequence opt2 from PPP1R7__Homo_sapiens__NP_001269338
auggccgccgagcgcggcgccggccagcagcagucccaggagaugauggaggaggagcacgagcuccccgucgacauggagaccaucaaccucgaccgcgacgccgaggacgucgaccucaaccacuaccgcaucggcaagaucgagggcuucgagguccucaagaaggucaagacccucugccuccgccagaaccucaucaagugcaucgagaaccucgaggagcuccagucccuccgcgagcucgaccucuacgacaaccagaucaagaagaucgagaaccucgaggcccucaccgagcucgagauccucgacaucuccuucaaccuccuccgcaacaucgagggcgucgacaagcucacccgccucaagaagcucuuccucgucaacaacaagaucuccaagaucgagaaccucuccaaccuccaccagcuccagaugcucgagcucggcuccaaccgcauccgcgccaucgagaacaucgacacccucaccaaccucgagucccucuuccucggcaagaacaagaucaccaagcuccagaaccucgacgcccucaccaaccucaccguccucuccaugcaguccaaccgccucaccaagaucgagggccuccagaaccucgucaaccuccgcgagcucuaccucucccacaacggcaucgaggucaucgagggccucgagaacaacaacaagcucaccaugcucgacaucgccuccaaccgcaucaagaagaucgagaacaucucccaccucaccgagcuccaggaguucuggaugaacgacaaccuccucgaguccugguccgaccucgacgagcucaagggcgcccgcucccucgagaccgucuaccucgagcgcaacccccuccagaaggacccccaguaccgccgcaaggucaugcucgcccuccccuccguccgccagaucgacgccaccuucguccgcuucuga

SEQ ID NO: 48015 - RNA, 4125 nt, Artificial Sequence
  derived and/or modified sequence opt2 from PPP1R9A__Homo_sapiens__NP_001159632
augcucaagaccgaguccuccggcgagcgcaccacccuccgcuccgccuccccccaccgcaacgccuaccgcaccgaguuccaggcccucaaguccaccuucgacaagcccaaguccgacggcgagcagaagaccaaggagggcgagggcucccagcagucccgcggccgcaaguacggcuccaacgucaaccgcaucaagaaccucuucaugcagaugggcauggagcccaacgagaacgccgccgucaucgccaagacccgcggcaagggcggccacuccuccccccagcgccgcaugaagcccaaggaguuccucgagaagaccgacggcuccgucgucaagcucgaguccuccgucuccgagcgcaucucccgcuucgacaccauguacgacggccccuccuacuccaaguucaccgagacccgcaagauguucgagcgcuccguccacgaguccggccagaacaaccgcuacucccccaagaaggagaaggccggcggcuccgagccccaggacgaguggggcggcuccaaguccaaccgcggcuccaccgacucccucgacucccucuccucccgcaccgaggccgucucccccaccgucucccagcucuccgccgucuucgagaacaccgacucccccuccgccaucaucuccgagaaggccgagaacaacgaguacuccgucaccggccacuacccccucaaccuccccuccgucaccgucaccaaccucgacaccuucggccaccucaaggacuccaacuccuggccccccuccaacaagcgcggcgucgacaccgaggacgcccacaaguccaacgccacccccguccccgaggucgccuccaaguccaccucccucgccuccauccccggcgaggagauccagcaguccaaggagcccgaggacuccaccuccaaccagcagacccccgacuccaucgacaaggacggccccgaggagcccugcgccgaguccaaggccaugcccaaguccgagauccccuccccccagucccagcuccucgaggacgccgaggccaaccucgucggccgcgaggccgccaagcagcagcgcaaggagcucgccggcggcgacuucaccucccccgacgccuccgccuccuccugcggcaaggagguccccgaggacuccaacaacuucgacggcucccacgucuacaugcacuccgacuacaacgucuaccgcguccgcucccgcuacaacuccgacuggggcgagaccggcaccgagcaggacgaggaggaggacuccgacgagaacuccuacuaccagcccgacauggaguacuccgagaucgucggccuccccgaggaggaggagauccccgccaaccgcaagaucaaguucuccuccgcccccaucaaggucuucaacaccuacuccaacgaggacuacgaccgccgcaacgacgaggucgaccccgucgccgccuccgccgaguacgagcucgagaagcgcgucgagaagcucgagcucuuccccgucgagcucgagaaggacgaggacggccucggcaucuccaucaucggcaugggcgucggcgccgacgccggccucgagaagcucggcaucuucgucaagaccgucaccgagggcggcgccgcccagcgcgacggccgcauccaggucaacgaccagaucgucgaggucgacggcaucucccucgucggcgucacccagaacuucgccgccaccguccuccgcaacaccaagggcaacguccgcuucgucaucggccgcgagaagcccggccaggucuccgaggucgcccagcucaucucccagacccucgagcaggagcgccgccagcgcgagcuccucgagcagcacuacgcccaguacgacgccgacgacgacgagaacaccgucgccgagcuccagggcauguccggcaacugcaacaacaacaacaacuacuuccucaagaccggcgaguacgccaccgacgaggaggaggacgaggucggccccguccuccccggcuccgacauggccaucgaggucuucgagcuccccgagaacgaggacauguucucccccuccgagcucgacaccuccaagcucucccacaaguucaaggagcuccagaucaagcacgccgucaccgaggccgagauccagaagcucaagaccaagcuccaggccgccgagaacgagaagguccgcugggagcucgagaagacccagcuccagcagaacaucgaggagaacaaggagcgcaugcucaagcucgaguccuacuggaucgaggcccagacccucugccacaccgucaacgagcaccucaaggagacccagucccaguaccaggcccucgagaagaaguacaacaaggccaagaagcucaucaaggacuuccagcagaaggagcucgacuucaucaagcgccaggaggccgagcgcaagaagaucgaggaccucgagaaggcccaccucgucgagguccagggccuccagguccgcauccgcgaccucgaggccgaggucuuccgccuccucaagcagaacggcacccaggucaacaacaacaacaacaucuucgagcgccgcaccucccucggcgaggucuccaagggcgacaccauggagaaccucgacggcaagcagaccuccugccaggacggccucucccaggaccucaacgaggccguccccgagaccgagcgccucgacuccaaggcccucaagacccgcgcccagcucuccgucaagaaccgccgccagcgccccucccgcacccgccucuacgacuccgucuccuccaccgacggcgaggacucccucgagcgcaagcccuccaacuccuucuacaaccacaugcacaucaccaagcuccucccccccaagggccuccgcaccuccucccccgaguccgacuccggcguccccccccucacccccgucgacuccaacguccccuucuccuccgaccacaucgccgaguuccaggaggagccccucgaccccgagaugggcccccucuccuccauguggggcgacaccucccucuucuccaccuccaaguccgaccacgacgucgaggagucccccugccaccaccagaccaccaacaagaagauccuccgcgagaaggacgacgccaaggaccccaagucccuccgcgccuccuccucccucgccguccagggcggcaagaucaagcgcaaguucgucgaccucggcgccccccuccgccgcaacuccuccaagggcaagaaguggaaggagaaggagaaggaggccucccgcuucuccgccggcucccgcaucuuccgcggccgccucgagaacuggacccccaagcccugcuccaccgcccagaccuccacccgcucccccugcaugcccuucuccugguucaacgacucccgcaagggcuccuacuccuuccgcaaccuccccgcccccaccuccucccuccagcccucccccgagacccucaucuccgacaagaagggcuccaaggucgagaacaccuggaucaccaaggccaacaagcgcaaccccaaccccuccuccuccuccaucuucggccgccacucccagcucauguccgucgucuggauccaggagaccaacaacuucaccuucaacgacgacuucucccccuccuccaccuccuccgccgaccucuccggccucggcgccgagcccaagacccccggccucucccagucccucgcccucuccuccgacgagauccucgacgacggccagucccccaagcacucccagugccagaaccgcgccguccaggagugguccguccagcaggucucccacuggcucaugucccucaaccucgagcaguacgucuccgaguucuccgcccagaacaucaccggcgagcagcuccuccagcucgacggcaacaagcucaaggcccucggcaugaccgccucccaggaccgcgccgucgucaagaagaagcucaaggagaugaagaugucccucgagaaggcccgcaaggcccaggagaagauggagaagcagcgcgagaagcuccgccgcaaggagcaggagcagaugcagcgcaaguccaagaagaccgagaagaugaccuccaccaccgccgagggcgccggcgagcaguga

SEQ ID NO: 48016 - RNA, 930 nt, Artificial Sequence
  derived and/or modified sequence opt2 from PPP2CA__Homo_sapiens__NP_002706
auggacgagaaggucuucaccaaggagcucgaccaguggaucgagcagcucaacgagugcaagcagcucuccgagucccaggucaagucccucugcgagaaggccaaggagauccucaccaaggaguccaacguccaggagguccgcugccccgucaccgucugcggcgacguccacggccaguuccacgaccucauggagcucuuccgcaucggcggcaagucccccgacaccaacuaccucuucaugggcgacuacgucgaccgcggcuacuacuccgucgagaccgucacccuccucgucgcccucaagguccgcuaccgcgagcgcaucaccauccuccgcggcaaccacgagucccgccagaucacccaggucuacggcuucuacgacgagugccuccgcaaguacggcaacgccaacgucuggaaguacuucaccgaccucuucgacuaccucccccucaccgcccucgucgacggccagaucuucugccuccacggcggccucucccccuccaucgacacccucgaccacauccgcgcccucgaccgccuccaggaggucccccacgagggccccaugugcgaccuccucugguccgaccccgacgaccgcggcggcuggggcaucuccccccgcggcgccggcuacaccuucggccaggacaucuccgagaccuucaaccacgccaacggccucacccucgucucccgcgcccaccagcucgucauggagggcuacaacuggugccacgaccgcaacgucgucaccaucuucuccgcccccaacuacugcuaccgcugcggcaaccaggccgccaucauggagcucgacgacacccucaaguacuccuuccuccaguucgaccccgccccccgccgcggcgagccccacgucacccgccgcacccccgacuacuuccucuga

SEQ ID NO: 48017 - RNA, 930 nt, Artificial Sequence
  derived and/or modified sequence opt2 from PPP2CB__Homo_sapiens__NP_001009552
auggacgacaaggccuucaccaaggagcucgaccagugggucgagcagcucaacgagugcaagcagcucaacgagaaccagguccgcacccucugcgagaaggccaaggagauccucaccaaggaguccaacguccaggagguccgcugccccgucaccgucugcggcgacguccacggccaguuccacgaccucauggagcucuuccgcaucggcggcaagucccccgacaccaacuaccucuucaugggcgacuacgucgaccgcggcuacuacuccgucgagaccgucacccuccucgucgcccucaagguccgcuaccccgagcgcaucaccauccuccgcggcaaccacgagucccgccagaucacccaggucuacggcuucuacgacgagugccuccgcaaguacggcaacgccaacgucuggaaguacuucaccgaccucuucgacuaccucccccucaccgcccucgucgacggccagaucuucugccuccacggcggccucucccccuccaucgacacccucgaccacauccgcgcccucgaccgccuccaggaggucccccacgagggccccaugugcgaccuccucugguccgaccccgacgaccgcggcggcuggggcaucuccccccgcggcgccggcuacaccuucggccaggacaucuccgagaccuucaaccacgccaacggccucacccucgucucccgcgcccaccagcucgucauggagggcuacaacuggugccacgaccgcaacgucgucaccaucuucuccgcccccaacuacugcuaccgcugcggcaaccaggccgccaucauggagcucgacgacacccucaaguacuccuuccuccaguucgaccccgccccccgccgcggcgagccccacgucacccgccgcacccccgacuacuuccucuga

SEQ ID NO: 48018 - RNA, 1770 nt, Artificial Sequence
  derived and/or modified sequence opt2 from PPP2R1A__Homo_sapiens__NP_055040
auggccgccgccgacggcgacgacucccucuaccccaucgccguccucaucgacgagcuccgcaacgaggacguccagcuccgccucaacuccaucaagaagcucuccaccaucgcccucgcccucggcgucgagcgcacccgcuccgagcuccuccccuuccucaccgacaccaucuacgacgaggacgagguccuccucgcccucgccgagcagcucggcaccuucaccacccucgucggcggccccgaguacguccacugccuccuccccccccucgagucccucgccaccgucgaggagaccgucguccgcgacaaggccgucgagucccuccgcgccaucucccacgagcacucccccuccgaccucgaggcccacuucgucccccucgucaagcgccucgccggcggcgacugguucaccucccgcaccuccgccugcggccucuucuccgucugcuacccccgcgucuccuccgccgucaaggccgagcuccgccaguacuuccgcaaccucugcuccgacgacacccccaugguccgccgcgccgccgccuccaagcucggcgaguucgccaagguccucgagcucgacaacgucaaguccgagaucauccccauguucuccaaccucgccuccgacgagcaggacuccguccgccuccucgccgucgaggccugcgucaacaucgcccagcuccucccccaggaggaccucgaggcccucgucaugcccacccuccgccaggccgccgaggacaaguccuggcgcguccgcuacauggucgccgacaaguucaccgagcuccagaaggccgucggccccgagaucaccaagaccgaccucguccccgccuuccagaaccucaugaaggacugcgaggccgagguccgcgccgccgccucccacaaggucaaggaguucugcgagaaccucuccgccgacugccgcgagaacgucaucaugucccagauccuccccugcaucaaggagcucgucuccgacgccaaccagcacgucaaguccgcccucgccuccgucaucaugggccucucccccauccucggcaaggacaacaccaucgagcaccuccucccccucuuccucgcccagcucaaggacgagugccccgagguccgccucaacaucaucuccaaccucgacugcgucaacgaggucaucggcauccgccagcucucccagucccuccuccccgccaucgucgagcucgccgaggacgccaaguggcgcguccgccucgccaucaucgaguacaugccccuccucgccggccagcucggcgucgaguucuucgacgagaagcucaacucccucugcauggccuggcucgucgaccacgucuacgccauccgcgaggccgccaccuccaaccucaagaagcucgucgagaaguucggcaaggagugggcccacgccaccaucauccccaagguccucgccauguccggcgaccccaacuaccuccaccgcaugaccacccucuucugcaucaacguccucuccgaggucugcggccaggacaucaccaccaagcacaugcuccccaccguccuccgcauggccggcgaccccgucgccaacguccgcuucaacgucgccaagucccuccagaagaucggccccauccucgacaacuccacccuccaguccgaggucaagcccauccucgagaagcucacccaggaccaggacgucgacgucaaguacuucgcccaggaggcccucaccguccucucccucgccuga

SEQ ID NO: 48019 - RNA, 1671 nt, Artificial Sequence
  derived and/or modified sequence opt2 from PPP2R1B__Homo_sapiens__NP_001171033
auggccggcgccuccgagcucggcaccggccccggcgccgccggcggcgacggcgacgacucccucuaccccaucgccguccucaucgacgagcuccgcaacgaggacguccagcuccgccucaacuccaucaagaagcucuccaccaucgcccucgcccucggcgucgagcgcacccgcuccgagcuccuccccuuccucaccgacaccaucuacgacgaggacgagguccuccucgcccucgccgagcagcucggcaacuucaccggccucgucggcggccccgacuucgcccacugccuccuccccccccucgagaaccucgccaccgucgaggagaccgucguccgcgacaaggccgucgagucccuccgccagaucucccaggagcacacccccgucgcccucgaggccuacuucgucccccucgucaagcgccucgccuccggcgacugguucaccucccgcaccuccgccugcggccucuucuccgucugcuacccccgcgccuccaacgccgucaaggccgagauccgccagcaguuccgcucccucugcuccgacgacacccccaugguccgccgcgccgccgccuccaagcucggcgaguucgccaagguccucgagcucgacuccgucaaguccgagaucgucccccucuucaccucccucgccuccgacgagcaggacuccguccgccuccucgccgucgaggccugcgucuccaucgcccagcuccucucccaggacgaccucgagacccucgucaugcccacccuccgccaggccgccgaggacaaguccuggcgcguccgcuacauggucgccgaccgcuucuccgagcuccagaaggccaugggccccaagaucacccucaacgaccucauccccgccuuccagaaccuccucaaggacugcgaggccgagguccgcgccgccgccgcccacaaggucaaggagcucggcgagaaccuccccaucgaggaccgcgagaccaucaucaugaaccagauccuccccuacaucaagugccccgacguccgccucaacaucaucuccaaccucgacugcgucaacgaggucaucggcauccgccagcucucccagucccuccuccccgccaucgucgagcucgccgaggacgccaaguggcgcguccgccucgccaucaucgaguacaugccccuccucgccggccagcucggcgucgaguucuucgacgagaagcucaacucccucugcauggccuggcucgucgaccacgucuacgccauccgcgaggccgccaccaacaaccucaugaagcucguccagaaguucggcaccgagugggcccagaacaccaucguccccaagguccucgucauggccaacgaccccaacuaccuccaccgcaugaccacccucuucugcaucaacgcccucuccgaggccugcggccaggagaucaccaccaagcagaugcuccccaucguccucaagauggccggcgaccaggucgccaacguccgcuucaacgucgccaagucccuccagaagaucggccccauccucgacaccaacgcccuccagggcgaggucaagcccguccuccagaagcucggccaggacgaggacauggacgucaaguacuucgcccaggaggccaucuccguccucgcccucgccuga

SEQ ID NO: 48020 - RNA, 1374 nt, Artificial Sequence
  derived and/or modified sequence opt2 from PPP2R2A__Homo_sapiens__NP_001171062
auguuccccaaguucucccuccgcuccauguuccacggcgccggcggcggcaacgacauccaguggugcuucucccaggucaagggcgccgucgacgacgacgucgccgaggccgacaucaucuccaccgucgaguucaaccacuccggcgagcuccucgccaccggcgacaagggcggccgcgucgucaucuuccagcaggagcaggagaacaagauccagucccacucccgcggcgaguacaacgucuacuccaccuuccagucccacgagcccgaguucgacuaccucaagucccucgagaucgaggagaagaucaacaagauccgcuggcucccccagaagaacgccgcccaguuccuccucuccaccaacgacaagaccaucaagcucuggaagaucuccgagcgcgacaagcgccccgagggcuacaaccucaaggaggaggacggccgcuaccgcgaccccaccaccgucaccacccuccgcguccccgucuuccgccccauggaccucauggucgaggccuccccccgccgcaucuucgccaacgcccacaccuaccacaucaacuccaucuccaucaacuccgacuacgagaccuaccucuccgccgacgaccuccgcaucaaccucuggcaccucgagaucaccgaccgcuccuucaacaucgucgacaucaagcccgccaacauggaggagcucaccgaggucaucaccgccgccgaguuccaccccaacuccugcaacaccuucgucuacuccuccuccaagggcaccauccgccucugcgacaugcgcgccuccgcccucugcgaccgccacuccaagcucuucgaggagcccgaggaccccuccaaccgcuccuucuucuccgagaucaucuccuccaucuccgacgucaaguucucccacuccggccgcuacaugaugacccgcgacuaccucuccgucaagaucugggaccucaacauggagaaccgccccgucgagaccuaccagguccacgaguaccuccgcuccaagcucugcucccucuacgagaacgacugcaucuucgacaaguucgagugcugcuggaacggcuccgacuccgucgucaugaccggcuccuacaacaacuucuuccgcauguucgaccgcaacaccaagcgcgacaucacccucgaggccucccgcgagaacaacaagccccgcaccguccucaagccccgcaaggucugcgccuccggcaagcgcaagaaggacgagaucuccgucgacucccucgacuucaacaagaagauccuccacaccgccuggcaccccaaggagaacaucaucgccgucgccaccaccaacaaccucuacaucuuccaggacaaggucaacuga

SEQ ID NO: 48021 - RNA, 1350 nt, Artificial Sequence
  derived and/or modified sequence opt2 from PPP2R2B__Homo_sapiens__NP_001258828
augauccccggcaucggcacccucacccaggacacccucuggugcuucucccaggucaagggcaccaucgagaucggcaccaccgaggccgacaucaucuccaccgucgaguucaaccacaccggcgagcuccucgccaccggcgacaagggcggccgcgucgucaucuuccagcgcgagcaggaguccaagaaccagguccaccgccgcggcgaguacaacgucuacuccaccuuccagucccacgagcccgaguucgacuaccucaagucccucgagaucgaggagaagaucaacaagauccgcuggcucccccagcagaacgccgccuacuuccuccucuccaccaacgacaagaccgucaagcucuggaaggucuccgagcgcgacaagcgccccgagggcuacaaccucaaggacgaggagggccgccuccgcgaccccgccaccaucaccacccuccgcguccccguccuccgccccauggaccucauggucgaggccaccccccgccgcgucuucgccaacgcccacaccuaccacaucaacuccaucuccgucaacuccgacuacgagaccuacauguccgccgacgaccuccgcaucaaccucuggaacuucgagaucaccaaccaguccuucaacaucgucgacaucaagcccgccaacauggaggagcucaccgaggucaucaccgccgccgaguuccacccccaccacugcaacaccuucgucuacuccuccuccaagggcaccauccgccucugcgacaugcgcgccuccgcccucugcgaccgccacaccaaguucuucgaggagcccgaggaccccuccaaccgcuccuucuucuccgagaucaucuccuccaucuccgacgucaaguucucccacuccggccgcuacaucaugacccgcgacuaccucaccgucaaggucugggaccucaacauggagaaccgccccaucgagaccuaccagguccacgacuaccuccgcuccaagcucugcucccucuacgagaacgacugcaucuucgacaaguucgagugcgucuggaacggcuccgacuccgucaucaugaccggcuccuacaacaacuucuuccgcauguucgaccgcaacaccaagcgcgacgucacccucgaggccucccgcgagaacuccaagccccgcgccauccucaagccccgcaaggucugcgucggcggcaagcgccgcaaggacgagaucuccgucgacucccucgacuucuccaagaagauccuccacaccgccuggcaccccuccgagaacaucaucgccgucgccgccaccaacaaccucuacaucuuccaggacaaggucaacuga

SEQ ID NO: 48022 - RNA, 1323 nt, Artificial Sequence
  derived and/or modified sequence opt2 from PPP2R2C__Homo_sapiens__NP_001193924
augcgcgaggccgacacccuccgccccccccagcucauggaggucuccgccgacaucaucuccaccgucgaguucaaccacaccggcgagcuccucgccaccggcgacaagggcggccgcgucgucaucuuccagcgcgagcccgaguccaagaacgccccccacucccagggcgaguacgacgucuacuccaccuuccagucccacgagcccgaguucgacuaccucaagucccucgagaucgaggagaagaucaacaagaucaaguggcucccccagcagaacgccgcccacucccuccucuccaccaacgacaagaccaucaagcucuggaagaucaccgagcgcgacaagcgccccgagggcuacaaccucaaggacgaggagggcaagcucaaggaccucuccaccgucaccucccuccagguccccguccucaagcccauggaccucauggucgaggucuccccccgccgcaucuucgccaacggccacaccuaccacaucaacuccaucuccgucaacuccgacugcgagaccuacauguccgccgacgaccuccgcaucaaccucuggcaccucgccaucaccgaccgcuccuucaacaucgucgacaucaagcccgccaacauggaggaccucaccgaggucaucaccgccuccgaguuccacccccaccacugcaaccucuucgucuacuccuccuccaagggcucccuccgccucugcgacaugcgcgccgccgcccucugcgacaagcacuccaagcucuucgaggagcccgaggaccccuccaaccgcuccuucuucuccgagaucaucuccuccgucuccgacgucaaguucucccacuccggccgcuacaugcucacccgcgacuaccucaccgucaaggucugggaccucaacauggaggcccgccccaucgagaccuaccagguccacgacuaccuccgcuccaagcucugcucccucuacgagaacgacugcaucuucgacaaguucgagugcgccuggaacggcuccgacuccgucaucaugaccggcgccuacaacaacuucuuccgcauguucgaccgcaacaccaagcgcgacgucacccucgaggccucccgcgaguccuccaagccccgcgccguccucaagccccgccgcgucugcgucggcggcaagcgccgccgcgacgacaucuccgucgacucccucgacuucaccaagaagauccuccacaccgccuggcaccccgccgagaacaucaucgccaucgccgccaccaacaaccucuacaucuuccaggacaaggucaacuccgacaugcacuga

SEQ ID NO: 48023 - RNA, 1245 nt, Artificial Sequence
  derived and/or modified sequence opt2 from PPP2R3A__Homo_sapiens__NP_001177376
auggacaucgaggagcagaaggccgacaucuacgagaugggcaagaucgccaaggucugcggcugcccccucuacuggaaggcccccauguuccgcgccgccggcggcgagaagaccggcuucgucaccgcccaguccuucaucgccauguggcgcaagcuccucaacaaccaccacgacgacgccuccaaguucaucugccuccucgccaagcccaacugcuccucccucgagcaggaggacuucaucccccuccuccaggacgucgucgacacccaccccggccucaccuuccucaaggacgcccccgaguuccacucccgcuacaucaccaccgucauccagcgcaucuucuacaccgucaaccgcuccugguccggcaagaucaccuccaccgagauccgcaaguccaacuuccuccagacccucgcccuccucgaggaggaggaggacaucaaccagaucaccgacuacuucuccuacgagcacuucuacgucaucuacugcaaguucugggagcucgacaccgaccacgaccucuacaucucccaggccgaccucucccgcuacaacgaccaggccuccuccucccgcaucaucgagcgcaucuucuccggcgccgucacccgcggcaagaccauccagaaggagggccgcauguccuacgccgacuucgucugguuccucaucuccgaggaggacaagcgcaaccccaccuccaucgaguacugguuccgcugcauggacgucgacggcgacggcguccucuccauguacgagcucgaguacuucuacgaggagcagugcgagcgcauggaggccaugggcaucgagccccuccccuuccacgaccuccucugccagaugcucgaccucgucaagcccgccgucgacggcaagaucacccuccgcgaccucaagcgcugccgcauggcccacaucuucuacgacaccuucuucaaccucgagaaguaccucgaccacgagcagcgcgaccccuucgccguccagaaggacgucgagaacgacggccccgagcccuccgacugggaccgcuucgccgccgaggaguacgagacccucgucgccgaggaguccgcccaggcccaguuccaggagggcuucgaggacuacgagaccgacgagcccgccucccccuccgaguucggcaacaaguccaacaagauccucuccgccucccuccccgagaagugcggcaagcuccaguccgucgacgaggaguga

SEQ ID NO: 48024 - RNA, 1728 nt, Artificial Sequence
  derived and/or modified sequence opt2 from PPP2R3B__Homo_sapiens__NP_037371
augccccccggcaagguccuccagcccguccucaagaugaaggucgacgagcucuuccucuacuggcucuccgaggccuccacccagcgcaugcuccaggacugccuccgccgcaucaaggcccccggccgcgaccagcccacccccggcgacggcgagcagcccggcgccuggcccaccgccccccucgccgccccccgccccuccggccucgagccccccggcacccccggccccggccccgcccucccccucggcgccgccuccuccccccgcaacgccccccacguccgcggcacccgccgcuccgccggcacccgcgucguccagacccgcaaggaggagccccucccccccgccaccucccaguccauccccaccuucuacuucccccgcggccgcccccaggacuccgucaacgucgacgccgucaucuccaagaucgaguccaccuucgcccgcuucccccacgagcgcgccaccauggacgacaugggccucgucgccaaggccugcggcugcccccucuacuggaagggcccccucuucuacggcgccggcggcgagcgcaccggcuccgucuccguccacaaguucgucgccauguggcgcaagauccuccagaacugccacgacgacgccgccaaguucguccaccuccucaugucccccggcugcaacuaccucguccaggaggacuucguccccuuccuccaggacgucgucaacacccaccccggccucuccuuccucaaggaggccuccgaguuccacucccgcuacaucaccaccgucauccagcgcaucuucuacgccgucaaccgcuccugguccggccgcaucaccugcgccgagcuccgccgcuccuccuuccuccagaacgucgcccuccucgaggaggaggccgacaucaaccagcucaccgaguucuucuccuacgagcacuucuacgucaucuacugcaaguucugggagcucgacaccgaccacgaccuccucaucgacgccgacgaccucgcccgccacaacgaccacgcccucuccaccaagaugaucgaccgcaucuucuccggcgccgucacccgcggccgcaagguccagaaggagggcaagaucuccuacgccgacuucgucugguuccucaucuccgaggaggacaagaagacccccaccuccaucgaguacugguuccgcugcauggaccucgacggcgacggcgcccucuccauguucgagcucgaguacuucuacgaggagcagugccgccgccucgacuccauggccaucgaggcccuccccuuccaggacugccucugccagaugcucgaccucgucaagccccgcaccgagggcaagaucacccuccaggaccucaagcgcugcaagcucgccaacgucuucuucgacaccuucuucaacaucgagaaguaccucgaccacgagcagaaggagcagaucucccuccuccgcgacggcgacuccggcggccccgagcucuccgacugggagaaguacgccgccgaggaguacgacauccucgucgccgaggagaccgccggcgagcccugggaggacggcuucgaggccgagcucucccccgucgagcagaagcucuccgcccuccgcuccccccucgcccagcgccccuucuucgaggcccccuccccccucggcgccgucgaccucuacgaguacgccugcggcgacgaggaccucgagccccucuga

SEQ ID NO: 48025 - RNA, 867 nt, Artificial Sequence
  derived and/or modified sequence opt2 from PPP2R4__Homo_sapiens__NP_001180326
augggcaaguggaagcgcucccaggccuacgccgacuacaucggcuucauccucacccucaacgagggcgucaagggcaagaagcucaccuucgaguaccgcgucuccgaggccaucgagaagcucgucgcccuccucaacacccucgaccgcuggaucgacgagaccccccccgucgaccagcccucccgcuucggcaacaaggccuaccgcaccugguacgccaagcucgacgaggaggccgagaaccucgucgccaccgucguccccacccaccucgccgccgccguccccgaggucgccgucuaccucaaggaguccgucggcaacuccacccgcaucgacuacggcaccggccacgaggccgccuucgccgccuuccucugcugccucugcaagaucggcguccuccgcgucgacgaccagaucgccaucgucuucaaggucuucaaccgcuaccucgaggucaugcgcaagcuccagaagaccuaccgcauggagcccgccggcucccagggcgucuggggccucgacgacuuccaguuccuccccuucaucuggggcuccucccagcucaucgaccaccccuaccucgagccccgccacuucgucgacgagaaggccgucaacgagaaccacaaggacuacauguuccucgagugcauccucuucaucaccgagaugaagaccggccccuucgccgagcacuccaaccagcucuggaacaucuccgccguccccuccugguccaaggucaaccagggccucauccgcauguacaaggccgagugccucgagaaguuccccgucauccagcacuucaaguucggcucccuccuccccauccaccccgucaccuccggcuga

SEQ ID NO: 48026 - RNA, 1290 nt, Artificial Sequence
  derived and/or modified sequence opt2 from PPP2R5A__Homo_sapiens__NP_001186685
augaucaugaacgccaccuccaacgagcagcaggagcucuucugccagaagcuccagcagugcugcauccucuucgacuucauggacuccgucuccgaccucaaguccaaggagaucaagcgcgccacccucaacgagcucgucgaguacgucuccaccaaccgcggcgucaucgucgaguccgccuacuccgacaucgucaagaugaucuccgccaacaucuuccgcacccucccccccuccgacaaccccgacuucgaccccgaggaggacgagcccacccucgaggccuccuggccccacauccagcucgucuacgaguucuuccuccgcuuccucgagucccccgacuuccagcccuccaucgccaagcgcuacaucgaccagaaguucguccagcagcuccucgagcucuucgacuccgaggacccccgcgagcgcgacuuccucaagaccguccuccaccgcaucuacggcaaguuccucggccuccgcgccuucauccgcaagcagaucaacaacaucuuccuccgcuucaucuacgagaccgagcacuucaacggcgucgccgagcuccucgagauccucggcuccaucaucaacggcuucgcccucccccucaaggccgagcacaagcaguuccucaugaagguccucauccccaugcacaccgccaagggccucgcccucuuccacgcccagcucgccuacugcgucguccaguuccucgagaaggacaccacccucaccgagcccgucauccgcggccuccucaaguucuggcccaagaccugcucccagaaggaggucauguuccucggcgagaucgaggagauccucgacgucaucgagcccacccaguucaagaagaucgaggagccccucuucaagcagaucuccaagugcgucuccuccucccacuuccaggucgccgagcgcgcccucuacuucuggaacaacgaguacauccucucccucaucgaggagaacaucgacaagauccuccccaucauguucgccucccucuacaagaucuccaaggagcacuggaaccccaccaucgucgcccucgucuacaacguccucaagacccucauggagaugaacggcaagcucuucgacgaccucaccuccuccuacaaggccgagcgccagcgcgagaagaagaaggagcucgagcgcgaggagcucuggaagaagcucgaggagcucaagcucaagaaggcccucgagaagcagaacuccgccuacaacaugcacuccauccucuccaacaccuccgccgaguga

SEQ ID NO: 48027 - RNA, 1494 nt, Artificial Sequence
  derived and/or modified sequence opt2 from PPP2R5B__Homo_sapiens__NP_006235
auggagaccaagcucccccccgccuccacccccaccucccccuccucccccggccucucccccguccccccccccgacaaggucgacggcuucucccgccgcucccuccgccgcgcccgcccccgccgcucccacuccuccucccaguuccgcuaccaguccaaccagcaggagcucaccccccucccccuccucaaggacguccccgccuccgagcuccacgagcuccucucccgcaagcucgcccagugcggcgucauguucgacuuccucgacugcgucgccgaccucaagggcaaggaggucaagcgcgccgcccucaacgagcucgucgagugcgucggcuccacccgcggcguccucaucgagcccgucuaccccgacaucauccgcaugaucuccgucaacaucuuccgcacccucccccccuccgagaaccccgaguucgaccccgaggaggacgagcccaaccucgagcccuccuggccccaccuccagcucgucuacgaguucuuccuccgcuuccucgagucccccgacuuccagcccuccgucgccaagcgcuacgucgaccagaaguucguccucaugcuccucgagcucuucgacuccgaggacccccgcgagcgcgaguaccucaagaccauccuccaccgcgucuacggcaaguuccucggccuccgcgccuacauccgcaagcagugcaaccacaucuuccuccgcuucaucuacgaguucgagcacuucaacggcgucgccgagcuccucgagauccucggcuccaucaucaacggcuucgcccucccccucaagaccgagcacaagcaguuccucguccgcguccucaucccccuccacuccgucaagucccucuccgucuuccacgcccagcucgccuacugcgucguccaguuccucgagaaggacgccacccucaccgagcacgucauccgcggccuccucaaguacuggcccaagaccugcacccagaaggaggucauguuccucggcgagauggaggagauccucgacgucaucgagcccucccaguucgucaagauccaggagccccucuucaagcaggucgcccgcugcgucuccuccccccacuuccaggucgccgagcgcgcccucuacuucuggaacaacgaguacauccucucccucaucgaggacaacugccacaccguccuccccgccgucuucggcacccucuaccaggucuccaaggagcacuggaaccagaccaucgucucccucaucuacaacguccucaagaccuucauggagaugaacggcaagcucuucgacgagcucaccgccuccuacaagcucgagaagcagcaggagcagcagaaggcccaggagcgccaggagcucuggcagggccucgaggagcuccgccuccgccgccuccagggcacccagggcgccaaggaggccccccuccagcgccucaccccccaggucgccgccuccggcggccaguccuga

SEQ ID NO: 48028 - RNA, 1668 nt, Artificial Sequence
  derived and/or modified sequence opt2 from PPP2R5C__Homo_sapiens__NP_001155197
augcccaacaagaacaagaaggagaaggagucccccaaggccggcaaguccggcaaguccuccaaggagggccaggacaccgucgaguccgagggcaccucccccgaggagcccuccucccccaaggucccccccccccuccuccccgagcuccucguccucaucuucggcggccuccagggccgcgacgucccccccgccgaccaggagaagcucuucauccagaagcuccgccagugcugcguccucuucgacuucgucuccgacccccucuccgaccucaaguggaaggaggucaagcgcgccgcccucuccgagauggucgaguacaucacccacaaccgcaacgucaucaccgagcccaucuaccccgaggucguccacauguucgccgucaacauguuccgcacccucccccccuccuccaaccccaccggcgccgaguucgaccccgaggaggacgagcccacccucgaggccgccuggccccaccuccagcucgucuacgaguucuuccuccgcuuccucgagucccccgacuuccagcccaacaucgccaagaaguacaucgaccagaaguucguccuccagcuccucgagcucuucgacuccgaggacccccgcgagcgcgacuuccucaagaccacccuccaccgcaucuacggcaaguuccucggccuccgcgccuacauccgcaagcagaucaacaacaucuucuaccgcuucaucuacgagaccgagcaccacaacggcaucgccgagcuccucgagauccucggcuccaucaucaacggcuucgcccucccccucaaggaggagcacaagaucuuccuccucaagguccuccucccccuccacaaggucaagucccucuccgucuaccacccccagcucgccuacugcgucguccaguuccucgagaaggacuccacccucaccgagcccgucgucauggcccuccucaaguacuggcccaagacccacucccccaaggaggucauguuccucaacgagcucgaggagauccucgacgucaucgagcccuccgaguucgucaagaucauggagccccucuuccgccagcucgccaagugcgucuccuccccccacuuccaggucgccgagcgcgcccucuacuacuggaacaacgaguacaucaugucccucaucuccgacaacgccgccaagauccuccccaucauguuccccucccucuaccgcaacuccaagacccacuggaacaagaccauccacggccucaucuacaacgcccucaagcucuucauggagaugaaccagaagcucuucgacgacugcacccagcaguucaaggccgagaagcucaaggagaagcucaagaugaaggagcgcgaggaggccugggucaagaucgagaaccucgccaaggccaacccccaguacaccgucuacucccaggccuccaccauguccauccccgucgccauggagaccgacggcccccucuucgaggacguccagaugcuccgcaagaccgucaaggacgaggcccaccaggcccagaaggaccccaagaaggaccgcccccucgcccgccgcaaguccgagcucccccaggacccccacaccaagaaggcccucgaggcccacugccgcgccgacgagcucgccucccaggacggccgcuga

SEQ ID NO: 48029 - RNA, 1809 nt, Artificial Sequence
  derived and/or modified sequence opt2 from PPP2R5D__Homo_sapiens__NP_006236
augcccuacaagcucaagaaggagaaggagccccccaaggucgccaagugcaccgccaagcccuccuccuccggcaaggacggcggcggcgagaacaccgaggaggcccagccccagccccagccccagccccagccccaggcccagucccagccccccuccuccaacaagcgccccuccaacuccacccccccccccacccagcucuccaagaucaaguacuccggcggcccccagaucgucaagaaggagcgccgccaguccuccucccgcuucaaccucuccaagaaccgcgagcuccagaagcuccccgcccucaaggacucccccacccaggagcgcgaggagcucuucauccagaagcuccgccagugcugcguccucuucgacuucgucuccgacccccucuccgaccucaaguucaaggaggucaagcgcgccggccucaacgagauggucgaguacaucacccacucccgcgacgucgucaccgaggccaucuaccccgaggccgucaccauguucuccgucaaccucuuccgcacccucccccccuccuccaaccccaccggcgccgaguucgaccccgaggaggacgagcccacccucgaggccgccuggccccaccuccagcucgucuacgaguucuuccuccgcuuccucgagucccccgacuuccagcccaacaucgccaagaaguacaucgaccagaaguucguccucgcccuccucgaccucuucgacuccgaggacccccgcgagcgcgacuuccucaagaccauccuccaccgcaucuacggcaaguuccucggccuccgcgccuacauccgccgccagaucaaccacaucuucuaccgcuucaucuacgagaccgagcaccacaacggcaucgccgagcuccucgagauccucggcuccaucaucaacggcuucgcccucccccucaaggaggagcacaagauguuccucauccgcguccuccucccccuccacaaggucaagucccucuccgucuaccacccccagcucgccuacugcgucguccaguuccucgagaaggaguccucccucaccgagcccgucaucgucggccuccucaaguucuggcccaagacccacucccccaaggaggucauguuccucaacgagcucgaggagauccucgacgucaucgagcccuccgaguucuccaaggucauggagccccucuuccgccagcucgccaagugcgucuccuccccccacuuccaggucgccgagcgcgcccucuacuacuggaacaacgaguacaucaugucccucaucuccgacaacgccgcccgcguccuccccaucauguuccccgcccucuaccgcaacuccaagucccacuggaacaagaccauccacggccucaucuacaacgcccucaagcucuucauggagaugaaccagaagcucuucgacgacugcacccagcaguacaaggccgagaagcagaagggccgcuuccgcaugaaggagcgcgaggagauguggcagaagaucgaggagcucgcccgccucaacccccaguaccccauguuccgcgccccccccccccucccccccgucuacuccauggagaccgagacccccaccgccgaggacauccagcuccucaagcgcaccgucgagaccgaggccguccagaugcucaaggacaucaagaaggagaagguccuccuccgccgcaaguccgagcucccccaggacgucuacaccaucaaggcccucgaggcccacaagcgcgccgaggaguuccucaccgccucccaggaggcccucuga

SEQ ID NO: 48030 - RNA, 1389 nt, Artificial Sequence
  derived and/or modified sequence opt2 from PPP2R5E__Homo_sapiens__NP_001269109
auguccuccgcccccaccaccccccccuccgucgacaaggucgacggcuucucccgcaaguccguccgcaaggcccgccagaagcgcucccaguccuccucccaguuccgcucccagggcaagcccaucgagcucaccccccucccccuccucaaggacguccccuccuccgagcagcccgagcucuuccucaagaagcuccagcagugcugcgucaucuucgacuucauggacacccucuccgaccucaagaugaaggaguacaagcgcuccacccucaacgagcucgucgacuacaucaccaucucccgcggcugccucaccgagcagaccuaccccgaggucguccgcauggucuccugcaacaucuuccgcacccucccccccuccgacuccaacgaguucgaccccgaggaggacgagcccacccucgaggccuccuggccccaccuccagcucgucuacgaguucuucauccgcuuccucgagucccaggaguuccagcccuccaucgccaagaaguacaucgaccagaaguucguccuccagcuccucgagcucuucgacuccgaggacccccgcgagcgcgacuaccucaagaccguccuccaccgcaucuacggcaaguuccucggccuccgcgccuucauccgcaagcagaucaacaacaucuuccuccgcuucgucuacgagaccgagcacuucaacggcgucgccgagcuccucgagauccucggcuccaucaucaacggcuucgcccucccccucaaggccgagcacaagcaguuccucgucaagguccucaucccccuccacaccguccgcucccucucccucuuccacgcccagcucgccuacugcaucguccaguuccucgagaaggaccccucccucaccgagcccgucauccgcggccucaugaaguucuggcccaagaccugcucccagaaggaggucauguuccucggcgagcucgaggagauccucgacgucaucgagcccucccaguucgucaagauccaggagccccucuucaagcagaucgccaagugcgucuccuccccccacuuccaggucgccgagcgcgcccucuacuacuggaacaacgaguacaucaugucccucaucgaggagaacuccaacgucauccuccccaucauguucuccucccucuaccgcaucuccaaggagcacuggaaccccgccaucgucgcccucgucuacaacguccucaaggccuucauggagaugaacuccaccauguucgacgagcucaccgccaccuacaacgagaagaagaaggagaaggagcgcgaggagcucuggaagaagcucgaggaccucgagcucaagcgcggccuccgccgcgacggcaucauccccaccuga

SEQ ID NO: 48031 - RNA, 1566 nt, Artificial Sequence
  derived and/or modified sequence opt2 from PPP3CA__Homo_sapiens__NP_000935
auguccgagcccaaggccaucgaccccaagcucuccaccaccgaccgcgucgucaaggccguccccuucccccccucccaccgccucaccgccaaggaggucuucgacaacgacggcaagccccgcgucgacauccucaaggcccaccucaugaaggagggccgccucgaggaguccgucgcccuccgcaucaucaccgagggcgccuccauccuccgccaggagaagaaccuccucgacaucgacgcccccgucaccgucugcggcgacauccacggccaguucuucgaccucaugaagcucuucgaggucggcggcucccccgccaacacccgcuaccucuuccucggcgacuacgucgaccgcggcuacuucuccaucgagugcguccucuaccucugggcccucaagauccucuaccccaagacccucuuccuccuccgcggcaaccacgagugccgccaccucaccgaguacuucaccuucaagcaggagugcaagaucaaguacuccgagcgcgucuacgacgccugcauggacgccuucgacugccucccccucgccgcccucaugaaccagcaguuccucugcguccacggcggccucucccccgagaucaacacccucgacgacauccgcaagcucgaccgcuucaaggagccccccgccuacggccccaugugcgacauccucugguccgacccccucgaggacuucggcaacgagaagacccaggagcacuucacccacaacaccguccgcggcugcuccuacuucuacuccuaccccgccgucugcgaguuccuccagcacaacaaccuccucuccauccuccgcgcccacgaggcccaggacgccggcuaccgcauguaccgcaagucccagaccaccggcuuccccucccucaucaccaucuucuccgcccccaacuaccucgacgucuacaacaacaaggccgccguccucaaguacgagaacaacgucaugaacauccgccaguucaacugcuccccccaccccuacuggcuccccaacuucauggacgucuucaccuggucccuccccuucgucggcgagaaggucaccgagaugcucgucaacguccucaacaucugcuccgacgacgagcucggcuccgaggaggacggcuucgacggcgccaccgccgccgcccgcaaggaggucauccgcaacaagauccgcgccaucggcaagauggcccgcgucuucuccguccuccgcgaggaguccgaguccguccucacccucaagggccucacccccaccggcaugcuccccuccggcguccucuccggcggcaagcagacccuccaguccgccaccgucgaggccaucgaggccgacgaggccaucaagggcuucuccccccagcacaagaucaccuccuucgaggaggccaagggccucgaccgcaucaacgagcgcaugcccccccgccgcgacgccaugcccuccgacgccaaccucaacuccaucaacaaggcccucaccuccgagaccaacggcaccgacuccaacggcuccaacuccuccaacauccaguga

SEQ ID NO: 48032 - RNA, 1578 nt, Artificial Sequence
  derived and/or modified sequence opt2 from PPP3CB__Homo_sapiens__NP_001135825
auggccgcccccgagcccgcccgcgccgcccccccccccccccccccccccccccccccccccggcgccgaccgcgucgucaaggccguccccuucccccccacccaccgccucaccuccgaggaggucuucgaccucgacggcaucccccgcgucgacguccucaagaaccaccucgucaaggagggccgcgucgacgaggagaucgcccuccgcaucaucaacgagggcgccgccauccuccgccgcgagaagaccaugaucgaggucgaggcccccaucaccgucugcggcgacauccacggccaguucuucgaccucaugaagcucuucgaggucggcggcucccccgccaacacccgcuaccucuuccucggcgacuacgucgaccgcggcuacuucuccaucgagugcguccucuaccucuggguccucaagauccucuaccccuccacccucuuccuccuccgcggcaaccacgagugccgccaccucaccgaguacuucaccuucaagcaggagugcaagaucaaguacuccgagcgcgucuacgaggccugcauggaggccuucgacucccucccccucgccgcccuccucaaccagcaguuccucugcguccacggcggccucucccccgagauccacacccucgacgacauccgccgccucgaccgcuucaaggagccccccgccuucggccccaugugcgaccuccucugguccgaccccuccgaggacuucggcaacgagaagucccaggagcacuucucccacaacaccguccgcggcugcuccuacuucuacaacuaccccgccgucugcgaguuccuccagaacaacaaccuccucuccaucauccgcgcccacgaggcccaggacgccggcuaccgcauguaccgcaagucccagaccaccggcuuccccucccucaucaccaucuucuccgcccccaacuaccucgacgucuacaacaacaaggccgccguccucaaguacgagaacaacgucaugaacauccgccaguucaacugcuccccccaccccuacuggcuccccaacuucauggacgucuucaccuggucccuccccuucgucggcgagaaggucaccgagaugcucgucaacguccucuccaucugcuccgacgacgagcucaugaccgagggcgaggaccaguucgacgucggcuccgccgccgcccgcaaggagaucauccgcaacaagauccgcgccaucggcaagauggcccgcgucuucuccguccuccgcgaggaguccgaguccguccucacccucaagggccucacccccaccggcaugcuccccuccggcguccucgccggcggccgccagacccuccaguccgccaccgucgaggccaucgaggccgagaaggccauccgcggcuucucccccccccaccgcaucugcuccuucgaggaggccaagggccucgaccgcaucaacgagcgcaugcccccccgcaaggacgccguccagcaggacggcuucaacucccucaacaccgcccacgccaccgagaaccacggcaccggcaaccacaccgcccaguga

SEQ ID NO: 48033 - RNA, 1566 nt, Artificial Sequence
  derived and/or modified sequence opt2 from PPP3CC__Homo_sapiens__NP_001230903
auguccggccgccgcuuccaccucuccaccaccgaccgcgucaucaaggccguccccuucccccccacccagcgccucaccuucaaggaggucuucgagaacggcaagcccaaggucgacguccucaagaaccaccucgucaaggagggccgccucgaggaggaggucgcccucaagaucaucaacgacggcgccgccauccuccgccaggagaagaccaugaucgaggucgacgcccccaucaccgucugcggcgacauccacggccaguucuucgaccucaugaagcucuucgaggucggcggcucccccuccaacacccgcuaccucuuccucggcgacuacgucgaccgcggcuacuucuccaucgagugcguccucuaccucuggucccucaagaucaaccaccccaagacccucuuccuccuccgcggcaaccacgagugccgccaccucaccgacuacuucaccuucaagcaggagugccgcaucaaguacuccgagcaggucuacgacgccugcauggagaccuucgacugccucccccucgccgcccuccucaaccagcaguuccucugcguccacggcggcaugucccccgagaucaccucccucgacgacauccgcaagcucgaccgcuucaccgagccccccgccuucggccccgucugcgaccuccucugguccgaccccuccgaggacuacggcaacgagaagacccucgagcacuacacccacaacaccguccgcggcugcuccuacuucuacuccuaccccgccgucugcgaguuccuccagaacaacaaccuccucuccaucauccgcgcccacgaggcccaggacgccggcuaccgcauguaccgcaagucccaggccaccggcuuccccucccucaucaccaucuucuccgcccccaacuaccucgacgucuacaacaacaaggccgccguccucaaguacgagaacaacgucaugaacauccgccaguucaacugcuccccccaccccuacuggcuccccaacuucauggacgucuucaccuggucccuccccuucgucggcgagaaggucaccgagaugcucgucaacguccucaacaucugcuccgacgacgagcucaucuccgacgacgaggccgaggaccacuacauccccuccuaccagaagggcuccaccaccguccgcaaggagaucauccgcaacaagauccgcgccaucggcaagauggcccgcgucuucuccauccuccgccaggaguccgaguccguccucacccucaagggccucacccccaccggcacccucccccucggcguccucuccggcggcaagcagaccaucgagaccgccaccgucgaggccgucgaggcccgcgaggccauccgcggcuucucccuccagcacaagauccgcuccuucgaggaggcccgcggccucgaccgcaucaacgagcgcaugcccccccgcaaggacuccauccacgccggcggccccaugaaguccgucaccuccgcccacucccacgccgcccaccgcuccgaccagggcaagaaggcccacuccuga

SEQ ID NO: 48034 - RNA, 513 nt, Artificial Sequence
  derived and/or modified sequence opt2 from PPP3R1__Homo_sapiens__NP_000936
augggcaacgaggccuccuacccccucgagaugugcucccacuucgacgccgacgagaucaagcgccucggcaagcgcuucaagaagcucgaccucgacaacuccggcucccucuccgucgaggaguucaugucccuccccgagcuccagcagaacccccucguccagcgcgucaucgacaucuucgacaccgacggcaacggcgaggucgacuucaaggaguucaucgagggcgucucccaguucuccgucaagggcgacaaggagcagaagcuccgcuucgccuuccgcaucuacgacauggacaaggacggcuacaucuccaacggcgagcucuuccagguccucaagaugauggucggcaacaaccucaaggacacccagcuccagcagaucgucgacaagaccaucaucaacgccgacaaggacggcgacggccgcaucuccuucgaggaguucugcgccgucgucggcggccucgacauccacaagaagauggucgucgacgucuga

SEQ ID NO: 48035 - RNA, 522 nt, Artificial Sequence
  derived and/or modified sequence opt2 from PPP3R2__Homo_sapiens__NP_671709
auguccaccaugggcaacgaggccuccuaccccgccgagaugugcucccacuucgacaacgacgagaucaagcgccucggccgccgcuucaagaagcucgaccucgacaaguccggcucccucuccgucgaggaguucaugucccuccccgagcuccgccacaacccccucguccgccgcgucaucgacgucuucgacaccgacggcgacggcgaggucgacuucaaggaguucauccucggcaccucccaguucuccgucaagggcgacgaggagcagaagcuccgcuucgccuucuccaucuacgacauggacaaggacggcuacaucuccaacggcgagcucuuccagguccucaagaugauggucggcaacaaccucaccgacuggcagcuccagcagcucgucgacaagaccaucaucauccucgacaaggacggcgacggcaagaucuccuucgaggaguucuccgccgucguccgcgaccucgagauccacaagaagcucguccucaucgucuga

SEQ ID NO: 48036 - RNA, 924 nt, Artificial Sequence
  derived and/or modified sequence opt2 from PPP4C__Homo_sapiens__NP_002711
auggccgagaucuccgaccucgaccgccagaucgagcagcuccgccgcugcgagcucaucaaggaguccgaggucaaggcccucugcgccaaggcccgcgagauccucgucgaggaguccaacguccagcgcgucgacucccccgucaccgucugcggcgacauccacggccaguucuacgaccucaaggagcucuuccgcgucggcggcgacguccccgagaccaacuaccucuucaugggcgacuucgucgaccgcggcuucuacuccgucgagaccuuccuccuccuccucgcccucaagguccgcuaccccgaccgcaucacccucauccgcggcaaccacgagucccgccagaucacccaggucuacggcuucuacgacgagugccuccgcaaguacggcuccgucaccgucuggcgcuacugcaccgagaucuucgacuaccucucccucuccgccaucaucgacggcaagaucuucugcguccacggcggccucucccccuccauccagacccucgaccagauccgcaccaucgaccgcaagcaggaggucccccacgacggccccaugugcgaccuccucugguccgaccccgaggacaccaccggcuggggcgucuccccccgcggcgccggcuaccucuucggcuccgacgucgucgcccaguucaacgccgccaacgacaucgacaugaucugccgcgcccaccagcucgucauggagggcuacaaguggcacuucaacgagaccguccucaccgucugguccgcccccaacuacugcuaccgcugcggcaacgucgccgccauccucgagcucgacgagcaccuccagaaggacuucaucaucuucgaggccgccccccaggagacccgcggcauccccuccaagaagcccgucgccgacuacuuccucuga

SEQ ID NO: 48037 - RNA, 2853 nt, Artificial Sequence
  derived and/or modified sequence opt2 from PPP4R1__Homo_sapiens__NP_001035847
auggccgaccucucccuccuccaggaggaccuccaggaggacgccgacggcuucggcgucgacgacuacuccuccgaguccgacgucaucaucauccccuccgcccucgacuucgucucccaggacgagaugcucaccccccucggccgccucgacaaguacgccgccuccgagaacaucuucaaccgccagauggucgcccgcucccuccucgacacccuccgcgaggucugcgacgacgagcgcgacugcaucgccguccucgagcgcaucucccgccucgccgacgacuccgagcccaccguccgcgccgagcucauggagcaggucccccacaucgcccucuucugccaggagaaccgccccuccauccccuacgccuucuccaaguuccuccuccccaucgucguccgcuaccucgccgaccagaacaaccagguccgcaagaccucccaggccgcccuccucgcccuccucgagcaggagcucaucgagcgcuucgacgucgagaccaaggucugccccguccucaucgagcucaccgcccccgacuccaacgacgacgucaagaccgaggccgucgccaucaugugcaagauggcccccauggucggcaaggacaucaccgagcgccucauccucccccgcuucugcgagaugugcugcgacugccgcauguuccacguccgcaaggucugcgccgccaacuucggcgacaucugcuccgucgucggccagcaggccaccgaggagaugcuccucccccgcuucuuccagcucugcuccgacaacgucuggggcguccgcaaggccugcgccgagugcuucauggccgucuccugcgccaccugccaggagauccgccgcaccaagcucuccgcccucuucaucaaccucaucuccgaccccucccgcuggguccgccaggccgccuuccagucccucggccccuucaucuccaccuucgccaaccccuccuccuccggccaguacuucaaggaggaguccaaguccuccgaggagauguccgucgagaacaagaaccgcacccgcgaccaggaggcccccgaggacguccagguccgccccgaggacacccccuccgaccucuccgucuccaacuccuccgucauccucgagaacaccauggaggaccacgccgccgaggccuccggcaagccccucggcgagaucuccgucccccucgacuccucccuccucugcacccucuccuccgagucccaccaggaggccgccuccaacgagaacgacaagaagcccggcaacuacaaguccaugcuccgccccgaggucggcaccaccucccaggacuccgcccuccucgaccaggagcucuacaacuccuuccacuucuggcgcaccccccuccccgagaucgaccucgacaucgagcucgagcagaacuccggcggcaagcccucccccgagggccccgaggaggaguccgagggccccguccccuccucccccaacaucaccauggccacccgcaaggagcucgaggagaugaucgagaaccucgagccccacaucgacgaccccgacgucaaggcccaggucgagguccucuccgccgcccuccgcgccuccucccucgacgcccacgaggagaccaucuccaucgagaagcgcuccgaccuccaggacgagcucgacaucaacgagcuccccaacugcaagaucaaccaggaggacuccgucccccucaucuccgacgccgucgagaacauggacuccacccuccacuacauccacuccgacuccgaccucuccaacaacuccuccuucucccccgacgaggagcgccgcaccaagguccaggacgucgucccccaggcccuccucgaccaguaccucuccaugaccgaccccucccgcgcccagaccgucgacaccgagaucgccaagcacugcgccuacucccuccccggcgucgcccucacccucggccgccagaacuggcacugccuccgcgagaccuacgagacccucgccuccgacaugcaguggaagguccgccgcacccucgccuucuccauccacgagcucgccgucauccucggcgaccagcucaccgccgccgaccucguccccaucuucaacggcuuccucaaggaccucgacgagguccgcaucggcguccucaagcaccuccacgacuuccucaagcuccuccacaucgacaagcgccgcgaguaccucuaccagcuccaggaguuccucgucaccgacaacucccgcaacuggcgcuuccgcgccgagcucgccgagcagcucauccuccuccucgagcucuacuccccccgcgacgucuacgacuaccuccgccccaucgcccucaaccucugcgccgacaaggucuccuccguccgcuggaucuccuacaagcucgucuccgagauggucaagaagcuccacgccgccaccccccccaccuucggcgucgaccucaucaacgagcucgucgagaacuucggccgcugccccaagugguccggccgccaggccuucgucuucgucugccagaccgucaucgaggacgacugccuccccauggaccaguucgccguccaccucaugccccaccuccucacccucgccaacgaccgcguccccaacguccgcguccuccucgccaagacccuccgccagacccuccucgagaaggacuacuuccucgccuccgccuccugccaccaggaggccgucgagcagaccaucauggcccuccagauggaccgcgacuccgacgucaaguacuucgccuccauccaccccgccuccaccaagaucuccgaggacgccauguccaccgccuccuccaccuacuga

SEQ ID NO: 48038 - RNA, 1434 nt, Artificial Sequence
  derived and/or modified sequence opt2 from PPP5C__Homo_sapiens__NP_001191213
auggccauggccgagggcgagcgcaccgagugcgccgagcccccccgcgacgagccccccgccgacggcgcccucaagcgcgccgaggagcucaagacccaggccaacgacuacuucaaggccaaggacuacgagaacgccaucaaguucuacucccaggccaucgagcucaaccccuccaacgccaucuacuacggcaaccgcucccucgccuaccuccgcaccgagugcuacggcuacgcccucggcgacgccacccgcgccaucgagcucgacaagaaguacaucaagggcuacuaccgccgcgccgccuccaacauggcccucggcaaguuccgcgccgcccuccgcgacuacgagaccgucgucaaggucaagccccacgacaaggacgccaagaugaaguaccaggagugcaacaagaucgucaagcagaaggccuucgagcgcgccaucgccggcgacgagcacaagcgcuccgucgucgacucccucgacaucgaguccaugaccaucgaggacgaguacuccggccccaagcucgaggacggcaaggucaccaucuccuucaugaaggagcucaugcagugguacaaggaccagaagaagcuccaccgcaagugcgccuaccagaccgagaagaucaccgucugcggcgacacccacggccaguucuacgaccuccucaacaucuucgagcucaacggccuccccuccgagaccaaccccuacaucuucaacggcgacuucgucgaccgcggcuccuucuccgucgaggucauccucacccucuucggcuucaagcuccucuaccccgaccacuuccaccuccuccgcggcaaccacgagaccgacaacaugaaccagaucuacggcuucgagggcgaggucaaggccaaguacaccgcccagauguacgagcucuucuccgaggucuucgaguggcucccccucgcccagugcaucaacggcaagguccucaucaugcacggcggccucuucuccgaggacggcgucacccucgacgacauccgcaagaucgagcgcaaccgccagccccccgacuccggccccaugugcgaccuccucugguccgacccccagccccagaacggccgcuccaucuccaagcgcggcgucuccugccaguucggccccgacgucaccaaggccuuccucgaggagaacaaccucgacuacaucauccgcucccacgaggucaaggccgagggcuacgaggucgcccacggcggccgcugcgucaccgucuucuccgcccccaacuacugcgaccagaugggcaacaaggccuccuacauccaccuccagggcuccgaccuccgcccccaguuccaccaguucaccgccgucccccaccccaacgucaagcccauggccuacgccaacacccuccuccagcucggcaugauguga

SEQ ID NO: 48039 - RNA, 1029 nt, Artificial Sequence
  derived and/or modified sequence opt2 from PPP6C__Homo_sapiens__NP_001116827
auggccccccucgaccucgacaaguacgucgagaucgcccgccucugcaaguaccuccccgagaacgaccucaaggucucccccaucugcggccucgcccccuccggcugcggcgcccccgccggccgccccuuccucucccccggccccccccccgucuuccacuuccuccgcuuccucaaggagcgccucugcgacuacgucugcgaccuccuccucgaggaguccaacguccagcccgucuccacccccgucaccgucugcggcgacauccacggccaguucuacgaccucugcgagcucuuccgcaccggcggccagguccccgacaccaacuacaucuucaugggcgacuucgucgaccgcggcuacuacucccucgagaccuucaccuaccuccucgcccucaaggccaaguggcccgaccgcaucacccuccuccgcggcaaccacgagucccgccagaucacccaggucuacggcuucuacgacgagugccagaccaaguacggcaacgccaacgccuggcgcuacugcaccaaggucuucgacaugcucaccgucgccgcccucaucgacgagcagauccucugcguccacggcggccucucccccgacaucaagacccucgaccagauccgcaccaucgagcgcaaccaggagaucccccacaagggcgccuucugcgaccucgucugguccgaccccgaggacgucgacaccugggccaucuccccccgcggcgccggcuggcucuucggcgccaaggucaccaacgaguucguccacaucaacaaccucaagcucaucugccgcgcccaccagcucguccacgagggcuacaaguucauguucgacgagaagcucgucaccgucugguccgcccccaacuacugcuaccgcugcggcaacaucgccuccaucauggucuucaaggacgucaacacccgcgagcccaagcucuuccgcgccguccccgacuccgagcgcgucauccccccccgcaccaccacccccuacuuccucuga

SEQ ID NO: 48040 - RNA, 2802 nt, Artificial Sequence
  derived and/or modified sequence opt2 from PPP6R2__Homo_sapiens__NP_001229828
auguucuggaaguucgaccucaacaccaccucccacgucgacaagcuccucgacaaggagcacgucacccuccaggagcucauggacgaggacgacauccuccaggagugcaaggcccagaaccagaagcuccucgacuuccucugccgccagcagugcauggaggagcucgucucccucaucacccaggaccccccccucgacauggaggagaagguccgcuucaaguaccccaacaccgccugcgagcuccucaccugcgacgucccccagaucuccgaccgccucggcggcgacgagucccuccucucccuccucuacgacuuccucgaccacgagcccccccucaacccccuccucgccuccuucuucuccaagaccaucggcaaccucaucgcccgcaagaccgagcaggucaucaccuuccucaagaagaaggacaaguucaucucccucguccucaagcacaucggcaccuccgcccucauggaccuccuccuccgccucgucuccugcgucgagcccgccggccuccgccaggacguccuccacuggcucaacgaggagaaggucauccagcgccucgucgagcucauccaccccucccaggacgaggaccgccaguccaacgccucccagacccucugcgacaucguccgccucggccgcgaccagggcucccagcuccaggaggcccucgagcccgacccccuccucaccgcccucgagucccgccaggacugcgucgagcagcuccucaagaacauguucgacggcgaccgcaccgaguccugccucgucuccggcacccagguccuccucacccuccucgagacccgccgcgucggcaccgagggccucgucgacuccuucucccagggccucgagcgcuccuacgccgucuccuccuccguccuccacggcaucgagccccgccucaaggacuuccaccagcuccuccucaacccccccaagaagaaggccauccucaccaccaucggcguccucgaggagccccucggcaacgcccgccuccacggcgcccgccucauggccgcccuccuccacaccaacacccccuccaucaaccaggagcucugccgccucaacaccauggaccuccuccucgaccucuucuucaaguacaccuggaacaacuuccuccacuuccaggucgagcucugcaucgccgccauccucucccacgccgcccgcgaggagcgcaccgaggccuccggcuccgagucccgcgucgagcccccccacgagaacggcaaccgcucccucgagaccccccagcccgccgccucccuccccgacaacaccauggucacccaccucuuccagaagugcugccucguccagcgcauccucgaggccugggaggccaacgaccacacccaggccgccggcggcaugcgccgcggcaacaugggccaccucacccgcaucgccaacgccgucguccagaaccucgagcgcggccccguccagacccacaucuccgaggucauccgcggccuccccgccgacugccgcggccgcugggaguccuucgucgaggagacccucaccgagaccaaccgccgcaacaccgucgaccucgccuucuccgacuaccagauccagcagaugaccgccaacuucgucgaccaguucggcuucaacgacgaggaguucgccgaccaggacgacaacaucaacgcccccuucgaccgcaucgccgagaucaacuucaacaucgacgccgacgaggacucccccuccgccgcccucuucgaggccugcugcuccgaccgcauccagcccuucgacgacgacgaggacgaggacaucugggaggacuccgacacccgcugcgccgcccgcgucauggcccgcccccgcuucggcgccccccacgccuccgaguccugcuccaagaacggccccgagcgcggcggccaggacggcaaggccucccucgaggcccaccgcgacgcccccggcgccggcgccccccccgcccccggcaagaaggaggccccccccgucgagggcgacuccgagggcgccauguggaccgccgucuucgacgagcccgccaacuccacccccaccgcccccggcgucguccgcgacgucggcuccuccgucugggccgccggcaccuccgcccccgaggagaagggcugggccaaguucaccgacuuccagcccuucugcugcuccgaguccggcccccgcugcuccucccccgucgacaccgagugcucccacgccgagggcucccgcucccagggccccgagaaggccuucucccccgccucccccugcgccuggaacgucugcgucacccgcaaggccccccuccucgccuccgacuccuccuccuccggcggcucccacuccgaggacggcgaccagaaggccgccuccgccauggacgccgucucccgcggccccggccgcgaggcccccccccuccccaccgucgcccgcaccgaggaggccgucggccgcgucggcugcgccgacucccgccuccucucccccgccugccccgcccccaaggaggucaccgccgcccccgccgucgccgucccccccgaggccaccgucgccaucaccaccgcccucuccaaggccggccccgccauccccacccccgccgucuccuccgcccucgccgucgccgucccccucggccccaucauggccgucaccgccgcccccgccauggucgccacccucggcaccgucaccaaggacggcaagaccgacgccccccccgagggcgccgcccucaacggccccgucuga

SEQ ID NO: 48041 - RNA, 2640 nt, Artificial Sequence
  derived and/or modified sequence opt2 from PPP6R3__Homo_sapiens__NP_001157632
auguucuggaaguucgaccuccacuccuccucccacaucgacacccuccucgagcgcgaggacgucacccucaaggagcucauggacgaggaggacguccuccaggagugcaaggcccagaaccgcaagcucaucgaguuccuccucaaggccgagugccucgaggaccucgucuccuucaucaucgaggagcccccccaggacauggacgagaagauccgcuacaaguaccccaacaucuccugcgagcuccucaccuccgacgucucccagaugaacgaccgccucggcgaggacgagucccuccucaugaagcucuacuccuuccuccucaacgacuccccccucaacccccuccucgccuccuucuucuccaagguccucuccauccucaucucccgcaagcccgagcagaucgucgacuuccucaagaagaagcacgacuucgucgaccucaucaucaagcacaucggcaccuccgccaucauggaccuccuccuccgccuccucaccugcaucgagcccccccagccccgccaggacguccucaacuggcucaacgaggagaagaucauccagcgccucgucgagaucguccaccccucccaggaggaggaccgccacuccaacgccucccagucccucugcgagaucguccgccucucccgcgaccagaugcuccagauccagaacuccaccgagcccgacccccuccucgccacccucgagaagcaggagaucaucgagcagcuccucuccaacaucuuccacaaggagaagaacgaguccgccaucgucuccgccauccagauccuccucacccuccucgagacccgccgccccaccuucgagggccacaucgagaucugcccccccggcaugucccacuccgccugcuccgucaacaaguccguccucgaggccauccgcggccgccucggcuccuuccacgagcuccuccucgagccccccaagaaguccgucaugaagaccaccuggggcguccucgacccccccgucggcaacacccgccucaacgucauccgccucaucuccucccuccuccagaccaacaccuccuccaucaacggcgaccucauggagcucaacuccaucggcgucauccucaacauguucuucaaguacaccuggaacaacuuccuccacacccaggucgagaucugcaucgcccucauccucgccucccccuucgagaacaccgagaacgccaccaucaccgaccaggacuccaccggcgacaaccuccuccucaagcaccucuuccagaagugccagcucaucgagcgcauccucgaggccugggagaugaacgagaagaagcaggccgagggcggccgccgccacggcuacaugggccaccucacccgcaucgccaacugcaucguccacuccaccgacaagggccccaacuccgcccucguccagcagcucaucaaggaccuccccgacgagguccgcgagcgcugggagaccuucugcaccuccucccucggcgagaccaacaagcgcaacaccgucgaccucgucaccaccugccacauccacuccuccuccgacgacgagaucgacuucaaggagaccggcuucucccaggacuccucccuccagcaggccuucuccgacuaccagaugcagcagaugaccuccaacuucaucgaccaguucggcuucaacgacgagaaguucgccgaccaggacgacaucggcaacgucuccuucgaccgcgucuccgacaucaacuucacccucaacaccaacgaguccggcaacaucgcccucuucgaggccugcugcaaggagcgcauccagcaguucgacgacggcggcuccgacgaggaggacaucugggaggagaagcacaucgccuucacccccgagucccagcgccgcuccuccuccggcuccaccgacuccgaggaguccaccgacuccgaggaggaggacggcgccaagcaggaccucuucgagcccuccuccgccaacaccgaggacaagauggaggucgaccucuccgagccccccaacugguccgccaacuucgacguccccauggagaccacccacggcgccccccucgacuccgucggcuccgacgucugguccaccgaggagcccaugcccaccaaggagaccggcugggccuccuucuccgaguucaccuccucccucuccaccaaggacucccuccgcuccaacucccccgucgagauggagaccuccaccgagcccauggacccccucacccccuccgccgccgcccucgccguccagcccgaggccgccggcuccgucgccauggaggccuccuccgacggcgaggaggacgccgaguccaccgacaaggucaccgagaccgucaugaacggcggcaugaaggagacccucucccucaccgucgacgccaagaccgagaccgccgucuucaagcgcguccucaaguccuaccgcgaggagggcaagcucuccaccucccaggacgccgccugcaaggacgccgaggagugccccgagaccgccgaggccaagugcgccgccccccgcccccccuccuccucccccgagcagcgcaccggccagcccuccgcccccggcgacaccuccgucaacggccccgucuga

SEQ ID NO: 48042 - RNA, 4203 nt, Artificial Sequence
  derived and/or modified sequence opt2 from PPRC1__Homo_sapiens__NP_001275656
auggccgcccgccgcggccgccgcgacggcgucgcccccccccccuccggcggccccggccccgaccccggcggcggcgcccgcggcuccggcuggggcucccgcucccaggcccccuacggcacccucggcgccgucuccggcggcgagcagguccuccuccacgaggaggccggcgacuccggcuucgucucccucucccgccucggccccucccuccgcgacaaggaccucgagauggaggagcucaugcuccaggacgagacccuccucggcaccaugcaguccuacauggacgccucccucaucucccucaucgaggacuucggcucccucggcgagucccgccucucccucgaggaccagaacgaggucucccuccucaccgcccucaccgagauccucgacaacgccgacuccgagaaccucucccccuucgacuccauccccgacuccgagcuccucgucuccccccgcgagggcuccucccuccacaagcuccucacccucucccgcaccccccccgagcgcgaccucaucacccccgucgacccccucggccccuccaccggcuccucccgcggcuccggcgucgagaugucccuccccgaccccuccugggacuucuccccccccuccuuccucgagaccuccucccccaagcuccccuccuggcgccccccccgcucccgcccccgcuggggccaguccccccccccccagcagcgcuccgacggcgaggaggaggaggaggucgccuccuucuccggccagauccucgccggcgagcucgacaacugcgucuccuccauccccgacuuccccaugcaccucgccugccccgaggaggaggacaaggccaccgccgccgagauggccguccccgccgccggcgacgaguccaucuccucccucuccgagcucguccgcgccaugcaccccuacugccuccccaaccucacccaccucgccucccucgaggacgagcuccaggagcagcccgacgaccucacccuccccgagggcugcgucguccucgagaucgucggccaggccgccaccgccggcgacgaccucgagauccccgucgucguccgccaggucucccccggcccccgccccguccuccucgacgacucccucgagaccuccuccgcccuccagcuccucaugcccacccucgaguccgagaccgaggccgccguccccaaggucacccucugcuccgagaaggagggccucucccucaacuccgaggagaagcucgacuccgccugccuccucaagccccgcgaggucgucgagcccgucguccccaaggagccccagaacccccccgccaacgccgcccccggcucccagcgcgcccgcaagggccgcaagaagaaguccaaggagcagcccgccgccugcgucgagggcuacgcccgccgccuccgcuccuccucccgcggccaguccaccgucggcaccgaggucaccucccaggucgacaaccuccagaagcagccccaggaggagcuccagaaggaguccggcccccuccagggcaagggcaagccccgcgccugggcccgcgccugggccgccgcccucgagaacuccucccccaagaaccucgagcgcuccgccggccaguccucccccgccaaggagggcccccucgaccucuaccccaagcucgccgacaccauccagaccaaccccauccccacccaccucucccucgucgacuccgcccaggccucccccaugcccgucgacuccgucgaggccgaccccaccgccgucggccccguccucgccggccccguccccgucgaccccggccucgucgaccucgccuccaccuccuccgagcucgucgagccccuccccgccgagcccguccucaucaaccccguccucgccgacuccgccgccgucgaccccgccgucguccccaucuccgacaaccucccccccgucgacgccguccccuccggccccgcccccgucgaccucgcccucgucgaccccguccccaacgaccucacccccgucgaccccguccucgucaagucccgccccaccgacccccgccgcggcgccgucuccuccgcccucggcggcuccgccccccagcuccucgucgaguccgagucccucgacccccccaagaccaucauccccgaggucaaggaggucgucgacucccucaagaucgaguccggcaccuccgccaccacccacgaggcccgcccccgcccccucucccucuccgaguaccgccgccgccgccagcagcgccaggccgagaccgaggagcgcuccccccagccccccaccggcaaguggcccucccuccccgagacccccaccggccucgccgacauccccugccucgucaucccccccgcccccgccaagaagaccgcccuccagcgcucccccgagaccccccucgagaucugccucguccccgucggccccucccccgccucccccucccccgagccccccgucuccaagcccgucgccuccucccccaccgagcagguccccucccaggagaugccccuccucgcccgccccuccccccccguccaguccgucucccccgccguccccaccccccccuccauguccgccgcccuccccuuccccgccggcggccucggcaugccccccucccuccccccccccccccuccagccccccucccucccccucuccaugggccccguccuccccgaccccuucacccacuacgccccccuccccuccuggcccugcuacccccacgucucccccuccggcuaccccugccucccccccccccccaccgucccccucgucuccggcacccccggcgccuacgccgucccccccaccugcuccguccccugggcccccccccccgcccccgucucccccuacuccuccaccugcaccuacggcccccucggcuggggccccggcccccagcacgcccccuucugguccaccguccccccccccccccucccccccgccuccaucggccgcgccgucccccagcccaagauggagucccgcggcacccccgccggcccccccgagaacguccucccccucuccauggcccccccccucucccucggccuccccggccacggcgccccccagaccgagcccaccaaggucgaggucaagcccguccccgccuccccccaccccaagcacaaggucuccgcccucguccaguccccccagaugaaggcccucgccugcgucuccgccgagggcgucaccgucgaggagcccgccuccgagcgccucaagcccgagacccaggagacccgcccccgcgagaagcccccccuccccgccaccaaggccguccccaccccccgccaguccaccguccccaagcuccccgccguccaccccgcccgccuccgcaagcucuccuuccuccccaccccccgcacccagggcuccgaggacgucguccaggccuucaucuccgagaucggcaucgaggccuccgaccucuccucccuccucgagcaguucgagaaguccgaggccaagaaggagugccccccccccgcccccgccgacucccucgccgucggcaacuccggcuccuccugcuccuccuccggccgcucccgccgcugcuccuccuccuccuccuccuccuccuccuccuccuccuccuccuccuccuccuccuccucccgcucccgcucccgcucccccuccccccgccgccgcuccgaccgccgccgccgcuacuccuccuaccgcucccacgaccacuaccagcgccagcgcguccuccagaaggagcgcgccaucgaggagcgccgcgucgucuucaucggcaagauccccggccgcaugacccgcuccgagcucaagcagcgcuucuccgucuucggcgagaucgaggagugcaccauccacuuccgcguccagggcgacaacuacggcuucgucaccuaccgcuacgccgaggaggccuucgccgccaucgaguccggccacaagcuccgccaggccgacgagcagcccuucgaccucugcuucggcggccgccgccaguucugcaagcgcuccuacuccgaccucgacuccaaccgcgaggacuucgaccccgcccccgucaaguccaaguucgacucccucgacuucgacacccuccucaagcaggcccagaagaaccuccgccgcuga

SEQ ID NO: 48043 - RNA, 909 nt, Artificial Sequence
  derived and/or modified sequence opt2 from PPT2__Homo_sapiens__NP_001191032
augcucggccucugcggccagcgccuccccgccgccuggguccuccuccuccuccccuuccucccccuccuccuccucgccgcccccgccccccaccgcgccuccuacaagcccgucaucgucguccacggccucuucgacuccuccuacuccuuccgccaccuccucgaguacaucaacgagacccaccccggcaccgucgucaccguccucgaccucuucgacggccgcgagucccuccgcccccucugggagcagguccagggcuuccgcgaggccgucguccccaucauggccaaggccccccagggcguccaccucaucugcuacucccagggcggccucgucugccgcgcccuccucuccgucauggacgaccacaacgucgacuccuucaucucccucuccuccccccagaugggccaguacggcgacaccgacuaccucaaguggcucuuccccaccuccaugcgcuccaaccucuaccgcaucugcuacucccccuggggccaggaguucuccaucugcaacuacuggcacgacccccaccacgacgaccucuaccucaacgccuccuccuuccucgcccucaucaacggcgagcgcgaccaccccaacgccaccgucuggcgcaagaacuuccuccgcgucggccaccucguccucaucggcggccccgacgacggcgucaucacccccuggcaguccuccuucuucggcuucuacgacgccaacgagaccguccucgagauggaggagcagcucgucuaccuccgcgacuccuucggccucaagacccuccucgcccgcggcgccaucguccgcugccccauggccggcaucucccacaccgccuggcacuccaaccgcacccucuacgagaccugcaucgagcccuggcucuccuga

SEQ ID NO: 48044 - RNA, 288 nt, Artificial Sequence
  derived and/or modified sequence opt2 from PPY__Homo_sapiens__NP_002713
auggccgccgcccgccucugccucucccuccuccuccucuccaccugcgucgcccuccuccuccagccccuccucggcgcccagggcgccccccucgagcccgucuaccccggcgacaacgccacccccgagcagauggcccaguacgccgccgaccuccgccgcuacaucaacaugcucacccgcccccgcuacggcaagcgccacaaggaggacacccucgccuucuccgaguggggcuccccccacgccgccgucccccgcgagcucuccccccucgaccucuga

SEQ ID NO: 48045 - RNA, 498 nt, Artificial Sequence
  derived and/or modified sequence opt2 from PQBP1__Homo_sapiens__NP_001161464
augccccuccccgucgcccuccagacccgccucgccaagcgcggcauccucaagcaccucgagcccgagcccgaggaggagaucaucgccgaggacuacgacgacgaccccgucgacuacgaggccacccgccucgagggccucccccccuccugguacaaggucuucgaccccuccugcggccuccccuacuacuggaacgccgaccgcgaggagggcaaggagcgccgccaccaccgccgcgaggagcucgcccccuaccccaaguccaagaaggccgucucccgcaaggacgaggagcucgaccccauggaccccuccuccuacuccgacgccccccgcggcaccugguccaccggccuccccaagcgcaacgaggccaagaccggcgccgacaccaccgccgccggcccccucuuccagcagcgccccuaccccucccccggcgccguccuccgcgccaacgccgaggccucccgcaccaagcagcaggacuga

SEQ ID NO: 48046 - RNA, 567 nt, Artificial Sequence
  derived and/or modified sequence opt2 from PQLC3__Homo_sapiens__NP_001269639
auggaggccgcccuccucggccucugcaacugguccacccucggcgucugcgccgcccucaagcucccccagaucuccgccguccucgccgcccgcuccgcccgcggccucucccuccccucccuccuccucgagcucgccggcuuccucgucuuccuccgcuaccagugcuacuacggcuaccccccccucaccuaccucgaguaccccauccucaucgcccaggacgucauccuccuccucugcaucuuccacuucaacggcaacgucaagcaggccacccccuacaucgccguccucgucuccuccugguucauccucgcccuccagaaguggaucaucgaccucgccaugaaccucugcaccuucaucuccgccgccuccaaguucgcccagcuccagugccucuggaagacccgcgacuccggcaccgucuccgcccucaccuggucccucuccuccuacaccugcgccauccuccuccgcuucgucaucaugcucgcccucaacaucugggucaccgucaccguccuccgcuaccgcaagaccgccaucaaggccgaguga

SEQ ID NO: 48047 - RNA, 174 nt, Artificial Sequence
  derived and/or modified sequence opt2 from PRAC1__Homo_sapiens__NP_115767
augcucugcgcccacuucuccgaccagggccccgcccaccucaccaccuccaaguccgccuuccucuccaacaagaagaccuccacccucaagcaccuccucggcgagacccgcuccgacggcuccgccugcaacuccggcaucuccggcggccgcggccgcaagauccccuga

SEQ ID NO: 48048 - RNA, 273 nt, Artificial Sequence
  derived and/or modified sequence opt2 from PRAC2__Homo_sapiens__XP_011523050
auggaccgccgccgcauggcccuccgccccggcucccgccgccccaccgccuucuucuuccacucccgcuggcucguccccaaccuccucgccuucuuccucggccucuccggcgccggccccauccaccuccccaugcccuggcccaacggccgccgccaccgcguccucgacccccacacccagcucuccacccacgaggcccccggccgcuggaagcccgucgccccccgcaccaugaaggccugcccccagguccuccucgagugguga

SEQ ID NO: 48049 - RNA, 567 nt, Artificial Sequence
  derived and/or modified sequence opt2 from PRADC1__Homo_sapiens__NP_115695
augguccccggcgccgccggcuggugcugccucguccucuggcuccccgccugcgucgccgcccacggcuuccgcauccacgacuaccucuacuuccagguccucucccccggcgacauccgcuacaucuucaccgccacccccgccaaggacuucggcggcaucuuccacacccgcuacgagcagauccaccucguccccgccgagccccccgaggccugcggcgagcucuccaacggcuucuucauccaggaccagaucgcccucgucgagcgcggcggcugcuccuuccucuccaagacccgcgucguccaggagcacggcggccgcgccgucaucaucuccgacaacgccgucgacaacgacuccuucuacgucgagaugauccaggacuccacccagcgcaccgccgacauccccgcccucuuccuccucggccgcgacggcuacaugauccgccgcucccucgagcagcacggccuccccugggccaucaucuccauccccgucaacgucaccuccauccccaccuucgagcuccuccagccccccuggaccuucugguga

SEQ ID NO: 48050 - RNA, 537 nt, Artificial Sequence
  derived and/or modified sequence opt2 from PRAF2__Homo_sapiens__NP_009144
auguccgagguccgccuccccccccuccgcgcccucgacgacuucguccucggcuccgcccgccucgccgcccccgaccccugcgacccccagcgcuggugccaccgcgucaucaacaaccuccucuacuaccagaccaacuaccuccucugcuucggcaucggccucgcccucgccggcuacguccgcccccuccacacccuccucuccgcccucgucgucgccgucgcccucggcguccucgucugggccgccgagacccgcgccgccguccgccgcugccgccgcucccaccccgccgccugccucgccgccguccucgccgucggccuccucguccucugggucgccggcggcgccugcaccuuccucuucuccaucgccggccccguccuccucauccucguccacgccucccuccgccuccgcaaccucaagaacaagaucgagaacaagaucgaguccaucggccucaagcgcacccccaugggccuccuccucgaggcccucggccaggagcaggaggccggcuccuga

SEQ ID NO: 48051 - RNA, 2013 nt, Artificial Sequence
  derived and/or modified sequence opt2 from PRAM1__Homo_sapiens__NP_115528
auggcccaccaccuccccgccgccauggagucccaccaggacuuccgcuccaucaaggccaaguuccaggccucccagcccgagcccuccgaccuccccaagaagccccccaagcccgaguucggcaagcucaagaaguucucccagcccgagcucuccgagcaccccaagaaggccccccuccccgaguucggcgccgucucccucaagccccccccccccgaggucaccgaccuccccaagaagccccccccccccgaggucaccgaccuccccaagaagccccccccccccgaggucaccgaccuccccaagaagccccccccccccgaggucaccgaccuccccaagaagcccuccaagcucgagcucuccgaccucuccaagaaguucccccagcucggcgccacccccuucccccgcaagccccuccagcccgaggucggcgaggccccccucaaggccucccuccccgagcccggcgcccccgcccgcaagccccuccagcccgacgagcucucccaccccgcccgcccccccuccgagcccaaguccggcgccuucccccgcaagcucuggcagcccgaggccggcgaggccaccccccgcuccccccagcccgagcucuccaccuuccccaagaagcccgcccagcccgaguucaacgucuaccccaagaagcccccccagccccaggucggcggccuccccaagaaguccgucccccagcccgaguucuccgaggccgcccagaccccccucuggaagccccaguccuccgagcccaagcgcgacuccuccgccuuccccaagaaggccucccagcccccccucuccgacuuccccaagaagcccccccagcccgagcucggcgaccucacccgcaccuccuccgagcccgaggucuccguccuccccaagcgcccccgccccgccgaguucaaggcccucuccaagaagcccccccagcccgagcucggcggccucccccgcaccuccuccgagcccgaguucaacucccucccccgcaagcuccuccagcccgagcgccgcggccccccccgcaaguucucccagcccgagcccuccgccguccucaagcgccacccccagcccgaguucuucggcgaccucccccgcaagcccccccuccccuccuccgccuccgaguccucccuccccgccgccgucgccggcuucuccucccgccacccccucucccccggcuucggcgccgccggcaccccccgcuggcgcuccggcggccucguccacuccggcggcgcccgccccggccuccgccccucccaccccccccgccgccgcccccucccccccgccuccucccucggccacccccccgccaagcccccccucccccccggccccgucgacaugcaguccuuccgccgccccuccgccgccuccaucgaccuccgccgcacccgcuccgccgccggccuccacuuccaggaccgccagcccgaggacaucccccagguccccgacgagaucuacgagcucuacgacgacgucgagccccgcgacgacuccucccccucccccaagggccgcgacgaggcccccuccguccagcaggccgcccgccgccccccccaggaccccgcccuccgcaaggagaaggacccccagccccagcagcucccccccauggaccccaagcuccucaagcagcuccgcaaggccgagaaggccgagcgcgaguuccgcaagaaguucaaguucgagggcgagaucgucguccacaccaagaugaugaucgaccccaacgccaagacccgccgcggcggcggcaagcaccucggcauccgccgcggcgagauccucgaggucaucgaguucaccuccaacgaggagaugcucugccgcgaccccaagggcaaguacggcuacgucccccgcaccgcccuccucccccucgagaccgaggucuacgacgacgucgacuucugcgacccccucgagaaccagccccucccccucggccgcuga

SEQ ID NO: 48052 - RNA, 1530 nt, Artificial Sequence
  derived and/or modified sequence opt2 from PRAME__Homo_sapiens__NP_996837
auggagcgccgccgccucuggggcuccauccagucccgcuacaucuccauguccgucuggaccuccccccgccgccucgucgagcucgccggccagucccuccucaaggacgaggcccucgccaucgccgcccucgagcuccucccccgcgagcucuuccccccccucuucauggccgccuucgacggccgccacucccagacccucaaggccaugguccaggccuggcccuucaccugccucccccucggcguccucaugaagggccagcaccuccaccucgagaccuucaaggccguccucgacggccucgacguccuccucgcccaggagguccgcccccgccgcuggaagcuccagguccucgaccuccgcaagaacucccaccaggacuucuggaccgucugguccggcaaccgcgccucccucuacuccuuccccgagcccgaggccgcccagcccaugaccaagaagcgcaaggucgacggccucuccaccgaggccgagcagcccuucauccccgucgagguccucgucgaccucuuccucaaggagggcgccugcgacgagcucuucuccuaccucaucgagaaggucaagcgcaagaagaacguccuccgccucugcugcaagaagcucaagaucuucgccaugcccaugcaggacaucaagaugauccucaagaugguccagcucgacuccaucgaggaccucgaggucaccugcaccuggaagcuccccacccucgccaaguucucccccuaccucggccagaugaucaaccuccgccgccuccuccucucccacauccacgccuccuccuacaucucccccgagaaggaggagcaguacaucgcccaguucaccucccaguuccucucccuccagugccuccaggcccucuacgucgacucccucuucuuccuccgcggccgccucgaccagcuccuccgccacgucaugaacccccucgagacccucuccaucaccaacugccgccucuccgagggcgacgucaugcaccucucccagucccccuccgucucccagcucuccguccucucccucuccggcgucaugcucaccgacgucucccccgagccccuccaggcccuccucgagcgcgccuccgccacccuccaggaccucgucuucgacgagugcggcaucaccgacgaccagcuccucgcccuccuccccucccucucccacugcucccagcucaccacccucuccuucuacggcaacuccaucuccaucuccgcccuccagucccuccuccagcaccucaucggccucuccaaccucacccacguccucuaccccgucccccucgaguccuacgaggacauccacggcacccuccaccucgagcgccucgccuaccuccacgcccgccuccgcgagcuccucugcgagcucggccgccccuccauggucuggcucuccgccaaccccugcccccacugcggcgaccgcaccuucuacgaccccgagcccauccucugccccugcuucaugcccaacuga

SEQ ID NO: 48053 - RNA, 429 nt, Artificial Sequence
  derived and/or modified sequence opt2 from PRAP1__Homo_sapiens__NP_001138673
augcgccgccuccuccucgucaccucccucgucgucguccuccucugggaggccggcgccguccccgcccccaagguccccaucaagaugcaggucaagcacuggcccuccgagcaggaccccgagaaggccuggggcgcccgcgucgucgagccccccgagaaggacgaccagcucgucguccucuuccccguccagaagcccaagcuccucaccaccgaggagaagccccgcggcaccaaggccuggauggagaccgaggacacccucggccacguccucucccccgagcccgaccacgacucccucuaccaccccccccccgaggaggaccagggcgaggagcgcccccgccucugggucaugcccaaccaccagguccuccucggccccgaggaggaccaggaccacaucuaccacccccaguga

SEQ ID NO: 48054 - RNA, 996 nt, Artificial Sequence
  derived and/or modified sequence opt2 from PRB1__Homo_sapiens__NP_005030
augcuccucauccuccucuccgucgcccuccucgcccucuccuccgcccagaaccucaacgaggacgucucccaggaggagucccccucccucaucgccggcaacccccagggccccuccccccagggcggcaacaagccccagggccccccccccccccccggcaagccccagggcccccccccccagggcggcaacaagccccagggcccccccccccccggcaagccccagggcccccccccccagggcgacaagucccgcuccccccgcuccccccccggcaagccccagggcccccccccccagggcggcaaccagccccagggccccccccccccccccggcaagccccagggcccccccccccagggcggcaaccgcccccagggcccccccccccccggcaagccccagggcccccccccccagggcgacaagucccgcuccccccgcuccccccccggcaagccccagggcccccccccccagggcggcaaccagccccagggccccccccccccccccggcaagccccagggcccccccccccagggcggcaagaagccccagggcccccccccccccggcaagccccagggcccccccccccagggcgacaagucccgcuccucccaguccccccccggcaagccccagggcccccccccccagggcggcaaccagccccagggccccccccccccccccggcaagccccagggcccccccccccagggcggcaacaagccccagggcccccccccccccggcaagccccagggcccccccgcccagggcggcuccaagucccaguccgcccgcuccccccccggcaagccccagggccccccccagcaggagggcaacaacccccagggcccccccccccccgccggcggcaacccccagcagccccaggccccccccgccggccagccccagggccccccccgccccccccagggcggccgccccucccgccccccccaguga

SEQ ID NO: 48055 - RNA, 1251 nt, Artificial Sequence
  derived and/or modified sequence opt2 from PRB2__Homo_sapiens__NP_006239
augcuccucauccuccucuccgucgcccuccucgcccucuccuccgcccagaaccucaacgaggacgucucccaggaggagucccccucccucaucgccggcaacccccagggcgcccccccccagggcggcaacaagccccagggcccccccuccccccccggcaagccccagggcccccccccccagggcggcaaccagccccagggccccccccccccccccggcaagccccagggcccccccccccagggcggcaacaagccccagggcccccccccccccggcaagccccagggcccccccccccagggcgacaagucccgcuccccccgcuccccccccggcaagccccagggcccccccccccagggcggcaaccagccccagggccccccccccccccccggcaagccccagggcccccccccccagggcggcaacaagccccagggcccccccccccccggcaagccccagggcccccccccccagggcgacaacaagucccgcuccucccgcuccccccccggcaagccccagggcccccccccccagggcggcaaccagccccagggccccccccccccccccggcaagccccagggcccccccccccagggcggcaacaagccccagggcccccccccccccggcaagccccagggcccccccccccagggcgacaacaagucccaguccgcccgcuccccccccggcaagccccagggcccccccccccagggcggcaaccagccccagggccccccccccccccccggcaagccccagggcccccccccccagggcggcaacaagccccagggcccccccccccccggcaagccccagggcccccccccccagggcggcuccaagucccgcuccucccgcuccccccccggcaagccccagggcccccccccccagggcggcaaccagccccagggccccccccccccccccggcaagccccagggcccccccccccagggcggcaacaagccccagggcccccccccccccggcaagccccagggcccccccccccagggcggcuccaagucccgcuccgcccgcuccccccccggcaagccccagggccccccccagcaggagggcaacaacccccagggcccccccccccccgccggcggcaacccccagcagccccaggccccccccgccggccagccccagggccccccccgccccccccagggcggccgccccucccgccccccccaguga

SEQ ID NO: 48056 - RNA, 930 nt, Artificial Sequence
  derived and/or modified sequence opt2 from PRB3__Homo_sapiens__NP_006240
augcuccucauccuccucuccgucgcccuccucgcccucuccuccgcccagucccucaacgaggacgucucccaggaggagucccccuccgucaucuccggcaagcccgagggccgccgcccccagggcggcaaccagccccagcgcaccccccccccccccggcaagcccgagggccgccccccccagggcggcaaccagucccagggcccccccccccgccccggcaagcccgagggcccccccccccagggcggcaaccagucccagggcccccccccccgccccggcaagcccgagggccagcccccccagggcggcaaccagucccagggcccccccccccgccccggcaagcccgagggcccccccccccagggcggcaaccagucccagggcccccccccccgccccggcaagcccgagggcccccccccccagggcggcaaccagucccagggcccccccccccgccccggcaagcccgagggcccccccccccagggcggcaaccagucccagggcccccccccccaccccggcaagcccgagggcccccccccccagggcggcaaccagucccagggcccccccccccgccccggcaagcccgagggcccccccccccagggcggcaaccagucccagggcccccccccccgccccggcaagcccgagggcccccccucccagggcggcaacaagccccagggcccccccccccaccccggcaagccccagggcccccccccccaggagggcaacaagccccagcgcccccccccccccggccgcccccagggcccccccccccccggcggcaacccccagcagccccuccccccccccgccggcaagccccagggcccccccccccccccccagggcggccgcccccaccgccccccccagggccagcccccccaguga

SEQ ID NO: 48057 - RNA, 537 nt, Artificial Sequence
  derived and/or modified sequence opt2 from PRB4__Homo_sapiens__NP_001248328
augcuccucauccuccucuccgucgcccuccucgcccucuccuccgccgaguccuccuccgaggacgucucccaggaggagucccucuuccucaucuccggcaagcccgagggccgccgcccccagggcggcaaccagccccagcgccccccccccccccccggcaagccccagggcccccccccccagggcggcaaccagucccagggccccccccccccccccggcaagcccgagggccgccccccccagggcggcaaccagucccagggcccccccccccaccccggcaagcccgagcgcccccccccccagggcggcaaccagucccagggcaagccccagggccccccccagcaggagggcaacaagccccagggcccccccccccccggcaagccccagggccccccccccgccggcggcaacccccagcagccccaggccccccccgccggcaagccccagggcccccccccccccccccagggcggccgccccccccgccccgcccagggccagcagcccccccaguga

SEQ ID NO: 48058 - RNA, 1578 nt, Artificial Sequence
  derived and/or modified sequence opt2 from PRC1__Homo_sapiens__NP_001254509
augcgccgcuccgagguccucgccgaggaguccaucgucugccuccagaaggcccucaaccaccuccgcgagaucugggagcucaucggcauccccgaggaccagcgccuccagcgcaccgaggucgucaagaagcacaucaaggaggagggcgagaccaccauccuccagcucgagaaggaccuccgcacccaggucgagcucaugcgcaagcagaagaaggagcgcaagcaggagcucaagcuccuccaggagcaggaccaggagcucugcgagauccucugcaugccccacuacgacaucgacuccgccuccguccccucccucgaggagcucaaccaguuccgccagcacgucaccacccuccgcgagaccaaggccucccgccgcgaggaguucgucuccaucaagcgccagaucauccucugcauggaggagcucgaccacacccccgacaccuccuucgagcgcgacgucgucugcgaggacgaggacgccuucugccucucccucgagaacaucgccacccuccagaagcuccuccgccagcucgagaugcagaagucccagaacgaggccgucugcgagggccuccgcacccagauccgcgagcucugggaccgccuccagauccccgaggaggagcgcgaggccgucgccaccaucauguccggcuccaaggccaagguccgcaaggcccuccagcucgaggucgaccgccucgaggagcucaagaugcagaacaugaagaaggucaucgaggccauccgcgucgagcucguccaguacugggaccagugcuucuacucccaggagcagcgccaggccuucgcccccuucugcgccgaggacuacaccgagucccuccuccagcuccacgacgccgagaucguccgccucaagaacuacuacgagguccacaaggagcucuucgagggcguccagaagugggaggagaccuggcgccucuuccucgaguucgagcgcaaggccuccgaccccaaccgcuucaccaaccgcggcggcaaccuccucaaggaggagaagcagcgcgccaagcuccagaagaugcuccccaagcucgaggaggagcucaaggcccgcaucgagcucugggagcaggagcacuccaaggccuucauggucaacggccagaaguucauggaguacgucgccgagcagugggagaugcaccgccucgagaaggagcgcgccaagcaggagcgccagcucaagaacaagaagcagaccgagaccgagaugcucuacggcuccgccccccgcacccccuccaagcgccgcggccucgcccccaacacccccggcaaggcccgcaagcucaacaccaccaccauguccaacgccaccgccaacuccuccauccgccccaucuucggcggcaccgucuaccacucccccgucucccgccucccccccuccggcuccaagcccgucgccgccuccaccugcuccggcaagaagaccccccgcaccggccgccacggcgccaacaaggagaaccucgagcucaacggcuccauccucuccgcccgcaccuucaagggcuuccagaucuga

SEQ ID NO: 48059 - RNA, 1476 nt, Artificial Sequence
  derived and/or modified sequence opt2 from PRCC__Homo_sapiens__NP_005964
augucccucgucgccuacgccuccuccgacgaguccgagcccgacgaggccgagcccgagcccgaggaggaggaggccgucgcccccaccuccggccccgcccucggcggccucuucgccucccuccccgcccccaagggccccgcccuccuccccccccccccccagaugcucgcccccgccuucccccccccccuccuccuccccccccccaccggcgacccccgccuccagcccccccccccccuccccuucggccucggcggcuucccccccccccccggcgucucccccgccgaggccgccggcgucggcgagggccucggccucggccuccccuccccccgcggccccggccucaaccuccccccccccaucggcggcgccggccccccccucggccuccccaagcccaagaagcgcaaggagcccgucaagaucgccgcccccgagcuccacaagggcgacuccgacuccgaggaggacgagcccaccaagaagaagaccauccuccagggcuccuccgagggcaccggccucuccgcccuccucccccagcccaagaaccucaccgucaaggagaccaaccgccuccuccucccccacgccuucucccgcaagcccuccgacggcucccccgacaccaagcccucccgccucgccuccaagaccaagaccuccucccucgcccccgucgucggcaccaccaccaccacccccucccccuccgccaucaaggccgccgccaaguccgccgcccuccaggucaccaagcagaucacccaggaggaggacgacuccgacgaggaggucgcccccgagaacuucuucucccuccccgagaaggccgagccccccggcgucgagcccuaccccuaccccauccccaccguccccgaggagcucccccccggcaccgagcccgagcccgccuuccaggacgacgccgccaacgccccccucgaguucaagauggccgccggcuccuccggcgcccccuggaugcccaagcccggcgacgacuacuccuacaaccaguucuccaccuacggcgacgccaacgccgccggcgccuacuaccaggacuacuacuccggcggcuacuaccccgcccaggaccccgcccucguccccccccaggagaucgcccccgacgccuccuucaucgacgacgaggccuucaagcgccuccagggcaagcgcaaccgcggccgcgaggagaucaacuucgucgagaucaagggcgacgaccagcucuccggcgcccagcaguggaugaccaagucccucaccgaggagaagaccaugaaguccuucuccaagaagaagggcgagcagcccaccggccagcagcgccgcaagcaccagaucaccuaccucauccaccaggccaaggagcgcgagcucgagcucaagaacaccugguccgagaacaagcucucccgccgccagacccaggccaaguacggcuucuga

SEQ ID NO: 48060 - RNA, 165 nt, Artificial Sequence
  derived and/or modified sequence opt2 from PRCD__Homo_sapiens__NP_001071088
augugcaccacccucuuccuccucuccacccucgccaugcucuggcgccgccgcuucgccaaccgcguccagcccgagcccuccgacgucgacggcgccgcccgcggcuccucccucgacgccgacccccaguccuccggccgcgagaaggagccccucaaguga

SEQ ID NO: 48061 - RNA, 1491 nt, Artificial Sequence
  derived and/or modified sequence opt2 from PRCP__Homo_sapiens__NP_005031
augggccgccgcgcccuccuccuccuccuccucuccuuccucgcccccugggccaccaucgcccuccgccccgcccuccgcgcccucggcucccuccaccuccccaccaaccccaccucccuccccgccgucgccaagaacuacuccguccucuacuuccagcagaaggucgaccacuucggcuucaacaccgucaagaccuucaaccagcgcuaccucgucgccgacaaguacuggaagaagaacggcggcuccauccucuucuacaccggcaacgagggcgacaucaucugguucugcaacaacaccggcuucaugugggacgucgccgaggagcucaaggccaugcucgucuucgccgagcaccgcuacuacggcgagucccuccccuucggcgacaacuccuucaaggacucccgccaccucaacuuccucaccuccgagcaggcccucgccgacuucgccgagcucaucaagcaccucaagcgcaccauccccggcgccgagaaccagcccgucaucgccaucggcggcuccuacggcggcaugcucgccgccugguuccgcaugaaguacccccacauggucgucggcgcccucgccgccuccgcccccaucuggcaguucgaggaccucguccccugcggcgucuucaugaagaucgucaccaccgacuuccgcaaguccggcccccacugcuccgaguccauccaccgcuccugggacgccaucaaccgccucuccaacaccggcuccggccuccaguggcucaccggcgcccuccaccucugcuccccccucaccucccaggacauccagcaccucaaggacuggaucuccgagaccugggucaaccucgccauggucgacuaccccuacgccuccaacuuccuccagccccuccccgccuggcccaucaaggucgucugccaguaccucaagaaccccaacgucuccgacucccuccuccuccagaacaucuuccaggcccucaacgucuacuacaacuacuccggccaggucaagugccucaacaucuccgagaccgccaccuccucccucggcacccucggcugguccuaccaggccugcaccgaggucgucaugcccuucugcaccaacggcgucgacgacauguucgagccccacuccuggaaccucaaggagcucuccgacgacugcuuccagcaguggggcguccgcccccgccccuccuggaucaccaccauguacggcggcaagaacaucuccucccacaccaacaucgucuucuccaacggcgagcucgaccccugguccggcggcggcgucaccaaggacaucaccgacacccucgucgccgucaccaucuccgagggcgcccaccaccucgaccuccgcaccaagaacgcccucgaccccauguccguccuccucgcccgcucccucgagguccgccacaugaagaacuggauccgcgacuucuacgacuccgccggcaagcagcacuga

SEQ ID NO: 48062 - RNA, 3483 nt, Artificial Sequence
  derived and/or modified sequence opt2 from PRDM10__Homo_sapiens__NP_064613
auggacuccaaggacgaguccucccacgucuggcccaccuccgccgagcacgagcagaacgccgcccagguccacuucguccccgacaccggcaccgucgcccagaucgucuacaccgacgaccagguccgccccccccagcaggucgucuacaccgccgacggcgccuccuacaccuccgucgacggccccgagcacacccucgucuacauccaccccgucgaggccgcccagacccucuucaccgaccccggccaggucgccuacguccagcaggacgccaccgcccagcaggccucccuccccguccacaaccagguccuccccuccaucgaguccgucgacggcuccgacccccucgccacccuccagaccccccucggccgccucgaggccaaggaggaggaggacgaggacgaggacgaggacaccgaggaggacgaggaggaggacggcgaggacaccgaccucgacgacugggagcccgaccccccccgccccuucgacccccacgaccucuggugcgaggagugcaacaacgcccacgccuccgucugccccaagcacggcccccuccaccccauccccaaccgccccguccucacccgcgcccgcgccucccucccccucguccucuacaucgaccgcuuccucggcggcgucuucuccaagcgccgcauccccaagcgcacccaguucggccccgucgagggcccccucguccgcggcuccgagcucaaggacugcuacauccaccucaaggucucccucgacaagggcgaccgcaaggagcgcgaccuccacgaggaccucugguucgagcucuccgacgagacccucugcaacuggaugauguucguccgccccgcccagaaccaccucgagcagaaccucgucgccuaccaguacggccaccacgucuacuacaccaccaucaagaacgucgagcccaagcaggagcucaaggucugguacgccgccuccuacgccgaguucgucaaccagaagauccacgacaucuccgaggaggagcgcaagguccuccgcgagcaggagaagaacuggcccugcuacgagugcaaccgccgcuucaucuccuccgagcagcuccagcagcaccucaacucccacgacgagaagcucgacgucuucucccgcacccgcggccgcggccgcggccgcggcaagcgccgcuucggccccggccgccgccccggccgcccccccaaguucauccgccucgagaucaccuccgagaacggcgagaaguccgacgacggcacccaggaccuccuccacuuccccaccaaggagcaguucgacgaggccgagcccgccacccucaacggccucgaccagcccgagcagaccaccauccccaucccccagcucccccaggagacccaguccucccucgagcacgagcccgagacccacacccuccaccuccagccccagcacgaggaguccgucguccccacccaguccacccucaccgccgacgacaugcgccgcgccaagcgcauccgccucgagcuccagaacgccgcccuccagcaccucuucauccgcaaguccuuccgccccuucaagugccuccagugcggcaaggccuuccgcgagaaggacaagcucgaccagcaccuccgcuuccacggccgcgagggcaacugcccccucaccugcgaccucugcaacaagggcuucaucuccuccaccucccucgagucccacaugaagcuccacuccgaccagaagaccuacuccugcaucuucugccccgaguccuucgaccgccucgaccuccucaaggaccacgucgccauccacaucaacgacggcuacuucaccugccccaccugcaagaagcgcuuccccgacuucauccaggucaagaagcacguccgcuccuuccacuccgagaagaucuaccagugcaccgagugcgacaaggccuucugccgccccgacaagcuccgccuccacaugcuccgccacuccgaccgcaaggacuuccucugcuccaccugcggcaagcaguucaagcgcaaggacaagcuccgcgagcacaugcagcgcaugcacaaccccgagcgcgaggccaagaaggccgaccgcaucucccgcuccaagaccuucaagccccgcaucaccuccaccgacuacgacuccuucaccuucaagugccgccucugcaugaugggcuuccgccgccgcggcaugcucgucaaccaccucuccaagcgccaccccgacaugaagaucgaggagguccccgagcucacccuccccaucaucaagcccaaccgcgacuacuucugccaguacugcgacaaggucuacaaguccgccuccaagcgcaaggcccacauccucaagaaccaccccggcgccgagcucccccccuccauccgcaagcuccgccccgccggccccggcgagcccgaccccaugcucuccacccacacccagcucaccggcaccaucgccaccccccccgucugcugcccccacugcuccaagcaguacuccuccaagaccaagaugguccagcacauccgcaagaagcaccccgaguucgcccagcucuccaacaccauccacaccccccucaccaccgccgucaucuccgccacccccgccguccucaccaccgacuccgccaccggcgagaccgucgucaccaccgaccuccucacccaggccaugaccgagcucucccagacccucaccaccgacuaccgcaccccccagggcgacuaccagcgcauccaguacauccccgucucccaguccgccuccggccuccagcagccccagcacauccagcuccaggucguccaggucgccuccgccaccuccccccaccagucccagcaguccaccgucgacgucggccagcuccacgacccccagcccuacccccagcacgccauccagguccagcacauccaggucuccgagcccaccgccuccgcccccuccuccgcccaggucuccggccagccccucucccccuccgcccagcaggcccagcagggccucucccccucccacauccagggcuccuccuccacccagggccaggcccuccagcagcagcagcagcagcagcagaacuccuccguccagcacaccuaccuccccuccgccuggaacuccuuccgcggcuacuccuccgagauccagaugaugacccucccccccggccaguucgucaucaccgacuccggcgucgccacccccgucaccaccggccaggucaaggccgucaccuccggccacuacguccucuccgagucccaguccgagcucgaggagaagcagaccuccgcccucuccggcggcguccaggucgagccccccgcccacuccgacucccucgacccccagaccaacucccagcagcagaccacccaguacaucaucaccaccaccaccaacggcaacggcuccuccgagguccacaucaccaagcccuga

SEQ ID NO: 48063 - RNA, 1434 nt, Artificial Sequence
  derived and/or modified sequence opt2 from PRDM11__Homo_sapiens__NP_001243625
augaccgagaacaugaaggagugccucgcccagaccaacgccgccgucggcgacauggucaccgucgucaagaccgaggucugcuccccccuccgcgaccaggaguacggccagcccugcucccgccgccccgacuccuccgccauggaggucgagcccaagaagcucaagggcaagcgcgaccucaucguccccaaguccuuccagcaggucgacuucugguucugcgaguccugccaggaguacuucgucgacgagugccccaaccacggcccccccgucuucgucuccgacacccccguccccgucggcauccccgaccgcgccgcccucaccaucccccagggcauggaggucgucaaggacaccuccggcgaguccgacguccgcugcgucaacgaggucauccccaagggccacaucuucggccccuacgagggccagaucuccacccaggacaaguccgccggcuucuucuccuggcucaucgucgacaagaacaaccgcuacaaguccaucgacggcuccgacgagaccaaggccaacuggaugcgcuacgucgucaucucccgcgaggagcgcgagcagaaccuccucgccuuccagcacuccgagcgcaucuacuuccgcgccugccgcgacauccgccccggcgaguggcuccgcgucugguacuccgaggacuacaugaagcgccuccacuccaugucccaggagaccauccaccgcaaccucgcccgcggcgagaagcgccuccagcgcgagaaguccgagcagguccucgacaaccccgaggaccuccgcggccccauccaccucuccguccuccgccagggcaagucccccuacaagcgcggcuucgacgagggcgacguccacccccaggccaagaagaagaagaucgaccucaucuucaaggacguccucgaggccucccucgaguccgccaaggucgaggcccaccagcucgcccucuccaccucccucgucauccgcaagguccccaaguaccaggacgacgccuacucccagugcgccaccaccaugacccacggcguccagaacaucggccagacccagggcgagggcgacuggaaggucccccagggcgucuccaaggagcccggccagcucgaggacgaggaggaggagcccuccuccuucaaggccgacucccccgccgaggccucccucgccuccgacccccacgagcuccccaccaccuccuucugccccaacugcauccgccucaagaagaagguccgcgagcuccaggccgagcucgacaugcucaaguccggcaagcuccccgagccccccguccuccccccccagguccucgagcuccccgaguucuccgaccccgccggcaagcucgucuggaugcgccuccucuccgagggccgcguccgcuccggccucugcggcggcuga

SEQ ID NO: 48064 - RNA, 2124 nt, Artificial Sequence
  derived and/or modified sequence opt2 from PRDM13__Homo_sapiens__NP_067633
augcacggcgccgcccgcgcccccgccaccuccgucuccgccgacugcugcauccccgccggccuccgccucggccccguccccggcaccuucaagcucggcaaguaccucuccgaccgccgcgagcccggccccaagaagaagguccgcaugguccgcggcgagcucgucgacgaguccggcggcuccccccucgaguggaucggccucauccgcgccgcccgcaacucccaggagcagacccucgaggccaucgccgaccuccccggcggccagaucuucuaccgcgcccuccgcgacguccagcccggcgaggagcucaccgucugguacuccaacucccucgcccagugguucgacauccccaccaccgccacccccacccacgacgagaagggcgaggagcgcuacaucugcugguacugcuggcgcaccuuccgcuaccccaacucccucaaggcccaccuccgcuuccacugcgucuucuccggcggcggcggcggcgccuuccuccaccacgagcacgccgcccgccagggcgccguccccgccgccgacggccucggccucucccccaagccccccgcccccgacuucgccgcccccucccaggccggcacccuccgcccccacccccucggccccccccccguccaggccugcggcgcccgcgagggcaucaagcgcgaggccuccuccgcccccuccgccaccucccccacccccggcaaguggggccagcccaagaagggcaaggagcagcucgaccgcgcccucgacauguccggcgccgcccgcggccagggccacuuccucggcaucgucggcggcuccuccgccggcgucggcucccucgccuucuaccccggcguccgcuccgccuucaagcccgccggccucgcccgcgccgccgccgccgcccacggcgaccccuaccgcgaggaguccuccuccaagcagggcgccggccucgcccucggccgccuccucggcggcggccgcgccugcggccgccccggcuccggcgagaacuccgccgccggcggcgccggccaccaccaccaccaccacgcccaccaccaccaccaccccaagugccuccucgccggcgaccccccccccccccccccccccggccuccccugcuccggcgcccuccgcggcuucccccuccucuccgucccccccgaggaggccuccgccuucaagcacgucgagcgcgccccccccgccgccgccgcccuccccggcgcccgcuacgcccagcucccccccgcccccggccucccccucgagcgcugcgcccuccccccccucgaccccggcggccucaaggccuaccccggcggcgagugcucccaccuccccgccgucaugcccgccuucaccgucuacaacggcgagcuccucuacggcucccccgccaccaccgccuacuacccccucaagcuccacuucggcggccuccucaaguaccccgaguccaucuccuacuucuccggccccgccgccgccgcccucucccccgccgagcucggcucccucgccuccaucgaccgcgagaucgccaugcacaaccagcagcucuccgagauggccgccggcaagggccgcggccgccucgacuccggcacccucccccccgccgucgccgccgccggcggcaccggcggcggcggcuccggcggcuccggcgccggcaagcccaagaccggccaccucugccucuacugcggcaagcucuacucccgcaaguacggccucaagauccacaugcgcacccacaccggcuacaagccccucaagugcaaggucugccuccgccccuucggcgaccccuccaaccucaacaagcacauccgccuccacgccgagggcaacacccccuaccgcugcgaguucugcggcaagguccucguccgccgccgcgaccucgagcgccacgucaagucccgccaccccggccagucccuccucgccaaggccggcgacggccccggcgccgagcccggcuacccccccgagcccggcgaccccaaguccgacgacuccgacgucgacgucugcuucaccgacgaccaguccgaccccgaggucggcggcggcggcgagcgcgaccucuga

SEQ ID NO: 48065 - RNA, 1716 nt, Artificial Sequence
  derived and/or modified sequence opt2 from PRDM14__Homo_sapiens__NP_078780
auggcccucccccgccccuccgaggccgucccccaggacaaggucugcuacccccccgaguccuccccccagaaccucgccgccuacuacacccccuuccccuccuacggccacuaccgcaacucccucgccaccgucgaggaggacuuccagcccuuccgccagcucgaggccgccgccuccgccgcccccgccaugccccccuuccccuuccgcauggcccccccccuccucucccccggccucggccuccagcgcgagccccucuacgaccuccccugguacuccaagcucccccccugguaccccaucccccacgucccccgcgaggucccccccuuccucuccuccucccacgaguacgccggcgccuccuccgaggaccucggccaccagaucaucggcggcgacaacgaguccggccccugcugcggccccgacacccucaucccccccccccccgccgacgccucccuccuccccgagggccuccgcaccucccagcuccuccccugcucccccuccaagcaguccgaggacggccccaagcccuccaaccaggagggcaagucccccgcccgcuuccaguucaccgaggaggaccuccacuucguccucuacggcgucacccccucccucgagcaccccgccucccuccaccacgccaucuccggccuccucgucccccccgacuccuccggcuccgacucccucccccagacccucgacaaggacucccuccagcuccccgagggccucugccucaugcagaccgucuucggcgaggucccccacuucggcgucuucugcuccuccuucaucgccaagggcguccgcuucggccccuuccagggcaaggucgucaacgccuccgaggucaagaccuacggcgacaacuccgucaugugggagaucuucgaggacggccaccucucccacuucaucgacggcaagggcggcaccggcaacuggauguccuacgucaacugcgcccgcuuccccaaggagcagaaccucgucgccguccagugccagggccacaucuucuacgaguccugcaaggagauccaccagaaccaggagcuccucgucugguacggcgacugcuacgagaaguuccucgacauccccgucucccuccaggucaccgagcccggcaagcagcccuccggccccuccgaggaguccgccgagggcuaccgcugcgagcgcugcggcaaggucuucaccuacaaguacuaccgcgacaagcaccucaaguacacccccugcgucgacaagggcgaccgcaaguuccccugcucccucugcaagcgcuccuucgagaagcgcgaccgccuccgcauccacauccuccacguccacgagaagcaccgcccccacaagugcuccaccugcggcaagugcuucucccaguccuccucccucaacaagcacaugcgcguccacuccggcgaccgccccuaccagugcgucuacugcaccaagcgcuucaccgccuccuccauccuccgcacccacauccgccagcacuccggcgagaagcccuucaagugcaaguacugcggcaaguccuucgccucccacgccgcccacgacucccacguccgccgcucccacaaggaggacgacggcugcuccugcuccaucugcggcaagaucuucuccgaccaggagaccuucuacucccacaugaaguuccacgaggacuacuga

SEQ ID NO: 48066 - RNA, 2478 nt, Artificial Sequence
  derived and/or modified sequence opt2 from PRDM1__Homo_sapiens__NP_001189
augcucgacaucugccucgagaagcgcgucggcaccacccucgccgcccccaagugcaacuccuccaccguccgcuuccagggccucgccgagggcaccaagggcaccaugaagauggacauggaggacgccgacaugacccucuggaccgaggccgaguucgaggagaagugcaccuacaucgucaacgaccaccccugggacuccggcgccgacggcggcaccuccguccaggccgaggccucccucccccgcaaccuccucuucaaguacgccaccaacuccgaggaggucaucggcgucauguccaaggaguacauccccaagggcacccgcuucggcccccucaucggcgagaucuacaccaacgacaccguccccaagaacgccaaccgcaaguacuucuggcgcaucuacucccgcggcgagcuccaccacuucaucgacggcuucaacgaggagaaguccaacuggaugcgcuacgucaaccccgcccacuccccccgcgagcagaaccucgccgccugccagaacggcaugaacaucuacuucuacaccaucaagcccauccccgccaaccaggagcuccucgucugguacugccgcgacuucgccgagcgccuccacuaccccuaccccggcgagcucaccaugaugaaccucacccagacccaguccucccucaagcagcccuccaccgagaagaacgagcucugccccaagaacguccccaagcgcgaguacuccgucaaggagauccucaagcucgacuccaaccccuccaagggcaaggaccucuaccgcuccaacaucuccccccucaccuccgagaaggaccucgacgacuuccgccgccgcggcucccccgagaugcccuucuacccccgcgucgucuaccccauccgcgccccccuccccgaggacuuccucaaggccucccucgccuacggcaucgagcgccccaccuacaucacccgcucccccauccccuccuccaccacccccucccccuccgcccgcuccucccccgaccagucccucaaguccuccuccccccacuccucccccggcaacaccgucucccccgucggccccggcucccaggagcaccgcgacuccuacgccuaccucaacgccuccuacggcaccgagggccucggcuccuaccccggcuacgccccccucccccaccucccccccgccuucauccccuccuacaacgcccacuaccccaaguuccuccucccccccuacggcaugaacugcaacggccucuccgccgucuccuccaugaacggcaucaacaacuucggccucuucccccgccucugccccgucuacuccaaccuccucggcggcggcucccucccccaccccaugcucaaccccaccucccuccccuccucccuccccuccgacggcgcccgccgccuccuccagcccgagcacccccgcgagguccucguccccgccccccacuccgccuucuccuucaccggcgccgccgccuccaugaaggacaaggccugcucccccaccuccggcucccccaccgccggcaccgccgccaccgccgagcacgucguccagcccaaggccaccuccgccgccauggccgcccccuccuccgacgaggccaugaaccucaucaagaacaagcgcaacaugaccggcuacaagacccuccccuacccccucaagaagcagaacggcaagaucaaguacgagugcaacgucugcgccaagaccuucggccagcucuccaaccucaagguccaccuccgcguccacuccggcgagcgccccuucaagugccagaccugcaacaagggcuucacccagcucgcccaccuccagaagcacuaccucguccacaccggcgagaagccccacgagugccaggucugccacaagcgcuucuccuccaccuccaaccucaagacccaccuccgccuccacuccggcgagaagcccuaccagugcaaggucugccccgccaaguucacccaguucguccaccucaagcuccacaagcgccuccacacccgcgagcgcccccacaagugcucccagugccacaagaacuacauccaccucugcucccucaagguccaccucaagggcaacugcgccgccgcccccgcccccggccucccccucgaggaccucacccgcaucaacgaggagaucgagaaguucgacaucuccgacaacgccgaccgccucgaggacgucgaggacgacaucuccgucaucuccgucgucgagaaggagauccucgccgucguccgcaaggagaaggaggagaccggccucaaggucucccuccagcgcaacaugggcaacggccuccucuccuccggcugcucccucuacgaguccuccgaccucccccucaugaagcucccccccuccaacccccucccccucguccccgucaaggucaagcaggagaccgucgagcccauggaccccuga

SEQ ID NO: 48067 - RNA, 2406 nt, Artificial Sequence
  derived and/or modified sequence opt2 from PRDM4__Homo_sapiens__NP_036538
augcaccaccgcaugaacgagaugaaccucucccccgucggcauggagcagcucaccuccuccuccgucuccaacgcccuccccgucuccggcucccaccucggccucgccgccucccccacccacuccgccauccccgcccccggccuccccgucgccauccccaaccucggccccucccucuccucccuccccuccgcccucucccucaugcuccccaugggcaucggcgaccgcggcgucaugugcggccuccccgagcgcaacuacacccucccccccccccccuacccccaccucgaguccuccuacuuccgcaccauccuccccggcauccucuccuaccucgccgaccgcccccccccccaguacauccaccccaacuccaucaacgucgacggcaacaccgcccucuccaucaccaacaaccccuccgcccucgaccccuaccaguccaacggcaacgucggccucgagcccggcaucgucuccaucgacucccgcuccgucaacacccacggcgcccagucccuccaccccuccgacggccacgaggucgcccucgacaccgccaucaccauggagaacgucucccgcgucaccucccccaucuccaccgacggcauggccgaggagcucaccauggacggcgucgccggcgagcacucccagauccccaacggcucccgcucccacgagccccucuccgucgacuccgucuccaacaaccucgccgccgacgccgucggccacggcggcgucauccccaugcacggcaacggccucgagcuccccgucgucauggagaccgaccacaucgccucccgcgucaacggcauguccgacuccgcccucuccgacuccauccacaccgucgccauguccaccaacuccgucuccgucgcccucuccaccucccacaaccucgccucccucgaguccgucucccuccacgaggucggccucucccucgagcccgucgccgucuccuccaucacccaggaggucgccaugggcaccggccacgucgacgucuccuccgacucccucuccuucgucucccccucccuccagauggaggacuccaacuccaacaaggagaacauggccacccucuucaccaucuggugcacccucugcgaccgcgccuaccccuccgacugccccgagcacggccccgucaccuucguccccgacacccccaucgagucccgcgcccgccucucccuccccaagcagcucguccuccgccaguccaucgucggcgccgaggucggcgucuggaccggcgagaccauccccguccgcaccugcuucggcccccucaucggccagcagucccacuccauggaggucgccgaguggaccgacaaggccgucaaccacaucuggaagaucuaccacaacggcguccucgaguucugcaucaucaccaccgacgagaacgagugcaacuggaugauguucguccgcaaggcccgcaaccgcgaggagcagaaccucgucgccuacccccacgacggcaagaucuucuucugcaccucccaggacaucccccccgagaacgagcuccucuucuacuacucccgcgacuacgcccagcagaucggcguccccgagcaccccgacguccaccucugcaacugcggcaaggagugcaacuccuacaccgaguucaaggcccaccucaccucccacauccacaaccaccuccccacccagggccacuccggcucccacggccccucccacuccaaggagcgcaaguggaagugcuccaugugcccccaggccuucaucucccccuccaagcuccacguccacuucaugggccacaugggcaugaagccccacaagugcgacuucugcuccaaggccuucuccgaccccuccaaccuccgcacccaccucaagauccacaccggccagaagaacuaccgcugcacccucugcgacaaguccuucacccagaaggcccaccucgagucccacauggucauccacaccggcgagaagaaccucaagugcgacuacugcgacaagcucuucaugcgccgccaggaccucaagcagcacguccucauccacacccaggagcgccagaucaagugccccaagugcgacaagcucuuccuccgcaccaaccaccucaagaagcaccucaacucccacgagggcaagcgcgacuacgucugcgagaagugcaccaaggccuaccucaccaaguaccaccucacccgccaccucaagaccugcaagggccccaccuccuccuccuccgcccccgaggaggaggaggaggacgacuccgaggaggaggaccucgccgacuccgucggcaccgaggacugccgcaucaacuccgccgucuacuccgccgacgagucccucuccgcccacaaguga

SEQ ID NO: 48068 - RNA, 1800 nt, Artificial Sequence
  derived and/or modified sequence opt2 from PRDM5__Homo_sapiens__NP_001287752
augcucggcauguacguccccgaccgcuucucccucaaguccucccgcguccaggacggcaugggccucuacaccgcccgccgcguccgcaagggcgagaaguucggccccuucgccggcgagaagcgcaugcccgaggaccucgacgagaacauggacuaccgccucaugugggagguccgcggcuccaagggcgagguccucuacauccucgacgccaccaacccccgccacuccaacuggcuccgcuucguccacgaggcccccucccaggagcagaagaaccucgccgccauccaggagggcgagaacaucuucuaccucgccgucgaggacaucgagaccgacaccgagcuccucaucggcuaccucgacuccgacauggaggccgaggaggaggagcagcagaucaugaccgucaucaaggagggcgaggucgagaacucccgccgccaguccaccgccggccgcaaggaccgccucggcugcaaggaggacuacgccugcccccagugcgaguccuccuucaccuccgaggacauccucgccgagcaccuccagacccuccaccagaagcccaccgaggagaaggaguucaagugcaagaacugcggcaagaaguuccccgucaagcaggcccuccagcgccacuucgagcagcaccaggagaccugccgcggcgacgcccgcuucgucugcaaggccgacuccugcggcaagcgccucaaguccaaggacgcccucaagcgccaccaggagaacguccacaccggcgaccccaagaagaagcucaucugcuccgucugcaacaagaagugcuccuccgccuccucccuccaggagcaccgcaagauccacgagaucuucgacugccaggagugcaugaagaaguucaucuccgccaaccagcucaagcgccacaugaucacccacuccgagaagcgccccuacaacugcgagaucugcaacaaguccuucaagcgccucgaccaggucggcgcccacaaggucauccacuccgaggacaagcccuacaagugcaagcucugcggcaagggcuucgcccaccgcaacgucuacaagaaccacaagaagacccacuccgaggagcgccccuuccagugcgaggagugcaaggcccucuuccgcacccccuucucccuccagcgccaccuccucauccacaacuccgagcgcaccuucaagugccaccacugcgacgccaccuucaagcgcaaggacacccucaacguccacguccaggucguccacgagcgccacaagaaguaccgcugcgagcucugcaacaaggccuucgucacccccuccguccuccgcucccacaagaagacccacaccggcgagaaggagaagaucugccccuacugcggccagaaguucgccuccuccggcacccuccgcguccacauccgcucccacaccggcgagcgccccuaccagugccccuacugcgagaagggcuucuccaagaacgacggccucaagaugcacauccgcacccacacccgcgagaagcccuacaagugcuccgagugcuccaaggccuucucccagaagcgcggccucgacgagcacaagcgcacccacaccggcgagaagcccuuccagugcgacgucugcgaccucgccuucucccucaagaagaugcucauccgccacaagaugacccacaaccccaaccgcccccucgccgagugccaguucugccacaagaaguucacccgcaacgacuaccucaagguccacauggacaacauccacggcgucgccgacuccuga

SEQ ID NO: 48069 - RNA, 1788 nt, Artificial Sequence
  derived and/or modified sequence opt2 from PRDM6__Homo_sapiens__NP_001129711
augcucaagcccggcgaccccggcggcuccgccuuccucaaggucgaccccgccuaccuccagcacuggcagcagcucuucccccacggcggcgccggcccccucaagggcuccggcgccgccggccuccucuccgccccccagccccuccagccccccccccccccccccccccccgagcgcgccgagcccccccccgacucccuccgcccccgccccgccucccucuccuccgccuccuccacccccgccuccuccuccaccuccgccuccuccgccuccuccugcgccgccgccgccgccgccgccgcccucgccggccucuccgcccuccccgucucccagcuccccgucuucgccccccucgccgccgccgccgucgccgccgagccccucccccccaaggagcucugccucggcgccaccuccggccccggccccgucaagugcggcggcggcggcggcggcggcggcgagggccgcggcgccccccgcuuccgcugcuccgccgaggagcucgacuacuaccucuacggccagcagcgcauggagaucaucccccucaaccagcacaccuccgaccccaacaaccgcugcgacaugugcgccgacaaccgcaacggcgagugccccaugcacggcccccuccacucccuccgccgccucgucggcaccuccuccgccgccgccgccgcccccccccccgagcuccccgaguggcuccgcgaccucccccgcgaggucugccucugcaccuccaccguccccggccucgccuacggcaucugcgccgcccagcgcauccagcagggcaccuggaucggccccuuccagggcguccuccucccccccgagaagguccaggccggcgccguccgcaacacccagcaccucugggagaucuacgaccaggacggcacccuccagcacuucaucgacggcggcgagcccuccaaguccuccuggaugcgcuacauccgcugcgcccgccacugcggcgagcagaaccucaccgucguccaguaccgcuccaacaucuucuaccgcgccugcaucgacaucccccgcggcaccgagcuccucgucugguacaacgacuccuacaccuccuucuucggcaucccccuccagugcaucgcccaggacgagaaccucaacguccccuccaccgucauggaggccaugugccgccaggacgcccuccagcccuucaacaaguccuccaagcucgcccccaccacccagcagcgcuccgucgucuucccccagacccccugcucccgcaacuucucccuccucgacaaguccggccccaucgaguccggcuucaaccagaucaacgucaagaaccagcgcguccucgccucccccaccuccaccucccagcuccacuccgaguucuccgacuggcaccucuggaagugcggccagugcuucaagaccuucacccagcgcauccuccuccagaugcacgucugcacccagaaccccgaccgccccuaccagugcggccacugcucccaguccuucucccagcccuccgagcuccgcaaccacgucgucacccacuccuccgaccgccccuucaagugcggcuacugcggccgcgccuucgccggcgccaccacccucaacaaccacauccgcacccacaccggcgagaagcccuucaagugcgagcgcugcgagcgcuccuucacccaggccacccagcucucccgccaccagcgcaugcccaacgagugcaagcccaucaccgagucccccgaguccaucgaggucgacuga

SEQ ID NO: 48070 - RNA, 1479 nt, Artificial Sequence
  derived and/or modified sequence opt2 from PRDM7__Homo_sapiens__NP_001091643
augucccccgagcgcucccaggaggagucccccgagggcgacaccgagcgcaccgagcgcaagcccauggucaaggacgccuucaaggacaucuccaucuacuucaccaaggaggagugggccgagaugggcgacugggagaagacccgcuaccgcaacgucaagaugaacuacaacgcccucaucaccgucggccuccgcgccacccgccccgccuucaugugccaccgccgccaggccaucaagcuccaggucgacgacaccgaggacuccgacgaggaguggaccccccgccagcaggucaagccccccuggauggccuuccgcggcgagcaguccaagcaccagaagggcaugcccaaggccuccuucaacaacgaguccucccuccgcgagcucuccggcacccccaaccuccucaacaccuccgacuccgagcaggcccagaagcccgucuccccccccggcgaggccuccaccuccggccagcacucccgccucaagcucgagcuccgccgcaaggagaccgagggcaagauguacucccuccgcgagcgcaagggccacgccuacaaggagaucuccgagccccaggacgacgacuaccucuacugcgagaugugccagaacuucuucaucgacuccugcgccgcccacggcccccccaccuucgucaaggacuccgccgucgacaagggccaccccaaccgcuccgcccucucccucccccccggccuccgcaucggccccuccggcaucccccaggccggccucggcgucuggaacgaggccuccgaccucccccucggccuccacuucggccccuacgagggccgcaucaccgaggacgaggaggccgccaacuccggcuacuccuggcucaucaccaagggccgcaacugcuacgaguacgucgacggcaaggacaaguccuccgccaacuggaugcgcuacgucaacugcgcccgcgacgacgaggagcagaaccucgucgccuuccaguaccaccgccagaucuucuaccgcaccugccgcgucauccgccccggcugcgagcuccucgucugguccggcgacgaguacggccaggagcucggcauccgcuccuccaucgagcccgccgagucccucggccaggccgucaacugcugguccggcaugggcauguccauggcccgcaacugggccuccuccggcgccgccuccggccgcaaguccuccuggcagggcgagaaccagucccagcgcuccauccacgucccccacgccgucuggcccuuccaggucaagaacuucuccgucaacauguggaacgccaucaccccccuccgcaccucccaggaccaccuccaggagaacuucuccaaccagcgcauccccgcccagggcauccgcauccgcuccggcaacauccucauccacgccgccgucaugaccaagcccaaggucaagcgcuccaagaagggccccaacuccuga

SEQ ID NO: 48071 - RNA, 2070 nt, Artificial Sequence
  derived and/or modified sequence opt2 from PRDM8__Homo_sapiens__NP_064611
auggaggacaccggcauccagcgcggcaucugggacggcgacgccaaggccguccagcagugccucaccgacaucuucaccuccgucuacaccaccugcgacauccccgagaacgccaucuucggccccugcguccucucccacaccucccucuacgacuccaucgccuucaucgcccucaaguccaccgacaagcgcaccguccccuacaucuuccgcgucgacaccuccgccgccaacggcuccuccgagggccucauguggcuccgccucguccaguccgcccgcgacaaggaggagcagaaccucgaggccuacaucaagaacggccagcucuucuaccgcucccuccgccgcaucgccaaggacgaggagcuccucgucugguacggcaaggagcucaccgagcuccuccuccucugccccucccgcucccacaacaagaugaacggcuccucccccuacaccugccucgagugcucccagcgcuuccaguucgaguuccccuacgucgcccaccuccgcuuccgcugccccaagcgccuccacuccgccgacaucuccccccaggacgagcagggcggcggcgucggcaccaaggaccacggcggcggcggcggcggcggcaaggaccagcagcagcagcagcaggaggccccccucggccccggccccaaguucugcaaggccggcccccuccaccacuaccccucccccucccccgaguccuccaaccccuccgccgccgccggcggcuccuccgccaagcccuccaccgacuuccacaaccucgcccgcgagcucgagaacucccgcggcggcuccuccugcucccccgcccagucccucuccuccggcuccggcuccggcggcggcggcggccaccaggaggccgagcucucccccgacggcaucgccaccggcggcggcaagggcaagcgcaaguuccccgaggaggccgccgagggcggcggcggcgccggccucgucggcggccgcggccgcuucgucgagcgcccccuccccgccuccaaggaggaccucgucugcaccccccagcaguaccgcgccuccggcuccuacuucggccucgaggagaacggccgccucuucgccccccccucccccgagaccggcgaggccaagcgcuccgccuucgucgaggucaagaaggccgcccgcgccgccucccuccaggaggagggcaccgccgacggcgccggcgucgccuccgaggaccaggacgccggcggcggcggcggcuccuccacccccgccgccgccucccccgucggcgccgagaagcuccucgccccccgccccggcggcccccuccccucccgccucgagggcggcucccccgcccgcggcuccgccuucaccuccgucccccagcucggcuccgccggcuccaccuccggcggcggcggcaccggcgccggcgccgccggcggcgccggcggcggccagggcgccgccuccgacgagcgcaaguccgccuucucccagcccgcccgcuccuucucccagcucuccccccucguccucggccagaagcucggcgcccucgagcccugccaccccgccgacggcgucggccccacccgccucuaccccgccgccgccgacccccucgccgucaagcuccagggcgccgccgaccucaacggcggcugcggcucccuccccuccggcggcggcggccuccccaagcagucccccuuccucuacgccaccgccuucuggcccaaguccuccgccgccgccgccgccgccgccgccgccgccgccgccggcccccuccagcuccagcuccccuccgcccucacccuccucccccccuccuucaccucccucugccuccccgcccagaacuggugcgccaagugcaacgccuccuuccgcaugaccuccgaccucgucuaccacaugcgcucccaccacaagaaggaguacgccauggagccccucgucaagcgccgccgcgaggagaagcucaagugccccaucugcaacgaguccuuccgcgagcgccaccaccucucccgccacaugaccucccacaacuga

SEQ ID NO: 48072 - RNA, 2685 nt, Artificial Sequence
  derived and/or modified sequence opt2 from PRDM9__Homo_sapiens__NP_064612
augucccccgagaagucccaggaggagucccccgaggaggacaccgagcgcaccgagcgcaagcccauggucaaggacgccuucaaggacaucuccaucuacuucaccaaggaggagugggccgagaugggcgacugggagaagacccgcuaccgcaacgucaagcgcaacuacaacgcccucaucaccaucggccuccgcgccacccgccccgccuucaugugccaccgccgccaggccaucaagcuccaggucgacgacaccgaggacuccgacgaggaguggaccccccgccagcaggucaagccccccuggauggcccuccgcgucgagcagcgcaagcaccagaagggcaugcccaaggccuccuucuccaacgaguccucccucaaggagcucucccgcaccgccaaccuccucaacgccuccggcuccgagcaggcccagaagcccgucucccccuccggcgaggccuccaccuccggccagcacucccgccucaagcucgagcuccgcaagaaggagaccgagcgcaagauguacucccuccgcgagcgcaagggccacgccuacaaggaggucuccgagccccaggacgacgacuaccucuacugcgagaugugccagaacuucuucaucgacuccugcgccgcccacggcccccccaccuucgucaaggacuccgccgucgacaagggccaccccaaccgcuccgcccucucccucccccccggccuccgcaucggccccuccggcaucccccaggccggccucggcgucuggaacgaggccuccgaccucccccucggccuccacuucggccccuacgagggccgcaucaccgaggacgaggaggccgccaacaacggcuacuccuggcucaucaccaagggccgcaacugcuacgaguacgucgacggcaaggacaaguccugggccaacuggaugcgcuacgucaacugcgcccgcgacgacgaggagcagaaccucgucgccuuccaguaccaccgccagaucuucuaccgcaccugccgcgucauccgccccggcugcgagcuccucgucugguacggcgacgaguacggccaggagcucggcaucaaguggggcuccaaguggaagaaggagcucauggccggccgcgagcccaagcccgagauccaccccugccccuccugcugccucgccuucuccucccagaaguuccucucccagcacgucgagcgcaaccacuccucccagaacuuccccggccccuccgcccgcaagcuccuccagcccgagaaccccugccccggcgaccagaaccaggagcagcaguaccccgacccccacucccgcaacgacaagaccaagggccaggagaucaaggagcgcuccaagcuccucaacaagcgcaccuggcagcgcgagaucucccgcgccuucuccuccccccccaagggccagaugggcuccugccgcgucggcaagcgcaucauggaggaggagucccgcaccggccagaaggucaaccccggcaacaccggcaagcucuucgucggcgucggcaucucccgcaucgccaaggucaaguacggcgagugcggccagggcuucuccgucaaguccgacgucaucacccaccagcgcacccacaccggcgagaagcucuacgucugccgcgagugcggccgcggcuucuccuggaagucccaccuccucauccaccagcgcauccacaccggcgagaagcccuacgucugccgcgagugcggccgcggcuucuccuggcaguccguccuccucacccaccagcgcacccacaccggcgagaagcccuacgucugccgcgagugcggccgcggcuucucccgccaguccguccuccucacccaccagcgccgccacaccggcgagaagcccuacgucugccgcgagugcggccgcggcuucucccgccaguccguccuccucacccaccagcgccgccacaccggcgagaagcccuacgucugccgcgagugcggccgcggcuucuccuggcaguccguccuccucacccaccagcgcacccacaccggcgagaagcccuacgucugccgcgagugcggccgcggcuucuccuggcaguccguccuccucacccaccagcgcacccacaccggcgagaagcccuacgucugccgcgagugcggccgcggcuucuccaacaagucccaccuccuccgccaccagcgcacccacaccggcgagaagcccuacgucugccgcgagugcggccgcggcuuccgcgacaagucccaccuccuccgccaccagcgcacccacaccggcgagaagcccuacgucugccgcgagugcggccgcggcuuccgcgacaaguccaaccuccucucccaccagcgcacccacaccggcgagaagcccuacgucugccgcgagugcggccgcggcuucuccaacaagucccaccuccuccgccaccagcgcacccacaccggcgagaagcccuacgucugccgcgagugcggccgcggcuuccgcaacaagucccaccuccuccgccaccagcgcacccacaccggcgagaagcccuacgucugccgcgagugcggccgcggcuucuccgaccgcuccucccucugcuaccaccagcgcacccacaccggcgagaagcccuacgucugccgcgaggacgaguga

SEQ ID NO: 48073 - RNA, 597 nt, Artificial Sequence
  derived and/or modified sequence opt2 from PRDX2__Homo_sapiens__NP_005800
auggccuccggcaacgcccgcaucggcaagcccgcccccgacuucaaggccaccgccgucgucgacggcgccuucaaggaggucaagcucuccgacuacaagggcaaguacgucguccucuucuucuacccccucgacuucaccuucgucugccccaccgagaucaucgccuucuccaaccgcgccgaggacuuccgcaagcucggcugcgagguccucggcgucuccgucgacucccaguucacccaccucgccuggaucaacaccccccgcaaggagggcggccucggcccccucaacaucccccuccucgccgacgucacccgccgccucuccgaggacuacggcguccucaagaccgacgagggcaucgccuaccgcggccucuucaucaucgacggcaagggcguccuccgccagaucaccgucaacgaccuccccgucggccgcuccgucgacgaggcccuccgccucguccaggccuuccaguacaccgacgagcacggcgaggucugccccgccggcuggaagcccggcuccgacaccaucaagcccaacgucgacgacuccaaggaguacuucuccaagcacaacuga

SEQ ID NO: 48074 - RNA, 771 nt, Artificial Sequence
  derived and/or modified sequence opt2 from PRDX3__Homo_sapiens__NP_006784
auggccgccgccgucggccgccuccuccgcgccuccgucgcccgccacgucuccgccauccccuggggcaucuccgccaccgccgcccuccgccccgccgccugcggccgcaccucccucaccaaccuccucugcuccggcuccucccaggccaagcucuucuccaccuccuccuccugccacgcccccgccgucacccagcacgcccccuacuucaagggcaccgccgucgucaacggcgaguucaaggaccucucccucgacgacuucaagggcaaguaccucguccucuucuucuacccccucgacuucaccuucgucugccccaccgagaucgucgccuucuccgacaaggccaacgaguuccacgacgucaacugcgaggucgucgccgucuccgucgacucccacuucucccaccucgccuggaucaacaccccccgcaagaacggcggccucggccacaugaacaucgcccuccucuccgaccucaccaagcagaucucccgcgacuacggcguccuccucgagggcuccggccucgcccuccgcggccucuucaucaucgaccccaacggcgucaucaagcaccucuccgucaacgaccuccccgucggccgcuccgucgaggagacccuccgccucgucaaggccuuccaguacgucgagacccacggcgaggucugccccgccaacuggacccccgacucccccaccaucaagcccucccccgccgccuccaaggaguacuuccagaaggucaaccaguga

SEQ ID NO: 48075 - RNA, 816 nt, Artificial Sequence
  derived and/or modified sequence opt2 from PRDX4__Homo_sapiens__NP_006397
auggaggcccucccccuccucgccgccaccacccccgaccacggccgccaccgccgccuccuccuccucccccuccuccucuuccuccuccccgccggcgccguccagggcugggagaccgaggagcgcccccgcacccgcgaggaggagugccacuucuacgccggcggccaggucuaccccggcgaggccucccgcgucuccgucgccgaccacucccuccaccucuccaaggccaagaucuccaagcccgcccccuacugggagggcaccgccgucaucgacggcgaguucaaggagcucaagcucaccgacuaccgcggcaaguaccucgucuucuucuucuacccccucgacuucaccuucgucugccccaccgagaucaucgccuucggcgaccgccucgaggaguuccgcuccaucaacaccgaggucgucgccugcuccgucgacucccaguucacccaccucgccuggaucaacaccccccgccgccagggcggccucggccccauccgcaucccccuccucuccgaccucacccaccagaucuccaaggacuacggcgucuaccucgaggacuccggccacacccuccgcggccucuucaucaucgacgacaagggcauccuccgccagaucacccucaacgaccuccccgucggccgcuccgucgacgagacccuccgccucguccaggccuuccaguacaccgacaagcacggcgaggucugccccgccggcuggaagcccggcuccgagaccaucauccccgaccccgccggcaagcucaaguacuucgacaagcucaacuga

SEQ ID NO: 48076 - RNA, 645 nt, Artificial Sequence
  derived and/or modified sequence opt2 from PRDX5__Homo_sapiens__NP_036226
augggccucgccggcgucugcgcccuccgccgcuccgccggcuacauccucgucggcggcgccggcggccaguccgccgccgccgccgcccgccgcugcuccgagggcgagugggccuccggcggcguccgcuccuucucccgcgccgccgccgccauggcccccaucaaggucggcgacgccauccccgccgucgaggucuucgagggcgagcccggcaacaaggucaaccucgccgagcucuucaagggcaagaagggcguccucuucggcguccccggcgccuucacccccggcugcuccaagacccaccuccccggcuucgucgagcaggccgaggcccucaaggccaagggcguccaggucgucgccugccucuccgucaacgacgccuucgucaccggcgaguggggccgcgcccacaaggccgagggcaagguccgccuccucgccgaccccaccggcgccuucggcaaggagaccgaccuccuccucgacgacucccucgucuccaucuucggcaaccgccgccucaagcgcuucuccauggucguccaggacggcaucgucaaggcccucaacgucgagcccgacggcaccggccucaccugcucccucgcccccaacaucaucucccagcucuga

SEQ ID NO: 48077 - RNA, 675 nt, Artificial Sequence
  derived and/or modified sequence opt2 from PRDX6__Homo_sapiens__NP_004896
augcccggcggccuccuccucggcgacgucgcccccaacuucgaggccaacaccaccgucggccgcauccgcuuccacgacuuccucggcgacuccuggggcauccucuucucccacccccgcgacuucacccccgucugcaccaccgagcucggccgcgccgccaagcucgcccccgaguucgccaagcgcaacgucaagcucaucgcccucuccaucgacuccgucgaggaccaccucgccugguccaaggacaucaacgccuacaacugcgaggagcccaccgagaagcuccccuuccccaucaucgacgaccgcaaccgcgagcucgccauccuccucggcaugcucgaccccgccgagaaggacgagaagggcaugcccgucaccgcccgcgucgucuucgucuucggccccgacaagaagcucaagcucuccauccucuaccccgccaccaccggccgcaacuucgacgagauccuccgcgucgucaucucccuccagcucaccgccgagaagcgcgucgccacccccgucgacuggaaggacggcgacuccgucaugguccuccccaccauccccgaggaggaggccaagaagcucuuccccaagggcgucuucaccaaggagcuccccuccggcaagaaguaccuccgcuacaccccccagcccuga

SEQ ID NO: 48078 - RNA, 1254 nt, Artificial Sequence
  derived and/or modified sequence opt2 from PREB__Homo_sapiens__NP_037520
augggccgccgccgcgcccccgagcucuaccgcgcccccuucccccucuacgcccuccaggucgaccccuccaccggccuccucaucgccgccggcggcggcggcgccgccaagaccggcaucaagaacggcguccacuuccuccagcucgagcucaucaacggccgccucuccgccucccuccuccacucccacgacaccgagacccgcgccaccaugaaccucgcccucgccggcgacauccucgccgccggccaggacgcccacugccagcuccuccgcuuccaggcccaccagcagcagggcaacaaggccgagaaggccggcuccaaggagcagggcccccgccagcgcaagggcgccgcccccgccgagaagaagugcggcgccgagacccagcacgagggccucgagcuccgcgucgagaaccuccaggccguccagaccgacuucuccuccgacccccuccagaaggucgucugcuucaaccacgacaacacccuccucgccaccggcggcaccgacggcuacguccgcgucuggaagguccccucccucgagaagguccucgaguucaaggcccacgagggcgagaucgaggaccucgcccucggccccgacggcaagcucgucaccgucggccgcgaccucaaggccuccgucuggcagaaggaccagcucgucacccagcuccacuggcaggagaacggccccaccuucuccuccacccccuaccgcuaccaggccugccgcuucggccagguccccgaccagcccgccggccuccgccucuucaccguccagaucccccacaagcgccuccgccagcccccccccugcuaccucaccgccugggacggcuccaacuuccucccccuccgcaccaaguccugcggccacgaggucgucuccugccucgacgucuccgaguccggcaccuuccucggccucggcaccgucaccggcuccgucgccaucuacaucgccuucucccuccagugccucuacuacguccgcgaggcccacggcaucgucgucaccgacgucgccuuccuccccgagaagggccgcggccccgagcuccucggcucccacgagaccgcccucuucuccgucgccgucgacucccgcugccagcuccaccuccuccccucccgccgcuccguccccgucuggcuccuccuccuccucugcgucggccucaucaucgucaccauccuccuccuccaguccgccuuccccggcuuccucuga

SEQ ID NO: 48079 - RNA, 1149 nt, Artificial Sequence
  derived and/or modified sequence opt2 from PRELP__Homo_sapiens__NP_958505
augcgcuccccccucugcuggcuccucccccuccucauccucgccuccgucgcccagggccagcccacccgccgcccccgccccggcaccggccccggccgccgcccccgcccccgcccccgccccacccccuccuucccccagcccgacgagcccgccgagcccaccgaccucccccccccccucccccccggcccccccuccaucuuccccgacugcccccgcgagugcuacugcccccccgacuuccccuccgcccucuacugcgacucccgcaaccuccgcaagguccccgucauccccccccgcauccacuaccucuaccuccagaacaacuucaucaccgagcuccccgucgaguccuuccagaacgccaccggccuccgcuggaucaaccucgacaacaaccgcauccgcaagaucgaccagcgcguccucgagaagcuccccggccucgucuuccucuacauggagaagaaccagcucgaggagguccccuccgcccucccccgcaaccucgagcagcuccgccucucccagaaccacaucucccgcaucccccccggcgucuucuccaagcucgagaaccuccuccuccucgaccuccagcacaaccgccucuccgacggcgucuucaagcccgacaccuuccacggccucaagaaccucaugcagcucaaccucgcccacaacauccuccgcaagaugcccccccgcguccccaccgccauccaccagcucuaccucgacuccaacaagaucgagaccauccccaacggcuacuucaaguccuuccccaaccucgccuucauccgccucaacuacaacaagcucaccgaccgcggccuccccaagaacuccuucaacaucuccaaccuccucguccuccaccucucccacaaccgcaucuccuccguccccgccaucaacaaccgccucgagcaccucuaccucaacaacaacuccaucgagaagaucaacggcacccagaucugccccaacgaccucgucgccuuccacgacuucuccuccgaccucgagaacgucccccaccuccgcuaccuccgccucgacggcaacuaccucaagccccccaucccccucgaccucaugaugugcuuccgccuccuccaguccgucgucaucuga

SEQ ID NO: 48080 - RNA, 2133 nt, Artificial Sequence
  derived and/or modified sequence opt2 from PREP__Homo_sapiens__NP_002717
augcucucccuccaguaccccgacgucuaccgcgacgagaccgccguccaggacuaccacggccacaagaucugcgaccccuacgccuggcucgaggaccccgacuccgagcagaccaaggccuucgucgaggcccagaacaagaucaccguccccuuccucgagcagugccccauccgcggccucuacaaggagcgcaugaccgagcucuacgacuaccccaaguacuccugccacuucaagaagggcaagcgcuacuucuacuucuacaacaccggccuccagaaccagcgcguccucuacguccaggacucccucgagggcgaggcccgcgucuuccucgaccccaacauccucuccgacgacggcaccgucgcccuccgcggcuacgccuucuccgaggacggcgaguacuucgccuacggccucuccgccuccggcuccgacugggucaccaucaaguucaugaaggucgacggcgccaaggagcuccccgacguccucgagcgcgucaaguucuccugcauggccuggacccacgacggcaagggcauguucuacaacuccuacccccagcaggacggcaaguccgacggcaccgagaccuccaccaaccuccaccagaagcucuacuaccacguccucggcaccgaccaguccgaggacauccucugcgccgaguuccccgacgagcccaaguggaugggcggcgccgagcucuccgacgacggccgcuacguccuccucuccauccgcgagggcugcgaccccgucaaccgccucugguacugcgaccuccagcaggaguccuccggcaucgccggcauccucaagugggucaagcucaucgacaacuucgagggcgaguacgacuacgucaccaacgagggcaccgucuucaccuucaagaccaaccgccagucccccaacuaccgcgucaucaacaucgacuuccgcgaccccgaggaguccaaguggaagguccucguccccgagcacgagaaggacguccucgaguggaucgccugcguccgcuccaacuuccucguccucugcuaccuccacgacgucaagaacauccuccagcuccacgaccucaccaccggcgcccuccucaagaccuucccccucgacgucggcuccaucgucggcuacuccggccagaagaaggacaccgagaucuucuaccaguucaccuccuuccucucccccggcaucaucuaccacugcgaccucaccaaggaggagcucgagccccgcgucuuccgcgaggucaccgucaagggcaucgacgccuccgacuaccagaccguccagaucuucuaccccuccaaggacggcaccaagauccccauguucaucguccacaagaagggcaucaagcucgacggcucccaccccgccuuccucuacggcuacggcggcuucaacaucuccaucacccccaacuacuccgucucccgccucaucuucguccgccacaugggcggcauccucgccgucgccaacauccgcggcggcggcgaguacggcgagaccuggcacaagggcggcauccucgccaacaagcagaacugcuucgacgacuuccagugcgccgccgaguaccucaucaaggagggcuacaccucccccaagcgccucaccaucaacggcggcuccaacggcggccuccucgucgccgccugcgccaaccagcgccccgaccucuucggcugcgucaucgcccaggucggcgucauggacaugcucaaguuccacaaguacaccaucggccacgccuggaccaccgacuacggcugcuccgacuccaagcagcacuucgaguggcucgucaaguacuccccccuccacaacgucaagcuccccgaggccgacgacauccaguaccccuccaugcuccuccucaccgccgaccacgacgaccgcgucgucccccuccacucccucaaguucaucgccacccuccaguacaucgucggccgcucccgcaagcaguccaacccccuccucauccacgucgacaccaaggccggccacggcgccggcaagcccaccgccaaggucaucgaggaggucuccgacauguucgccuucaucgcccgcugccucaacgucgacuggauccccuga

SEQ ID NO: 48081 - RNA, 1998 nt, Artificial Sequence
  derived and/or modified sequence opt2 from PREPL__Homo_sapiens__NP_001035844
augcagcagaagaccaagcucuuccuccaggcccucaaguacuccaucccccaccucggcaagugcaugcagaagcagcaccucaaccacuacaacuucgccgaccacugcuacaaccgcaucaagcucaagaaguaccaccucaccaagugccuccagaacaagcccaagaucuccgagcucgcccgcaacauccccucccgcuccuucuccugcaaggaccuccagcccgucaagcaggagaacgagaagccccuccccgagaacauggacgccuucgagaagguccgcaccaagcucgagacccagccccaggaggaguacgagaucaucaacgucgaggucaagcacggcggcuucgucuacuaccaggagggcugcugccucguccgcuccaaggacgaggaggccgacaacgacaacuacgagguccucuucaaccucgaggagcucaagcucgaccagcccuucaucgacugcauccgcgucgcccccgacgagaaguacgucgccgccaagauccgcaccgaggacuccgaggccuccaccugcgucaucaucaagcucuccgaccagcccgucauggaggccuccuuccccaacgucuccuccuucgagugggucaaggacgaggaggacgaggacguccucuucuacaccuuccagcgcaaccuccgcugccacgacgucuaccgcgccaccuucggcgacaacaagcgcaacgagcgcuucuacaccgagaaggaccccuccuacuucgucuuccucuaccucaccaaggacucccgcuuccucaccaucaacaucaugaacaagaccaccuccgaggucuggcucaucgacggccucucccccugggacccccccguccucauccagaagcgcauccacggcguccucuacuacgucgagcaccgcgacgacgagcucuacauccucaccaacgucggcgagcccaccgaguucaagcucccccccugggccugcggcuucaucauggacaccaacuccgaccccaagaacugccccuuccagcucugcucccccauccgcccccccaaguacuacaccuacaaguucgccgagggcaagcucuucgaggagaccggccacgaggaccccaucaccaagaccucccgcguccuccgccucgaggccaaguccaaggacggcaagcucguccccaugaccgucuuccacaagaccgacuccgaggaccuccagaagaagccccuccucguccacgucuacggcgccuacggcauggaccucaagaugaacuuccgccccgagcgccgcguccucgucgacgacggcuggauccucgccuacugccacguccgcggcggcggcgagcucggccuccaguggcacgccgacggccgccucaccaagaagcucaacggccucgccgaccucgaggccugcaucaagacccuccacggccagggcuucucccagcccucccucaccacccucaccgccuucuccgccggcggcguccucgccggcgcccucugcaacuccaaccccgagcucguccgcgccgucacccucgaggcccccuuccucgacguccucaacaccaugauggacaccacccucccccucacccucgaggagcucgaggaguggggcaaccccuccuccgacgagaagcacaagaacuacaucaagcgcuacugccccuaccagaacaucaagccccagcacuaccccuccauccacaucaccgccuacgagaacgacgagcgcgucccccucaagggcaucgucuccuacaccgagaagcucaaggaggccaucgccgagcacgccaaggacaccggcgagggcuaccagacccccaacaucauccucgacauccagcccggcggcaaccacgucaucgaggacucccacaagaagaucaccgcccagaucaaguuccucuacgaggagcucggccucgacuccaccuccgucuucgaggaccucaagaaguaccucaaguucuga

SEQ ID NO: 48082 - RNA, 4980 nt, Artificial Sequence
  derived and/or modified sequence opt2 from PREX1__Homo_sapiens__NP_065871
auggaggcccccuccggcuccgagcccggcggcgacggcgccggcgacugcgcccaccccgacccccgcgcccccggcgccgccgcccccuccuccggccccggccccugcgccgccgcccgcgaguccgagcgccagcuccgccuccgccucugcguccucaacgagauccucggcaccgagcgcgacuacgucggcacccuccgcuuccuccaguccgccuuccuccaccgcauccgccagaacgucgccgacuccgucgagaagggccucaccgaggagaacgucaagguccucuucuccaacaucgaggacauccucgagguccacaaggacuuccucgccgcccucgaguacugccuccaccccgagccccagucccagcacgagcucggcaacgucuuccucaaguucaaggacaaguucugcgucuacgaggaguacugcuccaaccacgagaaggcccuccgccuccucgucgagcucaacaagauccccaccguccgcgccuuccuccucuccugcaugcuccucggcggccgcaagaccaccgacaucccccucgagggcuaccuccucucccccauccagcgcaucugcaaguacccccuccuccucaaggagcucgccaagcgcacccccggcaagcaccccgaccaccccgccguccaguccgcccuccaggccaugaagaccgucugcuccaacaucaacgagaccaagcgccagauggagaagcucgaggcccucgagcagcuccagucccacaucgagggcugggagggcuccaaccucaccgacaucugcacccagcuccuccuccagggcacccuccucaagaucuccgccggcaacauccaggagcgcgccuucuuccucuucgacaaccuccucgucuacugcaagcgcaagucccgcgucaccggcuccaagaaguccaccaagcgcaccaaguccaucaacggcucccucuacaucuuccgcggccgcaucaacaccgaggucauggaggucgagaacgucgaggacggcaccgccgacuaccacuccaacggcuacaccgucaccaacggcuggaagauccacaacaccgccaagaacaagugguucgucugcauggccaagaccgccgaggagaagcagaaguggcucgacgccaucauccgcgagcgcgagcagcgcgagucccucaagcucggcauggagcgcgacgccuacgucaugaucgccgagaagggcgagaagcucuaccacaugaugaugaacaagaaggucaaccucaucaaggaccgccgccgcaagcucuccaccguccccaagugcuuccucggcaacgaguucgucgccuggcuccucgagaucggcgagaucuccaagaccgaggagggcgucaaccucggccaggcccuccucgagaacggcaucauccaccacgucuccgacaagcaccaguucaagaacgagcaggucauguaccgcuuccgcuacgacgacggcaccuacaaggcccgcuccgagcucgaggacaucauguccaagggcguccgccucuacugccgccuccacucccucuacacccccgucaucaaggaccgcgacuaccaccucaagaccuacaaguccguccuccccggcuccaagcucgucgacuggcuccucgcccagggcgacugccagacccgcgaggaggccgucgcccucggcgucggccucugcaacaacggcuucaugcaccacguccucgagaaguccgaguuccgcgacgagucccaguacuuccgcuuccacgccgacgaggagauggagggcaccuccuccaagaacaagcagcuccgcaacgacuucaagcucgucgagaacauccucgccaagcgccuccucauccucccccaggaggaggacuacggcuucgacaucgaggagaagaacaaggccgucgucgucaaguccguccagcgcggcucccucgccgaggucgccggccuccaggucggccgcaagaucuacuccaucaacgaggaccucgucuuccuccgccccuucuccgaggucgaguccauccucaaccaguccuucugcucccgccgcccccuccgccuccucgucgccaccaaggccaaggagaucaucaagauccccgaccagcccgacacccucugcuuccagauccgcggcgccgccccccccuacgucuacgccgucggccgcggcuccgaggccauggccgccggccucugcgccggccagugcauccucaaggucaacggcuccaacgucaugaacgacggcgcccccgagguccucgagcacuuccaggccuuccgcucccgccgcgaggaggcccucggccucuaccaguggaucuaccacacccacgaggacgcccaggaggcccgcgccucccaggaggccuccaccgaggaccccuccggcgagcaggcccaggaggaggaccaggccgacuccgccuucccccuccucucccucggcccccgccucucccucugcgaggacucccccauggucacccucaccgucgacaacguccaccucgagcacggcgucgucuacgaguacgucuccaccgccggcguccgcugccacguccucgagaagaucgucgagccccgcggcugcuucggccucaccgccaagauccucgaggccuucgccgccaacgacuccgucuucgucgagaacugccgccgccucauggcccucuccuccgccaucgucaccaugccccacuucgaguuccgcaacaucugcgacaccaagcucgaguccaucggccagcgcaucgccugcuaccaggaguucgccgcccagcucaagucccgcgucuccccccccuucaagcaggccccccucgagccccacccccucugcggccucgacuucugccccaccaacugccacaucaaccucauggaggucuccuaccccaagaccacccccuccgucggccgcuccuucuccauccgcuucggccgcaagcccucccucaucggccucgaccccgagcagggccaccucaaccccauguccuacacccagcacugcaucaccaccauggccgcccccuccuggaagugccuccccgccgccgagggcgacccccagggccagggccuccacgacggcuccuucggccccgccuccggcacccucggccaggaggaccgcggccucuccuuccuccucaagcaggaggaccgcgagauccaggacgccuaccuccagcucuucaccaagcucgacgucgcccucaaggagaugaagcaguacgucacccagaucaaccgccuccucuccaccaucaccgagcccaccuccggcggcuccugcgacgccucccucgccgaggaggccuccucccucccccucgucuccgaggaguccgagauggaccgcuccgaccacggcggcaucaagaaggucugcuucaaggucgccgaggaggaccaggaggacuccggccacgacaccauguccuaccgcgacuccuacuccgagugcaacuccaaccgcgacuccguccucuccuacaccuccguccgcuccaacuccuccuaccucggcuccgacgagaugggcuccggcgacgagcuccccugcgacaugcgcauccccuccgacaagcaggacaagcuccacggcugccucgagcaccucuucaaccaggucgacuccaucaacgcccuccucaagggccccgucaugucccgcgccuucgaggagaccaagcacuuccccaugaaccacucccuccaggaguucaagcagaaggaggagugcaccauccgcggccgcucccucauccagaucuccauccaggaggaccccuggaaccuccccaacuccaucaagacccucgucgacaacauccagcgcuacgucgaggacggcaagaaccagcuccuccucgcccuccucaagugcaccgacaccgagcuccagcuccgccgcgacgccaucuucugccaggcccucgucgccgccgucugcaccuucuccgagcagcuccucgccgcccucggcuaccgcuacaacaacaacggcgaguacgaggaguccucccgcgacgccucccgcaaguggcucgagcaggucgccgccaccggcguccuccuccacugccagucccuccucucccccgccaccgucaaggaggagcgcaccaugcucgaggacaucugggucacccucuccgagcucgacaacgucaccuucuccuucaagcagcucgacgagaacuacgucgccaacaccaacgucuucuaccacaucgagggcucccgccaggcccucaaggucaucuucuaccucgacuccuaccacuucuccaagcuccccucccgccucgagggcggcgccucccuccgccuccacaccgcccucuucaccaagguccucgagaacgucgagggccuccccucccccggcucccaggccgccgaggaccuccagcaggacaucaacgcccagucccucgagaagguccagcaguacuaccgcaagcuccgcgccuucuaccucgagcgcuccaaccuccccaccgacgccuccaccaccgccgucaagaucgaccagcucauccgccccaucaacgcccucgacgagcucugccgccucaugaaguccuucguccaccccaagcccggcgccgccggcuccgucggcgccggccucauccccaucuccuccgagcucugcuaccgccucggcgccugccagauggucaugugcggcaccggcaugcagcgcuccacccucuccgucucccucgagcaggccgccauccucgcccgcucccacggccuccuccccaagugcaucaugcaggccaccgacaucaugcgcaagcagggcccccgcgucgagauccucgccaagaaccuccgcgucaaggaccagaugccccagggcgccccccgccucuaccgccucugccagccccccgucgacggcgaccucuga

SEQ ID NO: 48083 - RNA, 4821 nt, Artificial Sequence
  derived and/or modified sequence opt2 from PREX2__Homo_sapiens__NP_079146
auguccgaggacucccgcggcgacucccgcgccgaguccgccaaggaccucgagaagcagcuccgccuccgcgucugcguccucuccgagcuccagaagaccgagcgcgacuacgucggcacccucgaguuccucgucuccgccuuccuccaccgcaugaaccagugcgccgccuccaaggucgacaagaacgucaccgaggagaccgucaagaugcucuucuccaacaucgaggacauccucgccguccacaaggaguuccucaaggucgucgaggagugccuccaccccgagcccaacgcccagcaggaggucggcaccugcuuccuccacuucaaggacaaguuccgcaucuacgacgaguacugcuccaaccacgagaaggcccagaagcuccuccucgagcucaacaagauccgcaccauccgcaccuuccuccucaacugcaugcuccucggcggccgcaagaacaccgacgucccccucgagggcuaccucgucacccccauccagcgcaucugcaaguacccccucauccucaaggagcuccucaagcgcaccccccgcaagcacuccgacuacgccgccgucauggaggcccuccaggccaugaaggccgucugcuccaacaucaacgaggccaagcgccagauggagaagcucgagguccucgaggaguggcagucccacaucgagggcugggagggcuccaacaucaccgacaccugcaccgagaugcucaugugcggcguccuccucaagaucuccuccggcaacauccaggagcgcgucuucuuccucuucgacaaccuccucgucuacugcaagcgcaagcaccgccgccucaagaacuccaaggccuccaccgacggccaccgcuaccucuuccgcggccgcaucaacaccgaggucauggaggucgagaacgucgacgacggcaccgccgacuuccacuccuccggccacaucgucgucaacggcuggaagauccacaacaccgccaagaacaagugguucgucugcauggccaagacccccgaggagaagcacgagugguucgaggccauccucaaggagcgcgagcgccgcaagggccucaagcucggcauggagcaggacaccugggucaugaucuccgagcagggcgagaagcucuacaagaugaugugccgccagggcaaccucaucaaggaccgcaagcgcaagcucaccaccuuccccaagugcuuccucggcuccgaguucgucuccuggcuccucgagaucggcgagauccaccgccccgaggagggcguccaccucggccaggcccuccucgagaacggcaucauccaccacgucaccgacaagcaccaguucaagcccgagcagaugcucuaccgcuuccgcuacgacgacggcaccuucuacccccgcaacgagaugcaggacgucaucuccaagggcguccgccucuacugccgccuccacucccucuucacccccgucauccgcgacaaggacuaccaccuccgcaccuacaaguccgucgucauggccaacaagcucaucgacuggcucaucgcccagggcgacugccgcacccgcgaggaggccaugaucuucggcgucggccucugcgacaacggcuucaugcaccacguccucgagaaguccgaguucaaggacgagccccuccucuuccgcuucuucuccgacgaggagauggagggcuccaacaugaagcaccgccucaugaagcacgaccucaaggucgucgagaacgucaucgccaagucccuccucaucaaguccaacgagggcuccuacggcuucggccucgaggacaagaacaagguccccaucaucaagcucgucgagaagggcuccaacgccgagauggccggcauggaggucggcaagaagaucuucgccaucaacggcgaccucgucuucaugcgccccuucaacgaggucgacugcuuccucaaguccugccucaacucccgcaagccccuccgcguccucgucuccaccaagccccgcgagaccgucaagauccccgacuccgccgacggccucggcuuccagauccgcggcuucggccccuccgucguccacgccgucggccgcggcaccgucgccgccgccgccggccuccaccccggccagugcaucaucaaggucaacggcaucaacgucuccaaggagacccacgccuccgucaucgcccacgucaccgccugccgcaaguaccgccgccccaccaagcaggacuccauccagugggucuacaacuccaucgaguccgcccaggaggaccuccagaagucccacuccaagccccccggcgacgaggccggcgacgccuucgacugcaaggucgaggaggucaucgacaaguucaacaccauggccaucaucgacggcaagaaggagcacgucucccucaccgucgacaacguccaccucgaguacggcgucgucuacgaguacgacuccaccgccggcaucaagugcaacgucgucgagaagaugaucgagcccaagggcuucuucucccucaccgccaagauccucgaggcccucgccaaguccgacgagcacuucguccagaacugcaccucccucaacucccucaacgaggucauccccaccgaccuccaguccaaguucuccgcccucugcuccgagcgcaucgagcaccucugccagcgcaucuccuccuacaagaaguucucccgcguccucaagaaccgcgccuggcccaccuucaagcaggccaaguccaagaucuccccccuccacuccuccgacuucugccccaccaacugccacgucaacgucauggaggucuccuaccccaagaccuccaccucccucggcuccgccuucggcguccagcucgacucccgcaagcacaacucccacgacaaggagaacaaguccuccgagcagggcaagcucucccccauggucuacauccagcacaccaucaccaccauggccgcccccuccggccucucccucggccagcaggacggccacggccuccgcuaccuccucaaggaggaggaccucgagacccaggacaucuaccagaagcuccucggcaagcuccagaccgcccucaaggaggucgagaugugcgucugccagaucgacgaccuccucuccuccaucaccuacucccccaagcucgagcgcaagaccuccgagggcaucauccccaccgacuccgacaacgagaagggcgagcgcaacuccaagcgcgucugcuucaacgucgccggcgacgagcaggaggacuccggccacgacaccaucuccaaccgcgacuccuacuccgacugcaacuccaaccgcaacuccaucgccuccuucaccuccaucugcuccucccagugcuccuccuacuuccacuccgacgagauggacuccggcgacgagcucccccucuccguccgcaucucccacgacaagcaggacaagauccacuccugccucgagcaccucuucucccaggucgacuccaucaccaaccuccucaagggccaggccgucguccgcgccuucgaccagaccaaguaccucacccccggccgcggccuccaggaguuccagcaggagauggagcccaagcucuccugccccaagcgccuccgccuccacaucaagcaggaccccuggaaccuccccuccuccguccgcacccucgcccagaacauccgcaaguucgucgaggaggucaagugccgccuccuccucgcccuccucgaguacuccgacuccgagacccagcuccgccgcgacauggucuucugccagacccucgucgccaccgucugcgccuucuccgagcagcucauggccgcccucaaccagauguucgacaacuccaaggagaacgagauggagaccugggaggccucccgccgcuggcucgaccagaucgccaacgccggcguccucuuccacuuccagucccuccucucccccaaccucaccgacgagcaggccaugcucgaggacacccucgucgcccucuucgaccucgagaaggucuccuucuacuucaagcccuccgaggaggagccccucgucgccaacgucccccucaccuaccaggccgagggcucccgccaggcccucaaggucuacuucuacaucgacuccuaccacuucgagcagcucccccagcgccucaagaacggcggcggcuucaagauccaccccguccucuucgcccaggcccucgaguccauggagggcuacuacuaccgcgacaacgucuccgucgaggaguuccaggcccagaucaacgccgccucccucgagaaggucaagcaguacaaccagaagcuccgcgccuucuaccucgacaaguccaacuccccccccaacuccaccuccaaggccgccuacgucgacaagcucaugcgcccccucaacgcccucgacgagcucuaccgccucgucgccuccuucauccgcuccaagcgcaccgccgccugcgccaacaccgccugcuccgccuccggcgucggccuccucuccgucuccuccgagcucugcaaccgccucggcgccugccacaucaucaugugcuccuccggcguccaccgcugcacccucuccgucacccucgagcaggccaucauccucgcccgcucccacggccuccccccccgcuacaucaugcaggccaccgacgucaugcgcaagcagggcgcccgcguccagaacaccgccaagaaccucggcguccgcgaccgcaccccccaguccgccccccgccucuacaagcucugcgagccccccccccccgccggcgaggaguga

SEQ ID NO: 48084 - RNA, 1668 nt, Artificial Sequence
  derived and/or modified sequence opt2 from PRF1__Homo_sapiens__NP_001076585
auggccgcccgccuccuccuccucggcauccuccuccuccuccucccccuccccguccccgcccccugccacaccgccgcccgcuccgagugcaagcgcucccacaaguucguccccggcgccuggcucgccggcgagggcgucgacgucaccucccuccgccgcuccggcuccuuccccgucgacacccagcgcuuccuccgccccgacggcaccugcacccucugcgagaacgcccuccaggagggcacccuccagcgccucccccucgcccucaccaacuggcgcgcccagggcuccggcugccagcgccacgucacccgcgccaaggucuccuccaccgaggccgucgcccgcgacgccgcccgcuccauccgcaacgacuggaaggucggccucgacgucacccccaagcccaccuccaacguccacgucuccgucgccggcucccacucccaggccgccaacuucgccgcccagaagacccaccaggaccaguacuccuucuccaccgacaccgucgagugccgcuucuacuccuuccacgucguccacacccccccccuccaccccgacuucaagcgcgcccucggcgaccucccccaccacuucaacgccuccacccagcccgccuaccuccgccucaucuccaacuacggcacccacuucauccgcgccgucgagcucggcggccgcaucuccgcccucaccgcccuccgcaccugcgagcucgcccucgagggccucaccgacaacgaggucgaggacugccucaccgucgaggcccaggucaacaucggcauccacggcuccaucuccgccgaggccaaggccugcgaggagaagaagaagaagcacaagaugaccgccuccuuccaccagaccuaccgcgagcgccacuccgaggucgucggcggccaccacaccuccaucaacgaccuccucuucggcauccaggccggccccgagcaguacuccgccugggucaacucccuccccggcucccccggccucgucgacuacacccucgagccccuccacguccuccucgacucccaggacccccgccgcgaggcccuccgccgcgcccucucccaguaccucaccgaccgcgcccgcuggcgcgacugcucccgccccugcccccccggccgccagaaguccccccgcgaccccugccagugcgucugccacggcuccgccgucaccacccaggacugcugcccccgccagcgcggccucgcccagcucgaggucaccuucauccaggccuggggccucuggggcgacugguucaccgccaccgacgccuacgucaagcucuucuucggcggccaggagcuccgcaccuccaccgucugggacaacaacaaccccaucugguccguccgccucgacuucggcgacguccuccucgccaccggcggcccccuccgccuccaggucugggaccaggacuccggccgcgacgacgaccuccucggcaccugcgaccaggcccccaaguccggcucccacgagguccgcugcaaccucaaccacggccaccucaaguuccgcuaccacgcccgcugccucccccaccucggcggcggcaccugccucgacuacgucccccagaugcuccucggcgagccccccggcaaccgcuccggcgccgucugguga

SEQ ID NO: 48085 - RNA, 636 nt, Artificial Sequence
  derived and/or modified sequence opt2 from PRG2__Homo_sapiens__NP_001230174
augaagcucccccuccuccucgcccuccucuucggcgccgucuccgcccuccaccuccgcuccgagaccuccaccuucgagaccccccucggcgccaagacccuccccgaggacgaggagacccccgagcaggagauggaggagacccccugccgcgagcucgaggaggaggaggaguggggcuccggcuccgaggacgccuccaagaaggacggcgccgucgaguccaucuccguccccgacauggucgacaagaaccucaccugccccgaggaggaggacaccgucaaggucgucggcauccccggcugccagaccugccgcuaccuccucuucaccugccgccgcugcuaccgcggcaaccucgucuccauccacaacuucaacaucaacuaccgcauccagugcuccgucuccgcccucaaccagggccaggucuggaucggcggccgcaucaccggcuccggccgcugccgccgcuuccagugggucgacggcucccgcuggaacuucgccuacugggccgcccaccagcccuggucccgcggcggccacugcgucgcccucugcacccgcggcggccacuggcgccgcgcccacugccuccgccgccuccccuucaucugcuccuacuga

SEQ ID NO: 48086 - RNA, 4092 nt, Artificial Sequence
  derived and/or modified sequence opt2 from PRG4__Homo_sapiens__NP_001121180
auggccuggaagacccuccccaucuaccuccuccuccuccucuccgucuucgucauccagcaggucuccucccaggagcucuccugcaagggccgcugcuucgaguccuucgagcgcggccgcgagugcgacugcgacgcccagugcaagaaguacgacaagugcugccccgacuacgaguccuucugcgccgagguccacaaccccaccuccccccccuccuccaagaaggcccccccccccuccggcgccucccagaccaucaaguccaccaccaagcgcucccccaagccccccaacaagaagaagaccaagaaggucaucgaguccgaggagaucaccgaggagcacuccgucuccgagaaccaggaguccuccuccuccuccuccuccuccuccuccuccuccaccauccgcaagaucaaguccuccaagaacuccgccgccaaccgcgagcuccagaagaagcucaaggucaaggacaacaagaagaaccgcaccaagaagaagcccacccccaagccccccgucgucgacgaggccggcuccggccucgacaacggcgacuucaaggucaccacccccgacaccuccaccacccagcacaacaaggucuccaccucccccaagaucaccaccgccaagcccaucaacccccgccccucccucccccccaacuccgacaccuccaaggagaccucccucaccgucaacaaggagaccaccgucgagaccaaggagaccaccaccaccaacaagcagaccuccaccgacggcaaggagaagaccaccuccgccaaggagacccaguccaucgagaagaccuccgccaaggaccucgcccccaccuccaagguccucgccaagcccacccccaaggccgagaccaccaccaagggccccgcccucaccacccccaaggagcccacccccaccacccccaaggagcccgccuccaccacccccaaggagcccacccccaccaccaucaaguccgcccccaccacccccaaggagcccgcccccaccaccaccaaguccgcccccaccacccccaaggagcccgcccccaccaccaccaaggagcccgcccccaccacccccaaggagcccgcccccaccaccaccaaggagcccgcccccaccaccaccaaguccgcccccaccacccccaaggagcccgcccccaccacccccaagaagcccgcccccaccacccccaaggagcccgcccccaccacccccaaggagcccacccccaccacccccaaggagcccgcccccaccaccaaggagcccgcccccaccacccccaaggagcccgcccccaccgcccccaagaagcccgcccccaccacccccaaggagcccgcccccaccacccccaaggagcccgcccccaccaccaccaaggagcccucccccaccacccccaaggagcccgcccccaccaccaccaaguccgcccccaccaccaccaaggagcccgcccccaccaccaccaaguccgcccccaccacccccaaggagcccucccccaccaccaccaaggagcccgcccccaccacccccaaggagcccgcccccaccacccccaagaagcccgcccccaccacccccaaggagcccgcccccaccacccccaaggagcccgcccccaccaccaccaagaagcccgcccccaccacccccaaggagcccgcccccaccacccccaaggagaccgcccccaccacccccaagaagcucacccccaccacccccgagaagcucgcccccaccacccccgagaagcccgcccccaccacccccgaggagcucgcccccaccacccccgaggagcccacccccaccacccccgaggagcccgcccccaccacccccaaggccgccgcccccaacacccccaaggagcccgcccccaccacccccaaggagcccgcccccaccacccccaaggagcccgcccccaccacccccaaggagaccgcccccaccacccccaagggcaccgcccccaccacccucaaggagcccgcccccaccacccccaagaagcccgcccccaaggagcucgcccccaccaccaccaaggagcccaccuccaccaccuccgacaagcccgcccccaccacccccaagggcaccgcccccaccacccccaaggagcccgcccccaccacccccaaggagcccgcccccaccacccccaagggcaccgcccccaccacccucaaggagcccgcccccaccacccccaagaagcccgcccccaaggagcucgcccccaccaccaccaagggccccaccuccaccaccuccgacaagcccgcccccaccacccccaaggagaccgcccccaccacccccaaggagcccgcccccaccacccccaagaagcccgcccccaccacccccgagacccccccccccaccaccuccgaggucuccacccccaccaccaccaaggagcccaccaccauccacaagucccccgacgaguccacccccgagcucuccgccgagcccacccccaaggcccucgagaacucccccaaggagcccggcguccccaccaccaagacccccgccgccaccaagcccgagaugaccaccaccgccaaggacaagaccaccgagcgcgaccuccgcaccacccccgagaccaccaccgccgcccccaagaugaccaaggagaccgccaccaccaccgagaagaccaccgaguccaagaucaccgccaccaccacccaggucaccuccaccaccacccaggacaccacccccuucaagaucaccacccucaagaccaccacccucgcccccaaggucaccaccaccaagaagaccaucaccaccaccgagaucaugaacaagcccgaggagaccgccaagcccaaggaccgcgccaccaacuccaaggccaccacccccaagccccagaagcccaccaaggcccccaagaagcccaccuccaccaagaagcccaagaccaugccccgcguccgcaagcccaagaccacccccaccccccgcaagaugaccuccaccaugcccgagcucaaccccaccucccgcaucgccgaggccaugcuccagaccaccacccgccccaaccagacccccaacuccaagcucgucgaggucaaccccaaguccgaggacgccggcggcgccgagggcgagaccccccacaugcuccuccgcccccacgucuucaugcccgaggucacccccgacauggacuaccucccccgcguccccaaccagggcaucaucaucaaccccaugcucuccgacgagaccaacaucugcaacggcaagcccgucgacggccucaccacccuccgcaacggcacccucgucgccuuccgcggccacuacuucuggaugcucucccccuucuccccccccucccccgcccgccgcaucaccgaggucuggggcauccccucccccaucgacaccgucuucacccgcugcaacugcgagggcaagaccuucuucuucaaggacucccaguacuggcgcuucaccaacgacaucaaggacgccggcuaccccaagcccaucuucaagggcuucggcggccucaccggccagaucgucgccgcccucuccaccgccaaguacaagaacuggcccgaguccgucuacuucuucaagcgcggcggcuccauccagcaguacaucuacaagcaggagcccguccagaagugccccggccgccgccccgcccucaacuaccccgucuacggcgagaccacccagguccgccgccgccgcuucgagcgcgccaucggccccucccagacccacaccauccgcauccaguacucccccgcccgccucgccuaccaggacaagggcguccuccacaacgaggucaaggucuccauccucuggcgcggccuccccaacgucgucaccuccgccaucucccuccccaacauccgcaagcccgacggcuacgacuacuacgccuucuccaaggaccaguacuacaacaucgacguccccucccgcaccgcccgcgccaucaccacccgcuccggccagacccucuccaaggucugguacaacugccccuga

SEQ ID NO: 48087 - RNA, 564 nt, Artificial Sequence
  derived and/or modified sequence opt2 from PRH1__Homo_sapiens__NP_001278243
augcuccucauccuccucuccgucgcccuccucgccuucuccuccgcccaggaccucaacgaggacgucucccaggaggacgucccccucgucaucuccgacggcggcgacuccgagcaguuccucgacgaggagcgccagggccccccccucggcggccagcagucccagcccuccgccggcgacggcaaccaggacgacggcccccagcagggccccccccagcagggcggccagcagcagcagggccccccccccccccagggcaagccccagggccccccccagcagggcggccagcagcagcagggccccccccccccccagggcaagccccagggccccccccagcagggcggccaccccccccccccccagggccgcccccagggccccccccagcagggcggccacccccgccccccccgcggccgcccccagggccccccccagcagggcggccaccagcagggcccccccccccccccccccggcaagccccagggcccccccccccagggcggccgcccccagggccccccccagggccaguccccccaguga

SEQ ID NO: 48088 - RNA, 501 nt, Artificial Sequence
  derived and/or modified sequence opt2 from PRH2__Homo_sapiens__NP_001103683
augcuccucauccuccucuccgucgcccuccucgccuucuccuccgcccaggaccucgacgaggacgucucccaggaggacgucccccucgucaucuccgacggcggcgacuccgagcaguucaucgacgaggagcgccagggccccccccucggcggccagcagucccagcccuccgccggcgacggcaaccagaacgacggcccccagcagggccccccccagcagggcggccagcagcagcagggccccccccccccccagggcaagccccagggccccccccagcagggcggccaccccccccccccccagggccgcccccagggccccccccagcagggcggccacccccgccccccccgcggccgcccccagggccccccccagcagggcggccaccagcagggcccccccccccccccccccggcaagccccagggcccccccccccagggcggccgcccccagggccccccccagggccaguccccccaguga

SEQ ID NO: 48089 - RNA, 2496 nt, Artificial Sequence
  derived and/or modified sequence opt2 from PRICKLE1__Homo_sapiens__NP_001138354
augccccucgagauggagcccaagauguccaagcucgccuucggcugccagcgcuccuccaccuccgacgacgacuccggcugcgcccucgaggaguacgccugggucccccccggccuccgccccgagcagauccagcucuacuucgccugccuccccgaggagaagguccccuacgucaacucccccggcgagaagcaccgcaucaagcagcuccucuaccagcuccccccccacgacaacgagguccgcuacugccagucccucuccgaggaggagaagaaggagcuccaggucuucuccgcccagcgcaagaaggaggcccucggccgcggcaccaucaagcuccucucccgcgccgucaugcacgccgucugcgagcagugcggccucaagaucaacggcggcgaggucgccgucuucgccucccgcgccggccccggcgucugcuggcaccccuccugcuucgucugcuucaccugcaacgagcuccucgucgaccucaucuacuucuaccaggacggcaagauccacugcggccgccaccacgccgagcuccucaagccccgcugcuccgccugcgacgagaucaucuucgccgacgagugcaccgaggccgagggccgccacuggcacaugaagcacuucugcugccucgagugcgagaccguccucggcggccagcgcuacaucaugaaggacggccgccccuucugcugcggcugcuucgagucccucuacgccgaguacugcgagaccugcggcgagcacaucggcgucgaccacgcccagaugaccuacgacggccagcacuggcacgccaccgaggccugcuucuccugcgcccagugcaaggccucccuccucggcugccccuuccuccccaagcagggccagaucuacugcuccaagaccugcucccucggcgaggacguccacgccuccgacuccuccgacuccgccuuccaguccgcccgcucccgcgacucccgccgcuccguccgcaugggcaaguccucccgcuccgccgaccagugccgccagucccuccuccucucccccgcccucaacuacaaguuccccggccucuccggcaacgccgacgacacccucucccgcaagcucgacgaccucucccucucccgccagggcaccuccuucgccuccgaggaguucuggaagggccgcgucgagcaggagacccccgaggaccccgaggagugggccgaccacgaggacuacaugacccagcuccuccucaaguucggcgacaagucccucuuccagccccagcccaacgagauggacauccgcgccuccgagcacuggaucuccgacaacauggucaaguccaagaccgagcucaagcagaacaaccagucccucgccuccaagaaguaccaguccgacauguacugggcccagucccaggacggccucggcgacuccgccuacggcucccaccccggccccgccuccucccgccgccuccaggagcucgagcucgaccacggcgccuccggcuacaaccacgacgagacccagugguacgaggacucccucgagugccucuccgaccucaagcccgagcaguccguccgcgacuccauggacucccucgcccucuccaacaucaccggcgccuccgucgacggcgagaacaagccccgccccucccucuacucccuccagaacuucgaggagauggagaccgaggacugcgagaagauguccaacaugggcacccucaacuccuccaugcuccaccgcuccgccgagucccucaagucccucuccuccgagcucugccccgagaagauccuccccgaggagaagcccguccaccuccccguccuccgccgcuccaagucccagucccgcccccagcaggucaaguucuccgacgacgucaucgacaacggcaacuacgacaucgagauccgccagccccccauguccgagcgcacccgccgccgcgucuacaacuucgaggagcgcggcucccgcucccaccaccaccgccgccgccgcucccgcaagucccgcuccgacaacgcccucaaccucgucaccgagcgcaaguacucccccaaggaccgccuccgccucuacacccccgacaacuacgagaaguucauccagaacaaguccgcccgcgagauccaggccuacauccagaacgccgaccucuacggccaguacgcccacgccaccuccgacuacggccuccagaaccccggcaugaaccgcuuccucggccucuacggcgaggacgacgacuccuggugcuccuccuccuccuccuccuccgacuccgaggaggagggcuacuuccucggccagcccaucccccagccccgcccccagcgcuucgccuacuacaccgacgaccucuccuccccccccuccgcccuccccaccccccaguucggccagcgcaccaccaaguccaagaagaagaagggccacaagggcaagaacugcaucaucuccuga

SEQ ID NO: 48090 - RNA, 2535 nt, Artificial Sequence
  derived and/or modified sequence opt2 from PRICKLE2__Homo_sapiens__NP_942559
auggucaccgucaugccccucgagauggagaagaccaucuccaagcucauguucgacuuccagcgcaacuccaccuccgacgacgacuccggcugcgcccucgaggaguacgccugggucccccccggccucaagcccgagcagguccaccaguacuacuccugccuccccgaggagaagguccccuacgucaacucccccggcgagaagcuccgcaucaagcagcuccuccaccagcuccccccccacgacaacgagguccgcuacugcaacucccucgacgaggaggagaagcgcgagcucaagcucuucuccucccagcgcaagcgcgagaaccucggccgcggcaacguccgccccuuccccgucaccaugaccggcgccaucugcgagcagugcggcggccagaucaacggcggcgacaucgccgucuucgccucccgcgccggccacggcgucugcuggcacccccccugcuucgucugcaccgucugcaacgagcuccucgucgaccucaucuacuucuaccaggacggcaagaucuacugcggccgccaccacgccgagugccucaagccccgcugcgccgccugcgacgagaucaucuucgccgacgagugcaccgaggccgagggccgccacuggcacaugaagcacuucugcugcuucgagugcgagaccguccucggcggccagcgcuacaucaugaaggagggccgccccuacugcugccacugcuucgagucccucuacgccgaguacugcgacaccugcgcccagcacaucggcaucgaccagggccagaugaccuacgacggccagcacuggcacgccaccgagaccugcuucugcugcgcccacugcaagaagucccuccucggccgccccuuccuccccaagcagggccagaucuucugcucccgcgccugcuccgccggcgaggaccccaacggcuccgacuccuccgacuccgccuuccagaacgcccgcgccaaggagucccgccgcuccgccaagaucggcaagaacaagggcaagaccgaggagcccaugcucaaccagcacucccagcuccaggucuccuccaaccgccucuccgccgacgucgacccccucucccuccagauggacaugcucucccucuccucccagacccccucccucaaccgcgaccccaucuggcgcucccgcgaggagcccuaccacuacggcaacaagauggagcagaaccagacccaguccccccuccagcuccucucccagugcaacauccgcaccuccuacucccccggcggccagggcgccggcgcccagcccgagauguggggcaagcacuucuccaaccccaagcgcuccuccucccucgccaugaccggccacgccggcuccuucaucaaggagugccgcgaggacuacuaccccggccgccuccgcucccaggaguccuacuccgacauguccucccaguccuucuccgagacccgcggcuccauccagguccccaaguacgaggaggaggaggaggaggagggcggccucuccacccagcagugccgcacccgccaccccaucuccucccucaaguacaccgaggacaugacccccaccgagcagaccccccgcggcuccauggagucccucgcccucuccaacgccaccggccucuccgccgacggcggcgccaagcgccaggagcaccucucccgcuucuccaugcccgaccucuccaaggacuccggcaugaacgucuccgagaagcucuccaacaugggcacccucaacuccuccaugcaguuccgcuccgccgaguccguccgcucccuccucuccgcccagcaguaccaggagauggagggcaaccuccaccagcucuccaaccccaucggcuaccgcgaccuccagucccacggccgcaugcaccaguccuucgacuucgacggcggcauggccggcuccaagcuccccggccaggagggcguccgcauccagcccauguccgagcgcacccgccgccgcgccaccucccgcgacgacaaccgccgcuuccgcccccaccgcucccgccgcucccgccgcucccgcuccgacaacgcccuccaccucgccuccgagcgcgaggccaucucccgccucaaggaccgccccccccuccgcgcccgcgaggacuacgaccaguucaugcgccagcgcuccuuccaggaguccaugggccacggcucccgccgcgaccucuacggccagugcccccgcaccgucuccgaccucgcccuccagaacgccuucggcgaccgcuggggccccuacuucgccgaguacgacuggugcuccaccugcuccuccuccuccgaguccgacaacgagggcuacuuccucggcgagcccaucccccagcccgcccgccuccgcuacgucaccuccgacgagcuccuccacaaguacuccuccuacggccuccccaaguccuccacccucggcggccgcggccagcuccacucccgcaagcgccagaaguccaagaacugcaucaucuccuga

SEQ ID NO: 48091 - RNA, 1155 nt, Artificial Sequence
  derived and/or modified sequence opt2 from PRICKLE4__Homo_sapiens__NP_037529
auguccguccagaacuccggcuggccccaccaggaggacucccccaagccccaggaccccggcccccccgccaacuccgacuccgacuccggccaccuccccggcgaggaccccgaggacacccacgcccagggccccgccguccucucccucggcucccucugccucgacaccaaccaggcccccaacuggaccggccuccagacccuccuccagcagcuccccccccaggacaucgacgagcgcuacugccucgcccucggcgaggaggagcgcgccgagcuccagcucuucugcgcccgccgcaagcaggaggcccucggccagggcgucgcccgccucguccuccccaagcucgagggccacaccugcgagaagugccgcgagcuccucaagcccggcgaguacggcgucuucgccgcccgcgccggcgagcagcgcugcuggcaccagcccugcuucgccugccaggccugcggccaggcccucaucaaccucaucuacuucuaccacgacggccagcucuacugcggccgccaccacgccgagcuccuccgcccccgcugccccgccugcgaccagcucaucuucuccuggcgcugcaccgaggccgagggccagcgcuggcacgagaaccacuucugcugccaggacugcgccggcccccucggcggcggccgcuacgcccuccccggcggcucccccugcugccccuccugcuucgagaaccgcuacuccgacgccggcuccuccugggccggcgcccucgagggccaggccuuccucggcgagaccggccucgaccgcaccgagggccgcgaccagaccuccgucaacuccgccacccucucccgcacccuccucgccgccgccggcggcuccucccuccagacccagcgcggccuccccggcuccuccccccagcaggagaaccgccccggcgacaaggccgaggcccccaagggccaggagcagugccgccucgagaccauccgcgaccccaaggacacccccuucuccaccugcuccuccuccuccgacuccgagcccgagggcuucuuccucggcgagcgccucccccaguccuggaagacccccggcucccuccaggccgaggacuccaacgccuccaagacccacugcaccaugugcuga

SEQ ID NO: 48092 - RNA, 1263 nt, Artificial Sequence
  derived and/or modified sequence opt2 from PRIM1__Homo_sapiens__NP_000937
auggagaccuucgaccccaccgagcuccccgagcuccucaagcucuacuaccgccgccucuuccccuacucccaguacuaccgcuggcucaacuacggcggcgucaucaagaacuacuuccagcaccgcgaguucuccuucacccucaaggacgacaucuacauccgcuaccaguccuucaacaaccaguccgaccucgagaaggagaugcagaagaugaaccccuacaagaucgacaucggcgccgucuacucccaccgccccaaccagcacaacaccgucaagcucggcgccuuccaggcccaggagaaggagcucgucuucgacaucgacaugaccgacuacgacgacguccgccgcugcugcuccuccgccgacaucugccccaagugcuggacccucaugaccauggccauccgcaucaucgaccgcgcccucaaggaggacuucggcuucaagcaccgccucugggucuacuccggccgccgcggcguccacugcugggucugcgacgaguccguccgcaagcucuccuccgccguccgcuccggcaucgucgaguaccucucccucgucaagggcggccaggacgucaagaagaagguccaccucuccgagaagauccaccccuucauccgcaaguccaucaacaucaucaagaaguacuucgaggaguacgcccucgucaaccaggacauccucgagaacaaggaguccugggacaagauccucgcccucguccccgagaccauccacgacgagcuccagcaguccuuccagaagucccacaacucccuccagcgcugggagcaccucaagaaggucgccucccgcuaccagaacaacaucaagaacgacaaguacggccccuggcucgagugggagaucaugcuccaguacugcuucccccgccucgacaucaacgucuccaagggcaucaaccaccuccucaagucccccuucuccguccaccccaagaccggccgcaucuccguccccaucgaccuccagaaggucgaccaguucgaccccuucaccguccccaccaucuccuucaucugccgcgagcucgacgccaucuccaccaacgaggaggagaaggaggagaacgaggccgaguccgacgucaagcaccgcacccgcgacuacaagaagaccucccucgcccccuacgucaaggucuucgagcacuuccucgagaaccucgacaagucccgcaagggcgagcuccucaagaaguccgaccuccagaaggacuucuga

SEQ ID NO: 48093 - RNA, 462 nt, Artificial Sequence
  derived and/or modified sequence opt2 from PRIMA1__Homo_sapiens__XP_011544946
augcuccuccgcgaccucguccuccgccgcggcugcugcugguccucccuccuccuccacugcgcccuccacccccucuggggcuucguccaggucacccacggcgagccccagaaguccugcuccaaggucaccgacuccugccgccacgucugccagugccgccccccccccccccuccccccccccccccccccccccccccccccccgccuccucuccgcccccgcccccaacuccaccuccugccccaccgaggaguccuggugguccggccucgucaucaucaucgccgucugcugcgccucccucgucuuccucaccguccucgucaucaucugcuacaaggccaucaagcgcaagccccuccgcaaggacgagaacggcaccuccgucgccgaguaccccauguccgccucccaguccaacaagggcgucgacgucaacaacgccgucgucuga

SEQ ID NO: 48094 - RNA, 1683 nt, Artificial Sequence
  derived and/or modified sequence opt2 from PRIMPOL__Homo_sapiens__NP_689896
augaaccgcaagugggaggccaagcucaagcagaucgaggagcgcgccucccacuacgagcgcaagccccucuccuccgucuaccgcccccgccucuccaagcccgaggagccccccuccaucuggcgccucuuccaccgccaggcccaggccuucaacuucgucaaguccugcaaggaggacguccacgucuucgcccucgagugcaaggucggcgacggccagcgcaucuaccucgucaccaccuacgccgaguucugguucuacuacaagucccgcaagaaccuccuccacugcuacgaggucauccccgagaacgccgucugcaagcucuacuucgaccucgaguucaacaagcccgccaaccccggcgccgacggcaagaagauggucgcccuccucaucgaguacgucugcaaggcccuccaggagcucuacggcgucaacugcuccgccgaggacguccucaaccucgacuccuccaccgacgagaaguucucccgccaccucaucuuccagcuccacgacgucgccuucaaggacaacauccacgucggcaacuuccuccgcaagauccuccagcccgcccucgaccuccucggcuccgaggacgacgacuccgcccccgagaccaccggccacggcuucccccacuucuccgaggcccccgcccgccagggcuucuccuucaacaagauguucaccgagaaggccaccgaggaguccuggaccuccaacuccaagaagcucgagcgccucggcuccgccgagcaguccucccccgaccucuccuuccucgucgucaagaacaacaugggcgagaagcaccucuucgucgaccucggcgucuacacccgcaaccgcaacuuccgccucuacaaguccuccaagaucggcaagcgcgucgcccucgaggucaccgaggacaacaaguucuuccccauccaguccaaggacgucuccgacgaguaccaguacuuccucuccucccucgucuccaacguccgcuucuccgacacccuccgcauccucaccugcgagcccucccagaacaagcagaagggcgucggcuacuucaacuccaucggcaccuccgucgagaccaucgagggcuuccagugcucccccuaccccgaggucgaccacuucguccucucccucgucaacaaggacggcaucaagggcggcauccgccgcuggaacuacuucuuccccgaggagcuccucgucuacgacaucugcaaguaccgcuggugcgagaacaucggccgcgcccacaaguccaacaacaucaugauccucgucgaccucaagaacgaggucugguaccagaagugccacgaccccgucugcaaggccgagaacuucaaguccgacugcuucccccuccccgccgaggucugccuccucuuccucuucaaggaggaggaggaguucaccaccgacgaggccgacgagacccgcuccaacgagacccagaacccccacaagcccucccccucccgccucuccaccggcgccuccgccgacgccgucugggacaacggcaucgacgacgccuacuuccucgaggccaccgaggacgccgagcucgccgaggccgccgagaacucccuccucuccuacaacuccgaggucgacgagauccccgacgagcucaucaucgagguccuccaggaguga

SEQ ID NO: 48095 - RNA, 1680 nt, Artificial Sequence
  derived and/or modified sequence opt2 from PRKAA1__Homo_sapiens__NP_006242
augcgccgccucuccuccuggcgcaagauggccaccgccgagaagcagaagcacgacggccgcgucaagaucggccacuacauccucggcgacacccucggcgucggcaccuucggcaaggucaaggucggcaagcacgagcucaccggccacaaggucgccgucaagauccucaaccgccagaagauccgcucccucgacgucgucggcaagauccgccgcgagauccagaaccucaagcucuuccgccacccccacaucaucaagcucuaccaggucaucuccacccccuccgacaucuucauggucauggaguacgucuccggcggcgagcucuucgacuacaucugcaagaacggccgccucgacgagaaggagucccgccgccucuuccagcagauccucuccggcgucgacuacugccaccgccacauggucguccaccgcgaccucaagcccgagaacguccuccucgacgcccacaugaacgccaagaucgccgacuucggccucuccaacaugauguccgacggcgaguuccuccgcaccuccugcggcucccccaacuacgccgcccccgaggucaucuccggccgccucuacgccggccccgaggucgacaucugguccuccggcgucauccucuacgcccuccucugcggcacccuccccuucgacgacgaccacguccccacccucuucaagaagaucugcgacggcaucuucuacaccccccaguaccucaaccccuccgucaucucccuccucaagcacaugcuccaggucgaccccaugaagcgcgccaccaucaaggacauccgcgagcacgagugguucaagcaggaccuccccaaguaccucuuccccgaggaccccuccuacuccuccaccaugaucgacgacgaggcccucaaggaggucugcgagaaguucgagugcuccgaggaggagguccucuccugccucuacaaccgcaaccaccaggacccccucgccgucgccuaccaccucaucaucgacaaccgccgcaucaugaacgaggccaaggacuucuaccucgccaccuccccccccgacuccuuccucgacgaccaccaccucacccgcccccaccccgagcgcguccccuuccucgucgccgagaccccccgcgcccgccacacccucgacgagcucaacccccagaaguccaagcaccagggcguccgcaaggccaaguggcaccucggcauccgcucccagucccgccccaacgacaucauggccgaggucugccgcgccaucaagcagcucgacuacgaguggaaggucgucaaccccuacuaccuccgcguccgccgcaagaaccccgucaccuccaccuacuccaagaugucccuccagcucuaccaggucgacucccgcaccuaccuccucgacuuccgcuccaucgacgacgagaucaccgaggccaaguccggcaccgccaccccccagcgcuccggcuccgucuccaacuaccgcuccugccagcgcuccgacuccgacgccgaggcccagggcaaguccuccgaggucucccucaccuccuccgucaccucccucgacuccucccccgucgaccucaccccccgccccggcucccacaccaucgaguucuucgagaugugcgccaaccucaucaagauccucgcccaguga

SEQ ID NO: 48096 - RNA, 813 nt, Artificial Sequence
  derived and/or modified sequence opt2 from PRKAB1__Homo_sapiens__XP_005253966
augggcaacaccuccuccgagcgcgccgcccucgagcgccacggcggccacaagaccccccgccgcgacuccuccggcggcaccaaggacggcgaccgccccaagauccucauggacucccccgaggacgccgaccucuuccacuccgaggagaucaaggcccccgagaaggaggaguuccucgccuggcagcacgaccucgaggucaacgacaaggcccccgcccaggcccgccccaccgucuuccgcuggaccggcggcggcaaggaggucuaccucuccggcuccuucaacaacugguccaagcucccccucacccgcucccacaacaacuucgucgccauccucgaccuccccgagggcgagcaccaguacaaguucuucgucgacggccaguggacccacgaccccuccgagcccaucgucaccucccagcucggcaccgucaacaacaucauccaggucaagaagaccgacuucgaggucuucgacgcccucauggucgacucccagaagugcuccgacgucuccgagcucuccuccuccccccccggccccuaccaccaggagcccuacgucugcaagcccgaggagcgcuuccgcgccccccccauccuccccccccaccuccuccaggucauccucaacaaggacaccggcaucuccugcgaccccgcccuccuccccgagcccaaccacgucaugcucaaccaccucuacgcccucuccaucaaggacggcgucaugguccucuccgccacccaccgcuacaagaagaaguacgucaccacccuccucuacaagcccaucuga

SEQ ID NO: 48097 - RNA, 1056 nt, Artificial Sequence
  derived and/or modified sequence opt2 from PRKACA__Homo_sapiens__NP_002721
augggcaacgccgccgccgccaagaagggcuccgagcaggaguccgucaaggaguuccucgccaaggccaaggaggacuuccucaagaagugggagucccccgcccagaacaccgcccaccucgaccaguucgagcgcaucaagacccucggcaccggcuccuucggccgcgucaugcucgucaagcacaaggagaccggcaaccacuacgccaugaagauccucgacaagcagaaggucgucaagcucaagcagaucgagcacacccucaacgagaagcgcauccuccaggccgucaacuuccccuuccucgucaagcucgaguucuccuucaaggacaacuccaaccucuacauggucauggaguacguccccggcggcgagauguucucccaccuccgccgcaucggccgcuucuccgagccccacgcccgcuucuacgccgcccagaucguccucaccuucgaguaccuccacucccucgaccucaucuaccgcgaccucaagcccgagaaccuccucaucgaccagcagggcuacauccaggucaccgacuucggcuucgccaagcgcgucaagggccgcaccuggacccucugcggcacccccgaguaccucgcccccgagaucauccucuccaagggcuacaacaaggccgucgacuggugggcccucggcguccucaucuacgagauggccgccggcuacccccccuucuucgccgaccagcccauccagaucuacgagaagaucgucuccggcaagguccgcuuccccucccacuucuccuccgaccucaaggaccuccuccgcaaccuccuccaggucgaccucaccaagcgcuucggcaaccucaagaacggcgucaacgacaucaagaaccacaagugguucgccaccaccgacuggaucgccaucuaccagcgcaaggucgaggcccccuucauccccaaguucaagggccccggcgacaccuccaacuucgacgacuacgaggaggaggagauccgcgucuccaucaacgagaagugcggcaaggaguucuccgaguucuga

SEQ ID NO: 48098 - RNA, 795 nt, Artificial Sequence
  derived and/or modified sequence opt2 from PRKACB__Homo_sapiens__NP_001287844
auguccgcccgcaaguccuccgacgccuccgccugcuccuccuccgagaucuccgacuccuucgucaaggaguuccucgccaaggccaaggaggacuuccucaagaagugggagaaccccacccagaacaacgccggccucgaggacuucgagcgcaagaagacccucggcaccggcuccuucggccgcgucaugcucgucaagcacaaggccaccgagcaguacuacgccaugaagauccucgacaagcagaaggucgucaagcucaagcagaucgagcacacccucaacgagaagcgcauccuccaggccgucaacuuccccuuccucguccgccucgaguacgccuucaaggacaacuccaaccucuacauggucauggaguacguccccggcggcgagauguucucccaccuccgccgcaucggccgcuucuccgagccccacgcccgcuucuacgccgcccagaucguccucaccuucgaguaccuccacucccucgaccucaucuaccgcgaccucaagcccgagaaccuccucaucgaccaccagggcuacauccaggucaccgacuucggcuucgccaagcgcgucaagggccgcaccuggacccucugcggcacccccgaguaccucgcccccgagaucauccucuccaagggcuacaacaaggccgucgacuggugggcccucggcguccucaucuacgagauggccgccggcuacccccccuucuucgccgaccagcccauccagaucuacgagaagaucgucuccggcaagcagaacuucuga

SEQ ID NO: 48099 - RNA, 1056 nt, Artificial Sequence
  derived and/or modified sequence opt2 from PRKACG__Homo_sapiens__NP_002723
augggcaacgcccccgccaagaaggacaccgagcaggaggaguccgucaacgaguuccucgccaaggcccgcggcgacuuccucuaccgcuggggcaaccccgcccagaacaccgccuccuccgaccaguucgagcgccuccgcacccucggcaugggcuccuucggccgcgucaugcucguccgccaccaggagaccggcggccacuacgccaugaagauccucaacaagcagaaggucgucaagaugaagcaggucgagcacauccucaacgagaagcgcauccuccaggccaucgacuuccccuuccucgucaagcuccaguucuccuucaaggacaacuccuaccucuaccucgucauggaguacguccccggcggcgagauguucucccgccuccagcgcgucggccgcuucuccgagccccacgccugcuucuacgccgcccaggucguccucgccguccaguaccuccacucccucgaccucauccaccgcgaccucaagcccgagaaccuccucaucgaccagcagggcuaccuccaggucaccgacuucggcuucgccaagcgcgucaagggccgcaccuggacccucugcggcacccccgaguaccucgcccccgagaucauccucuccaagggcuacaacaaggccgucgacuggugggcccucggcguccucaucuacgagauggccgucggcuucccccccuucuacgccgaccagcccauccagaucuacgagaagaucgucuccggccgcguccgcuuccccuccaagcucuccuccgaccucaagcaccuccuccgcucccuccuccaggucgaccucaccaagcgcuucggcaaccuccgcaacggcgucggcgacaucaagaaccacaagugguucgccaccaccuccuggaucgccaucuacgagaagaaggucgaggcccccuucauccccaaguacaccggccccggcgacgccuccaacuucgacgacuacgaggaggaggagcuccgcaucuccaucaacgagaagugcgccaaggaguucuccgaguucuga

SEQ ID NO: 48100 - RNA, 1023 nt, Artificial Sequence
  derived and/or modified sequence opt2 from PRKAG1__Homo_sapiens__NP_001193638
auggagaccgucaucuccuccgacuccucccccgccgucgagaacgagcacccccaggagacccccgaguccaacaacuccgucuacaccuccuucaugaagucccaccgcugcuacgaccucauccccaccuccuccaagcucgucgucuucgacaccucccuccaggucaagaaggccuucuucgcccucgucaccaacggcguccgcgccgccccccucugggacuccaagaagcaguccuucgucguccuccgcgcccucuccugcccccucggcaugcucaccaucaccgacuucaucaacauccuccaccgcuacuacaaguccgcccucguccagaucuacgagcucgaggagcacaagaucgagaccuggcgcgaggucuaccuccaggacuccuucaagccccucgucugcaucucccccaacgccucccucuucgacgccgucuccucccucauccgcaacaagauccaccgccuccccgucaucgaccccgaguccggcaacacccucuacauccucacccacaagcgcauccucaaguuccucaagcucuucaucaccgaguuccccaagcccgaguucauguccaagucccucgaggagcuccagaucggcaccuacgccaacaucgccaugguccgcaccaccacccccgucuacgucgcccucggcaucuucguccagcaccgcgucuccgcccuccccgucgucgacgagaagggccgcgucgucgacaucuacuccaaguucgacgucaucaaccucgccgccgagaagaccuacaacaaccucgacgucuccgucaccaaggcccuccagcaccgcucccacuacuucgagggcguccucaagugcuaccuccacgagacccucgagaccaucaucaaccgccucgucgaggccgagguccaccgccucgucgucgucgacgagaacgacgucgucaagggcaucgucucccucuccgacauccuccaggcccucguccucaccggcggcgagaagaagcccuga

SEQ ID NO: 48101 - RNA, 1578 nt, Artificial Sequence
  derived and/or modified sequence opt2 from PRKAG2__Homo_sapiens__NP_001035723
augccccuccucgacggcgaccucgagggcuccggcaagcacuccucccgcaaggucgacucccccuucggccccggcucccccuccaagggcuucuucucccgcggcccccagccccgccccuccucccccauguccgcccccguccgccccaagaccucccccggcucccccaagaccgucuuccccuucuccuaccaggagucccccccccgcuccccccgccgcauguccuucuccggcaucuuccgcuccuccuccaaggaguccucccccaacuccaaccccgccaccucccccggcggcauccgcuucuucucccgcucccgcaagaccuccggccucuccuccucccccuccacccccacccaggucaccaagcagcacaccuucccccucgaguccuacaagcacgagcccgagcgccucgagaaccgcaucuacgccuccuccuccccccccgacaccggccagcgcuucugccccuccuccuuccagucccccacccgccccccccucgccucccccacccacuacgcccccuccaaggccgccgcccucgccgccgcccucggccccgccgaggccggcaugcucgagaagcucgaguucgaggacgaggccgucgaggacuccgaguccggcgucuacaugcgcuucaugcgcucccacaagugcuacgacaucguccccaccuccuccaagcucgucgucuucgacaccacccuccaggucaagaaggccuucuucgcccucgucgccaacggcguccgcgccgccccccucugggaguccaagaagcaguccuucgucggcaugcucaccaucaccgacuucaucaacauccuccaccgcuacuacaagucccccaugguccagaucuacgagcucgaggagcacaagaucgagaccuggcgcgagcucuaccuccaggagaccuucaagccccucgucaacaucucccccgacgccucccucuucgacgccgucuacucccucaucaagaacaagauccaccgccuccccgucaucgaccccaucuccggcaacgcccucuacauccucacccacaagcgcauccucaaguuccuccagcucuucauguccgacaugcccaagcccgccuucaugaagcagaaccucgacgagcucggcaucggcaccuaccacaacaucgccuucauccaccccgacacccccaucaucaaggcccucaacaucuucgucgagcgccgcaucuccgcccuccccgucgucgacgaguccggcaaggucgucgacaucuacuccaaguucgacgucaucaaccucgccgccgagaagaccuacaacaaccucgacaucaccgucacccaggcccuccagcaccgcucccaguacuucgagggcgucgucaagugcaacaagcucgagauccucgagaccaucgucgaccgcaucguccgcgccgagguccaccgccucgucgucgucaacgaggccgacuccaucgucggcaucaucucccucuccgacauccuccaggcccucauccucacccccgccggcgccaagcagaaggagaccgagaccgaguga

SEQ ID NO: 48102 - RNA, 1470 nt, Artificial Sequence
  derived and/or modified sequence opt2 from PRKAG3__Homo_sapiens__NP_059127
auggagcccggccucgagcacgcccuccgccgcacccccuccugguccucccucggcggcuccgagcaccaggagauguccuuccucgagcaggagaacuccuccuccuggcccucccccgccgucaccuccuccuccgagcgcauccgcggcaagcgccgcgccaaggcccuccgcuggacccgccagaaguccgucgaggagggcgagccccccggccagggcgagggcccccgcucccgccccgccgccgaguccaccggccucgaggccaccuuccccaagaccaccccccucgcccaggccgaccccgccggcgucggcaccccccccaccggcugggacugccuccccuccgacugcaccgccuccgccgccggcuccuccaccgacgacgucgagcucgccaccgaguuccccgccaccgaggccugggagugcgagcucgagggccuccucgaggagcgccccgcccucugccucuccccccaggcccccuuccccaagcucggcugggacgacgagcuccgcaagcccggcgcccagaucuacaugcgcuucaugcaggagcacaccugcuacgacgccauggccaccuccuccaagcucgucaucuucgacaccaugcucgagaucaagaaggccuucuucgcccucgucgccaacggcguccgcgccgccccccucugggacuccaagaagcaguccuucgucggcaugcucaccaucaccgacuucauccucguccuccaccgcuacuaccgcuccccccucguccagaucuacgagaucgagcagcacaagaucgagaccuggcgcgagaucuaccuccagggcugcuucaagccccucgucuccaucucccccaacgacucccucuucgaggccgucuacacccucaucaagaaccgcauccaccgccuccccguccucgaccccgucuccggcaacguccuccacauccucacccacaagcgccuccucaaguuccuccacaucuucggcucccuccucccccgccccuccuuccucuaccgcaccauccaggaccucggcaucggcaccuuccgcgaccucgccgucguccucgagaccgcccccauccucaccgcccucgacaucuucgucgaccgccgcgucuccgcccuccccgucgucaacgagugcggccaggucgucggccucuacucccgcuucgacgucauccaccucgccgcccagcagaccuacaaccaccucgacauguccgucggcgaggcccuccgccagcgcacccucugccucgagggcguccucuccugccagccccacgagucccucggcgaggucaucgaccgcaucgcccgcgagcagguccaccgccucguccucgucgacgagacccagcaccuccucggcgucgucucccucuccgacauccuccaggcccucguccucucccccgccggcaucgacgcccucggcgccuga

SEQ ID NO: 48103 - RNA, 1146 nt, Artificial Sequence
  derived and/or modified sequence opt2 from PRKAR1A__Homo_sapiens__NP_001263218
auggaguccggcuccaccgccgccuccgaggaggcccgcucccuccgcgagugcgagcucuacguccagaagcacaacauccaggcccuccucaaggacuccaucguccagcucugcaccgcccgccccgagcgccccauggccuuccuccgcgaguacuucgagcgccucgagaaggaggaggccaagcagauccagaaccuccagaaggccggcacccgcaccgacucccgcgaggacgagaucuccccccccccccccaaccccgucgucaagggccgccgccgccgcggcgccaucuccgccgaggucuacaccgaggaggacgccgccuccuacguccgcaaggucauccccaaggacuacaagaccauggccgcccucgccaaggccaucgagaagaacguccucuucucccaccucgacgacaacgagcgcuccgacaucuucgacgccauguucuccgucuccuucaucgccggcgagaccgucauccagcagggcgacgagggcgacaacuucuacgucaucgaccagggcgagaccgacgucuacgucaacaacgagugggccaccuccgucggcgagggcggcuccuucggcgagcucgcccucaucuacggcaccccccgcgccgccaccgucaaggccaagaccaacgucaagcucuggggcaucgaccgcgacuccuaccgccgcauccucaugggcuccacccuccgcaagcgcaagauguacgaggaguuccucuccaaggucuccauccucgagucccucgacaagugggagcgccucaccgucgccgacgcccucgagcccguccaguucgaggacggccagaagaucgucguccagggcgagcccggcgacgaguucuucaucauccucgagggcuccgccgccguccuccagcgccgcuccgagaacgaggaguucgucgaggucggccgccucggccccuccgacuacuucggcgagaucgcccuccucaugaaccgcccccgcgccgccaccgucgucgcccgcggcccccucaagugcgucaagcucgaccgcccccgcuucgagcgcguccucggccccugcuccgacauccucaagcgcaacauccagcaguacaacuccuucgucucccucuccgucuga

SEQ ID NO: 48104 - RNA, 1146 nt, Artificial Sequence
  derived and/or modified sequence opt2 from PRKAR1B__Homo_sapiens__NP_002726
auggccuccccccccgccugccccuccgaggaggacgagucccucaagggcugcgagcucuacguccagcuccacggcauccagcagguccucaaggacugcaucguccaccucugcaucuccaagcccgagcgccccaugaaguuccuccgcgagcacuucgagaagcucgagaaggaggagaaccgccagauccucgcccgccagaaguccaacucccaguccgacucccacgacgaggaggucucccccaccccccccaaccccgucgucaaggcccgccgccgccgcggcggcgucuccgccgaggucuacaccgaggaggacgccgucuccuacguccgcaaggucauccccaaggacuacaagaccaugaccgcccucgccaaggccaucuccaagaacguccucuucgcccaccucgacgacaacgagcgcuccgacaucuucgacgccauguuccccgucacccacaucgccggcgagaccgucauccagcagggcaacgagggcgacaacuucuacgucgucgaccagggcgaggucgacgucuacgucaacggcgagugggucaccaacaucuccgagggcggcuccuucggcgagcucgcccucaucuacggcaccccccgcgccgccaccgucaaggccaagaccgaccucaagcucuggggcaucgaccgcgacuccuaccgccgcauccucaugggcuccacccuccgcaagcgcaagauguacgaggaguuccucuccaaggucuccauccucgagucccucgagaagugggagcgccucaccgucgccgacgcccucgagcccguccaguucgaggacggcgagaagaucgucguccagggcgagcccggcgacgacuucuacaucaucaccgagggcaccgccuccguccuccagcgccgcucccccaacgaggaguacgucgaggucggccgccucggccccuccgacuacuucggcgagaucgcccuccuccucaaccgcccccgcgccgccaccgucgucgcccgcggcccccucaagugcgucaagcucgaccgcccccgcuucgagcgcguccucggccccugcuccgagauccucaagcgcaacauccagcgcuacaacuccuucaucucccucaccgucuga

SEQ ID NO: 48105 - RNA, 1215 nt, Artificial Sequence
  derived and/or modified sequence opt2 from PRKAR2A__Homo_sapiens__NP_004148
augucccacauccagaucccccccggccucaccgagcuccuccagggcuacaccgucgagguccuccgccagcagccccccgaccucgucgaguucgccgucgaguacuucacccgccuccgcgaggcccgcgcccccgccuccguccuccccgccgccaccccccgccagucccucggccaccccccccccgagcccggccccgaccgcgucgccgacgccaagggcgacuccgaguccgaggaggacgaggaccucgagguccccguccccucccgcuucaaccgccgcgucuccgucugcgccgagaccuacaaccccgacgaggaggaggaggacaccgacccccgcgucauccaccccaagaccgacgagcagcgcugccgccuccaggaggccugcaaggacauccuccucuucaagaaccucgaccaggagcagcucucccagguccucgacgccauguucgagcgcaucgucaaggccgacgagcacgucaucgaccagggcgacgacggcgacaacuucuacgucaucgagcgcggcaccuacgacauccucgucaccaaggacaaccagacccgcuccgucggccaguacgacaaccgcggcuccuucggcgagcucgcccucauguacaacaccccccgcgccgccaccaucgucgccaccuccgagggcucccucuggggccucgaccgcgucaccuuccgccgcaucaucgucaagaacaacgccaagaagcgcaagauguucgaguccuucaucgaguccgucccccuccucaagucccucgaggucuccgagcgcaugaagaucgucgacgucaucggcgagaagaucuacaaggacggcgagcgcaucaucacccagggcgagaaggccgacuccuucuacaucaucgaguccggcgaggucuccauccucauccgcucccgcaccaaguccaacaaggacggcggcaaccaggaggucgagaucgcccgcugccacaagggccaguacuucggcgagcucgcccucgucaccaacaagccccgcgccgccuccgccuacgccgucggcgacgucaagugccucgucauggacguccaggccuucgagcgccuccucggccccugcauggacaucaugaagcgcaacaucucccacuacgaggagcagcucgucaagauguucggcuccuccgucgaccucggcaaccucggccaguga

SEQ ID NO: 48106 - RNA, 1257 nt, Artificial Sequence
  derived and/or modified sequence opt2 from PRKAR2B__Homo_sapiens__NP_002727
auguccaucgagauccccgccggccucaccgagcuccuccagggcuucaccgucgagguccuccgccaccagcccgccgaccuccucgaguucgcccuccagcacuucacccgccuccagcaggagaacgagcgcaagggcaccgcccgcuucggccacgagggccgcaccuggggcgaccucggcgccgccgccggcggcggcacccccuccaagggcgucaacuucgccgaggagcccaugcaguccgacuccgaggacggcgaggaggaggaggccgcccccgccgacgccggcgccuucaacgcccccgucaucaaccgcuucacccgccgcgccuccgucugcgccgaggccuacaaccccgacgaggaggaggacgacgccgagucccgcaucauccaccccaagaccgacgaccagcgcaaccgccuccaggaggccugcaaggacauccuccucuucaagaaccucgaccccgagcagaugucccagguccucgacgccauguucgagaagcucgucaaggacggcgagcacgucaucgaccagggcgacgacggcgacaacuucuacgucaucgaccgcggcaccuucgacaucuacgucaagugcgacggcgucggccgcugcgucggcaacuacgacaaccgcggcuccuucggcgagcucgcccucauguacaacaccccccgcgccgccaccaucaccgccaccucccccggcgcccucuggggccucgaccgcgucaccuuccgccgcaucaucgucaagaacaacgccaagaagcgcaagauguacgaguccuucaucgagucccuccccuuccucaagucccucgaguucuccgagcgccucaaggucgucgacgucaucggcaccaaggucuacaacgacggcgagcagaucaucgcccagggcgacuccgccgacuccuucuucaucgucgaguccggcgaggucaagaucaccaugaagcgcaagggcaaguccgaggucgaggagaacggcgccgucgagaucgcccgcugcucccgcggccaguacuucggcgagcucgcccucgucaccaacaagccccgcgccgccuccgcccacgccaucggcaccgucaagugccucgccauggacguccaggccuucgagcgccuccucggccccugcauggagaucaugaagcgcaacaucgccaccuacgaggagcagcucgucgcccucuucggcaccaacauggacaucgucgagcccaccgccuga

SEQ ID NO: 48107 - RNA, 2019 nt, Artificial Sequence
  derived and/or modified sequence opt2 from PRKCA__Homo_sapiens__NP_002728
auggccgacgucuuccccggcaacgacuccaccgccucccaggacgucgccaaccgcuucgcccgcaagggcgcccuccgccagaagaacguccacgaggucaaggaccacaaguucaucgcccgcuucuucaagcagcccaccuucugcucccacugcaccgacuucaucuggggcuucggcaagcagggcuuccagugccaggucugcugcuucgucguccacaagcgcugccacgaguucgucaccuucuccugccccggcgccgacaagggccccgacaccgacgacccccgcuccaagcacaaguucaagauccacaccuacggcucccccaccuucugcgaccacugcggcucccuccucuacggccucauccaccagggcaugaagugcgacaccugcgacaugaacguccacaagcagugcgucaucaacguccccucccucugcggcauggaccacaccgagaagcgcggccgcaucuaccucaaggccgaggucgccgacgagaagcuccacgucaccguccgcgacgccaagaaccucauccccauggaccccaacggccucuccgaccccuacgucaagcucaagcucauccccgaccccaagaacgaguccaagcagaagaccaagaccauccgcuccacccucaacccccaguggaacgaguccuucaccuucaagcucaagcccuccgacaaggaccgccgccucuccgucgagaucugggacugggaccgcaccacccgcaacgacuucaugggcucccucuccuucggcgucuccgagcucaugaagaugcccgccuccggcugguacaagcuccucaaccaggaggagggcgaguacuacaacguccccauccccgagggcgacgaggagggcaacauggagcuccgccagaaguucgagaaggccaagcucggccccgccggcaacaaggucaucucccccuccgaggaccgcaagcagcccuccaacaaccucgaccgcgucaagcucaccgacuucaacuuccucaugguccucggcaagggcuccuucggcaaggucaugcucgccgaccgcaagggcaccgaggagcucuacgccaucaagauccucaagaaggacgucgucauccaggacgacgacgucgagugcaccauggucgagaagcgcguccucgcccuccucgacaagccccccuuccucacccagcuccacuccugcuuccagaccgucgaccgccucuacuucgucauggaguacgucaacggcggcgaccucauguaccacauccagcaggucggcaaguucaaggagccccaggccgucuucuacgccgccgagaucuccaucggccucuucuuccuccacaagcgcggcaucaucuaccgcgaccucaagcucgacaacgucaugcucgacuccgagggccacaucaagaucgccgacuucggcaugugcaaggagcacaugauggacggcgucaccacccgcaccuucugcggcacccccgacuacaucgcccccgagaucaucgccuaccagcccuacggcaaguccgucgacuggugggccuacggcguccuccucuacgagaugcucgccggccagccccccuucgacggcgaggacgaggacgagcucuuccaguccaucauggagcacaacgucuccuaccccaagucccucuccaaggaggccgucuccaucugcaagggccucaugaccaagcaccccgccaagcgccucggcugcggccccgagggcgagcgcgacguccgcgagcacgccuucuuccgccgcaucgacugggagaagcucgagaaccgcgagauccagccccccuucaagcccaaggucugcggcaagggcgccgagaacuucgacaaguucuucacccgcggccagcccguccucaccccccccgaccagcucgucaucgccaacaucgaccaguccgacuucgagggcuucuccuacgucaacccccaguucguccaccccauccuccaguccgccgucuga

SEQ ID NO: 48108 - RNA, 2022 nt, Artificial Sequence
  derived and/or modified sequence opt2 from PRKCB__Homo_sapiens__NP_002729
auggccgaccccgccgccggccccccccccuccgagggcgaggaguccaccguccgcuucgcccgcaagggcgcccuccgccagaagaacguccacgaggucaagaaccacaaguucaccgcccgcuucuucaagcagcccaccuucugcucccacugcaccgacuucaucuggggcuucggcaagcagggcuuccagugccaggucugcugcuucgucguccacaagcgcugccacgaguucgucaccuucuccugccccggcgccgacaagggccccgccuccgacgacccccgcuccaagcacaaguucaagauccacaccuacuccucccccaccuucugcgaccacugcggcucccuccucuacggccucauccaccagggcaugaagugcgacaccugcaugaugaacguccacaagcgcugcgucaugaacguccccucccucugcggcaccgaccacaccgagcgccgcggccgcaucuacauccaggcccacaucgaccgcgacguccucaucguccucguccgcgacgccaagaaccucguccccauggaccccaacggccucuccgaccccuacgucaagcucaagcucauccccgaccccaaguccgaguccaagcagaagaccaagaccaucaagugcucccucaaccccgaguggaacgagaccuuccgcuuccagcucaaggaguccgacaaggaccgccgccucuccgucgagaucugggacugggaccucaccucccgcaacgacuucaugggcucccucuccuucggcaucuccgagcuccagaaggccuccgucgacggcugguucaagcuccucucccaggaggagggcgaguacuucaacguccccgucccccccgagggcuccgaggccaacgaggagcuccgccagaaguucgagcgcgccaagaucucccagggcaccaagguccccgaggagaagaccaccaacaccgucuccaaguucgacaacaacggcaaccgcgaccgcaugaagcucaccgacuucaacuuccucaugguccucggcaagggcuccuucggcaaggucaugcucuccgagcgcaagggcaccgacgagcucuacgccgucaagauccucaagaaggacgucgucauccaggacgacgacgucgagugcaccauggucgagaagcgcguccucgcccuccccggcaagccccccuuccucacccagcuccacuccugcuuccagaccauggaccgccucuacuucgucauggaguacgucaacggcggcgaccucauguaccacauccagcaggucggccgcuucaaggagccccacgccgucuucuacgccgccgagaucgccaucggccucuucuuccuccaguccaagggcaucaucuaccgcgaccucaagcucgacaacgucaugcucgacuccgagggccacaucaagaucgccgacuucggcaugugcaaggagaacaucugggacggcgucaccaccaagaccuucugcggcacccccgacuacaucgcccccgagaucaucgccuaccagcccuacggcaaguccgucgacuggugggccuucggcguccuccucuacgagaugcucgccggccaggcccccuucgagggcgaggacgaggacgagcucuuccaguccaucauggagcacaacgucgccuaccccaaguccauguccaaggaggccgucgccaucugcaagggccucaugaccaagcaccccggcaagcgccucggcugcggccccgagggcgagcgcgacaucaaggagcacgccuucuuccgcuacaucgacugggagaagcucgagcgcaaggagauccagccccccuacaagcccaaggccugcggccgcaacgccgagaacuucgaccgcuucuucacccgccacccccccguccucaccccccccgaccaggaggucauccgcaacaucgaccaguccgaguucgagggcuucuccuucgucaacuccgaguuccucaagcccgaggucaaguccuga

SEQ ID NO: 48109 - RNA, 786 nt, Artificial Sequence
  derived and/or modified sequence opt2 from PRKCDBP__Homo_sapiens__NP_659477
augcgcgaguccgcccucgagcgcggccccguccccgaggcccccgccggcggccccguccacgccgucaccgucgucacccuccucgagaagcucgccuccaugcucgagacccuccgcgagcgccagggcggccucgcccgccgccagggcggccucgccggcuccguccgccgcauccaguccggccucggcgcccucucccgcucccacgacaccaccuccaacacccucgcccagcuccucgccaaggccgagcgcgucuccucccacgccaacgccgcccaggagcgcgccguccgccgcgccgcccagguccagcgccucgaggccaaccacggccuccucgucgcccgcggcaagcuccacguccuccucuucaaggaggagggcgagguccccgccuccgccuuccagaaggcccccgagccccucggccccgccgaccaguccgagcucggccccgagcagcucgaggccgaggucggcgaguccuccgacgaggagcccgucgagucccgcgcccagcgccuccgccgcaccggccuccagaagguccagucccuccgccgcgcccucuccggccgcaagggccccgccgcccccccccccacccccgucaagcccccccgccucggccccggccgcuccgccgaggcccagcccgaggcccagcccgcccucgagcccacccucgagcccgagcccccccaggacaccgaggaggaccccggccgccccggcgccgccgaggaggcccuccuccagauggaguccgucgccuga

SEQ ID NO: 48110 - RNA, 2031 nt, Artificial Sequence
  derived and/or modified sequence opt2 from PRKCD__Homo_sapiens__NP_997704
auggcccccuuccuccgcaucgccuucaacuccuacgagcucggcucccuccaggccgaggacgaggccaaccagcccuucugcgccgucaagaugaaggaggcccucuccaccgagcgcggcaagacccucguccagaagaagcccaccauguaccccgaguggaaguccaccuucgacgcccacaucuacgagggccgcgucauccagaucguccucaugcgcgccgccgaggagcccgucuccgaggucaccgucggcgucuccguccucgccgagcgcugcaagaagaacaacggcaaggccgaguucuggcucgaccuccagccccaggccaagguccucauguccguccaguacuuccucgaggacgucgacugcaagcaguccaugcgcuccgaggacgaggccaaguuccccaccaugaaccgccgcggcgccaucaagcaggccaagauccacuacaucaagaaccacgaguucaucgccaccuucuucggccagcccaccuucugcuccgucugcaaggacuucgucuggggccucaacaagcagggcuacaagugccgccagugcaacgccgccauccacaagaagugcaucgacaagaucaucggccgcugcaccggcaccgccgccaacucccgcgacaccaucuuccagaaggagcgcuucaacaucgacaugccccaccgcuucaagguccacaacuacaugucccccaccuucugcgaccacugcggcucccuccucuggggccucgucaagcagggccucaagugcgaggacugcggcaugaacguccaccacaagugccgcgagaaggucgccaaccucugcggcaucaaccagaagcuccucgccgaggcccucaaccaggucacccagcgcgccucccgccgcuccgacuccgccuccuccgagcccgucggcaucuaccagggcuucgagaagaagaccggcgucgccggcgaggacaugcaggacaacuccggcaccuacggcaagaucugggagggcuccuccaagugcaacaucaacaacuucaucuuccacaagguccucggcaagggcuccuucggcaagguccuccucggcgagcucaagggccgcggcgaguacuucgccaucaaggcccucaagaaggacgucguccucaucgacgacgacgucgagugcaccauggucgagaagcgcguccucacccucgccgccgagaaccccuuccucacccaccucaucugcaccuuccagaccaaggaccaccucuucuucgucauggaguuccucaacggcggcgaccucauguaccacauccaggacaagggccgcuucgagcucuaccgcgccaccuucuacgccgccgagaucaugugcggccuccaguuccuccacuccaagggcaucaucuaccgcgaccucaagcucgacaacguccuccucgaccgcgacggccacaucaagaucgccgacuucggcaugugcaaggagaacaucuucggcgagucccgcgccuccaccuucugcggcacccccgacuacaucgcccccgagauccuccagggccucaaguacaccuucuccgucgacuggugguccuucggcguccuccucuacgagaugcucaucggccagucccccuuccacggcgacgacgaggacgagcucuucgaguccauccgcgucgacaccccccacuacccccgcuggaucaccaaggaguccaaggacauccucgagaagcucuucgagcgcgagcccaccaagcgccucggcgucaccggcaacaucaagauccaccccuucuucaagaccaucaacuggacccuccucgagaagcgccgccucgagccccccuuccgccccaaggucaaguccccccgcgacuacuccaacuucgaccaggaguuccucaacgagaaggcccgccucuccuacuccgacaagaaccucaucgacuccauggaccaguccgccuucgccggcuucuccuucgucaaccccaaguucgagcaccuccucgaggacuga

SEQ ID NO: 48111 - RNA, 2214 nt, Artificial Sequence
  derived and/or modified sequence opt2 from PRKCE__Homo_sapiens__XP_005264485
auggucgucuucaacggccuccucaagaucaagaucugcgaggccgucucccucaagcccaccgccuggucccuccgccacgccgucggcccccgcccccagaccuuccuccucgaccccuacaucgcccucaacgucgacgacucccgcaucggccagaccgccaccaagcagaagaccaacucccccgccuggcacgacgaguucgucaccgacgucugcaacggccgcaagaucgagcucgccgucuuccacgacgcccccaucggcuacgacgacuucgucgccaacugcaccauccaguucgaggagcuccuccagaacggcucccgccacuucgaggacuggaucgaccucgagcccgagggccgcgucuacgucaucaucgaccucuccggcuccuccggcgaggcccccaaggacaacgaggagcgcgucuuccgcgagcgcaugcgcccccgcaagcgccagggcgccguccgccgccgcguccaccaggucaacggccacaaguucauggccaccuaccuccgccagcccaccuacugcucccacugccgcgacuucaucuggggcgucaucggcaagcagggcuaccagugccaggucugcaccugcgucguccacaagcgcugccacgagcucaucaucaccaagugcgccggccucaagaagcaggagacccccgaccaggucggcucccagcgcuucuccgucaacaugccccacaaguucggcauccacaacuacaagguccccaccuucugcgaccacugcggcucccuccucuggggccuccuccgccagggccuccagugcaaggucugcaagaugaacguccaccgccgcugcgagaccaacgucgcccccaacugcggcgucgacgcccgcggcaucgccaagguccucgccgaccucggcgucacccccgacaagaucaccaacuccggccagcgccgcaagaagcucaucgccggcgccgaguccccccagcccgccuccggcuccucccccuccgaggaggaccgcuccaaguccgcccccaccucccccugcgaccaggagaucaaggagcucgagaacaacauccgcaaggcccucuccuucgacaaccgcggcgaggagcaccgcgccgccuccucccccgacggccagcucaugucccccggcgagaacggcgagguccgccagggccaggccaagcgccucggccucgacgaguucaacuucaucaagguccucggcaagggcuccuucggcaaggucaugcucgccgagcucaagggcaaggacgaggucuacgccgucaagguccucaagaaggacgucauccuccaggacgacgacgucgacugcaccaugaccgagaagcgcauccucgcccucgcccgcaagcaccccuaccucacccagcucuacugcugcuuccagaccaaggaccgccucuucuucgucauggaguacgucaacggcggcgaccucauguuccagauccagcgcucccgcaaguucgacgagccccgcucccgcuucuacgccgccgaggucaccuccgcccucauguuccuccaccagcacggcgucaucuaccgcgaccucaagcucgacaacauccuccucgacgccgagggccacugcaagcucgccgacuucggcaugugcaaggagggcauccucaacggcgucaccaccaccaccuucugcggcacccccgacuacaucgcccccgagauccuccaggagcucgaguacggccccuccgucgacuggugggcccucggcguccucauguacgagaugauggccggccagccccccuucgaggccgacaacgaggacgaccucuucgaguccauccuccacgacgacguccucuaccccgucuggcucuccaaggaggccgucuccauccucaaggccuucaugaccaagaacccccacaagcgccucggcugcgucgccucccagaacggcgaggacgccaucaagcagcaccccuucuucaaggagaucgacuggguccuccucgagcagaagaagaucaagccccccuucaagccccgcaucaagaccaagcgcgacgucaacaacuucgaccaggacuucacccgcgaggagcccguccucacccucgucgacgaggccaucgucaagcagaucaaccaggaggaguucaagggcuucuccuacuucggcgaggaccucaugcccuga

SEQ ID NO: 48112 - RNA, 2094 nt, Artificial Sequence
  derived and/or modified sequence opt2 from PRKCG__Homo_sapiens__NP_002730
auggccggccucggccccggcgucggcgacuccgagggcggcccccgcccccucuucugccgcaagggcgcccuccgccagaaggucguccacgaggucaagucccacaaguucaccgcccgcuucuucaagcagcccaccuucugcucccacugcaccgacuucaucuggggcaucggcaagcagggccuccagugccaggucugcuccuucgucguccaccgccgcugccacgaguucgucaccuucgagugccccggcgccggcaagggcccccagaccgacgacccccgcaacaagcacaaguuccgccuccacuccuacuccucccccaccuucugcgaccacugcggcucccuccucuacggccucguccaccagggcaugaagugcuccugcugcgagaugaacguccaccgccgcugcguccgcuccguccccucccucugcggcgucgaccacaccgagcgccgcggccgccuccagcucgagauccgcgcccccaccgccgacgagauccacgucaccgucggcgaggcccgcaaccucauccccauggaccccaacggccucuccgaccccuacgucaagcucaagcucauccccgacccccgcaaccucaccaagcagaagacccgcaccgucaaggccacccucaaccccgucuggaacgagaccuucgucuucaaccucaagcccggcgacgucgagcgccgccucuccgucgaggucugggacugggaccgcaccucccgcaacgacuucaugggcgccauguccuucggcgucuccgagcuccucaaggcccccgucgacggcugguacaagcuccucaaccaggaggagggcgaguacuacaacguccccgucgccgacgccgacaacugcucccuccuccagaaguucgaggccugcaacuacccccucgagcucuacgagcgcguccgcaugggccccuccuccucccccauccccucccccucccccucccccaccgaccccaagcgcugcuucuucggcgccucccccggccgccuccacaucuccgacuucuccuuccucaugguccucggcaagggcuccuucggcaaggucaugcucgccgagcgccgcggcuccgacgagcucuacgccaucaagauccucaagaaggacgucaucguccaggacgacgacgucgacugcacccucgucgagaagcgcguccucgcccucggcggccgcggccccggcggccgcccccacuuccucacccagcuccacuccaccuuccagacccccgaccgccucuacuucgucauggaguacgucaccggcggcgaccucauguaccacauccagcagcucggcaaguucaaggagccccacgccgccuucuacgccgccgagaucgccaucggccucuucuuccuccacaaccagggcaucaucuaccgcgaccucaagcucgacaacgucaugcucgacgccgagggccacaucaagaucaccgacuucggcaugugcaaggagaacgucuuccccggcaccaccacccgcaccuucugcggcacccccgacuacaucgcccccgagaucaucgccuaccagcccuacggcaaguccgucgacuggugguccuucggcguccuccucuacgagaugcucgccggccagccccccuucgacggcgaggacgaggaggagcucuuccaggccaucauggagcagaccgucaccuaccccaagucccucucccgcgaggccgucgccaucugcaagggcuuccucaccaagcaccccggcaagcgccucggcuccggccccgacggcgagcccaccauccgcgcccacggcuucuuccgcuggaucgacugggagcgccucgagcgccucgagauccccccccccuuccgcccccgccccugcggccgcuccggcgagaacuucgacaaguucuucacccgcgccgcccccgcccucaccccccccgaccgccucguccucgccuccaucgaccaggccgacuuccagggcuucaccuacgucaaccccgacuucguccaccccgacgcccgcucccccaccucccccguccccguccccgucauguga

SEQ ID NO: 48113 - RNA, 2052 nt, Artificial Sequence
  derived and/or modified sequence opt2 from PRKCH__Homo_sapiens__NP_006246
auguccuccggcaccaugaaguucaacggcuaccuccgcguccgcaucggcgaggccgucggccuccagcccacccgcuggucccuccgccacucccucuucaagaagggccaccagcuccucgaccccuaccucaccgucuccgucgaccagguccgcgucggccagaccuccaccaagcagaagaccaacaagcccaccuacaacgaggaguucugcgccaacgucaccgacggcggccaccucgagcucgccgucuuccacgagaccccccucggcuacgaccacuucgucgccaacugcacccuccaguuccaggagcuccuccgcaccaccggcgccuccgacaccuucgagggcugggucgaccucgagcccgagggcaaggucuucgucgucaucacccucaccggcuccuucaccgaggccacccuccagcgcgaccgcaucuucaagcacuucacccgcaagcgccagcgcgccaugcgccgccgcguccaccagaucaacggccacaaguucauggccaccuaccuccgccagcccaccuacugcucccacugccgcgaguucaucuggggcgucuucggcaagcagggcuaccagugccaggucugcaccugcgucguccacaagcgcugccaccaccucaucgucaccgccugcaccugccagaacaacaucaacaaggucgacuccaagaucgccgagcagcgcuucggcaucaacaucccccacaaguucuccauccacaacuacaagguccccaccuucugcgaccacugcggcucccuccucuggggcaucaugcgccagggccuccagugcaagaucugcaagaugaacguccacauccgcugccaggccaacgucgcccccaacugcggcgucaacgccgucgagcucgccaagacccucgccggcaugggccuccagcccggcaacaucucccccaccuccaagcucgucucccgcuccacccuccgccgccagggcaaggaguccuccaaggagggcaacggcaucggcgucaacuccuccaaccgccucggcaucgacaacuucgaguucauccgcguccucggcaagggcuccuucggcaaggucaugcucgcccgcgucaaggagaccggcgaccucuacgccgucaagguccucaagaaggacgucauccuccaggacgacgacgucgagugcaccaugaccgagaagcgcauccucucccucgcccgcaaccaccccuuccucacccagcucuucugcugcuuccagacccccgaccgccucuucuucgucauggaguucgucaacggcggcgaccucauguuccacauccagaagucccgccgcuucgacgaggcccgcgcccgcuucuacgccgccgagaucaucuccgcccucauguuccuccacgacaagggcaucaucuaccgcgaccucaagcucgacaacguccuccucgaccacgagggccacugcaagcucgccgacuucggcaugugcaaggagggcaucugcaacggcgucaccaccgccaccuucugcggcacccccgacuacaucgcccccgagauccuccaggagaugcucuacggccccgccgucgacuggugggccaugggcguccuccucuacgagaugcucugcggccacgcccccuucgaggccgagaacgaggacgaccucuucgaggccauccucaacgacgaggucgucuaccccaccuggcuccacgaggacgccaccggcauccucaaguccuucaugaccaagaaccccaccaugcgccucggcucccucacccagggcggcgagcacgccauccuccgccaccccuucuucaaggagaucgacugggcccagcucaaccaccgccagaucgagccccccuuccgcccccgcaucaagucccgcgaggacgucuccaacuucgaccccgacuucaucaaggaggagcccguccucacccccaucgacgagggccaccuccccaugaucaaccaggacgaguuccgcaacuucuccuacgucucccccgagcuccagcccuga

SEQ ID NO: 48114 - RNA, 1791 nt, Artificial Sequence
  derived and/or modified sequence opt2 from PRKCI__Homo_sapiens__NP_002731
augcccacccagcgcgacuccuccaccaugucccacaccgucgccggcggcggcuccggcgaccacucccaccagguccgcgucaaggccuacuaccgcggcgacaucaugaucacccacuucgagcccuccaucuccuucgagggccucugcaacgagguccgcgacaugugcuccuucgacaacgagcagcucuucaccaugaaguggaucgacgaggagggcgaccccugcaccgucuccucccagcucgagcucgaggaggccuuccgccucuacgagcucaacaaggacuccgagcuccucauccacgucuuccccugcguccccgagcgccccggcaugcccugccccggcgaggacaaguccaucuaccgccgcggcgcccgccgcuggcgcaagcucuacugcgccaacggccacaccuuccaggccaagcgcuucaaccgccgcgcccacugcgccaucugcaccgaccgcaucuggggccucggccgccagggcuacaagugcaucaacugcaagcuccucguccacaagaagugccacaagcucgucaccaucgagugcggccgccacucccucccccaggagcccgucaugcccauggaccaguccuccaugcacuccgaccacgcccagaccgucauccccuacaaccccuccucccacgagucccucgaccaggucggcgaggagaaggaggccaugaacacccgcgaguccggcaaggccuccuccucccucggccuccaggacuucgaccuccuccgcgucaucggccgcggcuccuacgccaagguccuccucguccgccucaagaagaccgaccgcaucuacgccaugaaggucgucaagaaggagcucgucaacgacgacgaggacaucgacuggguccagaccgagaagcacgucuucgagcaggccuccaaccaccccuuccucgucggccuccacuccugcuuccagaccgagucccgccucuucuucgucaucgaguacgucaacggcggcgaccucauguuccacaugcagcgccagcgcaagcuccccgaggagcacgcccgcuucuacuccgccgagaucucccucgcccucaacuaccuccacgagcgcggcaucaucuaccgcgaccucaagcucgacaacguccuccucgacuccgagggccacaucaagcucaccgacuacggcaugugcaaggagggccuccgccccggcgacaccaccuccaccuucugcggcacccccaacuacaucgcccccgagauccuccgcggcgaggacuacggcuucuccgucgacuggugggcccucggcguccucauguucgagaugauggccggccgcucccccuucgacaucgucggcuccuccgacaaccccgaccagaacaccgaggacuaccucuuccaggucauccucgagaagcagauccgcaucccccgcucccucuccgucaaggccgccuccguccucaaguccuuccucaacaaggaccccaaggagcgccucggcugccacccccagaccggcuucgccgacauccagggccaccccuucuuccgcaacgucgacugggacaugauggagcagaagcaggucgucccccccuucaagcccaacaucuccggcgaguucggccucgacaacuucgacucccaguucaccaacgagcccguccagcucacccccgacgacgacgacaucguccgcaagaucgaccaguccgaguucgagggcuucgaguacaucaacccccuccucauguccgccgaggagugcgucuga

SEQ ID NO: 48115 - RNA, 1932 nt, Artificial Sequence
  derived and/or modified sequence opt2 from PRKCQ__Homo_sapiens__NP_001229342
augucccccuuccuccgcaucggccucuccaacuucgacugcggcuccugccaguccugccagggcgaggccgucaaccccuacugcgccguccucgucaaggaguacgucgaguccgagaacggccagauguacauccagaagaagcccaccauguacccccccugggacuccaccuucgacgcccacaucaacaagggccgcgucaugcagaucaucgucaagggcaagaacgucgaccucaucuccgagaccaccgucgagcucuacucccucgccgagcgcugccgcaagaacaacggcaagaccgagaucuggcucgagcucaagccccagggccgcaugcucaugaacgcccgcuacuuccucgagauguccgacaccaaggacaugaacgaguucgagaccgagggcuucuucgcccuccaccagcgccgcggcgccaucaagcaggccaagguccaccacgucaagugccacgaguucaccgccaccuucuucccccagcccaccuucugcuccgucugccacgaguucgucuggggccucaacaagcagggcuaccagugccgccagugcaacgccgccauccacaagaagugcaucgacaaggucaucgccaagugcaccggcuccgccaucaacucccgcgagaccauguuccacaaggagcgcuucaagaucgacaugccccaccgcuucaaggucuacaacuacaagucccccaccuucugcgagcacugcggcacccuccucuggggccucgcccgccagggccucaagugcgacgccugcggcaugaacguccaccaccgcugccagaccaaggucgccaaccucugcggcaucaaccagaagcucauggccgaggcccucgccaugaucgaguccacccagcaggcccgcugccuccgcgacaccgagcagaucuuccgcgagggccccgucgagaucggccuccccugcuccaucaagaacgaggcccgcccccccugccuccccacccccggcaagcgcgagccccagggcaucuccugggaguccccccucgacgaggucgacaagaugugccaccuccccgagcccgagcucaacaaggagcgccccucccuccagaucaagcucaagaucgaggacuucauccuccacaagaugcucggcaagggcuccuucggcaaggucuuccucgccgaguucaagaagaccaaccaguucuucgccaucaaggcccucaagaaggacgucguccucauggacgacgacgucgagugcaccauggucgagaagcgcguccucucccucgccugggagcaccccuuccucacccacauguucugcaccuuccagaccaaggagaaccucuucuucgucauggaguaccucaacggcggcgaccucauguaccacauccaguccugccacaaguucgaccucucccgcgccaccuucuacgccgccgagaucauccucggccuccaguuccuccacuccaagggcaucgucuaccgcgaccucaagcucgacaacauccuccucgacaaggacggccacaucaagaucgccgacuucggcaugugcaaggagaacaugcucggcgacgccaagaccaacaccuucugcggcacccccgacuacaucgcccccgagcucuucguccgcgagcccgagaagcgccucggcguccgcggcgacauccgccagcacccccucuuccgcgagaucaacugggaggagcucgagcgcaaggagaucgacccccccuuccgccccaaggucaagucccccuucgacugcuccaacuucgacaaggaguuccucaacgagaagccccgccucuccuucgccgaccgcgcccucaucaacuccauggaccagaacauguuccgcaacuucuccuucaugaaccccggcauggagcgccucaucuccuga

SEQ ID NO: 48116 - RNA, 1587 nt, Artificial Sequence
  derived and/or modified sequence opt2 from PRKCSH__Homo_sapiens__XP_011526433
augcuccucccccuccuccuccuccuccccaugugcugggccgucgaggucaagcgcccccgcggcgucucccucaccaaccaccacuucuacgacgaguccaagcccuucaccugccucgacggcuccgccaccauccccuucgaccaggucaacgacgacuacugcgacugcaaggacggcuccgacgagcccggcaccgccgccugccccaacggcuccuuccacugcaccaacaccggcuacaagccccucuacauccccuccaaccgcgucaacgacggcgucugcgacugcugcgacggcaccgacgaguacaacuccggcgucaucugcgagaacaccugcaaggagaagggccgcaaggagcgcgagucccuccagcagauggccgaggucacccgcgagggcuuccgccucaagaagauccucaucgaggacuggaagaaggcccgcgaggagaagcagaagaagcucaucgagcuccaggccggcaagaagucccucgaggaccaggucgagaugcuccgcaccgucaaggaggaggccgagaagcccgagcgcgaggccaaggagcagcaccagaagcucugggaggagcagcucgccgccgccaaggcccagcaggagcaggagcucgccgccgacgccuucaaggagcucgacgacgacauggacggcaccgucuccgucaccgagcuccagacccaccccgagcucgacaccgacggcgacggcgcccucuccgaggccgaggcccaggcccuccucuccggcgacacccagaccgacgccaccuccuucuacgaccgcgucugggccgccauccgcgacaaguaccgcuccgaggcccuccccaccgaccuccccgcccccuccgcccccgaccucaccgagcccaaggaggagcagccccccguccccuccucccccaccgaggaggaggaggaggaggaggaggaggaggaggaggaggccgaggaggaggaggaggaggaggacuccgaggaggccccccccccccucucccccccccagcccgccucccccgccgaggaggacaagaugccccccuacgacgagcagacccaggccuucaucgacgccgcccaggaggcccgcaacaaguucgaggaggccgagcgcucccucaaggacauggaggaguccauccgcaaccucgagcaggagaucuccuucgacuucggccccaacggcgaguucgccuaccucuacucccagugcuacgagcucaccaccaacgaguacgucuaccgccucugccccuucaagcucgucucccagaagcccaagcucggcggcucccccaccucccucggcaccuggggcuccuggaucggccccgaccacgacaaguucuccgccaugaaguacgagcagggcaccggcugcuggcagggccccaaccgcuccaccaccguccgccuccucugcggcaaggagaccauggucaccuccaccaccgagcccucccgcugcgaguaccucauggagcucaugacccccgccgccugccccgagcccccccccgaggcccccaccgaggacgaccacgacgagcucuga

SEQ ID NO: 48117 - RNA, 1788 nt, Artificial Sequence
  derived and/or modified sequence opt2 from PRKCZ__Homo_sapiens__XP_011540075
augcccucccgcaccggccccaagauggagggcuccggcggccgcguccgccucaaggcccacuacggcggcgacaucuucaucaccuccgucgacgccgccaccaccuucgaggagcucugcgaggagguccgcgacaugugccgccuccaccagcagcacccccucacccucaagugggucgacuccgagggcgaccccugcaccgucuccucccagauggagcucgaggaggccuuccgccucgcccgccagugccgcgacgagggccucaucauccacgucuuccccuccacccccgagcagcccggccuccccugccccggcgaggacaaguccaucuaccgccgcggcgcccgccgcuggcgcaagcucuaccgcgccaacggccaccucuuccaggccaagcgcuucaaccgccgcgccuacugcggccagugcuccgagcgcaucuggggccucgcccgccagggcuaccgcugcaucaacugcaagcuccucguccacaagcgcugccacggccucgucccccucaccugccgcaagcacauggacuccgucaugcccucccaggagccccccgucgacgacaagaacgaggacgccgaccuccccuccgaggagaccgacggcaucgccuacaucuccuccucccgcaagcacgacuccaucaaggacgacuccgaggaccucaagcccgucaucgacggcauggacggcaucaagaucucccagggccucggccuccaggacuucgaccucauccgcgucaucggccgcggcuccuacgccaagguccuccucguccgccucaagaagaacgaccagaucuacgccaugaaggucgucaagaaggagcucguccacgacgacgaggacaucgacuggguccagaccgagaagcacgucuucgagcaggccuccuccaaccccuuccucgucggccuccacuccugcuuccagaccaccucccgccucuuccucgucaucgaguacgucaacggcggcgaccucauguuccacaugcagcgccagcgcaagcuccccgaggagcacgcccgcuucuacgccgccgagaucugcaucgcccucaacuuccuccacgagcgcggcaucaucuaccgcgaccucaagcucgacaacguccuccucgacgccgacggccacaucaagcucaccgacuacggcaugugcaaggagggccucggccccggcgacaccaccuccaccuucugcggcacccccaacuacaucgcccccgagauccuccgcggcgaggaguacggcuucuccgucgacuggugggcccucggcguccucauguucgagaugauggccggccgcucccccuucgacaucaucaccgacaaccccgacaugaacaccgaggacuaccucuuccaggucauccucgagaagcccauccgcaucccccgcuuccucuccgucaaggccucccacguccucaagggcuuccucaacaaggaccccaaggagcgccucggcugccgcccccagaccggcuucuccgacaucaagucccacgccuucuuccgcuccaucgacugggaccucaugcaccgccagcuccgcugcaccgacgcccgcaccaccuggaccccccgccgcugcggccgcaccgacgacauggacgcccagaccauguggaugcacggccgccgccgccacaccgacgacuccuccaccgacgacuccgacgcccgcaccccccgccgccgcggccgcaccgacgacgccgacgcccagaugaccuggacccaccgcuga

SEQ ID NO: 48118 - RNA, 2739 nt, Artificial Sequence
  derived and/or modified sequence opt2 from PRKD1__Homo_sapiens__NP_002733
auguccgccccccccguccuccgcccccccuccccccuccuccccgucgccgccgccgccgccgccgccgccgccgcccucguccccggcuccggccccggccccgcccccuuccucgcccccgucgccgcccccgucggcggcaucuccuuccaccuccagaucggccucucccgcgagcccguccuccuccuccaggacuccuccggcgacuacucccucgcccacguccgcgagauggccugcuccaucgucgaccagaaguuccccgagugcggcuucuacggcauguacgacaagauccuccucuuccgccacgaccccaccuccgagaacauccuccagcucgucaaggccgccuccgacauccaggagggcgaccucaucgaggucguccucuccgccuccgccaccuucgaggacuuccagauccgcccccacgcccucuucguccacuccuaccgcgcccccgccuucugcgaccacugcggcgagaugcucuggggccucguccgccagggccucaagugcgagggcugcggccucaacuaccacaagcgcugcgccuucaagauccccaacaacugcuccggcguccgccgccgccgccucuccaacgucucccucaccggcgucuccaccauccgcaccuccuccgccgagcucuccaccuccgcccccgacgagccccuccuccagaagucccccuccgaguccuucaucggccgcgagaagcgcuccaacucccaguccuacaucggccgccccauccaccucgacaagauccucauguccaaggucaaggucccccacaccuucgucauccacuccuacacccgccccaccgucugccaguacugcaagaagcuccucaagggccucuuccgccagggccuccagugcaaggacugccgcuucaacugccacaagcgcugcgcccccaagguccccaacaacugccucggcgaggucaccaucaacggcgaccuccucucccccggcgccgaguccgacgucgucauggaggagggcuccgacgacaacgacuccgagcgcaacuccggccucauggacgacauggaggaggccaugguccaggacgccgagauggccauggccgagugccagaacgacuccggcgagaugcaggaccccgaccccgaccacgaggacgccaaccgcaccaucucccccuccaccuccaacaacaucccccucaugcgcgucguccaguccgucaagcacaccaagcgcaaguccuccaccgucaugaaggagggcuggaugguccacuacaccuccaaggacacccuccgcaagcgccacuacuggcgccucgacuccaagugcaucacccucuuccagaacgacaccggcucccgcuacuacaaggagaucccccucuccgagauccucucccucgagcccgucaagaccuccgcccucauccccaacggcgccaacccccacugcuucgagaucaccaccgccaacgucgucuacuacgucggcgagaacgucgucaaccccuccucccccucccccaacaacuccguccucaccuccggcgucggcgccgacgucgcccgcaugugggagaucgccauccagcacgcccucaugcccgucauccccaagggcuccuccgucggcaccggcaccaaccuccaccgcgacaucuccgucuccaucuccgucuccaacugccagauccaggagaacgucgacaucuccaccgucuaccagaucuuccccgacgagguccucggcuccggccaguucggcaucgucuacggcggcaagcaccgcaagaccggccgcgacgucgccaucaagaucaucgacaagcuccgcuuccccaccaagcaggagucccagcuccgcaacgaggucgccauccuccagaaccuccaccaccccggcgucgucaaccucgagugcauguucgagacccccgagcgcgucuucgucgucauggagaagcuccacggcgacaugcucgagaugauccucuccuccgagaagggccgccuccccgagcacaucaccaaguuccucaucacccagauccucgucgcccuccgccaccuccacuucaagaacaucguccacugcgaccucaagcccgagaacguccuccucgccuccgccgaccccuucccccaggucaagcucugcgacuucggcuucgcccgcaucaucggcgagaaguccuuccgccgcuccgucgucggcacccccgccuaccucgcccccgagguccuccgcaacaagggcuacaaccgcucccucgacaugugguccgucggcgucaucaucuacgucucccucuccggcaccuuccccuucaacgaggacgaggacauccacgaccagauccagaacgccgccuucauguacccccccaaccccuggaaggagaucucccacgaggccaucgaccucaucaacaaccuccuccaggucaagaugcgcaagcgcuacuccgucgacaagacccucucccaccccuggcuccaggacuaccagaccuggcucgaccuccgcgagcucgagugcaagaucggcgagcgcuacaucacccacgaguccgacgaccuccgcugggagaaguacgccggcgagcagggccuccaguaccccacccaccucaucaaccccuccgccucccacuccgacacccccgagaccgaggagaccgagaugaaggcccucggcgagcgcgucuccauccucuga

SEQ ID NO: 48119 - RNA, 2673 nt, Artificial Sequence
  derived and/or modified sequence opt2 from PRKD3__Homo_sapiens__XP_005264294
auguccgccaacaacuccccccccuccgcccagaaguccguccuccccaccgccauccccgccguccuccccgccgccucccccugcuccucccccaagaccggccucuccgcccgccucuccaacggcuccuucuccgcccccucccucaccaacucccgcggcuccguccacaccgucuccuuccuccuccagaucggccucacccgcgaguccgucaccaucgaggcccaggagcucucccucuccgccgucaaggaccucgucugcuccaucgucuaccagaaguuccccgagugcggcuucuucggcauguacgacaagauccuccucuuccgccacgacaugaacuccgagaacauccuccagcucaucaccuccgccgacgagauccacgagggcgaccucgucgaggucguccucuccgcccucgccaccgucgaggacuuccagauccgcccccacacccucuacguccacuccuacaaggcccccaccuucugcgacuacugcggcgagaugcucuggggccucguccgccagggccucaagugcgagggcugcggccucaacuaccacaagcgcugcgccuucaagauccccaacaacugcuccggcguccgcaagcgccgccucuccaacgucucccuccccggccccggccucuccgucccccgcccccuccagcccgaguacgucgcccuccccuccgaggagucccacguccaccaggagcccuccaagcgcauccccuccugguccggccgccccaucuggauggagaagauggucaugugccgcgucaaggucccccacaccuucgccguccacuccuacacccgccccaccaucugccaguacugcaagcgccuccucaagggccucuuccgccagggcaugcagugcaaggacugcaaguucaacugccacaagcgcugcgccuccaaggucccccgcgacugccucggcgaggucaccuucaacggcgagcccuccucccucggcaccgacaccgacauccccauggacaucgacaacaacgacaucaacuccgacuccucccgcggccucgacgacaccgaggagcccuccccccccgaggacaagauguucuuccucgaccccuccgaccucgacgucgagcgcgacgaggaggccgucaagaccaucucccccuccaccuccaacaacaucccccucaugcgcgucguccaguccaucaagcacaccaagcgcaaguccuccaccauggucaaggagggcuggaugguccacuacaccucccgcgacaaccuccgcaagcgccacuacuggcgccucgacuccaagugccucacccucuuccagaacgaguccggcuccaaguacuacaaggagaucccccucuccgagauccuccgcaucuccuccccccgcgacuucaccaacaucucccagggcuccaacccccacugcuucgagaucaucaccgacaccauggucuacuucgucggcgagaacaacggcgacuccucccacaaccccguccucgccgccaccggcgucggccucgacgucgcccaguccugggagaaggccauccgccaggcccucaugcccgucaccccccaggccuccgucugcaccucccccggccagggcaaggaccacaaggaccucuccaccuccaucuccgucuccaacugccagauccaggagaacgucgacaucuccaccgucuaccagaucuucgccgacgagguccucggcuccggccaguucggcaucgucuacggcggcaagcaccgcaagaccggccgcgacgucgccaucaaggucaucgacaagaugcgcuuccccaccaagcaggagucccagcuccgcaacgaggucgccauccuccagaaccuccaccaccccggcaucgucaaccucgagugcauguucgagacccccgagcgcgucuucgucgucauggagaagcuccacggcgacaugcucgagaugauccucuccuccgagaagucccgccuccccgagcgcaucaccaaguucauggucacccagauccucgucgcccuccgcaaccuccacuucaagaacaucguccacugcgaccucaagcccgagaacguccuccucgccuccgccgagcccuucccccaggucaagcucugcgacuucggcuucgcccgcaucaucggcgagaaguccuuccgccgcuccgucgucggcacccccgccuaccucgcccccgagguccuccgcuccaagggcuacaaccgcucccucgacaugugguccgucggcgucaucaucuacgucucccucuccggcaccuuccccuucaacgaggacgaggacaucaacgaccagauccagaacgccgccuucauguacccccccaaccccuggcgcgagaucuccggcgaggccaucgaccucaucaacaaccuccuccaggucaagaugcgcaagcgcuacuccgucgacaagucccucucccaccccuggcuccaggacuaccagaccuggcucgaccuccgcgaguucgagacccgcaucggcgagcgcuacaucacccacgaguccgacgacgcccgcugggagauccacgccuacacccacaaccucgucuaccccaagcacuucaucauggcccccaaccccgacgacauggaggaggaccccuga

SEQ ID NO: 48120 - RNA, 12294 nt, Artificial Sequence
  derived and/or modified sequence opt2 from PRKDC__Homo_sapiens__NP_001075109
auggccggcuccggcgccggcguccgcugcucccuccuccgccuccaggagacccucuccgccgccgaccgcugcggcgccgcccucgccggccaccagcucauccgcggccucggccaggagugcguccucuccuccucccccgccguccucgcccuccagaccucccucgucuucucccgcgacuucggccuccucgucuucguccgcaagucccucaacuccaucgaguuccgcgagugccgcgaggagauccucaaguuccucugcaucuuccucgagaagaugggccagaagaucgcccccuacuccgucgagaucaagaacaccugcaccuccgucuacaccaaggaccgcgccgccaagugcaagauccccgcccucgaccuccucaucaagcuccuccagaccuuccgcuccucccgccucauggacgaguucaagaucggcgagcucuucuccaaguucuacggcgagcucgcccucaagaagaagauccccgacaccguccucgagaaggucuacgagcuccucggccuccucggcgagguccaccccuccgagaugaucaacaacgccgagaaccucuuccgcgccuuccucggcgagcucaagacccagaugaccuccgccguccgcgagcccaagcuccccguccucgccggcugccucaagggccucuccucccuccucugcaacuucaccaaguccauggaggaggacccccagaccucccgcgagaucuucaacuucguccucaaggccauccgcccccagaucgaccucaagcgcuacgccguccccuccgccggccuccgccucuucgcccuccacgccucccaguucuccaccugccuccucgacaacuacgucucccucuucgagguccuccucaaguggugcgcccacaccaacgucgagcucaagaaggccgcccucuccgcccucgaguccuuccucaagcaggucuccaacauggucgccaagaacgccgagaugcacaagaacaagcuccaguacuucauggagcaguucuacggcaucauccgcaacgucgacuccaacaacaaggagcucuccaucgccauccgcggcuacggccucuucgccggccccugcaaggucaucaacgccaaggacgucgacuucauguacgucgagcucauccagcgcugcaagcagauguuccucacccagaccgacaccggcgacgaccgcgucuaccagaugcccuccuuccuccaguccgucgccuccguccuccucuaccucgacaccguccccgaggucuacacccccguccucgagcaccucgucgucaugcagaucgacuccuucccccaguacucccccaagaugcagcucgucugcugccgcgccaucgucaaggucuuccucgcccucgccgccaagggccccguccuccgcaacugcaucuccaccgucguccaccagggccucauccgcaucugcuccaagcccgucguccuccccaagggccccgaguccgaguccgaggaccaccgcgccuccggcgagguccgcaccggcaaguggaagguccccaccuacaaggacuacgucgaccucuuccgccaccuccucuccuccgaccagaugauggacuccauccucgccgacgaggccuucuucuccgucaacuccuccuccgagucccucaaccaccuccucuacgacgaguucgucaaguccguccucaagaucgucgagaagcucgaccucacccucgagauccagaccgucggcgagcaggagaacggcgacgaggcccccggcgucuggaugauccccaccuccgaccccgccgccaaccuccaccccgccaagcccaaggacuucuccgccuucaucaaccucgucgaguucugccgcgagauccuccccgagaagcaggccgaguucuucgagcccugggucuacuccuucuccuacgagcucauccuccaguccacccgccucccccucaucuccggcuucuacaagcuccucuccaucaccguccgcaacgccaagaagaucaaguacuucgagggcgucucccccaagucccucaagcacucccccgaggaccccgagaaguacuccugcuucgcccucuucgucaaguucggcaaggaggucgccgucaagaugaagcaguacaaggacgagcuccucgccuccugccucaccuuccuccucucccucccccacaacaucaucgagcucgacguccgcgccuacguccccgcccuccagauggccuucaagcucggccucuccuacaccccccucgccgaggucggccucaacgcccucgaggagugguccaucuacaucgaccgccacgucaugcagcccuacuacaaggacauccuccccugccucgacggcuaccucaagaccuccgcccucuccgacgagaccaagaacaacugggaggucuccgcccucucccgcgccgcccagaagggcuucaacaaggucguccucaagcaccucaagaagaccaagaaccucuccuccaacgaggccaucucccucgaggagauccgcauccgcgucguccagaugcucggcucccucggcggccagaucaacaagaaccuccucaccgucaccuccuccgacgagaugaugaaguccuacgucgccugggaccgcgagaagcgccucuccuucgccguccccuuccgcgagaugaagcccgucaucuuccucgacgucuuccucccccgcgucaccgagcucgcccucaccgccuccgaccgccagaccaaggucgccgccugcgagcuccuccacuccauggucauguucaugcucggcaaggccacccagaugcccgagggcggccagggcgccccccccauguaccagcucuacaagcgcaccuuccccguccuccuccgccucgccugcgacgucgaccaggucacccgccagcucuacgagccccucgucaugcagcucauccacugguucaccaacaacaagaaguucgagucccaggacaccgucgcccuccucgaggccauccucgacggcaucgucgaccccgucgacuccacccuccgcgacuucugcggccgcugcauccgcgaguuccucaagugguccaucaagcagaucaccccccagcagcaggagaagucccccgucaacaccaagucccucuucaagcgccucuacucccucgcccuccaccccaacgccuucaagcgccucggcgccucccucgccuucaacaacaucuaccgcgaguuccgcgaggaggagucccucgucgagcaguucgucuucgaggcccucgucaucuacauggagucccucgcccucgcccacgccgacgagaagucccucggcaccauccagcagugcugcgacgccaucgaccaccucugccgcaucaucgagaagaagcacgucucccucaacaaggccaagaagcgccgccucccccgcggcuucccccccuccgccucccucugccuccucgaccucgucaaguggcuccucgcccacugcggccgcccccagaccgagugccgccacaaguccaucgagcucuucuacaaguucgucccccuccuccccggcaaccgcucccccaaccucuggcucaaggacguccucaaggaggagggcgucuccuuccucaucaacaccuucgagggcggcggcugcggccagcccuccggcauccucgcccagcccacccuccucuaccuccgcggccccuucucccuccaggccacccucugcuggcucgaccuccuccucgccgcccucgagugcuacaacaccuucaucggcgagcgcaccgucggcgcccuccagguccucggcaccgaggcccaguccucccuccucaaggccgucgccuucuuccucgaguccaucgccaugcacgacaucaucgccgccgagaagugcuucggcaccggcgccgccggcaaccgcaccuccccccaggagggcgagcgcuacaacuacuccaagugcaccgucgucguccgcaucauggaguucaccaccacccuccucaacaccucccccgagggcuggaagcuccucaagaaggaccucugcaacacccaccucaugcgcguccucguccagacccucugcgagcccgccuccaucggcuucaacaucggcgacguccaggucauggcccaccuccccgacgucugcgucaaccucaugaaggcccucaagaugucccccuacaaggacauccucgagacccaccuccgcgagaagaucaccgcccaguccaucgaggagcucugcgccgucaaccucuacggccccgacgcccaggucgaccgcucccgccucgccgccgucgucuccgccugcaagcagcuccaccgcgccggccuccuccacaacauccuccccucccaguccaccgaccuccaccacuccgucggcaccgagcuccucucccucgucuacaagggcaucgcccccggcgacgagcgccagugccuccccucccucgaccucuccugcaagcagcucgccuccggccuccucgagcucgccuucgccuucggcggccucugcgagcgccucgucucccuccuccucaaccccgccguccucuccaccgccucccucggcuccucccagggcuccgucauccacuucucccacggcgaguacuucuacucccucuucuccgagaccaucaacaccgagcuccucaagaaccucgaccucgccguccucgagcucaugcaguccuccgucgacaacaccaagauggucuccgccguccucaacggcaugcucgaccaguccuuccgcgagcgcgccaaccagaagcaccagggccucaagcucgccaccaccauccuccagcacuggaagaagugcgacuccuggugggccaaggacuccccccucgagaccaagauggccguccucgcccuccucgccaagauccuccagaucgacuccuccgucuccuucaacaccucccacggcuccuuccccgaggucuucaccaccuacaucucccuccucgccgacaccaagcucgaccuccaccucaagggccaggccgucacccuccuccccuucuucaccucccucaccggcggcucccucgaggagcuccgccgcguccucgagcagcucaucgucgcccacuuccccaugcagucccgcgaguucccccccggcaccccccgcuucaacaacuacgucgacugcaugaagaaguuccucgacgcccucgagcucucccagucccccaugcuccucgagcucaugaccgagguccucugccgcgagcagcagcacgucauggaggagcucuuccaguccuccuuccgccgcaucgcccgccgcggcuccugcgucacccaggucggccuccucgaguccgucuacgagauguuccgcaaggacgacccccgccucuccuucacccgccaguccuucgucgaccgcucccuccucacccuccucuggcacugcucccucgacgcccuccgcgaguucuucuccaccaucgucgucgacgccaucgacguccucaagucccgcuucaccaagcucaacgaguccaccuucgacacccagaucaccaagaagaugggcuacuacaagauccucgacgucauguacucccgccuccccaaggacgacguccacgccaaggaguccaagaucaaccaggucuuccacggcuccugcaucaccgagggcaacgagcucaccaagacccucaucaagcucugcuacgacgccuucaccgagaacauggccggcgagaaccagcuccucgagcgccgccgccucuaccacugcgccgccuacaacugcgccaucuccgucaucugcugcgucuucaacgagcucaaguucuaccagggcuuccucuucuccgagaagcccgagaagaaccuccucaucuucgagaaccucaucgaccucaagcgccgcuacaacuuccccgucgaggucgagguccccauggagcgcaagaagaaguacaucgagauccgcaaggaggcccgcgaggccgccaacggcgacuccgacggccccuccuacauguccucccucuccuaccucgccgacuccacccucuccgaggagaugucccaguucgacuucuccaccggcguccaguccuacuccuacuccucccaggacccccgccccgccaccggccgcuuccgccgccgcgagcagcgcgaccccaccguccacgacgacguccucgagcucgagauggacgagcucaaccgccacgagugcauggccccccucaccgcccucgucaagcacaugcaccgcucccucggccccccccagggcgaggaggacuccgucccccgcgaccuccccuccuggaugaaguuccuccacggcaagcucggcaaccccaucgucccccucaacauccgccucuuccucgccaagcucgucaucaacaccgaggaggucuuccgccccuacgccaagcacuggcucuccccccuccuccagcucgccgccuccgagaacaacggcggcgagggcauccacuacauggucgucgagaucgucgccaccauccucuccuggaccggccucgccacccccaccggcguccccaaggacgagguccucgccaaccgccuccucaacuuccucaugaagcacgucuuccaccccaagcgcgccgucuuccgccacaaccucgagaucaucaagacccucgucgagugcuggaaggacugccucuccauccccuaccgccucaucuucgagaaguucuccggcaaggaccccaacuccaaggacaacuccgucggcauccagcuccucggcaucgucauggccaacgaccucccccccuacgacccccagugcggcauccaguccuccgaguacuuccaggcccucgucaacaacauguccuucguccgcuacaaggaggucuacgccgccgccgccgagguccucggccucauccuccgcuacgucauggagcgcaagaacauccucgaggagucccucugcgagcucgucgccaagcagcucaagcagcaccagaacaccauggaggacaaguucaucgucugccucaacaaggucaccaaguccuuccccccccucgccgaccgcuucaugaacgccgucuucuuccuccuccccaaguuccacggcguccucaagacccucugccucgaggucguccucugccgcgucgagggcaugaccgagcucuacuuccagcucaaguccaaggacuucguccaggucaugcgccaccgcgacgacgagcgccagaaggucugccucgacaucaucuacaagaugaugcccaagcucaagcccgucgagcuccgcgagcuccucaaccccgucgucgaguucgucucccaccccuccaccaccugccgcgagcagauguacaacauccucauguggauccacgacaacuaccgcgaccccgaguccgagaccgacaacgacucccaggagaucuucaagcucgccaaggacguccucauccagggccucaucgacgagaaccccggccuccagcucaucauccgcaacuucuggucccacgagacccgccuccccuccaacacccucgaccgccuccucgcccucaacucccucuacucccccaagaucgagguccacuuccucucccucgccaccaacuuccuccucgagaugaccuccaugucccccgacuaccccaaccccauguucgagcacccccucuccgagugcgaguuccaggaguacaccaucgacuccgacuggcgcuuccgcuccaccguccucacccccauguucgucgagacccaggccucccagggcacccuccagacccgcacccaggagggcucccucuccgcccgcuggcccgucgccggccagauccgcgccacccagcagcagcacgacuucacccucacccagaccgccgacggccgcuccuccuucgacuggcucaccggcuccuccaccgacccccucgucgaccacaccucccccuccuccgacucccuccucuucgcccacaagcgcuccgagcgccuccagcgcgccccccucaaguccgucggccccgacuucggcaagaagcgccucggccuccccggcgacgaggucgacaacaaggucaagggcgccgccggccgcaccgaccuccuccgccuccgccgccgcuucaugcgcgaccaggagaagcucucccucauguacgcccgcaagggcgucgccgagcagaagcgcgagaaggagaucaaguccgagcucaagaugaagcaggacgcccaggucguccucuaccgcuccuaccgccacggcgaccuccccgacauccagaucaagcacuccucccucaucaccccccuccaggccgucgcccagcgcgaccccaucaucgccaagcagcucuucuccucccucuucuccggcauccucaaggagauggacaaguucaagacccucuccgagaagaacaacaucacccagaagcuccuccaggacuucaaccgcuuccucaacaccaccuucuccuucuucccccccuucgucuccugcauccaggacaucuccugccagcacgccgcccuccucucccucgaccccgccgccgucuccgccggcugccucgccucccuccagcagcccgucggcauccgccuccucgaggaggcccuccuccgccuccuccccgccgagcuccccgccaagcgcguccgcggcaaggcccgccucccccccgacguccuccgcugggucgagcucgccaagcucuaccgcuccaucggcgaguacgacguccuccgcggcaucuucaccuccgagaucggcaccaagcagaucacccaguccgcccuccucgccgaggcccgcuccgacuacuccgaggccgccaagcaguacgacgaggcccucaacaagcaggacugggucgacggcgagcccaccgaggccgagaaggacuucugggagcucgccucccucgacugcuacaaccaccucgccgaguggaagucccucgaguacugcuccaccgccuccaucgacuccgagaacccccccgaccucaacaagaucugguccgagcccuucuaccaggagaccuaccuccccuacaugauccgcuccaagcucaagcuccuccuccagggcgaggccgaccagucccuccucaccuucaucgacaaggccaugcacggcgagcuccagaaggccauccucgagcuccacuacucccaggagcucucccuccucuaccuccuccaggacgacgucgaccgcgccaaguacuacauccagaacggcauccaguccuucaugcagaacuacuccuccaucgacguccuccuccaccagucccgccucaccaagcuccaguccguccaggcccucaccgagauccaggaguucaucuccuucaucuccaagcagggcaaccucuccucccaggucccccucaagcgccuccucaacaccuggaccaaccgcuaccccgacgccaagauggaccccaugaacaucugggacgacaucaucaccaaccgcugcuucuuccucuccaagaucgaggagaagcucaccccccuccccgaggacaacuccaugaacgucgaccaggacggcgaccccuccgaccgcauggagguccaggagcaggaggaggacaucuccucccucauccgcuccugcaaguucuccaugaagaugaagaugaucgacuccgcccgcaagcagaacaacuucucccucgccaugaagcuccucaaggagcuccacaaggaguccaagacccgcgacgacuggcucgucuccuggguccaguccuacugccgccucucccacugccgcucccgcucccagggcugcuccgagcagguccucaccguccucaagaccgucucccuccucgacgagaacaacgucuccuccuaccucuccaagaacauccucgccuuccgcgaccagaacauccuccucggcaccaccuaccgcaucaucgccaacgcccucuccuccgagcccgccugccucgccgagaucgaggaggacaaggcccgccgcauccucgagcucuccggcuccuccuccgaggacuccgagaaggucaucgccggccucuaccagcgcgccuuccagcaccucuccgaggccguccaggccgccgaggaggaggcccagccccccuccugguccugcggccccgccgccggcgucaucgacgccuacaugacccucgccgacuucugcgaccagcagcuccgcaaggaggaggagaacgccuccgucaucgacuccgccgagcuccaggccuaccccgcccucgucgucgagaagaugcucaaggcccucaagcucaacuccaacgaggcccgccucaaguucccccgccuccuccagaucaucgagcgcuaccccgaggagacccucucccucaugaccaaggagaucuccuccguccccugcuggcaguucaucuccuggaucucccacauggucgcccuccucgacaaggaccaggccgucgccguccagcacuccgucgaggagaucaccgacaacuacccccaggccaucgucuaccccuucaucaucuccuccgaguccuacuccuucaaggacaccuccaccggccacaagaacaaggaguucgucgcccgcaucaaguccaagcucgaccagggcggcgucauccaggacuucaucaacgcccucgaccagcucuccaaccccgagcuccucuucaaggacugguccaacgacguccgcgccgagcucgccaagacccccgucaacaagaagaacaucgagaagauguacgagcgcauguacgccgcccucggcgaccccaaggcccccggccucggcgccuuccgccgcaaguucauccagaccuucggcaaggaguucgacaagcacuucggcaagggcggcuccaagcuccuccgcaugaagcucuccgacuucaacgacaucaccaacaugcuccuccucaagaugaacaaggacuccaagccccccggcaaccucaaggagugcucccccuggauguccgacuucaaggucgaguuccuccgcaacgagcucgagauccccggccaguacgacggccgcggcaagccccuccccgaguaccacguccgcaucgccggcuucgacgagcgcgucaccgucauggccucccuccgccgccccaagcgcaucaucauccgcggccacgacgagcgcgagcaccccuuccucgucaagggcggcgaggaccuccgccaggaccagcgcgucgagcagcucuuccaggucaugaacggcauccucgcccaggacuccgccugcucccagcgcgcccuccagcuccgcaccuacuccgucguccccaugaccuccuccgacccccgcgccccccccugcgaguacaaggacuggcucaccaagauguccggcaagcacgacgucggcgccuacaugcucauguacaagggcgccaaccgcaccgagaccgucaccuccuuccgcaagcgcgaguccaagguccccgccgaccuccucaagcgcgccuucguccgcauguccaccucccccgaggccuuccucgcccuccgcucccacuucgccuccucccacgcccucaucugcaucucccacuggauccucggcaucggcgaccgccaccucaacaacuucauggucgccauggagaccggcggcgucaucggcaucgacuucggccacgccuucggcuccgccacccaguuccuccccguccccgagcucaugcccuuccgccucacccgccaguucaucaaccucaugcuccccaugaaggagaccggccucauguacuccaucaugguccacgcccuccgcgccuuccgcuccgaccccggccuccucaccaacaccauggacgucuucgucaaggagcccuccuucgacuggaagaacuucgagcagaagaugcucaagaagggcggcuccuggauccaggagaucaacgucgccgagaagaacugguacccccgccagaagaucugcuacgccaagcgcaagcucgccggcgccaaccccgccgucaucaccugcgacgagcuccuccucggccacgagaaggcccccgccuuccgcgacuacgucgccgucgcccgcggcuccaaggaccacaacauccgcgcccaggagcccgaguccggccucuccgaggagacccaggucaagugccucauggaccaggccaccgaccccaacauccucggccgcaccugggagggcugggagcccuggauguga

SEQ ID NO: 48121 - RNA, 2016 nt, Artificial Sequence
  derived and/or modified sequence opt2 from PRKG1__Homo_sapiens__NP_001091982
auguccgagcucgaggaggacuucgccaagauccucaugcucaaggaggagcgcaucaaggagcucgagaagcgccucuccgagaaggaggaggagauccaggagcucaagcgcaagcuccacaagugccaguccguccuccccguccccuccacccacaucggcccccgcaccacccgcgcccagggcaucuccgccgagccccagaccuaccgcuccuuccacgaccuccgccaggccuuccgcaaguucaccaaguccgagcgcuccaaggaccucaucaaggaggccauccucgacaacgacuucaugaagaaccucgagcucucccagauccaggagaucgucgacugcauguaccccgucgaguacggcaaggacuccugcaucaucaaggagggcgacgucggcucccucgucuacgucauggaggacggcaaggucgaggucaccaaggagggcgucaagcucugcaccaugggccccggcaaggucuucggcgagcucgccauccucuacaacugcacccgcaccgccaccgucaagacccucgucaacgucaagcucugggccaucgaccgccagugcuuccagaccaucaugaugcgcaccggccucaucaagcacaccgaguacauggaguuccucaaguccguccccaccuuccagucccuccccgaggagauccucuccaagcucgccgacguccucgaggagacccacuacgagaacggcgaguacaucauccgccagggcgcccgcggcgacaccuucuucaucaucuccaagggcaccgucaacgucacccgcgaggacucccccuccgaggaccccgucuuccuccgcacccucggcaagggcgacugguucggcgagaaggcccuccagggcgaggacguccgcaccgccaacgucaucgccgccgaggccgucaccugccucgucaucgaccgcgacuccuucaagcaccucaucggcggccucgacgacgucuccaacaaggccuacgaggacgccgaggccaaggccaaguacgaggccgaggccgccuucuucgccaaccucaagcucuccgacuucaacaucaucgacacccucggcgucggcggcuucggccgcgucgagcucguccagcucaaguccgaggaguccaagaccuucgccaugaagauccucaagaagcgccacaucgucgacacccgccagcaggagcacauccgcuccgagaagcagaucaugcagggcgcccacuccgacuucaucguccgccucuaccgcaccuucaaggacuccaaguaccucuacaugcucauggaggccugccucggcggcgagcucuggaccauccuccgcgaccgcggcuccuucgaggacuccaccacccgcuucuacaccgccugcgucgucgaggccuucgccuaccuccacuccaagggcaucaucuaccgcgaccucaagcccgagaaccucauccucgaccaccgcggcuacgccaagcucgucgacuucggcuucgccaagaagaucggcuucggcaagaagaccuggaccuucugcggcacccccgaguacgucgcccccgagaucauccucaacaagggccacgacaucuccgccgacuacuggucccucggcauccucauguacgagcuccucaccggcuccccccccuucuccggccccgaccccaugaagaccuacaacaucauccuccgcggcaucgacaugaucgaguuccccaagaagaucgccaagaacgccgccaaccucaucaagaagcucugccgcgacaaccccuccgagcgccucggcaaccucaagaacggcgucaaggacauccagaagcacaagugguucgagggcuucaacugggagggccuccgcaagggcacccucaccccccccaucauccccuccgucgccucccccaccgacaccuccaacuucgacuccuuccccgaggacaacgacgagcccccccccgacgacaacuccggcugggacaucgacuucuga

SEQ ID NO: 48122 - RNA, 1029 nt, Artificial Sequence
  derived and/or modified sequence opt2 from PRKG2__Homo_sapiens__NP_001269410
auguccaacuggaagcucuccaaggcccucucccucgagaugauccagcucaaggagaaggucgcccgcuucuccuccuccucccccuuccagaaccucgagaucaucgccacccucggcgucggcggcuucggccgcgucgagcucgucaaggucaagaacgagaacgucgccuucgccaugaagugcauccgcaagaagcacaucgucgacaccaagcagcaggagcacgucuacuccgagaagcgcauccucgaggagcucugcucccccuucaucgucaagcucuaccgcaccuucaaggacaacaaguacgucuacaugcuccucgaggccugccucggcggcgagcucugguccauccuccgcgaccgcggcuccuucgacgagcccaccuccaaguucugcgucgccugcgucaccgaggccuucgacuaccuccaccgccucggcaucaucuaccgcgaccucaagcccgagaaccucauccucgacgccgagggcuaccucaagcucgucgacuucggcuucgccaagaagaucggcuccggccagaagaccuggaccuucugcggcacccccgaguacgucgcccccgaggucauccucaacaagggccacgacuucuccgucgacuucuggucccucggcauccucgucuacgagcuccucaccggcaacccccccuucuccggcgucgaccagaugaugaccuacaaccucauccucaagggcaucgagaagauggacuucccccgcaagaucacccgccgccccgaggaccucauccgccgccucugccgccagaaccccaccgagcgccucggcaaccucaagaacggcaucaacgacaucaagaagcaccgcuggcucaacggcuucaacugggagggccucaaggcccgcucccuccccuccccccuccagcgcgagcucaagggccccaucgaccacuccuacuucgacaaguacccccccgagaagggcaugccccccgacgagcucuccggcugggacaaggacuucuga

SEQ ID NO: 48123 - RNA, 909 nt, Artificial Sequence
  derived and/or modified sequence opt2 from PRKRA__Homo_sapiens__NP_001132989
augcaguccacccccuucugcggcuucugcucccucggcaagaugaucaccgccaagcccggcaagacccccauccagguccuccacgaguacggcaugaagaccaagaacauccccgucuacgagugcgagcgcuccgacguccagauccacguccccaccuucaccuuccgcgucaccgucggcgacaucaccugcaccggcgagggcaccuccaagaagcucgccaagcaccgcgccgccgaggccgccaucaacauccucaaggccaacgccuccaucugcuucgccguccccgacccccucaugcccgaccccuccaagcagcccaagaaccagcucaaccccaucggcucccuccaggagcucgccauccaccacggcuggcgccuccccgaguacacccucucccaggagggcggccccgcccacaagcgcgaguacaccaccaucugccgccucgaguccuucauggagaccggcaagggcgccuccaagaagcaggccaagcgcaacgccgccgagaaguuccucgccaaguucuccaacaucucccccgagaaccacaucucccucaccaacgucgucggccacucccucggcugcaccuggcacucccuccgcaacucccccggcgagaagaucaaccuccucaagcgcucccuccucuccauccccaacaccgacuacauccagcuccucuccgagaucgccaaggagcagggcuucaacaucaccuaccucgacaucgacgagcucuccgccaacggccaguaccagugccucgccgagcucuccaccucccccaucaccgucugccacggcuccggcaucuccugcggcaacgcccaguccgacgccgcccacaacgcccuccaguaccucaagaucaucgccgagcgcaaguga

SEQ ID NO: 48124 - RNA, 2286 nt, Artificial Sequence
  derived and/or modified sequence opt2 from PRKRIR__Homo_sapiens__NP_004696
augcccaacuucugcgccgcccccaacugcacccgcaaguccacccaguccgaccucgccuucuuccgcuucccccgcgaccccgcccgcugccagaagugggucgagaacugccgccgcgccgaccucgaggacaagacccccgaccagcucaacaagcacuaccgccucugcgccaagcacuucgagaccuccaugaucugccgcaccucccccuaccgcaccguccuccgcgacaacgccauccccaccaucuucgaccucaccucccaccucaacaacccccacucccgccaccgcaagcgcaucaaggagcucuccgaggacgagauccgcacccucaagcagaagaagaucgacgagaccuccgagcaggagcagaagcacaaggagaccaacaacuccaacgcccagaaccccuccgaggaggagggcgagggccaggacgaggacauccucccccucacccucgaggagaaggagaacaaggaguaccucaagucccucuucgagauccucauccucaugggcaagcagaacaucccccucgacggccacgaggccgacgagauccccgagggccucuucacccccgacaacuuccaggcccuccucgagugccgcaucaacuccggcgaggagguccuccgcaagcgcuucgagaccaccgccgucaacacccucuucugcuccaagacccagcagcgccagaugcucgagaucugcgaguccugcauccgcgaggagacccuccgcgagguccgcgacucccacuucuucuccaucaucaccgacgacgucgucgacaucgccggcgaggagcaccuccccguccucguccgcuucgucgacgagucccacaaccuccgcgaggaguucaucggcuuccuccccuacgaggccgacgccgagauccucgccgucaaguuccacaccaugaucaccgagaaguggggccucaacauggaguacugccgcggccaggccuacaucgucuccuccggcuucuccuccaagaugaaggucgucgccucccgccuccucgagaaguacccccaggccaucuacacccucugcuccuccugcgcccucaacauguggcucgccaaguccguccccgucaugggcgucuccgucgcccucggcaccaucgaggaggucugcuccuucuuccaccgcuccccccagcuccuccucgagcucgacaacgucaucuccguccucuuccagaacuccaaggagcgcggcaaggagcucaaggagaucugccacucccaguggaccggccgccacgacgccuucgagauccucgucgagcuccuccaggcccucguccucugccucgacggcaucaacuccgacaccaacauccgcuggaacaacuacaucgccggccgcgccuucguccucugcuccgccgucuccgacuucgacuucaucgucaccaucgucguccucaagaacguccucuccuucacccgcgccuucggcaagaaccuccagggccagaccuccgacgucuucuucgccgccggcucccucaccgccguccuccacucccucaacgaggucauggagaacaucgaggucuaccacgaguucugguucgaggaggccaccaaccucgccaccaagcucgacauccagaugaagcuccccggcaaguuccgccgcgcccaccagggcaaccucgagucccagcucaccuccgaguccuacuacaaggagacccucuccguccccaccgucgagcacaucauccaggagcucaaggacaucuucuccgagcagcaccucaaggcccucaagugccucucccucguccccuccgucaugggccagcucaaguucaacaccuccgaggagcaccacgccgacauguaccgcuccgaccuccccaaccccgacacccucuccgccgagcuccacugcuggcgcaucaaguggaagcaccgcggcaaggacaucgagcuccccuccaccaucuacgaggcccuccaccuccccgacaucaaguucuuccccaacgucuacgcccuccucaagguccucugcauccuccccgucaugaaggucgagaacgagcgcuacgagaacggccgcaagcgccucaaggccuaccuccgcaacacccucaccgaccagcgcuccuccaaccucgcccuccucaacaucaacuucgacaucaagcacgaccucgaccucauggucgacaccuacaucaagcucuacaccuccaaguccgagcuccccaccgacaacuccgagaccgucgagaacaccuga

SEQ ID NO: 48125 - RNA, 1077 nt, Artificial Sequence
  derived and/or modified sequence opt2 from PRKX__Homo_sapiens__NP_005035
auggaggcccccggccucgcccaggccgccgccgccgaguccgacucccgcaaggucgccgaggagacccccgacggcgcccccgcccucugccccucccccgaggcccucucccccgagccccccgucuacucccuccaggacuucgacacccucgccaccgucggcaccggcaccuucggccgcguccaccucgucaaggagaagaccgccaagcacuucuucgcccucaaggucauguccauccccgacgucauccgccucaagcaggagcagcacguccacaacgagaaguccguccucaaggaggucucccaccccuuccucauccgccucuucuggaccuggcacgacgagcgcuuccucuacaugcucauggaguacguccccggcggcgagcucuucuccuaccuccgcaaccgcggccgcuucuccuccaccaccggccucuucuacuccgccgagaucaucugcgccaucgaguaccuccacuccaaggagaucgucuaccgcgaccucaagcccgagaacauccuccucgaccgcgacggccacaucaagcucaccgacuucggcuucgccaagaagcucgucgaccgcaccuggacccucugcggcacccccgaguaccucgcccccgaggucauccaguccaagggccacggccgcgccgucgacuggugggcccucggcauccucaucuucgagaugcucuccggcuucccccccuucuucgacgacaaccccuucggcaucuaccagaagauccucgccggcaagaucgacuucccccgccaccucgacuuccacgucaaggaccucaucaagaagcuccucgucgucgaccgcacccgccgccucggcaacaugaagaacggcgccaacgacgucaagcaccaccgcugguuccgcuccgucgacugggaggccgucccccagcgcaagcucaagccccccaucguccccaagaucgccggcgacggcgacaccuccaacuucgagaccuaccccgagaacgacugggacaccgccgcccccgucccccagaaggaccucgagaucuucaagaacuucuga

SEQ ID NO: 48126 - RNA, 264 nt, Artificial Sequence
  derived and/or modified sequence opt2 from PRLH__Homo_sapiens__NP_056977
augaagguccuccgcgccuggcuccucugccuccucaugcucggccucgcccuccgcggcgccgccucccgcacccaccgccacuccauggagauccgcacccccgacaucaaccccgccugguacgccucccgcggcauccgccccgucggccgcuucggccgccgccgcgccacccucggcgacguccccaagcccggccuccgcccccgccucaccugcuucccccucgagggcggcgccauguccucccaggacggcuga

SEQ ID NO: 48127 - RNA, 684 nt, Artificial Sequence
  derived and/or modified sequence opt2 from PRL__Homo_sapiens__NP_000939
augaacaucaagggcucccccuggaagggcucccuccuccuccuccucgucuccaaccuccuccucugccaguccgucgccccccuccccaucugccccggcggcgccgcccgcugccaggucacccuccgcgaccucuucgaccgcgccgucguccucucccacuacauccacaaccucuccuccgagauguucuccgaguucgacaagcgcuacacccacggccgcggcuucaucaccaaggccaucaacuccugccacaccuccucccucgccacccccgaggacaaggagcaggcccagcagaugaaccagaaggacuuccucucccucaucgucuccauccuccgcuccuggaacgagccccucuaccaccucgucaccgagguccgcggcaugcaggaggcccccgaggccauccucuccaaggccgucgagaucgaggagcagaccaagcgccuccucgagggcauggagcucaucgucucccagguccaccccgagaccaaggagaacgagaucuaccccgucugguccggccuccccucccuccagauggccgacgaggagucccgccucuccgccuacuacaaccuccuccacugccuccgccgcgacucccacaagaucgacaacuaccucaagcuccucaagugccgcaucauccacaacaacaacugcuga

SEQ ID NO: 48128 - RNA, 1113 nt, Artificial Sequence
  derived and/or modified sequence opt2 from PRLHR__Homo_sapiens__NP_004239
auggccuccuccaccacccgcggcccccgcgucuccgaccucuucuccggccucccccccgccgucaccacccccgccaaccaguccgccgaggccuccgccggcaacggcuccgucgccggcgccgacgcccccgccgucacccccuuccagucccuccagcucguccaccagcucaagggccucaucguccuccucuacuccgucgucgucgucgucggccucgucggcaacugccuccucguccucgucaucgcccgcguccgccgccuccacaacgucaccaacuuccucaucggcaaccucgcccucuccgacguccucaugugcaccgccugcgucccccucacccucgccuacgccuucgagccccgcggcugggucuucggcggcggccucugccaccucgucuucuuccuccagcccgucaccgucuacgucuccgucuucacccucaccaccaucgccgucgaccgcuacgucguccucguccacccccuccgccgccgcaucucccuccgccucuccgccuacgccguccucgccaucugggcccucuccgccguccucgcccuccccgccgccguccacaccuaccacgucgagcucaagccccacgacguccgccucugcgaggaguucuggggcucccaggagcgccagcgccagcucuacgccuggggccuccuccucgucaccuaccuccucccccuccucgucauccuccucuccuacguccgcgucuccgucaagcuccgcaaccgcgucguccccggcugcgucacccagucccaggccgacugggaccgcgcccgccgccgccgcaccuucugccuccucgucgucgucgucgucgucuucgccgucugcuggcucccccuccacgucuucaaccuccuccgcgaccucgacccccacgccaucgaccccuacgccuucggccucguccagcuccucugccacuggcucgccauguccuccgccugcuacaaccccuucaucuacgccuggcuccacgacuccuuccgcgaggagcuccgcaagcuccucgucgccuggccccgcaagaucgccccccacggccagaacaugaccgucuccgucgucaucuga

SEQ ID NO: 48129 - RNA, 1566 nt, Artificial Sequence
  derived and/or modified sequence opt2 from PRLR__Homo_sapiens__NP_001191243
augaaggagaacgucgccuccgccaccgucuucacccuccuccucuuccucaacaccugccuccucaacguccagcccgaccccccccucgagcucgccgucgaggucaagcagcccgaggaccgcaagcccuaccucuggaucaagugguccccccccacccucaucgaccucaagaccggcugguucacccuccucuacgagauccgccucaagcccgagaaggccgccgagugggagauccacuucgccggccagcagaccgaguucaagauccucucccuccaccccggccagaaguaccucguccagguccgcugcaagcccgaccacggcuacugguccgccuggucccccgccaccuucauccagauccccuccgacuucaccaugaacgacaccaccgucuggaucuccgucgccguccucuccgccgucaucugccucaucaucgucugggccgucgcccucaagggcuacuccauggucaccugcaucuucccccccguccccggccccaagaucaagggcuucgacgcccaccuccucgagaagggcaaguccgaggagcuccucuccgcccucggcugccaggacuucccccccaccuccgacuacgaggaccuccucgucgaguaccucgaggucgacgacuccgaggaccagcaccucauguccguccacuccaaggagcaccccucccagggcaugaagcccaccuaccucgaccccgacaccgacuccggccgcggcuccugcgacucccccucccuccucuccgagaagugcgaggagccccaggccaaccccuccaccuucuacgaccccgaggucaucgagaagcccgagaaccccgagaccacccacaccugggacccccagugcaucuccauggagggcaagauccccuacuuccacgccggcggcuccaagugcuccaccuggccccucccccagcccucccagcacaacccccgcuccuccuaccacaacaucaccgacgucugcgagcucgccgucggccccgccggcgcccccgccacccuccucaacgaggccggcaaggacgcccucaaguccucccagaccaucaagucccgcgaggagggcaaggccacccagcagcgcgaggucgaguccuuccacuccgagaccgaccaggacacccccuggcuccucccccaggagaagacccccuucggcuccgccaagccccucgacuacgucgagauccacaaggucaacaaggacggcgcccucucccuccuccccaagcagcgcgagaacuccggcaagcccaagaagcccggcacccccgagaacaacaaggaguacgccaaggucuccggcgucauggacaacaacauccucguccucguccccgacccccacgccaagaacgucgccugcuucgaggaguccgccaaggaggccccccccucccucgagcagaaccaggccgagaaggcccucgccaacuucaccgccaccuccuccaagugccgccuccagcucggcggccucgacuaccucgaccccgccugcuucacccacuccuuccacuga

SEQ ID NO: 48130 - RNA, 156 nt, Artificial Sequence
  derived and/or modified sequence opt2 from PRM1__Homo_sapiens__NP_002752
auggcccgcuaccgcugcugccgcucccagucccgcucccgcuacuaccgccagcgccagcgcucccgccgccgccgccgccgcuccugccagacccgccgccgcgccaugcgcugcugccgcccccgcuaccgcccccgcugccgccgccacuga

SEQ ID NO: 48131 - RNA, 423 nt, Artificial Sequence
  derived and/or modified sequence opt2 from PRM2__Homo_sapiens__NP_001273285
augguccgcuaccgcguccgcucccucuccgagcgcucccacgaggucuaccgccagcagcuccacggccaggagcagggccaccacggccaggaggagcagggccucucccccgagcacgucgaggucuacgagcgcacccacggccagucccacuaccgccgccgccacugcucccgccgccgccuccaccgcauccaccgccgccagcaccgcuccugccgccgccgcaagcgccgcuccugccgccaccgccgccgccaccgccgcgagucccucggcgacccccucaaccagaacuuccucucccagaaggccgccgagcccggccgcgagcacgccgagggcaccaagcuccccggcccccucacccccuccuggaagcuccgcaagucccgccccaagcaccagguccgccccuga

SEQ ID NO: 48132 - RNA, 312 nt, Artificial Sequence
  derived and/or modified sequence opt2 from PRM3__Homo_sapiens__NP_067070
augggcucccgcugcgccaagcucaacaccggccagucccccggccacucccccggccacuccaccggccacggccgcggccacgaguccuccaugaagaagcucauggccugcgucucccaggacaacuucucccucuccuccgccggcgaggaggaggaggaggaggaggaggagggcgaggaggaggagaaggaggagcuccccguccagggcaagcuccuccuccucgagcccgagcgccaggaggagggccacaaggacaacgccgaggcccagcagucccccgagcccaagcgcacccccuccuga

SEQ ID NO: 48133 - RNA, 1116 nt, Artificial Sequence
  derived and/or modified sequence opt2 from PRMT1__Homo_sapiens__NP_001527
auggccgccgccgaggccgccaacugcaucauggagaacuucgucgccacccucgccaacggcaugucccuccagcccccccucgaggaggucuccugcggccaggccgaguccuccgagaagcccaacgccgaggacaugaccuccaaggacuacuacuucgacuccuacgcccacuucggcauccacgaggagaugcucaaggacgagguccgcacccucaccuaccgcaacuccauguuccacaaccgccaccucuucaaggacaaggucguccucgacgucggcuccggcaccggcauccucugcauguucgccgccaaggccggcgcccgcaaggucaucggcaucgagugcuccuccaucuccgacuacgccgucaagaucgucaaggccaacaagcucgaccacgucgucaccaucaucaagggcaaggucgaggaggucgagcuccccgucgagaaggucgacaucaucaucuccgaguggaugggcuacugccucuucuacgaguccaugcucaacaccguccucuacgcccgcgacaaguggcucgcccccgacggccucaucuuccccgaccgcgccacccucuacgucaccgccaucgaggaccgccaguacaaggacuacaagauccacuggugggagaacgucuacggcuucgacauguccugcaucaaggacgucgccaucaaggagccccucgucgacgucgucgaccccaagcagcucgucaccaacgccugccucaucaaggaggucgacaucuacaccgucaaggucgaggaccucaccuucaccucccccuucugccuccaggucaagcgcaacgacuacguccacgcccucgucgccuacuucaacaucgaguucacccgcugccacaagcgcaccggcuucuccaccucccccgagucccccuacacccacuggaagcagaccgucuucuacauggaggacuaccucaccgucaagaccggcgaggagaucuucggcaccaucggcaugcgccccaacgccaagaacaaccgcgaccucgacuucaccaucgaccucgacuucaagggccagcucugcgagcucuccugcuccaccgacuaccgcaugcgcuga

SEQ ID NO: 48134 - RNA, 996 nt, Artificial Sequence
  derived and/or modified sequence opt2 from PRMT2__Homo_sapiens__NP_001229793
auggccaccuccggcgacugcccccgcuccgagucccagggcgaggagcccgccgagugcuccgaggccggccuccuccaggagggcguccagcccgaggaguucgucgccaucgccgacuacgccgccaccgacgagacccagcucuccuuccuccgcggcgagaagauccucauccuccgccagaccaccgccgacuggugguggggcgagcgcgccggcugcugcggcuacauccccgccaaccacgucggcaagcacgucgacgaguacgaccccgaggacaccuggcaggacgaggaguacuucggcuccuacggcacccucaagcuccaccucgagaugcucgccgaccagccccgcaccaccaaguaccacuccgucauccuccagaacaaggagucccucaccgacaaggucauccucgacgucggcugcggcaccggcaucaucucccucuucugcgcccacuacgcccgcccccgcgccgucuacgccgucgaggccuccgagauggcccagcacaccggccagcucguccuccagaacggcuucgccgacaucaucaccgucuaccagcagaaggucgaggacgucguccuccccgagaaggucgacguccucgucuccgaguggaugggcaccugccuccucacccuccgcggcgagcuccgcuucgacauccgcaaggccggcacccuccacggcuucaccgccugguucuccguccacuuccagucccuccaggagggccagcccccccagguccucuccaccggccccuuccaccccaccacccacuggaagcagacccucuucaugauggacgaccccguccccguccacaccggcgacgucgucaccggcuccgucguccuccagcgcaaccccgucuggcgccgccacauguccgucgcccucuccugggccgucaccucccgccaggaccccaccucccagaaggucggcgagaaggucuuccccaucuggcgcuga

SEQ ID NO: 48135 - RNA, 1410 nt, Artificial Sequence
  derived and/or modified sequence opt2 from PRMT3__Homo_sapiens__NP_001138638
augugcucccucgccuccggcgccaccggcuacucccaccuccucaagaagcacuuccacaccgucucccucuccaucucccucauccucaccgccugguucaucaacaugaaccccaccgucgaguacaugaacuccaucuacaaccccguccccugggagaaggaggaguaccucaagcccguccucgaggacgaccuccuccuccaguucgacgucgaggaccucuacgagcccgucuccguccccuucuccuaccccaacggccucuccgagaacaccuccgucgucgagaagcucaagcacauggaggcccgcgcccucuccgccgaggccgcccucgcccgcgcccgcgaggaccuccagaagaugaagcaguucgcccaggacuucgucaugcacaccgacguccgcaccugcuccuccuccaccuccgucaucgccgaccuccaggaggacgaggacggcgucuacuucuccuccuacggccacuacggcauccacgaggagaugcucaaggacaagauccgcaccgaguccuaccgcgacuucaucuaccagaacccccacaucuucaaggacaaggucguccucgacgucggcugcggcaccggcauccucuccauguucgccgccaaggccggcgccaagaagguccucggcgucgaccaguccgagauccucuaccaggccauggacaucauccgccucaacaagcucgaggacaccaucacccucaucaagggcaagaucgaggagguccaccuccccgucgagaaggucgacgucaucaucuccgaguggaugggcuacuuccuccucuucgaguccaugcucgacuccguccucuacgccaagaacaaguaccucgccaagggcggcuccgucuaccccgacaucugcaccaucucccucgucgccgucuccgacgucaacaagcacgccgaccgcaucgccuucugggacgacgucuacggcuucaagauguccugcaugaagaaggccgucauccccgaggccgucgucgagguccucgaccccaagacccucaucuccgagcccugcggcaucaagcacaucgacugccacaccaccuccaucuccgaccucgaguucuccuccgacuucacccucaagaucacccgcaccuccaugugcaccgccaucgccggcuacuucgacaucuacuucgagaagaacugccacaaccgcgucgucuucuccaccggcccccaguccaccaagacccacuggaagcagaccgucuuccuccucgagaagcccuucuccgucaaggccggcgaggcccucaagggcaaggucaccguccacaagaacaagaaggacccccgcucccucaccgucacccucacccucaacaacuccacccagaccuacggccuccaguga

SEQ ID NO: 48136 - RNA, 1863 nt, Artificial Sequence
  derived and/or modified sequence opt2 from PRMT5__Homo_sapiens__NP_001034708
augcgcggccccaacuccggcaccgagaagggccgccucgucauccccgagaagcagggcuucgacuuccucugcaugcccgucuuccacccccgcuucaagcgcgaguucauccaggagcccgccaagaaccgccccggcccccagacccgcuccgaccuccuccucuccggccgcgacuggaacacccucaucgucggcaagcucucccccuggauccgccccgacuccaaggucgagaagauccgccgcaacuccgaggccgccaugcuccaggagcucaacuucggcgccuaccucggccuccccgccuuccuccucccccucaaccaggaggacaacaccaaccucgcccgcguccucaccaaccacauccacaccggccaccacuccuccauguucuggaugcgcgucccccucgucgcccccgaggaccuccgcgacgacaucaucgagaacgcccccaccacccacaccgaggaguacuccggcgaggagaagaccuggaugugguggcacaacuuccgcacccucugcgacuacuccaagcgcaucgccgucgcccucgagaucggcgccgaccuccccuccaaccacgucaucgaccgcuggcucggcgagcccaucaaggccgccauccuccccaccuccaucuuccucaccaacaagaagggcuuccccguccucuccaagaugcaccagcgccucaucuuccgccuccucaagcucgagguccaguucaucaucaccggcaccaaccaccacuccgagaaggaguucugcuccuaccuccaguaccucgaguaccucucccagaaccgccccccccccaacgccuacgagcucuucgccaagggcuacgaggacuaccuccaguccccccuccagccccucauggacaaccucgagucccagaccuacgaggucuucgagaaggaccccaucaaguacucccaguaccagcaggccaucuacaagugccuccucgaccgcguccccgaggaggagaaggacaccaacguccagguccucaugguccucggcgccggccgcggcccccucgucaacgccucccuccgcgccgccaagcaggccgaccgccgcaucaagcucuacgccgucgagaagaaccccaacgccgucgucacccucgagaacuggcaguucgaggaguggggcucccaggucaccgucgucuccuccgacaugcgcgagugggucgcccccgagaaggccgacaucaucgucuccgagcuccucggcuccuucgccgacaacgagcucucccccgagugccucgacggcgcccagcacuuccucaaggacgacggcgucuccauccccggcgaguacaccuccuuccucgcccccaucuccuccuccaagcucuacaacgagguccgcgccugccgcgagaaggaccgcgaccccgaggcccaguucgagaugcccuacgucguccgccuccacaacuuccaccagcucuccgccccccagcccugcuucaccuucucccaccccaaccgcgaccccaugaucgacaacaaccgcuacugcacccucgaguuccccgucgaggucaacaccguccuccacggcuucgccggcuacuucgagaccguccucuaccaggacaucacccucuccauccgccccgagacccacucccccggcauguucuccugguuccccauccucuuccccaucaagcagcccaucaccguccgcgagggccagaccaucugcguccgcuucuggcgcugcuccaacuccaagaaggucugguacgagugggccgucaccgcccccgucugcuccgccauccacaaccccaccggccgcuccuacaccaucggccucuga

SEQ ID NO: 48137 - RNA, 1158 nt, Artificial Sequence
  derived and/or modified sequence opt2 from PRMT8__Homo_sapiens__NP_001243465
auggagucccucgccuccgacggcuucaagcucaaggaggucuccuccgucaacuccccccccucccagcccccccagcccgucguccccgccaagcccguccagugcguccaccacgucuccacccagcccuccugccccggccgcggcaagauguccaagcuccucaaccccgaggagaugaccucccgcgacuacuacuucgacuccuacgcccacuucggcauccacgaggagaugcucaaggacgagguccgcacccucaccuaccgcaacuccauguaccacaacaagcacgucuucaaggacaaggucguccucgacgucggcuccggcaccggcauccucuccauguucgccgccaaggccggcgccaagaaggucuucggcaucgagugcuccuccaucuccgacuacuccgagaagaucaucaaggccaaccaccucgacaacaucaucaccaucuucaagggcaaggucgaggaggucgagcuccccgucgagaaggucgacaucaucaucuccgaguggaugggcuacugccucuucuacgaguccaugcucaacaccgucaucuucgcccgcgacaaguggcucaagcccggcggccucauguuccccgaccgcgccgcccucuacgucgucgccaucgaggaccgccaguacaaggacuucaagauccacuggugggagaacgucuacggcuucgacaugaccugcauccgcgacgucgccaugaaggagccccucgucgacaucgucgaccccaagcaggucgucaccaacgccugccucaucaaggaggucgacaucuacaccgucaagaccgaggagcucuccuucaccuccgccuucugccuccagauccagcgcaacgacuacguccacgcccucgucaccuacuucaacaucgaguucaccaagugccacaagaagaugggcuucuccaccgcccccgacgcccccuacacccacuggaagcagaccgucuucuaccucgaggacuaccucaccguccgccgcggcgaggagaucuacggcaccaucuccaugaagcccaacgccaagaacguccgcgaccucgacuucaccgucgaccucgacuucaagggccagcucugcgagaccuccgucuccaacgacuacaagaugcgcuga

SEQ ID NO: 48138 - RNA, 531 nt, Artificial Sequence
  derived and/or modified sequence opt2 from PRND__Homo_sapiens__NP_036541
augcgcaagcaccucuccuggugguggcucgccaccgucugcaugcuccucuucucccaccucuccgccguccagacccgcggcaucaagcaccgcaucaaguggaaccgcaaggcccuccccuccaccgcccagaucaccgaggcccaggucgccgagaaccgccccggcgccuucaucaagcagggccgcaagcucgacaucgacuucggcgccgagggcaaccgcuacuacgaggccaacuacuggcaguuccccgacggcauccacuacaacggcugcuccgaggccaacgucaccaaggaggccuucgucaccggcugcaucaacgccacccaggccgccaaccagggcgaguuccagaagcccgacaacaagcuccaccagcagguccucuggcgccucguccaggagcucugcucccucaagcacugcgaguucuggcucgagcgcggcgccggccuccgcgucaccaugcaccagcccguccuccucugccuccucgcccucaucuggcucaccgucaaguga

SEQ ID NO: 48139 - RNA, 762 nt, Artificial Sequence
  derived and/or modified sequence opt2 from PRNP__Homo_sapiens__NP_001073592
auggccaaccucggcugcuggaugcucguccucuucgucgccaccugguccgaccucggccucugcaagaagcgccccaagcccggcggcuggaacaccggcggcucccgcuaccccggccagggcucccccggcggcaaccgcuaccccccccagggcggcggcggcuggggccagccccacggcggcggcuggggccagccccacggcggcggcuggggccagccccacggcggcggcuggggccagccccacggcggcggcuggggccagggcggcggcacccacucccaguggaacaagcccuccaagcccaagaccaacaugaagcacauggccggcgccgccgccgccggcgccgucgucggcggccucggcggcuacaugcucggcuccgccaugucccgccccaucauccacuucggcuccgacuacgaggaccgcuacuaccgcgagaacaugcaccgcuaccccaaccaggucuacuaccgccccauggacgaguacuccaaccagaacaacuucguccacgacugcgucaacaucaccaucaagcagcacaccgucaccaccaccaccaagggcgagaacuucaccgagaccgacgucaagaugauggagcgcgucgucgagcagaugugcaucacccaguacgagcgcgagucccaggccuacuaccagcgcggcuccuccaugguccucuucuccuccccccccgucauccuccucaucuccuuccucaucuuccucaucgucggcuga

SEQ ID NO: 48140 - RNA, 1386 nt, Artificial Sequence
  derived and/or modified sequence opt2 from PROC__Homo_sapiens__NP_000303
auguggcagcucaccucccuccuccucuucgucgccaccuggggcaucuccggcacccccgccccccucgacuccgucuucuccuccuccgagcgcgcccaccagguccuccgcauccgcaagcgcgccaacuccuuccucgaggagcuccgccacuccucccucgagcgcgagugcaucgaggagaucugcgacuucgaggaggccaaggagaucuuccagaacgucgacgacacccucgccuucugguccaagcacgucgacggcgaccagugccucguccucccccucgagcaccccugcgccucccucugcugcggccacggcaccugcaucgacggcaucggcuccuucuccugcgacugccgcuccggcugggagggccgcuucugccagcgcgaggucuccuuccucaacugcucccucgacaacggcggcugcacccacuacugccucgaggaggucggcuggcgccgcugcuccugcgcccccggcuacaagcucggcgacgaccuccuccagugccaccccgccgucaaguuccccugcggccgccccuggaagcgcauggagaagaagcgcucccaccucaagcgcgacaccgaggaccaggaggaccaggucgacccccgccucaucgacggcaagaugacccgccgcggcgacucccccuggcaggucguccuccucgacuccaagaagaagcucgccugcggcgccguccucauccaccccuccuggguccucaccgccgcccacugcauggacgaguccaagaagcuccucguccgccucggcgaguacgaccuccgccgcugggagaagugggagcucgaccucgacaucaaggaggucuucguccaccccaacuacuccaaguccaccaccgacaacgacaucgcccuccuccaccucgcccagcccgccacccucucccagaccaucguccccaucugccuccccgacuccggccucgccgagcgcgagcucaaccaggccggccaggagacccucgucaccggcuggggcuaccacuccucccgcgagaaggaggccaagcgcaaccgcaccuucguccucaacuucaucaagauccccgucgucccccacaacgagugcuccgaggucauguccaacauggucuccgagaacaugcucugcgccggcauccucggcgaccgccaggacgccugcgagggcgacuccggcggccccauggucgccuccuuccacggcaccugguuccucgucggccucgucuccuggggcgagggcugcggccuccuccacaacuacggcgucuacaccaaggucucccgcuaccucgacuggauccacggccacauccgcgacaaggaggccccccagaaguccugggcccccuga

SEQ ID NO: 48141 - RNA, 717 nt, Artificial Sequence
  derived and/or modified sequence opt2 from PROCR__Homo_sapiens__NP_006395
augcucaccacccuccuccccauccuccuccucuccggcugggccuucugcucccaggacgccuccgacggccuccagcgccuccacaugcuccagaucuccuacuuccgcgaccccuaccacgucugguaccagggcaacgccucccucggcggccaccucacccacguccucgagggccccgacaccaacaccaccaucauccagcuccagccccuccaggagcccgaguccugggcccgcacccaguccggccuccaguccuaccuccuccaguuccacggccucguccgccucguccaccaggagcgcacccucgccuucccccucaccauccgcugcuuccucggcugcgagcucccccccgagggcucccgcgcccacgucuucuucgaggucgccgucaacggcuccuccuucgucuccuuccgccccgagcgcgcccucuggcaggccgacacccaggucaccuccggcgucgucaccuucacccuccagcagcucaacgccuacaaccgcacccgcuacgagcuccgcgaguuccucgaggacaccugcguccaguacguccagaagcacaucuccgccgagaacaccaagggcucccagaccucccgcuccuacaccucccucguccucggcguccucgucggcuccuucaucaucgccggcgucgccgucggcaucuuccucugcaccggcggccgccgcugcuga

SEQ ID NO: 48142 - RNA, 1230 nt, Artificial Sequence
  derived and/or modified sequence opt2 from PRODH__Homo_sapiens__XP_011528580
auggccgucgcccgcaucuccggcaccuccaacacccgccccaccggccccuccggcaccgccggcauggucuccuccguccccgcccccaccuccacccccaugcgccccuccgccaccgccaccuggcgccacuccugcgccgccuccaagccccagcuccaguucuccgagguccucgccaaguggcgcugcuucuuccaccagauggccgucgagcagggccaggccggccucgccgccauggacaccaagcucgaggucgccguccuccaggaguccgucgccaagcucggcaucgccucccgcgccgagaucgaggacugguucaccgccgagacccucggcgucuccggcaccauggaccuccucgacugguccucccucaucgacucccgcaccaagcucuccaagcaccucgucguccccaacgcccagaccggccagcucgagccccuccucucccgcuucaccgaggaggaggagcuccagaugacccgcaugcuccagcgcauggacguccucgccaagaaggccaccgagaugggcguccgccucauggucgacgccgagcagaccuacuuccagcccgccaucucccgccucacccucgagaugcagcgcaaguucaacgucgagaagccccucaucuucaacaccuaccagugcuaccucaaggacgccuacgacaacgucacccucgacgucgagcucgcccgccgcgagggcuggugcuucggcgccaagcucguccgcggcgccuaccucgcccaggagcgcgcccgcgccgccgagaucggcuacgaggaccccaucaaccccaccuacgaggccaccaacgccauguaccaccgcugccucgacuacguccucgaggagcucaagcacaacgccaaggccaaggucauggucgccucccacaacgaggacaccguccgcuucgcccuccgccgcauggaggagcucggccuccaccccgccgaccaccgcgucuacuucggccagcuccucggcaugugcgaccagaucuccuucccccucggccaggccggcuaccccgucuacaaguacguccccuacggccccgucauggagguccuccccuaccucucccgccgcgcccucgagaacuccucccucaugaagggcacccaccgcgagcgccagcuccucuggcucgagcuccuccgccgccuccgcaccggcaaccucuuccaccgccccgccuga

SEQ ID NO: 48143 - RNA, 390 nt, Artificial Sequence
  derived and/or modified sequence opt2 from PROK2__Homo_sapiens__NP_001119600
augcgcucccucugcugcgccccccuccuccuccuccuccuccuccccccccuccuccucaccccccgcgccggcgacgccgccgucaucaccggcgccugcgacaaggacucccagugcggcggcggcaugugcugcgccgucuccaucugggucaaguccauccgcaucugcacccccaugggcaagcucggcgacuccugccacccccucacccgcaagaacaacuucggcaacggccgccaggagcgccgcaagcgcaagcgcuccaagcgcaagaaggagguccccuucuucggccgccgcaugcaccacaccugccccugccuccccggccucgccugccuccgcaccuccuucaaccgcuucaucugccucgcccagaaguga

SEQ ID NO: 48144 - RNA, 1182 nt, Artificial Sequence
  derived and/or modified sequence opt2 from PROKR1__Homo_sapiens__NP_620414
auggagaccaccaugggcuucauggacgacaacgccaccaacaccuccaccuccuuccucuccguccucaacccccacggcgcccacgccaccuccuuccccuucaacuucuccuacuccgacuacgacaugccccucgacgaggacgaggacgucaccaacucccgcaccuucuucgccgccaagaucgucaucggcauggcccucgucggcaucaugcucgucugcggcaucggcaacuucaucuucaucgccgcccucguccgcuacaagaagcuccgcaaccucaccaaccuccucaucgccaaccucgccaucuccgacuuccucgucgccaucgucugcugccccuucgagauggacuacuacgucguccgccagcucuccugggagcacggccacguccucugcaccuccgucaacuaccuccgcaccgucucccucuacgucuccaccaacgcccuccucgccaucgccaucgaccgcuaccucgccaucguccacccccuccgcccccgcaugaagugccagaccgccaccggccucaucgcccucgucuggaccgucuccauccucaucgccauccccuccgccuacuucaccaccgagaccguccucgucaucgucaagucccaggagaagaucuucugcggccagaucuggcccgucgaccagcagcucuacuacaaguccuacuuccucuucaucuucggcaucgaguucgucggccccgucgucaccaugacccucugcuacgcccgcaucucccgcgagcucugguucaaggccguccccggcuuccagaccgagcagauccgcaagcgccuccgcugccgccgcaagaccguccucguccucaugugcauccucaccgccuacguccucugcugggcccccuucuacggcuucaccaucguccgcgacuucuuccccaccgucuucgucaaggagaagcacuaccucaccgccuucuacaucgucgagugcaucgccauguccaacuccaugaucaacacccucugcuucgucaccgucaagaacgacaccgucaaguacuucaagaagaucaugcuccuccacuggaaggccuccuacaacggcggcaaguccuccgccgaccucgaccucaagaccaucggcaugcccgccaccgaggaggucgacugcauccgccucaaguga

SEQ ID NO: 48145 - RNA, 1155 nt, Artificial Sequence
  derived and/or modified sequence opt2 from PROKR2__Homo_sapiens__NP_658986
auggccgcccagaacggcaacaccuccuucacccccaacuucaaccccccccaggaccacgccuccucccucuccuucaacuucuccuacggcgacuacgaccuccccauggacgaggacgaggacaugaccaagacccgcaccuucuucgccgccaagaucgucaucggcaucgcccucgccggcaucaugcucgucugcggcaucggcaacuucgucuucaucgccgcccucacccgcuacaagaagcuccgcaaccucaccaaccuccucaucgccaaccucgccaucuccgacuuccucgucgccaucaucugcugccccuucgagauggacuacuacgucguccgccagcucuccugggagcacggccacguccucugcgccuccgucaacuaccuccgcaccgucucccucuacgucuccaccaacgcccuccucgccaucgccaucgaccgcuaccucgccaucguccacccccucaagccccgcaugaacuaccagaccgccuccuuccucaucgcccucgucuggauggucuccauccucaucgccauccccuccgccuacuucgccaccgagaccguccucuucaucgucaagucccaggagaagaucuucugcggccagaucuggcccgucgaccagcagcucuacuacaaguccuacuuccucuucaucuucggcgucgaguucgucggccccgucgucaccaugacccucugcuacgcccgcaucucccgcgagcucugguucaaggccguccccggcuuccagaccgagcagauccgcaagcgccuccgcugccgccgcaagaccguccucguccucaugugcauccucaccgccuacguccucugcugggcccccuucuacggcuucaccaucguccgcgacuucuuccccaccgucuucgucaaggagaagcacuaccucaccgccuucuacgucgucgagugcaucgccauguccaacuccaugaucaacaccgucugcuucgucaccgucaagaacaacaccaugaaguacuucaagaagaugaugcuccuccacuggcgccccucccagcgcggcuccaaguccuccgccgaccucgaccuccgcaccaacggcguccccaccaccgaggaggucgacugcauccgccucaaguga

SEQ ID NO: 48146 - RNA, 747 nt, Artificial Sequence
  derived and/or modified sequence opt2 from PROL1__Homo_sapiens__NP_067048
augaagcucaccuucuuccucggccuccucgcccucaucuccugcuucacccccuccgagucccagcgcuucucccgccgccccuaccuccccggccagcuccccccccccccccucuaccgcccccgcugggucccccccuccccccccccccccuacgacucccgccucaacuccccccucucccuccccuucguccccggccgcgucccccccuccuccuucucccgcuucucccaggccgucauccucucccagcucuucccccucgaguccauccgccagccccgccucuuccccggcuaccccaaccuccacuucccccuccgccccuacuacgucggccccauccgcauccucaagccccccuucccccccauccccuucuuccucgccaucuaccuccccaucuccaaccccgagccccagaucaacaucaccaccgccgacaccaccaucaccaccaacccccccaccaccgccaccgccaccaccuccaccuccaccaagcccaccaugaccaucuccuccuccaccguccccaucuccuccacccccgagcccgccaccuccaucuccgccgccacccccgccgccuccaccgagaacaccacccagauccucgccaaccgcccccacaccguccuccucaacgccaccguccaggucaccaccuccaaccagaccauccucuccucccccgccuucaaguccuucuggcagaagcucuucgccaucuucggcuga

SEQ ID NO: 48147 - RNA, 2571 nt, Artificial Sequence
  derived and/or modified sequence opt2 from PROM1__Homo_sapiens__NP_001139319
auggcccucguccucggcucccuccuccuccucggccucugcggcaacuccuucuccggcggccagcccuccuccaccgacgcccccaaggccuggaacuacgagcuccccgccaccaacuacgagacccaggacucccacaaggccggccccaucggcauccucuucgagcucguccacaucuuccucuacgucguccagccccgcgacuuccccgaggacacccuccgcaaguuccuccagaaggccuacgaguccaagaucgacuacgacaagaucgucuacuacgaggccggcaucauccucugcugcguccucggccuccucuucaucauccucaugccccucgucggcuacuucuucugcaugugccgcugcugcaacaagugcggcggcgagaugcaccagcgccagaaggagaacggccccuuccuccgcaagugcuucgccaucucccuccucgucaucugcaucaucaucuccaucggcaucuucuacggcuucgucgccaaccaccagguccgcacccgcaucaagcgcucccgcaagcucgccgacuccaacuucaaggaccuccgcacccuccucaacgagacccccgagcagaucaaguacauccucgcccaguacaacaccaccaaggacaaggccuucaccgaccucaacuccaucaacuccguccucggcggcggcauccucgaccgccuccgccccaacaucauccccguccucgacgagaucaaguccauggccaccgccaucaaggagaccaaggaggcccucgagaacaugaacuccacccucaagucccuccaccagcaguccacccagcucuccuccucccucaccuccgucaagaccucccuccgcuccucccucaacgacccccucugccucguccaccccuccuccgagaccugcaacuccauccgccucucccucucccagcucaacuccaaccccgagcuccgccagcucccccccgucgacgccgagcucgacaacgucaacaacguccuccgcaccgaccucgacggccucguccagcagggcuaccagucccucaacgacauccccgaccgcguccagcgccagaccaccaccgucgucgccggcaucaagcgcguccucaacuccaucggcuccgacaucgacaacgucacccagcgccuccccauccaggacauccucuccgccuucuccgucuacgucaacaacaccgaguccuacauccaccgcaaccuccccacccucgaggaguacgacuccuacugguggcucggcggccucgucaucugcucccuccucacccucaucgucaucuucuacuaccucggccuccucugcggcgucugcggcuacgaccgccacgccacccccaccacccgcggcugcgucuccaacaccggcggcgucuuccucauggucggcgucggccucuccuuccucuucugcuggauccucaugaucaucgucguccucaccuucgucuucggcgccaacgucgagaagcucaucugcgagcccuacaccuccaaggagcucuuccgcguccucgacacccccuaccuccucaacgaggacugggaguacuaccucuccggcaagcucuucaacaaguccaagaugaagcucaccuucgagcaggucuacuccgacugcaagaagaaccgcggcaccuacggcacccuccaccuccagaacuccuucaacaucuccgagcaccucaacaucaacgagcacaccggcuccaucuccuccgagcucgagucccucaaggucaaccucaacaucuuccuccucggcgccgccggccgcaagaaccuccaggacuucgccgccugcggcaucgaccgcaugaacuacgacuccuaccucgcccagaccggcaagucccccgccggcgucaaccuccucuccuucgccuacgaccucgaggccaaggccaacucccucccccccggcaaccuccgcaacucccucaagcgcgacgcccagaccaucaagaccauccaccagcagcgcguccuccccaucgagcagucccucuccacccucuaccaguccgucaagauccuccagcgcaccggcaacggccuccucgagcgcgucacccgcauccucgccucccucgacuucgcccagaacuucaucaccaacaacaccuccuccgucaucaucgaggagaccaagaaguacggccgcaccaucaucggcuacuucgagcacuaccuccaguggaucgaguucuccaucuccgagaaggucgccuccugcaagcccgucgccaccgcccucgacaccgccgucgacgucuuccucugcuccuacaucaucgacccccucaaccucuucugguucggcaucggcaaggccaccgucuuccuccuccccgcccucaucuucgccgucaagcucgccaaguacuaccgccgcauggacuccgaggacgucuacgacgacgucgagaccauccccaugaagaacauggagaacggcaacaacggcuaccacaaggaccacgucuacggcauccacaaccccgucaugaccucccccucccagcacuga

SEQ ID NO: 48148 - RNA, 2505 nt, Artificial Sequence
  derived and/or modified sequence opt2 from PROM2__Homo_sapiens__NP_001159449
augaagcacacccucgcccuccucgccccccuccucggccucggccucggccucgcccucucccagcucgccgccggcgccaccgacugcaaguuccucggccccgccgagcaccucaccuucacccccgccgcccgcgcccgcuggcucgccccccgcguccgcgcccccggccuccucgacucccucuacggcaccguccgccgcuuccucuccgucguccagcucaaccccuuccccuccgagcucgucaaggcccuccucaacgagcucgccuccgucaaggucaacgaggucguccgcuacgaggccggcuacgucgucugcgccgucaucgccggccucuaccuccuccucguccccaccgccggccucugcuucugcugcugccgcugccaccgccgcugcggcggccgcgucaagaccgagcacaaggcccucgccugcgagcgcgccgcccucauggucuuccuccuccucaccacccuccuccuccucaucggcgucgucugcgccuucgucaccaaccagcgcacccacgagcagaugggccccuccaucgaggccaugcccgagacccuccucucccucuggggccucgucuccgacgucccccaggagcuccaggccgucgcccagcaguucucccucccccaggagcaggucuccgaggagcucgacggcgucggcgucuccaucggcuccgccauccacacccagcuccgcuccuccgucuacccccuccucgccgccgucggcucccucggccagguccuccaggucuccguccaccaccuccagacccucaacgccaccgucgucgagcuccaggccggccagcaggaccucgagcccgccauccgcgagcaccgcgaccgccuccucgagcuccuccaggaggcccgcugccagggcgacugcgccggcgcccucuccugggcccgcacccucgagcucggcgccgacuucucccagguccccuccgucgaccacguccuccaccagcucaagggcguccccgaggccaacuucuccuccaugguccaggaggagaacuccaccuucaacgcccuccccgcccucgccgccaugcagaccuccuccgucguccaggagcucaagaaggccgucgcccagcagcccgagggcguccgcacccucgccgagggcuuccccggccucgaggccgccucccgcugggcccaggcccuccaggaggucgaggaguccucccgccccuaccuccaggagguccagcgcuacgagaccuaccgcuggaucgucggcugcguccucugcuccgucguccucuucgucguccucugcaaccuccucggccucaaccucggcaucuggggccucuccgcccgcgacgaccccucccaccccgaggccaagggcgaggccggcgcccgcuuccucauggccggcgucggccucuccuuccucuucgccgccccccucauccuccucgucuucgccaccuuccucgucggcggcaacguccagacccucgucugccaguccugggagaacggcgagcucuucgaguucgccgacacccccggcaaccucccccccuccaugaaccucucccagcuccucggccuccgcaagaacaucuccauccaccaggccuaccagcagugcaaggagggcgccgcccucuggaccguccuccagcucaacgacuccuacgaccucgaggagcaccucgacaucaaccaguacaccaacaagcuccgccaggagcuccagucccucaaggucgacacccagucccucgaccuccucuccuccgccgcccgccgcgaccucgaggcccuccaguccuccggccuccagcgcauccacuaccccgacuuccucguccagauccagcgccccgucgucaagaccuccauggagcagcucgcccaggagcuccagggccucgcccaggcccaggacaacuccguccucggccagcgccuccaggaggaggcccagggccuccgcaaccuccaccaggagaaggucgucccccagcagucccucgucgccaagcucaaccucuccguccgcgcccucgaguccuccgcccccaaccuccagcucgagaccuccgacguccucgccaacgucaccuaccucaagggcgagcuccccgccugggccgcccgcauccuccgcaacgucuccgagugcuuccucgcccgcgagaugggcuacuucucccaguacgucgccuggguccgcgaggaggucacccagcgcaucgccaccugccagccccucuccggcgcccucgacaacucccgcgucauccucugcgacaugauggccgaccccuggaacgccuucugguucugccucgccuggugcaccuucuuccucauccccuccaucaucuucgccgucaagaccuccaaguacuuccgccccauccgcaagcgccucuccuccaccuccuccgaggagacccagcucuuccacaucccccgcgucaccucccucaagcucuga

SEQ ID NO: 48149 - RNA, 681 nt, Artificial Sequence
  derived and/or modified sequence opt2 from PROP1__Homo_sapiens__NP_006252
auggaggccgagcgccgccgccaggccgagaagcccaagaagggccgcgucggcuccucccuccuccccgagcgccaccccgccaccggcacccccaccaccaccgucgacuccuccgccccccccugccgccgccuccccggcgccggcggcggccgcucccgcuucuccccccagggcggccagcgcggccgcccccacucccgccgccgccaccgcaccaccuucucccccguccagcucgagcagcucgaguccgccuucggccgcaaccaguaccccgacaucugggcccgcgagucccucgcccgcgacaccggccucuccgaggcccgcauccaggucugguuccagaaccgccgcgccaagcagcgcaagcaggagcgcucccuccuccagccccucgcccaccucucccccgccgccuucuccuccuuccuccccgaguccaccgccugccccuacuccuacgccgccccccccccccccgucaccugcuucccccaccccuacucccacgcccuccccucccagcccuccaccggcggcgccuucgcccucucccaccaguccgaggacugguaccccacccuccaccccgcccccgccggccaccuccccugccccccccccccccccaugcucccccucucccucgagcccuccaaguccuggaacuga

SEQ ID NO: 48150 - RNA, 2031 nt, Artificial Sequence
  derived and/or modified sequence opt2 from PROS1__Homo_sapiens__NP_000304
augcgcguccucggcggccgcugcggcgcccuccucgccugccuccuccucguccuccccgucuccgaggccaacuuccucuccaagcagcaggccucccagguccucguccgcaagcgccgcgccaacucccuccucgaggagaccaagcagggcaaccucgagcgcgagugcaucgaggagcucugcaacaaggaggaggcccgcgaggucuucgagaacgaccccgagaccgacuacuucuaccccaaguaccucgucugccuccgcuccuuccagaccggccucuucaccgccgcccgccaguccaccaacgccuaccccgaccuccgcuccugcgucaacgccauccccgaccagugcuccccccuccccugcaacgaggacggcuacauguccugcaaggacggcaaggccuccuucaccugcaccugcaagcccggcuggcagggcgagaagugcgaguucgacaucaacgagugcaaggaccccuccaacaucaacggcggcugcucccagaucugcgacaacacccccggcuccuaccacugcuccugcaagaacggcuucgucaugcucuccaacaagaaggacugcaaggacgucgacgagugcucccucaagcccuccaucugcggcaccgccgucugcaagaacauccccggcgacuucgagugcgagugccccgagggcuaccgcuacaaccucaaguccaaguccugcgaggacaucgacgagugcuccgagaacaugugcgcccagcucugcgucaacuaccccggcggcuacaccugcuacugcgacggcaagaagggcuucaagcucgcccaggaccagaaguccugcgaggucgucuccgucugccucccccucaaccucgacaccaaguacgagcuccucuaccucgccgagcaguucgccggcgucguccucuaccucaaguuccgccuccccgagaucucccgcuucuccgccgaguucgacuuccgcaccuacgacuccgagggcgucauccucuacgccgaguccaucgaccacuccgccuggcuccucaucgcccuccgcggcggcaagaucgagguccagcucaagaacgagcacaccuccaagaucaccaccggcggcgacgucaucaacaacggccucuggaacauggucuccgucgaggagcucgagcacuccaucuccaucaagaucgccaaggaggccgucauggacaucaacaagcccggcccccucuucaagcccgagaacggccuccucgagaccaaggucuacuucgccggcuucccccgcaaggucgaguccgagcucaucaagcccaucaacccccgccucgacggcugcauccgcuccuggaaccucaugaagcagggcgccuccggcaucaaggagaucauccaggagaagcagaacaagcacugccucgucaccgucgagaagggcuccuacuaccccggcuccggcaucgcccaguuccacaucgacuacaacaacgucuccuccgccgagggcuggcacgucaacgucacccucaacauccgccccuccaccggcaccggcgucaugcucgcccucgucuccggcaacaacaccguccccuucgccgucucccucgucgacuccaccuccgagaagucccaggacauccuccucuccgucgagaacaccgucaucuaccgcauccaggcccucucccucugcuccgaccagcagucccaccucgaguuccgcgucaaccgcaacaaccucgagcucuccaccccccucaagaucgagaccaucucccacgaggaccuccagcgccagcucgccguccucgacaaggccaugaaggccaaggucgccaccuaccucggcggccuccccgacguccccuucuccgccacccccgucaacgccuucuacaacggcugcauggaggucaacaucaacggcguccagcucgaccucgacgaggccaucuccaagcacaacgacauccgcgcccacuccugccccuccgucuggaagaagaccaagaacuccuga

SEQ ID NO: 48151 - RNA, 2835 nt, Artificial Sequence
  derived and/or modified sequence opt2 from PROSER1__Homo_sapiens__NP_079414
auggacaagaaguccuucgagaugguccucgacgagauccgcaaggccguccucaccgaguacaagcucaaggccaucgaguacguccacggcuacuucuccuccgagcaggucgucgaccuccuccgcuacuucuccugggccgagccccagcucaaggccaugaaggcccuccagcacaagauggucgccguccagcccaccgaggucgucaacauccucaacugcuucaccuucuccaaggacaagcucgucgcccucgagcuccucgccuccaacaucaucgacgcccagaacucccgccccaucgaggaccucuuccgcgucaacauguccgagaagaagcgcugcaagcgcauccucgagcaggccuucaagggcggcugcaaggccccccacgccaugaucuccuccugcggcaccauccccggcaaccccuaccccaagggccgccccucccgcaucaacggcaucuuccccggcaccccccucaagaaggacggcgaggagugcaccaacgagggcaagggcaucgccgcccgcauccucggccccuccaagcccccccccuccaccuacaacccccacaagcccguccccuaccccaucccccccugccgcccccacgccaccaucgcccccuccgccuacaacaacgccggccucgucccccucgccaacgucaucgcccccccccccccccccuacacccccaaccccgucggcaccgagaacgaggaccucuccaaccccuccaagcccauccagaaccagaccuucuccacccccgccucccagcucuucuccccccacggcuccaaccccuccacccccgccgccacccccguccccaccgccucccccgucaaggccaucaaccaccccuccgccuccgccgccgccaccgucuccggcaugaaccuccucaacaccguccuccccgucuuccccggccaggucuccuccgccguccacaccccccagcccuccauccccaaccccaccgucauccgcacccccucccuccccaccgcccccgucaccuccauccacuccaccaccaccacccccguccccuccaucuucuccggccucgucucccuccccggccccuccgccacccccaccgccgccacccccacccccggccccaccccccgcuccacccucggcuccuccgaggccuucgccuccaccuccgcccccuucaccucccuccccuucuccaccuccuccuccgccgccuccaccuccaaccccaacuccgccucccucuccuccgucuucgccggccucccccucccccucccccccaccucccagggccucuccaaccccacccccgucaucgccggcggcuccacccccuccgucgccggcccccucggcgucaacuccccccuccucuccgcccucaagggcuuccucaccuccaacgacaccaaccucaucaacuccuccgcccucuccuccgccgucaccuccggccucgccucccucuccucccucacccuccagaacuccgacuccuccgccuccgcccccaacaagugcuacgcccccuccgccauccccaccccccagcgcaccuccacccccggccucgcccucuuccccggccuccccucccccgucgccaacuccaccuccaccccccucacccuccccguccaguccccccucgccaccgccgccuccgccuccaccuccguccccgucuccugcggcuccuccgccucccuccuccgcggcccccaccccggcaccuccgaccuccacaucuccuccacccccgccgccaccacccuccccgucaugaucaagaccgagcccaccucccccacccccuccgccuucaagggccccucccacuccggcaaccccucccacggcacccucggccucuccggcacccucggccgcgccuacaccuccaccuccguccccaucucccucuccgccugccucaaccccgcccucuccggccucuccucccucuccaccccccucaacggcuccaacccccucuccuccaucucccuccccccccacggcuccuccacccccaucgcccccgucuucaccgcccuccccuccuucaccucccucaccaacaacuucccccucaccggcaaccccucccucaaccccuccgucucccuccccggcucccucaucgccaccuccuccaccgccgccaccuccaccucccucccccaccccuccuccaccgccgccguccucuccggccucuccgccuccgcccccgucuccgccgcccccuucccccucaaccucuccaccgccguccccucccucuucuccgucacccagggcccccucuccuccuccaaccccuccuaccccggcuucuccgucuccaacacccccuccgucacccccgcccuccccuccuuccccggccuccaggcccccuccaccgucgccgccgucaccccccuccccgucgccgccaccgcccccucccccgcccccguccuccccggcuucgccuccgccuucuccuccaacuucaacuccgcccucgucgcccaggccggccucuccuccggccuccaggccgccggcuccuccgucuuccccggccuccucucccuccccggcauccccggcuucccccagaaccccucccaguccucccuccaggagcuccagcacaacgccgccgcccaguccgcccuccuccagcagguccacuccgccuccgcccucgaguccuaccccgcccagcccgacggcuuccccuccuaccccuccgcccccggcacccccuucucccuccagcccucccucucccaguccggcuggcaguga

SEQ ID NO: 48152 - RNA, 2217 nt, Artificial Sequence
  derived and/or modified sequence opt2 from PROX1__Homo_sapiens__XP_011508075
augcccgaccacgacuccaccgcccuccucucccgccagaccaagcgccgccgcgucgacaucggcgucaagcgcaccgucggcaccgccuccgccuucuucgccaaggcccgcgccaccuucuucuccgccaugaacccccagggcuccgagcaggacgucgaguacuccgucguccagcacgccgacggcgagaaguccaacguccuccgcaagcuccucaagcgcgccaacuccuacgaggacgccaugaugcccuuccccggcgccaccaucaucucccagcuccucaagaacaacaugaacaagaacggcggcaccgagcccuccuuccaggccuccggccucuccuccaccggcuccgagguccaccaggaggacaucugcuccaacuccucccgcgacuccccccccgagugccucucccccuucggccgccccaccaugucccaguucgacauggaccgccucugcgacgagcaccuccgcgccaagcgcgcccgcgucgagaacaucauccgcggcaugucccacucccccuccgucgcccuccgcggcaacgagaacgagcgcgagauggccccccaguccgucuccccccgcgaguccuaccgcgagaacaagcgcaagcagaagcucccccagcagcagcagcaguccuuccagcagcucgucuccgcccgcaaggagcagaagcgcgaggagcgccgccagcucaagcagcagcucgaggacaugcagaagcagcuccgccagcuccaggagaaguucuaccagaucuacgacuccaccgacuccgagaacgacgaggacggcaaccucuccgaggacuccaugcgcuccgagauccucgacgcccgcgcccaggacuccgucggccgcuccgacaacgagaugugcgagcucgaccccggccaguucaucgaccgcgcccgcgcccucauccgcgagcaggagauggccgagaacaagcccaagcgcgagggcaacaacaaggagcgcgaccacggccccaacucccuccagcccgagggcaagcaccucgccgagacccucaagcaggagcucaacaccgccaugucccaggucgucgacaccgucgucaaggucuucuccgccaagcccucccgccaggucccccaggucuuccccccccuccagaucccccaggcccgcuucgccgucaacggcgagaaccacaacuuccacaccgccaaccagcgccuccagugcuucggcgacgucaucauccccaacccccucgacaccuucggcaacguccagauggccuccuccaccgaccagaccgaggcccucccccucgucguccgcaagaacuccuccgaccaguccgccuccggccccgccgccggcggccaccaccagccccuccaccaguccccccucuccgccaccaccggcuucaccaccuccaccuuccgccaccccuucccccucccccucauggccuaccccuuccaguccccccucggcgcccccuccggcuccuucuccggcaaggaccgcgccucccccgagucccucgaccucacccgcgacaccaccucccuccgcaccaagauguccucccaccaccucucccaccaccccugcucccccgcccacccccccuccaccgccgagggccucucccucucccucaucaaguccgagugcggcgaccuccaggacauguccgagaucucccccuacuccggcuccgccaugcaggagggccucucccccaaccaccucaagaaggccaagcucauguucuucuacacccgcuaccccuccuccaacaugcucaagaccuacuucuccgacgucaaguucaaccgcugcaucaccucccagcucaucaagugguucuccaacuuccgcgaguucuacuacauccagauggagaaguacgcccgccaggccaucaacgacggcgucaccuccaccgaggagcucuccaucacccgcgacugcgagcucuaccgcgcccucaacaugcacuacaacaaggccaacgacuucgagcagguccccgagcgcuuccucgaggucgcccagaucacccuccgcgaguucuucaacgccaucaucgccggcaaggacgucgaccccuccuggaagaaggccaucuacaaggucaucugcaagcucgacuccgagguccccgagaucuucaagucccccaacugccuccaggagcuccuccacgaguga

SEQ ID NO: 48153 - RNA, 1269 nt, Artificial Sequence
  derived and/or modified sequence opt2 from PROZ__Homo_sapiens__NP_001243063
auggccggcugcgucccccuccuccagggccucguccucguccucgcccuccaccgcgucgagcccuccgccaccucccucaaggagcgccacggccuccacuccgacuccgccugcaccggcguccaggagucccucuuccuccccgccuccaaggccaacgacguccucguccgcuggaagcgcgccggcuccuaccuccucgaggagcucuucgagggcaaccucgagaaggagugcuacgaggagaucugcgucuacgaggaggcccgcgaggucuucgagaacgaggucgucaccgacgaguucuggcgccgcuacaagggcggcucccccugcaucucccagcccugccuccacaacggcuccugccaggacuccaucuggggcuacaccugcaccugcucccccggcuacgagggcuccaacugcgagcucgccaagaacgagugccaccccgagcgcaccgacggcugccagcacuucugccuccccggccaggaguccuacaccugcuccugcgcccagggcuaccgccucggcgaggaccacaagcagugcgucccccacgaccagugcgccugcggcguccucaccuccgagaagcgcgcccccgaccuccaggaccuccccuggcaggucaagcucaccaacuccgagggcaaggacuucugcggcggcgucaucauccgcgagaacuucguccucaccaccgccaagugcucccuccuccaccgcaacaucaccgucaagaccuacuucaaccgcaccucccaggacccccucaugaucaagaucacccacguccacguccacaugcgcuacgacgccgacgccggcgagaacgaccucucccuccucgagcucgaguggcccauccagugccccggcgccggccuccccgucugcacccccgagaaggacuucgccgagcaccuccucaucccccgcacccgcggccuccucuccggcugggcccgcaacggcaccgaccucggcaacucccucaccacccgccccgucacccucgucgagggcgaggagugcggccagguccucaacgucaccgucaccacccgcaccuacugcgagcgcuccuccgucgccgccaugcacuggauggacggcuccgucgucacccgcgagcaccgcggcuccugguuccucaccggcguccucggcucccagcccgucggcggccaggcccacaugguccucgucaccaaggucucccgcuacucccucugguucaagcagaucaugaacuga

SEQ ID NO: 48154 - RNA, 1515 nt, Artificial Sequence
  derived and/or modified sequence opt2 from PRPF19__Homo_sapiens__NP_055317
augucccucaucugcuccaucuccaacgagguccccgagcaccccugcgucucccccgucuccaaccacgucuacgagcgccgccucaucgagaaguacaucgccgagaacggcaccgaccccaucaacaaccagccccucuccgaggagcagcucaucgacaucaaggucgcccaccccauccgccccaagccccccuccgccaccuccauccccgccauccucaaggcccuccaggacgagugggacgccgucaugcuccacuccuucacccuccgccagcagcuccagaccacccgccaggagcucucccacgcccucuaccagcacgacgccgccugccgcgucaucgcccgccucaccaaggaggucaccgccgcccgcgaggcccucgccacccucaagccccaggccggccucaucgucccccaggccguccccuccucccagcccuccgucgucggcgccggcgagcccauggaccucggcgagcucgucggcaugacccccgagaucauccagaagcuccaggacaaggccaccguccucaccaccgagcgcaagaagcgcggcaagaccguccccgaggagcucgucaagcccgaggagcucuccaaguaccgccaggucgccucccacgucggccuccacuccgccuccauccccggcauccucgcccucgaccucugccccuccgacaccaacaagauccucaccggcggcgccgacaagaacgucgucgucuucgacaaguccuccgagcagauccucgccacccucaagggccacaccaagaaggucaccuccgucgucuuccaccccucccaggaccucgucuucuccgccucccccgacgccaccauccgcaucugguccguccccaacgccuccugcguccaggucguccgcgcccacgaguccgccgucaccggccucucccuccacgccaccggcgacuaccuccucuccuccuccgacgaccaguacugggccuucuccgacauccagaccggccgcguccucaccaaggucaccgacgagaccuccggcugcucccucaccugcgcccaguuccaccccgacggccucaucuucggcaccggcaccauggacucccagaucaagaucugggaccucaaggagcgcaccaacgucgccaacuuccccggccacuccggccccaucaccuccaucgccuucuccgagaacggcuacuaccucgccaccgccgccgacgacuccuccgucaagcucugggaccuccgcaagcucaagaacuucaagacccuccagcucgacaacaacuucgaggucaagucccucaucuucgaccaguccggcaccuaccucgcccucggcggcaccgacguccagaucuacaucugcaagcaguggaccgagauccuccacuucaccgagcacuccggccucaccaccggcgucgccuucggccaccacgccaaguucaucgccuccaccggcauggaccgcucccucaaguucuacucccucuga

SEQ ID NO: 48155 - RNA, 1500 nt, Artificial Sequence
  derived and/or modified sequence opt2 from PRPF31__Homo_sapiens__XP_006726118
augucccucgccgacgagcuccucgccgaccucgaggaggccgccgaggaggaggagggcggcuccuacggcgaggaggaggaggagcccgccaucgaggacguccaggaggagacccagcucgaccucuccggcgacuccgucaagaccaucgccaagcucugggacuccaagauguucgccgagaucaugaugaagaucgaggaguacaucuccaagcaggccaaggccuccgaggucaugggccccgucgaggccgcccccgaguaccgcgucaucgucgacgccaacaaccucaccgucgagaucgagaacgagcucaacaucauccacaaguucauccgcgacaaguacuccaagcgcuuccccgagcucgagucccucguccccaacgcccucgacuacauccgcaccgucaaggagcucggcaacucccucgacaagugcaagaacaacgagaaccuccagcagauccucaccaacgccaccaucauggucgucuccgucaccgccuccaccacccagggccagcagcucuccgaggaggagcucgagcgccucgaggaggccugcgacauggcccucgagcucaacgccuccaagcaccgcaucuacgaguacgucgagucccgcauguccuucaucgcccccaaccucuccaucaucaucggcgccuccaccgccgccaagaucaugggcgucgccggcggccucaccaaccucuccaagaugcccgccugcaacaucaugcuccucggcgcccagcgcaagacccucuccggcuucuccuccaccuccguccucccccacaccggcuacaucuaccacuccgacaucguccagucccucccccccgaccuccgccgcaaggccgcccgccucgucgccgccaagugcacccucgccgcccgcgucgacuccuuccacgaguccaccgagggcaaggucggcuacgagcucaaggacgagaucgagcgcaaguucgacaaguggcaggagcccccccccgucaagcaggucaagccccuccccgccccccucgacggccagcgcaagaagcgcggcggccgccgcuaccgcaagaugaaggagcgccucggccucaccgagauccgcaagcaggccaaccgcauguccuucggcgagaucgaggaggacgccuaccaggaggaccucggcuucucccucggccaccucggcaaguccggcuccggccgcguccgccagacccaggucaacgaggccaccaaggcccgcaucuccaagacccuccagcgcacccuccagaagcaguccgucgucuacggcggcaaguccaccauccgcgaccgcuccuccggcaccgccuccuccgucgccuucaccccccuccagggccucgagaucgucaacccccaggccgccgagaagaaggucgccgaggccaaccagaaguacuucuccuccauggccgaguuccucaaggucaagggcgagaaguccggccucauguccaccuga

SEQ ID NO: 48156 - RNA, 1050 nt, Artificial Sequence
  derived and/or modified sequence opt2 from PRPF38B__Homo_sapiens__XP_011539987
augaccaucggcgagaugcuccgcuccuuccucaccaagcucgagugguucuccacccucuucccccgcauccccguccccguccagaagaacaucgaccagcagaucaagacccgcccccgcaagaucaagaaggacggcaaggagggcgccgaggagaucgaccgccacgucgagcgccgccgcucccgcuccccccgccgcucccucuccccccgccgcuccccccgccgcucccgcucccgcucccaccaccgcgagggccacggcuccuccuccuucgaccgcgagcucgagcgcgagaaggagcgccagcgccucgagcgcgaggccaaggagcgcgagaaggagcgccgccgcucccgcuccaucgaccgcggccucgagcgccgccgcucccgcucccgcgagcgccaccgcucccgcucccgcucccgcgaccgcaagggcgaccgccgcgaccgcgaccgcgagcgcgagaaggagaacgagcgcggccgccgccgcgaccgcgacuacgacaaggagcgcggcaacgagcgcgagaaggagcgcgagcgcucccgcgagcgcuccaaggagcagcgcucccgcggcgaggucgaggagaagaagcacaaggaggacaaggacgaccgccgccaccgcgacgacaagcgcgacuccaagaaggagaagaagcacucccgcucccgcucccgcgagcgcaagcaccgcucccgcucccgcucccgcaacgccggcaagcgcucccgcucccgcuccaaggagaaguccuccaagcacaagaacgaguccaaggagaaguccaacaagcgcucccgcuccggcucccagggccgcaccgacuccgucgagaaguccaagaagcgcgagcacucccccuccaaggagaagucccgcaagcgcucccgcuccaaggagcgcucccacaagcgcgaccacuccgacuccaaggaccaguccgacaagcacgaccgccgccgcucccaguccaucgagcaggagucccaggagaagcagcacaagaacaaggacgagaccgucuga

SEQ ID NO: 48157 - RNA, 1251 nt, Artificial Sequence
  derived and/or modified sequence opt2 from PRPF3__Homo_sapiens__XP_011508434
auggcccucuccaagcgcgagcucgacgagcucaagcccuggaucgagaagaccgucaagcgcguccucggcuucuccgagcccaccgucgucaccgccgcccucaacugcgucggcaagggcauggacaagaagaaggccgccgaccaccucaagcccuuccucgacgacuccacccuccgcuucgucgacaagcucuucgaggccgucgaggagggccgcuccucccgccacuccaaguccuccuccgaccgcucccgcaagcgcgagcucaaggaggucuucggcgacgacuccgagaucuccaaggaguccuccggcgucaagaagcgccgcaucccccgcuucgaggaggucgaggaggagcccgaggucauccccggcccccccuccgagucccccggcaugcucaccaagcuccagaucaagcagaugauggaggccgccacccgccagaucgaggagcgcaagaagcagcucuccuucaucuccccccccaccccccagcccaagacccccuccuccucccagcccgagcgccuccccaucggcaacaccauccagcccucccaggccgccaccuucaugaacgacgccaucgagaaggcccgcaaggccgccgagcuccaggcccgcauccaggcccagcucgcccucaagcccggccucaucggcaacgccaacauggucggccucgccaaccuccacgccaugggcaucgccccccccaaggucgagcucaaggaccagaccaagcccaccccccucauccucgacgagcagggccgcaccgucgacgccaccggcaaggagaucgagcucacccaccgcaugcccacccucaaggccaacauccgcgccgucaagcgcgagcaguucaagcagcagcucaaggagaagcccuccgaggacauggaguccaacaccuucuucgacccccgcgucuccaucgcccccucccagcgccagcgccgcaccuucaaguuccacgacaagggcaaguucgagaagaucgcccagcgccuccgcaccaaggcccagcucgagaagcuccaggccgagaucucccaggccgcccgcaagaccggcauccacaccuccacccgccucgcccucaucgcccccaagaaggagcucaaggagggcgacauccccgagaucgaguggugggacuccuacaucauccccaacggcuucgaccucggcaagucccaggagcgccgccucuucuggaaccacaaguccugcuga

SEQ ID NO: 48158 - RNA, 2793 nt, Artificial Sequence
  derived and/or modified sequence opt2 from PRPF40A__Homo_sapiens__NP_060362
augugcuccggcuccggccgccgccgcuccucccucucccccaccaugcgccccggcaccggcgccgagcgcggcggccucaugaugggccaccccggcaugcacuacgcccccaugggcaugcaccccaugggccagcgcgccaacaugccccccgucccccacggcaugaugccccagaugaugccccccaugggcggcccccccaugggccagaugcccggcaugauguccuccgucaugcccggcaugaugaugucccacaugucccaggccuccaugcagcccgcccucccccccggcgucaacuccauggacgucgccgccggcaccgccuccggcgccaaguccauguggaccgagcacaagucccccgacggccgcaccuacuacuacaacaccgagaccaagcaguccaccugggagaagcccgacgaccucaagacccccgccgagcagcuccucuccaagugccccuggaaggaguacaaguccgacuccggcaagcccuacuacuacaacucccagaccaaggagucccgcugggccaagcccaaggagcucgaggaccucgagggcuaccagaacaccaucgucgccggcucccucaucaccaaguccaaccuccacgccaugaucaaggccgaggaguccuccaagcaggaggagugcaccaccaccuccaccgcccccguccccaccaccgagauccccaccaccauguccaccauggccgccgccgaggccgccgccgccgucgucgccgccgccgccgccgccgccgccgccgccgccgccgccaacgccaacgccuccaccuccgccuccaacaccgucuccggcaccguccccgucguccccgagcccgaggucaccuccaucgucgccaccgucgucgacaacgagaacaccgucaccaucuccaccgaggagcaggcccagcucaccuccacccccgccauccaggaccaguccgucgaggucuccuccaacaccggcgaggagaccuccaagcaggagaccgucgccgacuucacccccaagaaggaggaggaggagucccagcccgccaagaagaccuacaccuggaacaccaaggaggaggccaagcaggccuucaaggagcuccucaaggagaagcgcguccccuccaacgccuccugggagcaggccaugaagaugaucaucaacgacccccgcuacuccgcccucgccaagcucuccgagaagaagcaggccuucaacgccuacaagguccagaccgagaaggaggagaaggaggaggcccgcuccaaguacaaggaggccaaggaguccuuccagcgcuuccucgagaaccacgagaagaugaccuccaccacccgcuacaagaaggccgagcagauguucggcgagauggaggucuggaacgccaucuccgagcgcgaccgccucgagaucuacgaggacguccucuucuuccucuccaagaaggagaaggagcaggccaagcagcuccgcaagcgcaacugggaggcccucaagaacauccucgacaacauggccaacgucaccuacuccaccaccugguccgaggcccagcaguaccucauggacaaccccaccuucgccgaggacgaggagcuccagaacauggacaaggaggacgcccucaucugcuucgaggagcacauccgcgcccucgagaaggaggaggaggaggagaagcagaagucccuccuccgcgagcgccgccgccagcgcaagaaccgcgaguccuuccagaucuuccucgacgagcuccacgagcacggccagcuccacuccauguccuccuggauggagcucuaccccaccaucuccuccgacauccgcuucaccaacaugcucggccagcccggcuccaccgcccucgaccucuucaaguucuacgucgaggaccucaaggcccgcuaccacgacgagaagaagaucaucaaggacauccucaaggacaagggcuucgucgucgaggucaacaccaccuucgaggacuucgucgccaucaucuccuccaccaagcgcuccaccacccucgacgccggcaacaucaagcucgccuucaacucccuccucgagaaggccgaggcccgcgagcgcgagcgcgagaaggaggaggcccgcaagaugaagcgcaaggaguccgccuucaaguccaugcucaagcaggccgccccccccaucgagcucgacgccgucugggaggacauccgcgagcgcuucgucaaggagcccgccuucgaggacaucacccucgaguccgagcgcaagcgcaucuucaaggacuucaugcacguccucgagcacgagugccagcaccaccacuccaagaacaagaagcacuccaagaaguccaagaagcaccaccgcaagcgcucccgcucccgcuccggcuccgacuccgacgacgacgacucccacuccaagaagaagcgccagcgcuccgagucccgcuccgccuccgagcacuccuccuccgccgaguccgagcgcuccuacaagaaguccaagaagcacaagaagaaguccaagaagcgccgccacaaguccgacucccccgaguccgacgccgagcgcgagaaggacaagaaggagaaggaccgcgaguccgagaaggaccgcacccgccagcgcuccgaguccaagcacaagucccccaagaagaagaccggcaaggacuccggcaacugggacaccuccggcuccgagcucuccgagggcgagcucgagaagcgccgccgcacccuccucgagcagcucgacgacgaccaguga

SEQ ID NO: 48159 - RNA, 3024 nt, Artificial Sequence
  derived and/or modified sequence opt2 from PRPF4B__Homo_sapiens__NP_003904
auggccgccgccgagacccagucccuccgcgagcagcccgagauggaggacgccaacuccgagaaguccaucaacgaggagaacggcgaggucuccgaggaccagucccagaacaagcacucccgccacaagaagaagaagcacaagcaccgcuccaagcacaagaagcacaagcacuccuccgaggaggacaaggacaagaagcacaagcacaagcacaagcacaagaagcacaagcgcaaggagaucaucgacgccuccgacaaggagggcaugucccccgccaagcgcaccaagcucgacgaccucgcccuccucgaggaccucgagaagcagcgcgcccucaucaaggccgagcucgacaacgagcucauggagggcaagguccaguccggcaugggccucauccuccagggcuacgaguccggcuccgaggaggagggcgagauccacgagaaggcccgcaacggcaaccgcuccuccacccgcuccuccuccaccaagggcaagcucgagcucgucgacaacaagaucaccaccaagaagcgcuccaagucccgcuccaaggagcgcacccgccaccgcuccgacaagaagaaguccaagggcggcaucgagaucgucaaggagaagaccacccgcuccaaguccaaggagcgcaagaaguccaagucccccuccaagcgcuccaagucccaggaccaggcccgcaaguccaagucccccacccuccgccgccgcucccaggagaagaucggcaaggcccgcucccccaccgacgacaaggucaagaucgaggacaaguccaaguccaaggaccgcaagaagucccccaucaucaacgagucccgcucccgcgaccgcggcaagaagucccgcucccccgucgaccuccgcggcaaguccaaggaccgccgcucccgcuccaaggagcgcaaguccaagcgcuccgagaccgacaaggagaagaagcccaucaagucccccuccaaggacgccuccuccggcaaggagaaccgcucccccucccgccgccccggccgcucccccaagcgccgcucccucucccccaagccccgcgacaagucccgccgcucccgcuccccccuccucaacgaccgccgcuccaagcaguccaagucccccucccgcacccucucccccggccgccgcgccaagucccgcucccucgagcgcaagcgccgcgagcccgagcgccgccgccucuccuccccccgcacccgcccccgcgacgacauccucucccgccgcgagcgcuccaaggacgccucccccaucaaccgcuggucccccacccgccgccgcucccgcucccccauccgccgccgcucccgcuccccccuccgccgcucccgcuccccccgccgccgcucccgcuccccccgccgccgcgaccgcggccgccgcucccgcucccgccuccgccgccgcucccgcucccgcggcggccgccgccgccgcucccgcuccaaggucaaggaggacaaguucaagggcucccucuccgagggcaugaaggucgagcaggaguccuccuccgacgacaaccucgaggacuucgacgucgaggaggaggacgaggaggcccucaucgagcagcgccgcauccagcgccaggccaucguccagaaguacaaguaccucgccgaggacuccaacauguccguccccuccgagcccuccuccccccaguccuccacccgcacccgcucccccucccccgacgacauccucgagcgcgucgccgccgacgucaaggaguacgagcgcgagaacgucgacaccuucgaggccuccgucaaggccaagcacaaccucaugaccgucgagcagaacaacggcuccucccagaagaagcuccucgcccccgacauguucaccgaguccgacgacauguucgccgccuacuucgacuccgcccgccuccgcgccgccggcaucggcaaggacuucaaggagaaccccaaccuccgcgacaacuggaccgacgccgagggcuacuaccgcgucaacaucggcgagguccucgacaagcgcuacaacgucuacggcuacaccggccagggcgucuucuccaacgucguccgcgcccgcgacaacgcccgcgccaaccaggaggucgccgucaagaucauccgcaacaacgagcucaugcagaagaccggccucaaggagcucgaguuccucaagaagcucaacgacgccgaccccgacgacaaguuccacugccuccgccucuuccgccacuucuaccacaagcagcaccucugccucgucuucgagccccucuccaugaaccuccgcgagguccucaagaaguacggcaaggacgucggccuccacaucaaggccguccgcuccuacucccagcagcucuuccucgcccucaagcuccucaagcgcugcaacauccuccacgccgacaucaagcccgacaacauccucgucaacgaguccaagaccauccucaagcucugcgacuucggcuccgccucccacgucgccgacaacgacaucacccccuaccucgucucccgcuucuaccgcgcccccgagaucaucaucggcaaguccuacgacuacggcaucgacaugugguccgucggcugcacccucuacgagcucuacaccggcaagauccucuuccccggcaagaccaacaaccacaugcucaagcucgccauggaccucaagggcaagaugcccaacaagaugauccgcaagggcgucuucaaggaccagcacuucgaccagaaccucaacuucauguacaucgaggucgacaaggucaccgagcgcgagaaggucaccgucauguccaccaucaaccccaccaaggaccuccucgccgaccucaucggcugccagcgccuccccgaggaccagcgcaagaagguccaccagcucaaggaccuccucgaccagauccucaugcucgaccccgccaagcgcaucuccaucaaccaggcccuccagcacgccuucauccaggagaagaucuga

SEQ ID NO: 48160 - RNA, 1566 nt, Artificial Sequence
  derived and/or modified sequence opt2 from PRPF4__Homo_sapiens__NP_001231855
auggccuccucccgcgccuccuccaccgccaccaagaccaaggcccccgacgaccucgucgcccccgucgucaagaagccccacaucuacuacggcucccucgaggagaaggagcgcgagcgccucgccaagggcgaguccggcauccucggcaaggacggccucaaggccggcaucgaggccggcaacaucaacaucaccuccggcgaggucuucgagaucgaggagcacaucuccgagcgccaggccgagguccucgccgaguucgagcgccgcaagcgcgcccgccagaucaacgucuccaccgacgacuccgaggucaaggccugccuccgcgcccucggcgagcccaucacccucuucggcgagggccccgccgagcgccgcgagcgccuccgcaacauccucuccgucgucggcaccgacgcccucaagaagaccaagaaggacgacgagaaguccaagaaguccaaggaggaguaccagcagaccugguaccacgagggccccaacucccucaaggucgcccgccucuggaucgccaacuacucccucccccgcgccaugaagcgccucgaggaggcccgccuccacaaggagauccccgagaccacccgcaccucccagaugcaggagcuccacaagucccuccgcucccucaacaacuucugcucccagaucggcgacgaccgccccaucuccuacugccacuucucccccaacuccaagaugcucgccaccgccugcugguccggccucugcaagcucugguccguccccgacugcaaccuccuccacacccuccgcggccacaacaccaacgucggcgccaucgucuuccaccccaaguccaccgucucccucgaccccaaggacgucaaccucgccuccugcgccgccgacggcuccgucaagcucuggucccucgacuccgacgagcccgucgccgacaucgagggccacaccguccgcgucgcccgcgucauguggcaccccuccggccgcuuccucggcaccaccugcuacgaccgcuccuggcgccucugggaccucgaggcccaggaggagauccuccaccaggagggccacuccaugggcgucuacgacaucgccuuccaccaggacggcucccucgccggcaccggcggccucgacgccuucggccgcgucugggaccuccgcaccggccgcugcaucauguuccucgagggccaccucaaggagaucuacggcaucaacuucucccccaacggcuaccacaucgccaccggcuccggcgacaacaccugcaaggucugggaccuccgccagcgccgcugcgucuacaccauccccgcccaccagaaccucgucaccggcgucaaguucgagcccauccacggcaacuuccuccucaccggcgccuacgacaacaccgccaagaucuggacccaccccggcugguccccccucaagacccucgccggccacgagggcaaggucaugggccucgacaucuccuccgacggccagcucaucgccaccugcuccuacgaccgcaccuucaagcucuggauggccgaguga

SEQ ID NO: 48161 - RNA, 2826 nt, Artificial Sequence
  derived and/or modified sequence opt2 from PRPF6__Homo_sapiens__NP_036601
augaacaagaagaagaagcccuuccucggcaugcccgccccccucggcuacguccccggccucggccgcggcgccaccggcuucaccacccgcuccgacaucggccccgcccgcgacgccaacgaccccgucgacgaccgccacgccccccccggcaagcgcaccgucggcgaccagaugaagaagaaccaggccgccgacgacgacgacgaggaccucaacgacaccaacuacgacgaguucaacggcuacgccggcucccucuucuccuccggccccuacgagaaggacgacgaggaggccgacgccaucuacgccgcccucgacaagcgcauggacgagcgccgcaaggagcgccgcgagcagcgcgagaaggaggagaucgagaaguaccgcauggagcgccccaagauccagcagcaguucuccgaccucaagcgcaagcucgccgaggucaccgaggaggaguggcucuccauccccgaggucggcgacgcccgcaacaagcgccagcgcaacccccgcuacgagaagcucacccccguccccgacuccuucuucgccaagcaccuccagaccggcgagaaccacaccuccgucgacccccgccagacccaguucggcggccucaacacccccuaccccggcggccucaacacccccuaccccggcggcaugacccccggccucaugacccccggcaccggcgagcucgacaugcgcaagaucggccaggcccgcaacacccucauggacaugcgccucucccaggucuccgacuccgucuccggccagaccgucgucgaccccaagggcuaccucaccgaccucaacuccaugauccccacccacggcggcgacaucaacgacaucaagaaggcccgccuccuccucaaguccguccgcgagaccaacccccaccacccccccgccuggaucgccuccgcccgccucgaggaggucaccggcaagcuccaggucgcccgcaaccucaucaugaagggcaccgagaugugccccaaguccgaggacgucuggcucgaggccgcccgccuccagcccggcgacaccgccaaggccgucgucgcccaggccguccgccaccucccccaguccguccgcaucuacauccgcgccgccgagcucgagaccgacauccgcgccaagaagcgcguccuccgcaaggcccucgagcacguccccaacuccguccgccucuggaaggccgccgucgagcucgaggagcccgaggacgcccgcaucaugcucucccgcgccgucgagugcugccccaccuccgucgagcucuggcucgcccucgcccgccucgagaccuacgagaacgcccgcaagguccucaacaaggcccgcgagaacauccccaccgaccgccacaucuggaucaccgccgccaagcucgaggaggccaacggcaacacccagauggucgagaagaucaucgaccgcgccaucaccucccuccgcgccaacggcgucgagaucaaccgcgagcaguggauccaggacgccgaggagugcgaccgcgccggcuccgucgccaccugccaggccgucaugcgcgccgucaucggcaucggcaucgaggaggaggaccgcaagcacaccuggauggaggacgccgacuccugcgucgcccacaacgcccucgagugcgcccgcgccaucuacgccuacgcccuccaggucuuccccuccaagaaguccgucuggcuccgcgccgccuacuucgagaagaaccacggcacccgcgagucccucgaggcccuccuccagcgcgccgucgcccacugccccaaggccgagguccucuggcucaugggcgccaaguccaaguggcucgccggcgacguccccgccgcccgcuccauccucgcccucgccuuccaggccaaccccaacuccgaggagaucuggcucgccgccgucaagcucgaguccgagaacgacgaguacgagcgcgcccgccgccuccucgccaaggcccgcuccuccgcccccaccgcccgcgucuucaugaaguccgucaagcucgaguggguccaggacaacauccgcgccgcccaggaccucugcgaggaggcccuccgccacuacgaggacuuccccaagcucuggaugaugaagggccagaucgaggagcagaaggagaugauggagaaggcccgcgaggccuacaaccagggccucaagaagugcccccacuccaccccccucuggcuccuccucucccgccucgaggagaagaucggccagcucacccgcgcccgcgccauccucgagaagucccgccucaagaaccccaagaaccccggccucuggcucgaguccguccgccucgaguaccgcgccggccucaagaacaucgccaacacccucauggccaaggcccuccaggagugccccaacuccggcauccucugguccgaggccaucuuccucgaggcccgcccccagcgccgcaccaaguccgucgacgcccucaagaagugcgagcacgacccccacguccuccucgccgucgccaagcucuucuggucccagcgcaagaucaccaaggcccgcgagugguuccaccgcaccgucaagaucgacuccgaccucggcgacgccugggccuucuucuacaaguucgagcuccagcacggcaccgaggagcagcaggaggagguccgcaagcgcugcgaguccgccgagccccgccacggcgagcucuggugcgccgucuccaaggacaucgccaacuggcagaagaagaucggcgacauccuccgccucgucgccggccgcaucaagaacaccuucuga

SEQ ID NO: 48162 - RNA, 7008 nt, Artificial Sequence
  derived and/or modified sequence opt2 from PRPF8__Homo_sapiens__NP_006436
auggccggcgucuuccccuaccgcggccccggcaaccccguccccggcccccucgccccccuccccgacuacauguccgaggagaagcuccaggagaaggcccgcaaguggcagcagcuccaggccaagcgcuacgccgagaagcgcaaguucggcuucgucgacgcccagaaggaggacaugccccccgagcacguccgcaagaucauccgcgaccacggcgacaugaccaaccgcaaguuccgccacgacaagcgcgucuaccucggcgcccucaaguacaugccccacgccguccucaagcuccucgagaacaugcccaugcccugggagcagauccgcgacguccccguccucuaccacaucaccggcgccaucuccuucgucaacgagauccccugggucaucgagcccgucuacaucucccaguggggcuccauguggaucaugaugcgccgcgagaagcgcgaccgccgccacuucaagcgcaugcgcuucccccccuucgacgacgaggagcccccccucgacuacgccgacaacauccucgacgucgagccccucgaggccauccagcucgagcucgaccccgaggaggacgcccccguccucgacugguucuacgaccaccagccccuccgcgacucccgcaaguacgucaacggcuccaccuaccagcgcuggcaguucacccuccccaugauguccacccucuaccgccucgccaaccagcuccucaccgaccucgucgacgacaacuacuucuaccucuucgaccucaaggccuucuucaccuccaaggcccucaacauggccauccccggcggccccaaguucgagccccucguccgcgacaucaaccuccaggacgaggacuggaacgaguucaacgacaucaacaagaucaucauccgccagcccauccgcaccgaguacaagaucgccuuccccuaccucuacaacaaccucccccaccacguccaccucaccugguaccacacccccaacgucgucuucaucaagaccgaggaccccgaccuccccgccuucuacuucgacccccucaucaaccccaucucccaccgccacuccgucaagucccaggagccccuccccgacgacgacgaggaguucgagcuccccgaguucgucgagcccuuccucaaggacaccccccucuacaccgacaacaccgccaacggcaucgcccuccucugggccccccgccccuucaaccuccgcuccggccgcacccgccgcgcccucgacaucccccucgucaagaacugguaccgcgagcacugccccgccggccagcccgucaagguccgcgucuccuaccagaagcuccucaaguacuacguccucaacgcccucaagcaccgcccccccaaggcccagaagaagcgcuaccucuuccgcuccuucaaggccaccaaguucuuccaguccaccaagcucgacugggucgaggucggccuccaggucugccgccagggcuacaacaugcucaaccuccucauccaccgcaagaaccucaacuaccuccaccucgacuacaacuucaaccucaagcccgucaagacccucaccaccaaggagcgcaagaagucccgcuucggcaacgccuuccaccucugccgcgagguccuccgccucaccaagcucgucgucgacucccacguccaguaccgccucggcaacgucgacgccuuccagcucgccgacggccuccaguacaucuucgcccacgucggccagcucaccggcauguaccgcuacaaguacaagcucaugcgccagauccgcaugugcaaggaccucaagcaccucaucuacuaccgcuucaacaccggccccgucggcaagggccccggcugcggcuucugggccgccggcuggcgcgucuggcucuucuucaugcgcggcaucaccccccuccucgagcgcuggcucggcaaccuccucgcccgccaguucgagggccgccacuccaagggcgucgccaagaccgucaccaagcagcgcgucgagucccacuucgaccucgagcuccgcgccgccgucaugcacgacauccucgacaugaugcccgagggcaucaagcagaacaaggcccgcaccauccuccagcaccucuccgaggccuggcgcugcuggaaggccaacauccccuggaagguccccggccuccccacccccaucgagaacaugauccuccgcuacgucaaggccaaggccgacugguggaccaacaccgcccacuacaaccgcgagcgcauccgccgcggcgccaccgucgacaagaccgucugcaagaagaaccucggccgccucacccgccucuaccucaaggccgagcaggagcgccagcacaacuaccucaaggacggccccuacaucaccgccgaggaggccgucgccgucuacaccaccaccguccacuggcucgagucccgccgcuucucccccauccccuuccccccccucuccuacaagcacgacaccaagcuccucauccucgcccucgagcgccucaaggaggccuacuccgucaagucccgccucaaccagucccagcgcgaggagcucggccucaucgagcaggccuacgacaacccccacgaggcccucucccgcaucaagcgccaccuccucacccagcgcgccuucaaggaggucggcaucgaguucauggaccucuacucccaccucguccccgucuacgacgucgagccccucgagaagaucaccgacgccuaccucgaccaguaccucugguacgaggccgacaagcgccgccucuucccccccuggaucaagcccgccgacaccgagccccccccccuccucgucuacaaguggugccagggcaucaacaaccuccaggacgucugggagaccuccgagggcgagugcaacgucaugcucgagucccgcuucgagaagauguacgagaagaucgaccucacccuccucaaccgccuccuccgccucaucgucgaccacaacaucgccgacuacaugaccgccaagaacaacgucgucaucaacuacaaggacaugaaccacaccaacuccuacggcaucauccgcggccuccaguucgccuccuucaucguccaguacuacggccucgucauggaccuccucguccucggccuccaccgcgccuccgagauggccggccccccccagaugcccaacgacuuccucuccuuccaggacaucgccaccgaggccgcccaccccauccgccucuucugccgcuacaucgaccgcauccacaucuucuuccgcuucaccgccgacgaggcccgcgaccucauccagcgcuaccucaccgagcaccccgaccccaacaacgagaacaucgucggcuacaacaacaagaagugcuggccccgcgacgcccgcaugcgccucaugaagcacgacgucaaccucggccgcgccgucuucugggacaucaagaaccgccucccccgcuccgucaccaccguccagugggagaacuccuucgucuccgucuacuccaaggacaaccccaaccuccucuucaacaugugcggcuucgagugccgcauccuccccaagugccgcaccuccuacgaggaguucacccacaaggacggcgucuggaaccuccagaacgaggucaccaaggagcgcaccgcccagugcuuccuccgcgucgacgacgaguccaugcagcgcuuccacaaccgcguccgccagauccucauggccuccggcuccaccaccuucaccaagaucgucaacaaguggaacaccgcccucaucggccucaugaccuacuuccgcgaggccgucgucaacacccaggagcuccucgaccuccucgucaagugcgagaacaagauccagacccgcaucaagaucggccucaacuccaagaugcccucccgcuucccccccgucgucuucuacacccccaaggagcucggcggccucggcaugcucuccaugggccacguccucaucccccaguccgaccuccgcugguccaagcagaccgacgucggcaucacccacuuccgcuccggcaugucccacgaggaggaccagcucauccccaaccucuaccgcuacauccagcccugggaguccgaguucaucgacucccagcgcgucugggccgaguacgcccucaagcgccaggaggccaucgcccagaaccgccgccucacccucgaggaccucgaggacuccugggaccgcggcaucccccgcaucaacacccucuuccagaaggaccgccacacccucgccuacgacaagggcuggcgcguccgcaccgacuucaagcaguaccagguccucaagcagaaccccuucugguggacccaccagcgccacgacggcaagcucuggaaccucaacaacuaccgcaccgacaugauccaggcccucggcggcgucgagggcauccucgagcacacccucuucaagggcaccuacuuccccaccugggagggccucuucugggagaaggccuccggcuucgaggaguccaugaaguggaagaagcucaccaacgcccagcgcuccggccucaaccagauccccaaccgccgcuucacccucugguggucccccaccaucaaccgcgccaacgucuacgucggcuuccagguccagcucgaccucaccggcaucuucaugcacggcaagauccccacccucaagaucucccucauccagaucuuccgcgcccaccucuggcagaagauccacgaguccaucgucauggaccucugccaggucuucgaccaggagcucgacgcccucgagaucgagaccguccagaaggagaccauccacccccgcaaguccuacaagaugaacuccuccugcgccgacauccuccucuucgccuccuacaaguggaacgucucccgccccucccuccucgccgacuccaaggacgucauggacuccaccaccacccagaaguacuggaucgacauccagcuccgcuggggcgacuacgacucccacgacaucgagcgcuacgcccgcgccaaguuccucgacuacaccaccgacaacauguccaucuaccccucccccaccggcguccucaucgccaucgaccucgccuacaaccuccacuccgccuacggcaacugguuccccggcuccaagccccucauccagcaggccauggccaagaucaugaaggccaaccccgcccucuacguccuccgcgagcgcauccgcaagggccuccagcucuacuccuccgagcccaccgagcccuaccucuccucccagaacuacggcgagcucuucuccaaccagaucaucugguucgucgacgacaccaacgucuaccgcgucaccauccacaagaccuucgagggcaaccucaccaccaagcccaucaacggcgccaucuucaucuucaacccccgcaccggccagcucuuccucaagaucauccacaccuccgucugggccggccagaagcgccucggccagcucgccaaguggaagaccgccgaggaggucgccgcccucauccgcucccuccccgucgaggagcagcccaagcagaucaucgucacccgcaagggcaugcucgacccccucgagguccaccuccucgacuuccccaacaucgucaucaagggcuccgagcuccagcuccccuuccaggccugccucaaggucgagaaguucggcgaccucauccucaaggccaccgagccccagaugguccucuucaaccucuacgacgacuggcucaagaccaucuccuccuacaccgccuucucccgccucauccucauccuccgcgcccuccacgucaacaacgaccgcgccaaggucauccucaagcccgacaagaccaccaucaccgagccccaccacaucuggcccacccucaccgacgaggaguggaucaaggucgagguccagcucaaggaccucauccucgccgacuacggcaagaagaacaacgucaacgucgccucccucacccaguccgagauccgcgacaucauccucggcauggagaucuccgcccccucccagcagcgccagcagaucgccgagaucgagaagcagaccaaggagcagucccagcucaccgccacccagacccgcaccgucaacaagcacggcgacgagaucaucaccuccaccaccuccaacuacgagacccagaccuucuccuccaagaccgaguggcgcguccgcgccaucuccgccgccaaccuccaccuccgcaccaaccacaucuacgucuccuccgacgacaucaaggagaccggcuacaccuacauccuccccaagaacguccucaagaaguucaucugcaucuccgaccuccgcgcccagaucgccggcuaccucuacggcgucuccccccccgacaacccccaggucaaggagauccgcugcaucgucauggucccccaguggggcacccaccagaccguccaccuccccggccagcucccccagcacgaguaccucaaggagauggagccccucggcuggauccacacccagcccaacgaguccccccagcucuccccccaggacgucaccacccacgccaagaucauggccgacaaccccuccugggacggcgagaagaccaucaucaucaccugcuccuucacccccggcuccugcacccucaccgccuacaagcucacccccuccggcuacgaguggggccgccagaacaccgacaagggcaacaaccccaagggcuaccuccccucccacuacgagcgcguccagaugcuccucuccgaccgcuuccucggcuucuucaugguccccgcccaguccuccuggaacuacaacuucaugggcguccgccacgaccccaacaugaaguacgagcuccagcucgccaaccccaaggaguucuaccacgagguccaccgccccucccacuuccucaacuucgcccuccuccaggagggcgaggucuacuccgccgaccgcgaggaccucuacgccuga

SEQ ID NO: 48163 - RNA, 1041 nt, Artificial Sequence
  derived and/or modified sequence opt2 from PRPH2__Homo_sapiens__NP_000313
auggcccuccucaaggucaaguucgaccagaagaagcgcgucaagcucgcccagggccucuggcucaugaacugguucuccguccucgccggcaucaucaucuucucccucggccucuuccucaagaucgagcuccgcaagcgcuccgacgucaugaacaacuccgagucccacuucguccccaacucccucaucggcaugggcguccucuccugcgucuucaacucccucgccggcaagaucugcuacgacgcccucgaccccgccaaguacgcccgcuggaagcccuggcucaagcccuaccucgccaucugcguccucuucaacaucauccucuuccucgucgcccucugcugcuuccuccuccgcggcucccucgagaacacccucggccagggccucaagaacggcaugaaguacuaccgcgacaccgacacccccggccgcugcuucaugaagaagaccaucgacaugcuccagaucgaguucaagugcugcggcaacaacggcuuccgcgacugguucgagauccaguggaucuccaaccgcuaccucgacuucuccuccaaggaggucaaggaccgcaucaaguccaacgucgacggccgcuaccucgucgacggcguccccuucuccugcugcaaccccuccuccccccgccccugcauccaguaccagaucaccaacaacuccgcccacuacuccuacgaccaccagaccgaggagcucaaccucuggguccgcggcugccgcgccgcccuccucuccuacuacuccucccucaugaacuccaugggcgucgucacccuccucaucuggcucuucgaggucaccaucaccaucggccuccgcuaccuccagaccucccucgacggcgucuccaaccccgaggaguccgaguccgagucccagggcuggcuccucgagcgcuccguccccgagaccuggaaggccuuccucgaguccgucaagaagcucggcaagggcaaccaggucgaggccgagggcgccgacgccggccaggcccccgaggccggcuga

SEQ ID NO: 48164 - RNA, 1413 nt, Artificial Sequence
  derived and/or modified sequence opt2 from PRPH__Homo_sapiens__NP_006253
augucccaccaccccuccggccuccgcgccggcuucuccuccaccuccuaccgccgcaccuucggccccccccccucccucucccccggcgccuucuccuacuccuccuccucccgcuucuccuccucccgccuccucggcuccgccucccccuccuccuccguccgccucggcuccuuccgcuccccccgcgccggcgccggcgcccuccuccgccuccccuccgagcgccucgacuucuccauggccgaggcccucaaccaggaguuccucgccacccgcuccaacgagaagcaggagcuccaggagcucaacgaccgcuucgccaacuucaucgagaagguccgcuuccucgagcagcagaacgccgcccuccgcggcgagcucucccaggcccgcggccaggagcccgcccgcgccgaccagcucugccagcaggagcuccgcgagcuccgccgcgagcucgagcuccucggccgcgagcgcgaccgcguccaggucgagcgcgacggccucgccgaggaccucgccgcccucaagcagcgccucgaggaggagacccgcaagcgcgaggacgccgagcacaaccucguccucuuccgcaaggacgucgacgacgccacccucucccgccucgagcucgagcgcaagaucgagucccucauggacgagaucgaguuccucaagaagcuccacgaggaggagcuccgcgaccuccaggucuccgucgagucccagcagguccagcaggucgaggucgaggccaccgucaagcccgagcucaccgccgcccuccgcgacauccgcgcccaguacgaguccaucgccgccaagaaccuccaggaggccgaggagugguacaaguccaaguacgccgaccucuccgacgccgccaaccgcaaccacgaggcccuccgccaggccaagcaggagaugaacgagucccgccgccagauccagucccucaccugcgaggucgacggccuccgcggcaccaacgaggcccuccuccgccagcuccgcgagcucgaggagcaguucgcccucgaggccggcggcuaccaggccggcgccgcccgccucgaggaggagcuccgccagcucaaggaggagauggcccgccaccuccgcgaguaccaggagcuccucaacgucaagauggcccucgacaucgagaucgccaccuaccgcaagcuccucgagggcgaggagucccgcaucuccguccccguccacuccuucgccucccucaacaucaagaccaccguccccgaggucgagcccccccaggacucccacucccgcaagaccguccucaucaagaccaucgagacccgcaacggcgaggucgucaccgagucccagaaggagcagcgcuccgagcucgacaaguccuccgcccacuccuacuga

SEQ ID NO: 48165 - RNA, 957 nt, Artificial Sequence
  derived and/or modified sequence opt2 from PRPS1__Homo_sapiens__NP_002755
augcccaacaucaagaucuucuccggcuccucccaccaggaccucucccagaagaucgccgaccgccucggccucgagcucggcaaggucgucaccaagaaguucuccaaccaggagaccugcgucgagaucggcgaguccguccgcggcgaggacgucuacaucguccaguccggcugcggcgagaucaacgacaaccucauggagcuccucaucaugaucaacgccugcaagaucgccuccgccucccgcgucaccgccgucauccccugcuuccccuacgcccgccaggacaagaaggacaagucccgcgcccccaucuccgccaagcucgucgccaacaugcucuccgucgccggcgccgaccacaucaucaccauggaccuccacgccucccagauccagggcuucuucgacauccccgucgacaaccucuacgccgagcccgccguccucaaguggauccgcgagaacaucuccgaguggcgcaacugcaccaucgucucccccgacgccggcggcgccaagcgcgucaccuccaucgccgaccgccucaacgucgacuucgcccucauccacaaggagcgcaagaaggccaacgaggucgaccgcaugguccucgucggcgacgucaaggaccgcgucgccauccucgucgacgacauggccgacaccugcggcaccaucugccacgccgccgacaagcuccucuccgccggcgccacccgcgucuacgccauccucacccacggcaucuucuccggccccgccaucucccgcaucaacaacgccugcuucgaggccgucgucgucaccaacaccaucccccaggaggacaagaugaagcacugcuccaagauccaggucaucgacaucuccaugauccucgccgaggccauccgccgcacccacaacggcgaguccgucuccuaccucuucucccacgucccccucuga

SEQ ID NO: 48166 - RNA, 957 nt, Artificial Sequence
  derived and/or modified sequence opt2 from PRPS1L1__Homo_sapiens__NP_787082
augcccaacaucaagaucuucuccggcuccucccaccaggaccucucccagaagaucgccgaccgccucggccucgagcucggcaaggucgucaccaagaaguucuccaaccaggagaccugcgucgagaucgacgaguccguccgcggcgaggacgucuacaucguccaguccggcugcggcgagaucaacgacucccucauggagcuccucaucaugaucaacgccugcaagaucgccuccgccucccgcgucaccgccgucauccccugcuuccccuacgcccgccaggacaagaaggacaagucccgcucccccaucuccgccaagcucgucgccaacaugcucuccaucgccggcgccgaccacaucaucaccauggaccuccacgccucccagauccagggcuucuucgacauccccgucgacaaccucuacgccgagcccaccguccucaaguggauccgcgagaacauccccgaguggaagaacugcaucaucgucucccccgacgccggcggcgccaagcgcgucaccuccaucgccgaccagcucaacgucgacuucgcccucauccacaaggagcgcaagaaggccaacgaggucgacugcaucguccucgucggcgacgucaacgaccgcgucgccauccucgucgacgacauggccgacaccugcgucaccaucugccucgccgccgacaagcuccucuccgccggcgccacccgcgucuacgccauccucacccacggcaucuucuccggccccgccaucucccgcaucaacaccgccugcuucgaggccgucgucgucaccaacaccaucccccaggacgagaagaugaagcacugcuccaagauccgcgucaucgacaucuccaugauccucgccgaggccauccgccgcacccacaacggcgaguccgucuccuaccucuucucccacgucccccucuga

SEQ ID NO: 48167 - RNA, 966 nt, Artificial Sequence
  derived and/or modified sequence opt2 from PRPS2__Homo_sapiens__NP_001034180
augcccaacaucguccucuucuccggcuccucccaccaggaccucucccagcgcgucgccgaccgccucggccucgagcucggcaaggucgucaccaagaaguucuccaaccaggagaccuccgucgagaucggcgaguccguccgcggcgaggacgucuacaucauccaguccggcugcggcgagaucaacgacaaccucauggagcuccucaucaugaucaacgccugcaagaucgccuccuccucccgcgucaccgccgucauccccugcuuccccuacgcccgccaggacaagaaggacaaggucggcgagucccgcgcccccaucuccgccaagcucgucgccaacaugcucuccgucgccggcgccgaccacaucaucaccauggaccuccacgccucccagauccagggcuucuucgacauccccgucgacaaccucuacgccgagcccgccguccuccaguggauccgcgagaacaucgccgaguggaagaacugcaucaucgucucccccgacgccggcggcgccaagcgcgucaccuccaucgccgaccgccucaacgucgaguucgcccucauccacaaggagcgcaagaaggccaacgaggucgaccgcaugguccucgucggcgacgucaaggaccgcgucgccauccucgucgacgacauggccgacaccugcggcaccaucugccacgccgccgacaagcuccucuccgccggcgccaccaaggucuacgccauccucacccacggcaucuucuccggccccgccaucucccgcaucaacaacgccgccuucgaggccgucgucgucaccaacaccaucccccaggaggacaagaugaagcacugcaccaagauccaggucaucgacaucuccaugauccucgccgaggccauccgccgcacccacaacggcgaguccgucuccuaccucuucucccacgucccccucuga

SEQ ID NO: 48168 - RNA, 1158 nt, Artificial Sequence
  derived and/or modified sequence opt2 from PRPSAP1__Homo_sapiens__NP_002757
augcccaagaagcuccuccuccuccccccccccuccgccuccuccgccuuccgcgucccccgcgcccgccccguccccccccccgccaugaacgccgcccgcaccggcuaccgcgucuucuccgccaacuccaccgccgccugcaccgagcucgccaagcgcaucaccgagcgccucggcgccgagcucggcaaguccgucgucuaccaggagaccaacggcgagacccgcgucgagaucaaggaguccguccgcggccaggacaucuucaucauccagaccaucccccgcgacgucaacaccgccgucauggagcuccucaucauggccuacgcccucaagaccgccugcgcccgcaacaucaucggcgucauccccuacuuccccuacuccaagcaguccaagaugcgcaagcgcggcuccaucgucugcaagcuccucgccuccaugcucgccaaggccggccucacccacaucaucaccauggaccuccaccagaaggagauccagggcuucuucuccuuccccgucgacaaccuccgcgccucccccuuccuccuccaguacauccaggaggagauccccaacuaccgcaacgccgucaucgucgccaagucccccgacgccgccaagcgcgcccaguccuacgccgagcgccuccgccucggccucgccgucauccacggcgaggcccagugcaccgagcucgacauggacgacggccgccacuccccccccauggucaagaacgccaccguccaccccggccucgagcucccccucaugauggccaaggagaagccccccaucaccgucgucggcgacgucggcggccgcaucgccaucaucgucgacgacaucaucgacgacgucgaguccuucgucgccgccgccgagauccucaaggagcgcggcgccuacaagaucuacgucauggccacccacggcauccucuccgccgaggccccccgccucaucgaggaguccuccgucgacgaggucgucgucaccaacaccgucccccacgagguccagaagcuccagugccccaagaucaagaccgucgacaucucccucauccucuccgaggccauccgccgcauccacaacggcgaguccauggccuaccucuuccgcaacaucaccgucgacgacuga

SEQ ID NO: 48169 - RNA, 990 nt, Artificial Sequence
  derived and/or modified sequence opt2 from PRPSAP2__Homo_sapiens__NP_001230865
auguucugcgucaccccccccgagcucgagaccaagaugaacaucaccaagggcggccucguccucuucuccgccaacuccaacuccuccugcauggagcucuccaagaagaucgccgaggacgucaacaccaccaucauggagcuccucaucauggucuacgccugcaagaccuccugcgccaaguccaucaucggcgucauccccuacuuccccuacuccaagcagugcaagaugcgcaagcgcggcuccaucgucuccaagcuccucgccuccaugaugugcaaggccggccucacccaccucaucaccauggaccuccaccagaaggagauccagggcuucuucaacauccccgucgacaaccuccgcgccucccccuuccuccuccaguacauccaggaggagauccccgacuaccgcaacgccgucaucgucgccaagucccccgccuccgccaagcgcgcccaguccuucgccgagcgccuccgccucggcaucgccgucauccacggcgaggcccaggacgccgaguccgaccucgucgacggccgccacuccccccccaugguccgcuccgucgccgccauccaccccucccucgagauccccaugcucauccccaaggagaagccccccaucaccgucgucggcgacgucggcggccgcaucgccaucaucgucgacgacaucaucgacgacgucgacuccuuccucgccgccgccgagacccucaaggagcgcggcgccuacaagaucuucgucauggccacccacggccuccucuccuccgacgccccccgccgcaucgaggaguccgccaucgacgaggucgucgucaccaacaccaucccccacgagguccagaagcuccagugccccaagaucaagaccgucgacaucuccaugauccucuccgaggccauccgccgcauccacaacggcgaguccauguccuaccucuuccgcaacaucggccucgacgacuga

SEQ ID NO: 48170 - RNA, 1083 nt, Artificial Sequence
  derived and/or modified sequence opt2 from PRR11__Homo_sapiens__NP_060774
augcccaaguucaagcagcgccgccgcaagcucaaggccaaggccgagcgccucuucaagaagaaggaggccucccacuuccaguccaagcucaucaccccccccccccccccccccucccccgagcgcgucggcaucuccuccaucgacaucucccagucccgcuccuggcucaccuccuccuggaacuucaacuuccccaacauccgcgacgccaucaagcucuggaccaaccgcgucugguccaucuacuccuggugccagaacugcaucacccagucccucgagguccucaaggacaccaucuuccccucccgcaucugccaccgcgagcucuacuccgucaagcagcaguucugcauccucgaguccaagcucugcaagcuccaggaggcccucaagaccaucuccgaguccuccuccugccccuccugcggccagaccugccacauguccggcaagcucaccaacguccccgccugcguccucaucacccccggcgacuccaaggccguccucccccccacccucccccagcccgccucccacuuccccccccccccccccccccccccccuccccccccccccccccccccucgcccccguccuccuccgcaagcccucccucgccaaggcccuccaggccggcccccucaagaaggacggccccaugcagaucaccgucaaggaccuccucaccgucaagcucaagaagacccagucccucgacgagaagcgcaagcucauccccucccccaaggcccgcaacccccucgucaccgucuccgaccuccagcacgucacccucaagcccaacuccaagguccucuccacccgcgucaccaacguccucaucacccccggcaagucccagauggaccuccgcaagcuccuccgcaaggucgacgucgagcgcucccccggcggcaccccccucaccaacaaggagaacauggagaccggcaccggccucacccccgucaugacccaggcccuccgccgcaaguuccagcucgcccacccccgcucccccacccccacccucccccucuccaccuccuccuucgacgagcagaacuga

SEQ ID NO: 48171 - RNA, 297 nt, Artificial Sequence
  derived and/or modified sequence opt2 from PRR13__Homo_sapiens__NP_001005354
auguggaaccccaacgccggcggccccccccaccccgucccccagcccggcuaccccggcugccagccccucggccccuaccccccccccuaccccccccccgcccccggcaucccccccgucaacccccucgcccccggcauggucggccccgccgucaucgucgacaagaagaugcagaagaagaugaagaaggcccacaagaagaugcacaagcaccagaagcaccacaaguaccacaagcacggcaagcacuccuccuccuccuccuccuccuccuccuccgacuccgacuga

SEQ ID NO: 48172 - RNA, 390 nt, Artificial Sequence
  derived and/or modified sequence opt2 from PRR15__Homo_sapiens__XP_011513501
auggccgacuccggcgacgccggcuccuccggccccugguggaagucccucaccaacucccgcaagaaguccaaggaggccgccgucggcguccccccccccgcccagcccgcccccggcgagcccaccccccccgccccccccucccccgacuggaccuccuccucccgcgagaaccagcaccccaaccuccucggcggcgccggcgagccccccaagcccgacaagcucuacggcgacaaguccggcuccucccgccgcaaccucaagaucucccgcuccggccgcuucaaggagaagcgcaagguccgcgccacccuccuccccgaggccggccgcucccccgaggaggccggcuuccccggcgacccccacgaggacaagcaguga

SEQ ID NO: 48173 - RNA, 915 nt, Artificial Sequence
  derived and/or modified sequence opt2 from PRR16__Homo_sapiens__NP_001287712
auguccgccaaguccaagggcaaccccuccuccuccugccccgccgagggcccccccgccgccuccaagaccaaggucaaggagcagaucaagaucaucgucgaggaccucgagcucguccucggcgaccucaaggacgucgccaaggagcucaaggaggucgucgaccagaucgacacccucaccuccgaccuccagcucgaggacgagaugaccgacuccuccaagaccgacacccucaacuccuccuccuccggcaccaccgccuccucccucgagaagaucaagguccaggccaacgccccccucaucaagccccccgcccaccccuccgccauccucaccguccuccgcaagcccaaccccccccccccccccccccgccucacccccgucaagugcgaggaccccaagcgcgucguccccaccgccaaccccgucaagaccaacggcacccuccuccgcaacggcggccuccccggcggccccaacaagauccccaacggcgacaucugcugcauccccaacuccaaccucgacaaggcccccguccagcuccucaugcaccgccccgagaaggaccgcugcccccaggccggcccccgcgagcgcguccgcuucaacgagaagguccaguaccacggcuacugccccgacugcgacacccgcuacaacaucaagaaccgcgagguccaccuccacuccgagcccguccacccccccggcaagaucccccaccagggccccccccucccccccaccccccaccucccccccuucccccucgagaacggcggcaugggcaucucccacuccaacuccuucccccccauccgccccgccaccguccccccccccaccgcccccaagccccagaagaccauccuccgcaaguccaccaccaccaccgucuga

SEQ ID NO: 48174 - RNA, 417 nt, Artificial Sequence
  derived and/or modified sequence opt2 from PRR34__Homo_sapiens__NP_060750
augcccgccuccgccaccgccgccuggcacugccccccccucugccuccccccccuccccgccuccgcccccaccuccccccccaaccccgccacccgccccgcccccggccccggccgccgcgcccgcugcccccaguccgcccaccccgcccccacccgcggcgcccucaccuucugggcccccggcuccuggccccgcguccuccucgucccccgcucccccggccccguccuccgcgccccccgccucccccaccccgccgcccgcgcccgccgccgcgccuggcacggcgcccgccuccccggcucccccgcccgcgccggccgcaccuuccagcgcggccucgucuccaacuccugggcccacgccaucuuccucccccgcccccccaacguccucgagcuccaggucuga

SEQ ID NO: 48175 - RNA, 504 nt, Artificial Sequence
  derived and/or modified sequence opt2 from PRR3__Homo_sapiens__NP_001070965
augcccaagcgcaagaagcagaaccaccaccagccccccacccagcagcagcccccccuccccgagcgcgaggagaccggcgacgaggaggacggcucccccaucgcccuccaccgcggcccccccggcucccgcggcccccucauccccccccuccucucccucccccccccccccuggggccgcggccccauccgccgcggccucggcccccgcuccucccccuacggccgcggcugguggggcgucaacgccgagccccccuuccccggccccggccacggcggccccacccgcggcuccuuccacaaggagcagcgcaacccccgccgccucaaguccuggucccucaucaagaacaccugcccccccaaggacgacccccaggucauggaggacaaguccgaccgccccgucugccgccacuucgccaagaagggccacugccgcuacgaggaccucugcgccuucuaccaccccggcgucaacggccccccccucuga

SEQ ID NO: 48176 - RNA, 1140 nt, Artificial Sequence
  derived and/or modified sequence opt2 from PRR5__Homo_sapiens__NP_001017528
auguccucccccucccucuccgaccucggcaagcgcgagcccgccgccgccgccgacgagcgcggcacccagcagcgccgcgccugcgccaacgccaccuggaacuccauccacaacggcgucaucgccgucuuccagcgcaagggccuccccgaccaggagcucuucucccucaacgagggcguccgccagcuccucaagaccgagcucggcuccuucuucaccgaguaccuccagaaccagcuccucaccaagggcauggucauccuccgcgacaagauccgcuucuacgagggccagaagcuccucgacucccucgccgagaccugggacuucuucuucuccgacguccuccccaugcuccaggccaucuucuaccccguccagggcaaggagcccuccguccgccagcucgcccuccuccacuuccgcaacgccaucacccucuccgucaagcucgaggacgcccucgcccgcgcccacgcccgcgucccccccgccaucguccagaugcuccucguccuccagggcguccacgagucccgcggcgucaccgaggacuaccuccgccucgagacccucguccagaaggucgucucccccuaccucggcaccuacggccuccacuccuccgagggccccuucacccacuccugcauccucgagaagcgccuccuccgccgcucccgcuccggcgacguccucgccaagaaccccgucguccgcuccaaguccuacaacaccccccuccucaaccccguccaggagcacgaggccgagggcgccgccgccggcggcaccuccauccgccgccacuccgucuccgagaugaccuccugccccgagccccagggcuucuccgacccccccggccagggccccaccggcaccuuccgcuccucccccgccccccacuccggccccugccccucccgccucuaccccaccacccagccccccgagcagggccucgaccccacccgcuccucccucccccgcuccucccccgagaaccucgucgaccagauccucgaguccgucgacuccgacuccgagggcaucuucaucgacuucggccgcggccgcggcuccggcauguccgaccucgagggcuccggcggccgccaguccgucgucuga

SEQ ID NO: 48177 - RNA, 387 nt, Artificial Sequence
  derived and/or modified sequence opt2 from PRR9__Homo_sapiens__XP_011508108
augaccgccugcaccugcuccgccaaccacccccgcauguccuucuccgagcagcagugcaagcagcccugcguccccccccccugccuccccaagacccaggagcagugccaggccaaggccgaggaggucugccuccccaccugccagcaccccugccaggacaagugccucguccaggcccaggaggucugccucucccagugccaggaguccucccaggagaagugcccccagcagggccaggagcccuaccucccccccugccaggaccagugccccccccagugcgccgagcccugccaggagcucuuccagaccaagugcgucgaggucugcccccagaagguccaggagaagugcuccucccccggcaagggcaaguga

SEQ ID NO: 48178 - RNA, 1389 nt, Artificial Sequence
  derived and/or modified sequence opt2 from PRRC1__Homo_sapiens__NP_001273737
augauggaggaguccggcaucgagaccaccccccccggcacccccccccccaaccccgccggccucgccgccaccgccauguccuccacccccgucccccucgccgccaccuccuccuucuccucccccaacgucuccuccauggaguccuuccccccccucgccuacuccaccccccagcccccccucccccccguccgccccuccgccccccuccccuucguccccccccccgccguccccuccguccccccccucgucaccuccaugcccccccccgucucccccuccaccgccgccgccuucggcaacccccccgucucccacuucccccccuccaccuccgcccccaacacccuccuccccgccccccccuccggcccccccaucuccggcuucuccgucggcuccaccuacgacaucacccgcggccacgccggccgcgccccccagaccccccucaugcccuccuucuccgcccccuccggcaccggccuccuccccacccccaucacccagcaggccucccucaccucccucgcccagggcaccggcaccaccuccgccaucaccuuccccgaggagcaggaggacccccgcaucacccgcggccaggacgaggccuccgccggcggcaucuggggcuucaucaagggcgucgccggcaaccccauggucaaguccguccucgacaagaccaagcacuccgucgaguccaugaucaccacccucgaccccggcauggcccccuacaucaaguccggcggcgagcucgacaucgucgucaccuccaacaaggaggucaaggucgccgccguccgcgacgccuuccaggaggucuucggccucgccgucgucgucggcgaggccggccaguccaacaucgccccccagcccgucggcuacgccgccggccucaagggcgcccaggagcgcaucgacucccuccgccgcaccggcgucauccacgagaagcagaccgccgucuccgucgagaacuucaucgccgagcuccuccccgacaagugguucgacaucggcugccucgucgucgaggaccccguccacggcauccaccucgagaccuucacccaggccacccccgucccccucgaguucguccagcaggcccagucccucaccccccaggacuacaaccuccgcugguccggccuccucgucaccgucggcgagguccucgagaagucccuccucaacgucucccgcaccgacuggcacauggccuucaccggcaugucccgccgccagaugaucuacuccgccgcccgcgccaucgccgacgacuacuucccccgcauccccaaggagcaguggcaguccauggccuggcucaagcucgagaucuuccucccccucgucaccugguga

SEQ ID NO: 48179 - RNA, 6474 nt, Artificial Sequence
  derived and/or modified sequence opt2 from PRRC2A__Homo_sapiens__NP_542417
auguccgaccgcuccggccccaccgccaagggcaaggacggcaagaaguacuccucccucaaccucuucgacaccuacaagggcaagucccucgagauccagaagcccgccgucgccccccgccacggccuccagucccucggcaaggucgccaucgcccgccgcaugcccccccccgccaaccuccccucccucaaggccgagaacaagggcaacgaccccaacgucucccucguccccaaggacggcaccggcugggccuccaagcaggagcaguccgaccccaaguccuccgacgccuccaccgcccagccccccgagucccagccccuccccgccucccagacccccgccuccaaccagcccaagcgcccccccgccgcccccgagaacaccccccucguccccuccggcgucaaguccugggcccaggccuccgucacccacggcgcccacggcgacggcggccgcgccuccucccuccucucccgcuucucccgcgaggaguuccccacccuccaggccgccggcgaccaggacaaggccgccaaggagcgcgaguccgccgagcaguccuccggccccggccccucccuccgcccccagaacuccaccaccuggcgcgacggcggcggccgcggccccgacgagcucgagggccccgacuccaagcuccaccacggccacgacccccgcggcggccuccagcccuccggccccccccaguucccccccuaccgcggcaugaugccccccuucauguacccccccuaccuccccuuccccccccccuacggcccccagggccccuaccgcuaccccacccccgacggccccucccgcuucccccgcgucgccggcccccgcggcuccggcccccccaugcgccucgucgagcccgucggccgccccuccauccucaaggaggacaaccucaaggaguucgaccagcucgaccaggagaacgacgacggcugggccggcgcccacgaggaggucgacuacaccgagaagcucaaguucuccgacgaggaggacggccgcgacuccgacgaggagggcgccgagggccaccgcgacucccaguccgccuccggcgaggagcgcccccccgaggccgacggcaagaagggcaacucccccaacuccgagccccccacccccaagaccgccugggccgagaccucccgcccccccgagaccgagcccggcccccccgcccccaagcccccccucccccccccccaccgcggccccgccggcaacuggggcccccccggcgacuaccccgaccgcggcggcccccccugcaagccccccgcccccgaggacgaggacgaggccuggcgccagcgccgcaagcaguccuccuccgagaucucccucgccgucgagcgcgcccgccgccgccgcgaggaggaggagcgccgcaugcaggaggagcgccgcgccgccugcgccgagaagcucaagcgccucgacgagaaguucggcgcccccgacaagcgccucaaggccgagcccgccgccccccccgccgcccccuccacccccgcccccccccccgccguccccaaggagcuccccgccccccccgcccccccccccgccuccgcccccacccccgagaccgagcccgaggagcccgcccaggccccccccgcccaguccacccccacccccggcgucgccgccgcccccacccucgucuccggcggcggcuccaccuccuccaccuccuccggcuccuucgaggccucccccgucgagccccagcuccccuccaaggagggccccgagccccccgaggagguccccccccccaccaccccccccguccccaaggucgagcccaagggcgacggcaucggccccacccgccagccccccucccagggccucggcuaccccaaguaccagaagucccuccccccccgcuuccagcgccagcagcaggagcagcuccucaagcagcagcagcagcaccaguggcagcagcaccagcagggcuccgccccccccacccccgucccccccucccccccccagcccgucacccucggcgccguccccgccccccaggcccccccccccccccccaaggcccucuaccccggcgcccucggccgccccccccccaugccccccaugaacuucgacccccgcuggaugaugaucccccccuacgucgacccccgccuccuccagggccgccccccccucgacuucuacccccccggcguccaccccuccggccucgucccccgcgagcgcuccgacuccggcggcuccuccuccgagcccuucgaccgccacgcccccgccaugcuccgcgagcgcggcaccccccccgucgaccccaagcucgccugggucggcgacgucuucaccgccacccccgccgagccccgcccccucaccuccccccuccgccaggccgccgacgaggacgacaagggcaugcgcuccgagaccccccccguccccccccccccccccuaccucgccuccuaccccggcuuccccgagaacggcgcccccggcccccccaucucccgcuucccccucgaggagcccggcccccgcccccuccccuggccccccggcuccgacgaggucgccaagauccagacccccccccccaagaaggagccccccaaggaggagaccgcccagcucaccggccccgaggccggccgcaagcccgcccgcggcgucggcuccggcggccagggccccccccccccccgccgcgagucccgcaccgagacccgcuggggcccccgccccggcuccucccgccgcggcaucccccccgaggagcccggcgcccccccccgccgcgccggccccaucaagaagccccccccccccaccaaggucgaggagcucccccccaagccccucgagcagggcgacgagacccccaagccccccaagcccgacccccucaagaucaccaagggcaagcucggcggccccaaggagaccccccccaacggcaaccucucccccgccccccgccuccgccgcgacuacuccuacgagcgcgucggccccaccuccugccgcggccgcggccgcggcgaguacuucgcccgcggccgcggcuuccgcggcaccuacggcggccgcggccgcggcgcccgcucccgcgaguuccgcuccuaccgcgaguuccgcggcgacgacggccgcggcggcggcaccggcggccccaaccacccccccgccccccgcggccgcaccgccuccgagacccgcuccgagggcuccgaguacgaggagauccccaagcgccgccgccagcgcggcuccgagaccggcuccgagacccacgaguccgaccucgcccccuccgacaaggaggcccccacccccaaggagggcacccucacccaggucccccucgccccccccccccccggcgccccccccucccccgcccccgcccgcuucaccgcccgcggcggccgcgucuucaccccccgcggcguccccucccgccgcggccgcggcggcggccgcccccccccccaggucugccccggcugguccccccccgccaagucccucgcccccaagaagccccccaccggcccccucccccccuccaaggagccccucaaggagaagcucauccccggcccccucucccccgucgcccgcggcggcuccaacggcggcuccaacgucggcauggaggacggcgagcgcccccgccgccgccgccacggccgcgcccagcagcaggacaagcccccccgcuuccgccgccucaagcaggagcgcgagaacgccgcccgcggcuccgagggcaagcccucccucacccuccccgccuccgcccccggccccgaggaggcccucaccaccgucaccgucgcccccgccccccgccgcgccgccgccaagucccccgaccucuccaaccagaacuccgaccaggccaacgaggagugggagaccgccuccgaguccuccgacuucaccuccgagcgccgcggcgacaaggaggcccccccccccguccuccucacccccaaggccgucggcacccccggcggcggcggcggcggcgccguccccggcaucuccgccaugucccgcggcgaccucucccagcgcgccaaggaccucuccaagcgcuccuucuccucccagcgccccggcauggagcgccagaaccgccgccccggccccggcggcaaggccggcuccuccggcuccuccuccggcggcggcggcggcggccccggcggccgcaccggccccggccgcggcgacaagcgcuccuggcccucccccaagaaccgcucccgcccccccgaggagcgcccccccggccucccccuccccccccccccccccuccuccuccgccgucuuccgccucgaccaggucauccacuccaaccccgccggcauccagcaggcccucgcccagcucuccucccgccagggcuccgucaccgcccccggcggccacccccgccacaagcccggccucccccaggccccccagggccccuccccccgcccccccacccgcuacgagccccagcgcgucaacuccggccucuccuccgacccccacuucgaggagcccggccccaugguccgcggcgucggcggcaccccccgcgacuccgccggcgucucccccuucccccccaagcgccgcgagcgccccccccgcaagcccgagcuccuccaggaggagucccucccccccccccacuccuccggcuuccucggcuccaagcccgagggccccggcccccaggccgagucccgcgacaccggcaccgaggcccucaccccccacaucuggaaccgccuccacaccgccaccucccgcaaguccuaccgccccuccuccauggagcccuggauggagccccucucccccuucgaggacgucgccggcaccgagaugucccaguccgacuccggcgucgaccucuccggcgacucccaggucuccuccggccccugcucccagcgcuccucccccgacggcggccucaagggcgccgccgagggcccccccaagcgccccggcggcuccuccccccucaacgccguccccugcgagggcccccccggcuccgagcccccccgccgccccccccccgccccccacgacggcgaccgcaaggagcucccccgcgagcagccccucccccccggccccaucggcaccgagcgcucccagcgcaccgaccgcggcaccgagcccggccccauccgccccucccaccgccccggcccccccguccaguucggcaccuccgacaaggacuccgaccuccgccucgucgucggcgacucccucaaggccgagaaggagcucaccgccuccgucaccgaggccauccccgucucccgcgacugggagcuccuccccuccgccgccgccuccgccgagccccaguccaagaaccucgacuccggccacugcguccccgagcccuccuccuccggccagcgccucuaccccgaggucuucuacggcuccgccggccccuccuccucccagaucuccggcggcgccauggacucccagcuccaccccaacuccggcggcuuccgccccggcacccccucccuccaccccuaccgcucccagccccucuaccucccccccggccccgccccccccuccgcccuccucuccggccucgcccucaagggccaguuccucgacuucuccaccaugcaggccaccgagcucggcaagcuccccgccggcggcguccucuaccccccccccuccuuccucuacucccccgccuucugccccuccccccuccccgacaccucccuccuccagguccgccaggaccuccccucccccuccgacuucuacuccaccccccuccagcccggcggccaguccggcuuccuccccuccggcgcccccgcccagcagaugcuccuccccauggucgacucccagcuccccgucgucaacuucggcucccucccccccgcccccccccccgccccccccccccucucccuccuccccgucggccccgcccuccagccccccucccucgccguccgccccccccccgcccccgccacccgcguccuccccucccccgcccgccccuuccccgccucccucggccgcgccgagcuccaccccgucgagcucaagcccuuccaggacuaccagaagcucuccuccaaccucggcggccccggcuccucccgcaccccccccaccggccgcuccuucuccggccucaacucccgccucaaggccacccccuccaccuacuccggcgucuuccgcacccagcgcgucgaccucuaccagcaggccuccccccccgacgcccuccgcuggauccccaagcccugggagcgcaccggcccccccccccgcgagggccccucccgccgcgccgaggagcccggcucccgcggcgacaaggagcccggccucccccccccccgcuga

SEQ ID NO: 48180 - RNA, 8454 nt, Artificial Sequence
  derived and/or modified sequence opt2 from PRRC2C__Homo_sapiens__NP_055987
auguccgagaaguccggccaguccaccaaggccaaggacggcaagaaguacgccacccucucccucuucaacaccuacaagggcaagucccucgagacccagaagaccaccgcccgccacggccuccagucccucggcaaggucggcaucucccgccgcaugcccccccccgccaaccuccccucccucaaggccgagaacaagggcaacgaccccaacgucaacaucguccccaaggacggcaccggcugggccuccaagcaggagcagcacgaggaggagaagacccccgaggucccccccgcccagcccaagcccggcgucgccgccccccccgaggucgcccccgcccccaaguccugggccuccaacaagcagggcggccagggcgacggcauccaggucaacucccaguuccagcaggaguuccccucccuccaggccgccggcgaccaggagaagaaggagaaggagaccaacgacgacaacuacggccccggccccucccuccgcccccccaacgucgccugcuggcgcgacggcggcaaggccgccggcucccccuccuccuccgaccaggacgagaagcuccccggccaggacgaguccaccgccggcaccuccgagcagaacgacauccucaaggucgucgagaagcgcaucgccugcggccccccccaggccaagcucaacggccagcaggccgcccucgccucccaguaccgcgccaugaugccccccuacauguuccagcaguacccccgcaugaccuaccccccccuccacggccccaugcgcuucccccccucccucuccgagaccaacaagggccuccgcggccgcggccccccccccuccugggccuccgagcccgagcgccccuccauccucuccgccuccgagcucaaggagcucgacaaguucgacaaccucgacgccgaggccgacgagggcugggccggcgcccagauggaggucgacuacaccgagcagcucaacuucuccgacgacgacgagcagggcuccaacucccccaaggagaacaacuccgaggaccagggcuccaaggccuccgagaacaacgagaacaagaaggagaccgacgaggucuccaacaccaaguccuccucccagauccccgcccagcccuccgucgccaagguccccuacggcaagggccccuccuucaaccaggagcgcggcaccuccucccaccucccccccccccccaagcuccucgcccagcagcaccccccccccgaccgccaggccguccccggccgccccggccccuuccccuccaagcagcaggucgccgacgaggacgagaucuggaagcagcgccgccgccagcaguccgagaucuccgccgccgucgagcgcgcccgcaagcgccgcgaggaggaggagcgccgcauggaggagcagcgcaaggccgccugcgccgagaagcucaagcgccucgacgagaagcucggcauccucgagaagcagcccucccccgaggagauccgcgagcgcgagcgcgagaaggagcgcgagcgcgagaaggagcucgagaaggagcaggagcaggagcgcgagaaggagcgcgagaaggaccgcgagcgccagcaggagaaggagaaggagcucgagaaggagcaggagaagcagcgcgagauggagaaggagcgcaagcaggagaaggagaaggagcucgagcgccagaaggagaaggagaaggagcuccagaagaugaaggagcaggagaaggagugcgagcucgagaaggagcgcgagaagcucgaggagaagaucgagccccgcgagcccaaccucgagcccauggucgagaagcaggaguccgagaacuccugcaacaaggaggaggagcccgucuucacccgccaggacuccaaccgcuccgagaaggaggccacccccgucguccacgagaccgagcccgaguccggcucccagccccgccccgccguccucuccggcuacuucaagcaguuccagaagucccuccccccccgcuuccagcgccagcaggagcagaugaagcagcagcaguggcagcagcagcagcagcagggcguccucccccagaccguccccucccagcccuccuccuccaccguccccccccccccccaccgcccccucuaccagcccaugcagccccacccccagcaccucgccuccaugggcuucgacccccgcuggcucaugaugcaguccuacauggacccccgcaugauguccggccgccccgccauggacaucccccccauccaccccggcaugaucccccccaagccccucaugcgccgcgaccagauggagggcucccccaacuccuccgaguccuucgagcacaucgcccgcuccgcccgcgaccacgccaucucccucuccgagccccgcaugcucuggggcuccgaccccuacccccacgccgagccccagcaggccaccacccccaaggccaccgaggagcccgaggacguccgcuccgaggccgcccucgaccaggagcagaucaccgccgccuacuccgucgagcacaaccagcucgaggcccaccccaaggccgacuucauccgcgaguccuccgaggcccagguccagaaguuccucucccgcuccgucgaggacguccgcccccaccacaccgacgccaacaaccaguccgccugcuucgaggcccccgaccagaagacccucuccgccccccaggaggagcgcaucuccgccgucgagucccagcccucccgcaagcgcuccgucucccacggcuccaaccacacccagaagcccgacgagcagcgcuccgagcccuccgccggcauccccaaggucaccucccgcugcaucgacuccaaggagcccaucgagcgccccgaggagaagcccaagaaggagggcuucauccgcuccuccgagggccccaagcccgagaaggucuacaaguccaaguccgagacccgcuggggcccccgccccuccuccaaccgccgcgaggaggucaacgaccgccccguccgccgcuccggccccaucaagaagcccguccuccgcgacaugaaggaggagcgcgagcagcgcaaggagaaggagggcgagaaggccgagaaggucaccgagaaggucgucgucaagcccgagaagaccgagaagaaggaccucccccccccccccccccccccccagccccccgcccccauccagccccaguccguccccccccccauccagcccgaggccgagaaguuccccuccaccgagaccgccacccucgcccagaagcccucccaggacaccgagaagccccucgagcccgucuccaccguccaggucgagcccgccgucaagaccgucaaccagcagaccauggccgcccccgucgucaaggaggagaagcagcccgagaaggucaucuccaaggaccucgucaucgagcgcccccgccccgacucccgccccgccgucaagaaggaguccacccuccccccccgcaccuacuggaaggaggcccgcgagcgcgacugguuccccgaccagggcuaccgcggccgcggccgcggcgaguacuacucccgcggccgcuccuaccgcggcuccuacggcggccgcggccgcggcggccgcggccacacccgcgacuacccccaguaccgcgacaacaagccccgcgccgagcacauccccuccggcccccuccgccagcgcgaggaguccgagacccgcuccgaguccuccgacuucgaggucguccccaagcgccgccgccagcgcggcuccgagaccgacaccgacuccgagauccacgaguccgccuccgacaaggacucccucuccaagggcaagcuccccaagcgcgaggagcgccccgagaacaagaagcccgucaagccccacuccuccuucaagcccgacaaccacguccgcaucgacaaccgccuccucgagaagcccuacguccgcgacgacgacaaggccaagcccggcuuccuccccaagggcgagcccacccgccgcggccgcggcggcaccuuccgccgcggcggccgcgaccccggcggccgccccucccgccccuccacccuccgccgccccgccuaccgcgacaaccaguggaacccccgccaguccgagguccccaagcccgaggacggcgagcccccccgccgccacgagcaguucauccccaucgccgccgacaagcgcccccccaaguucgagcgcaaguucgaccccgcccgcgagcgcccccgccgccagcgccccacccgccccccccgccaggacaagcccccccgcuuccgccgccuccgcgagcgcgaggccgccuccaaguccaacgaggucgucgccguccccaccaacggcaccgucaacaacgucgcccaggagcccgucaacacccucggcgacaucuccggcaacaagacccccgaccucuccaaccagaacuccuccgaccaggccaacgaggagugggagaccgccuccgaguccuccgacuucaacgagcgccgcgagcgcgacgagaagaagaacgccgaccucaacgcccagaccgucgucaaggucggcgagaacguccucccccccaagcgcgagaucgccaagcgcuccuucuccucccagcgccccgucgaccgccagaaccgccgcggcaacaacggcccccccaaguccggccgcaacuucuccggcccccgcaacgagcgccgcuccggcccccccuccaaguccggcaagcgcggccccuucgacgaccagcccgccggcaccaccggcgucgaccucaucaacggcuccuccgcccaccaccaggagggcguccccaacggcaccggccagaagaacuccaaggacuccaccggcaagaagcgcgaggaccccaagcccggccccaagaagcccaaggagaaggucgacgcccucucccaguucgaccucaacaacuacgccuccgucgucaucaucgacgaccaccccgaggucaccgucaucgaggacccccaguccaaccucaacgacgacggcuucaccgaggucgucuccaagaagcagcagaagcgccuccaggacgaggagcgccgcaagaaggaggagcaggucauccaggucuggaacaagaagaacgccaacgagaagggccgcucccagaccuccaagcuccccccccgcuucgccaagaagcaggccaccggcauccagcaggcccaguccuccgccuccguccccccccucgccuccgccccccucccccccuccaccuccgccuccguccccgccuccaccuccgccccccuccccgccacccucacccccguccccgccuccaccuccgcccccguccccgccuccacccucgcccccguccucgccuccaccuccgcccccguccccgccuccccccucgcccccgucuccgccuccgccuccgucuccgccuccguccccgccuccaccuccgccgccgccaucaccuccuccuccgcccccgccuccgcccccgcccccacccccauccucgccuccgucuccacccccgccuccgucaccauccucgccuccgccuccauccccauccucgccuccgcccucgccuccaccuccgcccccacccccgcccccgccgccuccucccccgccgcccccgucaucaccgcccccaccauccccgccuccgcccccaccgccuccgucccccucgcccccgccuccgccuccgcccccgcccccgcccccacccccgucuccgcccccaaccccgccccccccgcccccgcccagacccaggcccagacccacaagcccguccagaacccccuccagaccaccucccaguccuccaagcagcccccccccuccauccgccuccccuccgcccagacccccaacggcaccgacuacgucgccuccggcaaguccauccagaccccccagucccacggcacccucaccgccgagcucugggacaacaaggucgccccccccgccguccucaacgacaucuccaagaagcucggccccaucucccccccccagccccccuccgucuccgccuggaacaagccccucaccuccuucggcuccgcccccuccuccgagggcgccaagaacggccaggaguccggccucgagaucggcaccgacaccauccaguucggcgcccccgccuccaacggcaacgagaacgaggucguccccguccucuccgagaaguccgccgacaagauccccgagcccaaggagcagcgccagaagcagccccgcgccggccccaucaaggcccagaagcuccccgaccucucccccgucgagaacaaggagcacaagcccggccccaucggcaaggagcgcucccucaagaaccgcaaggucaaggacgcccagcaggucgagcccgagggccaggagaagcccucccccgccaccguccgcuccaccgaccccgucaccaccaaggagaccaaggccgucuccgagauguccaccgagaucggcaccaugaucuccgucuccuccgccgaguacggcaccaacgccaaggaguccgucaccgacuacaccacccccuccuccucccuccccaacaccgucgccaccaacaacaccaagauggaggacacccucgucaacaacgucccccuccccaacacccucccccuccccaagcgcgagaccauccagcaguccuccucccucaccuccgucccccccaccaccuucucccucaccuucaagauggaguccgcccgcaaggccugggagaacucccccaacguccgcgagaagggcucccccgucaccuccaccgccccccccaucgccaccggcgucuccuccuccgccuccggccccuccaccgccaacuacaacuccuucuccuccgccuccaugccccagauccccgucgccuccgucacccccaccgccucccucuccggcgccggcaccuacaccaccuccucccucuccaccaaguccaccaccaccuccgacccccccaacaucugcaaggucaagccccagcagcuccagaccuccucccuccccuccgccucccacuucucccagcucuccugcaugcccucccucaucgcccagcagcagcagaacccccaggucuacgucucccaguccgccgccgcccagauccccgccuucuacauggacaccucccaccucuucaacacccagcacgcccgccucgccccccccucccucgcccagcagcagggcuuccagcccggccucucccagcccaccuccguccagcagauccccauccccaucuacgccccccuccagggccagcaccaggcccagcucucccucggcgccggccccgccgucucccaggcccaggagcucuucuccuccucccuccagcccuaccgcucccagcccgccuucaugcaguccucccucucccagcccuccgucguccucuccggcaccgccauccacaacuuccccaccguccagcaccaggagcucgccaaggcccaguccggccucgccuuccagcagaccuccaacacccagcccauccccauccucuacgagcaccagcucggccaggccuccggccucggcggcucccagcucaucgacacccaccuccuccaggcccgcgccaaccucacccaggccuccaaccucuacuccggccagguccagcagcccggccagaccaacuucuacaacaccgcccagucccccuccgcccuccagcaggucaccgucccccuccccgccucccagcucucccuccccaacuucggcuccaccggccagccccucaucgcccucccccagacccuccagcccccccuccagcacaccaccccccaggcccaggcccagucccucucccgccccgcccaggucucccagcccuuccgcggccucauccccgccggcacccagcacuccaugaucgccaccaccggcaagauguccgagauggagcucaaggccuucggcuccggcaucgacaucaagcccggcaccccccccaucgccggccgcuccaccacccccaccuccucccccuuccgcgccaccuccaccucccccaacucccaguccuccaagaugaacuccaucgucuaccagaagcaguuccaguccgcccccgccaccguccgcaugacccagcccuuccccacccaguucgccccccaggccaagcagcgcgccgagguccuccaguccacccagcgcuucuucuccgagcagcagcaguccaagcagaucggcggcggcaaggcccagaaggucgacuccgacuccuccaagccccccgagacccucaccgacccccccggcgucugccaggagaaggucgaggagaagcccccccccgcccccuccaucgccaccaagcccguccgcaccggccccaucaagccccaggccaucaagaccgaggagaccaaguccuga

SEQ ID NO: 48181 - RNA, 681 nt, Artificial Sequence
  derived and/or modified sequence opt2 from PRRG4__Homo_sapiens__NP_076986
auguucacccuccucguccuccucucccagcuccccaccgucacccucggcuucccccacugcgcccgcggccccaaggccuccaagcacgccggcgaggaggucuucaccuccaaggaggaggccaacuucuucauccaccgccgccuccucuacaaccgcuucgaccucgagcucuucacccccggcaaccucgagcgcgagugcaacgaggagcucugcaacuacgaggaggcccgcgagaucuucgucgacgaggacaagaccaucgccuucuggcaggaguacuccgccaagggccccaccaccaaguccgacggcaaccgcgagaagaucgacgucaugggccuccucaccggccucaucgccgccggcgucuuccucgucaucuucggccuccucggcuacuaccucugcaucaccaagugcaaccgccuccagcaccccugcuccuccgccgucuacgagcgcggccgccacacccccuccaucaucuuccgccgccccgaggaggccgcccucuccccccucccccccuccgucgaggacgccggccuccccuccuacgagcaggccgucgcccucacccgcaagcacuccgucuccccccccccccccuaccccggccacaccaagggcuuccgcgucuucaagaaguccaugucccuccccucccacuga

SEQ ID NO: 48182 - RNA, 921 nt, Artificial Sequence
  derived and/or modified sequence opt2 from PRRT1__Homo_sapiens__NP_085154
auguccuccgagaaguccggccuccccgacuccgucccccacaccucccccccccccuacaacgccccccagccccccgccgagccccccgccccccccccccaggccgcccccuccucccaccaccaccaccaccaccacuaccaccaguccggcaccgccacccucccccgccucggcgccggcggccucgccuccuccgccgccaccgcccagcgcggccccuccuccuccgccacccucccccgccccccccaccacgccccccccggccccgccgccggcgcccccccccccggcugcgccacccucccccgcaugccccccgaccccuaccuccaggagacccgcuucgagggcccccuccccccccccccccccgccgccgccgccccccccccccccgcccccgcccagaccgcccaggcccccggcuucgucguccccacccacgccggcaccgucggcacccucccccucggcggcuacgucgcccccggcuacccccuccagcuccagcccugcaccgccuacguccccgucuaccccgucggcacccccuacgccggcggcacccccggcggcaccggcgucaccuccacccuccccccccccccccagggccccggccucgcccuccucgagccccgccgccccccccacgacuacaugcccaucgccguccucaccaccaucugcugcuucuggcccaccggcaucaucgccaucuucaaggccguccagguccgcaccgcccucgcccgcggcgacauggucuccgccgagaucgccucccgcgaggcccgcaacuucuccuucaucucccucgccgucggcaucgccgccaugguccucugcaccauccucaccgucgucaucaucaucgccgcccagcaccacgagaacuacugggaccccuga

SEQ ID NO: 48183 - RNA, 900 nt, Artificial Sequence
  derived and/or modified sequence opt2 from PRRT2__Homo_sapiens__NP_001243372
auggccgccuccuccuccgagaucuccgagaugaagggcgucgaggagucccccaagguccccggcgagggccccggccacuccgaggccgagaccggccccccccagguccucgccggcguccccgaccagcccgaggccccccagcccggccccaacaccaccgccgcccccgucgacuccggccccaaggccggccucgcccccgagaccaccgagacccccgccggcgccuccgagaccgcccaggccaccgaccucucccucucccccggcggcgaguccaaggccaacugcucccccgaggaccccugccaggagaccgucuccaagcccgaggucuccaaggaggccaccgccgaccagggcucccgccucgaguccgccgccccccccgagcccgcccccgagcccgccccccagcccgacccccgccccgacucccagcccacccccaagcccgcccuccagcccgagcuccccacccaggaggaccccacccccgagauccucuccgaguccgucggcgagaagcaggagaacggcgccgucgucccccuccaggccggcgacggcgaggagggccccgcccccgagccccacuccccccccuccaagaaguccccccccgccaacggcgcccccccccgcguccuccagcagcucgucgaggaggaccgcaugcgccgcgcccacuccggccaccccggcuccccccgcggcucccucucccgccaccccuccucccagcucgccggccccggcgucgagggcggcgagggcacccagaagccccgcgacuacaucauccucgccauccucuccugcuucugccccauguggcccgucaacaucgucgccuucgccuacgccgucauggucucccccaugggccccuga

SEQ ID NO: 48184 - RNA, 654 nt, Artificial Sequence
  derived and/or modified sequence opt2 from PRRX1__Homo_sapiens__NP_008833
augaccuccuccuacggccacguccucgagcgccagcccgcccucggcggccgccucgacucccccggcaaccucgacacccuccaggccaagaagaacuucuccgucucccaccuccucgaccucgaggaggccggcgacauggucgccgcccaggccgacgagaacgucggcgaggccggccgcucccuccucgagucccccggccucaccuccggcuccgacaccccccagcaggacaacgaccagcucaacuccgaggagaagaagaagcgcaagcagcgccgcaaccgcaccaccuucaacuccucccagcuccaggcccucgagcgcgucuucgagcgcacccacuaccccgacgccuucguccgcgaggaccucgcccgccgcgucaaccucaccgaggcccgcguccaggucugguuccagaaccgccgcgccaaguuccgccgcaacgagcgcgccaugcucgccaacaagaacgccucccuccucaaguccuacuccggcgacgucaccgccgucgagcagcccaucgucccccgccccgccccccgccccaccgacuaccucuccuggggcaccgccucccccuaccgcuccuccucccucccccgcugcugccuccacgagggccuccacaacggcuucuga

SEQ ID NO: 48185 - RNA, 762 nt, Artificial Sequence
  derived and/or modified sequence opt2 from PRRX2__Homo_sapiens__NP_057391
auggacuccgccgccgccgccuucgcccucgacaagcccgcccucggccccggcccccccccccccccccccgcccucggccccggcgacugcgcccaggcccgcaagaacuucuccgucucccaccuccucgaccucgaggaggucgccgccgccggccgccucgccgcccgccccggcgcccgcgccgaggcccgcgagggcgccgcccgcgagcccuccggcggcuccuccggcuccgaggccgccccccaggacggcgagugccccucccccggccgcggcuccgccgccaagcgcaagaagaagcagcgccgcaaccgcaccaccuucaacuccucccagcuccaggcccucgagcgcgucuucgagcgcacccacuaccccgacgccuucguccgcgaggagcucgcccgccgcgucaaccucuccgaggcccgcguccaggucugguuccagaaccgccgcgccaaguuccgccgcaacgagcgcgccaugcucgccucccgcuccgccucccuccucaaguccuacucccaggaggccgccaucgagcagcccgucgccccccgccccaccgcccucucccccgacuaccucuccuggaccgccuccucccccuacuccaccgucccccccuacucccccggcuccuccggccccgccacccccggcgucaacauggccaacuccaucgccucccuccgccucaaggccaaggaguucucccuccaccacucccagguccccaccgucaacuga

SEQ ID NO: 48186 - RNA, 2628 nt, Artificial Sequence
  derived and/or modified sequence opt2 from PRSS12__Homo_sapiens__NP_003610
augacccucgcccgcuucguccucgcccucaugcucggcgcccuccccgaggucgucggcuucgacuccguccucaacgacucccuccaccacucccaccgccacuccccccccgccggcccccacuaccccuacuaccuccccacccagcagcgccccccccgcacccgccccccccccccccucccccgcuucccccgccccccccgcgcccuccccgcccagcgcccccacgcccuccaggccggccacaccccccgcccccaccccuggggcugccccgccggcgagcccugggucuccgucaccgacuucggcgcccccugccuccgcugggccgaggucccccccuuccucgagcgcuccccccccgccuccugggcccagcuccgcggccagcgccacaacuucugccgcucccccgacggcgccggccgccccuggugcuucuacggcgacgcccgcggcaaggucgacuggggcuacugcgacugccgccacggcuccguccgccuccgcggcggcaagaacgaguucgagggcaccgucgaggucuacgccuccggcgucuggggcaccgucugcuccucccacugggacgacuccgacgccuccgucaucugccaccagcuccagcucggcggcaagggcaucgccaagcagacccccuucuccggccucggccucauccccaucuacugguccaacguccgcugccgcggcgacgaggagaacauccuccucugcgagaaggacaucuggcagggcggcgucugcccccagaagauggccgccgccgucaccugcuccuucucccacggccccaccuuccccaucauccgccucgccggcggcuccuccguccacgagggccgcgucgagcucuaccacgccggccaguggggcaccgucugcgacgaccagugggacgacgccgacgccgaggucaucugccgccagcucggccucuccggcaucgccaaggccuggcaccaggccuacuucggcgagggcuccggccccgucaugcucgacgagguccgcugcaccggcaacgagcucuccaucgagcagugccccaaguccuccuggggcgagcacaacugcggccacaaggaggacgccggcgucuccugcaccccccucaccgacggcgucauccgccucgccggcggcaagggcucccacgagggccgccucgaggucuacuaccgcggccaguggggcaccgucugcgacgacggcuggaccgagcucaacaccuacgucgucugccgccagcucggcuucaaguacggcaagcaggccuccgccaaccacuucgaggaguccaccggccccaucuggcucgacgacgucuccugcuccggcaaggagacccgcuuccuccagugcucccgccgccaguggggccgccacgacugcucccaccgcgaggacgucuccaucgccugcuaccccggcggcgagggccaccgccucucccucggcuuccccguccgccucauggacggcgagaacaagaaggagggccgcgucgaggucuucaucaacggccaguggggcaccaucugcgacgacggcuggaccgacaaggacgccgccgucaucugccgccagcucggcuacaagggccccgcccgcgcccgcaccauggccuacuucggcgagggcaagggccccauccacgucgacaacgucaagugcaccggcaacgagcgcucccucgccgacugcaucaagcaggacaucggccgccacaacugccgccacuccgaggacgccggcgucaucugcgacuacuucggcaagaaggccuccggcaacuccaacaaggagucccucuccuccgucugcggccuccgccuccuccaccgccgccagaagcgcaucaucggcggcaagaacucccuccgcggcggcuggcccuggcaggucucccuccgccucaaguccucccacggcgacggccgccuccucugcggcgccacccuccucuccuccugcuggguccucaccgccgcccacugcuucaagcgcuacggcaacuccacccgcuccuacgccguccgcgucggcgacuaccacacccucguccccgaggaguucgaggaggagaucggcguccagcagaucgucauccaccgcgaguaccgccccgaccgcuccgacuacgacaucgcccucguccgccuccagggccccgaggagcagugcgcccgcuucuccucccacguccuccccgccugccucccccucuggcgcgagcgcccccagaagaccgccuccaacugcuacaucaccggcuggggcgacaccggccgcgccuacucccgcacccuccagcaggccgccaucccccuccuccccaagcgcuucugcgaggagcgcuacaagggccgcuucaccggccgcaugcucugcgccggcaaccuccacgagcacaagcgcgucgacuccugccagggcgacuccggcggcccccucaugugcgagcgccccggcgaguccugggucgucuacggcgucaccuccuggggcuacggcugcggcgucaaggacucccccggcgucuacaccaaggucuccgccuucguccccuggaucaaguccgucaccaagcucuga

SEQ ID NO: 48187 - RNA, 1545 nt, Artificial Sequence
  derived and/or modified sequence opt2 from PRSS16__Homo_sapiens__NP_005856
auggccgucuggcucgcccaguggcucggcccccuccuccucgucucccucuggggccuccucgcccccgccucccuccuccgccgccucggcgagcacauccagcaguuccaggaguccuccgcccagggccucggccucucccucggccccggcgccgccgcccuccccaaggucggcuggcucgagcagcuccucgaccccuucaacgucuccgaccgccgcuccuuccuccagcgcuacugggucaacgaccagcacugggucggccaggacggccccaucuuccuccaccucggcggcgagggcucccucggccccggcuccgucaugcgcggccaccccgccgcccucgcccccgccuggggcgcccucgucaucucccucgagcaccgcuucuacggccucuccauccccgccggcggccucgagauggcccagcuccgcuuccucuccucccgccucgcccucgccgacgucgucuccgcccgccucgcccucucccgccucuucaacaucuccuccuccucccccuggaucugcuucggcggcuccuacgccggcucccucgccgccugggcccgccucaaguucccccaccucaucuucgccuccgucgccuccuccgcccccguccgcgccguccucgacuucuccgaguacaacgacgucgucucccgcucccucauguccaccgccaucggcggcucccucgagugccgcgccgccgucuccgucgccuucgccgaggucgagcgccgccuccgcuccggcggcgccgcccaggccgcccuccgcaccgagcucuccgccugcggcccccucggccgcgccgagaaccaggccgagcuccucggcgcccuccaggcccucgucggcggcgucguccaguacgacggccagaccggcgccccccucuccguccgccagcucugcggccuccuccucggcggcggcggcaaccgcucccacuccacccccuacugcggccuccgccgcgccguccagaucguccuccacucccucggccagaagugccucuccuucucccgcgccgagaccgucgcccagcuccgcuccaccgagccccagcucuccggcgucggcgaccgccaguggcucuaccagaccugcaccgaguucggcuucuacgucaccugcgagaacccccgcugccccuucucccagcuccccgcccuccccucccagcucgaccucugcgagcaggucuucggccucuccgcccucuccgucgcccaggccgucgcccagaccaacuccuacuacggcggccagacccccggcgccaacaagguccucuucgucaacggcgacaccgaccccuggcacguccucuccgucacccaggcccucggcuccuccgaguccacccuccucauccgcaccggcucccacugccucgacauggcccccgagcgccccuccgacucccccucccuccgccucggccgccagaacaucuuccagcagcuccagaccuggcucaagcucgccaaggagucccagaucaagggcgaggucuga

SEQ ID NO: 48188 - RNA, 744 nt, Artificial Sequence
  derived and/or modified sequence opt2 from PRSS1__Homo_sapiens__NP_002760
augaacccccuccucauccucaccuucgucgccgccgcccucgccgcccccuucgacgacgacgacaagaucgucggcggcuacaacugcgaggagaacuccguccccuaccaggucucccucaacuccggcuaccacuucugcggcggcucccucaucaacgagcagugggucgucuccgccggccacugcuacaagucccgcauccagguccgccucggcgagcacaacaucgagguccucgagggcaacgagcaguucaucaacgccgccaagaucauccgccacccccaguacgaccgcaagacccucaacaacgacaucaugcucaucaagcucuccucccgcgccgucaucaacgcccgcgucuccaccaucucccuccccaccgccccccccgccaccggcaccaagugccucaucuccggcuggggcaacaccgccuccuccggcgccgacuaccccgacgagcuccagugccucgacgcccccguccucucccaggccaagugcgaggccuccuaccccggcaagaucaccuccaacauguucugcgucggcuuccucgagggcggcaaggacuccugccagggcgacuccggcggccccgucgucugcaacggccagcuccagggcgucgucuccuggggcgacggcugcgcccagaagaacaagcccggcgucuacaccaaggucuacaacuacgucaaguggaucaagaacaccaucgccgccaacuccuga

SEQ ID NO: 48189 - RNA, 678 nt, Artificial Sequence
  derived and/or modified sequence opt2 from PRSS21__Homo_sapiens__NP_001257381
augggcgcccgcggcgcccuccuccucgcccuccuccucgcccgcgccggccuccgcaagcccgagucccaggaggccgccccccucuccggccccugcggccgccgcgucaucaccucccgcaucgucggcggcgaggacgccgagcucggccgcuggcccuggcagggcucccuccgccucugggacucccacgucugcggcgucucccuccucucccaccgcugggcccucaccgccgcccacugcuucgagaccgaccucuccgaccccuccggcuggaugguccaguucggccagcucaccuccaugcccuccuucuggucccuccaggccuacuacacccgcuacuucgucuccaacaucuaccucuccccccgcuaccucggcaacucccccuacgacaucgcccucgucaagcucuccgcccccgucaccuacaccaagcacauccagcccaucugccuccaggccuccaccuucgaguucgagaaccgcaccgacugcugggucaccggcuggggcuacaucaaggaggacgagggcuccuccggccgccaccacaagcagcucuacguccagcccccccucccccagguccaguucccccagggccaccucuggcgccacggccucugcuggcagugcccccgccgcgagggcugccuccuccgcuga

SEQ ID NO: 48190 - RNA, 954 nt, Artificial Sequence
  derived and/or modified sequence opt2 from PRSS22__Homo_sapiens__NP_071402
auggucgucuccggcgccccccccgcccucggcggcggcugccucggcaccuucaccucccuccuccuccucgccuccaccgccauccucaacgccgcccgcauccccgucccccccgccugcggcaagccccagcagcucaaccgcgucgucggcggcgaggacuccaccgacuccgaguggcccuggaucgucuccauccagaagaacggcacccaccacugcgccggcucccuccucaccucccgcugggucaucaccgccgcccacugcuucaaggacaaccucaacaagcccuaccucuucuccguccuccucggcgccuggcagcucggcaaccccggcucccgcucccagaaggucggcgucgccugggucgagccccaccccgucuacuccuggaaggagggcgccugcgccgacaucgcccucguccgccucgagcgcuccauccaguucuccgagcgcguccuccccaucugccuccccgacgccuccauccaccucccccccaacacccacugcuggaucuccggcuggggcuccauccaggacggcgucccccucccccacccccagacccuccagaagcucaagguccccaucaucgacuccgaggucugcucccaccucuacuggcgcggcgccggccagggccccaucaccgaggacaugcucugcgccggcuaccucgagggcgagcgcgacgccugccucggcgacuccggcggcccccucaugugccaggucgacggcgccuggcuccucgccggcaucaucuccuggggcgagggcugcgccgagcgcaaccgccccggcgucuacaucucccucuccgcccaccgcuccugggucgagaagaucguccagggcguccagcuccgcggccgcgcccagggcggcggcgcccuccgcgcccccucccagggcuccggcgccgccgcccgcuccuga

SEQ ID NO: 48191 - RNA, 1299 nt, Artificial Sequence
  derived and/or modified sequence opt2 from PRSS23__Homo_sapiens__NP_001280107
augugcuccggcgccggcggcguccgcgccgccuccccccgccccgaggccggccgcgccggccucggcuggcgcggcggccgcacccgccagcuccccgcccuccucgccucccuccucgcccucggcugcgccgccggccaggccugggagccccgcgcccucucccgccgcccccaccucuccgagcgccgcuccgagccccgccccggccgcgccgcccgccgcggcaccguccucggcauggccggcauccccggccuccucuuccuccucuucuuccuccucugcgccgucggccaggucucccccuacuccgcccccuggaagcccaccuggcccgccuaccgccuccccgucguccucccccaguccacccucaaccucgccaagcaguaccucuccuacgagacccucuacgccaacggcucccgcaccgagacccaggucggcaucuacauccucuccuccuccggcgacggcgcccagcaccgcgacuccggcuccuccggcaagucccgccgcaagcgccagaucuacggcuacgacucccgcuucuccaucuucggcaaggacuuccuccucaacuaccccuucuccaccuccgucaagcucuccaccggcugcaccggcacccucgucgccgagaagcacguccucaccgccgcccacugcauccacgacggcaagaccuacgucaagggcacccagaagcuccgcgucggcuuccucaagcccaaguucaaggacggcggccgcggcgccaacgacuccaccuccgccaugcccgagcagaugaaguuccaguggauccgcgucaagcgcacccacguccccaagggcuggaucaagggcaacgccaacgacaucggcauggacuacgacuacgcccuccucgagcucaagaagccccacaagcgcaaguucaugaagaucggcgucuccccccccgccaagcagcuccccggcggccgcauccacuucuccggcuacgacaacgaccgccccggcaaccucgucuaccgcuucugcgacgucaaggacgagaccuacgaccuccucuaccagcagugcgacgcccagcccggcgccuccggcuccggcgucuacguccgcauguggaagcgccagcagcagaagugggagcgcaagaucaucggcaucuucuccggccaccagugggucgacaugaacggcuccccccaggacuucaacgucgccguccgcaucaccccccucaaguacgcccagaucugcuacuggaucaagggcaacuaccucgacugccgcgagggcuga

SEQ ID NO: 48192 - RNA, 873 nt, Artificial Sequence
  derived and/or modified sequence opt2 from PRSS27__Homo_sapiens__NP_114154
augcgccgccccgccgccgucccccuccuccuccuccucugcuucggcucccagcgcgccaaggccgccaccgccugcggccgcccccgcaugcucaaccgcauggucggcggccaggacacccaggagggcgaguggcccuggcaggucuccauccagcgcaacggcucccacuucugcggcggcucccucaucgccgagcaguggguccucaccgccgcccacugcuuccgcaacaccuccgagaccucccucuaccagguccuccucggcgcccgccagcucguccagcccggcccccacgccauguacgcccgcguccgccaggucgaguccaacccccucuaccagggcaccgccuccuccgccgacgucgcccucgucgagcucgaggcccccguccccuucaccaacuacauccuccccgucugccuccccgaccccuccgucaucuucgagaccggcaugaacugcugggucaccggcuggggcucccccuccgaggaggaccuccuccccgagccccgcauccuccagaagcucgccguccccaucaucgacacccccaagugcaaccuccucuacuccaaggacaccgaguucggcuaccagcccaagaccaucaagaacgacaugcucugcgccggcuucgaggagggcaagaaggacgccugcaagggcgacuccggcggcccccucgucugccucgucggccaguccuggcuccaggccggcgucaucuccuggggcgagggcugcgcccgccagaaccgccccggcgucuacauccgcgucaccgcccaccacaacuggauccaccgcaucauccccaagcuccaguuccagcccgcccgccucggcggccagaaguga

SEQ ID NO: 48193 - RNA, 744 nt, Artificial Sequence
  derived and/or modified sequence opt2 from PRSS2__Homo_sapiens__NP_002761
augaaccuccuccucauccucaccuucgucgccgccgccgucgccgcccccuucgacgacgacgacaagaucgucggcggcuacaucugcgaggagaacuccguccccuaccaggucucccucaacuccggcuaccacuucugcggcggcucccucaucuccgagcagugggucgucuccgccggccacugcuacaagucccgcauccagguccgccucggcgagcacaacaucgagguccucgagggcaacgagcaguucaucaacgccgccaagaucauccgccaccccaaguacaacucccgcacccucgacaacgacauccuccucaucaagcucuccucccccgccgucaucaacucccgcgucuccgccaucucccuccccaccgccccccccgccgccggcaccgagucccucaucuccggcuggggcaacacccucuccuccggcgccgacuaccccgacgagcuccagugccucgacgcccccguccucucccaggccgagugcgaggccuccuaccccggcaagaucaccaacaacauguucugcgucggcuuccucgagggcggcaaggacuccugccagggcgacuccggcggccccgucgucuccaacggcgagcuccagggcaucgucuccuggggcuacggcugcgcccagaagaaccgccccggcgucuacaccaaggucuacaacuacgucgacuggaucaaggacaccaucgccgccaacuccuga

SEQ ID NO: 48194 - RNA, 843 nt, Artificial Sequence
  derived and/or modified sequence opt2 from PRSS33__Homo_sapiens__NP_690851
augcgcggcgucuccugccuccagguccuccuccuccucguccucggcgccgccggcacccagggccgcaaguccgccgccugcggccagccccgcauguccucccgcaucgucggcggccgcgacggccgcgacggcgaguggcccuggcaggccuccauccagcaccgcggcgcccacgucugcggcggcucccucaucgccccccaguggguccucaccgccgcccacugcuucccccgccgcgcccuccccgccgaguaccgcguccgccucggcgcccuccgccucggcuccaccuccccccgcacccucuccguccccguccgccgcguccuccucccccccgacuacuccgaggacggcgcccgcggcgaccucgcccuccuccagcuccgccgccccgucccccucuccgcccgcguccagcccgucugccuccccguccccggcgcccgccccccccccggcacccccugccgcgucaccggcuggggcucccuccgccccggcgucccccuccccgaguggcgcccccuccagggcguccgcgucccccuccucgacucccgcaccugcgacggccucuaccacgucggcgccgacgucccccaggccgagcgcaucguccuccccggcucccucugcgccggcuacccccagggccacaaggacgccugccagggcgacuccggcggcccccucaccugccuccaguccggcuccuggguccucgucggcgucgucuccuggggcaagggcugcgcccuccccaaccgccccggcgucuacaccuccgucgccaccuacucccccuggauccaggcccgcgucuccuucuga

SEQ ID NO: 48195 - RNA, 1242 nt, Artificial Sequence
  derived and/or modified sequence opt2 from PRSS35__Homo_sapiens__NP_001163894
auggagaacaugcuccucuggcucaucuucuucacccccggcuggacccucaucgacggcuccgagauggagugggacuucauguggcaccuccgcaaggucccccgcaucgucuccgagcgcaccuuccaccucaccucccccgccuucgaggccgacgccaagaugauggucaacaccgucugcggcaucgagugccagaaggagcuccccacccccucccucuccgagcucgaggacuaccucuccuacgagaccgucuucgagaacggcacccgcacccucacccgcgucaagguccaggaccucguccucgagcccacccagaacaucaccaccaagggcgucuccguccgccgcaagcgccaggucuacggcaccgacucccgcuucuccauccucgacaagcgcuuccucaccaacuuccccuucuccaccgccgucaagcucuccaccggcugcuccggcauccucaucuccccccagcacguccucaccgccgcccacugcguccacgacggcaaggacuacgucaagggcuccaagaagcuccgcgucggccuccucaagaugcgcaacaaguccggcggcaagaagcgccgcggcuccaagcgcucccgccgcgaggccuccggcggcgaccagcgcgagggcacccgcgagcaccuccgcgagcgcgccaagggcggccgccgccgcaagaaguccggccgcggccagcgcaucgccgagggccgccccuccuuccaguggacccgcgucaagaacacccacauccccaagggcugggcccgcggcggcaugggcgacgccacccucgacuacgacuacgcccuccucgagcucaagcgcgcccacaagaagaaguacauggagcucggcaucucccccaccaucaagaagaugcccggcggcaugauccacuucuccggcuucgacaacgaccgcgccgaccagcucgucuaccgcuucugcuccgucuccgacgaguccaacgaccuccucuaccaguacugcgacgccgaguccggcuccaccggcuccggcgucuaccuccgccucaaggaccccgacaagaagaacuggaagcgcaagaucaucgccgucuacuccggccaccagugggucgacguccacggcguccagaaggacuacaacgucgccguccgcaucaccccccucaaguacgcccagaucugccucuggauccacggcaacgacgccaacugcgccuacggcuga

SEQ ID NO: 48196 - RNA, 786 nt, Artificial Sequence
  derived and/or modified sequence opt2 from PRSS3__Homo_sapiens__NP_001184026
augcacaugcgcgagaccuccggcuucacccucaagaagggccgcuccgccccccucgucuuccacccccccgacgcccucaucgccguccccuucgacgacgacgacaagaucgucggcggcuacaccugcgaggagaacucccuccccuaccaggucucccucaacuccggcucccacuucugcggcggcucccucaucuccgagcagugggucgucuccgccgcccacugcuacaagacccgcauccagguccgccucggcgagcacaacaucaagguccucgagggcaacgagcaguucaucaacgccgccaagaucauccgccaccccaaguacaaccgcgacacccucgacaacgacaucaugcucaucaagcucuccucccccgccgucaucaacgcccgcgucuccaccaucucccuccccaccgccccccccgccgccggcaccgagugccucaucuccggcuggggcaacacccucuccuucggcgccgacuaccccgacgagcucaagugccucgacgcccccguccucacccaggccgagugcaaggccuccuaccccggcaagaucaccaacuccauguucugcgucggcuuccucgagggcggcaaggacuccugccagcgcgacuccggcggccccgucgucugcaacggccagcuccagggcgucgucuccuggggccacggcugcgccuggaagaaccgccccggcgucuacaccaaggucuacaacuacgucgacuggaucaaggacaccaucgccgccaacuccuga

SEQ ID NO: 48197 - RNA, 1158 nt, Artificial Sequence
  derived and/or modified sequence opt2 from PRSS50__Homo_sapiens__NP_037402
augggccgcuggugccagaccgucgcccgcggccagcgcccccgcaccuccgcccccucccgcgccggcgcccuccuccuccuccuccuccuccuccgcuccgccggcugcuggggcgccggcgaggcccccggcgcccucuccaccgccgaccccgccgaccaguccguccagugcguccccaaggccaccugccccuccucccgcccccgccuccucuggcagacccccaccacccagacccuccccuccaccaccauggagacccaguuccccgucuccgagggcaaggucgaccccuaccgcuccugcggcuucuccuacgagcaggaccccacccuccgcgaccccgaggccgucgcccgccgcuggcccuggauggucuccguccgcgccaacggcacccacaucugcgccggcaccaucaucgccucccaguggguccucaccgucgcccacugccucaucuggcgcgacgucaucuacuccguccgcgucggcucccccuggaucgaccagaugacccagaccgccuccgacguccccguccuccaggucaucaugcacucccgcuaccgcgcccagcgcuucugguccugggucggccaggccaacgacaucggccuccucaagcucaagcaggagcucaaguacuccaacuacguccgccccaucugccuccccggcaccgacuacguccucaaggaccacucccgcugcaccgucaccggcuggggccucuccaaggccgacggcauguggccccaguuccgcaccauccaggagaaggaggucaucauccucaacaacaaggagugcgacaacuucuaccacaacuucaccaagauccccacccucguccagaucaucaagucccagaugaugugcgccgaggacacccaccgcgagaaguucugcuacgagcucaccggcgagccccucgucugcuccauggagggcaccugguaccucgucggccucgucuccuggggcgccggcugccagaaguccgaggccccccccaucuaccuccaggucuccuccuaccagcacuggaucugggacugccucaacggccaggcccucgcccuccccgcccccucccgcacccuccuccucgcccucccccucccccucucccuccucgccgcccucuga

SEQ ID NO: 48198 - RNA, 1662 nt, Artificial Sequence
  derived and/or modified sequence opt2 from PRSS53__Homo_sapiens__NP_001034592
augaaguggugcuggggccccguccuccucaucgccggcgccaccguccucauggagggccuccaggccgcccagcgcgccugcggccagcgcggccccggcccccccaagccccaggagggcaacaccguccccggcgaguggcccuggcaggccuccguccgccgccagggcgcccacaucugcuccggcucccucgucgccgacaccuggguccucaccgccgcccacugcuucgagaaggccgccgccaccgagcucaacuccugguccgucguccucggcucccuccagcgcgagggccucucccccggcgccgaggaggucggcgucgccgcccuccagcucccccgcgccuacaaccacuacucccagggcuccgaccucgcccuccuccagcucgcccaccccaccacccacaccccccucugccucccccagcccgcccaccgcuuccccuucggcgccuccugcugggccaccggcugggaccaggacaccuccgacgcccccggcacccuccgcaaccuccgccuccgccucaucucccgccccaccugcaacugcaucuacaaccagcuccaccagcgccaccucuccaaccccgcccgccccggcaugcucugcggcggcccccagcccggcguccagggccccugccagggcgacuccggcggccccguccucugccucgagcccgacggccacuggguccaggccggcaucaucuccuucgccuccuccugcgcccaggaggacgcccccguccuccucaccaacaccgccgcccacuccuccuggcuccaggcccgcguccagggcgccgccuuccucgcccagucccccgagacccccgagauguccgacgaggacuccugcgucgccugcggcucccuccgcaccgccggcccccaggccggcgcccccucccccuggcccugggaggcccgccucaugcaccagggccagcucgccugcggcggcgcccucgucuccgaggaggccguccucaccgccgcccacugcuucaucggccgccaggcccccgaggagugguccgucggccucggcacccgccccgaggaguggggccucaagcagcucauccuccacggcgccuacacccaccccgagggcggcuacgacauggcccuccuccuccucgcccagcccgucacccucggcgccucccuccgcccccucugccuccccuaccccgaccaccaccuccccgacggcgagcgcggcuggguccucggccgcgcccgccccggcgccggcaucuccucccuccagaccguccccgucacccuccucggcccccgcgccugcucccgccuccacgccgcccccggcggcgacggcucccccauccuccccggcauggucugcaccuccgccgucggcgagcuccccuccugcgagggccucuccggcgccccccucguccacgagguccgcggcaccugguuccucgccggccuccacuccuucggcgacgccugccagggccccgcccgccccgccgucuucaccgcccuccccgccuacgaggacugggucuccucccucgacuggcaggucuacuucgccgaggagcccgagcccgaggccgagcccggcuccugccucgccaacaucucccagcccaccuccugcuga

SEQ ID NO: 48199 - RNA, 831 nt, Artificial Sequence
  derived and/or modified sequence opt2 from PRSS55__Homo_sapiens__NP_001183949
augcuccucuucuccguccuccuccuccucucccucgucaccggcacccagcucggcccccgcaccccccuccccgaggccggcgucgccauccucggccgcgcccgcggcgcccaccgcccccagcccccccacccccccucccccgucuccgagugcggcgaccgcuccaucuucgagggccgcacccgcuacucccgcaucaccggcggcauggaggccgaggucggcgaguuccccuggcaggucuccauccaggcccgcuccgagcccuucugcggcggcuccauccucaacaagugguggauccucaccgccgcccacugccucuacuccgaggagcucuuccccgaggagcucuccgucguccucggcaccaacgaccucaccucccccuccauggagaucaaggaggucgccuccaucauccuccacaaggacuucaagcgcgccaacauggacaacgacaucgcccuccuccuccucgccucccccaucaagcucgacgaccucaagguccccaucugccuccccacccagcccggccccgccaccuggcgcgagugcugggucgccggcuggggccagaccaacgccgccgacaagaacuccgucaagaccgaccucaugaaggcccccauggucaucauggacugggaggagugcuccaagauguuccccaagcucaccaagaacaugcucugcgccggcuacaagaacgaguccuacgacgccugcaagcaguccuacuuccccacccuccagcgcaugaacaccggcuccucccagaccaagccccccggcucccacaccuuccaccuccagaacuga

SEQ ID NO: 48200 - RNA, 852 nt, Artificial Sequence
  derived and/or modified sequence opt2 from PRSS57__Homo_sapiens__NP_999875
augggccucggccuccgcggcuggggccgcccccuccucaccgucgccaccgcccucaugcuccccgucaagccccccgccggcuccuggggcgcccagaucaucggcggccacgaggucaccccccacucccgccccuacauggccuccguccgcuucggcggccagcaccacugcggcggcuuccuccuccgcgcccgcugggucgucuccgccgcccacugcuucucccaccgcgaccuccgcaccggccucgucguccucggcgcccacguccucuccaccgccgagcccacccagcaggucuucggcaucgacgcccucaccacccaccccgacuaccaccccaugacccacgccaacgacaucugccuccuccgccucaacggcuccgccguccucggccccgccgucggccuccuccgccuccccggccgccgcgcccgcccccccaccgccggcacccgcugccgcgucgccggcuggggcuucgucuccgacuucgaggagcucccccccggccucauggaggccaagguccgcguccucgaccccgacgucugcaacuccuccuggaagggccaccucacccucaccaugcucugcacccgcuccggcgacucccaccgccgcggcuucugcuccgccgacuccggcggcccccucgucugccgcaaccgcgcccacggccucgucuccuucuccggccucuggugcggcgaccccaagacccccgacgucuacacccaggucuccgccuucgucgccuggaucugggacgucguccgccgcuccuccccccagcccggcccccuccccggcaccacccgcccccccggcgaggccgccuga

SEQ ID NO: 48201 - RNA, 726 nt, Artificial Sequence
  derived and/or modified sequence opt2 from PRSS58__Homo_sapiens__NP_001001317
augaaguucauccuccucugggcccuccucaaccucaccgucgcccucgccuucaaccccgacuacaccgucuccuccaccccccccuaccucgucuaccucaaguccgacuaccuccccugcgccggcguccucauccacccccucugggucaucaccgccgcccacugcaaccuccccaagcuccgcgucauccucggcgucaccauccccgccgacuccaacgagaagcaccuccaggucaucggcuacgagaagaugauccaccacccccacuucuccgucaccuccaucgaccacgacaucaugcucaucaagcucaagaccgaggccgagcucaacgacuacgucaagcucgccaaccuccccuaccagaccaucuccgagaacaccaugugcuccgucuccaccugguccuacaacgucugcgacaucuacaaggagcccgacucccuccagaccgucaacaucuccgucaucuccaagccccagugccgcgacgccuacaagaccuacaacaucaccgagaacaugcucugcgucggcaucguccccggccgccgccagcccugcaaggaggucuccgccgcccccgccaucugcaacggcaugcuccagggcauccucuccuucgccgacggcugcguccuccgcgccgacgucggcaucuacgccaagaucuucuacuacauccccuggaucgagaacgucauccagaacaacuga

SEQ ID NO: 48202 - RNA, 1032 nt, Artificial Sequence
  derived and/or modified sequence opt2 from PRSS8__Homo_sapiens__NP_002764
auggcccagaagggcguccucggccccggccagcucggcgccgucgccauccuccucuaccucggccuccuccgcuccggcaccggcgccgagggcgccgaggcccccugcggcgucgccccccaggcccgcaucaccggcggcuccuccgccgucgccggccaguggcccuggcaggucuccaucaccuacgagggcguccacgucugcggcggcucccucgucuccgagcaguggguccucuccgccgcccacugcuuccccuccgagcaccacaaggaggccuacgaggucaagcucggcgcccaccagcucgacuccuacuccgaggacgccaaggucuccacccucaaggacaucaucccccaccccuccuaccuccaggagggcucccagggcgacaucgcccuccuccagcucucccgccccaucaccuucucccgcuacauccgccccaucugccuccccgccgccaacgccuccuuccccaacggccuccacugcaccgucaccggcuggggccacgucgcccccuccgucucccuccucacccccaagccccuccagcagcucgaggucccccucaucucccgcgagaccugcaacugccucuacaacaucgacgccaagcccgaggagccccacuucguccaggaggacauggucugcgccggcuacgucgagggcggcaaggacgccugccagggcgacuccggcggcccccucuccugccccgucgagggccucugguaccucaccggcaucgucuccuggggcgacgccugcggcgcccgcaaccgccccggcgucuacacccucgccuccuccuacgccuccuggauccaguccaaggucaccgagcuccagccccgcgucgucccccagacccaggagucccagcccgacuccaaccucugcggcucccaccucgccuucuccuccgcccccgcccagggccuccuccgccccauccucuuccucccccucggccucgcccucggccuccucucccccuggcucuccgagcacuga

SEQ ID NO: 48203 - RNA, 573 nt, Artificial Sequence
  derived and/or modified sequence opt2 from PRTFDC1__Homo_sapiens__NP_001269715
auggccggcuccuccgaggaggcccccgacuacggccgcggcgucgucaucauggacgacuggcccggcuacgaccucaaccucuucaccuacccccagcacuacuacggcgaccucgaguacguccucaucccccacggcaucaucgucgaccgcaucgagcgccucgccaaggacaucaugaaggacaucggcuacuccgacaucaugguccucugcguccucaagggcggcuacaaguucugcgccgaccucgucgagcaccucaagaacaucucccgcaacuccgaccgcuucgucuccaugaaggucgacuucauccgccucaaguccuaccgcaacgaccaguccaugggcgagaugcagaucaucggcggcgacgaccucuccacccucgccggcaagaacguccucaucgucgaggacgucgucggcaccggccgcaccaugaaggcccuccucuccaacaucgagaaguacaagcccaacaugaucaaggucgccucccuccucgucaagcgcaccucccgcuccgacggcuuccgccccgacucccacaugcgccaccaguga

SEQ ID NO: 48204 - RNA, 3453 nt, Artificial Sequence
  derived and/or modified sequence opt2 from PRTG__Homo_sapiens__NP_776175
auggcccccccccuccgcccccucgcccgccuccgcccccccggcaugcuccuccgcgcccuccuccuccuccuccuccucuccccccuccccggcgucuggugcuucuccgagcucuccuucgucaaggagccccaggacgucaccgucacccgcaaggaccccgucguccucgacugccaggcccacggcgagguccccaucaaggucaccuggcucaagaacggcgccaagauguccgagaacaagcgcaucgagguccucuccaacggcucccucuacaucuccgaggucgagggccgccgcggcgagcaguccgacgagggcuucuaccagugccucgccaugaacaaguacggcgccauccucucccagaaggcccaccucgcccucuccaccaucuccgccuucgagguccagcccaucuccaccgagguccacgagggcggcgucgcccgcuucgccugcaagaucuccucccacccccccgccgucaucaccugggaguucaaccgcaccacccuccccaugaccauggaccgcaucaccgcccuccccaccggcguccuccagaucuacgacgucucccagcgcgacuccggcaacuaccgcugcaucgccgccaccgucgcccaccgccgcaaguccauggaggccucccucaccgucauccccgccaaggaguccaaguccuuccacacccccaccaucaucgccggcccccagaacaucaccaccucccuccaccagaccgucguccucgagugcauggccaccggcaaccccaagcccaucaucuccuggucccgccucgaccacaaguccaucgacgucuucaacacccgcguccucggcaacggcaaccucaugaucuccgacguccgccuccagcacgccggcgucuacgucugccgcgccaccacccccggcacccgcaacuucaccgucgccauggccacccucaccguccucgccccccccuccuucgucgaguggcccgagucccucacccgcccccgcgccggcaccgcccgcuucgucugccaggccgagggcauccccucccccaagauguccuggcucaagaacggccgcaagauccacuccaacggccgcaucaagauguacaacuccaagcucgucaucaaccagaucauccccgaggacgacgccaucuaccagugcauggccgagaacucccagggcuccauccucucccgcgcccgccucaccgucgucauguccgaggaccgccccuccgcccccuacaacguccacgccgagaccauguccuccuccgccauccuccucgccugggagcgcccccucuacaacuccgacaaggucaucgccuacuccguccacuacaugaaggccgagggccucaacaacgaggaguaccaggucgucaucggcaacgacaccacccacuacaucaucgacgaccucgagcccgccuccaacuacaccuucuacaucgucgccuacaugcccaugggcgccucccagauguccgaccacgucacccagaacacccucgaggacgucccccuccgcccccccgagaucucccucaccucccgcucccccaccgacauccucaucuccuggcuccccauccccgccaaguaccgccgcggccaggucguccucuaccgccucuccuuccgccucuccaccgagaacuccauccagguccucgagcuccccggcaccacccacgaguaccuccucgagggccucaagcccgacuccgucuaccucguccgcaucaccgccgccacccgcgucggccucggcgaguccuccgucuggaccucccaccgcacccccaaggccaccuccgucaaggcccccaagucccccgagcuccaccucgagccccucaacugcaccaccaucuccguccgcuggcagcaggacgucgaggacaccgccgccauccagggcuacaagcucuacuacaaggaggagggccagcaggagaacggccccaucuuccucgacaccaaggaccuccucuacacccucuccggccucgacccccgccgcaaguaccacguccgccuccucgccuacaacaacaucgacgacggcuaccaggccgaccagaccgucuccacccccggcugcgucuccguccgcgaccgcaugguccccccccccccccccccccaccaccucuacgccaaggccaacaccuccuccuccaucuuccuccacuggcgccgccccgccuucaccgccgcccagaucaucaacuacaccauccgcugcaaccccgucggccuccagaacgccucccucguccucuaccuccagaccuccgagacccacaugcucguccagggccucgagcccaacaccaaguacgaguucgccguccgccuccacgucgaccagcucuccucccccuggucccccgucgucuaccacuccacccuccccgaggcccccgccggcccccccgucggcgucaaggucacccucaucgaggacgacaccgcccucgucuccuggaagccccccgacggccccgagaccgucgucacccgcuacaccauccucuacgccucccgcaaggccuggaucgccggcgaguggcagguccuccaccgcgagggcgccaucaccauggcccuccucgagaaccucgucgccggcaacgucuacaucgucaagaucuccgccuccaacgaggucggcgagggccccuucuccaacuccgucgagcucgccguccuccccaaggagaccuccgaguccaaccagcgccccaagcgccucgacuccgccgacgccaaggucuacuccggcuacuaccaccucgaccagaaguccaugaccggcaucgccgucggcgucggcaucgcccucaccugcauccucaucugcguccucauccucaucuaccgcuccaaggcccgcaaguccuccgccuccaagaccgcccagaacggcacccagcagcucccccgcaccuccgccucccucgccuccggcaacgaggucggcaagaaccucgagggcgccgucggcaacgaggagucccucaugcccaugaucaugcccaacuccuucaucgacgccaagggcggcaccgaccucaucaucaacuccuacggccccaucaucaagaacaacuccaagaagaagugguucuucuuccaggacuccaagaagauccaggucgagcagccccagcgccgcuucacccccgccgucugcuucuaccagcccggcaccaccguccucaucuccgacgaggacucccccuccucccccggccagaccaccuccuucucccgccccuucggcgucgccgccgacaccgagcacuccgccaacuccgagggcucccacgagaccggcgacuccggccgcuucucccacgaguccaacgacgagauccaccucuccuccgucaucuccaccaccccccccaaccucuga

SEQ ID NO: 48205 - RNA, 771 nt, Artificial Sequence
  derived and/or modified sequence opt2 from PRTN3__Homo_sapiens__NP_002768
auggcccaccgcccccccucccccgcccucgccuccguccuccucgcccuccuccucuccggcgccgcccgcgccgccgagaucgucggcggccacgaggcccagccccacucccgccccuacauggccucccuccagaugcgcggcaaccccggcucccacuucugcggcggcacccucauccaccccuccuucguccucaccgccgcccacugccuccgcgacaucccccagcgccucgucaacgucguccucggcgcccacaacguccgcacccaggagcccacccagcagcacuucuccgucgcccaggucuuccucaacaacuacgacgccgagaacaagcucaacgacguccuccucauccagcucuccucccccgccaaccucuccgccuccgucgccaccguccagcucccccagcaggaccagcccgucccccacggcacccagugccucgccaugggcuggggccgcgucggcgcccacgacccccccgcccagguccuccaggagcucaacgucaccgucgucaccuucuucugccgcccccacaacaucugcaccuucgucccccgccgcaaggccggcaucugcuucggcgacuccggcggcccccucaucugcgacggcaucauccagggcaucgacuccuucgucaucuggggcugcgccacccgccucuuccccgacuucuucacccgcgucgcccucuacgucgacuggauccgcuccacccuccgccgcgucgaggccaagggccgccccuga

SEQ ID NO: 48206 - RNA, 9267 nt, Artificial Sequence
  derived and/or modified sequence opt2 from PRUNE2__Homo_sapiens__NP_056040
auggaggaguuccuccagcgcgccaaguccaagcucaaccgcuccaagcgccucgagaagguccacgucgucaucggccccaaguccugcgaccucgacucccucaucuccaccuucaccuacgccuacuuccucgacaaggucuccccccccggcguccucugccuccccguccucaacaucccccgcaccgaguucaacuacuucaccgagacccgcuucauccucgaggagcucaacaucuccgaguccuuccacaucuuccgcgacgagaucaaccuccaccagcucaacgacgagggcaagcucuccaucacccucgucggcuccuccguccucgccuccgaggacaagacccucgaguccgccgucgucaaggucaucaaccccgucgagcaguccgacgccaacgucgaguuccgcgaguccuccuccucccucguccucaaggagauccuccaggaggcccccgagcucaucaccgagcagcucgcccaccgccuccgcggcuccauccucuucaaguggaugaccauggaguccgagaagaucuccgagaagcaggaggagauccucuccauccucgaggagaaguuccccaaccuccccccccgcgaggacaucaucaacguccuccaggagacccaguucuccgcccagggccucuccaucgagcagaccaugcucaaggaccucaaggagcucuccgacggcgagaucaaggucgccaucuccaccgucuccaugaaccucgagaacugccucuuccacuccaacaucaccuccgaccucaaggccuucaccgacaaguucggcuucgacguccucauccucuucuccuccuaccucuccgaggagcagcagccccgccgccagaucgccgucuacuccgagaacauggagcucugcucccagaucugcugcgagcucgaggagugccagaaccccugccucgagcucgagcccuucgacugcggcugcgacgagauccucgucuaccagcaggaggaccccuccgucaccugcgaccaggucguccucgucgucaaggaggucaucaaccgccgcugccccgagauggucuccaacucccgcaccuccuccaccgaggccgucgccggcuccgccccccucucccagggcuccuccggcaucauggagcucuacggcuccgacaucgagccccagcccuccuccgucaacuucaucgagaacccccccgaccucaacgacuccaaccaggcccaggucgacgccaacgucgaccucgucucccccgacuccggccucgccaccauccgcuccucccgcuccuccaaggaguccuccgucuuccucuccgacgacucccccgucggcgagggcgccggcccccaccacacccuccuccccggccucgacuccuacucccccauccccgagggcgccgucgccgaggagcacgccugguccggcgagcacggcgagcacuucgaccucuucaacuucgaccccgcccccauggccuccggccagucccagcaguccucccacuccgccgacuacucccccgccgacgacuucuuccccaacuccgaccucuccgagggccagcuccccgccggccccgagggccucgacggcaugggcaccaacauguccaacuacuccuccuccucccuccucuccggcgccggcaaggacucccucgucgagcacgacgaggaguucguccagcgccaggacuccccccgcgacaacuccgagcgcaaccucucccucaccgacuucgucggcgacgagucccccucccccgagcgccucaagaacaccggcaagcgcaucccccccacccccaugaacucccucgucgaguccucccccuccaccgaggagcccgccucccucuacaccgaggacaugacccagaaggccaccgacaccggccacaugggccccccccagacccacgcccgcugcuccuccugguggggcggccucgagaucgacuccaagaacaucgccgacgccugguccuccuccgagcaggaguccgucuuccagucccccgaguccuggaaggagcacaagcccuccuccaucgaccgccgcgccuccgacuccgucuuccagcccaagucccucgaguucaccaaguccggccccugggaguccgaguucggccagcccgagcucggcuccaacgacauccaggacaagaacgaggagucccuccccuuccagaaccuccccauggagaaguccccccuccccaacaccuccccccagggcaccaaccaccucaucgaggacuucgccucccucuggcacuccggccgcucccccaccgccaugcccgagcccuggggcaaccccaccgacgacggcgagcccgccgccgucgcccccuuccccgccugguccgccuucggcaaggaggaccacgacgaggcccucaagaacaccuggaaccuccaccccaccuccuccaagacccccuccguccgcgaccccaacgagugggccauggccaaguccggcuucgccuucuccuccuccgagcuccucgacaacucccccuccgagaucaacaacgaggccgcccccgagaucuggggcaagaagaacaacgacucccgcgaccacaucuucgcccccggcaaccccuccuccgaccucgaccacaccuggaccaacuccaagccccccaaggaggaccagaacggccucgucgaccccaagacccgcggcaaggucuacgagaaggucgacuccuggaaccucuucgaggagaacaugaagaagggcggcuccgacguccucguccccugggaggacuccuuccucuccuacaagugcuccgacuacuccgccuccaaccucggcgaggacuccguccccuccccccucgacaccaacuacuccaccuccgacuccuacaccucccccaccuucgccggcgacgagaaggagaccgagcacaagcccuucgccaaggaggagggcuucgaguccaaggacggcaacuccaccgccgaggagaccgacauccccccccagucccuccagcaguccucccgcaaccgcaucuccuccggccccggcaaccucgacaugugggccuccccccacaccgacaacuccuccgagaucaacaccacccacaaccucgacgagaacgagcucaagaccgagcacaccgacggcaagaacaucuccauggaggacgacgucggcgaguccucccaguccuccuacgacgaccccuccaugaugcagcucuacaacgagaccaaccgccagcucacccuccuccacuccuccaccaacucccgccagaccgcccccgacucccucgaccucuggaaccgcgucauccucgaggacacccaguccaccgccaccaucuccgacauggacaacgaccucgacugggacgacugcuccggcggcgccgccauccccuccgacggccagaccgagggcuacauggccgagggcuccgagcccgagacccgcuucaccguccgccagcucgagcccuggggccucgaguaccaggaggccaaccaggucgacugggagcuccccgccuccgacgagcacaccaaggacuccgcccccuccgagcaccacacccucaacgagaaguccggccagcucaucgccaacuccaucugggacuccgucaugcgcgacaaggacauguccuccuucaugcuccccggcuccucccacaucaccgacuccgagcagcgcgagcucccccccgagauccccucccacuccgccaacgucaaggacacccacucccccgacgcccccgccgccuccggcaccuccgaguccgaggcccucaucucccaccucgacaagcaggacaccgagcgcgagacccuccaguccgacgccgccucccucgccacccgccucgagaaccccggcuacuucccccaccccgaccccuggaagggccacggcgacggccaguccgaguccgagaaggaggcccagggcgccaccgaccgcggccaccucgacgaggaggaggucaucgccuccggcgucgagaacgccuccggcaucuccgagaagggccaguccgaccaggagcucuccucccucgucgccuccgagcaccaggagaucugcaucaaguccggcaagaucuccucccucgccgucaccuucuccccccagaccgaggagcccgaggagguccucgaguacgaggagggcuccuacaaccucgacucccgcgacguccagaccggcauguccgccgacaaccuccagcccaaggacacccacgagaagcaccucaugucccagcgcaacuccggcgagaccaccgagaccuccgacggcaugaacuucaccaaguacgucuccguccccgagaaggaccucgagaagaccgaggagugcaacuuccucgagcccgagaacgucggcggcggccccccccaccgcgucccccgcucccucgacuucggcgacguccccaucgacuccgacguccacgucuccuccaccugcuccgagaucaccaagaaccucgacgucaagggcuccgagaacucccuccccggcgccggcuccuccggcaacuucgaccgcgacaccaucuccuccgaguacacccacuccuccgccuccucccccgagcucaacgacuccuccgucgcccucuccuccuggggccagcagcccuccuccggcuaccaggaggagaaccagggcaacugguccgagcagaaccaccaggaguccgagcucaucaccaccgacggccaggucgagaucgucaccaaggucaaggaccucgagaagaaccgcaucaacgaguucgagaaguccuucgaccgcaagacccccaccuuccucgagaucuggaacgacuccgucgacggcgacuccuucuccucccucuccucccccgagaccggcaaguacuccgagcacuccggcacccaccaggaguccaaccucaucgccuccuaccaggagaagaacgagcacgacaucuccgccaccguccagcccgaggacgcccgcgucaucuccaccuccuccggcuccgacgacgacuccgucggcggcgaggaguccaucgaggaggagauccaggucgccaacugccacgucgccgaggacgagucccgcgccugggacucccucaacgaguccaacaaguuccucgucaccgccgaccccaaguccgagaacaucuacgacuaccucgacuccuccgagcccgccgagaacgagaacaaguccaaccccuucugcgacaaccagcaguccucccccgaccccuggaccuucuccccccucaccgagaccgagaugcagaucaccgccgucgagaaggagaagcgcuccucccccgagaccggcaccaccggcgacgucgccuggcagaucucccccaaggccuccuuccccaagaacgaggacaacucccagcucgagaugcucggcuucuccgccgacuccaccgagugguggaaggccuccccccaggagggccgccucaucgagucccccuucgagcgcgagcucuccgacuccuccggcguccucgagaucaacuccuccguccaccagaacgccucccccuggggcguccccguccagggcgacaucgagcccgucgagacccacuacaccaaccccuucuccgacaaccaccagucccccuuccucgagggcaacggcaagaacucccacgagcagcucuggaacauccagccccgccagcccgaccccgacgccgacaaguucucccagcucgucaagcucgaccagaucaaggagaaggacucccgcgagcagaccuucgucuccgccgccggcgacgagcucacccccgagacccccacccaggagcagugccaggacaccaugcuccccgucugcgaccaccccgacaccgccuucacccacgccgaggagaacuccugcgucaccuccaacgucuccaccaacgagggccaggagaccaaccagugggagcaggagaaguccuaccucggcgagaugaccaacuccuccaucgccaccgagaacuuccccgccgucuccucccccacccagcucaucaugaagcccggcuccgagugggacggcuccacccccuccgaggacucccgcggcaccuucguccccgacauccuccacggcaacuuccaggagggcggccagcucgccuccgccgcccccgaccucuggaucgacgccaagaagcccuucucccucaaggccgacggcgagaaccccgacauccucacccacugcgagcacgacuccaacucccaggccuccgacucccccgacaucugccacgacuccgaggccaagcaggagaccgagaagcaccucuccgccugcaugggccccgaggucgaguccuccgagcucugccucaccgagcccgagaucgacgaggagcccaucuacgagcccggccgcgaguucguccccuccaacgccgagcucgacuccgagaacgccaccguccucccccccaucggcuaccaggccgacaucaagggcuccucccagcccgccucccacaagggcucccccgagcccuccgagaucaacggcgacaacuccaccggccuccaggucuccgagaagggcgccucccccgacauggcccccauccucgagcccgucgaccgccgcaucccccgcaucgagaacgucgccaccuccaucuucgucacccaccaggagcccacccccgagggcgacggcuccuggaucuccgacuccuucucccccgagucccagcccggcgcccgcgcccucuucgacggcgacccccaccucuccaccgagaaccccgcccucguccccgacgcccuccucgccuccgacaccugccucgacaucuccgaggccgccuucgaccacuccuucuccgacgccuccggccucaacaccuccaccggcaccaucgacgacauguccaagcucacccucuccgagggccaccccgagacccccgucgacggcgaccucggcaagcaggacaucugcuccuccgaggccuccuggggcgacuucgaguacgacgucaugggccagaacaucgacgaggaccuccuccgcgagcccgagcacuuccucuacggcggcgaccccccccucgaggaggacucccucaagcagucccucgcccccuacaccccccccuucgaccucuccuaccucaccgagcccgcccaguccgccgagaccaucgaggaggccggcucccccgaggacgagucccucggcugccgcgccgccgagaucguccucuccgcccuccccgaccgccgcuccgagggcaaccaggccgagaccaagaaccgccuccccggcucccagcucgccguccuccacauccgcgaggaccccgaguccgucuaccuccccgucggcgccggcuccaacauccucucccccuccaacgucgacugggaggucgagaccgacaacuccgaccuccccgccggcggcgacaucggcccccccaacggcgccuccaaggagaucuccgagcucgaggaggagaagaccauccccaccaaggagcccgagcagaucaaguccgaguacaaggaggagcgcugcaccgagaagaacgaggaccgccacgcccuccacauggacuacauccucgucaaccgcgaggagaacucccacuccaagcccgagaccugcgaggagcgcgaguccaucgccgagcucgagcucuacgucggcuccaaggagaccggccuccagggcacccagcucgccuccuuccccgacaccugccagcccgccucccucaacgagcgcaagggccucuccgccgagaagauguccuccaaguccgacacccgcuccuccuucgagucccccgcccaggaccaguccuggauguuccucggccacuccgaggucggcgaccccucccucgacgcccgcgacuccggccccggcugguccggcaagaccgucgagcccuucuccgagcucggccucggcgagggcccccagcuccagauccucgaggagaugaagccccucgagucccucgcccucgaggaggccuccggccccgucucccagucccagaaguccaagucccgcggccgcgccggccccgacgccgucacccuccaggccgucacccacgacaacgagugggagaugcucuccccccagcccguccagaagaacaugauccccgacaccgagauggaggaggagaccgaguuccucgagcucggcacccgcaucucccgccccaacggccuccucuccgaggacgucggcauggacauccccuucgaggagggcguccucucccccuccgccgccgacaugcgccccgagccccccaacucccucgaccucaacgacacccacccccgccgcaucaagcucaccgcccccaacaucaaccucucccucgaccaguccgagggcuccauccucuccgacgacaaccucgacucccccgacgagaucgacaucaacgucgacgagcucgacacccccgacgaggccgacuccuucgaguacaccggccacgaccccaccgccaacaaggacuccggccaggaguccgaguccauccccgaguacaccgccgaggaggagcgcgaggacaaccgccucuggcgcaccgucgucaucggcgagcaggagcagcgcaucgacaugaaggucaucgagcccuaccgccgcgucaucucccacggcggcuacuacggcgacggccucaacgccaucaucgucuucgccgccugcuuccuccccgacuccucccgcgccgacuaccacuacgucauggagaaccucuuccucuacgucaucuccacccucgagcucauggucgccgaggacuacaugaucgucuaccucaacggcgccaccccccgccgccgcaugcccggccucggcuggaugaagaagugcuaccagaugaucgaccgccgccuccgcaagaaccucaaguccuucaucaucguccaccccuccugguucauccgcaccauccucgccgucacccgccccuucaucuccuccaaguucuccuccaagaucaaguacgucaacucccucuccgagcucuccggccucauccccauggacugcauccacauccccgaguccaucaucaagcucgacgaggagcuccgcgaggccuccgaggccgccaagaccuccugccucuacaacgaccccgagauguccuccauggagaaggacaucgaccucaagcucaaggagaagcccuga

SEQ ID NO: 48207 - RNA, 816 nt, Artificial Sequence
  derived and/or modified sequence opt2 from PRUNE__Homo_sapiens__NP_001290158
auggaccucaagaucggcaaggccacccccaaggacuccaaguacgucgagaagcucgaggcccucuuccccgaccuccccaagcgcaacgacaucuucgacucccuccagaaggccaaguucgacgucuccggccucaccaccgagcagaugcuccgcaaggaccagaagaccaucuaccgccagggcgucaaggucgccaucuccgccaucuacauggaccucgaggccuuccuccagcgcuccaaccuccucgccgaccuccacgccuucugccaggcccacuccuacgacguccucgucgccaugaccaucuucuucaacacccacaacgagcccguccgccagcucgccaucuucugcccccacgucgcccuccagaccaccaucugcgagguccucgagcgcucccacucccccccccucaagcucacccccgccuccuccacccaccccaaccuccacgccuaccuccagggcaacacccaggucucccgcaagaagcuccucccccuccuccaggaggcccucuccgccuacuucgacuccaugaagauccccuccggccagcccgagaccgccgacgucucccgcgagcaggucgacaaggagcucgaccgcgccuccaacucccucaucuccggccucucccaggacgaggaggaccccccccucccccccacccccaugaacucccucgucgacgagugcccccucgaccagggccuccccaagcucuccgccgaggccgucuucgagaagugcucccagaucucccucucccaguccaccaccgccucccucuccaagaaguga

SEQ ID NO: 48208 - RNA, 444 nt, Artificial Sequence
  derived and/or modified sequence opt2 from PRX__Homo_sapiens__NP_066007
auggaggcccgcucccgcuccgccgaggagcuccgccgcgccgagcucgucgagaucaucgucgagaccgaggcccagaccggcgucuccggcaucaacgucgccggcggcggcaaggagggcaucuucguccgcgagcuccgcgaggacucccccgccgcccgcucccucucccuccaggagggcgaccagcuccucuccgcccgcgucuucuucgagaacuucaaguacgaggacgcccuccgccuccuccagugcgccgagcccuacaaggucuccuucugccucaagcgcaccguccccaccggcgaccucgcccuccgccccggcaccgucuccggcuacgagaucaagggcccccgcgccaaggucgccaagcucguccgcguccucucccccgcccccgcccucgacugccccuccgaccccgucuccgcccccuga

SEQ ID NO: 48209 - RNA, 444 nt, Artificial Sequence
  derived and/or modified sequence opt2 from PRY__Homo_sapiens__XP_011529813
augggcgccaccggccucggcuuccuccucuccuggcgccaggacaaccucaacggcaccgacugccagggcugcaacauccucuacuucuccgagaccaccggcuccaugugcuccgagcucucccucaaccgcggccucgaggcccgccgcaagaaggaccucaaggacuccuuccucuggcgcuacggcaaggucggcugcaucucccucccccuccgcgagaugaccgccuggaucaaccccccccagaucuccgagaucuuccagggcuaccaccagcgcguccacggcgccgacgcccucucccuccagaccaacucccuccgcucccgccucuccucccagugccucggccaguccuuccuccuccgcacccucgagcgcggccgcggcuuccgcgcccucggcgacaucugcggccacguccacgaggaggacuga

SEQ ID NO: 48210 - RNA, 1584 nt, Artificial Sequence
  derived and/or modified sequence opt2 from PSAP__Homo_sapiens__NP_001035930
auguacgcccucuuccuccucgccucccuccucggcgccgcccucgccggccccguccucggccucaaggagugcacccgcggcuccgccgucuggugccagaacgucaagaccgccuccgacugcggcgccgucaagcacugccuccagaccgucuggaacaagcccaccgucaagucccuccccugcgacaucugcaaggacgucgucaccgccgccggcgacaugcucaaggacaacgccaccgaggaggagauccucgucuaccucgagaagaccugcgacuggcuccccaagcccaacauguccgccuccugcaaggagaucgucgacuccuaccuccccgucauccucgacaucaucaagggcgagaugucccgccccggcgaggucugcuccgcccucaaccucugcgagucccuccagaagcaccucgccgagcucaaccaccagaagcagcucgaguccaacaagauccccgagcucgacaugaccgaggucgucgcccccuucauggccaacaucccccuccuccucuacccccaggacggcccccgcuccaagccccagcccaaggacaacggcgacgucugccaggacugcauccagauggucaccgacauccagaccgccguccgcaccaacuccaccuucguccaggcccucgucgagcacgucaaggaggagugcgaccgccucggccccggcauggccgacaucugcaagaacuacaucucccaguacuccgagaucgccauccagaugaugaugcacaugcaggaccagcagcccaaggagaucugcgcccucgucggcuucugcgacgaggucaaggagaugcccaugcagacccucguccccgccaaggucgccuccaagaacgucauccccgcccucgagcucgucgagcccaucaagaagcacgagguccccgccaaguccgacgucuacugcgaggucugcgaguuccucgucaaggaggucaccaagcucaucgacaacaacaagaccgagaaggagauccucgacgccuucgacaagaugugcuccaagcuccccaagucccucuccgaggagugccaggaggucgucgacaccuacggcuccuccauccucuccauccuccucgaggaggucucccccgagcucgucugcuccaugcuccaccucugcuccggcacccgccuccccgcccucaccguccacgucacccagcccaaggacggcggcuucugcgaggucugcaagaagcucgucggcuaccucgaccgcaaccucgagaagaacuccaccaagcaggagauccucgccgcccucgagaagggcugcuccuuccuccccgaccccuaccagaagcagugcgaccaguucgucgccgaguacgagcccguccucaucgagauccucgucgaggucauggaccccuccuucgucugccucaagaucggcgccugccccuccgcccacaagccccuccucggcaccgagaagugcaucuggggccccuccuacuggugccagaacaccgagaccgccgcccagugcaacgccgucgagcacugcaagcgccacgucuggaacuga

SEQ ID NO: 48211 - RNA, 975 nt, Artificial Sequence
  derived and/or modified sequence opt2 from PSAT1__Homo_sapiens__NP_066977
auggacgccccccgccaggucgucaacuucggccccggccccgccaagcucccccacuccguccuccucgagauccagaaggagcuccucgacuacaagggcgucggcaucuccguccucgagaugucccaccgcuccuccgacuucgccaagaucaucaacaacaccgagaaccucguccgcgagcuccucgccguccccgacaacuacaaggucaucuuccuccagggcggcggcugcggccaguucuccgccgucccccucaaccucaucggccucaaggccggccgcugcgccgacuacgucgucaccggcgccugguccgccaaggccgccgaggaggccaagaaguucggcaccaucaacaucguccaccccaagcucggcuccuacaccaagauccccgaccccuccaccuggaaccucaaccccgacgccuccuacgucuacuacugcgccaacgagaccguccacggcgucgaguucgacuucauccccgacgucaagggcgccguccucgucugcgacauguccuccaacuuccucuccaagcccgucgacgucuccaaguucggcgucaucuucgccggcgcccagaagaacgucggcuccgccggcgucaccgucgucaucguccgcgacgaccuccucggcuucgcccuccgcgagugccccuccguccucgaguacaagguccaggccggcaacuccucccucuacaacaccccccccugcuucuccaucuacgucaugggccucguccucgaguggaucaagaacaacggcggcgccgccgccauggagaagcucuccuccaucaagucccagaccaucuacgagaucaucgacaacucccagggcuucuacgucuccgucggcggcauccgcgccucccucuacaacgccgucaccaucgaggacguccagaagcucgccgccuucaugaagaaguuccucgagaugcaccagcucuga

SEQ ID NO: 48212 - RNA, 345 nt, Artificial Sequence
  derived and/or modified sequence opt2 from PSCA__Homo_sapiens__NP_005663
auggccggccucgcccuccagcccggcaccgcccuccucugcuacuccugcaaggcccaggucuccaacgaggacugccuccaggucgagaacugcacccagcucggcgagcagugcuggaccgcccgcauccgcgccgucggccuccucaccgucaucuccaagggcugcucccucaacugcgucgacgacucccaggacuacuacgucggcaagaagaacaucaccugcugcgacaccgaccucugcaacgccuccggcgcccacgcccuccagcccgccgccgccauccucgcccuccuccccgcccucggccuccuccucuggggccccggccagcucuga

SEQ ID NO: 48213 - RNA, 3144 nt, Artificial Sequence
  derived and/or modified sequence opt2 from PSD3__Homo_sapiens__NP_056125
auggagggccgcuccgccgccgccgagaccuucgucugggucaacaacgccuccgcccacucccaguccgucgccaaggccaaguacgaguuccucuucggccgcuccgagggcaaggcccccgacaccuccgaccacggcggcuccacccuccucccccccaacgucaccaacgaguuccccgaguacggcaccauggaggagggcggcgagggccuccgcgccucccucgaguucgacggcgaggcccuccccugccacccccaggagcagcagggcguccagccccucaccggcugccacuccggccucgacuccgucaccgagggccccaaggacguccgcgaggcccccucccagucccaccucaaggagcagucccuccagcccaucgacucccucaucuccgcccucaaggccaccgaggcccgcaucaucuccggcacccuccaggccaccaagguccucgaccaggacgccgucuccuccuucuccguccagcaggucgagaaggagcucgacaccgccucccgcaagacccagcgcgucaacaagacccuccccgccggccagaagaaccuccccgagaucccccucuccgccgaggucaccaccgaggaguccuucuaccucuccauccagaaggaccucaccgcccuccucaccggcgacacccaggccgagaucucccagaucaugaacaacggccgcaagggcgccgucugcguccaggagcccuccugcccccucgccucccucggcuccuccgccgucaccugccacuccgccggcuccgucggcuuccucaaggagcagcgcuccgcccucggccgcgagcaccccggcggcugcgaccgcuccuccuccaugggccgccccggccgcgucaagcacgucgaguuccagggcgucgagauccucuggaccggcggcgacaagcgcgagacccagcaccccaucgacuucgagaccucccuccagcgcaccgccucccccgacuccaaggaguccuccaaggucccccgccaccucaucuccuccgccggccucugcaacuccuccucccucaccgagaacgucugggacgaguccuggaaggcccccuccgagcgccccggcaccuccuccggcaccuucucccccguccgccucgacgaguccggcgaggacgaggucuuccuccaggagaacaagcagcaccucgagaagacccccaagcccgagcgcgaccgcgagcgcaucuccgagcaggaggagcacgucaagggcgaggacgaggacauccucggccccggcuacaccgaggacuccaccgacgucuacuccucccaguucgagaccauccucgacaacaccucccucuacuacuccgccgagucccucgagacccucuacuccgagcccgacuccuacuucuccuucgagaugccccucacccccaugauccagcagcgcaucaaggagggcggccaguuccucgagcgcaccuccggcggcggccaccaggacauccucuccgucuccgccgacggcggcaucgucaugggcuacuccuccggcgucaccaacggccucaacgacgccuccgacuccaucuacaccaagggcacccccgagaucgccuucuggggcuccaacgccggcgucaagaccacccgccucgaggcccacuccgagaugggcuccaccgagauccucgagaaggagacccccgagaaccucuccaacggcaccuccuccaacgucgaggccgccaagcgccucgccaagcgccucuaccagcucgaccgcuucaagcgcuccgacgucgccaagcaccucggcaagaacaacgaguucuccaagcucgucgccgaggaguaccucaaguucuucgacuucaccggcaugacccucgaccagucccuccgcuacuucuucaaggccuucucccucgucggcgagacccaggagcgcgagcgcguccucauccacuucuccaaccgcuacuucuacugcaaccccgacaccaucgccucccaggacggcguccacugccucaccugcgccaucaugcuccucaacaccgaccuccacggccacaacaucggcaagaagaugaccugccaggaguucaucgccaaccuccagggcgucaacgagggcgucgacuucuccaaggaccuccucaaggcccucuacaacuccaucaagaacgagaagcucgagugggccgucgacgacgaggagaagaagaagucccccuccgaguccaccgaggagaaggccaacggcacccaccccaagaccaucucccgcaucggcuccaccaccaaccccuuccucgacaucccccacgaccccaacgccgccgucuacaaguccggcuuccucgcccgcaagauccacgccgacauggacggcaagaagaccccccgcggcaagcgcggcuggaagaccuucuacgccguccucaagggcaccguccucuaccuccagaaggacgaguacaagcccgagaaggcccucuccgaggaggaccucaagaacgccgucuccguccaccacgcccucgccuccaaggccaccgacuacgagaagaagcccaacgucuucaagcucaagaccgccgacuggcgcguccuccucuuccagacccagucccccgaggagaugcagggcuggaucaacaagaucaacugcgucgccgccgucuucuccgccccccccuuccccgccgccaucggcucccagaagaaguucucccgcccccuccuccccgccaccaccaccaagcucucccaggaggagcagcucaagucccacgaguccaagcucaagcagaucaccaccgagcucgccgagcaccgcuccuacccccccgacaagaaggucaaggccaaggacgucgacgaguacaagcucaaggaccacuaccucgaguucgagaagacccgcuacgagauguacgucuccauccucaaggagggcggcaaggagcuccucuccaacgacgaguccgaggccgccggccucaagaagucccacuccucccccucccucaaccccgacaccucccccaucaccgccaaggucaagcgcaacgucuccgagcgcaaggaccaccgccccgagacccccuccaucaagcagaaggucaccuga

SEQ ID NO: 48214 - RNA, 3171 nt, Artificial Sequence
  derived and/or modified sequence opt2 from PSD4__Homo_sapiens__NP_036587
augaugggcgacuaccgccuccccgaccacccccagcccauggagauccucaaccucuaccucggcgacucccucgagccccaccccggcgagugcccccgcgagaccugcucccacgaggacccccccgagcccuucgaggagcagaccugggccaccgacccccccgagcccacccgccagaacgucccccccuggggcuccggcgucgagcucacccaccucggcuccuggguccaccaggacggccucgagcccugccaggagcagacccgcgccaccgacccccccgaguccacccgccaggacgccccccccuggggcuccggcgucgagcucacccaccucggcucccccuccgcccagcgcgagcaccgccagaacaccgccucccccggcucccccgucaacucccaccuccccggcucccccaagcagaaccgcuccaccuccacccaggucgucuucugggccggcauccuccaggcccagaugugcguccucgaccucgaggaggagcucgagaagaccgagggccucaaggccggccucaagugcugccuccccaccccccccgucgaccuccccggcgacaccggccuccacuccuccccccccgagaacgaggacuccggcgaggacuccuccgagcccgagggcgagggccaggccuggcuccgcgagggcacccccgacuccuccccccaguggggcgccgaggaggaguccauguucuucuccaacccccucuuccucgccucccccugcuccgagaacuccgccuccggcgagugcuucuccuggggcgccuccgacucccacgccggcguccgcaccggccccgagucccccgccacccucgagcccccccuccccgaggacaccguccucugggagcucgaguccgagcccgaccucggcgacggcgccgccaucuccggccacugcaccccccccuuccccguccccaucuacaagccccacuccaucugcugggccuccgucgccgccgccgagggcgcccccgccgccccccccggccacggcgaguccgagggcgaccgccucggccccgcccccuccgccgcccccugcgucgacgaggcccucaccugggaguccggcugcgucggcuccgaccucggccccgccgcccaccccguccagcccugggccucccucucccccgagggcuggcagcgcggcggccccuucuggccccaggucacccucaacucccaggaccgcgacgagcgcgagggcggccacccccaggagucccuccccugcacccucgcccccugccccuggcgcucccccgccuccucccccgagcccuccucccccgaguccgagucccgcggccccggcccccgccccucccccgccuccucccaggagggcuccccccagcuccagcaccacuccuccggcauccuccccaaguggacccucgacgccucccaguccucccuccucgagaccgacggcgagcagcccuccucccucaagaagaaggaggccggcgaggcccccaagcccggcgaggaggucaaguccgagggcaccgcccgccccgccgagaccggcgacguccagcccgacauccaccucaccuccgccgagcacgagaaccuccgcacccccaugaacuccuccuggcuccccggcucccccaugccccaggcccagucccccgaggagggccagcgcccccccgccggcgacaagcucgccaacggcguccgcaacaacaaggucgccuggaaccucgccucccgccucuaccgccucgagggcuuccgcaaguccgaggucgccgccuaccuccagaagaacaacgacuucucccgcgccgucgccgaggaguaccucuccuucuuccaguucggcggccagucccucgaccgcgcccuccgcuccuuccuccaggcccucguccucuccggcgagacccaggagcgcgagcgcauccucuaccaguucucccgccgcuuccaccacugcaaccccggcaucuuccccuccgucgacuccguccacacccucaccugcgccaucaugcuccucaacaccgaccuccacggccagaacaucggcaaguccauguccugccaggaguucaucaccaaccucaacggccuccgcgacggcggcaacuuccccaaggagcuccucaaggcccucuacugguccauccgcuccgagaagcucgagugggccgucgacgaggaggacaccgcccgccccgagaaggcccagcccucccuccccgccggcaagauguccaagcccuuccuccagcucgcccaggaccccaccguccccaccuacaagcagggcauccucgcccgcaagaugcaccaggacgccgacggcaagaagacccccuggggcaagcgcggcuggaagauguuccacacccuccuccgcggcaugguccucuacuuccucaagcagggcgaggaccacugccucgagggcgagucccucgucggccagauggucgacgagcccgucggcguccaccacucccucgccacccccgccacccacuacaccaagaagccccacgucuuccagcuccgcaccgccgacuggcgccucuaccucuuccaggcccccaccgccaaggagauguccuccuggaucgcccgcaucaaccucgccgccgccacccacuccgccccccccuuccccgccgccgucggcucccagcgccgcuucguccgccccauccuccccgucggccccgcccaguccucccucgaggagcagcaccgcucccacgagaacugccucgacgccgccgccgacgaccuccucgaccuccagcgcaaccuccccgagcgccgcggccgcggccgcgagcucgaggagcaccgccuccgcaaggaguaccucgaguacgagaagacccgcuacgagaccuacguccagcuccucgucgcccgccuccacugccccuccgacgcccucgaccucugggaggagcagcucggccgcgaggccggcggcacccgcgagcccaagcucucccucaagaagucccacuccucccccucccuccaccaggacgaggcccccaccaccgccaaggucaagcgcaacaucuccgagcgccgcaccuaccgcaagaucauccccaagcgcaaccgcaaccagcucuga

SEQ ID NO: 48215 - RNA, 3075 nt, Artificial Sequence
  derived and/or modified sequence opt2 from PSD__Homo_sapiens__NP_002770
auggcccagggcgccaugcgcuucugcuccgagggcgacugcgccaucucccccccccgcugcccccgccgcuggcuccccgagggccccgucccccaguccccccccgccuccauguacggcuccaccggcucccuccuccgccgcgucgccggccccggcccccgcggccgcgagcucggccgcgucaccgcccccugcaccccccuccgcggcccccccuccccccgcgucgcccccucccccugggcccccuccucccccaccggccagcccccccccggcgcccaguccuccgucgucaucuuccgcuucgucgagaaggccuccguccgcccccucaacggccuccccgcccccggcggccucucccgcuccugggaccucggcggcgucucccccccccgccccacccccgcccucggccccggcuccaaccgcaagcuccgccucgaggccuccaccuccgacccccuccccgcccgcggcggcuccgcccuccccggcucccgcaaccucguccacggcccccccgcccccccccaggucggcgccgacggccucuacuccucccuccccaacggccucggcggcccccccgagcgccucgccacccucuucggcggccccgccgacaccggcuuccucaaccagggcgacaccugguccuccccccgcgaggucuccucccacgcccagcgcaucgcccgcgccaagugggaguucuucuacggcucccucgacccccccuccuccggcgccaagccccccgagcaggccccccccuccccccccggcgucggcucccgccagggcuccggcgucgccgucggccgcgccgccaaguacuccgagaccgaccucgacaccgucccccuccgcugcuaccgcgagaccgacaucgacgagguccucgccgagcgcgaggaggccgacuccgccaucgagucccagcccuccuccgagggcccccccggcaccgccuacccccccgccccccgccccggcccccuccccggcccccaccccucccucggcuccggcaacgaggacgaggacgacgacgaggccggcggcgaggaggacgucgacgacgaggucuucgaggccuccgagggcgcccgccccggcucccgcaugccccucaagucccccguccccuuccuccccggcaccucccccuccgccgacggccccgacuccuucuccugcgucuucgaggccauccucgagucccaccgcgccaagggcaccuccuacaccucccucgccucccucgaggcccucgccucccccggccccacccagucccccuucuucaccuucgagcuccccccccagccccccgccccccgccccgacccccccgcccccgccccccucgccccccucgagcccgacuccggcaccuccuccgccgccgacggccccuggacccagcgcggcgaggaggaggaggccgaggcccgcgccaagcucgcccccggccgcgagccccccucccccugccacuccgaggacucccucggccucggcgccgccccccucggcuccgagcccccccucucccagcucgucuccgacuccgacuccgagcucgacuccaccgagcgccucgcccucggcuccaccgacacccucuccaacggccagaaggccgaccucgaggccgcccagcgccucgccaagcgccucuaccgccucgacggcuuccgcaaggccgacgucgcccgccaccucggcaagaacaacgacuucuccaagcucgucgccggcgaguaccucaaguucuucgucuucaccggcaugacccucgaccaggcccuccgcgucuuccucaaggagcucgcccucaugggcgagacccaggagcgcgagcgcguccucgcccacuucucccagcgcuacuuccagugcaaccccgaggcccucuccuccgaggacggcgcccacacccucaccugcgcccucaugcuccucaacaccgaccuccacggccacaacaucggcaagcgcaugaccugcggcgacuucaucggcaaccucgagggccucaacgacggcggcgacuucccccgcgagcuccucaaggcccucuacuccuccaucaagaacgagaagcuccagugggccaucgacgaggaggagcuccgccgcucccucuccgagcucgccgaccccaaccccaaggucaucaagcgcaucuccggcggcuccggcuccggcuccucccccuuccucgaccucacccccgagcccggcgccgccgucuacaagcacggcgcccucguccgcaagguccacgccgaccccgacugccgcaagaccccccgcggcaagcgcggcuggaaguccuuccacggcauccucaagggcaugauccucuaccuccagaaggaggaguacaagcccggcaaggcccucuccgagaccgagcucaagaacgccaucuccauccaccacgcccucgccacccgcgccuccgacuacuccaagcgcccccacgucuucuaccuccgcaccgccgacuggcgcgucuuccucuuccaggcccccucccucgagcagaugcaguccuggaucacccgcaucaacgucgucgccgccauguucuccgccccccccuuccccgccgccgucuccucccagaagaaguucucccgcccccuccuccccuccgccgccacccgccucucccaggaggagcagguccgcacccacgaggccaagcucaaggccauggccuccgagcuccgcgagcaccgcgccgcccagcucggcaagaagggccgcggcaaggaggccgaggagcagcgccagaaggaggccuaccucgaguucgagaagucccgcuacuccaccuacgccgcccuccuccgcgucaagcucaaggccggcuccgaggagcucgacgccgucgaggccgcccucgcccaggccggcuccaccgaggacggccucccccccucccacuccucccccucccuccagcccaagcccuccucccagccccgcgcccagcgccacuccuccgagccccgccccggcgccggcuccggccgccgcaagcccuga

SEQ ID NO: 48216 - RNA, 1404 nt, Artificial Sequence
  derived and/or modified sequence opt2 from PSEN1__Homo_sapiens__XP_011535274
augaccgagcuccccgccccccucuccuacuuccagaacgcccagauguccgaggacaaccaccucuccaacaccguccgcucccagaacgacaaccgcgagcgccaggagcacaacgaccgccgcucccucggccaccccgagccccucuccaacggccgcccccagggcaacucccgccaggucgucgagcaggacgaggaggaggacgaggagcucacccucaaguacggcgccaagcacgucaucaugcucuucguccccgucacccucugcauggucgucgucgucgccaccaucaaguccgucuccuucuacacccgcaaggacggccagcucaucuacacccccuucaccgaggacaccgagaccgucggccagcgcgcccuccacuccauccucaacgccgccaucaugaucuccgucaucgucgucaugaccauccuccucgucguccucuacaaguaccgcugcuacaaggucauccacgccuggcucaucaucuccucccuccuccuccucuucuucuucuccuucaucuaccucggcgaggucuucaagaccuacaacgucgccgucgacuacaucaccgucgcccuccucaucuggaacuucggcgucgucggcaugaucuccauccacuggaagggcccccuccgccuccagcaggccuaccucaucaugaucuccgcccucauggcccucgucuucaucaaguaccuccccgaguggaccgccuggcucauccucgccgucaucuccgucuacgaccucgucgccguccucugccccaagggcccccuccgcaugcucgucgagaccgcccaggagcgcaacgagacccucuuccccgcccucaucuacuccuccaccauggucuggcucgucaacauggccgagggcgaccccgaggcccagcgccgcgucuccaagaacuccaaguacaacgccgaguccaccgagcgcgagucccaggacaccgucgccgagaacgacgacggcggcuucuccgaggagugggaggcccagcgcgacucccaccucggcccccaccgcuccacccccgagucccgcgccgccguccaggagcucuccuccuccauccucgccggcgaggaccccgaggagcgcggcgucaagcucggccucggcgacuucaucuucuacuccguccucgucggcaaggccuccgccaccgccuccggcgacuggaacaccaccaucgccugcuucgucgccauccucaucggccucugccucacccuccuccuccucgccaucuucaagaaggcccuccccgcccuccccaucuccaucaccuucggccucgucuucuacuucgccaccgacuaccucguccagcccuucauggaccagcucgccuuccaccaguucuacaucuga

SEQ ID NO: 48217 - RNA, 1344 nt, Artificial Sequence
  derived and/or modified sequence opt2 from PSEN2__Homo_sapiens__NP_036618
augcucaccuucauggccuccgacuccgaggaggaggucugcgacgagcgcaccucccucauguccgccgagucccccaccccccgcuccugccaggagggccgccagggccccgaggacggcgagaacaccgcccaguggcgcucccaggagaacgaggaggacggcgaggaggaccccgaccgcuacgucugcuccggcguccccggccgcccccccggccucgaggaggagcucacccucaaguacggcgccaagcacgucaucaugcucuucguccccgucacccucugcaugaucgucgucgucgccaccaucaaguccguccgcuucuacaccgagaagaacggccagcucaucuacacccccuucaccgaggacacccccuccgucggccagcgccuccucaacuccguccucaacacccucaucaugaucuccgucaucgucgucaugaccaucuuccucgucguccucuacaaguaccgcugcuacaaguucauccacggcuggcucaucauguccucccucaugcuccucuuccucuucaccuacaucuaccucggcgagguccucaagaccuacaacgucgccauggacuaccccacccuccuccucaccgucuggaacuucggcgccgucggcauggucugcauccacuggaagggcccccucguccuccagcaggccuaccucaucaugaucuccgcccucauggcccucgucuucaucaaguaccuccccgagugguccgccugggucauccucggcgccaucuccgucuacgaccucgucgccguccucugccccaagggcccccuccgcaugcucgucgagaccgcccaggagcgcaacgagcccaucuuccccgcccucaucuacuccuccgccauggucuggaccgucggcauggccaagcucgaccccuccucccagggcgcccuccagcuccccuacgaccccgagauggaggacuccuacgacuccuucggcgagcccuccuaccccgaggucuucgagcccccccucaccggcuaccccggcgaggagcucgaggaggaggaggagcgcggcgucaagcucggccucggcgacuucaucuucuacuccguccucgucggcaaggccgccgccaccggcuccggcgacuggaacaccacccucgccugcuucgucgccauccucaucggccucugccucacccuccuccuccucgccgucuucaagaaggcccuccccgcccuccccaucuccaucaccuucggccucaucuucuacuucuccaccgacaaccucguccgccccuucauggacacccucgccucccaccagcucuacaucuga

SEQ ID NO: 48218 - RNA, 306 nt, Artificial Sequence
  derived and/or modified sequence opt2 from PSENEN__Homo_sapiens__NP_001268461
augaaccucgagcgcgucuccaacgaggagaagcucaaccucugccgcaaguacuaccucggcggcuucgccuuccuccccuuccucuggcucgucaacaucuucugguucuuccgcgaggccuuccucguccccgccuacaccgagcagucccagaucaagggcuacgucuggcgcuccgccgucggcuuccucuucugggucaucguccucaccuccuggaucaccaucuuccagaucuaccgcccccgcuggggcgcccucggcgacuaccucuccuucaccaucccccucggcacccccuga

SEQ ID NO: 48219 - RNA, 1260 nt, Artificial Sequence
  derived and/or modified sequence opt2 from PSG1__Homo_sapiens__NP_001171754
augggcacccucuccgccccccccugcacccagcgcaucaaguggaagggccuccuccucaccgccucccuccucaacuucuggaaccuccccaccaccgcccaggucaccaucgaggccgagcccaccaaggucuccgagggcaaggacguccuccuccucguccacaaccucccccagaaccucaccggcuacaucugguacaagggccagaugcgcgaccucuaccacuacaucaccuccuacgucgucgacggcgagaucaucaucuacggccccgccuacuccggccgcgagaccgccuacuccaacgccucccuccucauccagaacgucacccgcgaggacgccggcuccuacacccuccacaucaucaagggcgacgacggcacccgcggcgucaccggccgcuucaccuucacccuccaccucgagacccccaagcccuccaucuccuccuccaaccucaacccccgcgagaccauggaggccgucucccucaccugcgaccccgagacccccgacgccuccuaccucugguggaugaacggccagucccuccccaugacccacucccucaagcucuccgagaccaaccgcacccucuuccuccucggcgucaccaaguacaccgccggccccuacgagugcgagauccgcaaccccgucuccgccucccgcuccgaccccgucacccucaaccuccuccccaagcuccccaagcccuacaucaccaucaacaaccucaacccccgcgagaacaaggacguccucaacuucaccugcgagcccaaguccgagaacuacaccuacaucugguggcucaacggccagucccuccccgucuccccccgcgucaagcgccccaucgagaaccgcauccucauccuccccuccgucacccgcaacgagaccggccccuaccagugcgagauccgcgaccgcuacggcggcauccgcuccgaccccgucacccucaacguccucuacggccccgaccucccccgcaucuaccccuccuucaccuacuaccgcuccggcgagguccucuaccucuccugcuccgccgacuccaacccccccgcccaguacuccuggaccaucaacgagaaguuccagcuccccggccagaagcucuucauccgccacaucaccaccaagcacuccggccucuacgucugcuccguccgcaacuccgccaccggcaaggaguccuccaaguccaugaccgucgaggucuccgacuggaccguccccuga

SEQ ID NO: 48220 - RNA, 1008 nt, Artificial Sequence
  derived and/or modified sequence opt2 from PSG2__Homo_sapiens__NP_112536
augggcccccucuccgccccccccugcaccgagcacaucaaguggaagggccuccucgucaccgccucccuccucaacuucuggaaccuccccaccaccgcccaggucaccaucgaggcccagccccccaaggucuccgagggcaaggacguccuccuccucguccacaaccucccccagaaccucaccggcuacaucugguacaagggccagauccgcgaccucuaccacuacaucaccuccuacgucgucgacggccagaucaucaucuacggccccgccuacuccggccgcgagaccgccuacuccaacgccucccuccucauccagaacgucacccgcgaggacgccggcuccuacacccuccacaucaucaagcgcggcgacggcacccgcggcgucaccggcuacuucaccuucacccucuaccucgagacccccaagcccuccaucuccuccuccaaccucaacccccgcgaggccauggagaccgucauccucaccugcgaccccgagacccccgacaccuccuaccagugguggaugaacggccagucccuccccaugacccaccgcuuccagcucuccgagaccaaccgcacccucuuccucuucggcgucaccaaguacaccgccggccccuacgagugcgagauccgcaacuccggcuccgccucccgcuccgaccccgucacccucaaccuccuccacggccccgaccucccccgcauccaccccuccuacaccaacuaccgcuccggcgacaaccucuaccucuccugcuucgccaacuccaacccccccgcccaguacuccuggaccaucaacggcaaguuccagcaguccggccagaaccucuucaucccccagaucaccaccaagcacuccggccucuacgucugcuccguccgcaacuccgccaccggcgaggaguccuccaccucccucaccgucaaggucuccgccuccacccgcaucggccuccucccccuccucaaccccaccuga

SEQ ID NO: 48221 - RNA, 1008 nt, Artificial Sequence
  derived and/or modified sequence opt2 from PSG5__Homo_sapiens__NP_001123486
augggcccccucuccgccccccccugcacccagcacaucaccuggaagggccuccuccucaccgccucccuccucaacuucuggaaccuccccaucaccgcccaggucaccaucgaggcccucccccccaaggucuccgagggcaaggacguccuccuccucguccacaaccucccccagaaccucgccggcuacaucugguacaagggccagcucauggaccucuaccacuacaucaccuccuacgucgucgacggccagaucaacaucuacggccccgccuacaccggccgcgagaccgucuacuccaacgccucccuccucauccagaacgucacccgcgaggacgccggcuccuacacccuccacaucaucaagcgcggcgaccgcacccgcggcgucaccggcuacuucaccuucaaccucuaccucaagcuccccaagcccuacaucaccaucaacaacuccaagccccgcgagaacaaggacguccucgccuucaccugcgagcccaaguccgagaacuacaccuacaucugguggcucaacggccagucccuccccgucuccccccgcgucaagcgccccaucgagaaccgcauccucauccuccccuccgucacccgcaacgagaccggccccuacgagugcgagauccgcgaccgcgacggcggcaugcgcuccgaccccgucacccucaacguccucuacggccccgaccuccccuccaucuaccccuccuucaccuacuaccgcuccggcgagaaccucuaccucuccugcuucgccgaguccaacccccccgccgaguacuucuggaccaucaacggcaaguuccagcaguccggccagaagcucuccaucccccagaucaccaccaagcaccgcggccucuacaccugcuccguccgcaacuccgccaccggcaaggaguccuccaaguccaugaccgucgaggucuccgcccccuccggcaucggccgccucccccuccucaaccccaucuga

SEQ ID NO: 48222 - RNA, 1275 nt, Artificial Sequence
  derived and/or modified sequence opt2 from PSG6__Homo_sapiens__NP_001027020
augggcccccucuccgccccccccugcacccagcacaucaccuggaagggccuccuccucaccgccucccuccucaacuucuggaaccuccccaccaccgcccaggucaucaucgaggccaagccccccaaggucuccgagggcaaggacguccuccuccucguccacaaccucccccagaaccucaccggcuacaucugguacaagggccagaugaccgaccucuaccacuacaucaccuccuacgucguccacggccagaucaucuacggccccgccuacuccggccgcgagaccgucuacuccaacgccucccuccucauccagaacgucacccaggaggacgccggcuccuacacccuccacaucaucaagcgcggcgacggcaccggcggcgucaccggcuacuucaccgucacccucuacuccgagacccccaagcccuccaucuccuccuccaaccucaacccccgcgaggucauggaggccguccgccucaucugcgaccccgagacccccgacgccuccuaccucuggcuccucaacggccagaaccuccccaugacccaccgccuccagcucuccaagaccaaccgcacccucuaccucuucggcgucaccaaguacaucgccggccccuacgagugcgagauccgcaaccccgucuccgccucccgcuccgaccccgucacccucaaccuccuccccaagcuccccaugcccuacaucaccaucaacaaccucaacccccgcgagaagaaggacguccucgccuucaccugcgagcccaagucccgcaacuacaccuacaucugguggcucaacggccagucccuccccgucuccccccgcgucaagcgccccaucgagaaccgcauccucauccuccccuccgucacccgcaacgagaccggccccuaccagugcgagauccgcgaccgcuacggcggcauccgcuccaaccccgucacccucaacguccucuacggccccgaccucccccgcaucuaccccuccuucaccuacuaccgcuccggcgagaaccucgaccucuccugcuucgccgacuccaacccccccgccgaguacuccuggaccaucaacggcaaguuccagcucuccggccagaagcucuucaucccccagaucaccaccaaccacuccggccucuacgccugcuccguccgcaacuccgccaccggcaaggagaucuccaaguccaugaucgucaaggucuccggccccugccacggcaaccagaccgagucccacuga

SEQ ID NO: 48223 - RNA, 1260 nt, Artificial Sequence
  derived and/or modified sequence opt2 from PSG8__Homo_sapiens__NP_001123639
augggccuccucuccgccccccccugcacccagcgcaucaccuggaagggccuccuccucaccgccucccuccucaacuucuggaacccccccaccaccgcccaggucaccaucgaggcccagcccaccaaggucuccgagggcaaggacguccuccuccucguccacaaccucccccagaaccucaccggcuacaucugguacaagggccagauccgcgaccucuaccacuacaucaccuccuacgucgucgacggccagaucaucaucuacggccccgccuacuccggccgcgagaccaucuacuccaacgccucccuccucauccagaacgucacccaggaggacgccggcuccuacacccuccacaucaucaugggcggcgacgagaaccgcggcgucaccggccacuucaccuucacccucuaccucgagacccccaagcccuccaucuccuccuccaagcucaacccccgcgaggccauggaggccgucucccucaccugcgaccccgagacccccgacgccuccuaccucugguggaugaacggccagucccuccccaugucccaccgccuccagcucuccgagaccaaccgcacccucuuccuccucggcgucaccaaguacaccgccggccccuacgagugcgagauccgcaaccccgucuccgccucccgcuccgaccccuucacccucaaccuccuccccaagcuccccaagcccuacaucaccaucaacaaccucaagccccgcgagaacaaggacguccucaacuucaccugcgagcccaaguccgagaacuacaccuacaucugguggcucaacggccagucccuccccgucuccccccgcgucaagcgccccaucgagaaccgcauccucauccuccccuccgucacccgcaacgagaccggccccuaccagugcgagauccgcgaccaguacggcggcauccgcuccuaccccgucacccucaacguccucuacggccccgaccucccccgcaucuaccccuccuucaccuacuaccgcuccggcgagguccucuaccucuccugcuccgccgacuccaacccccccgcccaguacuccuggaccaucaacggcaaguuccagcucuccggccagaagcucuucaucccccagaucaccaccaagcacuccggccucuacgccugcuccguccgcaacuccgccaccggcaaggaguccuccaaguccaugaccgucaaggucuccgacuggacccuccccuga

SEQ ID NO: 48224 - RNA, 1002 nt, Artificial Sequence
  derived and/or modified sequence opt2 from PSG9__Homo_sapiens__NP_001288636
augggcccccuccccgcccccuccugcacccagcgcaucaccuggaagggccuccuccucaccgccucccuccucaacuucuggaacccccccaccaccgccgaggucaccaucgaggcccagccccccaaggucuccgagggcaaggacguccuccuccucguccacaaccucccccagaaccuccccggcuacuucugguacaagggcgagaugaccgaccucuaccacuacaucaucuccuacaucgucgacggcaagaucaucaucuacggccccgccuacuccggccgcgagaccgucuacuccaacgccucccuccucauccagaacgucacccgcaaggacgccggcaccuacacccuccacaucaucaagcgcggcgacgagacccgcgaggagauccgccacuucaccuucacccucuacuccaagcuccccauccccuacaucaccaucaacaaccucaacccccgcgagaacaaggacguccucgccuucaccugcgagcccaaguccgagaacuacaccuacaucugguggcucaacggccagucccuccccgucucccccggcgucaagcgccccaucgagaaccgcauccucauccuccccuccgucacccgcaacgagaccggccccuaccagugcgagauccgcgaccgcuacggcggccuccgcuccaaccccgucauccucaacguccucuacggccccgaccucccccgcaucuaccccuccuucaccuacuaccgcuccggcgagaaccucgaccucuccugcuucaccgaguccaacccccccgccgaguacuucuggaccaucaacggcaaguuccagcaguccggccagaagcucuucaucccccagaucacccgcaaccacuccggccucuacgccugcuccguccacaacuccgccaccggcaaggagaucuccaaguccaugaccgucaaggucuccggccccugccacggcgaccucaccgagucccaguccuga

SEQ ID NO: 48225 - RNA, 1593 nt, Artificial Sequence
  derived and/or modified sequence opt2 from PSIP1__Homo_sapiens__NP_001121689
augacccgcgacuucaagcccggcgaccucaucuucgccaagaugaagggcuacccccacuggcccgcccgcgucgacgagguccccgacggcgccgucaagccccccaccaacaagcuccccaucuucuucuucggcacccacgagaccgccuuccucggccccaaggacaucuuccccuacuccgagaacaaggagaaguacggcaagcccaacaagcgcaagggcuucaacgagggccucugggagaucgacaacaaccccaaggucaaguucuccucccagcaggccgccaccaagcaguccaacgccuccuccgacgucgaggucgaggagaaggagaccuccgucuccaaggaggacaccgaccacgaggagaaggccuccaacgaggacgucaccaaggccgucgacaucaccacccccaaggccgcccgccgcggccgcaagcgcaaggccgagaagcaggucgagaccgaggaggccggcgucgucaccaccgccaccgccuccgucaaccucaaggucucccccaagcgcggccgccccgccgccaccgaggucaagauccccaagccccgcggccgccccaagauggucaagcagcccugccccuccgaguccgacaucaucaccgaggaggacaaguccaagaagaagggccaggaggagaagcagcccaagaagcagcccaagaaggacgaggagggccagaaggaggaggacaagccccgcaaggagcccgacaagaaggagggcaagaaggaggucgaguccaagcgcaagaaccucgccaagaccggcgucaccuccaccuccgacuccgaggaggagggcgacgaccaggagggcgagaagaagcgcaagggcggccgcaacuuccagaccgcccaccgccgcaacaugcucaagggccagcacgagaaggaggccgccgaccgcaagcgcaagcaggaggagcagauggagaccgagcagcagaacaaggacgagggcaagaagcccgaggucaagaaggucgagaagaagcgcgagaccuccauggacucccgccuccagcgcauccacgccgagaucaagaacucccucaagaucgacaaccucgacgucaaccgcugcaucgaggcccucgacgagcucgccucccuccaggucaccaugcagcaggcccagaagcacaccgagaugaucaccacccucaagaagauccgccgcuucaaggucucccaggucaucauggagaaguccaccaugcucuacaacaaguucaagaacauguuccucgucggcgagggcgacuccgucaucacccagguccucaacaagucccucgccgagcagcgccagcacgaggaggccaacaagaccaaggaccagggcaagaagggccccaacaagaagcucgagaaggagcagaccggcuccaagacccucaacggcggcuccgacgcccaggacggcaaccagccccagcacaacggcgaguccaacgaggacuccaaggacaaccacgaggccuccaccaagaagaagcccuccuccgaggagcgcgagaccgagaucucccucaaggacuccacccucgacaacuga

SEQ ID NO: 48226 - RNA, 1275 nt, Artificial Sequence
  derived and/or modified sequence opt2 from PSKH1__Homo_sapiens__NP_006733
augggcugcggcaccuccaagguccuccccgagccccccaaggacguccagcucgaccucgucaagaaggucgagcccuucuccggcaccaaguccgacgucuacaagcacuucaucaccgaggucgacuccgucggccccgucaaggccggcuuccccgccgccucccaguacgcccaccccugccccggcccccccaccgccggccacaccgagccccccuccgagcccccccgccgcgcccgcgucgccaaguaccgcgccaaguucgacccccgcgucaccgccaaguacgacaucaaggcccucaucggccgcggcuccuucucccgcgucguccgcgucgagcaccgcgccacccgccagcccuacgccaucaagaugaucgagaccaaguaccgcgagggccgcgaggucugcgaguccgagcuccgcguccuccgccgcguccgccacgccaacaucauccagcucgucgaggucuucgagacccaggagcgcgucuacauggucauggagcucgccaccggcggcgagcucuucgaccgcaucaucgccaagggcuccuucaccgagcgcgacgccacccgcguccuccagaugguccucgacggcguccgcuaccuccacgcccucggcaucacccaccgcgaccucaagcccgagaaccuccucuacuaccaccccggcaccgacuccaagaucaucaucaccgacuucggccucgccuccgcccgcaagaagggcgacgacugccucaugaagaccaccugcggcacccccgaguacaucgcccccgagguccucguccgcaagcccuacaccaacuccgucgacaugugggcccucggcgucaucgccuacauccuccucuccggcaccaugcccuucgaggacgacaaccgcacccgccucuaccgccagauccuccgcggcaaguacuccuacuccggcgagcccuggcccuccgucuccaaccucgccaaggacuucaucgaccgccuccucaccgucgaccccggcgcccgcaugaccgcccuccaggcccuccgccaccccugggucgucuccauggccgccuccuccuccaugaagaaccuccaccgcuccaucucccagaaccuccucaagcgcgccuccucccgcugccaguccaccaaguccgcccaguccacccgcuccucccgcuccacccgcuccaacaagucccgccgcguccgcgagcgcgagcuccgcgagcucaaccuccgcuaccagcagcaguacaacggcuga

SEQ ID NO: 48227 - RNA, 393 nt, Artificial Sequence
  derived and/or modified sequence opt2 from PSMA1__Homo_sapiens__NP_001137409
auguuccgcaaccaguacgacaacgacgucaccgucugguccccccagggccgcauccaccagaucgaguacgccauggaggccgucaagcagggcuccgccaccgucggccucaaguccaagacccacgccguccucgucgcccucaagcgcgcccaguccgagcucgccgcccaccagaagaagauccuccacgucgacaaccacaucggcaucuccaucgccggccucaccgccgacgcccgccuccucugcaacuucaugcgccaggagugccucgacucccgcuucgucuucgaccgcccccuccccgucucccgccucgucucccucaucggcuccuccauccucuucaugcucgccuucauggacaugaacuucgagggcuucuga

SEQ ID NO: 48228 - RNA, 705 nt, Artificial Sequence
  derived and/or modified sequence opt2 from PSMA2__Homo_sapiens__NP_002778
auggccgagcgcggcuacuccuucucccucaccaccuucucccccuccggcaagcucguccagaucgaguacgcccucgccgccgucgccggcggcgcccccuccgucggcaucaaggccgccaacggcgucguccucgccaccgagaagaagcagaaguccauccucuacgacgagcgcuccguccacaaggucgagcccaucaccaagcacaucggccucgucuacuccggcaugggccccgacuaccgcguccucguccaccgcgcccgcaagcucgcccagcaguacuaccucgucuaccaggagcccauccccaccgcccagcucguccagcgcgucgccuccgucaugcaggaguacacccaguccggcggcguccgccccuucggcgucucccuccucaucugcggcuggaacgagggccgccccuaccucuuccaguccgaccccuccggcgccuacuucgccuggaaggccaccgccaugggcaagaacuacgucaacggcaagaccuuccucgagaagcgcuacaacgaggaccucgagcucgaggacgccauccacaccgccauccucacccucaaggaguccuucgagggccagaugaccgaggacaacaucgaggucggcaucugcaacgaggccggcuuccgccgccucacccccaccgaggucaaggacuaccucgccgccaucgccuga

SEQ ID NO: 48229 - RNA, 768 nt, Artificial Sequence
  derived and/or modified sequence opt2 from PSMA3__Homo_sapiens__NP_002779
auguccuccaucggcaccggcuacgaccucuccgccuccaccuucucccccgacggccgcgucuuccaggucgaguacgccaugaaggccgucgagaacuccuccaccgccaucggcauccgcugcaaggacggcgucgucuucggcgucgagaagcucguccucuccaagcucuacgaggagggcuccaacaagcgccucuucaacgucgaccgccacgucggcauggccgucgccggccuccucgccgacgcccgcucccucgccgacaucgcccgcgaggaggccuccaacuuccgcuccaacuucggcuacaacaucccccucaagcaccucgccgaccgcgucgccauguacguccacgccuacacccucuacuccgccguccgccccuucggcugcuccuucaugcucggcuccuacuccgucaacgacggcgcccagcucuacaugaucgaccccuccggcgucuccuacggcuacuggggcugcgccaucggcaaggcccgccaggccgccaagaccgagaucgagaagcuccagaugaaggagaugaccugccgcgacaucgucaaggaggucgccaagaucaucuacaucguccacgacgaggucaaggacaaggccuucgagcucgagcucuccugggucggcgagcucaccaacggccgccacgagaucguccccaaggacauccgcgaggaggccgagaaguacgccaaggagucccucaaggaggaggacgaguccgacgacgacaacauguga

SEQ ID NO: 48230 - RNA, 786 nt, Artificial Sequence
  derived and/or modified sequence opt2 from PSMA4__Homo_sapiens__NP_001096137
augucccgccgcuacgacucccgcaccaccaucuucucccccgagggccgccucuaccaggucgaguacgccauggaggccaucggccacgccggcaccugccucggcauccucgccaacgacggcguccuccucgccgccgagcgccgcaacauccacaagcuccucgacgaggucuucuucuccgagaagaucuacaagcucaacgaggacauggccugcuccgucgccggcaucaccuccgacgccaacguccucaccaacgagcuccgccucaucgcccagcgcuaccuccuccaguaccaggagcccauccccugcgagcagcucgucaccgcccucugcgacaucaagcaggccuacacccaguucggcggcaagcgccccuucggcgucucccuccucuacaucggcugggacaagcacuacggcuuccagcucuaccaguccgaccccuccggcaacuacggcggcuggaaggccaccugcaucggcaacaacuccgccgccgccgucuccaugcucaagcaggacuacaaggagggcgagaugacccucaaguccgcccucgcccucgccaucaagguccucaacaagaccauggacgucuccaagcucuccgccgagaaggucgagaucgccacccucacccgcgagaacggcaagaccgucauccgcguccucaagcagaaggaggucgagcagcucaucaagaagcacgaggaggaggaggccaaggccgagcgcgagaagaaggagaaggagcagaaggagaaggacaaguga

SEQ ID NO: 48231 - RNA, 504 nt, Artificial Sequence
  derived and/or modified sequence opt2 from PSMA6__Homo_sapiens__NP_001269161
augaccggcaugaccgccgacucccgcucccagguccagcgcgcccgcuacgaggccgccaacuggaaguacaaguacggcuacgagauccccgucgacaugcucugcaagcgcaucgccgacaucucccaggucuacacccagaacgccgagaugcgcccccucggcugcugcaugauccucaucggcaucgacgaggagcagggcccccaggucuacaagugcgaccccgccggcuacuacugcggcuucaaggccaccgccgccggcgucaagcagaccgaguccaccuccuuccucgagaagaaggucaagaagaaguucgacuggaccuucgagcagaccgucgagaccgccaucaccugccucuccaccguccucuccaucgacuucaagcccuccgagaucgaggucggcgucgucaccgucgagaaccccaaguuccgcauccucaccgaggccgagaucgacgcccaccucgucgcccucgccgagcgcgacuga

SEQ ID NO: 48232 - RNA, 747 nt, Artificial Sequence
  derived and/or modified sequence opt2 from PSMA7__Homo_sapiens__NP_002783
auguccuacgaccgcgccaucaccgucuucucccccgacggccaccucuuccaggucgaguacgcccaggaggccgucaagaagggcuccaccgccgucggcguccgcggccgcgacaucgucguccucggcgucgagaagaaguccgucgccaagcuccaggacgagcgcaccguccgcaagaucugcgcccucgacgacaacgucugcauggccuucgccggccucaccgccgacgcccgcaucgucaucaaccgcgcccgcgucgagugccagucccaccgccucaccgucgaggaccccgucaccgucgaguacaucacccgcuacaucgccucccucaagcagcgcuacacccaguccaacggccgccgccccuucggcaucuccgcccucaucgucggcuucgacuucgacggcaccccccgccucuaccagaccgaccccuccggcaccuaccacgccuggaaggccaacgccaucggccgcggcgccaaguccguccgcgaguuccucgagaagaacuacaccgacgaggccaucgagaccgacgaccucaccaucaagcucgucaucaaggcccuccucgaggucguccaguccggcggcaagaacaucgagcucgccgucaugcgccgcgaccagucccucaagauccucaaccccgaggagaucgagaaguacgucgccgagaucgagaaggagaaggaggagaacgagaagaagaagcagaagaaggccuccuga

SEQ ID NO: 48233 - RNA, 822 nt, Artificial Sequence
  derived and/or modified sequence opt2 from PSMB10__Homo_sapiens__NP_002792
augcucaagcccgcccucgagccccgcggcggcuucuccuucgagaacugccagcgcaacgccucccucgagcgcguccuccccggccucaaggucccccacgcccgcaagaccggcaccaccaucgccggccucgucuuccaggacggcgucauccucggcgccgacacccgcgccaccaacgacuccgucgucgccgacaaguccugcgagaagauccacuucaucgcccccaagaucuacugcugcggcgccggcgucgccgccgacgccgagaugaccacccgcauggucgccuccaagauggagcuccacgcccucuccaccggccgcgagccccgcgucgccaccgucacccgcauccuccgccagacccucuuccgcuaccagggccacgucggcgccucccucaucgucggcggcgucgaccucaccggcccccagcucuacggcguccacccccacggcuccuacucccgccuccccuucaccgcccucggcuccggccaggacgccgcccucgccguccucgaggaccgcuuccagcccaacaugacccucgaggccgcccagggccuccucgucgaggccgucaccgccggcauccucggcgaccucggcuccggcggcaacgucgacgccugcgucaucaccaagaccggcgccaagcuccuccgcacccucuccucccccaccgagcccgucaagcgcuccggccgcuaccacuucguccccggcaccaccgccguccucacccagaccgucaagccccucacccucgagcucgucgaggagaccguccaggccauggaggucgaguga

SEQ ID NO: 48234 - RNA, 726 nt, Artificial Sequence
  derived and/or modified sequence opt2 from PSMB1__Homo_sapiens__NP_002784
augcucuccuccaccgccauguacuccgcccccggccgcgaccucggcauggagccccaccgcgccgccggcccccuccagcuccgcuucucccccuacgucuucaacggcggcaccauccucgccaucgccggcgaggacuucgccaucgucgccuccgacacccgccucuccgagggcuucuccauccacacccgcgacucccccaagugcuacaagcucaccgacaagaccgucaucggcugcuccggcuuccacggcgacugccucacccucaccaagaucaucgaggcccgccucaagauguacaagcacuccaacaacaaggccaugaccaccggcgccaucgccgccaugcucuccaccauccucuacucccgccgcuucuuccccuacuacgucuacaacaucaucggcggccucgacgaggagggcaagggcgccgucuacuccuucgaccccgucggcuccuaccagcgcgacuccuucaaggccggcggcuccgccuccgccaugcuccagccccuccucgacaaccaggucggcuucaagaacaugcagaacgucgagcacgucccccucucccucgaccgcgccaugcgccucgucaaggacgucuucaucuccgccgccgagcgcgacgucuacaccggcgacgcccuccgcaucugcaucgucaccaaggagggcauccgcgaggagaccgucucccuccgcaaggacuga

SEQ ID NO: 48235 - RNA, 795 nt, Artificial Sequence
  derived and/or modified sequence opt2 from PSMB4__Homo_sapiens__NP_002787
auggaggccuuccucggcucccgcuccggccucugggccggcggccccgcccccggccaguucuaccgcauccccuccacccccgacuccuucauggaccccgccuccgcccucuaccgcggccccaucacccgcacccagaaccccauggucaccggcaccuccguccucggcgucaaguucgagggcggcgucgucaucgccgccgacaugcucggcuccuacggcucccucgcccgcuuccgcaacaucucccgcaucaugcgcgucaacaacuccaccaugcucggcgccuccggcgacuacgccgacuuccaguaccucaagcagguccucggccagauggucaucgacgaggagcuccucggcgacggccacuccuacuccccccgcgccauccacuccuggcucacccgcgccauguacucccgccgcuccaagaugaacccccucuggaacaccauggucaucggcggcuacgccgacggcgaguccuuccucggcuacgucgacaugcucggcgucgccuacgaggcccccucccucgccaccggcuacggcgccuaccucgcccagccccuccuccgcgagguccucgagaagcagcccguccucucccagaccgaggcccgcgaccucgucgagcgcugcaugcgcguccucuacuaccgcgacgcccgcuccuacaaccgcuuccagaucgccaccgucaccgagaagggcgucgagaucgagggcccccucuccaccgagaccaacugggacaucgcccacaugaucuccggcuucgaguga

SEQ ID NO: 48236 - RNA, 483 nt, Artificial Sequence
  derived and/or modified sequence opt2 from PSMB5__Homo_sapiens__NP_001124197
auggccggcggcgccgccgacugcuccuucugggagcgccuccucgcccgccagugccgcaucuacgagcuccgcaacaaggagcgcaucuccgucgccgccgccuccaagcuccucgccaacauggucuaccaguacaagggcaugggccucuccaugggcaccaugaucugcggcugggacaagcgcggccccggccucuacuacgucgacuccgagggcaaccgcaucuccggcgccaccuucuccgucggcuccggcuccgucuacgccuacggcgucauggaccgcggcuacuccuacgaccucgaggucgagcaggccuacgaccucgcccgccgcgccaucuaccaggccaccuaccgcgacgccuacuccggcggcgccgucaaccucuaccacguccgcgaggacggcuggauccgcgucuccuccgacaacgucgccgaccuccacgagaaguacuccggcuccacccccuga

SEQ ID NO: 48237 - RNA, 720 nt, Artificial Sequence
  derived and/or modified sequence opt2 from PSMB6__Homo_sapiens__NP_002789
auggccgccacccuccucgccgcccgcggcgccggccccgcccccgccuggggccccgaggccuucacccccgacugggagucccgcgaggucuccaccggcaccaccaucauggccguccaguucgacggcggcgucguccucggcgccgacucccgcaccaccaccggcuccuacaucgccaaccgcgucaccgacaagcucacccccauccacgaccgcaucuucugcugccgcuccggcuccgccgccgacacccaggccgucgccgacgccgucaccuaccagcucggcuuccacuccaucgagcucaacgagcccccccucguccacaccgccgccucccucuucaaggagaugugcuaccgcuaccgcgaggaccucauggccggcaucaucaucgccggcugggacccccaggagggcggccaggucuacuccguccccaugggcggcaugaugguccgccaguccuucgccaucggcggcuccggcuccuccuacaucuacggcuacgucgacgccaccuaccgcgagggcaugaccaaggaggagugccuccaguucaccgccaacgcccucgcccucgccauggagcgcgacggcuccuccggcggcgucauccgccucgccgccaucgccgaguccggcgucgagcgccagguccuccucggcgaccagauccccaaguucgccgucgccacccucccccccgccuga

SEQ ID NO: 48238 - RNA, 834 nt, Artificial Sequence
  derived and/or modified sequence opt2 from PSMB7__Homo_sapiens__NP_002790
auggccgccgucuccgucuacgccccccccgucggcggcuucuccuucgacaacugccgccgcaacgccguccucgaggccgacuucgccaagcgcggcuacaagcuccccaagguccgcaagaccggcaccaccaucgccggcgucgucuacaaggacggcaucguccucggcgccgacacccgcgccaccgagggcauggucgucgccgacaagaacugcuccaagauccacuucaucucccccaacaucuacugcugcggcgccggcaccgccgccgacaccgacaugaccacccagcucaucuccuccaaccucgagcuccacucccucuccaccggccgccucccccgcgucgucaccgccaaccgcaugcucaagcagaugcucuuccgcuaccagggcuacaucggcgccgcccucguccucggcggcgucgacgucaccggcccccaccucuacuccaucuacccccacggcuccaccgacaagcuccccuacgucaccaugggcuccggcucccucgccgccauggccgucuucgaggacaaguuccgccccgacauggaggaggaggaggccaagaaccucgucuccgaggccaucgccgccggcaucuucaacgaccucggcuccggcuccaacaucgaccucugcgucaucuccaagaacaagcucgacuuccuccgccccuacaccguccccaacaagaagggcacccgccucggccgcuaccgcugcgagaagggcaccaccgccguccucaccgagaagaucaccccccucgagaucgagguccucgaggagaccguccagaccauggacaccuccuga

SEQ ID NO: 48239 - RNA, 819 nt, Artificial Sequence
  derived and/or modified sequence opt2 from PSMB8__Homo_sapiens__NP_004150
augcucaucggcacccccaccccccgcgacaccacccccuccuccuggcucaccuccucccuccucgucgaggccgccccccucgacgacaccacccuccccacccccgucuccuccggcugccccggccucgagcccaccgaguucuuccagucccucggcggcgacggcgagcgcaacguccagaucgagauggcccacggcaccaccacccucgccuucaaguuccagcacggcgucaucgccgccgucgacucccgcgccuccgccggcuccuacaucuccgcccuccgcgucaacaaggucaucgagaucaaccccuaccuccucggcaccauguccggcugcgccgccgacugccaguacugggagcgccuccucgccaaggagugccgccucuacuaccuccgcaacggcgagcgcaucuccgucuccgccgccuccaagcuccucuccaacaugaugugccaguaccgcggcaugggccucuccaugggcuccaugaucugcggcugggacaagaagggccccggccucuacuacgucgacgagcacggcacccgccucuccggcaacauguucuccaccggcuccggcaacaccuacgccuacggcgucauggacuccggcuaccgccccaaccucucccccgaggaggccuacgaccucggccgccgcgccaucgccuacgccacccaccgcgacuccuacuccggcggcgucgucaacauguaccacaugaaggaggacggcugggucaaggucgaguccaccgacgucuccgaccuccuccaccaguaccgcgaggccaaccaguga

SEQ ID NO: 48240 - RNA, 660 nt, Artificial Sequence
  derived and/or modified sequence opt2 from PSMB9__Homo_sapiens__NP_002791
augcuccgcgccggcgcccccaccggcgaccucccccgcgccggcgagguccacaccggcaccaccaucauggccgucgaguucgacggcggcgucgucaugggcuccgacucccgcgucuccgccggcgaggccgucgucaaccgcgucuucgacaagcucuccccccuccacgagcgcaucuacugcgcccucuccggcuccgccgccgacgcccaggccgucgccgacauggccgccuaccagcucgagcuccacggcaucgagcucgaggagcccccccucguccucgccgccgccaacgucguccgcaacaucuccuacaaguaccgcgaggaccucuccgcccaccucauggucgccggcugggaccagcgcgagggcggccaggucuacggcacccucggcggcaugcucacccgccagcccuucgccaucggcggcuccggcuccaccuucaucuacggcuacgucgacgccgccuacaagcccggcaugucccccgaggagugccgccgcuucaccaccgacgccaucgcccucgccaugucccgcgacggcuccuccggcggcgucaucuaccucgucaccaucaccgccgccggcgucgaccaccgcgucauccucggcaacgagcuccccaaguucuacgacgaguga

SEQ ID NO: 48241 - RNA, 1323 nt, Artificial Sequence
  derived and/or modified sequence opt2 from PSMC1__Homo_sapiens__NP_002793
augggccagucccaguccggcggccacggccccggcggcggcaagaaggacgacaaggacaagaagaagaaguacgagccccccguccccacccgcgucggcaagaagaagaagaagaccaagggccccgacgccgccuccaagcucccccucgucaccccccacacccagugccgccucaagcuccucaagcucgagcgcaucaaggacuaccuccucauggaggaggaguucauccgcaaccaggagcagaugaagccccucgaggagaagcaggaggaggagcgcuccaaggucgacgaccuccgcggcacccccauguccgucggcacccucgaggagaucaucgacgacaaccacgccaucgucuccaccuccgucggcuccgagcacuacgucuccauccucuccuucgucgacaaggaccuccucgagcccggcugcuccguccuccucaaccacaagguccacgccgucaucggcguccucauggacgacaccgacccccucgucaccgucaugaaggucgagaaggccccccaggagaccuacgccgacaucggcggccucgacaaccagauccaggagaucaaggaguccgucgagcucccccucacccaccccgaguacuacgaggagaugggcaucaagccccccaagggcgucauccucuacggcccccccggcaccggcaagacccuccucgccaaggccgucgccaaccagaccuccgccaccuuccuccgcgucgucggcuccgagcucauccagaaguaccucggcgacggccccaagcucguccgcgagcucuuccgcgucgccgaggagcacgcccccuccaucgucuucaucgacgagaucgacgccaucggcaccaagcgcuacgacuccaacuccggcggcgagcgcgagauccagcgcaccaugcucgagcuccucaaccagcucgacggcuucgacucccgcggcgacgucaaggucaucauggccaccaaccgcaucgagacccucgaccccgcccucauccgccccggccgcaucgaccgcaagaucgaguucccccuccccgacgagaagaccaagaagcgcaucuuccagauccacaccucccgcaugacccucgccgacgacgucacccucgacgaccucaucauggccaaggacgaccucuccggcgccgacaucaaggccaucugcaccgaggccggccucauggcccuccgcgagcgccgcaugaaggucaccaacgaggacuucaagaaguccaaggagaacguccucuacaagaagcaggagggcacccccgagggccucuaccucuga

SEQ ID NO: 48242 - RNA, 426 nt, Artificial Sequence
  derived and/or modified sequence opt2 from PSMC2__Homo_sapiens__NP_001191382
augcccgacuaccucggcgccgaccagcgcaagaccaaggaggacgagaaggacgacaagcccauccgcgcccucgacgagggcgacaucgcccuccucaagaccuacggccaguccaccuacucccgccagaucaagcaggucgaggacgacauccagcagcuccucaagaagaucaacgagcucaccggcaucaaggaguccgacaccggccucgccccccccgcccucugggaccucgccgccgacaagcagacccuccaguccgagcagccccuccaggucgcccgcugcaccaagaucaucaacgccgacuccgaggaccccaaguacaucaucaacgucaagcaguucgccaaguucgucgucgaccucuccgaccaggucgcccccaccgacaucgaggagggcaugcgcgucggcuga

SEQ ID NO: 48243 - RNA, 1320 nt, Artificial Sequence
  derived and/or modified sequence opt2 from PSMC3__Homo_sapiens__NP_002795
augaaccuccuccccaacaucgagucccccgucacccgccaggagaagauggccaccgucugggacgaggccgagcaggacggcaucggcgaggagguccucaagauguccaccgaggagaucauccagcgcacccgccuccucgacuccgagaucaagaucaugaaguccgagguccuccgcgucacccacgagcuccaggccaugaaggacaagaucaaggagaacuccgagaagaucaaggucaacaagacccuccccuaccucgucuccaacgucaucgagcuccucgacgucgaccccaacgaccaggaggaggacggcgccaacaucgaccucgacucccagcgcaagggcaagugcgccgucaucaagaccuccacccgccagaccuacuuccuccccgucaucggccucgucgacgccgagaagcucaagcccggcgaccucgucggcgucaacaaggacuccuaccucauccucgagacccuccccaccgaguacgacucccgcgucaaggccauggaggucgacgagcgccccaccgagcaguacuccgacaucggcggccucgacaagcagauccaggagcucgucgaggccaucguccuccccaugaaccacaaggagaaguucgagaaccucggcauccagccccccaagggcguccucauguacggcccccccggcaccggcaagacccuccucgcccgcgccugcgccgcccagaccaaggccaccuuccucaagcucgccggcccccagcucguccagauguucaucggcgacggcgccaagcucguccgcgacgccuucgcccucgccaaggagaaggcccccuccaucaucuucaucgacgagcucgacgccaucggcaccaagcgcuucgacuccgagaaggccggcgaccgcgagguccagcgcaccaugcucgagcuccucaaccagcucgacggcuuccagcccaacacccaggucaaggucaucgccgccaccaaccgcgucgacauccucgaccccgcccuccuccgcuccggccgccucgaccgcaagaucgaguuccccaugcccaacgaggaggcccgcgcccgcaucaugcagauccacucccgcaagaugaacgucucccccgacgucaacuacgaggagcucgcccgcugcaccgacgacuucaacggcgcccagugcaaggccgucugcgucgaggccggcaugaucgcccuccgccgcggcgccaccgagcucacccacgaggacuacauggagggcauccucgagguccaggccaagaagaaggccaaccuccaguacuacgccuga

SEQ ID NO: 48244 - RNA, 465 nt, Artificial Sequence
  derived and/or modified sequence opt2 from PSMC3IP__Homo_sapiens__NP_001242943
auguacggcaagcagaagaucuacuucgccgaccaggaccaguucgacauggucuccgacgccgaccuccagguccucgacggcaagaucgucgcccucaccgccaagguccagucccuccagcaguccugccgcuacauggaggccgagcucaaggagcucuccuccgcccucaccacccccgagaugcagaaggagauccaggagcucaagaaggagugcgccggcuaccgcgagcgccucaagaacaucaaggccgccaccaaccacgucacccccgaggagaaggagcaggucuaccgcgagcgccagaaguacugcaaggaguggcgcaagcgcaagcgcauggccaccgagcucuccgacgccauccucgagggcuaccccaaguccaagaagcaguucuucgaggaggucggcaucgagaccgacgaggacuacaacgucacccuccccgaccccuga

SEQ ID NO: 48245 - RNA, 1257 nt, Artificial Sequence
  derived and/or modified sequence opt2 from PSMC4__Homo_sapiens__NP_006494
auggaggagaucggcauccucgucgagaaggcccaggacgagauccccgcccucuccgucucccgcccccagaccggccucuccuuccucggccccgagcccgaggaccucgaggaccucuacucccgcuacaagaagcuccagcaggagcucgaguuccucgagguccaggaggaguacaucaaggacgagcagaagaaccucaagaaggaguuccuccacgcccaggaggaggucaagcgcauccaguccaucccccucgucaucggccaguuccucgaggccgucgaccagaacaccgccaucgucggcuccaccaccggcuccaacuacuacguccgcauccucuccaccaucgaccgcgagcuccucaagcccaacgccuccgucgcccuccacaagcacuccaacgcccucgucgacguccucccccccgaggccgacuccuccaucaugaugcucaccuccgaccagaagcccgacgucauguacgccgacaucggcggcauggacauccagaagcaggagguccgcgaggccgucgagcucccccucacccacuucgagcucuacaagcagaucggcaucgaccccccccgcggcguccucauguacggcccccccggcugcggcaagaccaugcucgccaaggccgucgcccaccacaccaccgccgccuucauccgcgucgucggcuccgaguucguccagaaguaccucggcgagggcccccgcaugguccgcgacgucuuccgccucgccaaggagaacgcccccgccaucaucuucaucgacgagaucgacgccaucgccaccaagcgcuucgacgcccagaccggcgccgaccgcgagguccagcgcauccuccucgagcuccucaaccagauggacggcuucgaccagaacgucaacgucaaggucaucauggccaccaaccgcgccgacacccucgaccccgcccuccuccgccccggccgccucgaccgcaagaucgaguucccccuccccgaccgccgccagaagcgccucaucuucuccaccaucaccuccaagaugaaccucuccgaggaggucgaccucgaggacuacgucgcccgccccgacaagaucuccggcgccgacaucaacuccaucugccaggaguccggcaugcucgccguccgcgagaaccgcuacaucguccucgccaaggacuucgagaaggccuacaagaccgucaucaagaaggacgagcaggagcacgaguucuacaaguga

SEQ ID NO: 48246 - RNA, 1197 nt, Artificial Sequence
  derived and/or modified sequence opt2 from PSMC5__Homo_sapiens__NP_001186092
auggagcucgaggagggcaaggccggcuccggccuccgccaguacuaccucuccaagaucgaggagcuccagcucaucgucaacgacaagucccagaaccuccgccgccuccaggcccagcgcaacgagcucaacgccaagguccgccuccuccgcgaggagcuccagcuccuccaggagcagggcuccuacgucggcgaggucguccgcgccauggacaagaagaagguccucgucaagguccaccccgagggcaaguucgucgucgacgucgacaagaacaucgacaucaacgacgucacccccaacugccgcgucgcccuccgcaacgacuccuacacccuccacaagauccuccccaacaaggucgacccccucgucucccucaugauggucgagaagguccccgacuccaccuacgagaugaucggcggccucgacaagcagaucaaggagaucaaggaggucaucgagcuccccgucaagcaccccgagcucuucgaggcccucggcaucgcccagcccaagggcguccuccucuacggcccccccggcaccggcaagacccuccucgcccgcgccgucgcccaccacaccgacugcaccuucauccgcgucuccggcuccgagcucguccagaaguucaucggcgagggcgcccgcaugguccgcgagcucuucgucauggcccgcgagcacgcccccuccaucaucuucauggacgagaucgacuccaucggcuccucccgccucgagggcggcuccggcggcgacuccgagguccagcgcaccaugcucgagcuccucaaccagcucgacggcuucgaggccaccaagaacaucaaggucaucauggccaccaaccgcaucgacauccucgacuccgcccuccuccgccccggccgcaucgaccgcaagaucgaguuccccccccccaacgaggaggcccgccucgacauccucaagauccacucccgcaagaugaaccucacccgcggcaucaaccuccgcaagaucgccgagcucaugcccggcgccuccggcgccgaggucaagggcgucugcaccgaggccggcauguacgcccuccgcgagcgccgcguccacgucacccaggaggacuucgagauggccgucgccaaggucaugcagaaggacuccgagaagaacauguccaucaagaagcucuggaaguga

SEQ ID NO: 48247 - RNA, 1212 nt, Artificial Sequence
  derived and/or modified sequence opt2 from PSMC6__Homo_sapiens__NP_002797
auggccauccccggcauccccuacgagcgccgccuccucaucauggccgacccccgcgacaaggcccuccaggacuaccgcaagaagcuccucgagcacaaggagaucgacggccgccucaaggagcuccgcgagcagcucaaggagcucaccaagcaguacgagaaguccgagaacgaccucaaggcccuccaguccgucggccagaucgucggcgagguccucaagcagcucaccgaggagaaguucaucgucaaggccaccaacggcccccgcuacgucgucggcugccgccgccagcucgacaaguccaagcucaagcccggcacccgcgucgcccucgacaugaccacccucaccaucaugcgcuaccucccccgcgaggucgacccccucgucuacaacaugucccacgaggaccccggcaacgucuccuacuccgagaucggcggccucuccgagcagauccgcgagcuccgcgaggucaucgagcucccccucaccaaccccgagcucuuccagcgcgucggcaucaucccccccaagggcugccuccucuacggcccccccggcaccggcaagacccuccucgcccgcgccgucgccucccagcucgacugcaacuuccucaaggucgucuccuccuccaucgucgacaaguacaucggcgaguccgcccgccucauccgcgagauguucaacuacgcccgcgaccaccagcccugcaucaucuucauggacgagaucgacgccaucggcggccgccgcuucuccgagggcaccuccgccgaccgcgagauccagcgcacccucauggagcuccucaaccagauggacggcuucgacacccuccaccgcgucaagaugaucauggccaccaaccgccccgacacccucgaccccgcccuccuccgccccggccgccucgaccgcaagauccacaucgaccuccccaacgagcaggcccgccucgacauccucaagauccacgccggccccaucaccaagcacggcgagaucgacuacgaggccaucgucaagcucuccgacggcuucaacggcgccgaccuccgcaacgucugcaccgaggccggcauguucgccauccgcgccgaccacgacuucgucguccaggaggacuucaugaaggccguccgcaaggucgccgacuccaagaagcucgaguccaagcucgacuacaagcccgucuga

SEQ ID NO: 48248 - RNA, 681 nt, Artificial Sequence
  derived and/or modified sequence opt2 from PSMD10__Homo_sapiens__NP_002805
auggagggcugcgucuccaaccucauggucugcaaccucgccuacuccggcaagcucgaggagcucaaggaguccauccucgccgacaagucccucgccacccgcaccgaccaggacucccgcaccgcccuccacugggccugcuccgccggccacaccgagaucgucgaguuccuccuccagcucggcguccccgucaacgacaaggacgacgccggcugguccccccuccacaucgccgccuccgccggccgcgacgagaucgucaaggcccuccucggcaagggcgcccaggucaacgccgucaaccagaacggcugcaccccccuccacuacgccgccuccaagaaccgccacgagaucgccgucaugcuccucgagggcggcgccaaccccgacgccaaggaccacuacgaggccaccgccaugcaccgcgccgccgccaagggcaaccucaagaugauccacauccuccucuacuacaaggccuccaccaacauccaggacaccgagggcaacaccccccuccaccucgccugcgacgaggagcgcgucgaggaggccaagcuccucgucucccagggcgccuccaucuacaucgagaacaaggaggagaagaccccccuccaggucgccaagggcggccucggccucauccucaagcgcauggucgagggcuga

SEQ ID NO: 48249 - RNA, 1371 nt, Artificial Sequence
  derived and/or modified sequence opt2 from PSMD12__Homo_sapiens__NP_002807
auggccgacggcggcuccgagcgcgccgacggccgcaucgucaagauggaggucgacuacuccgccaccgucgaccagcgccuccccgagugcgccaagcucgccaaggagggccgccuccaggaggucaucgagacccuccucucccucgagaagcagacccgcaccgccuccgacauggucuccaccucccgcauccucgucgccgucgucaagaugugcuacgaggccaaggagugggaccuccucaacgagaacaucaugcuccucuccaagcgccgcucccagcucaagcaggccgucgccaagaugguccagcagugcugcaccuacgucgaggagaucaccgaccuccccaucaagcuccgccucaucgacacccuccgcauggucaccgagggcaagaucuacgucgagaucgagcgcgcccgccucaccaagacccucgccaccaucaaggagcagaacggcgacgucaaggaggccgccuccauccuccaggagcuccaggucgagaccuacggcuccauggagaagaaggagcgcgucgaguucauccucgagcagaugcgccucugccucgccgucaaggacuacauccgcacccagaucaucuccaagaagaucaacaccaaguucuuccaggaggagaacaccgagaagcucaagcucaaguacuacaaccucaugauccagcucgaccagcacgagggcuccuaccucuccaucugcaagcacuaccgcgccaucuacgacacccccugcauccaggccgaguccgagaaguggcagcaggcccucaaguccgucguccucuacgucauccucgcccccuucgacaacgagcaguccgaccucguccaccgcaucuccggcgacaagaagcucgaggagauccccaaguacaaggaccuccucaagcucuucaccaccauggagcucaugcgcugguccacccucgucgaggacuacggcauggagcuccgcaagggcucccucgagucccccgccaccgacgucuucggcuccaccgaggagggcgagaagcgcuggaaggaccucaagaaccgcgucgucgagcacaacauccgcaucauggccaaguacuacacccgcaucaccaugaagcgcauggcccagcuccucgaccucuccgucgacgaguccgaggccuuccucuccaaccucgucgucaacaagaccaucuucgccaaggucgaccgccucgccggcaucaucaacuuccagcgccccaaggaccccaacaaccuccucaacgacuggucccagaagcucaacucccucaugucccucgucaacaagaccacccaccucaucgccaaggaggagaugauccacaaccuccaguga

SEQ ID NO: 48250 - RNA, 1131 nt, Artificial Sequence
  derived and/or modified sequence opt2 from PSMD13__Homo_sapiens__NP_002808
augaaggacguccccggcuuccuccagcagucccagaacuccggccccggccagcccgccgucuggcaccgccucgaggagcucuacaccaagaagcucuggcaccagcucacccuccagguccucgacuucguccaggaccccugcuucgcccagggcgacggccucaucaagcucuacgagaacuucaucuccgaguucgagcaccgcgucaacccccucucccucgucgagaucauccuccacgucguccgccagaugaccgaccccaacgucgcccucaccuuccucgagaagacccgcgagaaggucaaguccuccgacgaggccgucauccucugcaagaccgccaucggcgcccucaagcucaacaucggcgaccuccaggucaccaaggagaccaucgaggacgucgaggagaugcucaacaaccuccccggcgucaccuccguccacucccgcuucuacgaccucuccuccaaguacuaccagaccaucggcaaccacgccuccuacuacaaggacgcccuccgcuuccucggcugcgucgacaucaaggaccuccccgucuccgagcagcaggagcgcgccuucacccucggccucgccggccuccucggcgagggcgucuucaacuucggcgagcuccucaugcaccccguccucgagucccuccgcaacaccgaccgccaguggcucaucgacacccucuacgccuucaacuccggcaacgucgagcgcuuccagacccucaagaccgccuggggccagcagcccgaccucgccgccaacgaggcccagcuccuccgcaagauccagcuccucugccucauggagaugaccuucacccgccccgccaaccaccgccagcucaccuucgaggagaucgccaaguccgccaagaucaccgucaacgaggucgagcuccucgucaugaaggcccucuccgucggccucgucaagggcuccaucgacgaggucgacaagcgcguccacaugaccuggguccagccccgcguccucgaccuccagcagaucaagggcaugaaggaccgccucgaguucuggugcaccgacgucaaguccauggagaugcucgucgagcaccaggcccacgacauccucaccuga

SEQ ID NO: 48251 - RNA, 933 nt, Artificial Sequence
  derived and/or modified sequence opt2 from PSMD14__Homo_sapiens__NP_005796
auggaccgccuccuccgccucggcggcggcaugcccggccucggccagggcccccccaccgacgcccccgccgucgacaccgccgagcaggucuacaucuccucccucgcccuccucaagaugcucaagcacggccgcgccggcguccccauggaggucaugggccucaugcucggcgaguucgucgacgacuacaccguccgcgucaucgacgucuucgccaugccccaguccggcaccggcgucuccgucgaggccgucgaccccgucuuccaggccaagaugcucgacaugcucaagcagaccggccgccccgagauggucgucggcugguaccacucccaccccggcuucggcugcuggcucuccggcgucgacaucaacacccagcaguccuucgaggcccucuccgagcgcgccgucgccgucgucgucgaccccauccaguccgucaagggcaaggucgucaucgacgccuuccgccucaucaacgccaacaugaugguccucggccacgagccccgccagaccaccuccaaccucggccaccucaacaagcccuccauccaggcccucauccacggccucaaccgccacuacuacuccaucaccaucaacuaccgcaagaacgagcucgagcagaagaugcuccucaaccuccacaagaaguccuggauggagggccucacccuccaggacuacuccgagcacugcaagcacaacgaguccgucgucaaggagaugcucgagcucgccaagaacuacaacaaggccgucgaggaggaggacaagaugacccccgagcagcucgccaucaagaacgucggcaagcaggaccccaagcgccaccucgaggagcacgucgacguccucaugaccuccaacaucguccagugccucgccgccaugcucgacaccgucgucuucaaguga

SEQ ID NO: 48252 - RNA, 2769 nt, Artificial Sequence
  derived and/or modified sequence opt2 from PSMD1__Homo_sapiens__NP_001177966
augaucaccuccgccgccggcaucaucucccuccucgacgaggacgagccccagcucaaggaguucgcccuccacaagcucaacgccgucgucaacgacuucugggccgagaucuccgaguccgucgacaagaucgagguccucuacgaggacgagggcuuccgcucccgccaguucgccgcccucgucgccuccaaggucuucuaccaccucggcgccuucgaggagucccucaacuacgcccucggcgccggcgaccucuucaacgucaacgacaacuccgaguacgucgagaccaucaucgccaagugcaucgaccacuacaccaagcagugcgucgagaacgccgaccuccccgagggcgagaagaagcccaucgaccagcgccucgagggcaucgucaacaagauguuccagcgcugccucgacgaccacaaguacaagcaggccaucggcaucgcccucgagacccgccgccucgacgucuucgagaagaccauccucgaguccaacgacguccccggcaugcucgccuacucccucaagcucugcaugucccucaugcagaacaagcaguuccgcaacaagguccuccgcguccucgucaagaucuacaugaaccucgagaagcccgacuucaucaacgucugccagugccucaucuuccucgacgacccccaggccgucuccgacauccucgagaagcucgucaaggaggacaaccuccucauggccuaccagaucugcuucgaccucuacgaguccgccucccagcaguuccucuccuccgucauccagaaccuccgcaccgucggcacccccaucgccuccguccccggcuccaccaacaccggcaccguccccggcuccgagaaggacuccgacuccauggagaccgaggagaagaccuccuccgccuucgucggcaagacccccgaggccucccccgagcccaaggaccagacccucaagaugaucaagauccucuccggcgagauggccaucgagcuccaccuccaguuccucauccgcaacaacaacaccgaccucaugauccucaagaacaccaaggacgccguccgcaacuccgucugccacaccgccaccgucaucgccaacuccuucaugcacugcggcaccaccuccgaccaguuccuccgcgacaaccucgaguggcucgcccgcgccaccaacugggccaaguucaccgccaccgccucccucggcgucauccacaagggccacgagaaggaggcccuccagcucauggccaccuaccuccccaaggacaccucccccggcuccgccuaccaggagggcggcggccucuacgcccucggccucauccacgccaaccacggcggcgacaucaucgacuaccuccucaaccagcucaagaacgccuccaacgacaucguccgccacggcggcucccucggccucggccucgccgccaugggcaccgcccgccaggacgucuacgaccuccucaagaccaaccucuaccaggacgacgccgucaccggcgaggccgccggccucgcccucggccucgucaugcucggcuccaagaacgcccaggccaucgaggacauggucggcuacgcccaggagacccagcacgagaagauccuccgcggccucgccgucggcaucgcccucgucauguacggccgcauggaggaggccgacgcccucaucgagucccucugccgcgacaaggaccccauccuccgccgcuccggcauguacaccgucgccauggccuacugcggcuccggcaacaacaaggccauccgccgccuccuccacgucgccgucuccgacgucaacgacgacguccgccgcgccgccgucgagucccucggcuucauccucuuccgcacccccgagcagugccccuccgucgucucccuccucuccgaguccuacaacccccacguccgcuacggcgccgccauggcccucggcaucugcugcgccggcaccggcaacaaggaggccaucaaccuccucgagcccaugaccaacgaccccgucaacuacguccgccagggcgcccucaucgccuccgcccucaucaugauccagcagaccgagaucaccugccccaaggucaaccaguuccgccagcucuacuccaaggucaucaacgacaagcacgacgacgucauggccaaguucggcgccauccucgcccagggcauccucgacgccggcggccacaacgucaccaucucccuccagucccgcaccggccacacccacaugcccuccgucgucggcguccucgucuucacccaguucugguucugguucccccucucccacuuccucucccucgccuacacccccaccugcgucaucggccucaacaaggaccucaaggucuccaccgccguccucuccaucaccgccaaggccaagaagaaggagaaggagaaggagaagaaggaggaggagaagauggaggucgacgaggccgagaagaaggaggagaaggagaagaagaaggagcccgagcccaacuuccagcuccucgacaaccccgcccgcgucaugcccgcccagcucaagguccucaccaugcccgagaccugccgcuaccagcccuucaagccccucuccaucggcggcaucaucauccucaaggacaccuccgaggacaucgaggagcucgucgagcccgucgccgcccacggccccaagaucgaggaggaggagcaggagcccgagccccccgagcccuucgaguacaucgacgacuga

SEQ ID NO: 48253 - RNA, 2250 nt, Artificial Sequence
  derived and/or modified sequence opt2 from PSMD2__Homo_sapiens__NP_001265638
auguccauguccggcgaggucgccaaggaguggcaggagcucgacgacgccgagaagguccagcgcgagccccuccucacccucgucaaggagaucguccccuacaacauggcccacaacgccgagcacgaggccugcgaccuccucauggagaucgagcaggucgacaugcucgagaaggacaucgacgagaacgccuacgccaaggucugccucuaccucaccuccugcgucaacuacguccccgagcccgagaacuccgcccuccuccgcugcgcccucggcgucuuccgcaaguucucccgcuuccccgaggcccuccgccucgcccucaugcucaacgacauggagcucgucgaggacaucuucaccuccugcaaggacgucgucguccagaagcagauggccuucaugcucggccgccacggcgucuuccucgagcucuccgaggacgucgaggaguacgaggaccucaccgagaucauguccaacguccagcucaacuccaacuuccucgcccucgcccgcgagcucgacaucauggagcccaagguccccgacgacaucuacaagacccaccucgagaacaaccgcuucggcggcuccggcucccaggucgacuccgcccgcaugaaccucgccuccuccuucgucaacggcuucgucaacgccgccuucggccaggacaagcuccucaccgacgacggcaacaaguggcucuacaagaacaaggaccacggcaugcucuccgccgccgccucccucggcaugauccuccucugggacgucgacggcggccucacccagaucgacaaguaccucuacuccuccgaggacuacaucaaguccggcgcccuccucgccugcggcaucgucaacuccggcguccgcaacgagugcgaccccgcccucgcccuccucuccgacuacguccuccacaacuccaacaccaugcgccucggcuccaucuucggccucggccucgccuacgccggcuccaaccgcgaggacguccucacccuccuccuccccgucaugggcgacuccaaguccuccauggaggucgccggcgucaccgcccucgccugcggcaugaucgccgucggcuccugcaacggcgacgucaccuccaccauccuccagaccaucauggagaaguccgagaccgagcucaaggacaccuacgcccgcuggcucccccucggccucggccucaaccaccucggcaagggcgaggccaucgaggccauccucgccgcccucgaggucgucuccgagcccuuccgcuccuucgccaacacccucgucgacgucugcgccuacgccggcuccggcaacguccucaagguccagcagcuccuccacaucugcuccgagcacuucgacuccaaggagaaggaggaggacaaggacaagaaggagaagaaggacaaggacaagaaggaggcccccgccgacaugggcgcccaccagggcgucgccguccucggcaucgcccucaucgccaugggcgaggagaucggcgccgagauggcccuccgcaccuucggccaccuccuccgcuacggcgagcccacccuccgccgcgccgucccccucgcccucgcccucaucuccgucuccaacccccgccucaacauccucgacacccucuccaaguucucccacgacgccgaccccgaggucuccuacaacuccaucuucgccaugggcauggucggcuccggcaccaacaacgcccgccucgccgccaugcuccgccagcucgcccaguaccacgccaaggaccccaacaaccucuucaugguccgccucgcccagggccucacccaccucggcaagggcacccucacccucugccccuaccacuccgaccgccagcucaugucccaggucgccgucgccggccuccucaccguccucgucuccuuccucgacguccgcaacaucauccucggcaagucccacuacguccucuacggccucgucgccgccaugcagccccgcaugcucgucaccuucgacgaggagcuccgcccccuccccgucuccguccgcgucggccaggccgucgacgucgucggccaggccggcaagcccaagaccaucaccggcuuccagacccacaccacccccguccuccucgcccacggcgagcgcgccgagcucgccaccgaggaguuccuccccgucacccccauccucgagggcuucgucauccuccgcaagaaccccaacuacgaccucuga

SEQ ID NO: 48254 - RNA, 1605 nt, Artificial Sequence
  derived and/or modified sequence opt2 from PSMD3__Homo_sapiens__NP_002800
augaagcaggagggcuccgcccgccgccgcggcgccgacaaggccaagcccccccccggcggcggcgagcaggagcccccccccccccccgccccccaggacgucgagaugaaggaggaggccgccaccggcggcggcuccaccggcgaggccgacggcaagaccgccgccgccgccgccgagcacucccagcgcgagcucgacaccgucacccucgaggacaucaaggagcacgucaagcagcucgagaaggccgucuccggcaaggagccccgcuucguccuccgcgcccuccgcaugcuccccuccaccucccgccgccucaaccacuacguccucuacaaggccguccagggcuucuucaccuccaacaacgccacccgcgacuuccuccuccccuuccucgaggagcccauggacaccgaggccgaccuccaguuccgcccccgcaccggcaaggccgccuccaccccccuccuccccgaggucgaggccuaccuccagcuccucgucgucaucuucaugaugaacuccaagcgcuacaaggaggcccagaagaucuccgacgaccucaugcagaagaucuccacccagaaccgccgcgcccucgaccucgucgccgccaagugcuacuacuaccacgcccgcgucuacgaguuccucgacaagcucgacgucguccgcuccuuccuccacgcccgccuccgcaccgccacccuccgccacgacgccgacggccaggccacccuccucaaccuccuccuccgcaacuaccuccacuacucccucuacgaccaggccgagaagcucgucuccaaguccgucuuccccgagcaggccaacaacaacgagugggcccgcuaccucuacuacaccggccgcaucaaggccauccagcucgaguacuccgaggcccgccgcaccaugaccaacgcccuccgcaaggccccccagcacaccgccgucggcuucaagcagaccguccacaagcuccucaucgucgucgagcuccuccucggcgagauccccgaccgccuccaguuccgccagcccucccucaagcgcucccucaugcccuacuuccuccucacccaggccguccgcaccggcaaccucgccaaguucaaccagguccucgaccaguucggcgagaaguuccaggccgacggcaccuacacccucaucauccgccuccgccacaacgucaucaagaccggcguccgcaugaucucccucuccuacucccgcaucucccucgccgacaucgcccagaagcuccagcucgacucccccgaggacgccgaguucaucgucgccaaggccauccgcgacggcgucaucgaggccuccaucaaccacgagaagggcuacguccaguccaaggagaugaucgacaucuacuccacccgcgagccccagcucgccuuccaccagcgcaucuccuucugccucgacauccacaacauguccgucaaggccaugcgcuucccccccaaguccuacaacaaggaccucgaguccgccgaggagcgccgcgagcgcgagcagcaggaccucgaguucgccaaggagauggccgaggacgacgacgacuccuuccccuga

SEQ ID NO: 48255 - RNA, 1134 nt, Artificial Sequence
  derived and/or modified sequence opt2 from PSMD4__Homo_sapiens__NP_002801
augguccucgaguccaccauggucugcgucgacaacuccgaguacaugcgcaacggcgacuuccuccccacccgccuccaggcccagcaggacgccgucaacaucgucugccacuccaagacccgcuccaaccccgagaacaacgucggccucaucacccucgccaacgacugcgagguccucaccacccucacccccgacaccggccgcauccucuccaagcuccacaccguccagcccaagggcaagaucaccuucugcaccggcauccgcgucgcccaccucgcccucaagcaccgccagggcaagaaccacaagaugcgcaucaucgccuucgucggcucccccgucgaggacaacgagaaggaccucgucaagcucgccaagcgccucaagaaggagaaggucaacgucgacaucaucaacuucggcgaggaggaggucaacaccgagaagcucaccgccuucgucaacacccucaacggcaaggacggcaccggcucccaccucgucaccgucccccccggccccucccucgccgacgcccucaucuccucccccauccucgccggcgagggcggcgccaugcucggccucggcgccuccgacuucgaguucggcgucgaccccuccgccgaccccgagcucgcccucgcccuccgcgucuccauggaggagcagcgccagcgccaggaggaggaggcccgccgcgccgccgccgccuccgccgccgaggccggcaucgccaccaccggcaccgaggacuccgacgacgcccuccucaagaugaccaucucccagcaggaguucggccgcaccggccuccccgaccucuccuccaugaccgaggaggagcagaucgccuacgccaugcagaugucccuccagggcgccgaguucggccaggccgaguccgccgacaucgacgccuccuccgccauggacaccuccgagcccgccaaggaggaggacgacuacgacgucaugcaggaccccgaguuccuccaguccguccucgagaaccuccccggcgucgaccccaacaacgaggccauccgcaacgccaugggcucccucgccucccaggccaccaaggacggcaagaaggacaagaaggaggaggacaagaaguga

SEQ ID NO: 48256 - RNA, 1329 nt, Artificial Sequence
  derived and/or modified sequence opt2 from PSMD6__Homo_sapiens__NP_001258708
augccccucgagaaccucgaggaggagggccuccccaagaaccccgaccuccgcaucgcccagcuccgcuuccuccucucccuccccgagcaccgcggcgacgccgccguccgcgacgagcucauggccgccguccgcgacaacaacuucuggaaccgcauccgccaggagcagaccgaggacugcccccccuccucccccucccgcggcuggcacugccaggacuggcccucccgcaagccccccaccuccauccgccucugcuucgccaagcccaucaucaagcgccaccgcaugcccuccuacauggcccccuacuacgaggcccucugcaagucccucgacuggcagaucgacgucgaccuccucaacaagaugaagaaggccaacgaggacgagcucaagcgccucgacgaggagcucgaggacgccgagaagaaccucggcgaguccgagauccgcgacgccaugauggccaaggccgaguaccucugccgcaucggcgacaaggagggcgcccucaccgccuuccgcaagaccuacgacaagaccgucgcccucggccaccgccucgacaucgucuucuaccuccuccgcaucggccucuucuacauggacaacgaccucaucacccgcaacaccgagaaggccaagucccucaucgaggagggcggcgacugggaccgccgcaaccgccucaaggucuaccagggccucuacugcgucgccauccgcgacuucaagcaggccgccgagcucuuccucgacaccgucuccaccuucaccuccuacgagcucauggacuacaagaccuucgucaccuacaccgucuacgucuccaugaucgcccucgagcgccccgaccuccgcgagaaggucaucaagggcgccgagauccucgagguccuccacucccuccccgccguccgccaguaccucuucucccucuacgagugccgcuacuccgucuucuuccagucccucgccgucgucgagcaggagaugaagaaggacuggcucuucgccccccacuaccgcuacuacguccgcgagaugcgcauccacgccuacucccagcuccucgaguccuaccgcucccucacccucggcuacauggccgaggccuucggcgucggcgucgaguucaucgaccaggagcucucccgcuucaucgccgccggccgccuccacugcaagaucgacaaggucaacgagaucgucgagaccaaccgccccgacuccaagaacuggcaguaccaggagaccaucaagaagggcgaccuccuccucaaccgcguccagaagcucucccgcgucaucaacauguga

SEQ ID NO: 48257 - RNA, 975 nt, Artificial Sequence
  derived and/or modified sequence opt2 from PSMD7__Homo_sapiens__NP_002802
augcccgagcucgccguccagaaggucgucguccacccccucguccuccucuccgucgucgaccacuucaaccgcaucggcaaggucggcaaccagaagcgcgucgucggcguccuccucggcuccuggcagaagaagguccucgacgucuccaacuccuucgccguccccuucgacgaggacgacaaggacgacuccgucugguuccucgaccacgacuaccucgagaacauguacggcauguucaagaaggucaacgcccgcgagcgcaucgucggcugguaccacaccggccccaagcuccacaagaacgacaucgccaucaacgagcucaugaagcgcuacugccccaacuccguccucgucaucaucgacgucaagcccaaggaccucggccuccccaccgaggccuacaucuccgucgaggagguccacgacgacggcacccccaccuccaagaccuucgagcacgucaccuccgagaucggcgccgaggaggccgaggaggucggcgucgagcaccuccuccgcgacaucaaggacaccaccgucggcacccucucccagcgcaucaccaaccagguccacggccucaagggccucaacuccaagcuccucgacauccgcuccuaccucgagaaggucgccaccggcaagcuccccaucaaccaccagaucaucuaccagcuccaggacgucuucaaccuccuccccgacgucucccuccaggaguucgucaaggccuucuaccucaagaccaacgaccagauggucgucgucuaccucgccucccucauccgcuccgucgucgcccuccacaaccucaucaacaacaagaucgccaaccgcgacgccgagaagaaggagggccaggagaaggaggaguccaagaaggaccgcaaggaggacaaggagaaggacaaggacaaggagaaguccgacgucaagaaggaggagaagaaggagaagaaguga

SEQ ID NO: 48258 - RNA, 1053 nt, Artificial Sequence
  derived and/or modified sequence opt2 from PSMD8__Homo_sapiens__NP_002803
auguucaucaagggccgcgccccccgcgcccccccccgcgagcgccgccgcgccacccgcggcggccuccgccaggucgucgcccccccccgcgcccucggcuccaccucccgcccccacuuccgccgcgccuccgucugccgccgccgcugccgcaaguccggcggccuccucgccgccucccgcaagauggccgccgccgccgucaacggcgccgccggcuucuccuccuccggccccgccgccaccuccggcgccguccuccaggccgccaccggcauguacgagcagcucaagggcgaguggaaccgcaagucccccaaccucuccaagugcggcgaggagcucggccgccucaagcucguccuccucgagcucaacuuccuccccaccaccggcaccaagcucaccaagcagcagcucauccucgcccgcgacauccucgagaucggcgcccagugguccauccuccgcaaggacauccccuccuucgagcgcuacauggcccagcucaagugcuacuacuucgacuacaaggagcagcuccccgaguccgccuacaugcaccagcuccucggccucaaccuccucuuccuccucucccagaaccgcgucgccgaguuccacaccgagcucgagcgccuccccgccaaggacauccagaccaacgucuacaucaagcaccccgucucccucgagcaguaccucauggagggcuccuacaacaaggucuuccucgccaagggcaacauccccgccgaguccuacaccuucuucaucgacauccuccucgacaccauccgcgacgagaucgccggcugcaucgagaaggccuacgagaagauccucuucaccgaggccacccgcauccucuucuucaacacccccaagaagaugaccgacuacgccaagaagcgcggcuggguccucggccccaacaacuacuacuccuucgccucccagcagcagaagcccgaggacaccaccauccccuccaccgagcucgccaagcaggucaucgaguacgcccgccagcucgagaugaucgucuga

SEQ ID NO: 48259 - RNA, 672 nt, Artificial Sequence
  derived and/or modified sequence opt2 from PSMD9__Homo_sapiens__NP_002804
auguccgacgaggaggcccgccaguccggcggcuccucccaggccggcgucgucaccgucuccgacguccaggagcucaugcgccgcaaggaggagaucgaggcccagaucaaggccaacuacgacguccucgagucccagaagggcaucggcaugaacgagccccucgucgacugcgagggcuacccccgcuccgacgucgaccucuaccagguccgcaccgcccgccacaacaucaucugccuccagaacgaccacaaggccgucaugaagcaggucgaggaggcccuccaccagcuccacgcccgcgacaaggagaagcaggcccgcgacauggccgaggcccacaaggaggccaugucccgcaagcucggccaguccgagucccagggccccccccgcgccuucgccaaggucaacuccaucucccccggcucccccgccuccaucgccggccuccaggucgacgacgagaucgucgaguucggcuccgucaacacccagaacuuccagucccuccacaacaucggcuccgucguccagcacuccgagggcaagccccucaacgucaccgucauccgccgcggcgagaagcaccagcuccgccucguccccacccgcugggccggcaagggccuccucggcugcaacaucaucccccuccagcgcuga

SEQ ID NO: 48260 - RNA, 750 nt, Artificial Sequence
  derived and/or modified sequence opt2 from PSME1__Homo_sapiens__NP_006254
auggccaugcuccgcguccagcccgaggcccaggccaaggucgacgucuuccgcgaggaccucugcaccaagaccgagaaccuccucggcuccuacuuccccaagaagaucuccgagcucgacgccuuccucaaggagcccgcccucaacgaggccaaccucuccaaccucaaggccccccucgacauccccguccccgaccccgucaaggagaaggagaaggaggagcgcaagaagcagcaggagaaggaggacaaggacgagaagaagaagggcgaggacgaggacaagggcccccccugcggccccgucaacugcaacgagaagaucgucguccuccuccagcgccucaagcccgagaucaaggacgucaucgagcagcucaaccucgucaccaccuggcuccagcuccagaucccccgcaucgaggacggcaacaacuucggcgucgccguccaggagaaggucuucgagcucaugaccucccuccacaccaagcucgagggcuuccacacccagaucuccaaguacuucuccgagcgcggcgacgccgucaccaaggccgccaagcagccccacgucggcgacuaccgccagcucguccacgagcucgacgaggccgaguaccgcgacauccgccucauggucauggagauccgcaacgccuacgccguccucuacgacaucauccucaagaacuucgagaagcucaagaagccccgcggcgagaccaagggcaugaucuacuga

SEQ ID NO: 48261 - RNA, 720 nt, Artificial Sequence
  derived and/or modified sequence opt2 from PSME2__Homo_sapiens__NP_002809
auggccaagcccugcggcguccgccucuccggcgaggcccgcaagcaggucgaggucuuccgccagaaccucuuccaggaggccgaggaguuccucuaccgcuuccucccccagaagaucaucuaccucaaccagcuccuccaggaggacucccucaacgucgccgaccucaccucccuccgcgccccccucgacauccccauccccgaccccccccccaaggacgacgagauggagaccgacaagcaggagaagaaggagguccacaagugcggcuuccuccccggcaacgagaagguccucucccuccucgcccucgucaagcccgaggucuggacccucaaggagaagugcauccucgucaucaccuggauccagcaccucauccccaagaucgaggacggcaacgacuucggcgucgccauccaggagaagguccucgagcgcgucaacgccgucaagaccaaggucgaggccuuccagaccaccaucuccaaguacuucuccgagcgcggcgacgccgucgccaaggccuccaaggagacccacgucauggacuaccgcgcccucguccacgagcgcgacgaggccgccuacggcgagcuccgcgccaugguccucgaccuccgcgccuucuacgccgagcucuaccacaucaucuccuccaaccucgagaagaucgucaaccccaagggcgaggagaagcccuccauguacuga

SEQ ID NO: 48262 - RNA, 798 nt, Artificial Sequence
  derived and/or modified sequence opt2 from PSME3__Homo_sapiens__NP_001253974
auggagaaguggauccucaagaagaucaaguaccuccaguccggcggccucuccgccuccuacuacuccuacaaggucgacuccuuccgcgagcgcaucaccuccgaggccgaggaccucgucgccaacuucuuccccaagaagcuccucgagcucgacuccuuccucaaggagcccauccucaacauccacgaccucacccagauccacuccgacaugaaccuccccguccccgaccccauccuccucaccaacucccacgacggccucgacggccccaccuacaagaagcgccgccucgacgagugcgaggaggccuuccagggcaccaaggucuucgucaugcccaacggcaugcucaaguccaaccagcagcucgucgacaucaucgagaaggucaagcccgagauccgccuccucaucgagaagugcaacaccgucaagauguggguccagcuccucaucccccgcaucgaggacggcaacaacuucggcgucuccauccaggaggagaccgucgccgagcuccgcaccgucgaguccgaggccgccuccuaccucgaccagaucucccgcuacuacaucacccgcgccaagcucgucuccaagaucgccaaguacccccacgucgaggacuaccgccgcaccgucaccgagaucgacgagaaggaguacaucucccuccgccucaucaucuccgagcuccgcaaccaguacgucacccuccacgacaugauccucaagaacaucgagaagaucaagcgcccccgcuccuccaacgccgagacccucuacuga

SEQ ID NO: 48263 - RNA, 5532 nt, Artificial Sequence
  derived and/or modified sequence opt2 from PSME4__Homo_sapiens__NP_055429
auggagcccgccgagcgcgccggcgucggcgagccccccgagcccggcggccgccccgagcccggcccccgcggcuucgucccccagaaggagaucgucuacaacaagcuccuccccuacgccgagcgccucgacgccgaguccgaccuccagcucgcccagaucaagugcaaccucggccgcgccguccagcuccaggagcucuggcccggcggccucuucuggacccgcaagcucuccaccuacauccgccucuacggccgcaaguucuccaaggaggaccacguccucuucaucaagcuccucuacgagcucgucuccauccccaagcucgagaucuccaugaugcagggcuucgcccgccuccucaucaaccuccucaagaagaaggagcuccucucccgcgccgaccucgagcuccccuggcgcccccucuacgacauggucgagcgcauccucuacuccaagaccgagcaccucggccucaacugguuccccaacuccgucgagaacauccucaagacccucgucaaguccugccgccccuacuuccccgccgacgccaccgccgagaugcucgaggaguggcgcccccucaugugccccuucgacgucaccaugcagaaggccaucaccuacuucgagaucuuccuccccaccucccucccccccgagcuccaccacaagggcuucaagcucugguucgacgagcucaucggccucugggucuccguccagaaccucccccagugggagggccagcucgucaaccucuucgcccgccucgccaccgacaacaucggcuacaucgacugggaccccuacguccccaagaucuucacccgcauccuccgcucccucaaccuccccgucggcuccucccagguccucgucccccgcuuccucaccaacgccuacgacaucggccacgccgucaucuggaucaccgccaugaugggcggccccuccaagcucguccagaagcaccucgccggccucuucaacuccaucaccuccuucuaccaccccuccaacaacggccgcuggcucaacaagcucaugaagcuccuccagcgccuccccaacuccgucguccgccgccuccaccgcgagcgcuacaagaagcccuccuggcucacccccguccccgacucccacaagcucaccgaccaggacgucaccgacuucguccagugcaucauccagcccguccuccucgccauguucuccaagaccggcucccucgaggccgcccaggcccuccagaaccucgcccucaugcgccccgagcucgucaucccccccguccucgagcgcaccuaccccgcccucgagacccucaccgagccccaccagcucaccgccacccucuccugcgucaucggcgucgcccgcucccucgucuccggcggccgcugguuccccgagggccccacccacaugcucccccuccucaugcgcgcccuccccggcgucgaccccaacgacuucuccaagugcaugaucaccuuccaguucaucgccaccuucuccacccucgucccccucgucgacugcuccuccguccuccaggagcgcaacgaccucaccgaggucgagcgcgagcucugcuccgccaccgccgaguucgaggacuucguccuccaguucauggaccgcugcuucggccucaucgaguccuccacccucgagcagacccgcgaggagaccgagaccgagaagaugacccaccucgagucccucgucgagcucggccucuccuccaccuucuccaccauccucacccagugcuccaaggagaucuucauggucgcccuccagaaggucuucaacuucuccaccucccacaucuucgagacccgcgucgccggccgcauggucgccgacaugugccgcgccgccgucaagugcugccccgaggagucccucaagcucuucgucccccacugcugcuccgucaucacccagcucaccaugaacgacgacguccucaacgacgaggagcucgacaaggagcuccucuggaaccuccagcuccucuccgagaucacccgcgucgacggccgcaagcuccuccucuaccgcgagcagcucgucaagauccuccagcgcacccuccaccucaccugcaagcagggcuacacccucuccugcaaccuccuccaccaccuccuccgcuccaccacccucaucuaccccaccgaguacugcuccguccccggcggcuucgacaagccccccuccgaguacuuccccaucaaggacuggggcaagcccggcgaccucuggaaccucggcauccaguggcacguccccuccuccgaggaggucuccuucgccuucuaccuccucgacuccuuccuccagcccgagcucgucaagcuccagcacugcggcgacggcaagcucgagaugucccgcgacgacauccuccagucccucaccaucguccacaacugccucaucggcuccggcaaccuccuccccccccucaagggcgagcccgucaccaaccucguccccuccauggucucccucgaggagaccaagcucuacaccggccucgaguacgaccucucccgcgagaaccaccgcgaggucaucgccaccgucauccgcaagcuccucaaccacauccucgacaacuccgaggacgacaccaagucccucuuccucaucaucaagaucaucggcgaccuccuccaguuccagggcucccacaagcacgaguucgacucccgcuggaaguccuucaaccucgucaagaaguccauggagaaccgccuccacggcaagaagcagcacauccgcgcccuccucaucgaccgcgucaugcuccagcacgagcuccgcacccucaccgucgagggcugcgaguacaagaagauccaccaggacaugauccgcgaccuccuccgccucuccaccuccuccuacucccagguccgcaacaaggcccagcagaccuucuucgccgcccucggcgccuacaacuucugcugccgcgacaucaucccccucguccucgaguuccuccgccccgaccgccagggcgucacccagcagcaguucaagggcgcccucuacugccuccucggcaaccacuccggcgucugccucgccaaccuccacgacugggacugcaucguccagaccuggcccgccaucgucuccuccggccucucccaggccaugucccucgagaagcccuccaucguccgccucuucgacgaccucgccgagaagauccaccgccaguacgagaccaucggccucgacuucaccauccccaaguccugcgucgagaucgccgagcuccuccagcaguccaagaaccccuccaucaaccagauccuccucucccccgagaagaucaaggagggcaucaagcgccagcaggagaagaacgccgacgcccuccgcaacuacgagaaccucgucgacacccuccucgacggcgucgagcagcgcaaccuccccuggaaguucgagcacaucggcaucggccuccucucccuccuccuccgcgacgaccgcguccucccccuccgcgccauccgcuucuucgucgagaaccucaaccacgacgccaucgucguccgcaagauggccaucuccgccgucgccggcauccucaagcagcucaagcgcacccacaagaagcucaccaucaaccccugcgagaucuccggcugccccaagcccacccagaucaucgccggcgaccgccccgacaaccacuggcuccacuacgacuccaagaccaucccccgcaccaagaaggagugggaguccuccugcuucgucgagaagacccacuggggcuacuacaccuggcccaagaacauggucgucuacgccggcgucgaggagcagcccaagcucggccgcucccgcgaggacaugaccgaggccgagcagaucaucuucgaccacuucuccgaccccaaguucgucgagcagcucaucaccuuccucucccucgaggaccgcaagggcaaggacaaguucaacccccgccgcuucugccucuucaagggcaucuuccgcaacuucgacgacgccuuccuccccguccucaagccccaccucgagcaccucgucgccgacucccacgaguccacccagcgcugcgucgccgagaucaucgccggccucauccgcggcuccaagcacuggaccuucgagaaggucgagaagcucugggagcuccucugcccccuccuccgcaccgcccucuccaacaucaccgucgagaccuacaacgacuggggcgccugcaucgccaccuccugcgagucccgcgacccccgcaagcuccacuggcucuucgagcuccuccucgaguccccccucuccggcgagggcggcuccuucgucgacgccugccgccucuacguccuccagggcggccucgcccagcaggaguggcgcguccccgagcuccuccaccgccuccucaaguaccucgagcccaagcucacccaggucuacaagaacguccgcgagcgcaucggcuccguccucaccuacaucuucaugaucgacgucucccuccccaacaccacccccaccaucuccccccacguccccgaguucaccgcccgcauccucgagaagcucaagccccucauggacgucgacgaggagauccagaaccacgucauggaggagaacggcaucggcgaggaggacgagcgcacccagggcaucaagcuccucaagaccauccucaaguggcucauggccuccgccggccgcuccuucuccaccgccgucaccgagcagcuccagcuccucccccucuucuucaagaucgcccccgucgagaacgacaacuccuacgacgagcucaagcgcgacgccaagcucugccucucccucaugucccagggccuccucuacccccaccaggucccccucguccuccagguccucaagcagaccgcccgcuccuccuccuggcacgcccgcuacaccguccucaccuaccuccagaccauggucuucuacaaccucuucaucuuccucaacaacgaggacgccgucaaggacauccgcuggcucgucaucucccuccucgaggacgagcagcucgagguccgcgagauggccgccaccacccucuccggccuccuccagugcaacuuccucaccauggacucccccaugcagauccacuucgagcagcucugcaagaccaagcuccccaagaagcgcaagcgcgaccccggcuccgucggcgacaccauccccuccgccgagcucgucaagcgccacgccggcguccucggccucggcgccugcguccucuccucccccuacgacguccccaccuggaugccccagcuccucaugaaccucuccgcccaccucaacgacccccagcccaucgagaugaccgucaagaagacccucuccaacuuccgccgcacccaccacgacaacuggcaggagcacaagcagcaguucaccgacgaccagcuccucguccucaccgaccuccucgucucccccugcuacuacgccuga

SEQ ID NO: 48264 - RNA, 816 nt, Artificial Sequence
  derived and/or modified sequence opt2 from PSMF1__Homo_sapiens__NP_848693
auggccggccucgagguccucuucgccuccgccgcccccgccaucaccugccgccaggacgcccucgucugcuuccuccacugggaggucgucacccacggcuacuucggccucggcgucggcgaccagcccggccccaacgacaagaaguccgagcuccuccccgccggcuggaacaacaacaaggaccucuacguccuccgcuacgaguacaaggacggcucccgcaagcuccucgucaaggccaucaccgucgaguccuccaugauccucaacguccucgaguacggcucccagcaggucgccgaccucacccucaaccucgacgacuacaucgacgccgagcaccucggcgacuuccaccgcaccuacaagaacuccgaggagcuccgcucccgcaucgucuccggcaucaucacccccauccacgagcagugggagaaggccaacgucuccuccccccaccgcgaguucccccccgccaccgcccgcgaggucgacccccuccgcauccccccccaccacccccacaccucccgccagccccccuggugcgacccccucggccccuucgucgucggcggcgaggaccucgaccccuucggcccccgccgcggcggcaugaucgucgacccccuccgcuccggcuucccccgcgcccucaucgaccccuccuccggccuccccaaccgccucccccccggcgccgucccccccggcgcccgcuucgaccccuucggccccaucggcaccuccccccccggccccaaccccgaccaccuccccccccccggcuacgacgacauguaccucuga

SEQ ID NO: 48265 - RNA, 867 nt, Artificial Sequence
  derived and/or modified sequence opt2 from PSMG1__Homo_sapiens__NP_003711
auggccgccaccuucuucggcgaggucgucaaggcccccugccgcgccggcaccgaggacgaggaggaggaggaggagggccgccgcgagacccccgaggaccgcgagguccgccuccagcucgcccgcaagcgcgagguccgccuccuccgccgccagaccaagaccucccucgaggucucccuccucgagaaguaccccugcuccaaguucaucaucgccaucggcaacaacgccgucgccuuccucuccuccuucgucaugaacuccggcgucugggaggaggucggcugcgccaagcucuggaacgaguggugccgcaccaccgacaccacccaccucuccuccaccgaggccuucugcgucuucuaccaccucaaguccaaccccuccgucuuccucugccagugcuccugcuacgucgccgaggaccagcaguaccaguggcucgagaaggucuucggcuccugcccccgcaagaacaugcagaucaccauccucaccugccgccacgucaccgacuacaagaccuccgaguccaccggcucccuccccucccccuuccuccgcgcccucaagacccagaacuucaaggacuccgccugcugcccccuccucgagcagcccaacaucguccacgaccuccccgccgccguccucuccuacugccaggucuggaagauccccgccauccucuaccucugcuacaccgacgucaugaagcucgaccucaucaccgucgaggccuucaagcccauccucuccacccgcucccucaagggccucgucaagaacaucccccaguccaccgagauccucaagaagcucaugaccaccaacgagauccaguccaacaucuacaccuga

SEQ ID NO: 48266 - RNA, 795 nt, Artificial Sequence
  derived and/or modified sequence opt2 from PSMG2__Homo_sapiens__NP_064617
auguucguccccugcggcgaguccgcccccgaccucgccggcuucacccuccucaugcccgccgucuccgucggcaacgucggccagcucgccauggaccucaucaucuccacccucaacauguccaagaucggcuacuucuacaccgacugccucguccccauggucggcaacaaccccuacgccaccaccgagggcaacuccaccgagcucuccaucaacgccgaggucuacucccuccccucccgcaagcucgucgcccuccagcuccgcuccaucuucaucaaguacaaguccaagcccuucugcgagaagcuccucuccugggucaaguccuccggcugcgcccgcgucaucguccucuccuccucccacuccuaccagcgcaacgaccuccagcuccgcuccacccccuuccgcuaccuccucacccccuccaugcagaaguccguccagaacaagaucaagucccucaacugggaggagauggagaagucccgcugcauccccgagaucgacgacuccgaguucugcauccgcauccccggcggcggcaucaccaagacccucuacgacgaguccugcuccaaggagauccagauggccguccuccucaaguucgucuccgagggcgacaacauccccgacgcccucggccucgucgaguaccucaacgaguggcuccagauccucaagccccucuccgacgaccccaccgucuccgccucccgcuggaagauccccuccuccuggcgccuccucuucggcuccggccucccccccgcccucuucuga

SEQ ID NO: 48267 - RNA, 369 nt, Artificial Sequence
  derived and/or modified sequence opt2 from PSMG3__Homo_sapiens__XP_011513881
auggaggacaccccccucgucaucuccaagcagaagaccgaggucgucugcggcguccccacccaggucgucugcaccgccuucuccucccacauccucgucgucgucacccaguucggcaagaugggcacccucgucucccucgagcccuccuccgucgccuccgacgucuccaagcccguccucaccaccaagguccuccucggccaggacgagccccucauccacgucuucgccaagaaccucgucgccuucgucucccaggaggccggcaaccgcgccguccuccucgccgucgccgucaaggacaaguccauggagggccucaaggcccuccgcgaggucauccgcgucugccaggucugguga

SEQ ID NO: 48268 - RNA, 459 nt, Artificial Sequence
  derived and/or modified sequence opt2 from PSORS1C1__Homo_sapiens__NP_054787
augaccugcaccgaccagaagucccacucccagcgcgcccucggcacccagacccccgcccuccagggcccccagcuccucaacaccgaccccuccuccgaggagacccgccccccccacgucaaccccgaccgccucugccacauggagcccgccaaccacuucuggcacgccggcgaccuccaggccaugaucuccaaggaguuccaccucgccgccacccaggacgacugccgcaagggccgcacccaggaggacauccucguccccuccucccaccccgagcucuucgccuccguccuccccauggcccccgaggaggccgcccgccuccagcagccccagccccuccccccccccuccggcauccaccucuccgccucccgcacccucgcccccacccuccucuacuccuccccccccucccacucccccuucggccucuccucccucaucuga

SEQ ID NO: 48269 - RNA, 411 nt, Artificial Sequence
  derived and/or modified sequence opt2 from PSORS1C2__Homo_sapiens__NP_054788
augauccucaacuggaagcuccucggcauccucguccucugccuccacacccgcggcaucuccggcuccgagggccaccccucccacccccccgccgaggaccgcgaggaggccggcucccccacccucccccagggcccccccguccccggcgaccccuggcccggcgcccccccccucuucgaggaccccccccccacccgccccucccgccccuggcgcgaccuccccgagaccggcgucuggcuccccgagcccccccgcaccgaccccccccagcccccccgccccgacgaccccuggcccgccggcccccagccccccgagaaccccuggccccccgcccccgaggucgacaaccgcccccaggaggagcccgaccucgaccccccccgcgaggaguaccgcuga

SEQ ID NO: 48270 - RNA, 1572 nt, Artificial Sequence
  derived and/or modified sequence opt2 from PSPC1__Homo_sapiens__XP_006719907
augaugcuccgcggcaaccucaagcagguccgcaucgagaagaaccccgcccgccuccgcgcccucgaguccgccgucggcgaguccgagcccgccgccgccgccgccauggcccucgcccucgccggcgagcccgccccccccgcccccgccccccccgaggaccaccccgacgaggagaugggcuucaccaucgacaucaaguccuuccucaagcccggcgagaagaccuacacccagcgcugccgccucuucgucggcaaccuccccaccgacaucaccgaggaggacuucaagcgccucuucgagcgcuacggcgagcccuccgaggucuucaucaaccgcgaccgcggcuucggcuucauccgccucgagucccgcacccucgccgagaucgccaaggccgagcucgacggcaccauccucaagucccgcccccuccgcauccgcuucgccacccacggcgccgcccucaccgucaagaaccucucccccgucgucuccaacgagcuccucgagcaggccuucucccaguucggccccgucgagaaggccgucgucgucgucgacgaccgcggccgcgccaccggcaagggcuucgucgaguucgccgccaagccccccgcccgcaaggcccucgagcgcugcggcgacggcgccuuccuccucaccaccaccccccgccccgucaucgucgagcccauggagcaguucgacgacgaggacggccuccccgagaagcucaugcagaagacccagcaguaccacaaggagcgcgagcagcccccccgcuucgcccagcccggcaccuucgaguucgaguacgccucccgcuggaaggcccucgacgagauggagaagcagcagcgcgagcaggucgaccgcaacauccgcgaggccaaggagaagcucgaggccgagauggaggccgcccgccacgagcaccagcucaugcucaugcgccaggaccucaugcgccgccaggaggagcuccgccgccucgaggagcuccgcaaccaggagcuccagaagcgcaagcagauccagcuccgccacgaggaggagcaccgccgccgcgaggaggagaugauccgccaccgcgagcaggaggagcuccgccgccagcaggagggcuucaagcccaacuacauggagaaccgcgagcaggagaugcgcaugggcgacaugggcccccgcggcgccaucaacaugggcgacgccuucucccccgcccccgccggcaaccagggccccccccccaugaugggcaugaacaugaacaaccgcgccaccauccccggcccccccaugggccccggccccgccaugggccccgagggcgccgccaacaugggcacccccaugaugcccgacaacggcgccguccacaacgaccgcuucccccagggcccccccucccagaugggcucccccaugggcucccgcaccggcuccgagaccccccaggcccccauguccggcgucggccccgucuccggcggccccggcggcuucggccgcggcucccagggcggcaacuucgagggccccaacaagcgccgccgcuacuga

SEQ ID NO: 48271 - RNA, 678 nt, Artificial Sequence
  derived and/or modified sequence opt2 from PSPH__Homo_sapiens__XP_011513763
auggucucccacuccgagcuccgcaagcucuucuacuccgccgacgccgucugcuucgacgucgacuccaccgucauccgcgaggagggcaucgacgagcucgccaagaucugcggcgucgaggacgccgucuccgagaugacccgccgcgccaugggcggcgccguccccuucaaggccgcccucaccgagcgccucgcccucauccagcccucccgcgagcagguccagcgccucaucgccgagcagcccccccaccucacccccggcauccgcgagcucgucucccgccuccaggagcgcaacguccaggucuuccucaucuccggcggcuuccgcuccaucgucgagcacgucgccuccaagcucaacauccccgccaccaacgucuucgccaaccgccucaaguucuacuucaacggcgaguacgccggcuucgacgagacccagcccaccgccgaguccggcggcaagggcaaggucaucaagcuccucaaggagaaguuccacuucaagaagaucaucaugaucggcgacggcgccaccgacauggaggccugcccccccgccgacgccuucaucggcuucggcggcaacgucauccgccagcaggucaaggacaacgccaagugguacaucaccgacuucgucgagcuccucggcgagcucgaggaguga

SEQ ID NO: 48272 - RNA, 471 nt, Artificial Sequence
  derived and/or modified sequence opt2 from PSPN__Homo_sapiens__NP_004149
auggccgucggcaaguuccuccucggcucccuccuccuccucucccuccagcucggccagggcuggggccccgacgcccgcggcguccccgucgccgacggcgaguucuccuccgagcaggucgccaaggccggcggcaccuggcucggcacccaccgcccccucgcccgccuccgccgcgcccucuccggccccugccagcucuggucccucacccucuccgucgccgagcucggccucggcuacgccuccgaggagaaggucaucuuccgcuacugcgccggcuccugcccccgcggcgcccgcacccagcacggccucgcccucgcccgccuccagggccagggccgcgcccacggcggccccugcugccgccccacccgcuacaccgacgucgccuuccucgacgaccgccaccgcuggcagcgccucccccagcucuccgccgccgccugcggcugcggcggcuga

SEQ ID NO: 48273 - RNA, 1251 nt, Artificial Sequence
  derived and/or modified sequence opt2 from PSTPIP1__Homo_sapiens__NP_003969
augaugccccagcuccaguucaaggacgccuucuggugccgcgacuucaccgcccacaccggcuacgagguccuccuccagcgccuccucgacggccgcaagaugugcaaggacauggaggagcuccuccgccagcgcgcccaggccgaggagcgcuacggcaaggagcucguccagaucgcccgcaaggccggcggccagaccgagaucaacucccuccgcgccuccuucgacucccucaagcagcagauggagaacgucggcuccucccacauccagcucgcccucacccuccgcgaggagcuccgcucccucgaggaguuccgcgagcgccagaaggagcagcgcaagaaguacgaggccgucauggaccgcguccagaaguccaagcucucccucuacaagaaggccauggaguccaagaagaccuacgagcagaagugccgcgacgccgacgacgccgagcaggccuucgagcgcaucuccgccaacggccaccagaagcaggucgagaagucccagaacaaggcccgccagugcaaggacuccgccaccgaggccgagcgcgucuaccgccaguccaucgcccagcucgagaagguccgcgccgagugggagcaggagcaccgcaccaccugcgaggccuuccagcuccaggaguucgaccgccucaccauccuccgcaacgcccucuggguccacuccaaccagcucuccaugcagugcgucaaggacgacgagcucuacgaggagguccgccucacccucgagggcugcuccaucgacgccgacaucgacuccuucauccaggccaaguccaccggcaccgagccccccgcccccguccccuaccagaacuacuacgaccgcgaggucaccccccucaccuccucccccggcauccagcccuccugcggcaugaucaagcgcuucuccggccuccuccacggcucccccaagaccaccucccucgccgccuccgccgccuccaccgagacccucacccccacccccgagcgcaacgagggcgucuacaccgccaucgccguccaggagauccagggcaaccccgccucccccgcccaggaguaccgcgcccucuacgacuacaccgcccagaaccccgacgagcucgaccucuccgccggcgacauccucgaggucauccucgagggcgaggacggcugguggaccgucgagcgcaacggccagcgcggcuucguccccggcuccuaccucgagaagcucuga

SEQ ID NO: 48274 - RNA, 1005 nt, Artificial Sequence
  derived and/or modified sequence opt2 from PSTPIP2__Homo_sapiens__NP_077748
augacccgcucccucuucaagggcaacuucugguccgccgacauccucuccaccaucggcuacgacaacaucauccagcaccucaacaacggccgcaagaacugcaaggaguucgaggacuuccucaaggagcgcgccgccaucgaggagcgcuacggcaaggaccuccucaaccucucccgcaagaagcccugcggccaguccgagaucaacacccucaagcgcgcccucgaggucuucaagcagcaggucgacaacgucgcccagugccacauccagcucgcccagucccuccgcgaggaggcccgcaagauggaggaguuccgcgagaagcagaagcuccagcgcaagaagaccgagcucaucauggacgccauccacaagcagaagucccuccaguucaagaagaccauggacgccaagaagaacuacgagcagaagugccgcgacaaggacgaggccgagcaggccgucucccgcuccgccaaccucgucaaccccaagcagcaggagaagcucuucgucaagcucgccaccuccaagaccgccgucgaggacuccgacaaggccuacaugcuccacaucggcacccucgacaagguccgcgaggaguggcaguccgagcacaucaaggccugcgaggccuucgaggcccaggagugcgagcgcaucaacuucuuccgcaacgcccucuggcuccacgucaaccagcucucccagcagugcgucaccuccgacgagauguacgagcagguccgcaagucccucgagaugugcuccauccagcgcgacaucgaguacuucgucaaccagcgcaagaccggccagaucccccccgcccccaucauguacgagaacuucuacuccucccagaagaacgccguccccgccggcaaggccaccggccccaaccucgcccgccgcggcccccuccccauccccaaguccucccccgacgaccccaacuacucccucgucgacgacuacucccuccucuaccaguga

SEQ ID NO: 48275 - RNA, 1674 nt, Artificial Sequence
  derived and/or modified sequence opt2 from PTBP1__Homo_sapiens__NP_002810
auggacggcaucguccccgacaucgccgucggcaccaagcgcggcuccgacgagcucuucuccaccugcgucaccaacggccccuucaucauguccuccaacuccgccuccgccgccaacggcaacgacuccaagaaguucaagggcgacucccgcuccgccggcguccccucccgcgucauccacauccgcaagcuccccaucgacgucaccgagggcgaggucaucucccucggccuccccuucggcaaggucaccaaccuccucaugcucaagggcaagaaccaggccuucaucgagaugaacaccgaggaggccgccaacaccauggucaacuacuacaccuccgucacccccguccuccgcggccagcccaucuacauccaguucuccaaccacaaggagcucaagaccgacuccucccccaaccaggcccgcgcccaggccgcccuccaggccgucaacuccguccaguccggcaaccucgcccucgccgccuccgccgccgccgucgacgccggcauggccauggccggccagucccccguccuccgcaucaucgucgagaaccucuucuaccccgucacccucgacguccuccaccagaucuucuccaaguucggcaccguccucaagaucaucaccuucaccaagaacaaccaguuccaggcccuccuccaguacgccgaccccgucuccgcccagcacgccaagcucucccucgacggccagaacaucuacaacgccugcugcacccuccgcaucgacuucuccaagcucaccucccucaacgucaaguacaacaacgacaagucccgcgacuacacccgccccgaccuccccuccggcgacucccagcccucccucgaccagaccauggccgccgccuucggcgcccccggcaucaucuccgccucccccuacgccggcgccggcuucccccccaccuucgccaucccccaggccgccggccucuccguccccaacguccacggcgcccucgccccccucgccauccccuccgccgccgccgccgccgccgccgccggccgcaucgccauccccggccucgccggcgccggcaacuccguccuccucgucuccaaccucaaccccgagcgcgucaccccccagucccucuucauccucuucggcgucuacggcgacguccagcgcgucaagauccucuucaacaagaaggagaacgcccucguccagauggccgacggcaaccaggcccagcucgccaugucccaccucaacggccacaagcuccacggcaagcccauccgcaucacccucuccaagcaccagaacguccagcucccccgcgagggccaggaggaccagggccucaccaaggacuacggcaacuccccccuccaccgcuucaagaagcccggcuccaagaacuuccagaacaucuucccccccuccgccacccuccaccucuccaacaucccccccuccgucuccgaggaggaccucaagguccucuucuccuccaacggcggcgucgucaagggcuucaaguucuuccagaaggaccgcaagauggcccucauccagaugggcuccgucgaggaggccguccaggcccucaucgaccuccacaaccacgaccucggcgagaaccaccaccuccgcgucuccuucuccaaguccaccaucuga

SEQ ID NO: 48276 - RNA, 1614 nt, Artificial Sequence
  derived and/or modified sequence opt2 from PTBP2__Homo_sapiens__NP_001287914
auggacggcaucgucaccgaggucgccgucggcgucaagcgcggcuccgacgagcuccucuccggcuccguccucuccucccccaacuccaacauguccuccauggucgucaccgccaacggcaacgacuccaagaaguucaagggcgaggacaagauggacggcgcccccucccgcguccuccacauccgcaagcuccccggcgaggucaccgagaccgaggucaucgcccucggccuccccuucggcaaggucaccaacauccucaugcucaagggcaagaaccaggccuuccucgagcucgccaccgaggaggccgccaucaccauggucaacuacuacuccgccgucaccccccaccuccgcaaccagcccaucuacauccaguacuccaaccacaaggagcucaagaccgacaacacccucaaccagcgcgcccaggccguccuccaggccgucaccgccguccagaccgccaacaccccccucuccggcaccaccgucuccgaguccgccgucacccccgcccagucccccguccuccgcaucaucaucgacaacauguacuaccccgucacccucgacguccuccaccagaucuucuccaaguucggcgccguccucaagaucaucaccuucaccaagaacaaccaguuccaggcccuccuccaguacggcgaccccgucaacgcccagcaggccaagcucgcccucgacggccagaacaucuacaacgccugcugcacccuccgcaucgacuucuccaagcucgucaaccucaacgucaaguacaacaacgacaagucccgcgacuacacccgccccgaccuccccuccggcgacggccagcccgcccucgaccccgccaucgccgccgccuucgccaaggagaccucccuccucggccuccccgucgccgccguccccggcgcccucuccccccucgccauccccaacgccgccgccgccgccgccgccgccgccgccggccgcgucggcaugcccggcgucuccgccggcggcaacaccguccuccucgucuccaaccucaacgaggagauggucaccccccagucccucuucacccucuucggcgucuacggcgacguccagcgcgucaagauccucuacaacaagaaggacuccgcccucauccagauggccgacggcaaccagucccagcucgccaugaaccaccucaacggccagaagauguacggcaagaucauccgcgucacccucuccaagcaccagaccguccagcucccccgcgagggccucgacgaccagggccucaccaaggacuucggcaacuccccccuccaccgcuucaagaagcccggcuccaagaacuuccagaacaucuucccccccuccgccacccuccaccucuccaacaucccccccuccgucgccgaggaggaccuccgcacccucuucgccaacaccggcggcaccgucaaggccuucaaguucuuccagcgcgaccacaagauggcccuccuccagauggccaccgucgaggaggccauccaggcccucaucgaccuccacaacuacaaccucggcgagaaccaccaccuccgcgucuccuucuccaaguccaccaucuga

SEQ ID NO: 48277 - RNA, 2103 nt, Artificial Sequence
  derived and/or modified sequence opt2 from PTCD1__Homo_sapiens__NP_056360
auggacuucguccgccucgcccgccucuucgcccgcgcccgccccaugggccucuucauccuccagcaccucgaccccugccgcgcccgcugggccggcggccgcgagggccucaugcgccccaugugggcccccuucuccuccuccuccucccagcucccccucggccaggagcgccaggagaacaccggcucccucggcuccgaccccucccacuccaacuccaccgccacccaggaggaggacgaggaggaggaggaguccuucggcacccucuccgacaaguacuccucccgccgccucuuccgcaaguccgccgcccaguuccacaaccuccgcuucggcgagcgccgcgacgagcagauggagcccgagcccaagcucuggcgcggccgccgcaacacccccuacugguacuuccuccagugcaagcaccucaucaaggagggcaagcucgucgaggcccucgaccucuucgagcgccagaugcucaaggaggagcgccuccagcccauggaguccaacuacaccguccucaucggcggcugcggccgcgucggcuaccucaagaaggccuucaaccucuacaaccagaugaagaagcgcgaccucgagcccuccgacgccaccuacaccgcccucuucaacgucugcgccgagucccccuggaaggacuccgcccuccaguccgcccucaagcuccgccagcagcuccaggccaagaacuucgagcucaaccucaagaccuaccacgcccuccucaagauggccgccaagugcgccgaccuccgcaugugccucgacgucuucaaggagaucauccacaagggccacgucgucaccgaggagaccuucuccuuccuccucaugggcugcauccaggacaagaagaccggcuuccgcuacgcccuccaggucuggcgccucaugcucucccucggccuccagcccucccgcgacuccuacaaccuccuccucgucgccgcccgcgacugcggccucggcgacccccaggucgccuccgagcuccuccucaagccccgcgaggaggccaccguccuccagccccccgucucccgccagcgcccccgccgcaccgcccaggccaaggccggcaaccucauguccgccaugcuccacgucgaggcccucgagcgccagcucuuccucgagcccucccaggcccucggcccccccgagccccccgaggcccgcguccccggcaaggcccagcccgaggucgacaccaaggccgagcccucccacaccgccgcccucaccgccgucgcccucaagcccccccccgucgagcucgaggucaaccuccucacccccggcgccgucccccccaccgucgucuccuucggcaccgucaccacccccgccgaccgccucgcccucaucggcggccucgagggcuuccucuccaagauggccgagcaccgccagcagcccgacauccgcacccucacccuccucgccgaggucgucgaguccggcucccccgccgagucccuccuccucgcccuccucgacgagcaccaggucgaggccgaccucaccuucuucaacacccucguccgcaagaaguccaagcucggcgaccucgagggcgccaaggcccuccuccccguccucgccaagcgcggccucguccccaaccuccagaccuucugcaaccucgccaucggcugccaccgccccaaggacggccuccagcuccucaccgacaugaagaagucccaggucacccccaacacccacaucuacuccgcccucaucaacgccgccauccgcaagcucaacuacaccuaccucaucuccauccucaaggacaugaagcagaaccgcguccccgucaacgaggucgucauccgccagcucgaguucgccgcccaguacccccccaccuucgaccgcuaccagggcaagaacaccuaccucgagaagaucgacggcuuccgcgccuacuacaagcaguggcucaccgucaugcccgccgaggagaccccccaccccuggcagaaguuccgcaccaagccccagggcgaccaggacaccggcaaggaggccgacgacggcugcgcccucggcggccgcuga

SEQ ID NO: 48278 - RNA, 4344 nt, Artificial Sequence
  derived and/or modified sequence opt2 from PTCH1__Homo_sapiens__NP_000255
auggccuccgccggcaacgccgccgagccccaggaccgcggcggcggcggcuccggcugcaucggcgcccccggccgccccgccggcggcggccgccgccgccgcaccggcggccuccgccgcgccgccgcccccgaccgcgacuaccuccaccgccccuccuacugcgacgccgccuucgcccucgagcagaucuccaagggcaaggccaccggccgcaaggccccccucuggcuccgcgccaaguuccagcgccuccucuucaagcucggcugcuacauccagaagaacugcggcaaguuccucgucgucggccuccucaucuucggcgccuucgccgucggccucaaggccgccaaccucgagaccaacgucgaggagcucugggucgaggucggcggccgcgucucccgcgagcucaacuacacccgccagaagaucggcgaggaggccauguucaacccccagcucaugauccagacccccaaggaggagggcgccaacguccucaccaccgaggcccuccuccagcaccucgacuccgcccuccaggccucccgcguccacgucuacauguacaaccgccaguggaagcucgagcaccucugcuacaaguccggcgagcucaucaccgagaccggcuacauggaccagaucaucgaguaccucuaccccugccucaucaucaccccccucgacugcuucugggagggcgccaagcuccaguccggcaccgccuaccuccucggcaagcccccccuccgcuggaccaacuucgacccccucgaguuccucgaggagcucaagaagaucaacuaccaggucgacuccugggaggagaugcucaacaaggccgaggucggccacggcuacauggaccgccccugccucaaccccgccgaccccgacugccccgccaccgcccccaacaagaacuccaccaagccccucgacauggcccucguccucaacggcggcugccacggccucucccgcaaguacaugcacuggcaggaggagcucaucgucggcggcaccgucaagaacuccaccggcaagcucgucuccgcccacgcccuccagaccauguuccagcucaugacccccaagcagauguacgagcacuucaagggcuacgaguacgucucccacaucaacuggaacgaggacaaggccgccgccauccucgaggccuggcagcgcaccuacgucgaggucguccaccaguccgucgcccagaacuccacccagaagguccucuccuucaccaccaccacccucgacgacauccucaaguccuucuccgacgucuccgucauccgcgucgccuccggcuaccuccucaugcucgccuacgccugccucaccaugcuccgcugggacugcuccaagucccagggcgccgucggccucgccggcguccuccucgucgcccucuccgucgccgccggccucggccucugcucccucaucggcaucuccuucaacgccgccaccacccagguccuccccuuccucgcccucggcgucggcgucgacgacgucuuccuccucgcccacgccuucuccgagaccggccagaacaagcgcauccccuucgaggaccgcaccggcgagugccucaagcgcaccggcgccuccgucgcccucaccuccaucuccaacgucaccgccuucuucauggccgcccucauccccauccccgcccuccgcgccuucucccuccaggccgccgucgucgucgucuucaacuucgccaugguccuccucaucuuccccgccauccucuccauggaccucuaccgccgcgaggaccgccgccucgacaucuucugcugcuucaccucccccugcgucucccgcgucauccaggucgagccccaggccuacaccgacacccacgacaacacccgcuacuccccccccccccccuacuccucccacuccuucgcccacgagacccagaucaccaugcaguccaccguccagcuccgcaccgaguacgacccccacacccacgucuacuacaccaccgccgagccccgcuccgagaucuccguccagcccgucaccgucacccaggacacccucuccugccagucccccgaguccaccuccuccacccgcgaccuccucucccaguucuccgacuccucccuccacugccucgagccccccugcaccaaguggacccucuccuccuucgccgagaagcacuacgcccccuuccuccucaagcccaaggccaaggucgucgucaucuuccucuuccucggccuccucggcgucucccucuacggcaccacccgcguccgcgacggccucgaccucaccgacaucgucccccgcgagacccgcgaguacgacuucaucgccgcccaguucaaguacuucuccuucuacaacauguacaucgucacccagaaggccgacuaccccaacauccagcaccuccucuacgaccuccaccgcuccuucuccaacgucaaguacgucaugcucgaggagaacaagcagcuccccaagauguggcuccacuacuuccgcgacuggcuccagggccuccaggacgccuucgacuccgacugggagaccggcaagaucaugcccaacaacuacaagaacggcuccgacgacggcguccucgccuacaagcuccucguccagaccggcucccgcgacaagcccaucgacaucucccagcucaccaagcagcgccucgucgacgccgacggcaucaucaaccccuccgccuucuacaucuaccucaccgccugggucuccaacgaccccgucgccuacgccgccucccaggccaacauccgcccccaccgccccgaguggguccacgacaaggccgacuacaugcccgagacccgccuccgcauccccgccgccgagcccaucgaguacgcccaguuccccuucuaccucaacggccuccgcgacaccuccgacuucgucgaggccaucgagaagguccgcaccaucugcuccaacuacaccucccucggccucuccuccuaccccaacggcuaccccuuccucuucugggagcaguacaucggccuccgccacuggcuccuccucuucaucuccgucguccucgccugcaccuuccucgucugcgccgucuuccuccucaaccccuggaccgccggcaucaucgucaugguccucgcccucaugaccgucgagcucuucggcaugaugggccucaucggcaucaagcucuccgccguccccgucgucauccucaucgccuccgucggcaucggcgucgaguucaccguccacgucgcccucgccuuccucaccgccaucggcgacaagaaccgccgcgccguccucgcccucgagcacauguucgcccccguccucgacggcgccgucuccacccuccucggcguccucaugcucgccggcuccgaguucgacuucaucguccgcuacuucuucgccguccucgccauccucaccauccucggcguccucaacggccucguccuccuccccguccuccucuccuucuucggccccuaccccgaggucucccccgccaacggccucaaccgccuccccacccccucccccgagcccccccccuccgucguccgcuucgccaugccccccggccacacccacuccggcuccgacuccuccgacuccgaguacuccucccagaccaccgucuccggccucuccgaggagcuccgccacuacgaggcccagcagggcgccggcggccccgcccaccaggucaucgucgaggccaccgagaaccccgucuucgcccacuccaccgucguccaccccgagucccgccaccacccccccuccaacccccgccagcagccccaccucgacuccggcucccucccccccggccgccagggccagcagccccgccgcgaccccccccgcgagggccucuggcccccccccuaccgcccccgccgcgacgccuucgagaucuccaccgagggccacuccggccccuccaaccgcgcccgcuggggcccccgcggcgcccgcucccacaacccccgcaaccccgccuccaccgccaugggcuccuccguccccggcuacugccagcccaucaccaccgucaccgccuccgccuccgucaccgucgccguccaccccccccccguccccggccccggccgcaacccccgcggcggccucugccccggcuaccccgagaccgaccacggccucuucgaggacccccacguccccuuccacguccgcugcgagcgccgcgacuccaaggucgaggucaucgagcuccaggacgucgagugcgaggagcgcccccgcggcuccuccuccaacuga

SEQ ID NO: 48279 - RNA, 2667 nt, Artificial Sequence
  derived and/or modified sequence opt2 from PTCHD1__Homo_sapiens__NP_775766
augcuccgccagguccuccaccgcggccuccgcaccugcuucucccgccucggccacuucaucgccucccaccccgucuucuucgccuccgcccccguccucaucuccauccuccucggcgccuccuucucccgcuaccaggucgaggaguccgucgagcaccuccucgccccccagcacucccucgccaagaucgagcgcaaccucgucaacucccucuuccccgucaaccgcuccaagcaccgccucuacuccgaccuccagacccccggccgcuacggccgcgucaucgucaccuccuuccagaaggccaacaugcucgaccagcaccacaccgaccucauccucaagcuccacgccgccgucaccaagauccaggucccccgccccggcuucaacuacaccuucgcccacaucugcauccucaacaacgacaagaccugcaucgucgacgacaucguccacguccucgaggagcucaagaacgcccgcgccaccaaccgcaccaacuucgccaucaccuaccccaucacccaccucaaggacggccgcgccgucuacaacggccaccagcucggcggcgucaccguccacuccaaggaccgcgucaaguccgccgaggccauccagcucaccuacuaccuccaguccaucaacucccucaacgacauggucgccgagcgcugggaguccuccuucugcgacaccguccgccucuuccagaaguccaacuccaaggucaagauguaccccuacaccuccuccucccuccgcgaggacuuccagaagaccucccgcgucuccgagcgcuaccucgucaccucccucauccucgucgucaccauggccauccucugcugcuccaugcaggacugcguccgcuccaagcccuggcucggccuccucggccucgucaccaucucccucgccacccucaccgccgccggcaucaucaaccucaccggcggcaaguacaacuccaccuuccucggcguccccuucgucaugcucggccacggccucuacggcaccuucgagaugcucuccuccuggcgcaagacccgcgaggaccagcacgucaaggagcgcaccgccgccgucuacgccgacuccaugcucuccuucucccucaccaccgccauguaccucgucaccuucggcaucggcgccucccccuucaccaacaucgaggccgcccgcaucuucugcugcaacuccugcaucgccaucuucuucaacuaccucuacguccucuccuucuacggcuccucccucgucuucaccggcuacaucgagaacaacuaccagcacuccaucuucugccgcaagguccccaagcccgaggcccuccaggagaagcccgccugguaccgcuuccuccucaccgcccgcuucuccgaggacaccgccgagggcgaggaggccaacaccuacgagucccaccuccucgucugcuuccucaagcgcuacuacugcgacuggaucaccaacaccuacgucaagcccuucgucguccucuucuaccucaucuacaucuccuucgcccucaugggcuaccuccaggucuccgagggcuccgaccucuccaacaucgucgccaccgccacccagaccaucgaguacaccaccgcccagcagaaguacuucuccaacuacucccccgucaucggcuucuacaucuacgaguccaucgaguacuggaacaccuccguccaggaggacguccucgaguacaccaagggcuucguccgcaucuccugguucgaguccuaccucaacuaccuccgcaagcucaacgucuccaccggccuccccaagaagaacuucaccgacaugcuccgcaacuccuuccucaaggccccccaguucucccacuuccaggaggacaucaucuucuccaagaaguacaacgacgaggucgacgucgucgccucccgcauguuccucgucgccaagaccauggagaccaaccgcgaggagcucuacgaccuccucgagacccuccgccgccucuccgucaccuccaaggucaaguucaucgucuucaaccccuccuucgucuacauggaccgcuacgccuccucccucggcgccccccuccacaacuccugcaucuccgcccucuuccuccucuucuucuccgccuuccucgucgccgacucccucaucaacgucuggaucacccucaccgucgucuccgucgaguucggcgucaucggcuucaugacccucuggaaggucgagcucgacugcaucuccguccucugccucaucuacggcaucaacuacaccaucgacaacugcgcccccaugcucuccaccuucguccucggcaaggacuucacccgcaccaagugggucaagaacgcccucgagguccacggcgucgccauccuccaguccuaccucugcuacaucgucggccucaucccccucgccgccguccccuccaaccucaccugcacccucuuccgcugccucuuccucaucgccuucgucaccuucuuccacugcuucgccauccuccccgucauccucaccuuccucccccccuccaagaagaagcgcaaggagaagaagaaccccgagaaccgcgaggagaucgagugcgucgagauggucgacaucgacuccacccgcgucgucgaccagaucaccaccgucuga

SEQ ID NO: 48280 - RNA, 2541 nt, Artificial Sequence
  derived and/or modified sequence opt2 from PTCHD4__Homo_sapiens__NP_001013754
augugcuuccuccgccgccccggcgcccccgccuccuggaucugguggcgcaugcuccgccagguccuccgccgcggccuccaguccuucugccaccgccucggccucugcgucucccgccaccccgucuucuuccucaccguccccgccguccucaccaucaccuucggccucuccgcccucaaccgcuuccagcccgagggcgaccucgagcgccucgucgcccccucccacucccucgccaagaucgagcgcucccucgccuccucccucuucccccucgaccaguccaagucccagcucuacuccgaccuccacacccccggccgcuacggccgcgucauccuccucucccccaccggcgacaacauccuccuccaggccgagggcauccuccagacccaccgcgccguccucgagaugaaggacggccgcaacuccuucaucggccaccagcucggcggcgucgucgagguccccaacuccaaggaccagcgcgucaaguccgcccgcgccauccagaucaccuacuaccuccagaccuacggcuccgccacccaggaccucaucggcgagaagugggagaacgaguucugcaagcucauccgcaagcuccaggaggagcaccaggagcuccagcucuacucccucgccuccuucucccucuggcgcgacuuccacaagaccuccauccucgcccgcuccaagguccucgucucccucguccucauccucaccaccgccacccucuccuccuccaugaaggacugccuccgcuccaagcccuuccucggccuccucggcguccucaccgucugcaucuccaucaucaccgccgccggcaucuucuucaucaccgacggcaaguacaacuccacccuccucggcauccccuucuucgccaugggccacggcaccaagggcgucuucgagcuccucuccggcuggcgccgcaccaaggagaaccuccccuucaaggaccgcaucgccgacgccuacuccgacgucauggucaccuacaccaugaccuccucccucuacuucaucaccuucggcaugggcgccucccccuucaccaacaucgaggccgucaaggucuucugccagaacaugugcgucuccauccuccucaacuacuucuacaucuucuccuucuucggcuccugccucgucuucgccggccagcucgagcagaaccgcuaccacuccaucuucugcugcaagauccccuccgccgaguaccucgaccgcaagcccgucugguuccagaccgucauguccgacggccaccagcagaccucccaccacgagaccaaccccuaccagcaccacuucauccagcacuuccuccgcgagcacuacaacgaguggaucaccaacaucuacgucaagcccuucgucgucauccucuaccucaucuacgccuccuucuccuucaugggcugccuccagaucuccgacggcgccaacaucaucaaccuccucgccuccgacucccccuccgucuccuacgccaugguccagcagaaguacuucuccaacuacucccccgucaucggcuucuacgucuacgagccccucgaguacuggaacuccuccguccaggacgaccuccgccgccucugcuccggcuucaccgccgucuccugggucgagcaguacuaccaguuccucaaggucuccaacgucuccgccaacaacaaguccgacuucaucuccguccuccaguccuccuuccucaagaagcccgaguuccagcacuuccgcaacgacaucaucuucuccaaggccggcgacgaguccaacaucaucgccucccgccucuaccucgucgcccgcaccucccgcgacaagcagaaggagaucaccgagguccucgagaagcuccgcccccucucccucuccaaguccauccgcuucaucgucuucaaccccuccuucgucuucauggaccacuacucccucuccgucaccguccccguccucaucgccggcuucggcguccuccucguccucauccucaccuucuuccucgucauccacccccucggcaacuucuggcucauccucuccgucaccuccaucgagcucggcguccucggccucaugacccucuggaacgucgacauggacugcaucuccauccucugccucaucuacacccucaacuucgccaucgaccacugcgccccccuccucuucaccuucguccucgccaccgagcacacccgcacccagugcaucaaguccucccuccaggaccacggcaccgccauccuccagaacgucaccuccuuccucaucggccucgucccccuccucuucguccccuccaaccucaccuucacccucuucaagugccuccuccucaccggcggcugcacccuccuccacugcuucgucauccuccccgucuuccucaccuucuucccccccuccaagaagcaccacaagaagaagaagcgcgccaagcgcaaggagcgcgaggagaucgagugcaucgagauccaggagaaccccgaccacgucaccaccgucuga

SEQ ID NO: 48281 - RNA, 771 nt, Artificial Sequence
  derived and/or modified sequence opt2 from PTCRA__Homo_sapiens__NP_001230098
auggccggcaccuggcuccuccuccuccucgcccucggcugccccgcccuccccaccggccccgucuccuuccccuccucccccgaggccgccaccaccggccccaucugguucuccgccggcaacggcuccgcccucgacgccuucaccuacggccccucccccgccaccgacggcaccuggaccaaccucgcccaccucucccuccccuccgaggagcucgccuccugggagccccucgucugccacaccggccccggcgccgagggccacucccgcuccacccagcccaugcaccucuccggcgaggccuccaccgcccgcaccugcccccaggagccccuccgcggcacccccggcggcgcccucuggcucggcguccuccgccuccuccucuucaagcuccuccucuucgaccuccuccucaccugcuccugccucugcgaccccgccggcccccuccccucccccgccaccaccacccgccuccgcgcccucggcucccaccgccuccaccccgccaccgagaccggcggccgcgaggccaccuccuccccccgcccccagccccgcgaccgccgcuggggcgacaccccccccggccgcaagcccggcucccccgucuggggcgagggcuccuaccucuccuccuaccccaccugccccgcccaggccuggugcucccgcuccgcccuccgcgcccccuccuccucccucggcgccuucuucgccggcgaccucccccccccccuccaggccggcgccgccuga

SEQ ID NO: 48282 - RNA, 984 nt, Artificial Sequence
  derived and/or modified sequence opt2 from PTDSS1__Homo_sapiens__NP_001277154
auggaguacgccgucaacugccacgucaucaccugggagcgcaucaucucccacuucgacaucuucgccuucggccacuucuggggcugggccaugaaggcccuccucauccgcuccuacggccucugcuggaccaucuccaucaccugggagcucaccgagcucuucuucaugcaccuccuccccaacuucgccgagugcuggugggaccaggucauccucgacauccuccucugcaacggcggcggcaucuggcucggcauggucgucugccgcuuccucgagaugcgcaccuaccacugggccuccuucaaggacauccacaccaccaccggcaagaucaagcgcgccguccuccaguucacccccgccuccuggaccuacguccgcugguucgaccccaaguccuccuuccagcgcgucgccggcgucuaccucuucaugaucaucuggcagcucaccgagcucaacaccuucuuccucaagcacaucuucgucuuccaggccucccacccccucuccuggggccgcauccucuucaucggcggcaucaccgcccccaccguccgccaguacuacgccuaccucaccgacacccagugcaagcgcgucggcacccagugcugggucuucggcgucaucggcuuccucgaggccaucgucugcaucaaguucggccaggaccucuucuccaagacccagauccucuacgucguccucuggcuccucugcgucgccuucaccaccuuccucugccucuacggcaugaucugguacgccgagcacuacggccaccgcgagaagaccuacuccgagugcgaggacggcaccuacucccccgagaucuccuggcaccaccgcaagggcaccaagggcuccgaggacuccccccccaagcacgccggcaacaacgagucccacuccucccgccgccgcaaccgccacuccaaguccaaggucaccaacggcgucggcaagaaguga

SEQ ID NO: 48283 - RNA, 1212 nt, Artificial Sequence
  derived and/or modified sequence opt2 from PTEN__Homo_sapiens__NP_000305
augaccgccaucaucaaggagaucgucucccgcaacaagcgccgcuaccaggaggacggcuucgaccucgaccucaccuacaucuaccccaacaucaucgccaugggcuuccccgccgagcgccucgagggcgucuaccgcaacaacaucgacgacgucguccgcuuccucgacuccaagcacaagaaccacuacaagaucuacaaccucugcgccgagcgccacuacgacaccgccaaguucaacugccgcgucgcccaguaccccuucgaggaccacaaccccccccagcucgagcucaucaagcccuucugcgaggaccucgaccaguggcucuccgaggacgacaaccacgucgccgccauccacugcaaggccggcaagggccgcaccggcgucaugaucugcgccuaccuccuccaccgcggcaaguuccucaaggcccaggaggcccucgacuucuacggcgagguccgcacccgcgacaagaagggcgucaccauccccucccagcgccgcuacgucuacuacuacuccuaccuccucaagaaccaccucgacuaccgccccgucgcccuccucuuccacaagaugauguucgagaccauccccauguucuccggcggcaccugcaacccccaguucgucgucugccagcucaaggucaagaucuacuccuccaacuccggccccacccgccgcgaggacaaguucauguacuucgaguucccccagccccuccccgucugcggcgacaucaaggucgaguucuuccacaagcagaacaagaugcucaagaaggacaagauguuccacuucugggucaacaccuucuucauccccggccccgaggagaccuccgagaaggucgagaacggcucccucugcgaccaggagaucgacuccaucugcuccaucgagcgcgccgacaacgacaaggaguaccucguccucacccucaccaagaacgaccucgacaaggccaacaaggacaaggccaaccgcuacuucucccccaacuucaaggucaagcucuacuucaccaagaccgucgaggagcccuccaaccccgaggccuccuccuccaccuccgucacccccgacgucuccgacaacgagcccgaccacuaccgcuacuccgacaccaccgacuccgaccccgagaacgagcccuucgacgaggaccagcacacccagaucaccaaggucuga

SEQ ID NO: 48284 - RNA, 909 nt, Artificial Sequence
  derived and/or modified sequence opt2 from PTER__Homo_sapiens__NP_001248766
auguccucccucuccggcaagguccagaccguccucggccucgucgagcccuccaagcucggccgcacccucacccacgagcaccucgccaugaccuucgacugcugcuacugcccccccccccccugccaggaggccaucuccaaggagcccaucgucaugaagaaccucuacuggauccagaagaacgccuacucccacaaggagaaccuccagcucaaccaggagaccgaggccaucaaggaggagcuccucuacuucaaggccaacggcggcggcgcccucgucgagaacaccaccaccggcaucucccgcgacacccagacccucaagcgccucgccgaggagaccggcguccacaucaucuccggcgccggcuucuacgucgacgccacccacuccuccgagacccgcgccauguccgucgagcagcucaccgacguccucaugaacgagauccuccacggcgccgacggcaccuccaucaagugcggcaucaucggcgagaucggcugcuccuggccccucaccgaguccgagcgcaagguccuccaggccaccgcccacgcccaggcccagcucggcugccccgucaucauccaccccggccgcuccucccgcgcccccuuccagaucauccgcauccuccaggaggccggcgccgacaucuccaagaccgucaugucccaccucgaccgcguccgccuccucgucgaggagggcugcgaggaccgcauccucgucgcccacgacauccacaccaagacccgccucaugaaguacggcggccacggcuacucccacauccucaccaacgucguccccaagaugcuccuccgcggcaucaccgagaacguccucgacaagauccucaucgagaaccccaagcaguggcucaccuucaaguga

SEQ ID NO: 48285 - RNA, 987 nt, Artificial Sequence
  derived and/or modified sequence opt2 from PTF1A__Homo_sapiens__NP_835455
auggacgccguccuccucgagcacuuccccggcggccucgacgccuuccccuccuccuacuucgacgaggacgacuucuucaccgaccaguccucccgcgacccccucgaggacggcgacgagcuccucgccgacgagcaggccgaggucgaguuccucucccaccagcuccacgaguacugcuaccgcgacggcgccugccuccuccuccagcccgccccccccgccgccccccucgcccucgccccccccuccuccggcggccucggcgagcccgacgacggcggcggcggcggcuacugcugcgagaccggcgccccccccggcggcuuccccuacucccccggcuccccccccuccugccucgccuaccccugcgccggcgccgccguccucucccccggcgcccgccuccgcggccucuccggcgccgccgccgccgccgcccgccgccgccgccgcguccgcuccgaggccgagcuccagcagcuccgccaggccgccaacguccgcgagcgccgccgcaugcaguccaucaacgacgccuucgagggccuccgcucccacauccccacccuccccuacgagaagcgccucuccaaggucgacacccuccgccucgccaucggcuacaucaacuuccucuccgagcucguccaggccgaccucccccuccgcggcggcggcgccggcggcugcggcggccccggcggcggcggccgccucggcggcgacucccccggcucccaggcccagaaggucaucaucugccaccgcggcacccgcucccccucccccuccgaccccgacuacggccuccccccccucgccggccacucccucuccuggaccgacgagaagcagcucaaggagcagaacaucauccgcaccgccaaggucuggacccccgaggacccccgcaagcucaacuccaaguccuccuucaacaacaucgagaacgagccccccuucgaguucgucuccuga

SEQ ID NO: 48286 - RNA, 1188 nt, Artificial Sequence
  derived and/or modified sequence opt2 from PTGDR2__Homo_sapiens__NP_004769
auguccgccaacgccacccucaagccccucugccccauccucgagcagaugucccgccuccagucccacuccaacaccuccauccgcuacaucgaccacgccgccguccuccuccacggccucgccucccuccucggccucgucgagaacggcgucauccucuucgucgucggcugccgcaugcgccagaccgucgucaccaccuggguccuccaccucgcccucuccgaccuccucgccuccgccucccuccccuucuucaccuacuuccucgccgucggccacuccugggagcucggcaccaccuucugcaagcuccacuccuccaucuucuuccucaacauguucgccuccggcuuccuccucuccgccaucucccucgaccgcugccuccaggucguccgccccgucugggcccagaaccaccgcaccgucgccgccgcccacaaggucugccucguccucugggcccucgccguccucaacaccguccccuacuucgucuuccgcgacaccaucucccgccucgacggccgcaucaugugcuacuacaacguccuccuccucaaccccggccccgaccgcgacgccaccugcaacucccgccaggucgcccucgccgucuccaaguuccuccucgccuuccucgucccccucgccaucaucgccuccucccacgccgccgucucccuccgccuccagcaccgcggccgccgccgccccggccgcuucguccgccucgucgccgccgucgucgccgccuucgcccucugcuggggccccuaccacgucuucucccuccucgaggcccgcgcccacgccaaccccggccuccgcccccucgucuggcgcggccuccccuucgucaccucccucgccuucuucaacuccgucgccaaccccguccucuacguccucaccugccccgacaugcuccgcaagcuccgccgcucccuccgcaccguccucgaguccguccucgucgacgacuccgagcucggcggcgccggcuccucccgccgccgccgcaccuccuccaccgcccgcuccgccuccccccucgcccucugcucccgccccgaggagccccgcggccccgcccgccuccucggcuggcuccucggcuccugcgccgccuccccccagaccggcccccucaaccgcgcccucuccuccaccuccuccuga

SEQ ID NO: 48287 - RNA, 1080 nt, Artificial Sequence
  derived and/or modified sequence opt2 from PTGDR__Homo_sapiens__XP_005267948
augaagucccccuucuaccgcugccagaacaccaccuccgucgagaagggcaacuccgccgucaugggcggcguccucuucuccaccggccuccucggcaaccuccucgcccucggccuccucgcccgcuccggccucggcuggugcucccgccgcccccuccgcccccuccccuccgucuucuacaugcucgucugcggccucaccgucaccgaccuccucggcaagugccuccucucccccgucguccucgccgccuacgcccagaaccgcucccuccgcguccucgcccccgcccucgacaacucccucugccaggccuucgccuucuucauguccuucuucggccucuccuccacccuccagcuccucgccauggcccucgagugcuggcucucccucggccaccccuucuucuaccgccgccacaucacccuccgccucggcgcccucgucgcccccgucgucuccgccuucucccucgccuucugcgcccuccccuucaugggcuucggcaaguucguccaguacugccccggcaccuggugcuucauccagaugguccacgaggagggcucccucuccguccucggcuacuccguccucuacuccucccucauggcccuccucguccucgccaccguccucugcaaccucggcgccaugcgcaaccucuacgccaugcaccgccgccuccagcgccacccccgcuccugcacccgcgacugcgccgagccccgcgccgacggccgcgaggccuccccccagccccucgaggagcucgaccaccuccuccuccucgcccucaugaccguccucuucaccaugugcucccuccccgucaucuaccgcgccuacuacggcgccuucaaggacgucaaggagaagaaccgcaccuccgaggaggccgaggaccuccgcgcccuccgcuuccucuccgucaucuccaucgucgaccccuggaucuucaucaucuuccgcucccccgucuuccgcaucuucuuccacaagaucuucauccgcccccuccgcuaccgcucccgcugcuccaacuccaccaacauggaguccucccucuga

SEQ ID NO: 48288 - RNA, 573 nt, Artificial Sequence
  derived and/or modified sequence opt2 from PTGDS__Homo_sapiens__NP_000945
auggccacccaccacacccucuggaugggccucgcccuccucggcguccucggcgaccuccaggccgcccccgaggcccaggucuccguccagcccaacuuccagcaggacaaguuccucggccgcugguucuccgccggccucgccuccaacuccuccuggcuccgcgagaagaaggccgcccucuccaugugcaaguccgucgucgcccccgccaccgacggcggccucaaccucaccuccaccuuccuccgcaagaaccagugcgagacccgcaccaugcuccuccagcccgccggcucccucggcuccuacuccuaccgcuccccccacuggggcuccaccuacuccgucuccgucgucgagaccgacuacgaccaguacgcccuccucuacucccagggcuccaagggccccggcgaggacuuccgcauggccacccucuacucccgcacccagaccccccgcgccgagcucaaggagaaguucaccgccuucugcaaggcccagggcuucaccgaggacaccaucgucuuccucccccagaccgacaagugcaugaccgagcaguga

SEQ ID NO: 48289 - RNA, 1209 nt, Artificial Sequence
  derived and/or modified sequence opt2 from PTGER1__Homo_sapiens__NP_000946
augucccccugcggcccccucaaccucucccucgccggcgaggccaccaccugcgccgcccccuggguccccaacaccuccgccgucccccccuccggcgccucccccgcccuccccaucuucuccaugacccucggcgccgucuccaaccuccucgcccucgcccuccucgcccaggccgccggccgccuccgccgccgccgcuccgccgccaccuuccuccucuucgucgccucccuccucgccaccgaccucgccggccacgucauccccggcgcccucguccuccgccucuacaccgccggccgcgcccccgccggcggcgccugccacuuccucggcggcugcauggucuucuucggccucugcccccuccuccucggcugcggcauggccgucgagcgcugcgucggcgucacccgcccccuccuccacgccgcccgcgucuccgucgcccgcgcccgccucgcccucgccgccgucgccgccgucgcccucgccgucgcccuccucccccucgcccgcgucggccgcuacgagcuccaguaccccggcaccuggugcuucaucggccucggcccccccggcggcuggcgccaggcccuccucgccggccucuucgccucccucggccucgucgcccuccucgccgcccucgucugcaacacccucuccggccucgcccuccuccgcgcccgcuggcgccgccgcucccgccgccccccccccgccuccggccccgacucccgccgccgcuggggcgcccacggcccccgcuccgccuccgccuccuccgccuccuccaucgccuccgccuccaccuucuucggcggcucccgcuccuccggcuccgcccgccgcgcccgcgcccacgacgucgagauggucggccagcucgucggcaucauggucgucuccugcaucugcuggucccccaugcucguccucgucgcccucgccgucggcggcugguccuccaccucccuccagcgcccccucuuccucgccguccgccucgccuccuggaaccagauccucgaccccugggucuacauccuccuccgccaggccguccuccgccagcuccuccgccuccuccccccccgcgccggcgccaagggcggccccgccggccucggccucacccccuccgccugggaggccuccucccuccgcuccucccgccacuccggccucucccacuucuga

SEQ ID NO: 48290 - RNA, 1077 nt, Artificial Sequence
  derived and/or modified sequence opt2 from PTGER2__Homo_sapiens__NP_000947
augggcaacgccuccaacgacucccaguccgaggacugcgagacccgccaguggcucccccccggcgagucccccgccaucuccuccgucauguucuccgccggcguccucggcaaccucaucgcccucgcccuccucgcccgccgcuggcgcggcgacgucggcugcuccgccggccgccgcuccucccucucccucuuccacguccucgucaccgagcucgucuucaccgaccuccucggcaccugccucaucucccccgucguccucgccuccuacgcccgcaaccagacccucgucgcccucgcccccgagucccgcgccugcaccuacuucgccuucgccaugaccuucuucucccucgccaccaugcucaugcucuucgccauggcccucgagcgcuaccucuccaucggccaccccuacuucuaccagcgccgcgucucccgcuccggcggccucgccguccuccccgucaucuacgccgucucccuccucuucugcucccucccccuccucgacuacggccaguacguccaguacugccccggcaccuggugcuucauccgccacggccgcaccgccuaccuccagcucuacgccacccuccuccuccuccucaucgucuccguccucgccugcaacuucuccgucauccucaaccucauccgcaugcaccgccgcucccgccgcucccgcugcggccccucccucggcuccggccgcggcggccccggcgcccgccgccgcggcgagcgcgucuccauggccgaggagaccgaccaccucauccuccucgccaucaugaccaucaccuucgccgucugcucccuccccuucaccaucuucgccuacaugaacgagaccuccucccgcaaggagaagugggaccuccaggcccuccgcuuccucuccaucaacuccaucaucgaccccugggucuucgccauccuccgcccccccguccuccgccucaugcgcuccguccucugcugccgcaucucccuccgcacccaggacgccacccagaccuccugcuccacccaguccgacgccuccaagcaggccgaccucuga

SEQ ID NO: 48291 - RNA, 1257 nt, Artificial Sequence
  derived and/or modified sequence opt2 from PTGER3__Homo_sapiens__XP_011540111
augaaggagacccgcggcuacggcggcgacgcccccuucugcacccgccucaaccacuccuacaccggcaugugggcccccgagcgcuccgccgaggcccgcggcaaccucacccgcccccccggcuccggcgaggacugcggcuccgucuccgucgccuuccccaucaccaugcuccucaccggcuucgucggcaacgcccucgccaugcuccucgucucccgcuccuaccgccgccgcgaguccaagcgcaagaaguccuuccuccucugcaucggcuggcucgcccucaccgaccucgucggccagcuccucaccacccccgucgucaucgucgucuaccucuccaagcagcgcugggagcacaucgaccccuccggccgccucugcaccuucuucggccucaccaugaccgucuucggccucuccucccucuucaucgccuccgccauggccgucgagcgcgcccucgccauccgcgccccccacugguacgccucccacaugaagacccgcgccacccgcgccguccuccucggcgucuggcucgccguccucgccuucgcccuccuccccguccucggcgucggccaguacaccguccaguggcccggcaccuggugcuucaucuccaccggccgcggcggcaacggcaccuccuccucccacaacuggggcaaccucuucuucgccuccgccuucgccuuccucggccuccucgcccucaccgucaccuucuccugcaaccucgccaccaucaaggcccucgucucccgcugccgcgccaaggccaccgccucccaguccuccgcccaguggggccgcaucaccaccgagaccgccauccagcucaugggcaucaugugcguccucuccgucugcugguccccccuccucaucaugaugcucaagaugaucuucaaccagaccuccgucgagcacugcaagacccacaccgagaagcagaaggagugcaacuucuuccucaucgccguccgccucgccucccucaaccagauccucgaccccugggucuaccuccuccuccgcaagauccuccuccgcaaguucugccagaugcgcaagcgccgccuccgcgagcaggccccccuccuccccaccuccaccgucaucgaccccucccgcuucugcgcccagcccuuccgcugguuccucgaccucuccuuccccgccauguccuccucccacccccagcucccccucacccucgccuccuucaagcuccucuccaaguga

SEQ ID NO: 48292 - RNA, 1467 nt, Artificial Sequence
  derived and/or modified sequence opt2 from PTGER4__Homo_sapiens__NP_000949
auguccacccccggcgucaacuccuccgccucccucucccccgaccgccucaacucccccgucaccauccccgccgucauguucaucuucggcgucgucggcaaccucgucgccaucgucguccucugcaagucccgcaaggagcagaaggagaccaccuucuacacccucgucugcggccucgccgucaccgaccuccucggcacccuccucgucucccccgucaccaucgccaccuacaugaagggccaguggcccggcggccagccccucugcgaguacuccaccuucauccuccucuucuucucccucuccggccucuccaucaucugcgccauguccgucgagcgcuaccucgccaucaaccacgccuacuucuacucccacuacgucgacaagcgccucgccggccucacccucuucgccgucuacgccuccaacguccucuucugcgcccuccccaacaugggccucggcuccucccgccuccaguaccccgacaccuggugcuucaucgacuggaccaccaacgucaccgcccacgccgccuacuccuacauguacgccggcuucuccuccuuccucauccucgccaccguccucugcaacguccucgucugcggcgcccuccuccgcaugcaccgccaguucaugcgccgcaccucccucggcaccgagcagcaccacgccgccgccgccgccuccgucgccucccgcggccaccccgccgccucccccgcccucccccgccucuccgacuuccgccgccgccgcuccuuccgccgcaucgccggcgccgagauccagauggucauccuccucaucgccaccucccucgucguccucaucugcuccaucccccucgucguccgcgucuucgucaaccagcucuaccagcccucccucgagcgcgaggucuccaagaaccccgaccuccaggccauccgcaucgccuccgucaaccccauccucgaccccuggaucuacauccuccuccgcaagaccguccucuccaaggccaucgagaagaucaagugccucuucugccgcaucggcggcucccgccgcgagcgcuccggccagcacugcuccgacucccagcgcaccuccuccgccauguccggccacucccgcuccuucaucucccgcgagcucaaggagaucuccuccaccucccagacccuccuccccgaccucucccuccccgaccucuccgagaacggccucggcggccgcaaccuccuccccggcguccccggcaugggccucgcccaggaggacaccaccucccuccgcacccuccgcaucuccgagaccuccgacuccucccagggccaggacuccgaguccguccuccucgucgacgaggccggcggcuccggccgcgccggccccgcccccaagggcuccucccuccaggucaccuuccccuccgagacccucaaccucuccgagaagugcaucuga

SEQ ID NO: 48293 - RNA, 1134 nt, Artificial Sequence
  derived and/or modified sequence opt2 from PTGES2__Homo_sapiens__NP_079348
auggaccccgccgcccgcgucguccgcgcccucuggcccggcggcugcgcccucgccuggcgccucggcggccgcccccagccccuccuccccacccagucccgcgccggcuucgccggcgccgccggcggccccucccccgucgccgccgcccgcaagggcuccccccgccuccucggcgccgccgcccucgcccucggcggcgcccucggccucuaccacaccgcccgcuggcaccuccgcgcccaggaccuccacgccgagcgcuccgccgcccagcucucccucuccucccgccuccagcucacccucuaccaguacaagaccugccccuucugcuccaagguccgcgccuuccucgacuuccacgcccuccccuaccaggucgucgaggucaaccccguccgccgcgccgagaucaaguucuccuccuaccgcaagguccccauccucgucgcccaggagggcgaguccucccagcagcucaacgacuccuccgucaucaucuccgcccucaagaccuaccucgucuccggccagccccucgaggagaucaucaccuacuaccccgccaugaaggccgucaacgagcagggcaaggaggucaccgaguucggcaacaaguacuggcucaugcucaacgagaaggaggcccagcaggucuacggcggcaaggaggcccgcaccgaggagaugaaguggcgccagugggccgacgacuggcucguccaccucaucucccccaacgucuaccgcacccccaccgaggcccucgccuccuucgacuacaucguccgcgagggcaaguucggcgccgucgagggcgccgucgccaaguacaugggcgccgccgccauguaccucaucuccaagcgccucaagucccgccaccgccuccaggacaacguccgcgaggaccucuacgaggccgccgacaagugggucgccgccgucggcaaggaccgccccuucaugggcggccagaagcccaaccucgccgaccucgccgucuacggcguccuccgcgucauggagggccucgacgccuucgacgaccucaugcagcacacccacauccagcccugguaccuccgcgucgagcgcgccaucaccgaggccucccccgcccacuga

SEQ ID NO: 48294 - RNA, 483 nt, Artificial Sequence
  derived and/or modified sequence opt2 from PTGES3__Homo_sapiens__NP_006592
augcagcccgccuccgccaagugguacgaccgccgcgacuacgucuucaucgaguucugcgucgaggacuccaaggacgucaacgucaacuucgagaaguccaagcucaccuucuccugccucggcggcuccgacaacuucaagcaccucaacgagaucgaccucuuccacugcaucgaccccaacgacuccaagcacaagcgcaccgaccgcuccauccucugcugccuccgcaagggcgaguccggccaguccuggccccgccucaccaaggagcgcgccaagcucaacuggcucuccgucgacuucaacaacuggaaggacugggaggacgacuccgacgaggacauguccaacuucgaccgcuucuccgagaugaugaacaacaugggcggcgacgaggacgucgaccuccccgaggucgacggcgccgacgacgacucccaggacuccgacgacgagaagaugcccgaccucgaguga

SEQ ID NO: 48295 - RNA, 459 nt, Artificial Sequence
  derived and/or modified sequence opt2 from PTGES__Homo_sapiens__NP_004869
augcccgcccacucccucgucauguccucccccgcccuccccgccuuccuccucugcuccacccuccucgucaucaagauguacgucgucgccaucaucaccggccagguccgccuccgcaagaaggccuucgccaaccccgaggacgcccuccgccacggcggcccccaguacugccgcuccgaccccgacgucgagcgcugccuccgcgcccaccgcaacgacauggagaccaucuaccccuuccucuuccucggcuucgucuacuccuuccucggccccaaccccuucgucgccuggaugcacuuccucgucuuccucgucggccgcgucgcccacaccgucgccuaccucggcaagcuccgcgcccccauccgcuccgucaccuacacccucgcccagcuccccugcgccuccauggcccuccagauccucugggaggccgcccgccaccucuga

SEQ ID NO: 48296 - RNA, 1161 nt, Artificial Sequence
  derived and/or modified sequence opt2 from PTGIR__Homo_sapiens__NP_000951
auggccgacuccugccgcaaccucaccuacguccgcggcuccgucggccccgccaccuccacccucauguucgucgccggcgucgucggcaacggccucgcccucggcauccucuccgcccgccgccccgcccgccccuccgccuucgccguccucgucaccggccucgccgccaccgaccuccucggcaccuccuuccucucccccgccgucuucgucgccuacgcccgcaacuccucccuccucggccucgcccgcggcggccccgcccucugcgacgccuucgccuucgccaugaccuucuucggccucgccuccaugcucauccucuucgccauggccgucgagcgcugccucgcccucucccaccccuaccucuacgcccagcucgacggcccccgcugcgcccgccucgcccuccccgccaucuacgccuucugcguccucuucugcgcccucccccuccucggccucggccagcaccagcaguacugccccggcuccuggugcuuccuccgcaugcgcugggcccagcccggcggcgccgccuucucccucgccuacgccggccucgucgcccuccucgucgccgccaucuuccucugcaacggcuccgucacccucucccucugccgcauguaccgccagcagaagcgccaccagggcucccucggcccccgcccccgcaccggcgaggacgaggucgaccaccucauccuccucgcccucaugaccgucgucauggccgucugcucccucccccucaccauccgcugcuucacccaggccgucgcccccgacuccuccuccgagaugggcgaccuccucgccuuccgcuucuacgccuucaaccccauccucgaccccugggucuucauccucuuccgcaaggccgucuuccagcgccucaagcucugggucugcugccucugccucggccccgcccacggcgacucccagaccccccucucccagcucgccuccggccgccgcgacccccgcgcccccuccgcccccgucggcaaggagggcuccugcgucccccucuccgccuggggcgagggccaggucgagccccucccccccacccagcaguccuccggcuccgccgucggcaccuccuccaaggccgaggccuccgucgccugcucccucugcuga

SEQ ID NO: 48297 - RNA, 1503 nt, Artificial Sequence
  derived and/or modified sequence opt2 from PTGIS__Homo_sapiens__NP_000952
auggccugggccgcccuccucggccuccucgccgcccuccuccuccuccuccuccucucccgccgccgcacccgccgccccggcgagcccccccucgaccucggcuccauccccuggcucggcuacgcccucgacuucggcaaggacgccgccuccuuccucacccgcaugaaggagaagcacggcgacaucuucaccauccucgucggcggccgcuacgucaccguccuccucgacccccacuccuacgacgccgucgucugggagccccgcacccgccucgacuuccacgccuacgccaucuuccucauggagcgcaucuucgacguccagcucccccacuacucccccuccgacgagaaggcccgcaugaagcucacccuccuccaccgcgagcuccaggcccucaccgaggccauguacaccaaccuccacgccguccuccucggcgacgccaccgaggccggcuccggcuggcacgagaugggccuccucgacuucuccuacuccuuccuccuccgcgccggcuaccucacccucuacggcaucgaggcccucccccgcacccacgagucccaggcccaggaccgcguccacuccgccgacgucuuccacaccuuccgccagcucgaccgccuccuccccaagcucgcccgcggcucccucuccgucggcgacaaggaccacaugugcuccgucaagucccgccucuggaagcuccucucccccgcccgccucgcccgccgcgcccaccgcuccaaguggcucgaguccuaccuccuccaccucgaggagaugggcgucuccgaggagaugcaggcccgcgcccucguccuccagcucugggccacccagggcaacaugggccccgccgccuucuggcuccuccucuuccuccucaagaaccccgaggcccucgccgccguccgcggcgagcucgaguccauccucuggcaggccgagcagcccgucucccagaccaccacccucccccagaagguccucgacuccacccccguccucgacuccguccucuccgagucccuccgccucaccgccgcccccuucaucacccgcgaggucgucgucgaccucgccaugcccauggccgacggccgcgaguucaaccuccgccgcggcgaccgccuccuccucuuccccuuccucuccccccagcgcgaccccgagaucuacaccgaccccgaggucuucaaguacaaccgcuuccucaaccccgacggcuccgagaagaaggacuucuacaaggacggcaagcgccucaagaacuacaacaugcccuggggcgccggccacaaccacugccucggccgcuccuacgccgucaacuccaucaagcaguucgucuuccucguccucguccaccucgaccucgagcucaucaacgccgacgucgagauccccgaguucgaccucucccgcuacggcuucggccucaugcagcccgagcacgacguccccguccgcuaccgcauccgccccuga

SEQ ID NO: 48298 - RNA, 906 nt, Artificial Sequence
  derived and/or modified sequence opt2 from PTGR1__Homo_sapiens__NP_001139581
augguccgcaccaagaccuggacccucaagaagcacuucgucggcuaccccaccaacuccgacuucgagcucaagaccgccgagcuccccccccucaagaacggcgagguccuccucgaggcccucuuccucaccgucgaccccuacaugcgcgucgccgccaagcgccucaaggagggcgacaccaugaugggccagcaggucgccaaggucgucgaguccaagaacgucgcccuccccaagggcaccaucguccucgccucccccggcuggaccacccacuccaucuccgacggcaaggaccucgagaagcuccucaccgaguggcccgacaccaucccccucucccucgcccucggcaccgucggcaugcccggccucaccgccuacuucggccuccucgagaucugcggcgucaagggcggcgagaccgucauggucaacgccgccgccggcgccgucggcuccgucgucggccagaucgccaagcucaagggcugcaaggucgucggcgccgucggcuccgacgagaaggucgccuaccuccagaagcucggcuucgacgucgucuucaacuacaagaccgucgagucccucgaggagacccucaagaaggccucccccgacggcuacgacugcuacuucgacaacgucggcggcgaguucuccaacaccgucaucggccagaugaagaaguucggccgcaucgccaucugcggcgccaucuccaccuacaaccgcaccggcccccucccccccggccccccccccgagaucgucaucuaccaggagcuccgcauggaggccuucgucgucuaccgcuggcagggcgacgcccgccagaaggcccucaaggaccuccucaaguggguccucgagaucaagcgcgagaacgaggaggacuga

SEQ ID NO: 48299 - RNA, 1800 nt, Artificial Sequence
  derived and/or modified sequence opt2 from PTGS1__Homo_sapiens__NP_000953
augucccgcucccuccuccucugguuccuccucuuccuccuccuccuccccccccuccccguccuccucgccgaccccggcgcccccacccccgucaaccccugcugcuacuaccccugccagcaccagggcaucugcguccgcuucggccucgaccgcuaccagugcgacugcacccgcaccggcuacuccggccccaacugcaccauccccggccucuggaccuggcuccgcaacucccuccgccccucccccuccuucacccacuuccuccucacccacggccgcugguucugggaguucgucaacgccaccuucauccgcgagaugcucaugcgccucguccucaccguccgcuccaaccucauccccuccccccccaccuacaacuccgcccacgacuacaucuccugggaguccuucuccaacgucuccuacuacacccgcauccuccccuccguccccaaggacugccccacccccaugggcaccaagggcaagaagcagcuccccgacgcccagcuccucgcccgccgcuuccuccuccgccgcaaguucauccccgacccccagggcaccaaccucauguucgccuucuucgcccagcacuucacccaccaguucuucaagaccuccggcaagaugggccccggcuucaccaaggcccucggccacggcgucgaccucggccacaucuacggcgacaaccucgagcgccaguaccagcuccgccucuucaaggacggcaagcucaaguaccagguccucgacggcgagauguacccccccuccgucgaggaggcccccguccucaugcacuacccccgcggcauccccccccagucccagauggccgucggccaggaggucuucggccuccuccccggccucaugcucuacgccacccucuggcuccgcgagcacaaccgcgucugcgaccuccucaaggccgagcaccccaccuggggcgacgagcagcucuuccagaccacccgccucauccucaucggcgagaccaucaagaucgucaucgaggaguacguccagcagcucuccggcuacuuccuccagcucaaguucgaccccgagcuccucuucggcguccaguuccaguaccgcaaccgcaucgccauggaguucaaccaccucuaccacuggcacccccucaugcccgacuccuucaaggucggcucccaggaguacuccuacgagcaguuccucuucaacaccuccaugcucgucgacuacggcgucgaggcccucgucgacgccuucucccgccagaucgccggccgcaucggcggcggccgcaacauggaccaccacauccuccacgucgccgucgacgucauccgcgagucccgcgagaugcgccuccagcccuucaacgaguaccgcaagcgcuucggcaugaagcccuacaccuccuuccaggagcucgucggcgagaaggagauggccgccgagcucgaggagcucuacggcgacaucgacgcccucgaguucuaccccggccuccuccucgagaagugccaccccaacuccaucuucggcgaguccaugaucgagaucggcgcccccuucucccucaagggccuccucggcaaccccaucugcucccccgaguacuggaagcccuccaccuucggcggcgaggucggcuucaacaucgucaagaccgccacccucaagaagcucgucugccucaacaccaagaccugccccuacgucuccuuccgcguccccgacgccucccaggacgacggccccgccgucgagcgccccuccaccgagcucuga

SEQ ID NO: 48300 - RNA, 1815 nt, Artificial Sequence
  derived and/or modified sequence opt2 from PTGS2__Homo_sapiens__NP_000954
augcucgcccgcgcccuccuccucugcgccguccucgcccucucccacaccgccaaccccugcugcucccaccccugccagaaccgcggcgucugcauguccgucggcuucgaccaguacaagugcgacugcacccgcaccggcuucuacggcgagaacugcuccacccccgaguuccucacccgcaucaagcucuuccucaagcccacccccaacaccguccacuacauccucacccacuucaagggcuucuggaacgucgucaacaacauccccuuccuccgcaacgccaucauguccuacguccucaccucccgcucccaccucaucgacuccccccccaccuacaacgccgacuacggcuacaaguccugggaggccuucuccaaccucuccuacuacacccgcgcccucccccccguccccgacgacugccccaccccccucggcgucaagggcaagaagcagcuccccgacuccaacgagaucgucgagaagcuccuccuccgccgcaaguucauccccgacccccagggcuccaacaugauguucgccuucuucgcccagcacuucacccaccaguucuucaagaccgaccacaagcgcggccccgccuucaccaacggccucggccacggcgucgaccucaaccacaucuacggcgagacccucgcccgccagcgcaagcuccgccucuucaaggacggcaagaugaaguaccagaucaucgacggcgagauguacccccccaccgucaaggacacccaggccgagaugaucuaccccccccagguccccgagcaccuccgcuucgccgucggccaggaggucuucggccucguccccggccucaugauguacgccaccaucuggcuccgcgagcacaaccgcgucugcgacguccucaagcaggagcaccccgaguggggcgacgagcagcucuuccagaccucccgccucauccucaucggcgagaccaucaagaucgucaucgaggacuacguccagcaccucuccggcuaccacuucaagcucaaguucgaccccgagcuccucuucaacaagcaguuccaguaccagaaccgcaucgccgccgaguucaacacccucuaccacuggcacccccuccuccccgacaccuuccagauccacgaccagaaguacaacuaccagcaguucaucuacaacaacuccauccuccucgagcacggcaucacccaguucgucgaguccuucacccgccagaucgccggccgcgucgccggcggccgcaacgucccccccgccguccagaaggucucccaggccuccaucgaccagucccgccagaugaaguaccaguccuucaacgaguaccgcaagcgcuucaugcucaagcccuacgaguccuucgaggagcucaccggcgagaaggagauguccgccgagcucgaggcccucuacggcgacaucgacgccgucgagcucuaccccgcccuccucgucgagaagccccgccccgacgccaucuucggcgagaccauggucgaggucggcgcccccuucucccucaagggccucaugggcaacgucaucugcucccccgccuacuggaagcccuccaccuucggcggcgaggucggcuuccagaucaucaacaccgccuccauccagucccucaucugcaacaacgucaagggcugccccuucaccuccuucuccguccccgaccccgagcucaucaagaccgucaccaucaacgccuccuccucccgcuccggccucgacgacaucaaccccaccguccuccucaaggagcgcuccaccgagcucuga

SEQ ID NO: 48301 - RNA, 1782 nt, Artificial Sequence
  derived and/or modified sequence opt2 from PTH1R__Homo_sapiens__NP_000307
augggcaccgcccgcaucgcccccggccucgcccuccuccucugcugccccguccucuccuccgccuacgcccucgucgacgccgacgacgucaugaccaaggaggagcagaucuuccuccuccaccgcgcccaggcccagugcgagaagcgccucaaggagguccuccagcgccccgccuccaucauggaguccgacaagggcuggaccuccgccuccaccuccggcaagccccgcaaggacaaggccuccggcaagcucuaccccgaguccgaggaggacaaggaggcccccaccggcucccgcuaccgcggccgccccugccuccccgagugggaccacauccucugcuggccccucggcgcccccggcgaggucgucgccguccccugccccgacuacaucuacgacuucaaccacaagggccacgccuaccgccgcugcgaccgcaacggcuccugggagcucguccccggccacaaccgcaccugggccaacuacuccgagugcgucaaguuccucaccaacgagacccgcgagcgcgaggucuucgaccgccucggcaugaucuacaccgucggcuacuccgucucccucgccucccucaccgucgccguccucauccucgccuacuuccgccgccuccacugcacccgcaacuacauccacaugcaccucuuccucuccuucaugcuccgcgccgucuccaucuucgucaaggacgccguccucuacuccggcgccacccucgacgaggccgagcgccucaccgaggaggagcuccgcgccaucgcccaggccccccccccccccgccaccgccgccgccggcuacgccggcugccgcgucgccgucaccuucuuccucuacuuccucgccaccaacuacuacuggauccucgucgagggccucuaccuccacucccucaucuucauggccuucuucuccgagaagaaguaccucuggggcuucaccgucuucggcuggggccuccccgccgucuucgucgccgucugggucuccguccgcgccacccucgccaacaccggcugcugggaccucuccuccggcaacaagaaguggaucauccagguccccauccucgccuccaucguccucaacuucauccucuucaucaacaucguccgcguccucgccaccaagcuccgcgagaccaacgccggccgcugcgacacccgccagcaguaccgcaagcuccucaaguccacccucguccucaugccccucuucggcguccacuacaucgucuucauggccacccccuacaccgaggucuccggcacccucuggcagguccagaugcacuacgagaugcucuucaacuccuuccagggcuucuucgucgccaucaucuacugcuucugcaacggcgagguccaggccgagaucaagaaguccuggucccgcuggacccucgcccucgacuucaagcgcaaggcccgcuccggcuccuccuccuacuccuacggccccauggucucccacaccuccgucaccaacgucggcccccgcgucggccucggccucccccucuccccccgccuccuccccaccgccaccaccaacggccacccccagcuccccggccacgccaagcccggcacccccgcccucgagacccucgagaccaccccccccgccauggccgcccccaaggacgacggcuuccucaacggcuccugcuccggccucgacgaggaggccuccggccccgagcgcccccccgcccuccuccaggaggagugggagaccgucauguga

SEQ ID NO: 48302 - RNA, 303 nt, Artificial Sequence
  derived and/or modified sequence opt2 from PTH2__Homo_sapiens__NP_848544
auggagacccgccaggucucccgcuccccccgcguccgccuccuccuccuccuccuccuccuccucgucguccccuggggcguccgcaccgccuccggcgucgcccucccccccgucggcguccucucccuccgcccccccggccgcgccugggccgaccccgccaccccccgcccccgccgcucccucgcccucgccgacgacgccgccuuccgcgagcgcgcccgccuccucgccgcccucgagcgccgccacuggcucaacuccuacaugcacaagcuccucguccucgacgcccccuga

SEQ ID NO: 48303 - RNA, 1653 nt, Artificial Sequence
  derived and/or modified sequence opt2 from PTH2R__Homo_sapiens__NP_005039
auggccggccucggcgccucccuccacgucuggggcuggcucaugcucggcuccugccuccucgcccgcgcccagcucgacuccgacggcaccaucaccaucgaggagcagaucguccucguccucaaggccaagguccagugcgagcucaacaucaccgcccagcuccaggagggcgagggcaacugcuuccccgagugggacggccucaucugcuggccccgcggcaccgucggcaagaucuccgccguccccugcccccccuacaucuacgacuucaaccacaagggcgucgccuuccgccacugcaaccccaacggcaccugggacuucaugcacucccucaacaagaccugggccaacuacuccgacugccuccgcuuccuccagcccgacaucuccaucggcaagcaggaguucuucgagcgccucuacgucauguacaccgucggcuacuccaucuccuucggcucccucgccgucgccauccucaucaucggcuacuuccgccgccuccacugcacccgcaacuacauccacaugcaccucuucgucuccuucaugcuccgcgccaccuccaucuucgucaaggaccgcgucguccacgcccacaucggcgucaaggagcucgagucccucaucaugcaggacgacccccagaacuccaucgaggccaccuccgucgacaagucccaguacaucggcugcaagaucgccgucgucauguucaucuacuuccucgccaccaacuacuacuggauccucgucgagggccucuaccuccacaaccucaucuucgucgccuucuucuccgacaccaaguaccucuggggcuucauccucaucggcuggggcuuccccgccgccuucgucgccgccugggccgucgcccgcgccacccucgccgacgcccgcugcugggagcucuccgccggcgacaucaaguggaucuaccaggcccccauccucgccgccaucggccucaacuucauccucuuccucaacaccguccgcguccucgccaccaagaucugggagaccaacgccgucggccacgacacccgcaagcaguaccgcaagcucgccaaguccacccucguccucguccucgucuucggcguccacuacaucgucuucgucugccucccccacuccuucaccggccucggcugggagauccgcaugcacugcgagcucuucuucaacuccuuccagggcuucuucgucuccaucaucuacugcuacugcaacggcgagguccaggccgaggucaagaagauguggucccgcuggaaccucuccgucgacuggaagcgcaccccccccugcggcucccgccgcugcggcuccguccucaccaccgucacccacuccaccuccucccagucccaggucgccgccuccacccgcaugguccucaucuccggcaaggccgccaagaucgccucccgccagcccgacucccacaucacccuccccggcuacgucugguccaacuccgagcaggacugccucccccacuccuuccacgaggagaccaaggaggacuccggccgccagggcgacgacauccucauggagaagcccucccgccccauggaguccaaccccgacaccgagggcugccagggcgagaccgaggacguccucuga

SEQ ID NO: 48304 - RNA, 348 nt, Artificial Sequence
  derived and/or modified sequence opt2 from PTH__Homo_sapiens__NP_000306
augauccccgccaaggacauggccaaggucaugaucgucaugcucgccaucugcuuccucaccaaguccgacggcaaguccgucaagaagcgcuccgucuccgagauccagcucaugcacaaccucggcaagcaccucaacuccauggagcgcgucgaguggcuccgcaagaagcuccaggacguccacaacuucgucgcccucggcgccccccucgccccccgcgacgccggcucccagcgcccccgcaagaaggaggacaacguccucgucgagucccacgagaagucccucggcgaggccgacaaggccgacgucaacguccucaccaaggccaagucccaguga

SEQ ID NO: 48305 - RNA, 528 nt, Artificial Sequence
  derived and/or modified sequence opt2 from PTHLH__Homo_sapiens__NP_945315
augcagcgccgccucguccagcagugguccgucgccgucuuccuccucuccuacgccguccccuccugcggccgcuccgucgagggccucucccgccgccucaagcgcgccgucuccgagcaccagcuccuccacgacaagggcaaguccauccaggaccuccgccgccgcuucuuccuccaccaccucaucgccgagauccacaccgccgagauccgcgccaccuccgaggucucccccaacuccaagcccucccccaacaccaagaaccaccccguccgcuucggcuccgacgacgagggccgcuaccucacccaggagaccaacaaggucgagaccuacaaggagcagccccucaagacccccggcaagaagaagaagggcaagcccggcaagcgcaaggagcaggagaagaagaagcgccgcacccgcuccgccuggcucgacuccggcgucaccggcuccggccucgagggcgaccaccucuccgacaccuccaccaccucccucgagcucgacucccgcuga

SEQ ID NO: 48306 - RNA, 2904 nt, Artificial Sequence
  derived and/or modified sequence opt2 from PTK2B__Homo_sapiens__NP_775267
auguccggcgucuccgagccccucucccgcgucaagcucggcacccuccgccgccccgagggccccgccgagcccauggucgucguccccgucgacgucgagaaggaggacguccgcauccucaaggucugcuucuacuccaacuccuucaaccccggcaagaacuucaagcucgucaagugcaccguccagaccgagauccgcgagaucaucaccuccauccuccucuccggccgcaucggccccaacauccgccucgccgagugcuacggccuccgccucaagcacaugaaguccgacgagauccacuggcuccacccccagaugaccgucggcgagguccaggacaaguacgagugccuccacgucgaggccgaguggcgcuacgaccuccagauccgcuaccuccccgaggacuucauggagucccucaaggaggaccgcaccacccuccucuacuucuaccagcagcuccgcaacgacuacaugcagcgcuacgccuccaaggucuccgagggcauggcccuccagcucggcugccucgagcuccgccgcuucuucaaggacaugccccacaacgcccucgacaagaaguccaacuucgagcuccucgagaaggaggucggccucgaccucuucuuccccaagcagaugcaggagaaccucaagcccaagcaguuccgcaagaugauccagcagaccuuccagcaguacgccucccuccgcgaggaggagugcgucaugaaguucuucaacacccucgccggcuucgccaacaucgaccaggagaccuaccgcugcgagcucauccagggcuggaacaucaccgucgaccucgucaucggccccaagggcauccgccagcucaccucccaggacgccaagcccaccugccucgccgaguucaagcagauccgcuccauccgcugccucccccucgaggagggccaggccguccuccagcucggcaucgagggcgccccccaggcccucuccaucaagaccuccucccucgccgaggccgagaacauggccgaccucaucgacggcuacugccgccuccagggcgagcaccagggcucccucaucauccacccccgcaaggacggcgagaagcgcaacucccucccccagauccccaugcucaaccucgaggcccgccgcucccaccucuccgaguccugcuccaucgaguccgacaucuacgccgagauccccgacgagacccuccgccgccccggcggcccccaguacggcaucgcccgcgaggacgucguccucaaccgcauccucggcgagggcuucuucggcgaggucuacgagggcgucuacaccaaccacaagggcgagaagaucaacgucgccgucaagaccugcaagaaggacugcacccucgacaacaaggagaaguucauguccgaggccgucaucaugaagaaccucgaccacccccacaucgucaagcucaucggcaucaucgaggaggagcccaccuggaucaucauggagcucuaccccuacggcgagcucggccacuaccucgagcgcaacaagaacucccucaagguccucacccucguccucuacucccuccagaucugcaaggccauggccuaccucgaguccaucaacugcguccaccgcgacaucgccguccgcaacauccucgucgccucccccgagugcgucaagcucggcgacuucggccucucccgcuacaucgaggacgaggacuacuacaaggccuccgucacccgccuccccaucaaguggaugucccccgaguccaucaacuuccgccgcuucaccaccgccuccgacgucuggauguucgccgucugcaugugggagauccucuccuucggcaagcagcccuucuucuggcucgagaacaaggacgucaucggcguccucgagaagggcgaccgccuccccaagcccgaccucugcccccccguccucuacacccucaugacccgcugcugggacuacgaccccuccgaccgcccccgcuucaccgagcucgucugcucccucuccgacgucuaccagauggagaaggacaucgccauggagcaggagcgcaacgcccgcuaccgcacccccaagauccucgagcccaccgccuuccaggagcccccccccaagcccucccgccccaaguaccgcccccccccccagaccaaccuccucgcccccaagcuccaguuccaggaggaggacuucauccagcccuccucccgcgaggaggcccagcagcucugggaggccgagaaggucaagaugcgccagauccucgacaagcagcagaagcagauggucgaggacuaccaguggcuccgccaggaggagaagucccucgaccccauggucuacaugaacgacaaguccccccucacccccgagaaggaggucggcuaccucgaguucaccggccccccccagaagcccccccgccucggcgcccaguccauccagcccaccgccaaccucgaccgcaccgacgaccucgucuaccucaacgucauggagcucguccgcgccguccucgagcucaagaacgagcucugccagcucccccccgagggcuacgucgucgucgucaagaacgucggccucacccuccgcaagcucaucggcuccgucgacgaccuccuccccucccuccccuccuccucccgcaccgagaucgagggcacccagaagcuccucaacaaggaccucgccgagcucaucaacaagaugcgccucgcccagcagaacgccgucaccucccucuccgaggagugcaagcgccagaugcucaccgccucccacacccucgccgucgacgccaagaaccuccucgacgccgucgaccaggccaagguccucgccaaccucgcccacccccccgccgaguga

SEQ ID NO: 48307 - RNA, 3198 nt, Artificial Sequence
  derived and/or modified sequence opt2 from PTK2__Homo_sapiens__NP_001186578
auggccgccgccuaccucgaccccaaccucaaccacacccccaacuccuccaccaagacccaccucggcaccggcauggagcgcucccccggcgccauggagcgcguccucaaggucuuccacuacuucgaguccaacuccgagcccaccaccugggccuccaucauccgccacggcgacgccaccgacguccgcggcaucauccagaagaucgucgacucccacaaggucaagcacgucgccugcuacggcuuccgccucucccaccuccgcuccgaggagguccacuggcuccacgucgacaugggcgucuccuccguccgcgagaaguacgagcucgcccacccccccgaggaguggaaguacgagcuccgcauccgcuaccuccccaagggcuuccucaaccaguucaccgaggacaagcccacccucaacuucuucuaccagcaggucaaguccgacuacaugcucgagaucgccgaccaggucgaccaggagaucgcccucaagcucggcugccucgagauccgccgcuccuacugggagaugcgcggcaacgcccucgagaagaaguccaacuacgagguccucgagaaggacgucggccucaagcgcuucuuccccaagucccuccucgacuccgucaaggccaagacccuccgcaagcucauccagcagaccuuccgccaguucgccaaccucaaccgcgaggaguccauccucaaguucuucgagauccucucccccgucuaccgcuucgacaaggagugcuucaagugcgcccucggcuccuccuggaucaucuccgucgagcucgccaucggccccgaggagggcaucuccuaccucaccgacaagggcugcaaccccacccaccucgccgacuucacccagguccagaccauccaguacuccaacuccgaggacaaggaccgcaagggcaugcuccagcucaagaucgccggcgcccccgagccccucaccgucaccgcccccucccucaccaucgccgagaacauggccgaccucaucgacggcuacugccgccucgucaacggcaccucccaguccuucaucauccgcccccagaaggagggcgagcgcgcccuccccuccauccccaagcucgccaacuccgagaagcagggcaugcgcacccacgccgucuccgucuccgagaccgacgacuacgccgagaucaucgacgaggaggacaccuacaccaugcccuccacccgcgacuacgagauccagcgcgagcgcaucgagcucggccgcugcaucggcgagggccaguucggcgacguccaccagggcaucuacaugucccccgagaaccccgcccucgccgucgccaucaagaccugcaagaacugcaccuccgacuccguccgcgagaaguuccuccaggaggcccucaccaugcgccaguucgaccacccccacaucgucaagcucaucggcgucaucaccgagaaccccgucuggaucaucauggagcucugcacccucggcgagcuccgcuccuuccuccagguccgcaaguacucccucgaccucgccucccucauccucuacgccuaccagcucuccaccgcccucgccuaccucgaguccaagcgcuucguccaccgcgacaucgccgcccgcaacguccucgucuccuccaacgacugcgucaagcucggcgacuucggccucucccgcuacauggaggacuccaccuacuacaaggccuccaagggcaagcuccccaucaaguggauggcccccgaguccaucaacuuccgccgcuucaccuccgccuccgacgucuggauguucggcgucugcaugugggagauccucaugcacggcgucaagcccuuccagggcgucaagaacaacgacgucaucggccgcaucgagaacggcgagcgccuccccaugccccccaacugcccccccacccucuacucccucaugaccaagugcugggccuacgaccccucccgccgcccccgcuucaccgagcucaaggcccagcucuccaccauccucgaggaggagaaggcccagcaggaggagcgcaugcgcauggagucccgccgccaggccaccgucuccugggacuccggcggcuccgacgaggccccccccaagcccucccgccccggcuaccccuccccccgcuccuccgagggcuucuaccccuccccccagcacaugguccagaccaaccacuaccaggucuccggcuaccccggcucccacggcaucaccgccauggccggcuccaucuaccccggccaggccucccuccucgaccagaccgacuccuggaaccaccgcccccaggagaucgccauguggcagcccaacgucgaggacuccaccguccucgaccuccgcggcaucggccagguccuccccacccaccucauggaggagcgccucauccgccagcagcaggagauggaggaggaccagcgcuggcucgagaaggaggagcgcuuccucaagcccgacguccgccucucccgcggcuccaucgaccgcgaggacggcucccuccagggccccaucggcaaccagcacaucuaccagcccgucggcaagcccggcaaggaggagaagaacugggccgagcgcaaccccgccgccccccccaagaagcccccccgccccggcgcccccggccaccucggcucccucgccucccucuccucccccgccgacuccuacaacgagggcgucaagcccuggcgccuccagccccaggagaucucccccccccccaccgccaaccucgaccgcuccaacgacaaggucuacgagaacgucaccggccucgucaaggccgucaucgagauguccuccaagauccagcccgccccccccgaggaguacguccccauggucaaggaggucggccucgcccuccgcacccuccucgccaccgucgacgagaccaucccccuccuccccgccuccacccaccgcgagaucgagauggcccagaagcuccucaacuccgaccucggcgagcucaucaacaagaugaagcucgcccagcaguacgucaugaccucccuccagcaggaguacaagaagcagaugcucaccgccgcccacgcccucgccgucgacgccaagaaccuccucgacgucaucgaccaggcccgccucaagaugcucggccagacccgcccccacuga

SEQ ID NO: 48308 - RNA, 405 nt, Artificial Sequence
  derived and/or modified sequence opt2 from PTK6__Homo_sapiens__NP_001243287
auggucucccgcgaccaggcccaccucggccccaaguacgucggccucugggacuucaagucccgcaccgacgaggagcucuccuuccgcgccggcgacgucuuccacgucgcccgcaaggaggagcagugguggugggccacccuccucgacgaggccggcggcgccgucgcccagggcuacgucccccacaacuaccucgccgagcgcgagaccgucgaguccgagcccgccggccacgccggcugcgccgcccuccaggaccucgccgccugccgcggccccgccgcccccgagcgcggcggcguccucccccagcccgcccgcgccugcgagcucccccagggccccgagcccgucccccgccccgccgccggccgcgcccuccccgaggcccgcgccuga

SEQ ID NO: 48309 - RNA, 3237 nt, Artificial Sequence
  derived and/or modified sequence opt2 from PTK7__Homo_sapiens__NP_001257327
augggcuccuuccucuccggcgagaagcgccccuccgcccccaccgucggcuccgccauggagaagaaggaguuccccaccccccccggccgcgucggccccggcacccagaccgccaucgucuucaucaagcagcccuccucccaggacgcccuccagggccgccgcgcccuccuccgcugcgaggucgaggcccccggccccguccacgucuacuggcuccucgacggcgcccccguccaggacaccgagcgccgcuucgcccagggcuccucccucuccuucgccgccgucgaccgccuccaggacuccggcaccuuccagugcgucgcccgcgacgacgucaccggcgaggaggcccgcuccgccaacgccuccuucaacaucaaguggaucgaggccggccccgucguccucaagcaccccgccuccgaggccgagauccagccccagacccaggucacccuccgcugccacaucgacggccacccccgccccaccuaccagugguuccgcgacggcaccccccucuccgacggccaguccaaccacaccgucuccuccaaggagcgcaaccucacccuccgccccgccggccccgagcacuccggccucuacuccugcugcgcccacuccgccuucggccaggccugcuccucccagaacuucacccucuccaucgccgacgaguccuucgcccgcgucguccucgccccccaggacgucgucgucgcccgcuacgaggaggccauguuccacugccaguucuccgcccagcccccccccucccuccaguggcucuucgaggacgagacccccaucaccaaccgcucccgccccccccaccuccgccgcgccaccgucuucgccaacggcucccuccuccucacccagguccgcccccgcaacgccggcaucuaccgcugcaucggccagggccagcgcggcccccccaucauccucgaggccacccuccaccucgccgagaucgaggacaugccccucuucgagccccgcgucuucaccgccggcuccgaggagcgcgucaccugccucccccccaagggccuccccgagcccuccgucuggugggagcacgccggcguccgccuccccacccacggccgcgucuaccagaagggccacgagcucguccucgccaacaucgccgaguccgacgccggcgucuacaccugccacgccgccaaccucgccggccagcgccgccaggacgucaacaucaccgucgccaccguccccuccuggcucaagaagccccaggacucccagcucgaggagggcaagcccggcuaccucgacugccucacccaggccacccccaagcccaccgucgucugguaccgcaaccagaugcucaucuccgaggacucccgcuucgaggucuucaagaacggcacccuccgcaucaacuccgucgaggucuacgacggcaccugguaccgcugcauguccuccacccccgccggcuccaucgaggcccaggcccgcguccagguccucgagaagcucaaguucaccccccccccccagccccagcagugcauggaguucgacaaggaggccaccguccccugcuccgccaccggccgcgagaagcccaccaucaagugggagcgcgccgacggcuccucccuccccgagugggucaccgacaacgccggcacccuccacuucgcccgcgucacccgcgacgacgccggcaacuacaccugcaucgccuccaacggcccccagggccagauccgcgcccacguccagcucaccgucgccgucuucaucaccuucaaggucgagcccgagcgcaccaccgucuaccagggccacaccgcccuccuccagugcgaggcccagggcgaccccaagccccucauccaguggaagggcaaggaccgcauccucgaccccaccaagcucggcccccgcaugcacaucuuccagaacggcucccucgucauccacgacgucgcccccgaggacuccggccgcuacaccugcaucgccggcaacuccugcaacaucaagcacaccgaggccccccucuacgucgucgacaagcccguccccgaggaguccgagggccccggcucccccccccccuacaagaugauccagaccaucggccucuccgucggcgccgccgucgccuacaucaucgccguccucggccucauguucuacugcaagaagcgcugcaaggccaagcgccuccagaagcagcccgagggcgaggagcccgagauggagugccucaacggcggcccccuccagaacggccagcccuccgccgagauccaggaggaggucgcccucaccucccucggcuccggccccgccgccaccaacaagcgccacuccaccuccgacaagaugcacuucccccgcuccucccuccagcccaucaccacccucggcaaguccgaguucggcgaggucuuccucgccaaggcccagggccucgaggagggcgucgccgagacccucguccucgucaagucccuccaguccaaggacgagcagcagcagcucgacuuccgccgcgagcucgagauguucggcaagcucaaccacgccaacgucguccgccuccucggccucugccgcgaggccgagccccacuacaugguccucgaguacgucgaccucggcgaccucaagcaguuccuccgcaucuccaaguccaaggacgagaagcucaagucccagccccucuccaccaagcagaaggucgcccucugcacccaggucgcccucggcauggagcaccucuccaacaaccgcuucguccacaaggaccucgccgcccgcaacugccucgucuccgcccagcgccaggucaaggucuccgcccucggccucuccaaggacgucuacaacuccgaguacuaccacuuccgccaggccugggucccccuccgcuggaugucccccgaggccauccucgagggcgacuucuccaccaaguccgacgucugggccuucggcguccucaugugggaggucuucacccacggcgagaugccccacggcggccaggccgacgacgagguccucgccgaccuccaggccggcaaggcccgccucccccagcccgagggcugccccuccaagcucuaccgccucaugcagcgcugcugggcccucucccccaaggaccgccccuccuucuccgagaucgccuccgcccucggcgacuccaccgucgacuccaagcccuga

SEQ ID NO: 48310 - RNA, 336 nt, Artificial Sequence
  derived and/or modified sequence opt2 from PTMA__Homo_sapiens__NP_001092755
auguccgacgccgccgucgacaccuccuccgagaucaccaccaaggaccucaaggagaagaaggaggucgucgaggaggccgagaacggccgcgacgcccccgccaacggcaacgccgagaacgaggagaacggcgagcaggaggccgacaacgaggucgacgaggaggaggaggagggcggcgaggaggaggaggaggaggaggagggcgacggcgaggaggaggacggcgacgaggacgaggaggccgaguccgccaccggcaagcgcgccgccgaggacgacgaggacgacgacgucgacaccaagaagcagaagaccgacgaggacgacuga

SEQ ID NO: 48311 - RNA, 309 nt, Artificial Sequence
  derived and/or modified sequence opt2 from PTMS__Homo_sapiens__NP_002815
auguccgagaaguccgucgaggccgccgccgagcucuccgccaaggaccucaaggagaagaaggagaaggucgaggagaaggccucccgcaaggagcgcaagaaggaggucgucgaggaggaggagaacggcgccgaggaggaggaggaggagaccgccgaggacggcgaggaggaggacgagggcgaggaggaggacgaggaggaggaggaggaggacgacgagggccccgcccucaagcgcgccgccgaggaggaggacgaggccgaccccaagcgccagaagaccgagaacggcgccuccgccuga

SEQ ID NO: 48312 - RNA, 507 nt, Artificial Sequence
  derived and/or modified sequence opt2 from PTN__Homo_sapiens__XP_005250572
augcaggcccagcaguaccagcagcagcgccgcaaguucgccgccgccuuccucgccuucaucuucauccucgccgccgucgacaccgccgaggccggcaagaaggagaagcccgagaagaaggucaagaaguccgacugcggcgaguggcagugguccgucugcguccccaccuccggcgacugcggccucggcacccgcgagggcacccgcaccggcgccgagugcaagcagaccaugaagacccagcgcugcaagauccccugcaacuggaagaagcaguucggcgccgagugcaaguaccaguuccaggccuggggcgagugcgaccucaacaccgcccucaagacccgcaccggcucccucaagcgcgcccuccacaacgccgagugccagaagaccgucaccaucuccaagcccugcggcaagcucaccaagcccaagccccaggccgaguccaagaagaagaagaaggagggcaagaagcaggagaagaugcucgacuga

SEQ ID NO: 48313 - RNA, 1251 nt, Artificial Sequence
  derived and/or modified sequence opt2 from PTOV1__Homo_sapiens__NP_059128
augguccgcccccgccgcgcccccuaccgcuccggcgccggcggcccccucggcggccgcggccgccccccccgcccccucgucguccgcgccguccgcucccgcuccuggcccgccuccccccgcggcccccagcccccccgcauccgcgcccgcuccgccccccccauggagggcgcccgcgucuucggcgcccucggccccaucggccccuccucccccggccucacccucggcggccucgccgucuccgagcaccgccucuccaacaagcuccucgccugguccggcguccucgaguggcaggagaagcgccgccccuacuccgacuccaccgccaagcucaagcgcacccuccccugccaggccuacgucaaccagggcgagaaccucgagaccgaccaguggccccagaagcucaucaugcagcucaucccccagcagcuccucaccacccucggcccccucuuccgcaacucccagcucgcccaguuccacuucaccaaccgcgacugcgacucccucaagggccucugccgcaucaugggcaacggcuucgccggcugcaugcucuucccccacaucucccccugcgagguccgcguccucaugcuccucuacuccuccaagaagaagaucuucaugggccucauccccuacgaccaguccggcuucgucuccgccauccgccaggucaucaccacccgcaagcaggccgucggccccggcggcgucaacuccggccccguccagaucgucaacaacaaguuccucgccugguccggcgucauggaguggcaggagccccgccccgagcccaacucccgcuccaagcgcuggcuccccucccacgucuacgucaaccagggcgagauccuccgcaccgagcaguggccccgcaagcucuacaugcagcucaucccccagcagcuccucaccacccucgucccccucuuccgcaacucccgccucguccaguuccacuucaccaaggaccucgagacccucaagucccucugccgcaucauggacaacggcuucgccggcugcguccacuucuccuacaaggccuccugcgagauccgcguccucaugcuccucuacuccuccgagaagaagaucuucaucggccucaucccccacgaccagggcaacuucgucaacggcauccgccgcgucaucgccaaccagcagcagguccuccagcgcaaccucgagcaggagcagcagcagcgcggcaugggcggcuga

SEQ ID NO: 48314 - RNA, 522 nt, Artificial Sequence
  derived and/or modified sequence opt2 from PTP4A1__Homo_sapiens__XP_011534414
auggcccgcaugaaccgccccgcccccgucgaggucaccuacaagaacaugcgcuuccucaucacccacaaccccaccaacgccacccucaacaaguucaucgaggagcucaagaaguacggcgucaccaccaucguccgcgucugcgaggccaccuacgacaccacccucgucgagaaggagggcauccacguccucgacuggcccuucgacgacggcgccccccccuccaaccagaucgucgacgacuggcucucccucgucaagaucaaguuccgcgaggagcccggcugcugcaucgccguccacugcgucgccggccucggccgcgcccccguccucgucgcccucgcccucaucgagggcggcaugaaguacgaggacgccguccaguucauccgccagaagcgccgcggcgccuucaacuccaagcagcuccucuaccucgagaaguaccgccccaagaugcgccuccgcuucaaggacuccaacggccaccgcaacaacugcugcauccaguga

SEQ ID NO: 48315 - RNA, 447 nt, Artificial Sequence
  derived and/or modified sequence opt2 from PTP4A3__Homo_sapiens__XP_005250824
auggcccgcaugaaccgccccgcccccgucgaggucuccuacaagcacaugcgcuuccucaucacccacaaccccaccaacgccacccucuccaccuucaucgaggaccucaagaaguacggcgccaccaccgucguccgcgucugcgaggucaccuacgacaagaccccccucgagaaggacggcaucaccgucgucgacuggcccuucgacgacggcgcccccccccccggcaaggucgucgaggacuggcucucccucgucaaggccaaguucugcgaggcccccggcuccugcgucgccguccacugcgucgccggccucggccgcaagcgccgcggcgccaucaacuccaagcagcucaccuaccucgagaaguaccgccccaagcagcgccuccgcuucaaggacccccacacccacaagacccgcugcugcgucauguga

SEQ ID NO: 48316 - RNA, 456 nt, Artificial Sequence
  derived and/or modified sequence opt2 from PTPMT1__Homo_sapiens__NP_001137456
auggccgccaccgcccuccucgaggccggccucgcccgcguccucuucuaccccacccuccucuacacccucuuccgcggcaagguccccggccgcgcccaccgcgacugguaccaccgcaucgaccccaccguccuccucggcgcccucccccuccgcucccucacccgccaggucucccgcgccggcgagcccggcccccucccccgcccccgccgcuccguccccgucggcccccucggcuccccccccucccuccucucccaccucuucgccuccgccgccggcaccggccgcgagcgcgcccgcggcgaccaccacgagcgcggcguccgcgacgagguccccguccagcucuucaccggcgcccagauggagucccgcggcggcugcaagucccaccgccaggaccccgucauccacccccaccaggccuggcccgccggcugcuccuga

SEQ ID NO: 48317 - RNA, 1782 nt, Artificial Sequence
  derived and/or modified sequence opt2 from PTPN11__Homo_sapiens__NP_002825
augaccucccgccgcugguuccaccccaacaucaccggcgucgaggccgagaaccuccuccucacccgcggcgucgacggcuccuuccucgcccgccccuccaaguccaaccccggcgacuucacccucuccguccgccgcaacggcgccgucacccacaucaagauccagaacaccggcgacuacuacgaccucuacggcggcgagaaguucgccacccucgccgagcucguccaguacuacauggagcaccacggccagcucaaggagaagaacggcgacgucaucgagcucaaguacccccucaacugcgccgaccccaccuccgagcgcugguuccacggccaccucuccggcaaggaggccgagaagcuccucaccgagaagggcaagcacggcuccuuccucguccgcgagucccagucccaccccggcgacuucguccucuccguccgcaccggcgacgacaagggcgaguccaacgacggcaaguccaaggucacccacgucaugauccgcugccaggagcucaaguacgacgucggcggcggcgagcgcuucgacucccucaccgaccucgucgagcacuacaagaagaaccccauggucgagacccucggcaccguccuccagcucaagcagccccucaacaccacccgcaucaacgccgccgagaucgagucccgcguccgcgagcucuccaagcucgccgagaccaccgacaaggucaagcagggcuucugggaggaguucgagacccuccagcagcaggagugcaagcuccucuacucccgcaaggagggccagcgccaggagaacaagaacaagaaccgcuacaagaacauccuccccuucgaccacacccgcgucguccuccacgacggcgaccccaacgagcccgucuccgacuacaucaacgccaacaucaucaugcccgaguucgagaccaagugcaacaacuccaagcccaagaaguccuacaucgccacccagggcugccuccagaacaccgucaacgacuucuggcgcauggucuuccaggagaacucccgcgucaucgucaugaccaccaaggaggucgagcgcggcaaguccaagugcgucaaguacuggcccgacgaguacgcccucaaggaguacggcgucaugcgcguccgcaacgucaaggaguccgccgcccacgacuacacccuccgcgagcucaagcucuccaaggucggccagggcaacaccgagcgcaccgucuggcaguaccacuuccgcaccuggcccgaccacggcguccccuccgaccccggcggcguccucgacuuccucgaggagguccaccacaagcaggaguccaucauggacgccggccccgucgucguccacugcuccgccggcaucggccgcaccggcaccuucaucgucaucgacauccucaucgacaucauccgcgagaagggcgucgacugcgacaucgacguccccaagaccauccagaugguccgcucccagcgcuccggcaugguccagaccgaggcccaguaccgcuucaucuacauggccguccagcacuacaucgagacccuccagcgccgcaucgaggaggagcagaaguccaagcgcaagggccacgaguacaccaacaucaaguacucccucgccgaccagaccuccggcgaccaguccccccucccccccugcacccccaccccccccugcgccgagaugcgcgaggacuccgcccgcgucuacgagaacgucggccucaugcagcagcagaaguccuuccgcuga

SEQ ID NO: 48318 - RNA, 1986 nt, Artificial Sequence
  derived and/or modified sequence opt2 from PTPN12__Homo_sapiens__NP_001124480
augaucugggaguacaacgucgucaucaucgucauggccugccgcgaguucgagaugggccgcaagaagugcgagcgcuacuggccccucuacggcgaggaccccaucaccuucgcccccuucaagaucuccugcgaggacgagcaggcccgcaccgacuacuucauccgcacccuccuccucgaguuccagaacgagucccgccgccucuaccaguuccacuacgucaacuggcccgaccacgacguccccuccuccuucgacuccauccucgacaugaucucccucaugcgcaaguaccaggagcacgaggacguccccaucugcauccacugcuccgccggcugcggccgcaccggcgccaucugcgccaucgacuacaccuggaaccuccucaaggccggcaagauccccgaggaguucaacgucuucaaccucauccaggagaugcgcacccagcgccacuccgccguccagaccaaggagcaguacgagcucguccaccgcgccaucgcccagcucuucgagaagcagcuccagcucuacgagauccacggcgcccagaagaucgccgacggcgucaacgagaucaacaccgagaacauggucuccuccaucgagcccgagaagcaggacucccccccccccaagcccccccgcacccgcuccugccucgucgagggcgacgccaaggaggagauccuccagccccccgagccccaccccgucccccccauccucacccccuccccccccuccgccuuccccaccgucaccaccgucuggcaggacaacgaccgcuaccaccccaagcccguccuccacauggucuccuccgagcagcacuccgccgaccucaaccgcaacuacuccaaguccaccgagcuccccggcaagaacgaguccaccaucgagcagaucgacaagaagcucgagcgcaaccucuccuucgagaucaagaaggucccccuccaggagggccccaaguccuucgacggcaacacccuccucaaccgcggccacgccaucaagaucaaguccgccucccccugcaucgccgacaagaucuccaagccccaggagcucuccuccgaccucaacgucggcgacaccucccagaacuccugcgucgacugcuccgucacccaguccaacaaggucuccgucaccccccccgaggagucccagaacuccgacacccccccccgccccgaccgccucccccucgacgagaagggccacgucaccugguccuuccacggccccgagaacgccauccccauccccgaccucuccgagggcaacuccuccgacaucaacuaccagacccgcaagaccgucucccucacccccucccccaccacccaggucgagacccccgaccucgucgaccacgacaacaccuccccccucuuccgcaccccccucuccuucaccaacccccuccacuccgacgacuccgacuccgacgagcgcaacuccgacggcgccgucacccagaacaagaccaacaucuccaccgccuccgccaccgucuccgccgccaccuccaccgaguccaucuccacccgcaagguccuccccauguccaucgcccgccacaacaucgccggcaccacccacuccggcgccgagaaggacgucgacgucuccgaggacuccccccccccccuccccgagcgcacccccgaguccuucguccucgccuccgagcacaacacccccguccgcuccgagugguccgagcuccagucccaggagcgcuccgagcagaagaaguccgagggccucaucaccuccgagaacgagaagugcgaccaccccgccggcggcauccacuacgagaugugcaucgagugcccccccaccuucuccgacaagcgcgagcagaucuccgagaaccccaccgaggccaccgacaucggcuucggcaaccgcugcggcaagcccaagggcccccgcgacccccccuccgaguggaccuga

SEQ ID NO: 48319 - RNA, 7401 nt, Artificial Sequence
  derived and/or modified sequence opt2 from PTPN13__Homo_sapiens__NP_006255
augcacgucucccucgccgaggcccucgagguccgcggcggcccccuccaggaggaggagaucugggccguccucaaccaguccgccgagucccuccaggagcucuuccgcaaggucucccucgccgaccccgccgcccucggcuucaucaucucccccuggucccuccuccuccuccccuccggcuccgucuccuucaccgacgagaacaucuccaaccaggaccuccgcgccuucaccgcccccgagguccuccagaaccagucccucaccucccucuccgacgucgagaagauccacaucuacucccucggcaugacccucuacuggggcgccgacuacgaggucccccagucccagcccaucaagcucggcgaccaccucaacuccauccuccucggcaugugcgaggacgucaucuacgcccgcgucuccguccgcaccguccucgacgccugcuccgcccacauccgcaacuccaacugcgcccccuccuucuccuacgucaagcaccucgucaagcucguccucggcaaccucuccggcaccgaccagcucuccugcaacuccgagcagaagcccgaccgcucccaggccauccgcgaccgccuccgcggcaagggccuccccaccggccgcuccuccaccuccgacguccucgacauccagaagcccccccucucccaccagaccuuccucaacaagggccucuccaaguccaugggcuuccucuccaucaaggacacccaggacgagaacuacuucaaggacauccucuccgacaacuccggccgcgaggacuccgagaacaccuucucccccuaccaguucaagaccuccggccccgagaagaagcccauccccggcaucgacguccucuccaagaagaagaucugggccuccuccauggaccuccucugcaccgccgaccgcgacuucuccuccggcgagaccgccaccuaccgccgcugccaccccgaggccgucaccguccgcaccuccaccaccccccgcaagaaggaggcccgcuacuccgacggcuccaucgcccucgacaucuucggcccccagaagauggaccccaucuaccacacccgcgagcuccccaccuccuccgccaucuccuccgcccucgaccgcauccgcgagcgccagaagaagcuccagguccuccgcgaggccaugaacgucgaggagcccguccgccgcuacaagaccuaccacggcgacgucuucuccaccuccuccgagucccccuccaucaucuccuccgaguccgacuuccgccagguccgccgcuccgaggccuccaagcgcuucgaguccuccuccggccuccccggcgucgacgagacccucucccagggccagucccagcgccccucccgccaguacgagacccccuucgagggcaaccucaucaaccaggagaucaugcucaagcgccaggaggaggagcucaugcagcuccaggccaagauggcccuccgccagucccgccucucccucuaccccggcgacaccaucaaggccuccaugcucgacaucacccgcgacccccuccgcgagaucgcccucgagaccgccaugacccagcgcaagcuccgcaacuucuucggccccgaguucgucaagaugaccaucgagcccuucaucucccucgaccucccccgcuccauccucaccaagaagggcaagaacgaggacaaccgccgcaaggucaacaucaugcuccucaacggccagcgccucgagcucaccugcgacaccaagaccaucugcaaggacgucuucgacauggucgucgcccacaucggccucgucgagcaccaccucuucgcccucgccacccucaaggacaacgaguacuucuucgucgaccccgaccucaagcucaccaaggucgcccccgagggcuggaaggaggagcccaagaagaagaccaaggccaccgucaacuucacccucuucuuccgcaucaaguucuucauggacgacgucucccucauccagcacacccucaccugccaccaguacuaccuccagcuccgcaaggacauccucgaggagcgcaugcacugcgacgacgagaccucccuccuccucgccucccucgcccuccaggccgaguacggcgacuaccagcccgagguccacggcgucuccuacuuccgcauggagcacuaccuccccgcccgcgucauggagaagcucgaccucuccuacaucaaggaggagcuccccaagcuccacaacaccuacgucggcgccuccgagaaggagaccgagcucgaguuccucaaggucugccagcgccucaccgaguacggcguccacuuccaccgcguccaccccgagaagaagucccagaccggcauccuccucggcgucugcuccaagggcguccucgucuucgagguccacaacggcguccgcacccucguccuccgcuuccccuggcgcgagaccaagaagaucuccuucuccaagaagaagaucacccuccagaacaccuccgacggcaucaagcacggcuuccagaccgacaacuccaagaucugccaguaccuccuccaccucugcuccuaccagcacaaguuccagcuccagaugcgcgcccgccaguccaaccaggacgcccaggacaucgagcgcgccuccuuccgcucccucaaccuccaggccgaguccguccgcggcuucaacaugggccgcgccaucuccaccggcucccucgccuccuccacccucaacaagcucgccguccgcccccucuccguccaggccgagauccucaagcgccucuccugcuccgagcucucccucuaccagccccuccagaacuccuccaaggagaagaacgacaaggccuccugggaggagaagccccgcgagauguccaaguccuaccacgaccucucccaggccucccucuacccccaccgcaagaacgucaucgucaacauggagccccccccccagaccgucgccgagcucgucggcaagcccucccaccagaugucccgcuccgacgccgagucccucgccggcgucaccaagcucaacaacuccaaguccgucgccucccucaaccgcucccccgagcgccgcaagcacgaguccgacuccuccuccaucgaggaccccggccaggccuacguccucgacguccuccacaagcgcugguccaucgucuccucccccgagcgcgagaucacccucgucaaccucaagaaggacgccaaguacggccucggcuuccagaucaucggcggcgagaagaugggccgccucgaccucggcaucuucaucuccuccgucgcccccggcggccccgccgaccucgacggcugccucaagcccggcgaccgccucaucuccgucaacuccgucucccucgagggcgucucccaccacgccgccaucgagauccuccagaacgcccccgaggacgucacccucgucaucucccagcccaaggagaagaucuccaagguccccuccacccccguccaccucaccaacgagaugaagaacuacaugaagaaguccuccuacaugcaggacuccgccaucgacuccuccuccaaggaccaccacuggucccgcggcacccuccgccacaucuccgagaacuccuucggccccuccggcggccuccgcgagggcucccucuccucccaggacucccgcaccgaguccgccucccucucccagucccaggucaacggcuucuucgccucccaccucggcgaccagaccuggcaggagucccagcacggcucccccucccccuccgucaucuccaaggccaccgagaaggagaccuucaccgacuccaaccaguccaagaccaagaagcccggcaucuccgacgucaccgacuacuccgaccgcggcgacuccgacauggacgaggccaccuacuccuccucccaggaccaccagacccccaagcaggaguccuccuccuccgucaacaccuccaacaagaugaacuucaagaccuucuccuccuccccccccaagcccggcgacaucuucgaggucgagcucgccaagaacgacaacucccucggcaucuccgucaccggcggcgucaacaccuccguccgccacggcggcaucuacgucaaggccgucaucccccagggcgccgccgaguccgacggccgcauccacaagggcgaccgcguccucgccgucaacggcgucucccucgagggcgccacccacaagcaggccgucgagacccuccgcaacaccggccaggucguccaccuccuccucgagaagggccagucccccaccuccaaggagcacguccccgucaccccccagugcacccucuccgaccagaacgcccagggccagggccccgagaaggucaagaagaccacccaggucaaggacuacuccuucgucaccgaggagaacaccuucgaggucaagcucuucaagaacuccuccggccucggcuucuccuucucccgcgaggacaaccucauccccgagcagaucaacgccuccaucguccgcgucaagaagcucuuccccggccagcccgccgccgaguccggcaagaucgacgucggcgacgucauccucaaggucaacggcgccucccucaagggccucucccagcaggaggucaucuccgcccuccgcggcaccgcccccgaggucuuccuccuccucugccgccccccccccggcguccuccccgagaucgacaccgcccuccucaccccccuccagucccccgcccagguccuccccaacuccuccaaggacuccucccagcccuccugcgucgagcaguccaccuccuccgacgagaacgagauguccgacaaguccaagaagcagugcaagucccccucccgccgcgacuccuacuccgacuccuccggcuccggcgaggacgaccucgucaccgcccccgccaacaucuccaacuccaccugguccuccgcccuccaccagacccucuccaacauggucucccaggcccagucccaccacgaggcccccaagucccaggaggacaccaucugcaccauguucuacuacccccagaagauccccaacaagcccgaguucgaggacuccaaccccuccccccucccccccgacauggcccccggccaguccuaccagccccaguccgaguccgccuccuccuccuccauggacaaguaccacauccaccacaucuccgagcccacccgccaggagaacuggaccccccucaagaacgaccucgagaaccaccucgaggacuucgagcucgaggucgagcuccucaucacccucaucaaguccgagaagggcucccucggcuucaccgucaccaagggcaaccagcgcaucggcugcuacguccacgacgucauccaggaccccgccaaguccgacggccgccucaagcccggcgaccgccucaucaaggucaacgacaccgacgucaccaacaugacccacaccgacgccgucaaccuccuccgcgccgccuccaagaccguccgccucgucaucggccgcguccucgagcucccccgcauccccaugcucccccaccuccuccccgacaucacccucaccugcaacaaggaggagcucggcuucucccucugcggcggccacgacucccucuaccaggucgucuacaucuccgacaucaacccccgcuccgucgccgccaucgagggcaaccuccagcuccucgacgucauccacuacgucaacggcgucuccacccagggcaugacccucgaggaggucaaccgcgcccucgacaugucccuccccucccucguccucaaggccacccgcaacgaccuccccgucguccccuccuccaagcgcuccgccgucuccgcccccaaguccaccaagggcaacggcuccuacuccgucggcuccugcucccagcccgcccucacccccaacgacuccuucuccaccgucgccggcgaggagaucaacgagaucuccuaccccaagggcaagugcuccaccuaccagaucaagggcucccccaaccucacccuccccaaggaguccuacauccaggaggacgacaucuacgacgacucccaggaggccgaggucauccagucccuccucgacgucgucgacgaggaggcccagaaccuccucaacgagaacaacgccgccggcuacuccugcggccccggcacccucaagaugaacggcaagcucuccgaggagcgcaccgaggacaccgacugcgacggcuccccccuccccgaguacuucaccgaggccaccaagaugaacggcugcgaggaguacugcgaggagaaggucaaguccgagucccucauccagaagccccaggagaagaagaccgacgacgacgagaucaccuggggcaacgacgagcuccccaucgagcgcaccaaccacgaggacuccgacaaggaccacuccuuccucaccaacgacgagcucgccguccuccccgucgucaagguccuccccuccggcaaguacaccggcgccaaccucaaguccgucauccgcguccuccgcggccuccucgaccagggcauccccuccaaggagcucgagaaccuccaggagcucaagccccucgaccagugccucaucggccagaccaaggagaaccgccgcaagaaccgcuacaagaacauccuccccuacgacgccacccgcgucccccucggcgacgagggcggcuacaucaacgccuccuucaucaagauccccgucggcaaggaggaguucgucuacaucgccugccagggcccccuccccaccaccgucggcgacuucuggcagaugaucugggagcagaaguccaccgucaucgccaugaugacccaggaggucgagggcgagaagaucaagugccagcgcuacuggcccaacauccucggcaagaccaccauggucuccaaccgccuccgccucgcccucguccgcaugcagcagcucaagggcuucgucguccgcgccaugacccucgaggacauccagacccgcgagguccgccacaucucccaccucaacuucaccgccuggcccgaccacgacacccccucccagcccgacgaccuccucaccuucaucuccuacaugcgccacauccaccgcuccggccccaucaucacccacugcuccgccggcaucggccgcuccggcacccucaucugcaucgacgucguccucggccucaucucccaggaccucgacuucgacaucuccgaccucguccgcugcaugcgccuccagcgccacggcaugguccagaccgaggaccaguacaucuucugcuaccaggucauccucuacguccucacccgccuccaggccgaggaggagcagaagcagcagccccagcuccucaaguga

SEQ ID NO: 48320 - RNA, 3564 nt, Artificial Sequence
  derived and/or modified sequence opt2 from PTPN14__Homo_sapiens__NP_005392
augcccuucggccucaagcuccgccgcacccgccgcuacaacguccucuccaagaacugcuucgucacccgcauccgccuccucgacuccaacgucaucgagugcacccucuccgucgaguccaccggccaggagugccucgaggccgucgcccagcgccucgagcuccgcgagacccacuacuucggccucugguuccucuccaagucccagcaggcccgcugggucgagcucgagaagccccucaagaagcaccucgacaaguucgccaacgagccccuccucuucuucggcgucauguucuacguccccaacgucuccuggcuccagcaggaggccacccgcuaccaguacuaccuccaggucaagaaggacguccucgagggccgccuccgcugcacccucgaccaggucauccgccucgccggccucgccguccaggccgacuucggcgacuacaaccaguucgacucccaggacuuccuccgcgaguacguccucuuccccauggaccucgcccucgaggaggccguccucgaggagcucacccagaaggucgcccaggagcacaaggcccacuccggcauccuccccgccgaggccgagcucauguacaucaacgaggucgagcgccucgacggcuucggccaggagaucuuccccgucaaggacaaccacggcaacugcguccaccucggcaucuucuucaugggcaucuucguccgcaaccgcaucggccgccaggccgucaucuaccgcuggaacgacaugggcaacaucacccacaacaaguccaccauccucgucgagcucaucaacaaggaggagaccgcccucuuccacaccgacgacaucgagaacgccaaguacaucucccgccucuucgccacccgccacaaguucuacaagcagaacaagaucugcaccgagcaguccaacucccccccccccauccgccgccagcccaccuggucccgcuccucccucccccgccagcagcccuacauccucccccccguccacguccagugcggcgagcacuacuccgagacccacaccucccaggacuccaucuuccacggcaacgaggaggcccucuacugcaacucccacaacucccucgaccucaacuaccucaacggcaccgucaccaacggcuccgucugcuccguccacuccgucaacucccucaacugcucccaguccuucauccaggccucccccgucuccuccaaccucuccauccccggcuccgacaucaugcgcgccgacuacauccccucccaccgccacuccgccaucaucguccccuccuaccgccccacccccgacuacgagaccgucaugcgccagaugaagcgcggcauccuccacaccgacucccagucccagucccuccgcaaccucaacaucaucaacacccacgccuacaaccagcccgaggaccucgucuacucccagcccgagaugcgcgagcgccaccccuacaccguccccuacggcccccagggcgucuacuccaacaagcucgucucccccuccgaccagcgcaaccccaagaacaacgucguccccuccaagcccggcgccuccgccaucucccacaccgucuccacccccgagcucgccaacaugcagcuccagggcucccacaacuacuccaccgcccacaugcucaagaacuaccucuuccgcccccccccccccuacccccgcccccgccccgccaccuccacccccgaccucgccucccaccgccacaaguacgucuccggcuccucccccgaccucgucacccgcaagguccagcucuccgucaagaccuuccaggaggacuccucccccgucguccaccagucccuccaggaggucuccgagccccucaccgccaccaagcaccacggcaccgucaacaagcgccacucccucgaggucaugaacuccaugguccgcggcauggaggccaugacccucaagucccuccaccuccccauggcccgccgcaacacccuccgcgagcagggcccccccgaggagggcuccggcucccacgaggucccccagcucccccaguaccaccacaagaagaccuucuccgacgccaccaugcucauccacuccuccgaguccgaggaggaggaggaggaggcccccgaguccgucccccagauccccaugcuccgcgagaagauggaguacuccgcccagcuccaggccgcccucgcccgcauccccaacaagcccccccccgaguaccccggcccccgcaaguccgucuccaacggcgcccuccgccaggaccaggccucccucccccccgccauggcccgcgcccgcguccuccgccacggccccgccaaggccaucuccaugucccgcaccgacccccccgccgucaacggcgccucccucggccccuccaucuccgagcccgaccucaccuccgucaaggagcgcgucaagaaggagcccgucaaggagcgccccgucuccgagauguucucccucgaggacuccaucaucgagcgcgagaugaugauccgcaaccucgagaagcagaagauggccggccucgaggcccagaagcgcccccucaugcucgccgcccucaacggccucuccgucgcccgcgucuccggccgcgaggagaaccgcgucgacgccacccgcguccccauggacgagcgcuuccgcacccucaagaagaagcucgaggagggcauggucuucaccgaguacgagcagauccccaagaagaaggccaacggcaucuucuccaccgccgcccuccccgagaacgccgagcgcucccgcauccgcgaggucguccccuacgaggagaaccgcgucgagcucauccccaccaaggagaacaacaccggcuacaucaacgccucccacaucaaggucgucgucggcggcgccgaguggcacuacaucgccacccagggcccccucccccacaccugccacgacuucuggcagauggucugggagcagggcgucaacgucaucgccauggucaccgccgaggaggagggcggccgcaccaagucccaccgcuacuggcccaagcucggcuccaagcacuccuccgccaccuacggcaaguucaaggucaccaccaaguuccgcaccgacuccgucugcuacgccaccaccggccucaaggucaagcaccuccucuccggccaggagcgcaccgucuggcaccuccaguacaccgacuggcccgaccacggcugccccgaggacguccagggcuuccucuccuaccucgaggagauccaguccguccgccgccacaccaacuccaugcucgagggcaccaagaaccgccacccccccaucgucguccacugcuccgccggcgucggccgcaccggcguccucauccucuccgagcucaugaucuacugccucgagcacaacgagaaggucgagguccccaugaugcuccgccuccuccgcgagcagcgcauguucaugauccagaccaucgcccaguacaaguucgucuaccagguccucauccaguuccuccagaacucccgccucaucuga

SEQ ID NO: 48321 - RNA, 1062 nt, Artificial Sequence
  derived and/or modified sequence opt2 from PTPN18__Homo_sapiens__NP_001135842
augucccgcucccucgacuccgcccgcuccuuccucgagcgccucgaggcccgcggcggccgcgagggcgccguccucgccggcgaguucuccaagcgcugcgagcgcuacugggcccaggagcaggagccccuccagaccggccucuucugcaucacccucaucaaggagaaguggcucaacgaggacaucaugcuccgcacccucaaggucaccuuccagaaggagucccgcuccgucuaccagcuccaguacauguccuggcccgaccgcggcguccccuccucccccgaccacaugcucgccauggucgaggaggcccgccgccuccagggcuccggccccgagccccucugcguccacugcuccgccggcugcggccgcaccggcguccucugcaccgucgacuacguccgccagcuccuccucacccagaugaucccccccgacuucucccucuucgacgucguccucaagaugcgcaagcagcgccccgccgccguccagaccgaggagcaguaccgcuuccucuaccacaccgucgcccagauguucugcuccacccuccagaacgccuccccccacuaccagaacaucaaggagaacugcgccccccucuacgacgacgcccucuuccuccgcaccccccaggcccuccucgccaucccccgcccccccggcggcguccuccgcuccaucuccguccccggcucccccggccacgccauggccgacaccuacgccgucguccagaagcgcggcgcccccgccggcgccggcuccggcacccagaccggcaccggcaccggcaccggcgcccgcuccgccgaggaggccccccucuacuccaaggucaccccccgcgcccagcgccccggcgcccacgccgaggacgcccgcggcacccuccccggccgcguccccgccgaccagucccccgccggcuccggcgccuacgaggacgucgccggcggcgcccagaccggcggccucggcuucaaccuccgcaucggccgccccaagggcccccgcgacccccccgccgaguggacccgcgucuga

SEQ ID NO: 48322 - RNA, 1089 nt, Artificial Sequence
  derived and/or modified sequence opt2 from PTPN1__Homo_sapiens__NP_001265547
auggaggaggcccagcgcuccuacauccucacccagggcccccuccccaacaccugcggccacuucugggagauggucugggagcagaagucccgcggcgucgucaugcucaaccgcgucauggagaagggcucccucaagugcgcccaguacuggccccagaaggaggagaaggagaugaucuucgaggacaccaaccucaagcucacccucaucuccgaggacaucaaguccuacuacaccguccgccagcucgagcucgagaaccucaccacccaggagacccgcgagauccuccacuuccacuacaccaccuggcccgacuucggcguccccgagucccccgccuccuuccucaacuuccucuucaagguccgcgaguccggcucccucucccccgagcacggccccgucgucguccacugcuccgccggcaucggccgcuccggcaccuucugccucgccgacaccugccuccuccucauggacaagcgcaaggaccccuccuccgucgacaucaagaagguccuccucgagaugcgcaaguuccgcaugggccucauccagaccgccgaccagcuccgcuucuccuaccucgccgucaucgagggcgccaaguucaucaugggcgacuccuccguccaggaccaguggaaggagcucucccacgaggaccucgagcccccccccgagcacauccccccccccccccgcccccccaagcgcauccucgagccccacaacggcaagugccgcgaguucuuccccaaccaccagugggucaaggaggagacccaggaggacaaggacugccccaucaaggaggagaagggcuccccccucaacgccgcccccuacggcaucgaguccaugucccaggacaccgagguccgcucccgcgucgucggcggcucccuccgcggcgcccaggccgccucccccgccaagggcgagcccucccuccccgagaaggacgaggaccacgcccucuccuacuggaagcccuuccucgucaacaugugcgucgccaccguccucaccgccggcgccuaccucugcuaccgcuuccucuucaacuccaacaccuga

SEQ ID NO: 48323 - RNA, 3525 nt, Artificial Sequence
  derived and/or modified sequence opt2 from PTPN21__Homo_sapiens__XP_011534669
augccccuccccuucggccucaagcucaagcgcacccgccgcuacaccgucuccuccaaguccugccucgucgcccgcauccagcuccucaacaacgaguucgucgaguucacccucuccgucgaguccaccggccaggagucccucgaggccgucgcccagcgccucgagcuccgcgaggucaccuacuucucccucugguacuacaacaagcagaaccagcgccgcugggucgaccucgagaagccccucaagaagcagcucgacaaguacgcccucgagcccaccgucuacuucggcgucgucuucuacguccccuccgucucccagcuccagcaggagaucacccgcuaccaguacuaccuccagcucaagaaggacauccucgagggcuccauccccugcacccucgagcaggccauccagcucgccggccucgccguccaggccgacuucggcgacuucgaccaguacgagucccaggacuuccuccagaaguucgcccucuuccccgucggcuggcuccaggacgagaagguccucgaggaggccacccagaaggucgcccuccuccaccagaaguaccgcggccucaccgcccccgacgccgagaugcucuacaugcaggaggucgagcgcauggacggcuacggcgaggaguccuaccccgccaaggacucccagggcuccgacaucuccaucggcgccugccucgagggcaucuucgucaagcacaagaacggccgccaccccgucgucuuccgcuggcacgacaucgccaacaugucccacaacaaguccuucuucgcccucgagcucgccaacaaggaggagaccauccaguuccagaccgaggacauggagaccgccaaguacaucuggcgccucugcgucgcccgccacaaguucuaccgccucaaccagugcaaccuccagacccagaccgucaccgucaaccccauccgccgccgcuccuccucccgcaugucccuccccaagccccagcccuacgucaugcccccccccccccagcuccacuacaacggccacuacaccgagcccuacgccuccucccaggacaaccucuucguccccaaccagaacggcuacuacugccacucccagaccucccucgaccgcgcccagaucgaccucaacggccgcauccgcaacggcuccgucuacuccgcccacuccaccaacucccucaacaacccccagcccuaccuccagcccucccccauguccuccaaccccuccaucaccggcuccgacgucaugcgccccgacuaccuccccucccaccgccacuccgccgucaucccccccuccuaccgccccacccccgacuacgagaccgucaugaagcagcucaaccgcggccucguccacgccgagcgccagucccacucccuccgcaaccucaacaucggcuccuccuacgccuacucccgccccgccgcccucgucuacucccagcccgagauccgcgagcacgcccagcuccccucccccgccgccgcccacugccccuucucccucuccuacuccuuccacucccccucccccuaccccuaccccgccgagcgccgccccgucgucggcgccgucuccguccccgagcucaccaacgcccagcuccaggcccaggacuaccccucccccaacaucaugcgcacccaggucuaccgcccccccccccccuacccccccccccgccccgccaacuccacccccgaccucucccgccaccucuacaucuccuccuccaaccccgaccucaucacccgccgcguccaccacuccguccagaccuuccaggaggacucccuccccgucgcccacucccuccaggaggucuccgagccccucaccgccgcccgccacgcccagcuccacaagcgcaacuccaucgaggucgccggccucucccacggccucgagggccuccgccucaaggagcgcacccucuccgccuccgccgccgaggucgccccccgcgccgucuccgucggcucccagcccuccgucuucaccgagcgcacccagcgcgagggccccgaggaggccgagggccuccgcuacggccacaagaagucccucuccgacgccaccaugcucauccacuccuccgaggaggaggaggacgaggacuucgaggaggaguccggcgcccgcgccccccccgcccgcgcccgcgagccccgccccggccucgcccaggacccccccggcugcccccgcguccuccucgccggcccccuccacauccucgagcccaaggcccacguccccgacgccgagaagcgcaugauggacuccucccccguccgcaccaccgccgaggcccagcgccccuggcgcgacggccuccucaugcccuccauguccgaguccgaccucaccaccuccggccgcuaccgcgcccgccgcgacucccucaagaagcgccccgucuccgaccuccucuccggcaagaagaacaucgucgagggccuccccccccucggcggcaugaagaagacccgcgucgacgccaagaagaucggcccccucaagcucgccgcccucaacggccucucccucucccgcgucccccuccccgacgagggcaaggaggucgccacccgcgccaccaacgacgagcgcugcaagauccucgagcagcgccucgagcagggcauggucuucaccgaguacgagcgcauccucaagaagcgccucgucgacggcgagugcuccaccgcccgccuccccgagaacgccgagcgcaaccgcuuccaggacguccuccccuacgacgacguccgcgucgagcucguccccaccaaggagaacaacaccggcuacaucaacgccucccacaucaaggucuccgucuccggcaucgagugggacuacaucgccacccagggcccccuccagaacaccugccaggacuucuggcagauggucugggagcagggcaucgccaucaucgccauggucaccgccgaggaggagggcggccgcgagaaguccuuccgcuacuggccccgccucggcucccgccacaacaccgucaccuacggccgcuucaagaucaccacccgcuuccgcaccgacuccggcugcuacgccaccaccggccucaagaugaagcaccuccucaccggccaggagcgcaccgucuggcaccuccaguacaccgacuggcccgagcacggcugccccgaggaccucaagggcuuccucuccuaccucgaggagauccaguccguccgccgccacaccaacuccaccuccgacccccagucccccaaccccccccuccucguccacugcuccgccggcgucggccgcaccggcgucgucauccucuccgagaucaugaucgccugccucgagcacaacgagguccucgacaucccccgcguccucgacaugcuccgccagcagcgcaugaugcucguccagacccucugccaguacaccuucgucuaccgcguccucauccaguuccucaaguccucccgccucaucuga

SEQ ID NO: 48324 - RNA, 1980 nt, Artificial Sequence
  derived and/or modified sequence opt2 from PTPN22__Homo_sapiens__XP_011539526
augcagcucgaguucggccccuucuccgucuccugcgaggccgagaagcgcaaguccgacuacaucauccgcacccucaaggucaaguucaacuccgagacccgcaccaucuaccaguuccacuacaagaacuggcccgaccacgacguccccuccuccaucgaccccauccucgagcucaucugggacguccgcugcuaccaggaggacgacuccguccccaucugcauccacugcuccgccggcugcggccgcaccggcgucaucugcgccaucgacuacaccuggaugcuccucaaggacggcaucauccccgagaacuucuccgucuucucccucauccgcgagaugcgcacccagcgccccucccucguccagacccaggagcaguacgagcucgucuacaacgccguccucgagcucuucaagcgccagauggacgucauccgcgacaagcacuccggcaccgagucccaggccaagcacugcauccccgagaagaaccacacccuccaggccgacuccuacucccccaaccuccccaaguccaccaccaaggccgccaagaugaugaaccagcagcgcaccaagauggagaucaaggaguccuccuccuucgacuuccgcaccuccgagaucuccgccaaggaggagcucguccuccaccccgccaaguccuccaccuccuucgacuuccucgagcucaacuacuccuucgacaagaacgccgacaccaccaugaaguggcagaccaaggccuuccccaucgucggcgagccccuccagaagcaccagucccucgaccucggcucccuccucuucgagggcugcuccaacuccaagcccgucaacgccgccggccgcuacuucaacuccaagguccccaucacccgcaccaaguccacccccuucgagcucauccagcagcgcgagaccaaggaggucgacuccaaggagaacuucuccuaccucgagucccagccccacgacuccugcuucgucgagaugcaggcccagaaggucaugcacgucuccuccgccgagcucaacuacucccuccccuacgacuccaagcaccagauccgcaacgccuccaacgucaagcaccacgacuccuccgcccucggcgucuacuccuacaucccccucgucgagaaccccuacuucuccuccuggccccccuccggcaccuccuccaagaugucccucgaccuccccgagaagcaggacggcaccgucuuccccuccucccuccuccccaccuccuccaccucccucuucuccuacuacaacucccacgacucccucucccucaacucccccaccaacaucuccucccuccucaaccaggaguccgccguccucgccaccgccccccgcaucgacgacgagaucccccccccccuccccgucuggacccccgaguccuucaucgucgucgaggaggccggcgaguucucccccaacguccccaagucccucuccuccgccgucaaggucaagaucggcaccucccucgaguggggcggcaccuccgagcccaagaaguucgacgacuccgucauccuccgccccuccaaguccgucaagcuccgcucccccaaguccgagcuccaccaggaccgcuccucccccccccccccccuccccgagcgcacccucgaguccuucuuccucgccgacgaggacugcaugcaggcccaguccaucgagaccuacuccaccuccuaccccgacaccauggagaacuccaccuccuccaagcagacccucaagacccccggcaaguccuucacccgcuccaagucccucaagauccuccgcaacaugaagaaguccaucugcaacuccugcccccccaacaagcccgccgaguccguccaguccaacaacuccuccuccuuccucaacuucggcuucgccaaccgcuucuccaagcccaagggcccccgcaaccccccccccaccuggaacaucuga

SEQ ID NO: 48325 - RNA, 4533 nt, Artificial Sequence
  derived and/or modified sequence opt2 from PTPN23__Homo_sapiens__NP_001291411
augcucggcgccauggacaagcgcgucuccgaggagggcaugaaggucuccugcacccacuuccagugcgccgccggcgccuucgccuaccuccgcgagcacuucccccaggccuacuccgucgacaugucccgccagauccucacccucaacgucaaccucaugcucggccaggcccaggagugccuccucgagaaguccaugcucgacaaccgcaaguccuuccucgucgcccgcaucuccgcccaggucgucgacuacuacaaggaggccugccgcgcccucgagaaccccgacaccgccucccuccucggccgcauccagaaggacuggaagaagcucguccagaugaagaucuacuacuucgccgccgucgcccaccuccacaugggcaagcaggccgaggagcagcagaaguucggcgagcgcgucgccuacuuccaguccgcccucgacaagcucaacgaggccaucaagcucgccaagggccagcccgacaccguccaggacgcccuccgcuucaccauggacgucaucggcggcaaguacaacuccgccaagaaggacaacgacuucaucuaccacgaggccguccccgcccucgacacccuccagcccgucaagggcgccccccucgucaagccccuccccgucaaccccaccgaccccgccgucaccggccccgacaucuucgccaagcucguccccauggccgcccacgaggccuccucccucuacuccgaggagaaggccaagcuccuccgcgagaugauggccaagaucgaggacaagaacgagguccucgaccaguucauggacuccaugcagcucgaccccgagaccgucgacaaccucgacgccuacucccacauccccccccagcucauggagaagugcgccgcccucuccguccgccccgacaccguccgcaaccucguccaguccaugcagguccucuccggcgucuucaccgacgucgaggccucccucaaggacauccgcgaccuccucgaggaggacgagcuccucgagcagaaguuccaggaggccgucggccaggccggcgccaucuccaucaccuccaaggccgagcucgccgagguccgccgcgagugggccaaguacauggagguccacgagaaggccuccuucaccaacuccgagcuccaccgcgccaugaaccuccacgucggcaaccuccgccuccucuccggcccccucgaccagguccgcgccgcccuccccacccccgcccucucccccgaggacaaggccguccuccagaaccucaagcgcauccucgccaagguccaggagaugcgcgaccagcgcgucucccucgagcagcagcuccgcgagcucauccagaaggacgacaucaccgccucccucgucaccaccgaccacuccgagaugaagaagcucuucgaggagcagcucaagaaguacgaccagcucaaggucuaccucgagcagaaccucgccgcccaggaccgcguccucugcgcccucaccgaggccaacguccaguacgccgccguccgccgcguccucuccgaccucgaccagaaguggaacuccacccuccagacccucgucgccuccuacgaggccuacgaggaccucaugaagaagucccaggagggccgcgacuucuacgccgaccucgaguccaaggucgccgcccuccucgagcgcacccaguccaccugccaggcccgcgaggccgcccgccagcagcuccucgaccgcgagcucaagaagaagccccccccccgccccaccgcccccaagccccuccucccccgccgcgaggaguccgaggccgucgaggccggcgacccccccgaggagcuccgcucccucccccccgacauggucgccggcccccgccuccccgacaccuuccucggcuccgccaccccccuccacuucccccccucccccuuccccuccuccaccggccccggcccccacuaccucuccggcccccucccccccggcaccuacuccggccccacccagcucauccagccccgcgcccccggcccccacgccaugcccgucgcccccggccccgcccucuaccccgcccccgccuacacccccgagcucggccucgucccccgcuccuccccccagcacggcgucgucuccucccccuacgucggcgucggccccgccccccccgucgccggccuccccuccgccccccccccccaguucuccggccccgagcucgccauggccguccgccccgccaccaccaccgucgacuccauccaggcccccauccccucccacaccgccccccgccccaaccccacccccgccccccccccccccugcuuccccgucccccccccccagccccuccccacccccuacaccuaccccgccggcgccaagcagcccauccccgcccagcaccacuucuccuccggcauccccgccggcuuccccgccccccgcaucggcccccagccccagccccacccccagccccaccccucccaggccuucggcccccagcccccccagcagccccucccccuccagcacccccaccucuuccccccccaggcccccggccuccuccccccccagucccccuaccccuacgccccccagcccggcguccucggccagcccccccccccccuccacacccagcucuaccccggccccgcccaggacccccuccccgcccacuccggcgcccuccccuuccccucccccggccccccccagcccccccaccccccccucgccuacggccccgcccccuccacccgccccaugggcccccaggccgccccccucaccauccgcggccccuccuccgccggccaguccacccccuccccccaccucguccccucccccgcccccucccccggccccggccccguccccccccgcccccccgccgccgagcccccccccugccuccgccgcggcgccgccgccgccgaccuccucuccuccucccccgagucccagcacggcggcacccagucccccggcggcggccagccccuccuccagcccaccaaggucgacgccgccgagggccgccgcccccaggcccuccgccucaucgagcgcgaccccuacgagcaccccgagcgccuccgccagcuccagcaggagcucgaggccuuccgcggccagcucggcgacgucggcgcccucgacaccgucuggcgcgagcuccaggacgcccaggagcacgacgcccgcggccgcuccaucgccaucgcccgcugcuacucccucaagaaccgccaccaggacgucaugcccuacgacuccaaccgcgucguccuccgcuccggcaaggacgacuacaucaacgccuccugcgucgagggccucucccccuacugccccccccucgucgccacccaggccccccuccccggcaccgccgccgacuucuggcucaugguccacgagcagaaggucuccgucaucgucaugcucgucuccgaggccgagauggagaagcagaaggucgcccgcuacuuccccaccgagcgcggccagcccaugguccacggcgcccucucccucgcccucuccuccguccgcuccaccgagacccacgucgagcgcguccucucccuccaguuccgcgaccagucccucaagcgcucccucguccaccuccacuuccccaccuggcccgagcucggccuccccgacucccccuccaaccuccuccgcuucauccaggagguccacgcccacuaccuccaccagcgcccccuccacacccccaucaucguccacugcuccuccggcgucggccgcaccggcgccuucgcccuccucuacgccgccguccaggaggucgaggccggcaacggcauccccgagcucccccagcucguccgccgcaugcgccagcagcgcaagcacaugcuccaggagaagcuccaccuccgcuucugcuacgaggccgucguccgccacgucgagcagguccuccagcgccacggcguccccccccccugcaagccccucgccuccgccuccaucucccagaagaaccaccucccccaggacucccaggaccucguccucggcggcgacguccccaucuccuccauccaggccaccaucgccaagcucuccauccgcccccccggcggccucgagucccccgucgccucccuccccggccccgccgagccccccggccucccccccgccucccuccccgaguccacccccauccccuccuccuccccccccccccucuccuccccccuccccgaggccccccagcccaaggaggagccccccguccccgaggcccccuccuccggcccccccuccuccucccucgagcuccucgccucccucacccccgaggccuucucccucgacuccucccuccgcggcaagcagcgcauguccaagcacaacuuccuccaggcccacaacggccagggccuccgcgccacccgccccuccgacgacccccucucccuccucgacccccucuggacccucaacaagaccuga

SEQ ID NO: 48326 - RNA, 1233 nt, Artificial Sequence
  derived and/or modified sequence opt2 from PTPN2__Homo_sapiens__NP_001193942
augcccaccaccaucgagcgcgaguucgaggagcucgacacccagcgccgcuggcagccccucuaccucgagauccgcaacgagucccacgacuacccccaccgcgucgccaaguuccccgagaaccgcaaccgcaaccgcuaccgcgacgucucccccuacgaccacucccgcgucaagcuccagaacgccgagaacgacuacaucaacgccucccucgucgacaucgaggaggcccagcgcuccuacauccucacccagggcccccuccccaacaccugcugccacuucuggcucauggucuggcagcagaagaccaaggccgucgucaugcucaaccgcaucgucgagaaggaguccgucaagugcgcccaguacuggcccaccgacgaccaggagaugcucuucaaggagaccggcuucuccgucaagcuccucuccgaggacgucaaguccuacuacaccguccaccuccuccagcucgagaacaucaacuacaucgagaaccucuggaucacccucuaccucaagcuccucaugcucgacgucaagcgcucccucaaguccggcgagacccgcaccaucucccacuuccacuacaccaccuggcccgacuucggcguccccgagucccccgccuccuuccucaacuuccucuucaagguccgcgaguccggcucccucaaccccgaccacggccccgccgucauccacugcuccgccggcaucggccgcuccggcaccuucucccucgucgacaccugccucguccucauggagaagggcgacgacaucaacaucaagcagguccuccucaacaugcgcaaguaccgcaugggccucauccagacccccgaccagcuccgcuucuccuacauggccaucaucgagggcgccaagugcaucaagggcgacuccuccauccagaagcgcuggaaggagcucuccaaggaggaccucucccccgccuucgaccacucccccaacaagaucaugaccgagaaguacaacggcaaccgcaucggccucgaggaggagaagcucaccggcgaccgcugcaccggccucuccuccaagaugcaggacaccauggaggagaacuccgaguccgcccuccgcaagcgcauccgcgaggaccgcaaggccaccaccgcccagaagguccagcagaugaagcagcgccucaacgagaacgagcgcaagcgcaagcgcccccgccucaccgacaccuga

SEQ ID NO: 48327 - RNA, 2607 nt, Artificial Sequence
  derived and/or modified sequence opt2 from PTPN3__Homo_sapiens__NP_001138840
augaccucccgccuccgcgcccucggcggccgcaucaacaacauccgcaccuccgagcuccccaaggagaagacccgcuccgaggucaucugcuccauccacuuccucgacggcgucguccagaccuucaaggucaccaagcaggacaccggccagguccuccucgacaugguccacaaccaccucggcgucaccgagaaggaguacuucggccuccagcacgacgacgacuccgucgacuccccccgcuggcucgaggccuccaaggccauccgcaagcagcucaagggcggcuuccccugcacccuccacuuccgcguccgcuucuucauccccgaccccaacacccuccagcaggagcagacccgccaccucuacuuccuccagcucaagauggacaucugcgagggccgccucaccugcccccucaacuccgccgucguccucgccuccuacgccguccagucccacuucggcgacuacaacuccuccauccaccaccccggcuaccucuccgacucccacuucauccccgaccagaacgaggacuuccucaccaaggucgagucccuccacgagcagcacuccggccucaagcaguccgaggccgaguccugcuacaucaacaucgcccgcacccucgacuucuacggcgucgagcuccacuccggccgcgaccuccacaaccucgaccucaugaucggcaucgccuccgccggcgucgccgucuaccgcaaguacaucugcaccuccuucuaccccugggucaacauccucaagaucuccuucaagcgcaagaaguucuucauccaccagcgccagaagcaggccgagucccgcgagcacaucgucgccuucaacaugcucaacuaccgcuccugcaagaaccucuggaaguccugcgucgagcaccacaccuucuuccaggccaagaagcuccucccccaggagaagaacguccucucccaguacuggaccaugggcucccgcaacaccaagaagcgcuccccccgccuccgccacgagauccgcaagccccgccacuccuccgccgacaaccucgccaacgagaugaccuacaucaccgagaccgaggacgucuucuacaccuacaagggcucccucgccccccaggacuccgacuccgaggucucccagaaccgcuccccccaccaggagucccucuccgagaacaaccccgcccaguccuaccucacccagaaguccuccuccuccgucucccccuccuccaacgcccccggcuccugcucccccgacggcgucgaccagcagcuccucgacgacuuccaccgcgucaccaagggcggcuccaccgaggacgccucccaguacuacugcgacaagaacgacaacggcgacuccuaccucguccucauccgcaucacccccgacgaggacggcaaguucggcuucaaccucaagggcggcgucgaccagaagaugccccucgucgucucccgcaucaaccccgagucccccgccgacaccugcauccccaagcucaacgagggcgaccagaucguccucaucaacggccgcgacaucuccgagcacacccacgaccaggucgucauguucaucaaggccucccgcgagucccacucccgcgagcucgcccucgucauccgccgccgcgccguccgcuccuucgccgacuucaaguccgaggacgagcucaaccagcucuuccccgaggccaucuuccccaugugccccgagggcggcgacacccucgagggcuccauggcccagcucaagaagggccucgaguccggcaccguccucauccaguucgagcagcucuaccgcaagaagcccggccucgccaucaccuucgccaagcucccccagaaccucgacaagaaccgcuacaaggacguccuccccuacgacaccacccgcguccuccuccagggcaacgaggacuacaucaacgccuccuacgucaacauggagauccccgccgccaaccucgucaacaaguacaucgccacccagggcccccucccccacaccugcgcccaguucuggcaggucgucugggaccagaagcucucccucaucgucaugcucaccacccucaccgagcgcggccgcaccaagugccaccaguacuggcccgacccccccgacgucaugaaccacggcggcuuccacauccagugccaguccgaggacugcaccaucgccuacgucucccgcgagaugcucgucaccaacacccagaccggcgaggagcacaccgucacccaccuccaguacgucgccuggcccgaccacggcguccccgacgacuccuccgacuuccucgaguucgucaacuacguccgcucccuccgcgucgacuccgagcccguccucguccacugcuccgccggcaucggccgcaccggcguccucgucaccauggagaccgccaugugccucaccgagcgcaaccuccccaucuacccccucgacaucguccgcaagaugcgcgaccagcgcgccaugaugguccagaccuccucccaguacaaguucgucugcgaggccauccuccgcgucuacgaggagggccucguccagaugcucgaccccuccuga

SEQ ID NO: 48328 - RNA, 2781 nt, Artificial Sequence
  derived and/or modified sequence opt2 from PTPN4__Homo_sapiens__NP_002821
augaccucccgcuuccgccuccccgccggccgcaccuacaacguccgcgccuccgagcucgcccgcgaccgccagcacaccgaggucgucugcaacauccuccuccucgacaacaccguccaggccuucaaggucaacaagcacgaccagggccagguccuccucgacgucgucuucaagcaccucgaccucaccgagcaggacuacuucggccuccagcucgccgacgacuccaccgacaacccccgcuggcucgaccccaacaagcccauccgcaagcagcucaagcgcggcucccccuacucccucaacuuccgcgucaaguucuucgucuccgaccccaacaagcuccaggaggaguacacccgcuaccaguacuuccuccagaucaagcaggacauccucaccggccgccuccccugccccuccaacaccgccgcccuccucgccuccuucgccguccaguccgagcucggcgacuacgaccaguccgagaaccucuccggcuaccucuccgacuacuccuucauccccaaccagccccaggacuucgagaaggagaucgccaagcuccaccagcagcacaucggccucucccccgccgaggccgaguucaacuaccucaacaccgcccgcacccucgagcucuacggcgucgaguuccacuacgcccgcgaccaguccaacaacgagaucaugaucggcgucauguccggcggcauccucaucuacaagaaccgcguccgcaugaacaccuuccccuggcucaagaucgucaagaucuccuucaagugcaagcaguucuucauccagcuccgcaaggagcuccacgagucccgcgagacccuccucggcuucaacauggucaacuaccgcgccugcaagaaccucuggaaggccugcgucgagcaccacaccuucuuccgccucgaccgcccccuccccccccagaagaacuucuucgcccacuacuucacccucggcuccaaguuccgcuacugcggccgcaccgagguccaguccguccaguacggcaaggagaaggccaacaaggaccgcgucuucgcccgcucccccuccaagccccucgcccgcaagcucauggacugggaggucgucucccgcaacuccaucuccgacgaccgccucgagacccagucccuccccucccgcuccccccccggcacccccaaccaccgcaacuccaccuucacccaggagggcacccgccuccgccccuccuccgucggccaccucgucgaccacaugguccacaccucccccuccgaggucuucgucaaccagcgcucccccuccuccacccaggccaacuccaucguccucgaguccucccccucccaggagacccccggcgacggcaagccccccgcccucccccccaagcaguccaagaagaacuccuggaaccagauccacuacucccacucccagcaggaccucgagucccacaucaacgagaccuucgacauccccuccucccccgagaagcccacccccaacggcggcaucccccacgacaaccucguccucauccgcaugaagcccgacgagaacggccgcuucggcuucaacgucaagggcggcuacgaccagaagaugcccgucaucgucucccgcgucgcccccggcacccccgccgaccucugcgucccccgccucaacgagggcgaccaggucguccucaucaacggccgcgacaucgccgagcacacccacgaccaggucguccucuucaucaaggccuccugcgagcgccacuccggcgagcucaugcuccucguccgccccaacgccgucuacgacgucgucgaggagaagcucgagaacgagcccgacuuccaguacauccccgagaaggccccccucgacuccguccaccaggacgaccacucccuccgcgaguccaugauccagcucgccgagggccucaucaccggcaccguccucacccaguucgaccagcucuaccgcaagaagcccggcaugaccauguccugcgccaagcucccccagaacaucuccaagaaccgcuaccgcgacaucucccccuacgacgccacccgcgucauccucaagggcaacgaggacuacaucaacgccaacuacaucaacauggagauccccuccuccuccaucaucaaccaguacaucgccugccagggcccccucccccacaccugcaccgacuucuggcagaugaccugggagcagggcuccuccauggucgucaugcucaccacccaggucgagcgcggccgcgucaagugccaccaguacuggcccgagcccaccggcuccuccuccuacggcugcuaccaggucaccugccacuccgaggagggcaacaccgccuacaucuuccgcaagaugacccucuucaaccaggagaagaacgagucccgcccccucacccagauccaguacaucgccuggcccgaccacggcguccccgacgacuccuccgacuuccucgacuucgucugccacguccgcaacaagcgcgccggcaaggaggagcccgucgucguccacugcuccgccggcaucggccgcaccggcguccucaucaccauggagaccgccaugugccucaucgagugcaaccagcccgucuacccccucgacaucguccgcaccaugcgcgaccagcgcgccaugaugauccagacccccucccaguaccgcuucgucugcgaggccauccucaaggucuacgaggagggcuucgucaagccccucaccaccuccaccaacaaguga

SEQ ID NO: 48329 - RNA, 1602 nt, Artificial Sequence
  derived and/or modified sequence opt2 from PTPN5__Homo_sapiens__NP_001265165
augaacuacgagggcgcccgcuccgagcgcgagaaccacgccgccgacgacuccgagggcggcgcccucgacaugugcugcuccgagcgccuccccggccucccccagcccaucgucauggaggcccucgacgaggccgagggccuccaggacucccagcgcgagaugccccccccccccccccccuccccccccuccgaccccgcccagaagccccccccccgcggcgccggcucccacucccucaccguccgcuccucccucugccucuucgccgccucccaguuccuccucgagcccaccgccuggcucgacuccggcaccuggggcguccccucccuccuccucgucuuccucuccgucggccucguccucgucaccacccucgucuggcaccuccuccgcaccccccccgagccccccaccccccucccccccgaggaccgccgccaguccgucucccgccagcccuccuucaccuacuccgaguggauggaggagaagaucgaggacgacuuccucgaccucgaccccguccccgagacccccgucuucgacugcgucauggacaucaagcccgaggccgaccccaccucccucaccgucaaguccaugggccuccaggagcgccgcggcuccaacgucucccucacccucgacaugugcacccccggcugcaacgaggagggcuucggcuaccucauguccccccgcgaggaguccgcccgcgaguaccuccucuccgccucccgcguccuccaggccgaggagcuccacgagaaggcccucgaccccuuccuccuccaggccgaguucuucgagauccccaugaacuucgucgaccccaaggaguacgacauccccggccucguccgcaagaaccgcuacaagaccauccuccccaacccccacucccgcgucugccucaccucccccgaccccgacgacccccucuccuccuacaucaacgccaacuacauccgcggcuacggcggcgaggagaaggucuacaucgccacccagggccccaucgucuccaccgucgccgacuucuggcgcauggucuggcaggagcacacccccaucaucgucaugaucaccaacaucgaggagaugaacgagaagugcaccgaguacuggcccgaggagcaggucgccuacgacggcgucgagaucaccguccagaaggucauccacaccgaggacuaccgccuccgccucaucucccucaaguccggcaccgaggagcgcggccucaagcacuacugguucaccuccuggcccgaccagaagacccccgaccgcgcccccccccuccuccaccucguccgcgaggucgaggaggccgcccagcaggagggcccccacugcgcccccaucaucguccacugcuccgccggcaucggccgcaccggcugcuucaucgccaccuccaucugcugccagcagcuccgccaggagggcgucgucgacauccucaagaccaccugccagcuccgccaggaccgcggcggcaugauccagaccugcgagcaguaccaguucguccaccacgucaugucccucuacgagaagcagcucucccaccagucccccgaguga

SEQ ID NO: 48330 - RNA, 1788 nt, Artificial Sequence
  derived and/or modified sequence opt2 from PTPN6__Homo_sapiens__NP_002822
augguccgcugguuccaccgcgaccucuccggccucgacgccgagacccuccucaagggccgcggcguccacggcuccuuccucgcccgccccucccgcaagaaccagggcgacuucucccucuccguccgcgucggcgaccaggucacccacauccgcauccagaacuccggcgacuucuacgaccucuacggcggcgagaaguucgccacccucaccgagcucgucgaguacuacacccagcagcagggcguccuccaggaccgcgacggcaccaucauccaccucaaguacccccucaacugcuccgaccccaccuccgagcgcugguaccacggccacauguccggcggccaggccgagacccuccuccaggccaagggcgagcccuggaccuuccucguccgcgagucccucucccagcccggcgacuucguccucuccguccucuccgaccagcccaaggccggccccggcuccccccuccgcgucacccacaucaaggucaugugcgagggcggccgcuacaccgucggcggccucgagaccuucgacucccucaccgaccucgucgagcacuucaagaagaccggcaucgaggaggccuccggcgccuucgucuaccuccgccagcccuacuacgccacccgcgucaacgccgccgacaucgagaaccgcguccucgagcucaacaagaagcaggaguccgaggacaccgccaaggccggcuucugggaggaguucgagucccuccagaagcaggaggucaagaaccuccaccagcgccucgagggccagcgccccgagaacaagggcaagaaccgcuacaagaacauccuccccuucgaccacucccgcgucauccuccagggccgcgacuccaacauccccggcuccgacuacaucaacgccaacuacaucaagaaccagcuccucggccccgacgagaacgccaagaccuacaucgccucccagggcugccucgaggccaccgucaacgacuucuggcagauggccuggcaggagaacucccgcgucaucgucaugaccacccgcgaggucgagaagggccgcaacaagugcguccccuacuggcccgaggucggcaugcagcgcgccuacggccccuacuccgucaccaacugcggcgagcacgacaccaccgaguacaagcuccgcacccuccaggucuccccccucgacaacggcgaccucauccgcgagaucuggcacuaccaguaccucuccuggcccgaccacggcguccccuccgagcccggcggcguccucuccuuccucgaccagaucaaccagcgccaggagucccucccccacgccggccccaucaucguccacugcuccgccggcaucggccgcaccggcaccaucaucgucaucgacaugcucauggagaacaucuccaccaagggccucgacugcgacaucgacauccagaagaccauccagaugguccgcgcccagcgcuccggcaugguccagaccgaggcccaguacaaguucaucuacgucgccaucgcccaguucaucgagaccaccaagaagaagcucgagguccuccagucccagaagggccaggaguccgaguacggcaacaucaccuacccccccgccaugaagaacgcccacgccaaggccucccgcaccuccuccaagcacaaggaggacgucuacgagaaccuccacaccaagaacaagcgcgaggagaaggucaagaagcagcgcuccgccgacaaggagaaguccaagggcucccucaagcgcaaguga

SEQ ID NO: 48331 - RNA, 1305 nt, Artificial Sequence
  derived and/or modified sequence opt2 from PTPN7__Homo_sapiens__NP_001186726
augaaccgccucggcugcuggcccgcccgcucccucccccgcuccggccgcggcuccggccagcgcucccucggccucggcggccaccccuccggcccccgccaccccggcacccccgccgccaagcgcaccugggagucccccggcguccgcgcccgcgacugcccccucuccaccuccuggcucuccgagcccccccucggccccgccccccaccucuccaugguccaggcccacggcggccgcucccgcgcccagccccucacccucucccucggcgccgccaugacccagcccccccccgagaagacccccgccaagaagcacguccgccuccaggagcgccgcggcuccaacgucgcccucaugcucgacguccgcucccucggcgccgucgagcccaucugcuccgucaacaccccccgcgaggucacccuccacuuccuccgcaccgccggccacccccucacccgcugggcccuccagcgccagccccccucccccaagcagcucgaggaggaguuccucaagauccccuccaacuucgucucccccgaggaccucgacauccccggccacgccuccaaggaccgcuacaagaccauccuccccaacccccagucccgcgucugccucggccgcgcccagucccaggaggacggcgacuacaucaacgccaacuacauccgcggcuacgacggcaaggagaaggucuacaucgccacccagggccccaugcccaacaccgucuccgacuucugggagauggucuggcaggaggaggucucccucaucgucaugcucacccagcuccgcgagggcaaggagaagugcguccacuacuggcccaccgaggaggagaccuacggccccuuccagauccgcauccaggacaugaaggagugccccgaguacaccguccgccagcucaccauccaguaccaggaggagcgccgcuccgucaagcacauccucuucuccgccuggcccgaccaccagacccccgaguccgccggcccccuccuccgccucgucgccgaggucgaggagucccccgagaccgccgcccaccccggccccaucgucguccacugcuccgccggcaucggccgcaccggcugcuucaucgccacccgcaucggcugccagcagcucaaggcccgcggcgaggucgacauccucggcaucgucugccagcuccgccucgaccgcggcggcaugauccagaccgccgagcaguaccaguuccuccaccacacccucgcccucuacgccggccagcuccccgaggagcccucccccuga

SEQ ID NO: 48332 - RNA, 1782 nt, Artificial Sequence
  derived and/or modified sequence opt2 from PTPN9__Homo_sapiens__NP_002824
auggagcccgccaccgccccccgccccgacauggcccccgagcucacccccgaggaggagcaggccaccaagcaguuccucgaggagaucaacaaguggaccguccaguacaacgucuccccccucuccuggaacgucgccgucaaguuccucauggcccgcaaguucgacguccuccgcgccaucgagcucuuccacuccuaccgcgagacccgccgcaaggagggcaucgucaagcucaagccccacgaggagccccuccgcuccgagauccucuccggcaaguucaccauccucaacguccgcgaccccaccggcgccuccaucgcccucuucaccgcccgccuccaccacccccacaaguccguccagcacgucguccuccaggcccucuucuaccuccucgaccgcgccgucgacuccuucgagacccagcgcaacggccucgucuucaucuacgacaugugcggcuccaacuacgccaacuucgagcucgaccucggcaagaagguccucaaccuccucaagggcgccuuccccgcccgccucaagaagguccucaucgucggcgcccccaucugguuccgcguccccuacuccaucaucucccuccuccucaaggacaagguccgcgagcgcauccagauccucaagaccuccgaggucacccagcaccucccccgcgagugccuccccgagaaccucggcggcuacgucaagaucgaccucgccaccuggaacuuccaguuccucccccaggucaacggccaccccgaccccuucgacgagaucauccucuucucccucccccccgcccucgacugggacuccguccacguccccggcccccacgccaugaccauccaggagcucgucgacuacgucaacgcccgccagaagcagggcaucuacgaggaguacgaggacauccgccgcgagaaccccgucggcaccuuccacugcuccaugucccccggcaaccucgagaagaaccgcuacggcgacguccccugccucgaccagacccgcgucaagcucaccaagcgcuccggccacacccagaccgacuacaucaacgccuccuucauggacggcuacaagcagaagaacgccuacaucggcacccagggcccccucgagaacaccuaccgcgacuucuggcucauggucugggagcagaagguccucgucaucgucaugaccacccgcuucgaggagggcggccgccgcaagugcggccaguacuggccccucgagaaggacucccgcauccgcuucggcuuccucaccgucaccaaccucggcgucgagaacaugaaccacuacaagaagaccacccucgagauccacaacaccgaggagcgccagaagcgccaggucacccacuuccaguuccucuccuggcccgacuacggcguccccuccuccgccgccucccucaucgacuuccuccgcgucguccgcaaccagcagucccucgccgucuccaacaugggcgcccgcuccaagggccagugccccgagccccccaucgucguccacugcuccgccggcaucggccgcaccggcaccuucugcucccucgacaucugccucgcccagcucgaggagcucggcacccucaacgucuuccagaccgucucccgcaugcgcacccagcgcgccuucuccauccagacccccgagcaguacuacuucugcuacaaggccauccucgaguucgccgagaaggagggcauggucuccuccggccagaaccuccucgccgucgagucccaguga

SEQ ID NO: 48333 - RNA, 2409 nt, Artificial Sequence
  derived and/or modified sequence opt2 from PTPRA__Homo_sapiens__NP_002827
auggacuccugguucauccucguccuccucggcuccggccucaucugcgucuccgccaacaacgccaccaccgucgcccccuccgucggcaucacccgccucaucaacuccuccaccgccgagcccgucaaggaggaggccaagaccuccaaccccaccuccucccucaccucccucuccgucgcccccaccuucucccccaacaucacccucggccccaccuaccucaccaccgucaacuccuccgacuccgacaacggcaccacccgcaccgccuccaccaacuccaucggcaucaccaucucccccaacggcaccuggcuccccgacaaccaguucaccgacgcccgcaccgagcccugggagggcaacuccuccaccgccgccaccacccccgagaccuucccccccuccggcaacuccgacuccaaggaccgccgcgacgagacccccaucaucgccgucauggucgcccucuccucccuccucgucaucgucuucaucaucaucguccucuacaugcuccgcuucaagaaguacaagcaggccggcucccacuccaacuccuuccgccucuccaacggccgcaccgaggacgucgagccccaguccgucccccuccucgcccgcucccccuccaccaaccgcaaguaccccccccuccccgucgacaagcucgaggaggagaucaaccgccgcauggccgacgacaacaagcucuuccgcgaggaguucaacgcccuccccgccugccccauccaggccaccugcgaggccgccuccaaggaggagaacaaggagaagaaccgcuacgucaacauccuccccuacgaccacucccgcguccaccucacccccgucgagggcguccccgacuccgacuacaucaacgccuccuucaucaacggcuaccaggagaagaacaaguucaucgccgcccagggccccaaggaggagaccgucaacgacuucuggcgcaugaucugggagcagaacaccgccaccaucgucauggucaccaaccucaaggagcgcaaggagugcaagugcgcccaguacuggcccgaccagggcugcuggaccuacggcaacauccgcgucuccgucgaggacgucaccguccucgucgacuacaccguccgcaaguucugcauccagcaggucggcgacaugaccaaccgcaagccccagcgccucaucacccaguuccacuucaccuccuggcccgacuucggcguccccuucacccccaucggcaugcucaaguuccucaagaaggucaaggccugcaacccccaguacgccggcgccaucgucguccacugcuccgccggcgucggccgcaccggcaccuucgucgucaucgacgccaugcucgacaugaugcacaccgagcgcaaggucgacgucuacggcuucgucucccgcauccgcgcccagcgcugccagaugguccagaccgacaugcaguacgucuucaucuaccaggcccuccucgagcacuaccucuacggcgacaccgagcucgaggucaccucccucgagacccaccuccagaagaucuacaacaagauccccggcaccuccaacaacggccucgaggaggaguucaagaagcucaccuccaucaagauccagaacgacaagaugcgcaccggcaaccuccccgccaacaugaagaagaaccgcguccuccagaucauccccuacgaguucaaccgcgucaucauccccgucaagcgcggcgaggagaacaccgacuacgucaacgccuccuucaucgacggcuaccgccagaaggacuccuacaucgccucccagggcccccuccuccacaccaucgaggacuucuggcgcaugaucugggaguggaaguccugcuccaucgucaugcucaccgagcucgaggagcgcggccaggagaagugcgcccaguacuggcccuccgacggccucgucuccuacggcgacaucaccgucgagcucaagaaggaggaggagugcgaguccuacaccguccgcgaccuccucgucaccaacacccgcgagaacaagucccgccagauccgccaguuccacuuccacggcuggcccgaggucggcauccccuccgacggcaagggcaugaucuccaucaucgccgccguccagaagcagcagcagcaguccggcaaccaccccaucaccguccacugcuccgccggcgccggccgcaccggcaccuucugcgcccucuccaccguccucgagcgcgucaaggccgagggcauccucgacgucuuccagaccgucaagucccuccgccuccagcgcccccacaugguccagacccucgagcaguacgaguucugcuacaaggucguccaggaguacaucgacgccuucuccgacuacgccaacuucaaguga

SEQ ID NO: 48334 - RNA, 6648 nt, Artificial Sequence
  derived and/or modified sequence opt2 from PTPRB__Homo_sapiens__NP_001103224
auggaggccgaguucuacauggucauccucaccugccucaucuuccgcaacuccgagggcuuccagaucguccacguccagaagcagcagugccucuucaagaacgagaaggucgucgucggcuccugcaaccgcaccauccagaaccagcaguggauguggaccgaggacgagaagcuccuccacgucaaguccgcccucugccucgccaucuccaacuccucccgcggccccucccgcuccgccauccucgaccgcugcucccaggccccccgcuggaccugcuacgaccaggagggcuuccucgaggucgagaacgccucccucuuccuccagaagcagggcucccgcgucgucgucaagaaggcccgcaaguaccuccacuccuggaugaagaucgacgucaacaaggagggcaagcucgucaacgagucccucugccuccagaaggccggccucggcgccgaggucuccguccgcuccacccgcaacaccgcccccccccagauccucaccaccuucaacgccguccccgacggccucgucuuccucauccgcaacaccaccgaggccuucauccgcaacgccgccgagaacuacucccagaacuccuccgagcgccagcaccccaaccuccacaugaccggcaucaccgacaccuccuggguccucuccaccacccagcccuucuccuccaccaccgaggagaccggccucgccgagcccgagcgcugcaacuucacccucgccgaguccaaggccuccucccacuccgucuccauccaguggcgcauccucggcucccccugcaacuucucccucaucuacuccuccgacacccucggcgccgcccucugccccaccuuccgcaucgacaacaccaccuacggcugcaaccuccaggaccuccaggccggcaccaucuacaacuuccgcaucaucucccucgacgaggagcgcaccgucguccuccagaccgacccccucccccccgcccgcuucggcgucuccaaggagaagaccaccuccaccucccuccacgucugguggacccccuccuccggcaaggucaccuccuacgagguccagcucuucgacgagaacaaccagaagauccagggcguccagauccaggaguccaccuccuggaacgaguacaccuucuucaaccucaccgccggcuccaaguacaacaucgccaucaccgccgucuccggcggcaagcgcuccuucuccgucuacaccaacggcuccaccguccccucccccgucaaggacaucggcaucuccaccaaggccaacucccuccucaucuccuggucccacggcuccggcaacgucgagcgcuaccgccucaugcucauggacaagggcauccucguccacggcggcgucgucgacaagcacgccaccuccuacgccuuccacggccucacccccggcuaccucuacaaccucaccgucaugaccgaggccgccggccuccagaacuaccgcuggaagcucguccgcaccgcccccauggaggucuccaaccucaaggucaccaacgacggcucccucaccucccucaaggucaaguggcagcgcccccccggcaacgucgacuccuacaacaucacccucucccacaagggcaccaucaaggagucccgcguccucgcccccuggaucaccgagacccacuucaaggagcucguccccggccgccucuaccaggucaccgucuccugcgucuccggcgagcucuccgcccagaagauggccgucggccgcaccuuccccgacaaggucgccaaccucgaggccaacaacaacggccgcaugcgcucccucgucgucuccugguccccccccgccggcgacugggagcaguaccgcauccuccucuucaacgacuccgucguccuccucaacaucaccgucggcaaggaggagacccaguacgucauggacgacaccggccucguccccggccgccaguacgaggucgaggucaucgucgaguccggcaaccucaagaacuccgagcgcugccagggccgcaccgucccccucgccguccuccagcuccgcgucaagcacgccaacgagaccucccucuccaucauguggcagacccccgucgccgagugggagaaguacaucaucucccucgccgaccgcgaccuccuccucauccacaagucccucuccaaggacgccaaggaguucaccuucaccgaccucguccccggccgcaaguacauggccaccgucaccuccaucuccggcgaccucaagaacuccuccuccgucaagggccgcaccguccccgcccaggucaccgaccuccacgucgccaaccagggcaugaccuccucccucuucaccaacuggacccaggcccagggcgacgucgaguucuaccagguccuccucauccacgagaacgucgucaucaagaacgaguccaucuccuccgagaccucccgcuacuccuuccacucccucaaguccggcucccucuacuccgucgucgucaccaccgucuccggcggcaucuccucccgccaggucgucgucgagggccgcaccguccccuccuccgucuccggcgucaccgucaacaacuccggccgcaacgacuaccucuccgucuccuggcuccucgcccccggcgacgucgacaacuacgaggucacccucucccacgacggcaaggucguccagucccucgucaucgccaaguccguccgcgagugcuccuucuccucccucacccccggccgccucuacaccgucaccaucaccacccgcuccggcaaguacgagaaccacuccuucucccaggagcgcaccguccccgacaagguccagggcgucuccgucuccaacuccgcccgcuccgacuaccuccgcgucuccuggguccacgccaccggcgacuucgaccacuacgaggucaccaucaagaacaagaacaacuucauccagaccaaguccauccccaaguccgagaacgagugcgucuucguccagcucguccccggccgccucuacuccgucaccgucaccaccaaguccggccaguacgaggccaacgagcagggcaacggccgcaccauccccgagcccgucaaggaccucacccuccgcaaccgcuccaccgaggaccuccacgucaccugguccggcgccaacggcgacgucgaccaguacgagauccagcuccucuucaacgacaugaaggucuucccccccuuccaccucgucaacaccgccaccgaguaccgcuucaccucccucacccccggccgccaguacaagauccucguccucaccaucuccggcgacguccagcaguccgccuucaucgagggcuucaccguccccuccgccgucaagaacauccacaucucccccaacggcgccaccgacucccucaccgucaacuggacccccggcggcggcgacgucgacuccuacaccgucuccgccuuccgccacucccagaaggucgacucccagaccauccccaagcacgucuucgagcacaccuuccaccgccucgaggccggcgagcaguaccagaucaugaucgccuccgucuccggcucccucaagaaccagaucaacgucgucggccgcaccguccccgccuccguccagggcgucaucgccgacaacgccuacuccuccuacucccucaucgucuccuggcagaaggccgccggcgucgccgagcgcuacgacauccuccuccucaccgagaacggcauccuccuccgcaacaccuccgagcccgccaccaccaagcagcacaaguucgaggaccucacccccggcaagaaguacaagauccagauccucaccgucuccggcggccucuucuccaaggaggcccagaccgagggccgcaccguccccgccgccgucaccgaccuccgcaucaccgagaacuccacccgccaccucuccuuccgcuggaccgccuccgagggcgagcucuccugguacaacaucuuccucuacaaccccgacggcaaccuccaggagcgcgcccaggucgacccccucguccaguccuucuccuuccagaaccuccuccagggccgcauguacaagauggucaucgucacccacuccggcgagcucuccaacgaguccuucaucuucggccgcaccguccccgccuccgucucccaccuccgcggcuccaaccgcaacaccaccgacucccucugguucaacuggucccccgccuccggcgacuucgacuucuacgagcucauccucuacaaccccaacggcaccaagaaggagaacuggaaggacaaggaccucaccgaguggcgcuuccagggccucguccccggccgcaaguacguccucugggucgucacccacuccggcgaccucuccaacaaggucaccgccgagucccgcaccgcccccuccccccccucccucauguccuucgccgacaucgccaacaccucccucgccaucaccuggaagggcccccccgacuggaccgacuacaacgacuucgagcuccaguggcucccccgcgacgcccucaccgucuucaaccccuacaacaaccgcaaguccgagggccgcaucgucuacggccuccgccccggccgcuccuaccaguucaacgucaagaccgucuccggcgacuccuggaagaccuacuccaagcccaucuucggcuccguccgcaccaagcccgacaagauccagaaccuccacugccgcccccagaacuccaccgccaucgccugcuccuggaucccccccgacuccgacuucgacggcuacuccaucgagugccgcaagauggacacccaggaggucgaguucucccgcaagcucgagaaggagaagucccuccucaacaucaugaugcucgucccccacaagcgcuaccucgucuccaucaagguccaguccgccggcaugaccuccgaggucgucgaggacuccaccaucaccaugaucgaccgccccccccccccccccccccacauccgcgucaacgagaaggacguccucaucuccaaguccuccaucaacuucaccgucaacugcuccugguucuccgacaccaacggcgccgucaaguacuucaccgucgucguccgcgaggccgacggcuccgacgagcucaagcccgagcagcagcacccccuccccuccuaccucgaguaccgccacaacgccuccauccgcgucuaccagaccaacuacuucgccuccaagugcgccgagaaccccaacuccaacuccaaguccuucaacaucaagcucggcgccgagauggagucccucggcggcaagugcgaccccacccagcagaaguucugcgacggcccccucaagccccacaccgccuaccgcaucuccauccgcgccuucacccagcucuucgacgaggaccucaaggaguucaccaagccccucuacuccgacaccuucuucucccuccccaucaccaccgaguccgagccccucuucggcgccaucgagggcgucuccgccggccucuuccucaucggcaugcucgucgccgucgucgcccuccucaucugccgccagaaggucucccacggccgcgagcgccccuccgcccgccucuccauccgccgcgaccgcccccucuccguccaccucaaccucggccagaagggcaaccgcaagaccuccugccccaucaagaucaaccaguucgagggccacuucaugaagcuccaggccgacuccaacuaccuccucuccaaggaguacgaggagcucaaggacgucggccgcaaccaguccugcgacaucgcccuccuccccgagaaccgcggcaagaaccgcuacaacaacauccuccccuacgacgccacccgcgucaagcucuccaacgucgacgacgaccccugcuccgacuacaucaacgccuccuacauccccggcaacaacuuccgccgcgaguacaucgucacccagggcccccuccccggcaccaaggacgacuucuggaagauggucugggagcagaacguccacaacaucgucauggucacccagugcgucgagaagggccgcgucaagugcgaccacuacuggcccgccgaccaggacucccucuacuacggcgaccucauccuccagaugcucuccgaguccguccuccccgaguggaccauccgcgaguucaagaucugcggcgaggagcagcucgacgcccaccgccucauccgccacuuccacuacaccgucuggcccgaccacggcguccccgagaccacccagucccucauccaguucguccgcaccguccgcgacuacaucaaccgcucccccggcgccggccccaccgucguccacugcuccgccggcgucggccgcaccggcaccuucaucgcccucgaccgcauccuccagcagcucgacuccaaggacuccgucgacaucuacggcgccguccacgaccuccgccuccaccgcguccacaugguccagaccgagugccaguacgucuaccuccaccagugcguccgcgacguccuccgcgcccgcaagcuccgcuccgagcaggagaacccccucuuccccaucuacgagaacgucaaccccgaguaccaccgcgaccccgucuacucccgccacuga

SEQ ID NO: 48335 - RNA, 621 nt, Artificial Sequence
  derived and/or modified sequence opt2 from PTPRCAP__Homo_sapiens__NP_005599
auggcccuccccugcacccucggccucggcaugcuccucgcccuccccggcgcccucggcuccggcggcuccgccgaggacuccgucggcuccuccuccgucaccgucguccuccuccuccuccuccuccuccuccucgccaccggccucgcccucgccuggcgccgccucucccgcgacuccggcggcuacuaccaccccgcccgccucggcgccgcccucuggggccgcacccgccgccuccucugggccuccccccccggccgcuggcuccaggcccgcgccgagcucggcuccaccgacaacgaccucgagcgccaggaggacgagcaggacaccgacuacgaccacgucgccgacggcggccuccaggccgaccccggcgagggcgagcagcagugcggcgaggccuccucccccgagcagguccccguccgcgccgaggaggcccgcgacuccgacaccgagggcgaccucguccucggcucccccggccccgccuccgccggcggcuccgccgaggcccuccucuccgaccuccacgccuucgccggcuccgccgccugggacgacuccgcccgcgccgccggcggccagggccuccacgucaccgcccucuga

SEQ ID NO: 48336 - RNA, 4509 nt, Artificial Sequence
  derived and/or modified sequence opt2 from PTPRD__Homo_sapiens__NP_001035802
augguccacgucgcccgccuccuccuccuccuccucaccuucuuccuccgcaccgacgccgagacccccccccgcuucacccgcacccccgucgaccagaccggcgucuccggcggcgucgccuccuucaucugccaggccaccggcgacccccgccccaagaucgucuggaacaagaagggcaagaaggucuccaaccagcgcuucgaggucaucgaguucgacgacggcuccggcuccguccuccgcauccagccccuccgcaccccccgcgacgaggccaucuacgagugcgucgccuccaacaacgucggcgagaucuccgucuccacccgccucaccguccuccgcgaggaccagaucccccgcggcuuccccaccaucgacaugggcccccagcucaaggucgucgagcgcacccgcaccgccaccaugcucugcgccgccuccggcaaccccgaccccgagaucaccugguucaaggacuuccuccccgucgacaccuccaacaacaacggccgcaucaagcagcuccgcuccggcggcacccccauccgcggcgcccuccagaucgagcaguccgaggaguccgaccagggcaaguacgagugcgucgccaccaacuccgccggcacccgcuacuccgcccccgccaaccucuacguccgcgagcuccgcgagguccgccgcguccccccccgcuucuccaucccccccaccaaccacgagaucaugcccggcggcuccgucaacaucaccugcgucgccgucggcucccccaugcccuacgucaaguggaugcucggcgccgaggaccucacccccgaggacgacaugcccaucggccgcaacguccucgagcucaacgacguccgccaguccgccaacuacaccugcgucgccauguccacccucggcgucaucgaggccaucgcccagaucaccgucaaggcccuccccaagccccccggcacccccgucgucaccgaguccaccgccaccuccaucacccucaccugggacuccggcaaccccgagcccgucuccuacuacaucauccagcacaagcccaagaacuccgaggagcucuacaaggagaucgacggcgucgccaccacccgcuacuccgucgccggccucucccccuacuccgacuacgaguuccgcgucgucgccgucaacaacaucggccgcggcccccccuccgagcccguccucacccagaccuccgagcaggcccccuccuccgccccccgcgacguccaggcccgcaugcucuccuccaccaccauccucguccaguggaaggagcccgaggagcccaacggccagauccagggcuaccgcgucuacuacaccauggaccccacccagcacgucaacaacuggaugaagcacaacgucgccgacucccagaucaccaccaucggcaaccucgucccccagaagaccuacuccgucaagguccucgccuucaccuccaucggcgacggcccccucuccuccgacauccaggucaucacccagaccggcguccccggccagccccucaacuucaaggccgagcccgaguccgagaccuccauccuccucuccuggacccccccccgcuccgacaccaucgccaacuacgagcucgucuacaaggacggcgagcacggcgaggagcagcgcaucaccaucgagcccggcaccuccuaccgccuccagggccucaagcccaacucccucuacuacuuccgccucgccgcccgcuccccccagggccucggcgccuccaccgccgagaucuccgcccgcaccaugcaguccauguucgccaagaacuuccacgucaaggccgucaugaagaccuccguccuccucuccugggagauccccgagaacuacaacuccgccaugcccuucaagauccucuacgacgacggcaagauggucgaggaggucgacggccgcgccacccagaagcucaucgucaaccucaagcccgagaaguccuacuccuucguccucaccaaccgcggcaacuccgccggcggccuccagcaccgcgucaccgccaagaccgcccccgacguccuccgcaccaagcccgccuucaucggcaagaccaaccucgacggcaugaucaccguccagcuccccgagguccccgccaacgagaacaucaagggcuacuacaucaucaucgucccccucaagaagucccgcggcaaguucaucaagcccugggagucccccgacgagauggagcucgacgagcuccucaaggagaucucccgcaagcgccgcuccauccgcuacggccgcgaggucgagcucaagcccuacaucgccgcccacuucgacguccuccccaccgaguucacccucggcgacgacaagcacuacggcggcuucaccaacaagcagcuccaguccggccaggaguacgucuucuucguccucgccgucauggagcacgccgaguccaagauguacgccaccucccccuacuccgaccccgucgucuccauggaccucgacccccagcccaucaccgacgaggaggagggccucaucugggucgucggccccguccucgccgucgucuucaucaucugcaucgucaucgccauccuccucuacaaguccaagcccgaccgcaagcgcgccgaguccgacucccgcaaguccuccauccccaacaacaaggagauccccucccaccaccccaccgaccccgucgagcuccgccgccucaacuuccagacccccggcauggccucccacccccccauccccauccucgagcucgccgaccacaucgagcgccucaaggccaacgacaaccucaaguucucccaggaguacgaguccaucgaccccggccagcaguucaccugggagcacuccaaccucgaggucaacaagcccaagaaccgcuacgccaacgucaucgccuacgaccacucccgcguccuccucuccgccaucgagggcauccccggcuccgacuacgucaacgccaacuacaucgacggcuaccgcaagcagaacgccuacaucgccacccagggcucccuccccgagaccuucggcgacuucuggcgcaugaucugggagcagcgcuccgccaccgucgucaugaugaccaagcucgaggagcgcucccgcgucaagugcgaccaguacuggcccucccgcggcaccgagacccacggccucguccaggucacccuccucgacaccgucgagcucgccaccuacugcguccgcaccuucgcccucuacaagaacggcuccuccgagaagcgcgagguccgccaguuccaguucaccgccuggcccgaccacggcguccccgagcaccccacccccuuccucgccuuccuccgccgcgucaagaccugcaacccccccgacgccggccccauggucguccacugcuccgccggcgucggccgcaccggcugcuucaucgucaucgacgccaugcucgagcgcaucaagcacgagaagaccgucgacaucuacggccacgucacccucaugcgcgcccagcgcaacuacaugguccagaccgaggaccaguacaucuucauccacgacgcccuccucgaggccgucaccugcggcaacaccgagguccccgcccgcaaccucuacgccuacauccagaagcucacccagaucgagaccggcgagaacgucaccggcauggagcucgaguucaagcgccucgccuccuccaaggcccacaccucccgcuucaucuccgccaaccuccccugcaacaaguucaagaaccgccucgucaacaucaugcccuacgaguccacccgcgucugccuccagcccauccgcggcgucgagggcuccgacuacaucaacgccuccuucaucgacggcuaccgccagcagaaggccuacaucgccacccagggcccccucgccgagaccaccgaggacuucuggcgcaugcucugggagcacaacuccaccaucgucgucaugcucaccaagcuccgcgagaugggccgcgagaagugccaccaguacuggcccgccgagcgcuccgcccgcuaccaguacuucgucgucgaccccauggccgaguacaacaugccccaguacauccuccgcgaguucaaggucaccgacgcccgcgacggccagucccgcaccguccgccaguuccaguucaccgacuggcccgagcagggcguccccaaguccggcgagggcuucaucgacuucaucggccagguccacaagaccaaggagcaguucggccaggacggccccaucuccguccacugcuccgccggcgucggccgcaccggcgucuucaucacccucuccaucguccucgagcgcaugcgcuacgagggcgucgucgacaucuuccagaccgucaagaugcuccgcacccagcgccccgccaugguccagaccgaggaccaguaccaguucuccuaccgcgccgcccucgaguaccucggcuccuucgaccacuacgccaccuga

SEQ ID NO: 48337 - RNA, 2103 nt, Artificial Sequence
  derived and/or modified sequence opt2 from PTPRE__Homo_sapiens__NP_006495
auggagccccucugcccccuccuccucgucggcuucucccucccccucgcccgcgcccuccgcggcaacgagaccaccgccgacuccaacgagaccaccaccaccuccggcccccccgaccccggcgccucccagccccuccucgccuggcuccuccucccccuccuccuccuccuccucguccuccuccucgccgccuacuucuuccgcuuccgcaagcagcgcaaggccgucgucuccaccuccgacaagaagaugcccaacggcauccucgaggagcaggagcagcagcgcgucaugcuccucucccgcucccccuccggccccaagaaguacuuccccauccccgucgagcaccucgaggaggagauccgcauccgcuccgccgacgacugcaagcaguuccgcgaggaguucaacucccuccccuccggccacauccagggcaccuucgagcucgccaacaaggaggagaaccgcgagaagaaccgcuaccccaacauccuccccaacgaccacucccgcgucauccucucccagcucgacggcauccccugcuccgacuacaucaacgccuccuacaucgacggcuacaaggagaagaacaaguucaucgccgcccagggccccaagcaggagaccgucaacgacuucuggcgcauggucugggagcagaaguccgccaccaucgucaugcucaccaaccucaaggagcgcaaggaggagaagugccaccaguacuggcccgaccagggcugcuggaccuacggcaacauccgcgucugcgucgaggacugcgucguccucgucgacuacaccauccgcaaguucugcauccagccccagcuccccgacggcugcaaggccccccgccucgucucccagcuccacuucaccuccuggcccgacuucggcguccccuucacccccaucggcaugcucaaguuccucaagaaggucaagacccucaaccccguccacgccggccccaucgucguccacugcuccgccggcgucggccgcaccggcaccuucaucgucaucgacgccaugauggccaugaugcacgccgagcagaaggucgacgucuucgaguucgucucccgcauccgcaaccagcgcccccagaugguccagaccgacaugcaguacaccuucaucuaccaggcccuccucgaguacuaccucuacggcgacaccgagcucgacgucuccucccucgagaagcaccuccagaccaugcacggcaccaccacccacuucgacaagaucggccucgaggaggaguuccgcaagcucaccaacguccgcaucaugaaggagaacaugcgcaccggcaaccuccccgccaacaugaagaaggcccgcgucauccagaucauccccuacgacuucaaccgcgucauccucuccaugaagcgcggccaggaguacaccgacuacaucaacgccuccuucaucgacggcuaccgccagaaggacuacuucaucgccacccagggcccccucgcccacaccgucgaggacuucuggcgcaugaucugggaguggaagucccacaccaucgucaugcucaccgagguccaggagcgcgagcaggacaagugcuaccaguacuggcccaccgagggcuccgucacccacggcgagaucaccaucgagaucaagaacgacacccucuccgaggccaucuccauccgcgacuuccucgucacccucaaccagccccaggcccgccaggaggagcagguccgcgucguccgccaguuccacuuccacggcuggcccgagaucggcauccccgccgagggcaagggcaugaucgaccucaucgccgccguccagaagcagcagcagcagaccggcaaccaccccaucaccguccacugcuccgccggcgccggccgcaccggcaccuucaucgcccucuccaacauccucgagcgcgucaaggccgagggccuccucgacgucuuccaggccgucaagucccuccgccuccagcgcccccacaugguccagacccucgagcaguacgaguucugcuacaaggucguccaggacuucaucgacaucuucuccgacuacgccaacuucaaguga

SEQ ID NO: 48338 - RNA, 4338 nt, Artificial Sequence
  derived and/or modified sequence opt2 from PTPRG__Homo_sapiens__NP_002832
augcgccgccuccucgagcccugcugguggauccucuuccucaagaucaccuccuccguccuccacuacgucgucugcuuccccgcccucaccgagggcuacgucggcgcccuccacgagaaccgccacggcuccgccguccagauccgccgccgcaaggccuccggcgaccccuacugggccuacuccggcgccuacggccccgagcacugggucaccuccuccgucuccugcggcggccgccaccagucccccaucgacauccucgaccaguacgcccgcgucggcgaggaguaccaggagcuccagcucgacggcuucgacaacgaguccuccaacaagaccuggaugaagaacaccggcaagaccgucgccauccuccucaaggacgacuacuucgucuccggcgccggccuccccggccgcuucaaggccgagaaggucgaguuccacuggggccacuccaacggcuccgccggcuccgagcacuccaucaacggccgccgcuuccccgucgagaugcagaucuucuucuacaaccccgacgacuucgacuccuuccagaccgccaucuccgagaaccgcaucaucggcgccauggccaucuucuuccaggucuccccccgcgacaacuccgcccucgaccccaucauccacggccucaagggcgucguccaccacgagaaggagaccuuccucgaccccuucguccuccgcgaccuccuccccgccucccucggcuccuacuaccgcuacaccggcucccucaccaccccccccugcuccgagaucgucgaguggaucgucuuccgccgccccguccccaucuccuaccaccagcucgaggccuucuacuccaucuucaccaccgagcagcaggaccacgucaaguccgucgaguaccuccgcaacaacuuccgcccccagcagcgccuccacgaccgcgucgucuccaaguccgccguccgcgacuccuggaaccacgacaugaccgacuuccucgagaacccccucggcaccgaggccuccaaggucugcuccuccccccccauccacaugaagguccagccccucaaccagaccgcccuccaggucuccuggucccagcccgagaccaucuaccacccccccaucaugaacuacaugaucuccuacuccuggaccaagaacgaggacgagaaggagaagaccuucaccaaggacuccgacaaggaccucaaggccaccaucucccacgucucccccgacucccucuaccucuuccgcguccaggccgucugccgcaacgacaugcgcuccgacuucucccagaccaugcucuuccaggccaacaccacccgcaucuuccagggcacccgcaucgucaagaccggcguccccaccgccucccccgccuccuccgccgacauggcccccaucuccuccggcuccuccaccuggaccuccuccggcauccccuucuccuucgucuccauggccaccggcaugggccccuccuccuccggcucccaggccaccgucgccuccgucgucaccuccacccuccucgccggccucggcuucggcggcggcggcaucuccuccuuccccuccaccgucuggcccacccgccuccccaccgccgccuccgccuccaagcaggccgcccgccccguccucgccaccaccgaggcccucgccucccccggccccgacggcgacuccucccccaccaaggacggcgagggcaccgaggagggcgagaaggacgagaaguccgaguccgaggacggcgagcgcgagcacgaggaggacggcgagaaggacuccgagaagaaggagaaguccggcgucacccacgccgccgaggagcgcaaccagaccgagcccucccccacccccuccucccccaaccgcaccgccgagggcggccaccagaccauccccggccacgagcaggaccacaccgccguccccaccgaccagaccggcggccgccgcgacgccggccccggccucgaccccgacauggucaccuccacccaggucccccccaccgccaccgaggagcaguacgccggcuccgaccccaagcgccccgagaugcccuccaagaagcccaugucccgcggcgaccgcuucuccgaggacucccgcuucaucaccgucaaccccgccgagaagaacaccuccggcaugaucucccgccccgcccccggccgcauggaguggaucaucccccucaucgucgucuccgcccucaccuucgucugccucauccuccucaucgccguccucgucuacuggcgcggcugcaacaagaucaaguccaagggcuucccccgccgcuuccgcgagguccccuccuccggcgagcgcggcgagaagggcucccgcaagugcuuccagaccgcccacuucuacgucgaggacuccuccuccccccgcgucguccccaacgaguccauccccaucauccccauccccgacgacauggaggccauccccgucaagcaguucgucaagcacaucggcgagcucuacuccaacaaccagcacggcuucuccgaggacuucgaggagguccagcgcugcaccgccgacaugaacaucaccgccgagcacuccaaccaccccgagaacaagcacaagaaccgcuacaucaacauccucgccuacgaccacucccgcgucaagcuccgcccccuccccggcaaggacuccaagcacuccgacuacaucaacgccaacuacgucgacggcuacaacaaggccaaggccuacaucgccacccagggcccccucaaguccaccuucgaggacuucuggcgcaugaucugggagcagaacaccggcaucaucgucaugaucaccaaccucgucgagaagggccgccgcaagugcgaccaguacuggcccaccgagaacuccgaggaguacggcaacaucaucgucacccucaaguccaccaagauccacgccugcuacaccguccgccgcuucuccauccgcaacaccaaggucaagaagggccagaagggcaaccccaagggccgccagaacgagcgcgucgucauccaguaccacuacacccaguggcccgacaugggcguccccgaguacgcccuccccguccucaccuucguccgccgcuccuccgccgcccgcaugcccgagaccggccccguccucguccacugcuccgccggcgucggccgcaccggcaccuacaucgucaucgacuccaugcuccagcagaucaaggacaaguccaccgucaacguccucggcuuccucaagcacauccgcacccagcgcaacuaccucguccagaccgaggagcaguacaucuucauccacgacgcccuccucgaggccauccucggcaaggagaccgaggucuccuccaaccagcuccacuccuacgucaacuccauccucauccccggcgucggcggcaagacccgccucgagaagcaguucaagcucgucacccagugcaacgccaaguacgucgagugcuucuccgcccagaaggagugcaacaaggagaagaaccgcaacuccuccgucguccccuccgagcgcgcccgcgucggccucgccccccuccccggcaugaagggcaccgacuacaucaacgccuccuacaucaugggcuacuaccgcuccaacgaguucaucaucacccagcacccccucccccacaccaccaaggacuucuggcgcaugaucugggaccacaacgcccagaucaucgucaugcuccccgacaaccagucccucgccgaggacgaguucgucuacuggcccucccgcgaggaguccaugaacugcgaggccuucaccgucacccucaucuccaaggaccgccucugccucuccaacgaggagcagaucaucauccacgacuucauccucgaggccacccaggacgacuacguccucgagguccgccacuuccagugccccaaguggcccaaccccgacgcccccaucuccuccaccuucgagcucaucaacgucaucaaggaggaggcccucacccgcgacggccccaccaucguccacgacgaguacggcgccgucuccgccggcaugcucugcgcccucaccacccucucccagcagcucgagaacgagaacgccgucgacgucuuccaggucgccaagaugaucaaccucaugcgccccggcgucuucaccgacaucgagcaguaccaguucaucuacaaggccaugcucucccucgucuccaccaaggagaacggcaacggccccaugaccgucgacaagaacggcgccguccucaucgccgacgaguccgaccccgccgaguccauggagucccucgucuga

SEQ ID NO: 48339 - RNA, 2814 nt, Artificial Sequence
  derived and/or modified sequence opt2 from PTPRH__Homo_sapiens__NP_001154912
auggccggcgccggcggcggccucggcgucuggggcaaccucguccuccucggccucugcuccuggaccggcgcccgcgcccccgcccccaaccccggccgcaaccucaccgucgagacccagaccaccuccuccaucucccucuccugggagguccccgacggccucgacucccagaacuccaacuacuggguccagugcaccggcgacggcggcaccaccgagacccgcaacaccaccgccaccaacgucaccgucgacggccucggccccggcucccucuacaccugcuccgucugggucgagaaggacggcgucaacuccuccgucggcaccgucaccaccgccaccgcccccaaccccguccgcaaccucaccgucgaggcccagaccaacuccuccaucgcccucaccugggagguccccgacggccccgacccccagaacuccaccuacggcgucgaguacaccggcgacggcggccgcgccggcacccgcuccaccgcccacaccaacaucaccgucgaccgccucgagcccggcugccucuacgucuucuccgucugggucggcaagaacggcaucaacuccucccgcgagacccgcaacgccaccaccgcccccaaccccguccgcaaccuccacauggagacccagaccaacuccuccaucgcccucugcugggagguccccgacggccccuacccccaggacuacaccuacugggucgaguacaccggcgacggcggcggcaccgagacccgcaacaccaccaacaccuccgucaccgccgagcgccucgagcccggcacccucuacaccuucuccgucugggccgagaagaacggcgcccgcggcucccgccagaacgucuccaucuccaccguccccaacgccgucaccucccucuccaagcaggacuggaccaacuccaccaucgcccuccgcuggaccgccccccagggccccggccaguccuccuacuccuacugggucuccuggguccgcgagggcaugaccgacccccgcacccaguccaccuccggcaccgacaucacccucaaggagcucgaggccggcucccucuaccaccucaccgucugggccgagcgcaacgagguccgcggcuacaacuccacccucaccgccgccaccgcccccaacgaggucaccgaccuccagaacgagacccagaccaagaacuccgucaugcucugguggaaggcccccggcgacccccacucccagcucuacgucuacuggguccagugggccuccaagggccacccccgccgcggccaggacccccaggccaacugggucaaccagaccucccgcaccaacgagaccugguacaaggucgaggcccucgagcccggcacccucuacaacuucaccgucugggccgagcgcaacgacgucgccuccuccacccagucccucugcgccuccaccuaccccgacaccgucaccaucaccuccugcgucuccaccuccgccggcuacggcgucaaccucaucugguccugcccccagggcggcuacgaggccuucgagcucgaggucggcggccagcgcggcucccaggaccgcuccuccugcggcgaggccgucuccguccucggccucggccccgcccgcuccuaccccgccaccaucaccaccaucugggacggcaugaaggucgucucccacuccgucgucugccacaccgaguccgccggcgucaucgccggcgccuucgucggcauccuccucuuccucauccucgucggccuccucaucuucuuccucaagcgccgcaacaagaagaagcagcagaagcccgagcuccgcgaccucgucuucuccucccccggcgacauccccgccgaggacuucgccgaccacguccgcaagaacgagcgcgacuccaacugcggcuucgccgacgaguaccagcagcucucccucgucggccacucccagucccagauggucgccuccgccuccgagaacaacgccaagaaccgcuaccgcaacguccuccccuacgacuggucccgcgucccccucaagcccauccacgaggagcccggcuccgacuacaucaacgccuccuucaugcccggccucugguccccccaggaguucaucgccacccagggcccccucccccagaccgucggcgacuucuggcgccucgucugggagcagcagucccacacccucgucaugcucaccaacugcauggaggccggccgcgucaagugcgagcacuacuggccccucgacucccagcccugcacccacggccaccuccgcgucacccucgucggcgaggaggucauggagaacuggaccguccgcgagcuccuccuccuccaggucgaggagcagaagacccucuccguccgccaguuccacuaccaggccuggcccgaccacggcguccccuccucccccgacacccuccucgccuucuggcgcaugcuccgccaguggcucgaccagaccauggagggcggcccccccaucguccacugcuccgccggcgucggccgcaccggcacccucaucgcccucgacguccuccuccgccagcuccaguccgagggccuccucggccccuucuccuucguccgcaagaugcgcgagucccgcccccucaugguccagaccgaggcccaguacgucuuccuccaccagugcauccuccgcuuccuccagcaguccgcccaggcccccgccgagaaggagguccccuacgaggacgucgagaaccucaucuacgagaacgucgccgccauccaggcccacaagcucgaggucuga

SEQ ID NO: 48340 - RNA, 1620 nt, Artificial Sequence
  derived and/or modified sequence opt2 from PTPRJ__Homo_sapiens__NP_001091973
augaagcccgccgcccgcgaggcccgccuccccccccgcucccccggccuccgcugggcccucccccuccuccuccuccuccuccgccucggccagauccucugcgccggcggcacccccucccccauccccgaccccuccgucgccaccgucgccaccggcgagaacggcaucacccagaucuccuccaccgccgaguccuuccacaagcagaacggcaccggcaccccccaggucgagaccaacaccuccgaggacggcgaguccuccggcgccaacgacucccuccgcacccccgagcagggcuccaacggcaccgacggcgccucccagaagacccccuccuccaccggccccucccccgucuucgacaucaaggccgucuccaucucccccaccaacgucauccucaccuggaaguccaacgacaccgccgccuccgaguacaaguacgucgucaagcacaagauggagaacgagaagaccaucaccgucguccaccagcccuggugcaacaucaccggccuccgccccgccaccuccuacgucuucuccaucacccccggcaucggcaacgagaccuggggcgacccccgcgucaucaaggucaucaccgagcccauccccgucuccgaccuccgcgucgcccucaccggcguccgcaaggccgcccucuccugguccaacggcaacggcaccgccuccugccgcguccuccucgaguccaucggcucccacgaggagcucacccaggacucccgccuccaggucaacaucuccggccucaagcccggcguccaguacaacaucaaccccuaccuccuccaguccaacaagaccaagggcgacccccucggcaccgagggcggccucgacgccuccaacaccgagcgcucccgcgccggcucccccaccgcccccguccacgacgagucccucgucggccccgucgaccccuccuccggccagcagucccgcgacaccgagguccuccucgucggccucgagcccggcacccgcuacaacgccaccgucuacucccaggccgccaacggcaccgagggccagccccaggccaucgaguuccgcaccaacgccauccaggucuucgacgucaccgccgucaacaucuccgccaccucccucacccucaucuggaaggucuccgacaacgaguccuccuccaacuacaccuacaagauccacgucgccggcgagaccgacuccuccaaccucaacgucuccgagccccgcgccgucauccccggccuccgcuccuccaccuucuacaacaucaccgucugccccguccucggcgacaucgagggcacccccggcuuccuccagguccacaccccccccguccccgucuccgacuuccgcgucaccgucgucuccaccaccgagaucggccucgccugguccucccacgacgccgaguccuuccagaugcacaucacccaggagggcgccggcaacucccgcgucgagaucaccaccaaccaguccaucaucaucggcggccucuuccccggcaccaaguacugcuucgagaucguccccaagggccccaacggcaccgagggcgccucccgcaccgucugcaaccgcaccggcuga

SEQ ID NO: 48341 - RNA, 4341 nt, Artificial Sequence
  derived and/or modified sequence opt2 from PTPRK__Homo_sapiens__NP_001129120
auggacaccaccgccgccgccgcccuccccgccuucgucgcccuccuccuccucucccccuggccccuccucggcuccgcccagggccaguucuccgccggcggcugcaccuucgacgacggccccggcgccugcgacuaccaccaggaccucuacgacgacuucgaguggguccacgucuccgcccaggagccccacuaccucccccccgagaugccccagggcuccuacaugaucgucgacuccuccgaccacgaccccggcgagaaggcccgccuccagcuccccaccaugaaggagaacgacacccacugcaucgacuucuccuaccuccucuacucccagaagggccucaaccccggcacccucaacauccucguccgcgucaacaagggcccccucgccaaccccaucuggaacgucaccggcuucaccggccgcgacuggcuccgcgccgagcucgccgucuccaccuucuggcccaacgaguaccaggucaucuucgaggccgaggucuccggcggccgcuccggcuacaucgccaucgacgacauccagguccucuccuaccccugcgacaaguccccccacuuccuccgccucggcgacgucgaggucaacgccggccagaacgccaccuuccagugcaucgccaccggccgcgacgccguccacaacaagcucuggcuccagcgccgcaacggcgaggacauccccgucgcccagaccaagaacaucaaccaccgccgcuucgccgccuccuuccgccuccaggaggucaccaagaccgaccaggaccucuaccgcugcgucacccaguccgagcgcggcuccggcgucuccaacuucgcccagcucaucguccgcgagcccccccgccccaucgcccccccccagcuccucggcgucggccccaccuaccuccucauccagcucaacgccaacuccaucaucggcgacggccccaucauccucaaggaggucgaguaccgcaugaccuccggcuccuggaccgagacccacgccgucaacgcccccaccuacaagcucuggcaccucgaccccgacaccgaguacgagauccgcguccuccucacccgccccggcgagggcggcaccggccuccccggccccccccucaucacccgcaccaagugcgccgagcccaugcgcacccccaagacccucaagaucgccgagauccaggcccgccgcaucgccgucgacugggagucccucggcuacaacaucacccgcugccacaccuucaacgucaccaucugcuaccacuacuuccgcggccacaacgaguccaaggccgacugccucgacauggaccccaaggccccccagcacgucgucaaccaccucccccccuacaccaacgucucccucaagaugauccucaccaaccccgagggccgcaaggaguccgaggagaccaucauccagaccgacgaggacguccccggccccguccccgucaagucccuccagggcaccuccuucgagaacaagaucuuccucaacuggaaggagccccucgaccccaacggcaucaucacccaguacgagaucuccuacuccuccauccgcuccuucgaccccgccguccccgucgccggccccccccagaccgucuccaaccucuggaacuccacccaccacgucuucaugcaccuccaccccggcaccaccuaccaguucuucauccgcgccuccaccgucaagggcuucggccccgccaccgccaucaacgucaccaccaacaucuccgcccccacccuccccgacuacgagggcgucgacgccucccucaacgagaccgccaccaccaucaccguccuccuccgccccgcccaggccaagggcgcccccaucuccgccuaccagaucgucgucgaggagcuccacccccaccgcaccaagcgcgaggccggcgccauggagugcuaccagguccccgucaccuaccagaacgccauguccggcggcgcccccuacuacuucgccgccgagcucccccccggcaaccuccccgagcccgcccccuucaccgucggcgacaaccgcaccuaccagggcuucuggaaccccccccucgccccccgcaagggcuacaacaucuacuuccaggccauguccuccgucgagaaggagaccaagacccagugcguccgcaucgccaccaaggccgccgccaccgaggagcccgaggucauccccgaccccgccaagcagaccgaccgcgucgucaagaucgccggcaucuccgccggcauccucgucuucauccuccuccuccucgucgucauccucaucgucaagaaguccaagcucgccaagaagcgcaaggacgccaugggcaacacccgccaggagaugacccacauggucaacgccauggaccgcuccuacgccgaccaguccacccuccacgccgaggacccccucuccaucaccuucauggaccagcacaacuucuccccccgcuacgagaaccacuccgccaccgccgaguccucccgccuccucgacgucccccgcuaccucugcgagggcaccgagucccccuaccagaccggccagcuccaccccgccauccgcgucgccgaccuccuccagcacaucaaccucaugaagaccuccgacuccuacggcuucaaggaggaguacgaguccuucuucgagggccaguccgccuccugggacgucgccaagaaggaccagaaccgcgccaagaaccgcuacggcaacaucaucgccuacgaccacucccgcgucauccuccagcccgucgaggacgaccccuccuccgacuacaucaacgccaacuacaucgacaucuggcucuaccgcgacggcuaccagcgccccucccacuacaucgccacccagggccccguccacgagaccgucuacgacuucuggcgcaugaucuggcaggagcaguccgccugcaucgucauggucaccaaccucgucgaggucggccgcgucaagugcuacaaguacuggcccgacgacaccgaggucuacggcgacuucaaggucaccugcgucgagauggagccccucgccgaguacgucguccgcaccuucacccucgagcgccgcggcuacaacgagauccgcgaggucaagcaguuccacuucaccggcuggcccgaccacggcguccccuaccacgccaccggccuccucuccuucauccgccgcgucaagcucuccaacccccccuccgccggccccaucgucguccacugcuccgccggcgccggccgcaccggcugcuacaucgucaucgacaucaugcucgacauggccgagcgcgagggcgucgucgacaucuacaacugcgucaaggcccuccgcucccgccgcaucaacaugguccagaccgaggagcaguacaucuucauccacgacgccauccucgaggccugccucugcggcgagaccgccauccccgucugcgaguucaaggccgccuacuucgacaugauccgcaucgacucccagaccaacuccucccaccucaaggacgaguuccagacccucaacuccgucaccccccgccuccaggccgaggacugcuccaucgccugccucccccgcaaccacgacaagaaccgcuucauggacaugcucccccccgaccgcugccuccccuuccucaucaccaucgacggcgaguccuccaacuacaucaacgccgcccucauggacuccuaccgccagcccgccgccuucaucgucacccaguacccccuccccaacaccgucaaggacuucuggcgccucgucuacgacuacggcugcaccuccaucgucaugcucaacgaggucgaccucucccagggcugcccccaguacuggcccgaggagggcaugcuccgcuacggccccauccaggucgagugcauguccugcuccauggacugcgacgucaucaaccgcaucuuccgcaucugcaaccucacccgcccccaggagggcuaccucaugguccagcaguuccaguaccucggcugggccucccaccgcgagguccccggcuccaagcgcuccuuccucaagcucauccuccaggucgagaaguggcaggaggagugcgaggagggcgagggccgcaccaucauccacugccucaacggcggcggccgcuccggcauguucugcgccaucggcaucgucgucgagauggucaagcgccagaacgucgucgacgucuuccacgccgucaagacccuccgcaacuccaagcccaacauggucgaggcccccgagcaguaccgcuucugcuacgacgucgcccucgaguaccucgaguccuccuga

SEQ ID NO: 48342 - RNA, 4398 nt, Artificial Sequence
  derived and/or modified sequence opt2 from PTPRM__Homo_sapiens__NP_001098714
augcgcggccucggcaccugccucgccacccucgccggccuccuccucaccgccgccggcgagaccuucuccggcggcugccucuucgacgagcccuacuccaccugcggcuacucccaguccgagggcgacgacuucaacugggagcaggucaacacccucaccaagcccaccuccgaccccuggaugcccuccggcuccuucaugcucgucaacgccuccggccgccccgagggccagcgcgcccaccuccuccucccccagcucaaggagaacgacacccacugcaucgacuuccacuacuucgucuccuccaaguccaacuccccccccggccuccucaacgucuacgucaaggucaacaacggcccccucggcaaccccaucuggaacaucuccggcgaccccacccgcaccuggaaccgcgccgagcucgccaucuccaccuucuggcccaacuucuaccaggucaucuucgaggucaucaccuccggccaccagggcuaccucgccaucgacgaggucaagguccucggccaccccugcacccgcaccccccacuuccuccgcauccagaacgucgaggucaacgccggccaguucgccaccuuccagugcuccgccaucggccgcaccgucgccggcgaccgccucuggcuccagggcaucgacguccgcgacgccccccucaaggagaucaaggucaccuccucccgccgcuucaucgccuccuucaacgucgucaacaccaccaagcgcgacgccggcaaguaccgcugcaugauccgcaccgagggcggcgucggcaucuccaacuacgccgagcucgucgucaaggagccccccguccccaucgcccccccccagcucgccuccgucggcgccaccuaccucuggauccagcucaacgccaacuccaucaacggcgacggccccaucgucgcccgcgaggucgaguacugcaccgccuccggcuccuggaacgaccgccagcccgucgacuccaccuccuacaagaucggccaccucgaccccgacaccgaguacgagaucuccguccuccucacccgccccggcgagggcggcaccggcucccccggccccgcccuccgcacccgcaccaagugcgccgaccccaugcgcggcccccgcaagcucgaggucgucgaggucaagucccgccagaucaccauccgcugggagcccuucggcuacaacgucacccgcugccacuccuacaaccucaccguccacuacugcuaccaggucggcggccaggagcagguccgcgaggaggucuccugggacaccgagaacucccacccccagcacaccaucaccaaccucucccccuacaccaacgucuccgucaagcucauccucaugaaccccgagggccgcaaggagucccaggagcucaucguccagaccgacgaggaccuccccggcgccguccccaccgaguccauccagggcuccaccuucgaggagaagaucuuccuccaguggcgcgagcccacccagaccuacggcgucaucacccucuacgagaucaccuacaaggccgucuccuccuucgaccccgagaucgaccucuccaaccaguccggccgcgucuccaagcucggcaacgagacccacuuccucuucuucggccucuaccccggcaccaccuacuccuucaccauccgcgccuccaccgccaagggcuucggcccccccgccaccaaccaguucaccaccaagaucuccgcccccuccaugcccgccuacgagcucgagaccccccucaaccagaccgacaacaccgucaccgucaugcucaagcccgcccacucccgcggcgcccccgucuccgucuaccagaucgucgucgaggaggagcgcccccgccgcaccaagaagaccaccgagauccucaagugcuaccccguccccauccacuuccagaacgccucccuccucaacucccaguacuacuucgccgccgaguuccccgccgacucccuccaggccgcccagcccuucaccaucggcgacaacaagaccuacaacggcuacuggaacaccccccuccuccccuacaaguccuaccgcaucuacuuccaggccgccucccgcgccaacggcgagaccaagaucgacugcguccaggucgccaccaagggcgccgccacccccaagcccguccccgagcccgagaagcagaccgaccacaccgucaagaucgccggcgucaucgccggcauccuccucuucgucaucaucuuccucggcgucguccucgucaugaagaagcgcaagcucgccaagaagcgcaaggagaccauguccuccacccgccaggagaugaccgucauggucaacuccauggacaaguccuacgccgagcagggcaccaacugcgacgaggccuucuccuucauggacacccacaaccucaacggccgcuccgucuccucccccuccuccuucaccaugaagaccaacacccucuccaccuccguccccaacuccuacuaccccgaccccuucguccccaccgccauccucguccccaucaacgacgagacccacaccauggccuccgacaccuccucccucguccagucccacaccuacaagaagcgcgagcccgccgacguccccuaccagaccggccagcuccaccccgccauccgcgucgccgaccuccuccagcacaucacccagaugaagugcgccgagggcuacggcuucaaggaggaguacgaguccuucuucgagggccaguccgcccccugggacuccgccaagaaggacgagaaccgcaugaagaaccgcuacggcaacaucaucgccuacgaccacucccgcguccgccuccagaccaucgagggcgacaccaacuccgacuacaucaacggcaacuacaucgacggcuaccaccgccccaaccacuacaucgccacccagggccccaugcaggagaccaucuacgacuucuggcgcauggucuggcacgagaacaccgccuccaucaucauggucaccaaccucgucgaggucggccgcgucaagugcugcaaguacuggcccgacgacaccgagaucuacaaggacaucaaggucacccucaucgagaccgagcuccucgccgaguacgucauccgcaccuucgccgucgagaagcgcggcguccacgagauccgcgagauccgccaguuccacuucaccggcuggcccgaccacggcguccccuaccacgccaccggccuccucggcuucguccgccaggucaaguccaaguccccccccuccgccggcccccucgucguccacugcuccgccggcgccggccgcaccggcugcuucaucgucaucgacaucaugcucgacauggccgagcgcgagggcgucgucgacaucuacaacugcguccgcgagcuccgcucccgccgcgucaacaugguccagaccgaggagcaguacgucuucauccacgacgccauccucgaggccugccucugcggcgacaccuccguccccgccucccagguccgcucccucuacuacgacaugaacaagcucgacccccagaccaacuccucccagaucaaggaggaguuccgcacccucaacauggucacccccacccuccgcgucgaggacugcuccaucgcccuccucccccgcaaccacgagaagaaccgcugcauggacauccucccccccgaccgcugccuccccuuccucaucaccaucgacggcgaguccuccaacuacaucaacgccgcccucauggacuccuacaagcagcccuccgccuucaucgucacccagcacccccuccccaacaccgucaaggacuucuggcgccucguccucgacuaccacugcaccuccgucgucaugcucaacgacgucgaccccgcccagcucugcccccaguacuggcccgagaacggcguccaccgccacggccccauccaggucgaguucgucuccgccgaccucgaggaggacaucaucucccgcaucuuccgcaucuacaacgccgcccgcccccaggacggcuaccgcaugguccagcaguuccaguuccucggcuggcccauguaccgcgacacccccgucuccaagcgcuccuuccucaagcucauccgccaggucgacaaguggcaggaggaguacaacggcggcgagggccgcaccgucguccacugccucaacggcggcggccgcuccggcaccuucugcgccaucuccaucgucugcgagaugcuccgccaccagcgcaccgucgacgucuuccacgccgucaagacccuccgcaacaacaagcccaacauggucgaccuccucgaccaguacaaguucugcuacgaggucgcccucgaguaccucaacuccggcuga

SEQ ID NO: 48343 - RNA, 3048 nt, Artificial Sequence
  derived and/or modified sequence opt2 from PTPRN2__Homo_sapiens__NP_002838
augggccccccccucccccuccuccuccuccuccuccuccuccuccccccccgcguccuccccgccgcccccuccuccgucccccgcggccgccagcuccccggccgccucggcugccuccucgaggagggccucugcggcgccuccgaggccugcgucaacgacggcgucuucggccgcugccagaagguccccgccauggacuucuaccgcuacgaggucucccccgucgcccuccagcgccuccgcgucgcccuccagaagcucuccggcaccggcuucaccuggcaggacgacuacacccaguacgucauggaccaggagcucgccgaccuccccaagaccuaccuccgccgccccgaggccuccucccccgcccgccccuccaagcacuccgucggcuccgagcgccgcuacucccgcgagggcggcgccgcccucgccaacgcccuccgccgccaccuccccuuccucgaggcccucucccaggcccccgccuccgacguccucgcccgcacccacaccgcccaggaccgcccccccgccgagggcgacgaccgcuucuccgaguccauccucaccuacgucgcccacaccuccgcccucaccuacccccccggcucccgcacccagcuccgcgaggaccuccucccccgcacccucggccagcuccagcccgacgagcucucccccaaggucgacuccggcgucgaccgccaccaccucauggccgcccucuccgccuacgccgcccagcgcccccccgccccccccggcgagggcucccucgagccccaguaccuccuccgcgcccccucccgcaugccccgcccccuccucgcccccgccgccccccagaaguggcccuccccccucggcgacuccgaggaccccuccuccaccggcgacggcgcccgcauccacacccuccucaaggaccuccagcgccagcccgccgagguccgcggccucuccggccucgagcucgacggcauggccgagcucauggccggccucaugcagggcgucgaccacggcgucgcccgcggcucccccggccgcgccgcccucggcgaguccggcgagcaggccgacggccccaaggccacccuccgcggcgacuccuuccccgacgacggcguccaggacgacgacgaccgccucuaccaggagguccaccgccucuccgccacccucggcggccuccuccaggaccacggcucccgccuccuccccggcgcccuccccuucgcccgcccccucgacauggagcgcaagaaguccgagcaccccgaguccucccucuccuccgaggaggagaccgccggcgucgagaacgucaagucccagaccuacuccaaggaccuccucggccagcagccccacuccgagcccggcgccgccgccuucggcgagcuccagaaccagaugcccggccccuccaaggaggagcagucccuccccgccggcgcccaggaggcccucuccgacggccuccagcucgagguccagcccuccgaggaggaggcccgcggcuacaucgucaccgaccgcgacccccuccgccccgaggagggccgccgccucgucgaggacgucgcccgccuccuccagguccccuccuccgccuucgccgacgucgagguccucggccccgccgucaccuucaaggucuccgccaacguccagaacgucaccaccgaggacgucgagaaggccaccgucgacaacaaggacaagcucgaggagaccuccggccucaagauccuccagaccggcgucggcuccaaguccaagcucaaguuccuccccccccaggccgagcaggaggacuccaccaaguucaucgcccucacccucgucucccucgccugcauccucggcguccuccucgccuccggccucaucuacugccuccgccacuccucccagcaccgccucaaggagaagcucuccggccucggcggcgaccccggcgccgacgccaccgccgccuaccaggagcucugccgccagcgcauggccacccgcccccccgaccgccccgagggcccccacaccucccgcaucuccuccgucuccucccaguucuccgacggccccauccccucccccuccgcccgcuccuccgccuccuccugguccgaggagcccguccaguccaacauggacaucuccaccggccacaugauccucuccuacauggaggaccaccucaagaacaagaaccgccucgagaaggagugggaggcccucugcgccuaccaggccgagcccaacuccuccuucgucgcccagcgcgaggagaacguccccaagaaccgcucccucgccguccucaccuacgaccacucccgcguccuccucaaggccgagaacucccacucccacuccgacuacaucaacgccucccccaucauggaccacgacccccgcaaccccgccuacaucgccacccagggcccccuccccgccaccgucgccgacuucuggcagauggucugggaguccggcugcgucgucaucgucaugcucaccccccucgccgagaacggcguccgccagugcuaccacuacuggcccgacgagggcuccaaccucuaccacaucuacgaggucaaccucgucuccgagcacaucuggugcgaggacuuccucguccgcuccuucuaccucaagaaccuccagaccaacgagacccgcaccgucacccaguuccacuuccucuccugguacgaccgcggcguccccuccuccucccgcucccuccucgacuuccgccgcaaggucaacaagugcuaccgcggccgcuccugccccaucaucguccacugcuccgacggcgccggccgcuccggcaccuacguccucaucgacaugguccucaacaagauggccaagggcgccaaggagaucgacaucgccgccacccucgagcaccuccgcgaccagcgccccggcaugguccagaccaaggagcaguucgaguucgcccucaccgccgucgccgaggaggucaacgccauccucaaggcccucccccaguga

SEQ ID NO: 48344 - RNA, 2853 nt, Artificial Sequence
  derived and/or modified sequence opt2 from PTPRN__Homo_sapiens__NP_001186692
augcgccgcccccgccgccccggcggccucggcggcuccggcggccuccgccuccuccucugccuccuccuccucuccucccgccccggcggcugcuccgccgucuccgcccacggcugccucuucgaccgccgccucugcucccaccucgaggucugcauccaggacggccucuucggccagugccaggucggcgucggccaggcccgcccccuccuccaggucaccucccccguccuccagcgccuccagggcguccuccgccagcucaugucccagggccucuccuggcacgacgaccucacccaguacgucaucucccaggagauggagcgcaucccccgccuccgcccccccgagccccgcccccgcgaccgcuccggccucgcccccaagcgccccggccccgccggcgagcuccuccuccaggacauccccaccggcuccgcccccgccgcccagcaccgccucccccagccccccgucggcaagggcggcgccggcgccuccuccucccucuccccccuccaggccgagcuccuccccccccuccucgagcaccuccuccuccccccccagcccccccaccccucccucuccuacgagcccgcccuccuccagcccuaccucuuccaccaguucggcucccgcgacggcucccgcgucuccgagggcucccccggcauggucuccgucggcccccuccccaaggccgaggcccccgcccucuucucccgcaccgccuccaagggcaucuucggcgaccaccccggccacuccuacggcgaccuccccggccccucccccgcccagcucuuccaggacuccggccuccucuaccucgcccaggagcuccccgcccccucccgcgcccgcgucccccgccuccccgagcagggcuccuccucccgcgccgaggacucccccgagggcuacgagaaggagggccucggcgaccgcggcgagaagcccgccucccccgccguccagcccgacgccgcccuccagcgccucgccgccguccucgccggcuacggcgucgagcuccgccagcucacccccgagcagcucuccacccuccucacccuccuccagcuccuccccaagggcgccggccgcaaccccggcggcgucgucaacgucggcgccgacaucaagaagaccauggagggccccgucgagggccgcgacaccgccgagcuccccgcccgcaccucccccaugcccggccaccccaccgccucccccaccuccuccgagguccagcagguccccucccccgucuccuccgagccccccaaggccgcccgcccccccgucacccccguccuccucgagaagaaguccccccucggccagucccagcccaccgucgccggccagcccuccgcccgccccgccgccgaggaguacggcuacaucgucaccgaccagaacgucgucggccccgcccucaccuuccgcauccgccacaacgagcagaaccucucccucgccgacgucacccagcaggccggccucgucaaguccgagcucgaggcccagaccggccuccagauccuccagaccggcgucggccagcgcgaggaggccgccgccguccucccccagaccgcccacuccaccucccccaugcgcuccguccuccucacccucgucgcccucgccggcgucgccggccuccucgucgcccucgccgucgcccucugcguccgccagcacgcccgccagcaggacaaggagcgccucgccgcccucggccccgagggcgcccacggcgacaccaccuucgaguaccaggaccucugccgccagcacauggccaccaagucccucuucaaccgcgccgagggcccccccgagcccucccgcgucuccuccgucuccucccaguucuccgacgccgcccaggccucccccuccucccacuccuccacccccuccuggugcgaggagcccgcccaggccaacauggacaucuccaccggccacaugauccucgccuacauggaggaccaccuccgcaaccgcgaccgccucgccaaggaguggcaggcccucugcgccuaccaggccgagcccaacaccugcgccaccgcccagggcgagggcaacaucaagaagaaccgccaccccgacuuccuccccuacgaccacgcccgcaucaagcucaaggucgaguccucccccucccgcuccgacuacaucaacgccucccccaucaucgagcacgacccccgcaugcccgccuacaucgccacccagggcccccucucccacaccaucgccgacuucuggcagauggucugggaguccggcugcaccgucaucgucaugcucaccccccucgucgaggacggcgucaagcagugcgaccgcuacuggcccgacgagggcgccucccucuaccacgucuacgaggucaaccucgucuccgagcacaucuggugcgaggacuuccucguccgcuccuucuaccucaagaacguccagacccaggagacccgcacccucacccaguuccacuuccucuccuggcccgccgagggcacccccgccuccacccgcccccuccucgacuuccgccgcaaggucaacaagugcuaccgcggccgcuccugccccaucaucguccacugcuccgacggcgccggccgcaccggcaccuacauccucaucgacaugguccucaaccgcauggccaagggcgucaaggagaucgacaucgccgccacccucgagcacguccgcgaccagcgccccggccucguccgcuccaaggaccaguucgaguucgcccucaccgccgucgccgaggaggucaacgccauccucaaggcccucccccaguga

SEQ ID NO: 48345 - RNA, 3567 nt, Artificial Sequence
  derived and/or modified sequence opt2 from PTPRO__Homo_sapiens__NP_002839
augggccaccuccccaccggcauccacggcgcccgccgccuccucccccuccucuggcucuucguccucuucaagaacgccaccgccuuccacgucaccguccaggacgacaacaacaucgucgucucccucgaggccuccgacgucaucucccccgccuccgucuacgucgucaagaucaccggcgaguccaagaacuacuucuucgaguucgaggaguucaacuccacccuccccccccccgucaucuucaaggccuccuaccacggccucuacuacaucaucacccucgucgucgucaacggcaacgucgucaccaagcccucccgcuccaucaccguccucaccaagccccuccccgucaccuccgucuccaucuacgacuacaagcccucccccgagaccggcguccucuucgagauccacuaccccgagaaguacaacgucuucacccgcgucaacaucuccuacugggagggcaaggacuuccgcaccaugcucuacaaggacuucuucaagggcaagaccgucuucaaccacuggcuccccggcaugugcuacuccaacaucaccuuccagcucgucuccgaggccaccuucaacaaguccacccucgucgaguacuccggcgucucccacgagcccaagcagcaccgcaccgcccccuaccccccccagaacaucuccguccgcaucgucaaccucaacaagaacaacugggaggagcaguccggcaacuuccccgaggaguccuucaugcgcucccaggacaccaucggcaaggagaagcucuuccacuucaccgaggagacccccgagauccccuccggcaacaucuccuccggcuggcccgacuucaacuccuccgacuacgagaccaccucccagcccuacuggugggacuccgccuccgccgcccccgaguccgaggacgaguucgucuccguccuccccauggaguacgagaacaacuccacccucuccgagaccgagaaguccaccuccggcuccuucuccuucuuccccguccagaugauccucaccuggcucccccccaagccccccaccgccuucgacggcuuccacauccacaucgagcgcgaggagaacuucaccgaguaccucauggucgacgaggaggcccacgaguucgucgccgagcucaaggagcccggcaaguacaagcucuccgucaccaccuucuccuccuccggcuccugcgagacccgcaagucccaguccgccaagucccucuccuucuacaucucccccuccggcgaguggaucgaggagcucaccgagaagccccagcacgucuccguccacguccucuccuccaccaccgcccucauguccuggaccuccucccaggagaacuacaacuccaccaucgucuccgucgucucccucaccugccagaagcagaaggagucccagcgccucgagaagcaguacugcacccaggucaacuccuccaagcccaucaucgagaaccucguccccggcgcccaguaccaggucgucaucuaccuccgcaagggcccccucaucggcccccccuccgaccccgucaccuucgccaucguccccaccggcaucaaggaccucaugcucuacccccucggccccaccgccgucguccucuccuggacccgccccuaccucggcgucuuccgcaaguacgucgucgagauguucuacuucaaccccgccaccaugaccuccgaguggaccaccuacuacgagaucgccgccaccgucucccucaccgccuccguccgcaucgccaaccuccuccccgccugguacuacaacuuccgcgucaccauggucaccuggggcgaccccgagcucuccugcugcgacuccuccaccaucuccuucaucaccgcccccgucgcccccgagaucaccuccgucgaguacuucaacucccuccucuacaucuccuggaccuacggcgacgacaccaccgaccucucccacucccgcaugcuccacuggauggucgucgccgagggcaagaagaagaucaagaaguccgucacccgcaacgucaugaccgccauccucucccucccccccggcgacaucuacaaccucuccgucaccgccugcaccgagcgcggcuccaacaccuccaugcuccgccucgucaagcucgagcccgccccccccaagucccucuucgccgucaacaagacccagaccuccgucacccuccucugggucgaggagggcgucgccgacuucuucgaggucuucugccagcaggucggcuccucccagaagaccaagcuccaggagcccgucgccgucuccucccacgucgucaccaucuccucccuccuccccgccaccgccuacaacugcuccgucaccuccuucucccacgacucccccuccguccccaccuucaucgccgucuccaccauggucaccgagaugaaccccaacgucgucgucaucuccguccucgccauccucuccacccuccucaucggccuccuccucgucacccucaucauccuccgcaagaagcaccuccagauggcccgcgagugcggcgccggcaccuucgucaacuucgccucccucgagcgcgacggcaagcuccccuacaacugguccaagaacggccucaagaagcgcaagcucaccaaccccguccagcucgacgacuucgacgccuacaucaaggacauggccaaggacuccgacuacaaguucucccuccaguucgaggagcucaagcucaucggccucgacaucccccacuucgccgccgaccucccccucaaccgcugcaagaaccgcuacaccaacauccuccccuacgacuucucccgcguccgccucgucuccaugaacgaggaggagggcgccgacuacaucaacgccaacuacauccccggcuacaacuccccccaggaguacaucgccacccagggcccccuccccgagacccgcaacgacuucuggaagaugguccuccagcagaagucccagaucaucgucaugcucacccagugcaacgagaagcgccgcgucaagugcgaccacuacuggcccuucaccgaggagcccaucgccuacggcgacaucaccgucgagaugaucuccgaggaggagcaggacgacugggccugccgccacuuccgcaucaacuacgccgacgagaugcaggacgucaugcacuucaacuacaccgccuggcccgaccacggcguccccaccgccaacgccgccgaguccauccuccaguucguccacaugguccgccagcaggccaccaaguccaagggccccaugaucauccacugcuccgccggcgucggccgcaccggcaccuucaucgcccucgaccgccuccuccagcacauccgcgaccacgaguucgucgacauccucggccucgucuccgagaugcgcuccuaccgcauguccaugguccagaccgaggagcaguacaucuucauccaccagugcguccagcucauguggaugaagaagaagcagcaguucugcaucuccgacgucaucuacgagaacgucuccaaguccuga

SEQ ID NO: 48346 - RNA, 6900 nt, Artificial Sequence
  derived and/or modified sequence opt2 from PTPRQ__Homo_sapiens__NP_001138498
auggacuuccucaucaucuuccuccuccucuucaucggcaccuccgagacccaggucgacgucuccaacgucguccccggcacccgcuacgacaucaccaucuccuccaucuccaccaccuacaccucccccgucacccgcaucgucaccaccaacgucaccaagcccggcccccccgucuuccucgccggcgagcgcgucggcuccgccggcauccuccucuccuggaacaccccccccaaccccaacggccgcaucaucuccuacaucgucaaguacaaggaggucugccccuggaugcagaccgucuacacccagguccgcuccaagcccgacucccucgagguccuccucaccaaccucaaccccggcaccaccuacgagaucaaggucgccgccgagaacuccgccggcaucggcgucuucuccgaccccuuccucuuccagaccgccgaguccgcccccggcaaggucgucaaccucaccgucgaggccuacaacgccuccgccgucaagcucaucugguaccucccccgccagcccaacggcaagaucaccuccuucaagaucuccgucaagcacgcccgcuccggcaucgucgucaaggacgucuccauccgcgucgaggacauccucaccggcaagcuccccgagugcaacgagaacuccgaguccuuccucugguccaccgccucccccucccccacccucggccgcgucaccccccccucccgcaccacccacuccuccuccacccucacccagaacgagaucuccuccgucuggaaggagcccaucuccuucgucgucacccaccuccgccccuacaccaccuaccucuucgaggucuccgccgccaccaccgaggccggcuacaucgacuccaccaucguccgcacccccgaguccguccccgagggccccccccagaacugcgucaccggcaacaucaccggcaaguccuucuccauccucugggacccccccaccaucgucaccggcaaguucuccuaccgcgucgagcucuacggccccuccggccgcauccucgacaacuccaccaaggaccucaaguucgccuucaccaaccucacccccuucaccauguacgacgucuacaucgccgccgagaccuccgccggcaccggccccaaguccaacaucuccgucuucaccccccccgacguccccggcgccgucuucgaccuccagcucgccgaggucgaguccacccagguccgcaucaccuggaagaagccccgccagcccaacggcaucaucaaccaguaccgcgucaagguccucguccccgagaccggcaucauccucgagaacacccuccucaccggcaacaacgaguacaucaacgaccccauggcccccgagaucgucaacaucgucgagcccauggucggccucuacgagggcuccgccgagauguccuccgaccuccacucccucgccaccuucaucuacaacucccaccccgacaagaacuuccccgcccgcaaccgcgccgaggaccagaccucccccgucgucaccacccgcaaccaguacaucaccgacaucgccgccgagcagcucuccuacgucauccgccgccucguccccuucaccgagcacaugaucuccgucuccgccuucaccaucaugggcgagggcccccccaccguccucuccguccgcacccgccagcagguccccuccuccaucaagaucaucaacuacaagaacaucuccuccuccuccauccuccucuacugggacccccccgaguaccccaacggcaagaucacccacuacaccaucuacgccauggagcucgacaccaaccgcgccuuccagaucaccaccaucgacaacuccuuccucaucaccggccucaagaaguacaccaaguacaagaugcgcgucgccgccuccacccacgucggcgaguccucccucuccgaggagaacgacaucuucguccgcaccuccgaggacgagcccgaguccuccccccaggacgucgaggucaucgacgucaccgccgacgagauccgccucaagugguccccccccgagaagcccaacggcaucaucaucgccuacgagguccucuacaagaacaucgacacccucuacaugaagaacaccuccaccaccgacaucauccuccgcaaccuccgcccccacacccucuacaacaucuccguccgcuccuacacccgcuucggccacggcaaccaggucuccucccuccucuccguccgcaccuccgagaccguccccgacuccgcccccgagaacaucaccuacaagaacaucuccuccggcgagaucgagcucuccuuccucccccccuccucccccaacggcaucauccagaaguacaccaucuaccucaagcgcuccaacggcaacgaggagcgcaccaucaacaccaccucccucacccagaacaucaagguccucaagaaguacacccaguacaucaucgaggucuccgccuccacccucaagggcgagggcguccgcuccgcccccaucuccauccucaccgaggaggacgcccccgacucccccccccaggacuucuccgucaagcagcucuccggcgucaccgucaagcucuccuggcagcccccccucgagcccaacggcaucauccucuacuacaccgucuacgucuggaaccgcuccucccucaagaccaucaacgucaccgagaccucccucgagcucuccgaccucgacuacaacgucgaguacuccgccuacgucaccgccuccacccgcuucggcgacggcaagacccgcuccaacaucaucuccuuccagacccccgagggcgcccccuccgacccccccaaggacgucuacuacgccaaccucuccuccuccuccaucauccucuucuggaccccccccuccaagcccaacggcaucauccaguacuacuccgucuacuaccgcaacaccuccggcaccuucaugcagaacuucacccuccacgaggucaccaacgacuucgacaacaugaccgucuccaccaucaucgacaagcucaccaucuucuccuacuacaccuucuggcucaccgccuccaccuccgucggcaacggcaacaaguccuccgacaucaucgaggucuacaccgaccaggacauccccgagggcuucgucggcaaccucaccuacgaguccaucuccuccaccgccaucaacgucuccugggucccccccgcccagcccaacggccucgucuucuacuacgucucccucauccuccagcagaccccccgccacguccgccccccccucgucaccuacgagcgcuccaucuacuucgacaaccucgagaaguacaccgacuacauccucaagaucacccccuccaccgagaagggcuucuccgacaccuacaccgcccagcucuacaucaagaccgaggaggacguccccgagaccucccccaucaucaacaccuucaagaaccucuccuccaccuccguccuccucuccugggacccccccgucaagcccaacggcgccaucaucuccuacgaccucacccuccagggccccaacgagaacuacuccuucaucaccuccgacaacuacaucauccucgaggagcucucccccuucacccucuacuccuucuucgccgccgcccgcacccgcaagggccucggccccuccuccauccucuucuucuacaccgacgaguccgucccccucgcccccccccagaaccucacccucaucaacugcaccuccgacuucgucuggcucaaguggucccccuccccccuccccggcggcaucgucaaggucuacuccuucaagauccacgagcacgagaccgacaccaucuacuacaagaacaucuccggcuucaagaccgaggccaagcucgucggccucgagcccgucuccaccuacuccauccgcgucuccgccuucaccaaggucggcaacggcaaccaguucuccaacgucgucaaguucaccacccaggaguccguccccgacgucguccagaacaugcagugcauggccaccuccuggcaguccguccucgucaagugggacccccccaagaaggccaacggcaucaucacccaguacauggucaccgucgagcgcaacuccaccaaggucuccccccaggaccacauguacaccuucaucaagcuccucgccaacaccuccuacgucuucaagguccgcgccuccaccuccgccggcgagggcgacgaguccaccugccacgucuccacccuccccgagaccguccccuccguccccaccaacaucgccuucuccgacguccaguccaccuccgccacccucaccuggauccgccccgacaccauccucggcuacuuccagaacuacaagaucaccacccagcuccgcgcccagaagugcaaggagugggaguccgaggagugcgucgaguaccagaagauccaguaccucuacgaggcccaccucaccgaggagaccgucuacggccucaagaaguuccgcugguaccgcuuccaggucgccgccuccaccaacgccggcuacggcaacgccuccaacuggaucuccaccaagacccuccccggcccccccgacggcccccccgagaacguccacgucgucgccaccucccccuucuccaucuccaucuccugguccgagcccgccgucaucaccggccccaccugcuaccucaucgacgucaaguccgucgacaacgacgaguucaacaucuccuucaucaaguccaacgaggagaacaagaccaucgagaucaaggaccucgagaucuucacccgcuacuccgucgucaucaccgccuucaccggcaacaucuccgccgccuacgucgagggcaaguccuccgccgagaugaucgucaccacccucgaguccgcccccaaggacccccccaacaacaugaccuuccagaagauccccgacgaggucaccaaguuccagcucaccuuccucccccccucccagcccaacggcaacauccaggucuaccaggcccucgucuaccgcgaggacgaccccaccgccguccagauccacaaccucuccaucauccagaagaccaacaccuucgucaucgccaugcucgagggccucaagggcggccacaccuacaacaucuccgucuacgccgucaacuccgccggcgccggccccaagguccccaugcgcaucaccauggacaucaaggcccccgcccgccccaagaccaagcccacccccaucuacgacgccaccggcaagcuccucgucaccuccaccaccaucaccauccgcaugcccaucugcuacuacuccgacgaccacggccccaucaagaacguccagguccucgucaccgagaccggcgcccagcacgacggcaacgucaccaagugguacgacgccuacuucaacaaggcccgccccuacuucaccaacgagggcuuccccaacccccccugcaccgagggcaagaccaaguucuccggcaacgaggagaucuacaucaucggcgccgacaacgccugcaugauccccggcaacgaggacaagaucugcaacggcccccucaagcccaagaagcaguaccucuucaaguuccgcgccaccaacaucaugggccaguucaccgacuccgacuacuccgaccccgucaagacccucggcgagggccucuccgagcgcaccgucgagaucauccucuccgucacccucugcauccucuccaucauccuccucggcaccgccaucuucgccuucgcccgcauccgccagaagcagaaggagggcggcaccuacuccccccaggacgccgagaucaucgacaccaagcucaagcucgaccagcucaucaccgucgccgaccucgagcucaaggacgagcgccucacccgccuccucuccuaccgcaaguccaucaagcccaucuccaagaaguccuuccuccagcacgucgaggagcucugcaccaacaacaaccucaaguuccaggaggaguucuccgagcuccccaaguuccuccaggaccucuccuccaccgacgccgaccuccccuggaaccgcgccaagaaccgcuuccccaacaucaagcccuacaacaacaaccgcgucaagcucaucgccgacgccuccguccccggcuccgacuacaucaacgccuccuacaucuccggcuaccucugccccaacgaguucaucgccacccagggcccccuccccggcaccgucggcgacuucuggcgcauggucugggagacccgcgccaagacccucgucaugcucacccagugcuucgagaagggccgcauccgcugccaccaguacuggcccgaggacaacaagcccgucaccgucuucggcgacaucgucaucaccaagcucauggaggacguccagaucgacuggaccauccgcgaccucaagaucgagcgccacggcgacugcaugaccguccgccagugcaacuucaccgccuggcccgagcacggcguccccgagaacuccgccccccucauccacuucgucaagcucguccgcgccucccgcgcccacgacaccacccccaugaucguccacugcuccgccggcgucggccgcaccggcgucuucaucgcccucgaccaccucacccagcacaucaacgaccacgacuucgucgacaucuacggccucgucgccgagcuccgcuccgagcgcaugugcaugguccagaaccucgcccaguacaucuuccuccaccagugcauccucgaccuccucuccaacaagggcuccaaccagcccaucugcuucgucaacuacuccgcccuccagaagauggacucccucgacgccauggagggcgacgucgagcucgagugggaggagaccaccauguga

SEQ ID NO: 48347 - RNA, 1638 nt, Artificial Sequence
  derived and/or modified sequence opt2 from PTPRR__Homo_sapiens__NP_001193944
augcaguccaucuccaagcagacccuccagauggacgucaacaagcucaacaucacccuccuccgcaucuuccgccagggcgucgccgccgcccucggccuccucccccagcagguccacaucaaccgccucaucggcaagaagaacuccaucgagcucuucgucucccccaucaaccgcaagaccggcaucuccgacgcccuccccuccgaggagguccuccgcucccucaacaucaacguccuccaccagucccucucccaguucggcaucaccgaggucucccccgagaagaacguccuccagggccagcacgaggccgacaagaucugguccaaggagggcuucuacgccgucgucaucuuccucuccaucuucgucaucaucgucaccugccucaugauccucuaccgccucaaggagcgcuuccagcucucccuccgccaggacaaggagaagaaccaggagauccaccucucccccaucacccuccagcccgcccucuccgaggccaagaccguccacuccaugguccagcccgagcaggcccccaagguccucaacgucgucgucgacccccagggccgcggcgcccccgagaucaaggccaccaccgccaccuccgucugccccucccccuucaagaugaagcccaucggccuccaggagcgccgcggcuccaacgucucccucacccucgacauguccucccucggcaacaucgagcccuucgucuccauccccaccccccgcgagaaggucgccauggaguaccuccaguccgccucccgcauccucacccgcucccagcuccgcgacgucgucgccuccucccaccuccuccaguccgaguucauggagauccccaugaacuucgucgaccccaaggagaucgacaucccccgccacggcaccaagaaccgcuacaagaccauccuccccaacccccucucccgcgucugccuccgccccaagaacgucaccgacucccucuccaccuacaucaacgccaacuacauccgcggcuacuccggcaaggagaaggccuucaucgccacccagggccccaugaucaacaccgucgacgacuucuggcagauggucuggcaggaggacucccccgucaucgucaugaucaccaagcucaaggagaagaacgagaagugcguccucuacuggcccgagaagcgcggcaucuacggcaaggucgagguccucgucaucuccgucaacgagugcgacaacuacaccauccgcaaccucguccucaagcagggcucccacacccagcacgucaagcacuacugguacaccuccuggcccgaccacaagacccccgacuccgcccagccccuccuccagcucaugcucgacgucgaggaggaccgccucgccucccagggccgcggccccgucgucguccacugcuccgccggcaucggccgcaccggcugcuucaucgccaccuccaucggcugccagcagcucaaggaggagggcgucgucgacgcccucuccaucgucugccagcuccgcauggaccgcggcggcaugguccagaccuccgagcaguacgaguucguccaccacgcccucugccucuacgagucccgccucuccgccgagaccguccaguga

SEQ ID NO: 48348 - RNA, 5847 nt, Artificial Sequence
  derived and/or modified sequence opt2 from PTPRS__Homo_sapiens__NP_002841
auggcccccaccuggggccccggcauggucuccgucgucggccccaugggccuccucgucguccuccucgucggcggcugcgccgccgaggagcccccccgcuucaucaaggagcccaaggaccagaucggcgucuccggcggcgucgccuccuucgucugccaggccaccggcgaccccaagccccgcgucaccuggaacaagaagggcaagaaggucaacucccagcgcuucgagaccaucgaguucgacgaguccgccggcgccguccuccgcauccagccccuccgcaccccccgcgacgagaacgucuacgagugcgucgcccagaacuccgucggcgagaucaccguccacgccaagcucaccguccuccgcgaggaccagcuccccuccggcuuccccaacaucgacaugggcccccagcucaaggucgucgagcgcacccgcaccgccaccaugcucugcgccgccuccggcaaccccgaccccgagaucaccugguucaaggacuuccuccccgucgaccccuccgccuccaacggccgcaucaagcagcuccgcuccgagaccuucgaguccacccccauccgcggcgcccuccagaucgaguccuccgaggagaccgaccagggcaaguacgagugcgucgccaccaacuccgccggcguccgcuacuccucccccgccaaccucuacguccgcgagcuccgcgagguccgccgcgucgccccccgcuucuccauccuccccaugucccacgagaucaugcccggcggcaacgucaacaucaccugcgucgccgucggcucccccaugcccuacgucaaguggaugcagggcgccgaggaccucacccccgaggacgacaugcccgucggccgcaacguccucgagcucaccgacgucaaggacuccgccaacuacaccugcgucgccauguccucccucggcgucaucgaggccgucgcccagaucaccgucaagucccuccccaaggcccccggcacccccauggucaccgagaacaccgccaccuccaucaccaucaccugggacuccggcaaccccgaccccgucuccuacuacgucaucgaguacaaguccaagucccaggacggccccuaccagaucaaggaggacaucaccaccacccgcuacuccaucggcggccucucccccaacuccgaguacgagaucugggucuccgccgucaacuccaucggccagggcccccccuccgaguccgucgucacccgcaccggcgagcaggcccccgccuccgccccccgcaacguccaggcccgcaugcucuccgccaccaccaugaucguccagugggaggagcccgucgagcccaacggccucauccgcggcuaccgcgucuacuacaccauggagcccgagcaccccgucggcaacuggcagaagcacaacgucgacgacucccuccucaccaccgucggcucccuccucgaggacgagaccuacaccguccgcguccucgccuucaccuccgucggcgacggcccccucuccgaccccauccaggucaagacccagcagggcguccccggccagcccaugaaccuccgcgccgaggcccgcuccgagaccuccaucacccucuccuggucccccccccgccaggaguccaucaucaaguacgagcuccucuuccgcgagggcgaccacggccgcgaggucggccgcaccuucgaccccaccaccuccuacgucgucgaggaccucaagcccaacaccgaguacgccuuccgccucgccgcccgcuccccccagggccucggcgccuucacccccgucguccgccagcgcacccuccaguccaagcccuccgcccccccccaggacgucaagugcgucuccguccgcuccaccgccauccucgucuccuggcgcccccccccccccgagacccacaacggcgcccucgucggcuacuccguccgcuaccgcccccucggcuccgaggaccccgagcccaaggaggucaacggcaucccccccaccaccacccagauccuccucgaggcccucgagaaguggacccaguaccgcaucaccaccgucgcccacaccgaggucggccccggccccgaguccucccccgucgucguccgcaccgacgaggacguccccuccgcccccccccgcaaggucgaggccgaggcccucaacgccaccgccauccgcguccucuggcgcucccccgcccccggccgccagcacggccagauccgcggcuaccagguccacuacguccgcauggagggcgccgaggcccgcggccccccccgcaucaaggacgucaugcucgccgacgcccagugggagaccgacgacaccgccgaguacgagauggucaucaccaaccuccagcccgagaccgccuacuccaucaccgucgccgccuacaccaugaagggcgacggcgcccgcuccaagcccaaggucgucgucaccaagggcgccguccucggccgccccacccucuccguccagcagacccccgagggcucccuccucgcccgcugggagccccccgccggcaccgccgaggaccagguccucggcuaccgccuccaguucggccgcgaggacuccaccccccucgccacccucgaguucccccccuccgaggaccgcuacaccgccuccggcguccacaagggcgccaccuacgucuuccgccucgccgcccgcucccgcggcggccucggcgaggaggccgccgagguccucuccauccccgaggacaccccccgcggccacccccagauccucgaggccgccggcaacgccuccgccggcaccguccuccuccgcuggcucccccccguccccgccgagcgcaacggcgccaucgucaaguacaccgucgccguccgcgaggccggcgcccucggccccgcccgcgagaccgagcuccccgccgccgccgagcccggcgccgagaacgcccucacccuccagggccucaagcccgacaccgccuacgaccuccagguccgcgcccacacccgccgcggccccggccccuucuccccccccguccgcuaccgcaccuuccuccgcgaccaggucucccccaagaacuucaaggucaagaugaucaugaagaccuccguccuccucuccugggaguuccccgacaacuacaacucccccacccccuacaagauccaguacaacggccucacccucgacgucgacggccgcaccaccaagaagcucaucacccaccucaagccccacaccuucuacaacuucguccucaccaaccgcggcuccucccucggcggccuccagcagaccgucaccgccuggaccgccuucaaccuccucaacggcaagcccuccgucgcccccaagcccgacgccgacggcuucaucauggucuaccuccccgacggccagucccccguccccguccaguccuacuucaucgucauggucccccuccgcaagucccgcggcggccaguuccucaccccccucggcucccccgaggacauggaccucgaggagcucauccaggacaucucccgccuccagcgccgcucccuccgccacucccgccagcucgaggucccccgccccuacaucgccgcccgcuucuccguccucccccccaccuuccaccccggcgaccagaagcaguacggcggcuucgacaaccgcggccucgagcccggccaccgcuacguccucuucguccucgccguccuccagaaguccgagcccaccuucgccgccucccccuucuccgaccccuuccagcucgacaaccccgacccccagcccaucgucgacggcgaggagggccucaucugggucaucggccccguccucgccgucgucuucaucaucugcaucgucaucgccauccuccucuacaagaacaagcccgacuccaagcgcaaggacuccgagccccgcaccaagugccuccucaacaacgccgaccucgccccccaccaccccaaggaccccgucgagaugcgccgcaucaacuuccagacccccgacuccggccuccgcuccccccuccgcgagcccggcuuccacuucgaguccaugcucucccacccccccauccccaucgccgacauggccgagcacaccgagcgccucaaggccaacgacucccucaagcucucccaggaguacgaguccaucgaccccggccagcaguucaccugggagcacuccaaccucgaggucaacaagcccaagaaccgcuacgccaacgucaucgccuacgaccacucccgcgucauccuccagcccaucgagggcaucaugggcuccgacuacaucaacgccaacuacgucgacggcuaccgcugccagaacgccuacaucgccacccagggcccccuccccgagaccuucggcgacuucuggcgcauggucugggagcagcgcuccgccaccaucgucaugaugacccgccucgaggagaagucccgcaucaagugcgaccaguacuggcccaaccgcggcaccgagaccuacggcuucauccaggucacccuccucgacaccaucgagcucgccaccuucugcguccgcaccuucucccuccacaagaacggcuccuccgagaagcgcgagguccgccaguuccaguucaccgccuggcccgaccacggcguccccgaguaccccacccccuuccucgccuuccuccgccgcgucaagaccugcaacccccccgacgccggccccaucgucguccacugcuccgccggcgucggccgcaccggcugcuucaucgucaucgacgccaugcucgagcgcaucaagcccgagaagaccgucgacgucuacggccacgucacccucaugcgcucccagcgcaacuacaugguccagaccgaggaccaguacuccuucauccacgaggcccuccucgaggccgucggcugcggcaacaccgagguccccgcccgcucccucuacgccuacauccagaagcucgcccaggucgagcccggcgagcacgucaccggcauggagcucgaguucaagcgccucgccaacuccaaggcccacaccucccgcuucaucuccgccaaccuccccugcaacaaguucaagaaccgccucgucaacaucaugcccuacgaguccacccgcgucugccuccagcccauccgcggcgucgagggcuccgacuacaucaacgccuccuucaucgacggcuaccgccagcagaaggccuacaucgccacccagggcccccucgccgagaccaccgaggacuucuggcgcaugcucugggagaacaacuccaccaucgucgucaugcucaccaagcuccgcgagaugggccgcgagaagugccaccaguacuggcccgccgagcgcuccgcccgcuaccaguacuucgucgucgaccccauggccgaguacaacaugccccaguacauccuccgcgaguucaaggucaccgacgcccgcgacggccagucccgcaccguccgccaguuccaguucaccgacuggcccgagcagggcguccccaaguccggcgagggcuucaucgacuucaucggccagguccacaagaccaaggagcaguucggccaggacggccccaucuccguccacugcuccgccggcgucggccgcaccggcgucuucaucacccucuccaucguccucgagcgcaugcgcuacgagggcgucgucgacaucuuccagaccgucaagaugcuccgcacccagcgccccgccaugguccagaccgaggacgaguaccaguucugcuaccaggccgcccucgaguaccucggcuccuucgaccacuacgccaccuga
